United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 35

SEQ ID NO: 1257207 - RNA, 22 nt, Mycobacterium tuberculosis H37Rv
ugugcaucgccggcacggugaa

SEQ ID NO: 1257208 - RNA, 13 nt, Mycobacterium tuberculosis H37Rv
ugugccaccgcug

SEQ ID NO: 1257209 - RNA, 11 nt, Mycobacterium tuberculosis H37Rv
uguggcgauga

SEQ ID NO: 1257210 - RNA, 20 nt, Mycobacterium tuberculosis H37Rv
uguucggugguccuggcgaa

SEQ ID NO: 1257211 - RNA, 14 nt, Mycobacterium tuberculosis H37Rv
uguucuuggucacc

SEQ ID NO: 1257212 - RNA, 23 nt, Mycobacterium tuberculosis H37Rv
uguucgacugcagaaacagccgc

SEQ ID NO: 1257213 - RNA, 17 nt, Mycobacterium tuberculosis H37Rv
uguucgccgacgcgaag

SEQ ID NO: 1257214 - RNA, 15 nt, Mycobacterium tuberculosis H37Rv
uguucgcgcgcgacu

SEQ ID NO: 1257215 - RNA, 15 nt, Mycobacterium tuberculosis H37Rv
uguugagggugcccg

SEQ ID NO: 1257216 - RNA, 18 nt, Mycobacterium tuberculosis H37Rv
uguugaggccggugaacg

SEQ ID NO: 1257217 - RNA, 20 nt, Mycobacterium tuberculosis H37Rv
uguugacucugcguccaccg

SEQ ID NO: 1257218 - RNA, 14 nt, Mycobacterium tuberculosis H37Rv
uguugcaucgccgc

SEQ ID NO: 1257219 - RNA, 14 nt, Mycobacterium tuberculosis H37Rv
uguugccgaagccc

SEQ ID NO: 1257220 - RNA, 20 nt, Mycobacterium tuberculosis H37Rv
uguugcccuugggacugcgg

SEQ ID NO: 1257221 - RNA, 21 nt, Mycobacterium tuberculosis H37Rv
uguugccccggucggcgacgu

SEQ ID NO: 1257222 - RNA, 22 nt, Mycobacterium tuberculosis H37Rv
uguccgcugguggaguucgcgc

SEQ ID NO: 1257223 - RNA, 16 nt, Mycobacterium tuberculosis H37Rv
ugucgagccggugccg

SEQ ID NO: 1257224 - RNA, 14 nt, Mycobacterium tuberculosis H37Rv
uguccgcagcaccg

SEQ ID NO: 1257225 - RNA, 17 nt, Mycobacterium tuberculosis H37Rv
uguccgcagcggugcgc

SEQ ID NO: 1257226 - RNA, 16 nt, Mycobacterium tuberculosis H37Rv
uguccgauaacccggu

SEQ ID NO: 1257227 - RNA, 22 nt, Mycobacterium tuberculosis H37Rv
uguccgcgacguaguggaagcc

SEQ ID NO: 1257228 - RNA, 14 nt, Mycobacterium tuberculosis H37Rv
uguccgccgacgua

SEQ ID NO: 1257229 - RNA, 22 nt, Mycobacterium tuberculosis H37Rv
uguccagaacgguggcgcggug

SEQ ID NO: 1257230 - RNA, 19 nt, Mycobacterium tuberculosis H37Rv
uguccacgaugacgucgac

SEQ ID NO: 1257231 - RNA, 19 nt, Mycobacterium tuberculosis H37Rv
uguccgacgcaccaacgcg

SEQ ID NO: 1257232 - RNA, 17 nt, Mycobacterium tuberculosis H37Rv
uguccagcaugcccgcc

SEQ ID NO: 1257233 - RNA, 16 nt, Mycobacterium tuberculosis H37Rv
uguccaaugcaccguu

SEQ ID NO: 1257234 - RNA, 22 nt, Mycobacterium tuberculosis H37Rv
uguagccagcggcugcccaucg

SEQ ID NO: 1257235 - RNA, 21 nt, Mycobacterium tuberculosis H37Rv
uguagcugcgggucucgccga

SEQ ID NO: 1257236 - RNA, 14 nt, Mycobacterium tuberculosis H37Rv
uguagacgucgacc

SEQ ID NO: 1257237 - RNA, 15 nt, Mycobacterium tuberculosis H37Rv
ugucacguaacgccg

SEQ ID NO: 1257238 - RNA, 15 nt, Mycobacterium tuberculosis H37Rv
ugucacgcaccgcgg

SEQ ID NO: 1257239 - RNA, 14 nt, Mycobacterium tuberculosis H37Rv
ugucacgcaccgcg

SEQ ID NO: 1257240 - RNA, 18 nt, Mycobacterium tuberculosis H37Rv
ugucagcggccgcgacgu

SEQ ID NO: 1257241 - RNA, 19 nt, Mycobacterium tuberculosis H37Rv
ugucaccgccgggaagccg

SEQ ID NO: 1257242 - RNA, 17 nt, Mycobacterium tuberculosis H37Rv
ugguggguugaucgcgc

SEQ ID NO: 1257243 - RNA, 19 nt, Mycobacterium tuberculosis H37Rv
uggugggccgugggugucg

SEQ ID NO: 1257244 - RNA, 19 nt, Mycobacterium tuberculosis H37Rv
ugguggacgcagagucaac

SEQ ID NO: 1257245 - RNA, 23 nt, Mycobacterium tuberculosis H37Rv
ugguggccgaacgggucggcgac

SEQ ID NO: 1257246 - RNA, 14 nt, Mycobacterium tuberculosis H37Rv
ugguggaccuccgg

SEQ ID NO: 1257247 - RNA, 21 nt, Mycobacterium tuberculosis H37Rv
ugguaaccagggcagccgggu

SEQ ID NO: 1257248 - RNA, 22 nt, Mycobacterium tuberculosis H37Rv
ugguaaccauauggcccgcgag

SEQ ID NO: 1257249 - RNA, 21 nt, Mycobacterium tuberculosis H37Rv
ugguugacggcgaagucgagu

SEQ ID NO: 1257250 - RNA, 18 nt, Mycobacterium tuberculosis H37Rv
ugguguccaccaccggca

SEQ ID NO: 1257251 - RNA, 17 nt, Mycobacterium tuberculosis H37Rv
ugguguauucgcggaug

SEQ ID NO: 1257252 - RNA, 19 nt, Mycobacterium tuberculosis H37Rv
uguacaacgccgucgucgu

SEQ ID NO: 1257253 - RNA, 22 nt, Mycobacterium tuberculosis H37Rv
uguacaccgucgcguuggcggu

SEQ ID NO: 1257254 - RNA, 16 nt, Mycobacterium tuberculosis H37Rv
uuccgcucgagggaug

SEQ ID NO: 1257255 - RNA, 14 nt, Mycobacterium tuberculosis H37Rv
uucccggaugccga

SEQ ID NO: 1257256 - RNA, 13 nt, Mycobacterium tuberculosis H37Rv
uucccggugacca

SEQ ID NO: 1257257 - RNA, 23 nt, Mycobacterium tuberculosis H37Rv
uuccgggccggcgagcucgacga

SEQ ID NO: 1257258 - RNA, 15 nt, Mycobacterium tuberculosis H37Rv
uucccggaagcgccg

SEQ ID NO: 1257259 - RNA, 20 nt, Mycobacterium tuberculosis H37Rv
uucaacuuacgcgacgccgu

SEQ ID NO: 1257260 - RNA, 13 nt, Mycobacterium tuberculosis H37Rv
uucagggcgucga

SEQ ID NO: 1257261 - RNA, 13 nt, Mycobacterium tuberculosis H37Rv
uucagggugcuga

SEQ ID NO: 1257262 - RNA, 17 nt, Mycobacterium tuberculosis H37Rv
uucagguuaagugucgg

SEQ ID NO: 1257263 - RNA, 21 nt, Mycobacterium tuberculosis H37Rv
uguuggccguaccggugaucg

SEQ ID NO: 1257264 - RNA, 17 nt, Mycobacterium tuberculosis H37Rv
uguuggccggcgccacc

SEQ ID NO: 1257265 - RNA, 13 nt, Mycobacterium tuberculosis H37Rv
uuaccgacaccgu

SEQ ID NO: 1257266 - RNA, 17 nt, Mycobacterium tuberculosis H37Rv
uuaccaccgucaccgcc

SEQ ID NO: 1257267 - RNA, 20 nt, Mycobacterium tuberculosis H37Rv
uuaggcgauucugcgucugc

SEQ ID NO: 1257268 - RNA, 14 nt, Mycobacterium tuberculosis H37Rv
guuggcgaucgcga

SEQ ID NO: 1257269 - RNA, 17 nt, Mycobacterium tuberculosis H37Rv
guuggcgaucucgacgg

SEQ ID NO: 1257270 - RNA, 18 nt, Mycobacterium tuberculosis H37Rv
guuggcgaaauccgcgau

SEQ ID NO: 1257271 - RNA, 13 nt, Mycobacterium tuberculosis H37Rv
guuggccucgagc

SEQ ID NO: 1257272 - RNA, 14 nt, Mycobacterium tuberculosis H37Rv
guuggccguggucg

SEQ ID NO: 1257273 - RNA, 17 nt, Mycobacterium tuberculosis H37Rv
guuggccggcgccaccg

SEQ ID NO: 1257274 - RNA, 20 nt, Mycobacterium tuberculosis H37Rv
guugcucaagguccagcgau

SEQ ID NO: 1257275 - RNA, 18 nt, Mycobacterium tuberculosis H37Rv
guugcucggucucgucgc

SEQ ID NO: 1257276 - RNA, 12 nt, Mycobacterium tuberculosis H37Rv
guugcucgucca

SEQ ID NO: 1257277 - RNA, 17 nt, Mycobacterium tuberculosis H37Rv
guuggccgcgcucaucg

SEQ ID NO: 1257278 - RNA, 12 nt, Mycobacterium tuberculosis H37Rv
guuggcgggcug

SEQ ID NO: 1257279 - RNA, 20 nt, Mycobacterium tuberculosis H37Rv
guuggcggugaacaccgcca

SEQ ID NO: 1257280 - RNA, 19 nt, Mycobacterium tuberculosis H37Rv
guuggcggccagcgcaccg

SEQ ID NO: 1257281 - RNA, 18 nt, Mycobacterium tuberculosis H37Rv
guuggcgguggucccgau

SEQ ID NO: 1257282 - RNA, 17 nt, Mycobacterium tuberculosis H37Rv
guuggcucgugcccgac

SEQ ID NO: 1257283 - RNA, 17 nt, Mycobacterium tuberculosis H37Rv
guugggcaugucgccga

SEQ ID NO: 1257284 - RNA, 13 nt, Mycobacterium tuberculosis H37Rv
guuggucggugcu

SEQ ID NO: 1257285 - RNA, 20 nt, Mycobacterium tuberculosis H37Rv
guuggucguggcugugcggg

SEQ ID NO: 1257286 - RNA, 13 nt, Mycobacterium tuberculosis H37Rv
guugucgucggug

SEQ ID NO: 1257287 - RNA, 13 nt, Mycobacterium tuberculosis H37Rv
guugucgucgucg

SEQ ID NO: 1257288 - RNA, 15 nt, Mycobacterium tuberculosis H37Rv
guugucuuucacaug

SEQ ID NO: 1257289 - RNA, 16 nt, Mycobacterium tuberculosis H37Rv
guugugagccacgcgc

SEQ ID NO: 1257290 - RNA, 21 nt, Mycobacterium tuberculosis H37Rv
guuggucaucaacgccacgau

SEQ ID NO: 1257291 - RNA, 15 nt, Mycobacterium tuberculosis H37Rv
guuggggcacgacgc

SEQ ID NO: 1257292 - RNA, 13 nt, Mycobacterium tuberculosis H37Rv
guuggcucggcgc

SEQ ID NO: 1257293 - RNA, 19 nt, Mycobacterium tuberculosis H37Rv
guugggggucgggcucggg

SEQ ID NO: 1257294 - RNA, 13 nt, Mycobacterium tuberculosis H37Rv
guugugucaccgg

SEQ ID NO: 1257295 - RNA, 16 nt, Mycobacterium tuberculosis H37Rv
guugugcucggugacg

SEQ ID NO: 1257296 - RNA, 13 nt, Mycobacterium tuberculosis H37Rv
guugugcucggug

SEQ ID NO: 1257297 - RNA, 20 nt, Mycobacterium tuberculosis H37Rv
guuguugacagacacagcac

SEQ ID NO: 1257298 - RNA, 15 nt, Mycobacterium tuberculosis H37Rv
guuguucgccaccgc

SEQ ID NO: 1257299 - RNA, 14 nt, Mycobacterium tuberculosis H37Rv
guuguucaccgacg

SEQ ID NO: 1257300 - RNA, 12 nt, Mycobacterium tuberculosis H37Rv
guuguugccgac

SEQ ID NO: 1257301 - RNA, 23 nt, Mycobacterium tuberculosis H37Rv
guugaugcguagugcggcgugga

SEQ ID NO: 1257302 - RNA, 17 nt, Mycobacterium tuberculosis H37Rv
guugccccgaccgccgu

SEQ ID NO: 1257303 - RNA, 13 nt, Mycobacterium tuberculosis H37Rv
guugaccugcgca

SEQ ID NO: 1257304 - RNA, 20 nt, Mycobacterium tuberculosis H37Rv
guugaccucgcgcaccggcu

SEQ ID NO: 1257305 - RNA, 16 nt, Mycobacterium tuberculosis H37Rv
guugaucuggcguuca

SEQ ID NO: 1257306 - RNA, 18 nt, Mycobacterium tuberculosis H37Rv
guugaucuugacggucgc

SEQ ID NO: 1257307 - RNA, 18 nt, Mycobacterium tuberculosis H37Rv
guugcguuguccaccauc

SEQ ID NO: 1257308 - RNA, 17 nt, Mycobacterium tuberculosis H37Rv
guugcguaucgacccgc

SEQ ID NO: 1257309 - RNA, 17 nt, Mycobacterium tuberculosis H37Rv
guugcggucaucggcgc

SEQ ID NO: 1257310 - RNA, 17 nt, Mycobacterium tuberculosis H37Rv
guugccgacgagacggc

SEQ ID NO: 1257311 - RNA, 20 nt, Mycobacterium tuberculosis H37Rv
guugcccuggugugccgcgu

SEQ ID NO: 1257312 - RNA, 18 nt, Mycobacterium tuberculosis H37Rv
guugccgaucccggcgag

SEQ ID NO: 1257313 - RNA, 19 nt, Mycobacterium tuberculosis H37Rv
guugccgaucccggcgagc

SEQ ID NO: 1257314 - RNA, 15 nt, Mycobacterium tuberculosis H37Rv
guugccuucuuggcg

SEQ ID NO: 1257315 - RNA, 15 nt, Mycobacterium tuberculosis H37Rv
guugcgacggcguug

SEQ ID NO: 1257316 - RNA, 22 nt, Mycobacterium tuberculosis H37Rv
guugccgccgaagccgacgaac

SEQ ID NO: 1257317 - RNA, 15 nt, Mycobacterium tuberculosis H37Rv
guugccgccggccau

SEQ ID NO: 1257318 - RNA, 22 nt, Mycobacterium tuberculosis H37Rv
guugccgccggugccgaucagc

SEQ ID NO: 1257319 - RNA, 22 nt, Mycobacterium tuberculosis H37Rv
guuccgcugcggugccggcccu

SEQ ID NO: 1257320 - RNA, 22 nt, Mycobacterium tuberculosis H37Rv
guuccgcgacaaccacgaaagc

SEQ ID NO: 1257321 - RNA, 13 nt, Mycobacterium tuberculosis H37Rv
guuccgcgacagc

SEQ ID NO: 1257322 - RNA, 15 nt, Mycobacterium tuberculosis H37Rv
guuccuccagcagcg

SEQ ID NO: 1257323 - RNA, 16 nt, Mycobacterium tuberculosis H37Rv
guuccggcuucgucca

SEQ ID NO: 1257324 - RNA, 13 nt, Mycobacterium tuberculosis H37Rv
guuccucagcggc

SEQ ID NO: 1257325 - RNA, 15 nt, Mycobacterium tuberculosis H37Rv
guuccugcacgguca

SEQ ID NO: 1257326 - RNA, 20 nt, Mycobacterium tuberculosis H37Rv
guucccaccaccaccgccgg

SEQ ID NO: 1257327 - RNA, 16 nt, Mycobacterium tuberculosis H37Rv
guuccaucacggacca

SEQ ID NO: 1257328 - RNA, 22 nt, Mycobacterium tuberculosis H37Rv
guuccgccggccccaccgguac

SEQ ID NO: 1257329 - RNA, 19 nt, Mycobacterium tuberculosis H37Rv
guuccgauagccgaccagg

SEQ ID NO: 1257330 - RNA, 18 nt, Mycobacterium tuberculosis H37Rv
guuccgaucggcaaucga

SEQ ID NO: 1257331 - RNA, 14 nt, Mycobacterium tuberculosis H37Rv
guucccgcuugauc

SEQ ID NO: 1257332 - RNA, 21 nt, Mycobacterium tuberculosis H37Rv
guucgaugggugcaccgaaga

SEQ ID NO: 1257333 - RNA, 13 nt, Mycobacterium tuberculosis H37Rv
guucgccggaucg

SEQ ID NO: 1257334 - RNA, 21 nt, Mycobacterium tuberculosis H37Rv
guucgaccaucaucucggugg

SEQ ID NO: 1257335 - RNA, 21 nt, Mycobacterium tuberculosis H37Rv
guucgacucaugccgagcgac

SEQ ID NO: 1257336 - RNA, 14 nt, Mycobacterium tuberculosis H37Rv
guucgagggugacc

SEQ ID NO: 1257337 - RNA, 17 nt, Mycobacterium tuberculosis H37Rv
guucgaggucggcgauc

SEQ ID NO: 1257338 - RNA, 18 nt, Mycobacterium tuberculosis H37Rv
guucgauaagcagcucgg

SEQ ID NO: 1257339 - RNA, 19 nt, Mycobacterium tuberculosis H37Rv
guuccuugccgaucgccga

SEQ ID NO: 1257340 - RNA, 12 nt, Mycobacterium tuberculosis H37Rv
guucggcgucgu

SEQ ID NO: 1257341 - RNA, 17 nt, Mycobacterium tuberculosis H37Rv
guucggggcgcgguacc

SEQ ID NO: 1257342 - RNA, 22 nt, Mycobacterium tuberculosis H37Rv
guucgggugagcacccagcggc

SEQ ID NO: 1257343 - RNA, 19 nt, Mycobacterium tuberculosis H37Rv
guucgggcuccagcagcgc

SEQ ID NO: 1257344 - RNA, 18 nt, Mycobacterium tuberculosis H37Rv
guucggggcgcaccacga

SEQ ID NO: 1257345 - RNA, 14 nt, Mycobacterium tuberculosis H37Rv
guucgggcaacggc

SEQ ID NO: 1257346 - RNA, 17 nt, Mycobacterium tuberculosis H37Rv
guucgggcagcuggcga

SEQ ID NO: 1257347 - RNA, 19 nt, Mycobacterium tuberculosis H37Rv
guucuggauacccagcgcc

SEQ ID NO: 1257348 - RNA, 18 nt, Mycobacterium tuberculosis H37Rv
guucgguucgcgagucac

SEQ ID NO: 1257349 - RNA, 22 nt, Mycobacterium tuberculosis H37Rv
guucggucgucucgggcucgga

SEQ ID NO: 1257350 - RNA, 19 nt, Mycobacterium tuberculosis H37Rv
guucgcggcaucgucgcca

SEQ ID NO: 1257351 - RNA, 15 nt, Mycobacterium tuberculosis H37Rv
guucgcgcgccgcga

SEQ ID NO: 1257352 - RNA, 16 nt, Mycobacterium tuberculosis H37Rv
guucgcgcgccgcgac

SEQ ID NO: 1257353 - RNA, 14 nt, Mycobacterium tuberculosis H37Rv
guucgcugacggcc

SEQ ID NO: 1257354 - RNA, 19 nt, Mycobacterium tuberculosis H37Rv
guucggcacaaccaacgac

SEQ ID NO: 1257355 - RNA, 15 nt, Mycobacterium tuberculosis H37Rv
guucggccuugaucg

SEQ ID NO: 1257356 - RNA, 15 nt, Mycobacterium tuberculosis H37Rv
guucggcgaucuccg

SEQ ID NO: 1257357 - RNA, 21 nt, Mycobacterium tuberculosis H37Rv
guucggccaucguccagcagg

SEQ ID NO: 1257358 - RNA, 21 nt, Mycobacterium tuberculosis H37Rv
guucggccaccagaaccagcg

SEQ ID NO: 1257359 - RNA, 15 nt, Mycobacterium tuberculosis H37Rv
guuauugaugcccga

SEQ ID NO: 1257360 - RNA, 16 nt, Mycobacterium tuberculosis H37Rv
guucaccacgucgucg

SEQ ID NO: 1257361 - RNA, 17 nt, Mycobacterium tuberculosis H37Rv
guucaccaacgcgggaa

SEQ ID NO: 1257362 - RNA, 22 nt, Mycobacterium tuberculosis H37Rv
guucaaccggacgcccucacgc

SEQ ID NO: 1257363 - RNA, 20 nt, Mycobacterium tuberculosis H37Rv
guucaaccggacgaccggaa

SEQ ID NO: 1257364 - RNA, 22 nt, Mycobacterium tuberculosis H37Rv
guuagcggugaugggggugcac

SEQ ID NO: 1257365 - RNA, 21 nt, Mycobacterium tuberculosis H37Rv
guuagcauugaguucggccac

SEQ ID NO: 1257366 - RNA, 19 nt, Mycobacterium tuberculosis H37Rv
guuagaucacccgcagccg

SEQ ID NO: 1257367 - RNA, 13 nt, Mycobacterium tuberculosis H37Rv
guuacggagggca

SEQ ID NO: 1257368 - RNA, 18 nt, Mycobacterium tuberculosis H37Rv
guuacgcaucgucagcga

SEQ ID NO: 1257369 - RNA, 16 nt, Mycobacterium tuberculosis H37Rv
guuaccgaaggucauc

SEQ ID NO: 1257370 - RNA, 17 nt, Mycobacterium tuberculosis H37Rv
guuaccaggcguggacg

SEQ ID NO: 1257371 - RNA, 22 nt, Mycobacterium tuberculosis H37Rv
guuacaccaucaaggacucgga

SEQ ID NO: 1257372 - RNA, 15 nt, Mycobacterium tuberculosis H37Rv
guucagcgaccaaug

SEQ ID NO: 1257373 - RNA, 18 nt, Mycobacterium tuberculosis H37Rv
guucagcccgccgacgau

SEQ ID NO: 1257374 - RNA, 16 nt, Mycobacterium tuberculosis H37Rv
guucagcuuccgaauc

SEQ ID NO: 1257375 - RNA, 17 nt, Mycobacterium tuberculosis H37Rv
guucagcggccagcagu

SEQ ID NO: 1257376 - RNA, 17 nt, Mycobacterium tuberculosis H37Rv
guucacggggaccagau

SEQ ID NO: 1257377 - RNA, 19 nt, Mycobacterium tuberculosis H37Rv
guucacccacuccgccgau

SEQ ID NO: 1257378 - RNA, 21 nt, Mycobacterium tuberculosis H37Rv
guucaccucggcgacgaugau

SEQ ID NO: 1257379 - RNA, 17 nt, Mycobacterium tuberculosis H37Rv
guuccaacuccugcagc

SEQ ID NO: 1257380 - RNA, 23 nt, Mycobacterium tuberculosis H37Rv
guucaugcggcggcgcucgucga

SEQ ID NO: 1257381 - RNA, 19 nt, Mycobacterium tuberculosis H37Rv
guucaucacgccgccggag

SEQ ID NO: 1257382 - RNA, 17 nt, Mycobacterium tuberculosis H37Rv
guuccaccagcgcccgu

SEQ ID NO: 1257383 - RNA, 14 nt, Mycobacterium tuberculosis H37Rv
guuccacaccaggc

SEQ ID NO: 1257384 - RNA, 13 nt, Mycobacterium tuberculosis H37Rv
guuccagcaguac

SEQ ID NO: 1257385 - RNA, 19 nt, Mycobacterium tuberculosis H37Rv
guuccagggucacggucgg

SEQ ID NO: 1257386 - RNA, 15 nt, Mycobacterium tuberculosis H37Rv
guuccagcgcaucga

SEQ ID NO: 1257387 - RNA, 14 nt, Mycobacterium tuberculosis H37Rv
gugcuaaccgacgc

SEQ ID NO: 1257388 - RNA, 16 nt, Mycobacterium tuberculosis H37Rv
guggugaucuuggucu

SEQ ID NO: 1257389 - RNA, 21 nt, Mycobacterium tuberculosis H37Rv
guggugcugaccgcgccggac

SEQ ID NO: 1257390 - RNA, 16 nt, Mycobacterium tuberculosis H37Rv
guguagccgagcacgg

SEQ ID NO: 1257391 - RNA, 14 nt, Mycobacterium tuberculosis H37Rv
guguagcagcgcca

SEQ ID NO: 1257392 - RNA, 22 nt, Mycobacterium tuberculosis H37Rv
gugguuacagaugaaggugacg

SEQ ID NO: 1257393 - RNA, 16 nt, Mycobacterium tuberculosis H37Rv
gugucgaugcgggcug

SEQ ID NO: 1257394 - RNA, 14 nt, Mycobacterium tuberculosis H37Rv
gugucgccgccguu

SEQ ID NO: 1257395 - RNA, 19 nt, Mycobacterium tuberculosis H37Rv
gugucgccgaucaccgcau

SEQ ID NO: 1257396 - RNA, 17 nt, Mycobacterium tuberculosis H37Rv
gugucggcucgagucgc

SEQ ID NO: 1257397 - RNA, 21 nt, Mycobacterium tuberculosis H37Rv
gugucggguccaaccccagcg

SEQ ID NO: 1257398 - RNA, 13 nt, Mycobacterium tuberculosis H37Rv
gugucaccgccgg

SEQ ID NO: 1257399 - RNA, 15 nt, Mycobacterium tuberculosis H37Rv
guguaguacagcgca

SEQ ID NO: 1257400 - RNA, 19 nt, Mycobacterium tuberculosis H37Rv
guguccaccaccggcaccc

SEQ ID NO: 1257401 - RNA, 17 nt, Mycobacterium tuberculosis H37Rv
guguccggggaccucgg

SEQ ID NO: 1257402 - RNA, 11 nt, Mycobacterium tuberculosis H37Rv
guguccaccgg

SEQ ID NO: 1257403 - RNA, 15 nt, Mycobacterium tuberculosis H37Rv
guguccuggcccgau

SEQ ID NO: 1257404 - RNA, 16 nt, Mycobacterium tuberculosis H37Rv
guguccugucgcacca

SEQ ID NO: 1257405 - RNA, 14 nt, Mycobacterium tuberculosis H37Rv
gugugcgacgacgg

SEQ ID NO: 1257406 - RNA, 17 nt, Mycobacterium tuberculosis H37Rv
gugugcgucgcacgagc

SEQ ID NO: 1257407 - RNA, 21 nt, Mycobacterium tuberculosis H37Rv
gugugcaguccgaugccggaa

SEQ ID NO: 1257408 - RNA, 14 nt, Mycobacterium tuberculosis H37Rv
gugugccguggucg

SEQ ID NO: 1257409 - RNA, 22 nt, Mycobacterium tuberculosis H37Rv
gugucugggaccccgcugcgac

SEQ ID NO: 1257410 - RNA, 17 nt, Mycobacterium tuberculosis H37Rv
gugugagcugcucacgg

SEQ ID NO: 1257411 - RNA, 19 nt, Mycobacterium tuberculosis H37Rv
guguggaauggaccagcgc

SEQ ID NO: 1257412 - RNA, 13 nt, Mycobacterium tuberculosis H37Rv
guguggucgagcg

SEQ ID NO: 1257413 - RNA, 21 nt, Mycobacterium tuberculosis H37Rv
guguucgaccgcagggaccgg

SEQ ID NO: 1257414 - RNA, 13 nt, Mycobacterium tuberculosis H37Rv
guguucgacggca

SEQ ID NO: 1257415 - RNA, 21 nt, Mycobacterium tuberculosis H37Rv
guguucggugguccuggcgaa

SEQ ID NO: 1257416 - RNA, 17 nt, Mycobacterium tuberculosis H37Rv
guguugagcggcagcca

SEQ ID NO: 1257417 - RNA, 19 nt, Mycobacterium tuberculosis H37Rv
guguugccagaucagcacc

SEQ ID NO: 1257418 - RNA, 16 nt, Mycobacterium tuberculosis H37Rv
guguuggccgggucgu

SEQ ID NO: 1257419 - RNA, 23 nt, Mycobacterium tuberculosis H37Rv
guguuggaaaagaucuucgccga

SEQ ID NO: 1257420 - RNA, 17 nt, Mycobacterium tuberculosis H37Rv
guuaacacccugggcaa

SEQ ID NO: 1257421 - RNA, 19 nt, Mycobacterium tuberculosis H37Rv
uaacgccaagcucggccca

SEQ ID NO: 1257422 - RNA, 21 nt, Mycobacterium tuberculosis H37Rv
uaaaugccugcccaccuucga

SEQ ID NO: 1257423 - RNA, 18 nt, Mycobacterium tuberculosis H37Rv
uaaacugccgcggcaccg

SEQ ID NO: 1257424 - RNA, 19 nt, Mycobacterium tuberculosis H37Rv
uaagcccggucgcugaucc

SEQ ID NO: 1257425 - RNA, 15 nt, Mycobacterium tuberculosis H37Rv
uaaugccagcggcac

SEQ ID NO: 1257426 - RNA, 16 nt, Mycobacterium tuberculosis H37Rv
uaauucaacagcaccg

SEQ ID NO: 1257427 - RNA, 14 nt, Mycobacterium tuberculosis H37Rv
uacagcaucaaccg

SEQ ID NO: 1257428 - RNA, 15 nt, Mycobacterium tuberculosis H37Rv
uacagcaauccgcaa

SEQ ID NO: 1257429 - RNA, 11 nt, Mycobacterium tuberculosis H37Rv
uacacaccgag

SEQ ID NO: 1257430 - RNA, 23 nt, Mycobacterium tuberculosis H37Rv
uacagcgcaaagcccuccucgau

SEQ ID NO: 1257431 - RNA, 17 nt, Mycobacterium tuberculosis H37Rv
uacagucgaccggacac

SEQ ID NO: 1257432 - RNA, 13 nt, Mycobacterium tuberculosis H37Rv
uacagugcgcgga

SEQ ID NO: 1257433 - RNA, 17 nt, Mycobacterium tuberculosis H37Rv
uacagugcgcggaucaa

SEQ ID NO: 1257434 - RNA, 22 nt, Mycobacterium tuberculosis H37Rv
uaccagccgaagaaccggucgc

SEQ ID NO: 1257435 - RNA, 11 nt, Mycobacterium tuberculosis H37Rv
uaccagcaccg

SEQ ID NO: 1257436 - RNA, 12 nt, Mycobacterium tuberculosis H37Rv
uaccaccgccgc

SEQ ID NO: 1257437 - RNA, 15 nt, Mycobacterium tuberculosis H37Rv
uacccgcggcagcac

SEQ ID NO: 1257438 - RNA, 15 nt, Mycobacterium tuberculosis H37Rv
uacccgcgcgaccug

SEQ ID NO: 1257439 - RNA, 18 nt, Mycobacterium tuberculosis H37Rv
uaccccagaccgccacac

SEQ ID NO: 1257440 - RNA, 14 nt, Mycobacterium tuberculosis H37Rv
uaccauauccggac

SEQ ID NO: 1257441 - RNA, 14 nt, Mycobacterium tuberculosis H37Rv
uaccgcacccuggg

SEQ ID NO: 1257442 - RNA, 16 nt, Mycobacterium tuberculosis H37Rv
uaccgcaggugccacc

SEQ ID NO: 1257443 - RNA, 15 nt, Mycobacterium tuberculosis H37Rv
uaccgccgcgaccgc

SEQ ID NO: 1257444 - RNA, 15 nt, Mycobacterium tuberculosis H37Rv
uaccgcccgcaccgu

SEQ ID NO: 1257445 - RNA, 20 nt, Mycobacterium tuberculosis H37Rv
uaccgccguugccgaucagc

SEQ ID NO: 1257446 - RNA, 20 nt, Mycobacterium tuberculosis H37Rv
uaccgcguccuuuuccgccg

SEQ ID NO: 1257447 - RNA, 18 nt, Mycobacterium tuberculosis H37Rv
uaccggacccgcugaucu

SEQ ID NO: 1257448 - RNA, 23 nt, Mycobacterium tuberculosis H37Rv
uacgccaccggcaaucggcggca

SEQ ID NO: 1257449 - RNA, 13 nt, Mycobacterium tuberculosis H37Rv
uacgcaucgccgu

SEQ ID NO: 1257450 - RNA, 23 nt, Mycobacterium tuberculosis H37Rv
uaccgguccgucaccaccgccgc

SEQ ID NO: 1257451 - RNA, 16 nt, Mycobacterium tuberculosis H37Rv
uaccgugccgcccggu

SEQ ID NO: 1257452 - RNA, 22 nt, Mycobacterium tuberculosis H37Rv
uagcgcaccaccgucucgccgc

SEQ ID NO: 1257453 - RNA, 20 nt, Mycobacterium tuberculosis H37Rv
uagcgcagcgccuccucgau

SEQ ID NO: 1257454 - RNA, 23 nt, Mycobacterium tuberculosis H37Rv
uagcgcaugucgauccggcgcca

SEQ ID NO: 1257455 - RNA, 19 nt, Mycobacterium tuberculosis H37Rv
uagcgcagcgccuccucga

SEQ ID NO: 1257456 - RNA, 12 nt, Mycobacterium tuberculosis H37Rv
uagcgcaucgcc

SEQ ID NO: 1257457 - RNA, 12 nt, Mycobacterium tuberculosis H37Rv
uagcccaucggc

SEQ ID NO: 1257458 - RNA, 14 nt, Mycobacterium tuberculosis H37Rv
uagcccaucggcag

SEQ ID NO: 1257459 - RNA, 17 nt, Mycobacterium tuberculosis H37Rv
uagccaucggcuaggcc

SEQ ID NO: 1257460 - RNA, 22 nt, Mycobacterium tuberculosis H37Rv
uagccauuuccuuggcgcugag

SEQ ID NO: 1257461 - RNA, 14 nt, Mycobacterium tuberculosis H37Rv
uagccgaacagcgg

SEQ ID NO: 1257462 - RNA, 16 nt, Mycobacterium tuberculosis H37Rv
uagccgacuaucggcc

SEQ ID NO: 1257463 - RNA, 16 nt, Mycobacterium tuberculosis H37Rv
uagcccgcgucgacga

SEQ ID NO: 1257464 - RNA, 22 nt, Mycobacterium tuberculosis H37Rv
uagcccgauggugccgacccgc

SEQ ID NO: 1257465 - RNA, 19 nt, Mycobacterium tuberculosis H37Rv
uagcccgccauccgccgaa

SEQ ID NO: 1257466 - RNA, 18 nt, Mycobacterium tuberculosis H37Rv
uagccaggugugcggaac

SEQ ID NO: 1257467 - RNA, 15 nt, Mycobacterium tuberculosis H37Rv
uagccagauccguca

SEQ ID NO: 1257468 - RNA, 20 nt, Mycobacterium tuberculosis H37Rv
uagccagcaggaacgccgug

SEQ ID NO: 1257469 - RNA, 17 nt, Mycobacterium tuberculosis H37Rv
uagcagguguaggugcc

SEQ ID NO: 1257470 - RNA, 17 nt, Mycobacterium tuberculosis H37Rv
uagcauugucgccggau

SEQ ID NO: 1257471 - RNA, 16 nt, Mycobacterium tuberculosis H37Rv
uagcaacucgaucgcc

SEQ ID NO: 1257472 - RNA, 18 nt, Mycobacterium tuberculosis H37Rv
uagcaccacaucggugcc

SEQ ID NO: 1257473 - RNA, 11 nt, Mycobacterium tuberculosis H37Rv
uagcagcaccc

SEQ ID NO: 1257474 - RNA, 19 nt, Mycobacterium tuberculosis H37Rv
uacuugccuuuggucgcgg

SEQ ID NO: 1257475 - RNA, 17 nt, Mycobacterium tuberculosis H37Rv
uagaccgaaauggucgu

SEQ ID NO: 1257476 - RNA, 18 nt, Mycobacterium tuberculosis H37Rv
uagacccgucaccgccga

SEQ ID NO: 1257477 - RNA, 16 nt, Mycobacterium tuberculosis H37Rv
uagaccagugaccgca

SEQ ID NO: 1257478 - RNA, 13 nt, Mycobacterium tuberculosis H37Rv
uacugcgaucgcg

SEQ ID NO: 1257479 - RNA, 22 nt, Mycobacterium tuberculosis H37Rv
uacugcggugccacggugaccc

SEQ ID NO: 1257480 - RNA, 16 nt, Mycobacterium tuberculosis H37Rv
uacuggcuauccaccu

SEQ ID NO: 1257481 - RNA, 18 nt, Mycobacterium tuberculosis H37Rv
uacgccgcgccgaaucgc

SEQ ID NO: 1257482 - RNA, 13 nt, Mycobacterium tuberculosis H37Rv
uaucucggugacg

SEQ ID NO: 1257483 - RNA, 13 nt, Mycobacterium tuberculosis H37Rv
uagcggcuuggcc

SEQ ID NO: 1257484 - RNA, 19 nt, Mycobacterium tuberculosis H37Rv
uagcggauucagcgucgcc

SEQ ID NO: 1257485 - RNA, 19 nt, Mycobacterium tuberculosis H37Rv
uagcggcccgaucaccagc

SEQ ID NO: 1257486 - RNA, 18 nt, Mycobacterium tuberculosis H37Rv
uagcgggcaagaugaucg

SEQ ID NO: 1257487 - RNA, 17 nt, Mycobacterium tuberculosis H37Rv
uagcgggucagcugacg

SEQ ID NO: 1257488 - RNA, 17 nt, Mycobacterium tuberculosis H37Rv
uaucgcagcaucugcgg

SEQ ID NO: 1257489 - RNA, 16 nt, Mycobacterium tuberculosis H37Rv
uaucgaugcggcgacc

SEQ ID NO: 1257490 - RNA, 20 nt, Mycobacterium tuberculosis H37Rv
uaucgacccgcgcaaccggc

SEQ ID NO: 1257491 - RNA, 23 nt, Mycobacterium tuberculosis H37Rv
uaucgaaggcgacaucaccaccg

SEQ ID NO: 1257492 - RNA, 10 nt, Mycobacterium tuberculosis H37Rv
uaucgccagu

SEQ ID NO: 1257493 - RNA, 16 nt, Mycobacterium tuberculosis H37Rv
uauugcgcccggccau

SEQ ID NO: 1257494 - RNA, 13 nt, Mycobacterium tuberculosis H37Rv
ucaaaaagcucgg

SEQ ID NO: 1257495 - RNA, 22 nt, Mycobacterium tuberculosis H37Rv
uaugcgccaucucgacggugac

SEQ ID NO: 1257496 - RNA, 19 nt, Mycobacterium tuberculosis H37Rv
ucaacgcaaucgacugauc

SEQ ID NO: 1257497 - RNA, 18 nt, Mycobacterium tuberculosis H37Rv
ucaaccggacgaccggaa

SEQ ID NO: 1257498 - RNA, 17 nt, Mycobacterium tuberculosis H37Rv
ucaacaccgaguuccuc

SEQ ID NO: 1257499 - RNA, 13 nt, Mycobacterium tuberculosis H37Rv
ucaaagcagcgca

SEQ ID NO: 1257500 - RNA, 19 nt, Mycobacterium tuberculosis H37Rv
ucaacaccaacgacagcga

SEQ ID NO: 1257501 - RNA, 14 nt, Mycobacterium tuberculosis H37Rv
ucaagcacagcccg

SEQ ID NO: 1257502 - RNA, 23 nt, Mycobacterium tuberculosis H37Rv
ucaagcaaguccaccggaucguc

SEQ ID NO: 1257503 - RNA, 17 nt, Mycobacterium tuberculosis H37Rv
ucaagccacgucgucgc

SEQ ID NO: 1257504 - RNA, 16 nt, Mycobacterium tuberculosis H37Rv
ucaagcgggcuggcgu

SEQ ID NO: 1257505 - RNA, 20 nt, Mycobacterium tuberculosis H37Rv
ucaagcgaagagcgcacuga

SEQ ID NO: 1257506 - RNA, 12 nt, Mycobacterium tuberculosis H37Rv
ucaaggaagccg

SEQ ID NO: 1257507 - RNA, 21 nt, Mycobacterium tuberculosis H37Rv
ucaacgggccgcaucgucgcc

SEQ ID NO: 1257508 - RNA, 18 nt, Mycobacterium tuberculosis H37Rv
ucaacgggaugccggcga

SEQ ID NO: 1257509 - RNA, 22 nt, Mycobacterium tuberculosis H37Rv
ucaacgcggggaugucgaccgc

SEQ ID NO: 1257510 - RNA, 15 nt, Mycobacterium tuberculosis H37Rv
ucaacgcgcgcacgc

SEQ ID NO: 1257511 - RNA, 22 nt, Mycobacterium tuberculosis H37Rv
ucaacggcagaucccacgccag

SEQ ID NO: 1257512 - RNA, 18 nt, Mycobacterium tuberculosis H37Rv
ucaaggccaccucuucga

SEQ ID NO: 1257513 - RNA, 21 nt, Mycobacterium tuberculosis H37Rv
ucaaggccaccucuucgaucu

SEQ ID NO: 1257514 - RNA, 20 nt, Mycobacterium tuberculosis H37Rv
ucaaguugguucaccgcgau

SEQ ID NO: 1257515 - RNA, 21 nt, Mycobacterium tuberculosis H37Rv
ucagcaccccauggccaccga

SEQ ID NO: 1257516 - RNA, 21 nt, Mycobacterium tuberculosis H37Rv
ucagcaccgacggcgcaugcg

SEQ ID NO: 1257517 - RNA, 20 nt, Mycobacterium tuberculosis H37Rv
ucagcaccgugacagcggca

SEQ ID NO: 1257518 - RNA, 19 nt, Mycobacterium tuberculosis H37Rv
ucagcacgguguacgcccg

SEQ ID NO: 1257519 - RNA, 21 nt, Mycobacterium tuberculosis H37Rv
ucagcacgucgcggccgugga

SEQ ID NO: 1257520 - RNA, 15 nt, Mycobacterium tuberculosis H37Rv
ucagagacagcagcg

SEQ ID NO: 1257521 - RNA, 19 nt, Mycobacterium tuberculosis H37Rv
ucagaauugugugcagcag

SEQ ID NO: 1257522 - RNA, 16 nt, Mycobacterium tuberculosis H37Rv
ucagccgguggucugc

SEQ ID NO: 1257523 - RNA, 18 nt, Mycobacterium tuberculosis H37Rv
ucagcccggccagccgca

SEQ ID NO: 1257524 - RNA, 20 nt, Mycobacterium tuberculosis H37Rv
ucagcccggcacugaccgcg

SEQ ID NO: 1257525 - RNA, 21 nt, Mycobacterium tuberculosis H37Rv
ucagcccgaacucguuggcga

SEQ ID NO: 1257526 - RNA, 13 nt, Mycobacterium tuberculosis H37Rv
ucagcagcggcga

SEQ ID NO: 1257527 - RNA, 18 nt, Mycobacterium tuberculosis H37Rv
ucagcagcuccacuggcg

SEQ ID NO: 1257528 - RNA, 14 nt, Mycobacterium tuberculosis H37Rv
ucacgccgccggag

SEQ ID NO: 1257529 - RNA, 17 nt, Mycobacterium tuberculosis H37Rv
ucacgccgucaccgcug

SEQ ID NO: 1257530 - RNA, 15 nt, Mycobacterium tuberculosis H37Rv
ucacgccgucgcaga

SEQ ID NO: 1257531 - RNA, 18 nt, Mycobacterium tuberculosis H37Rv
ucacgcggaaaccaucgc

SEQ ID NO: 1257532 - RNA, 18 nt, Mycobacterium tuberculosis H37Rv
ucaccucgcacgacaccu

SEQ ID NO: 1257533 - RNA, 21 nt, Mycobacterium tuberculosis H37Rv
ucaccucgcacgacaccucga

SEQ ID NO: 1257534 - RNA, 18 nt, Mycobacterium tuberculosis H37Rv
ucaccguguugcacgcgg

SEQ ID NO: 1257535 - RNA, 23 nt, Mycobacterium tuberculosis H37Rv
ucaccguuguucccauagccagc

SEQ ID NO: 1257536 - RNA, 17 nt, Mycobacterium tuberculosis H37Rv
ucacgggcuaccggcag

SEQ ID NO: 1257537 - RNA, 13 nt, Mycobacterium tuberculosis H37Rv
ucacggucgacga

SEQ ID NO: 1257538 - RNA, 21 nt, Mycobacterium tuberculosis H37Rv
ucacggugggcgccgacaccg

SEQ ID NO: 1257539 - RNA, 22 nt, Mycobacterium tuberculosis H37Rv
ucacguucagcccaugcccggc

SEQ ID NO: 1257540 - RNA, 14 nt, Mycobacterium tuberculosis H37Rv
ucacuaccgaucac

SEQ ID NO: 1257541 - RNA, 19 nt, Mycobacterium tuberculosis H37Rv
ucacccugucgcgcaccgg

SEQ ID NO: 1257542 - RNA, 16 nt, Mycobacterium tuberculosis H37Rv
ucaccgaauaccgccg

SEQ ID NO: 1257543 - RNA, 14 nt, Mycobacterium tuberculosis H37Rv
ucaccgacaccgug

SEQ ID NO: 1257544 - RNA, 18 nt, Mycobacterium tuberculosis H37Rv
ucacccgggaugaccacc

SEQ ID NO: 1257545 - RNA, 14 nt, Mycobacterium tuberculosis H37Rv
ucacccgguagacg

SEQ ID NO: 1257546 - RNA, 17 nt, Mycobacterium tuberculosis H37Rv
ucacccugucgcgcacc

SEQ ID NO: 1257547 - RNA, 21 nt, Mycobacterium tuberculosis H37Rv
ucacccuauuggucggucgcg

SEQ ID NO: 1257548 - RNA, 14 nt, Mycobacterium tuberculosis H37Rv
ucacccgcccggaa

SEQ ID NO: 1257549 - RNA, 13 nt, Mycobacterium tuberculosis H37Rv
ucacccgcaucgg

SEQ ID NO: 1257550 - RNA, 14 nt, Mycobacterium tuberculosis H37Rv
ucacccgcaucggc

SEQ ID NO: 1257551 - RNA, 12 nt, Mycobacterium tuberculosis H37Rv
ucacccgcaucg

SEQ ID NO: 1257552 - RNA, 16 nt, Mycobacterium tuberculosis H37Rv
ucacccgcaggucgau

SEQ ID NO: 1257553 - RNA, 15 nt, Mycobacterium tuberculosis H37Rv
ucacccgcacguaga

SEQ ID NO: 1257554 - RNA, 16 nt, Mycobacterium tuberculosis H37Rv
ucaccccuucgccagc

SEQ ID NO: 1257555 - RNA, 12 nt, Mycobacterium tuberculosis H37Rv
ucaccggguugg

SEQ ID NO: 1257556 - RNA, 22 nt, Mycobacterium tuberculosis H37Rv
ucaccgggguugcccgcgacga

SEQ ID NO: 1257557 - RNA, 15 nt, Mycobacterium tuberculosis H37Rv
ucaccguacggccac

SEQ ID NO: 1257558 - RNA, 21 nt, Mycobacterium tuberculosis H37Rv
ucaccguacgggacgaagacc

SEQ ID NO: 1257559 - RNA, 18 nt, Mycobacterium tuberculosis H37Rv
ucaccggucaccgcgcag

SEQ ID NO: 1257560 - RNA, 19 nt, Mycobacterium tuberculosis H37Rv
ucaccgccggugcugacga

SEQ ID NO: 1257561 - RNA, 19 nt, Mycobacterium tuberculosis H37Rv
ucaccgccgucaccgccau

SEQ ID NO: 1257562 - RNA, 18 nt, Mycobacterium tuberculosis H37Rv
ucaccgccgggaugccgg

SEQ ID NO: 1257563 - RNA, 19 nt, Mycobacterium tuberculosis H37Rv
ucaccgccgcuaccgcccg

SEQ ID NO: 1257564 - RNA, 21 nt, Mycobacterium tuberculosis H37Rv
ucaccgccuuugccgccggca

SEQ ID NO: 1257565 - RNA, 18 nt, Mycobacterium tuberculosis H37Rv
ucaccgccguuaccgccg

SEQ ID NO: 1257566 - RNA, 16 nt, Mycobacterium tuberculosis H37Rv
ucaccgcgcaucaucg

SEQ ID NO: 1257567 - RNA, 20 nt, Mycobacterium tuberculosis H37Rv
ucaccauggcgccgcgccga

SEQ ID NO: 1257568 - RNA, 21 nt, Mycobacterium tuberculosis H37Rv
ucacccagcugggucccgcug

SEQ ID NO: 1257569 - RNA, 18 nt, Mycobacterium tuberculosis H37Rv
ucacccagcucgcgcacc

SEQ ID NO: 1257570 - RNA, 13 nt, Mycobacterium tuberculosis H37Rv
ucacccagcucgc

SEQ ID NO: 1257571 - RNA, 19 nt, Mycobacterium tuberculosis H37Rv
ucacccccuggacuucggg

SEQ ID NO: 1257572 - RNA, 12 nt, Mycobacterium tuberculosis H37Rv
ucaccccggugg

SEQ ID NO: 1257573 - RNA, 13 nt, Mycobacterium tuberculosis H37Rv
ucaccagcugcga

SEQ ID NO: 1257574 - RNA, 12 nt, Mycobacterium tuberculosis H37Rv
ucaccacgucgu

SEQ ID NO: 1257575 - RNA, 13 nt, Mycobacterium tuberculosis H37Rv
ucaccacgucguc

SEQ ID NO: 1257576 - RNA, 21 nt, Mycobacterium tuberculosis H37Rv
ucacaagccccgcgcguucgg

SEQ ID NO: 1257577 - RNA, 20 nt, Mycobacterium tuberculosis H37Rv
ucacaagccgugcagcucgg

SEQ ID NO: 1257578 - RNA, 15 nt, Mycobacterium tuberculosis H37Rv
ucaccaaccgcccga

SEQ ID NO: 1257579 - RNA, 15 nt, Mycobacterium tuberculosis H37Rv
ucaccaacgcgggaa

SEQ ID NO: 1257580 - RNA, 15 nt, Mycobacterium tuberculosis H37Rv
ucaccaaucugcggg

SEQ ID NO: 1257581 - RNA, 15 nt, Mycobacterium tuberculosis H37Rv
ucaccaaggucggcg

SEQ ID NO: 1257582 - RNA, 15 nt, Mycobacterium tuberculosis H37Rv
ucaccaccgcaccgg

SEQ ID NO: 1257583 - RNA, 13 nt, Mycobacterium tuberculosis H37Rv
ucaccaccggcac

SEQ ID NO: 1257584 - RNA, 12 nt, Mycobacterium tuberculosis H37Rv
ucaccaccggca

SEQ ID NO: 1257585 - RNA, 15 nt, Mycobacterium tuberculosis H37Rv
ucaccaccggaucgc

SEQ ID NO: 1257586 - RNA, 15 nt, Mycobacterium tuberculosis H37Rv
ucaccaccggcaccg

SEQ ID NO: 1257587 - RNA, 17 nt, Mycobacterium tuberculosis H37Rv
ucaccaccggcaccgcu

SEQ ID NO: 1257588 - RNA, 14 nt, Mycobacterium tuberculosis H37Rv
ucaccaccguggcg

SEQ ID NO: 1257589 - RNA, 19 nt, Mycobacterium tuberculosis H37Rv
ucacaugcccgcaccgucg

SEQ ID NO: 1257590 - RNA, 20 nt, Mycobacterium tuberculosis H37Rv
ucacaccagcgggcaucgcg

SEQ ID NO: 1257591 - RNA, 19 nt, Mycobacterium tuberculosis H37Rv
ucacaggccgccugggggu

SEQ ID NO: 1257592 - RNA, 17 nt, Mycobacterium tuberculosis H37Rv
ucaguagccacgcccac

SEQ ID NO: 1257593 - RNA, 23 nt, Mycobacterium tuberculosis H37Rv
ucaguccgacaccggcggcaucg

SEQ ID NO: 1257594 - RNA, 24 nt, Mycobacterium tuberculosis H37Rv
ucagggugggcgacgucaucgccg

SEQ ID NO: 1257595 - RNA, 16 nt, Mycobacterium tuberculosis H37Rv
ucauagcgcaccaccg

SEQ ID NO: 1257596 - RNA, 15 nt, Mycobacterium tuberculosis H37Rv
ucauacucgacaccg

SEQ ID NO: 1257597 - RNA, 16 nt, Mycobacterium tuberculosis H37Rv
ucauacucgacaccga

SEQ ID NO: 1257598 - RNA, 22 nt, Mycobacterium tuberculosis H37Rv
ucaggggcgccuuaggcguccg

SEQ ID NO: 1257599 - RNA, 20 nt, Mycobacterium tuberculosis H37Rv
ucagggugcugaucuugccg

SEQ ID NO: 1257600 - RNA, 22 nt, Mycobacterium tuberculosis H37Rv
ucaggcgguaguggcgaucugc

SEQ ID NO: 1257601 - RNA, 14 nt, Mycobacterium tuberculosis H37Rv
ucagcgaaccaccg

SEQ ID NO: 1257602 - RNA, 15 nt, Mycobacterium tuberculosis H37Rv
ucaucgacggugauc

SEQ ID NO: 1257603 - RNA, 19 nt, Mycobacterium tuberculosis H37Rv
ucaucgauccucgcccgca

SEQ ID NO: 1257604 - RNA, 15 nt, Mycobacterium tuberculosis H37Rv
ucaucgccagcggca

SEQ ID NO: 1257605 - RNA, 19 nt, Mycobacterium tuberculosis H37Rv
ucaucuguaaccuccucga

SEQ ID NO: 1257606 - RNA, 13 nt, Mycobacterium tuberculosis H37Rv
ucaugaacaucgg

SEQ ID NO: 1257607 - RNA, 21 nt, Mycobacterium tuberculosis H37Rv
ucaucuuggcgcgguccucca

SEQ ID NO: 1257608 - RNA, 18 nt, Mycobacterium tuberculosis H37Rv
uccaccaggacguggucg

SEQ ID NO: 1257609 - RNA, 13 nt, Mycobacterium tuberculosis H37Rv
uccaccagccggu

SEQ ID NO: 1257610 - RNA, 15 nt, Mycobacterium tuberculosis H37Rv
uccacaaguagccga

SEQ ID NO: 1257611 - RNA, 19 nt, Mycobacterium tuberculosis H37Rv
uccacccaccuggaucagc

SEQ ID NO: 1257612 - RNA, 20 nt, Mycobacterium tuberculosis H37Rv
uccacccaccuggaucagcg

SEQ ID NO: 1257613 - RNA, 20 nt, Mycobacterium tuberculosis H37Rv
uccaaggcucagcagcgccg

SEQ ID NO: 1257614 - RNA, 15 nt, Mycobacterium tuberculosis H37Rv
uccagaacgcaucgg

SEQ ID NO: 1257615 - RNA, 18 nt, Mycobacterium tuberculosis H37Rv
uccagaaggccgcaccgc

SEQ ID NO: 1257616 - RNA, 22 nt, Mycobacterium tuberculosis H37Rv
uccaccccgccgaucaccgcug

SEQ ID NO: 1257617 - RNA, 22 nt, Mycobacterium tuberculosis H37Rv
uccacccgccggccgucggccg

SEQ ID NO: 1257618 - RNA, 24 nt, Mycobacterium tuberculosis H37Rv
uccacgcaccacgagcagccgaug

SEQ ID NO: 1257619 - RNA, 21 nt, Mycobacterium tuberculosis H37Rv
uccacgauaucgaugcggcga

SEQ ID NO: 1257620 - RNA, 21 nt, Mycobacterium tuberculosis H37Rv
uccacgaugacgucgacaacg

SEQ ID NO: 1257621 - RNA, 14 nt, Mycobacterium tuberculosis H37Rv
uccacgacaaccgu

SEQ ID NO: 1257622 - RNA, 14 nt, Mycobacterium tuberculosis H37Rv
uccagcagcucggc

SEQ ID NO: 1257623 - RNA, 13 nt, Mycobacterium tuberculosis H37Rv
uccagcagcgcca

SEQ ID NO: 1257624 - RNA, 22 nt, Mycobacterium tuberculosis H37Rv
uccagcagcccgguggugcugu

SEQ ID NO: 1257625 - RNA, 14 nt, Mycobacterium tuberculosis H37Rv
uccagcgccgcggu

SEQ ID NO: 1257626 - RNA, 19 nt, Mycobacterium tuberculosis H37Rv
uccagcgcgccacccagca

SEQ ID NO: 1257627 - RNA, 12 nt, Mycobacterium tuberculosis H37Rv
uccagcgcaccg

SEQ ID NO: 1257628 - RNA, 13 nt, Mycobacterium tuberculosis H37Rv
uccagcgcaucga

SEQ ID NO: 1257629 - RNA, 13 nt, Mycobacterium tuberculosis H37Rv
uccagcggcaccg

SEQ ID NO: 1257630 - RNA, 13 nt, Mycobacterium tuberculosis H37Rv
uccagcucgggca

SEQ ID NO: 1257631 - RNA, 15 nt, Mycobacterium tuberculosis H37Rv
uccaggacggaucgu

SEQ ID NO: 1257632 - RNA, 14 nt, Mycobacterium tuberculosis H37Rv
uccgaucggcaauc

SEQ ID NO: 1257633 - RNA, 19 nt, Mycobacterium tuberculosis H37Rv
uccgaugcgugccgacccg

SEQ ID NO: 1257634 - RNA, 20 nt, Mycobacterium tuberculosis H37Rv
uccgaugcgugccgacccgc

SEQ ID NO: 1257635 - RNA, 14 nt, Mycobacterium tuberculosis H37Rv
uccgauaccgcgau

SEQ ID NO: 1257636 - RNA, 15 nt, Mycobacterium tuberculosis H37Rv
uccgacgaaccggga

SEQ ID NO: 1257637 - RNA, 16 nt, Mycobacterium tuberculosis H37Rv
uccgacaccggcggca

SEQ ID NO: 1257638 - RNA, 18 nt, Mycobacterium tuberculosis H37Rv
ucccgggugcgacgcgac

SEQ ID NO: 1257639 - RNA, 22 nt, Mycobacterium tuberculosis H37Rv
ucccggggugccgaucgaugcc

SEQ ID NO: 1257640 - RNA, 11 nt, Mycobacterium tuberculosis H37Rv
uccgacaccgg

SEQ ID NO: 1257641 - RNA, 13 nt, Mycobacterium tuberculosis H37Rv
uccgccggcgaca

SEQ ID NO: 1257642 - RNA, 20 nt, Mycobacterium tuberculosis H37Rv
uccgccggauagcaccggca

SEQ ID NO: 1257643 - RNA, 16 nt, Mycobacterium tuberculosis H37Rv
uccgccgucgccaccg

SEQ ID NO: 1257644 - RNA, 22 nt, Mycobacterium tuberculosis H37Rv
uccgccaaggaggccaucaucc

SEQ ID NO: 1257645 - RNA, 13 nt, Mycobacterium tuberculosis H37Rv
uccgccaacucgu

SEQ ID NO: 1257646 - RNA, 12 nt, Mycobacterium tuberculosis H37Rv
uccgcgccgauc

SEQ ID NO: 1257647 - RNA, 22 nt, Mycobacterium tuberculosis H37Rv
uccgcgccgacggccagcagga

SEQ ID NO: 1257648 - RNA, 15 nt, Mycobacterium tuberculosis H37Rv
uccgcgcucaaccgc

SEQ ID NO: 1257649 - RNA, 14 nt, Mycobacterium tuberculosis H37Rv
uccgcggcgcagca

SEQ ID NO: 1257650 - RNA, 19 nt, Mycobacterium tuberculosis H37Rv
uccgcggcgagcuccgaug

SEQ ID NO: 1257651 - RNA, 20 nt, Mycobacterium tuberculosis H37Rv
uccgcggccaccaccaggcu

SEQ ID NO: 1257652 - RNA, 22 nt, Mycobacterium tuberculosis H37Rv
uccgcggcaugcaaugcuggcg

SEQ ID NO: 1257653 - RNA, 17 nt, Mycobacterium tuberculosis H37Rv
uccgcggcauuggcguc

SEQ ID NO: 1257654 - RNA, 18 nt, Mycobacterium tuberculosis H37Rv
uccgcguggugcugaccg

SEQ ID NO: 1257655 - RNA, 17 nt, Mycobacterium tuberculosis H37Rv
uccgcgucuggacgcga

SEQ ID NO: 1257656 - RNA, 16 nt, Mycobacterium tuberculosis H37Rv
uccgcguagagcagca

SEQ ID NO: 1257657 - RNA, 17 nt, Mycobacterium tuberculosis H37Rv
uccgcgucugcucgcga

SEQ ID NO: 1257658 - RNA, 17 nt, Mycobacterium tuberculosis H37Rv
uccgcgucugcucggcg

SEQ ID NO: 1257659 - RNA, 14 nt, Mycobacterium tuberculosis H37Rv
uccgcuacggcguc

SEQ ID NO: 1257660 - RNA, 22 nt, Mycobacterium tuberculosis H37Rv
uccggacccacccgcaccgccg

SEQ ID NO: 1257661 - RNA, 19 nt, Mycobacterium tuberculosis H37Rv
uccggauucggacucgccg

SEQ ID NO: 1257662 - RNA, 20 nt, Mycobacterium tuberculosis H37Rv
uccggaucggccuguccacc

SEQ ID NO: 1257663 - RNA, 20 nt, Mycobacterium tuberculosis H37Rv
uccggccggccuagccgaug

SEQ ID NO: 1257664 - RNA, 22 nt, Mycobacterium tuberculosis H37Rv
uccggccgguuggccagccaca

SEQ ID NO: 1257665 - RNA, 17 nt, Mycobacterium tuberculosis H37Rv
uccggccgguccgggaa

SEQ ID NO: 1257666 - RNA, 19 nt, Mycobacterium tuberculosis H37Rv
uccggccgguaguagcuga

SEQ ID NO: 1257667 - RNA, 22 nt, Mycobacterium tuberculosis H37Rv
uccggcguucccgccauugccg

SEQ ID NO: 1257668 - RNA, 17 nt, Mycobacterium tuberculosis H37Rv
uccggcgugcagcaccc

SEQ ID NO: 1257669 - RNA, 13 nt, Mycobacterium tuberculosis H37Rv
uccggcuccaccc

SEQ ID NO: 1257670 - RNA, 23 nt, Mycobacterium tuberculosis H37Rv
uccggcgggugccgagcuggcga

SEQ ID NO: 1257671 - RNA, 16 nt, Mycobacterium tuberculosis H37Rv
uccggcguacgccgua

SEQ ID NO: 1257672 - RNA, 13 nt, Mycobacterium tuberculosis H37Rv
uccggcggcgacg

SEQ ID NO: 1257673 - RNA, 21 nt, Mycobacterium tuberculosis H37Rv
ucccgaacaauucacgcacca

SEQ ID NO: 1257674 - RNA, 14 nt, Mycobacterium tuberculosis H37Rv
uccccuuagcucca

SEQ ID NO: 1257675 - RNA, 15 nt, Mycobacterium tuberculosis H37Rv
ucccgaaacccgaug

SEQ ID NO: 1257676 - RNA, 15 nt, Mycobacterium tuberculosis H37Rv
ucccgaacuggcugu

SEQ ID NO: 1257677 - RNA, 14 nt, Mycobacterium tuberculosis H37Rv
ucccgaccagcaga

SEQ ID NO: 1257678 - RNA, 13 nt, Mycobacterium tuberculosis H37Rv
ucccgaucccggc

SEQ ID NO: 1257679 - RNA, 24 nt, Mycobacterium tuberculosis H37Rv
ucccgacccuucgggcuggucggu

SEQ ID NO: 1257680 - RNA, 17 nt, Mycobacterium tuberculosis H37Rv
uccccugcgcugcagcu

SEQ ID NO: 1257681 - RNA, 19 nt, Mycobacterium tuberculosis H37Rv
ucccgcgugccacucgaug

SEQ ID NO: 1257682 - RNA, 15 nt, Mycobacterium tuberculosis H37Rv
ucccgcucgcaggcc

SEQ ID NO: 1257683 - RNA, 17 nt, Mycobacterium tuberculosis H37Rv
ucccgaucgcgcuggga

SEQ ID NO: 1257684 - RNA, 14 nt, Mycobacterium tuberculosis H37Rv
ucccgaugaccuug

SEQ ID NO: 1257685 - RNA, 14 nt, Mycobacterium tuberculosis H37Rv
ucccgaugcuggca

SEQ ID NO: 1257686 - RNA, 19 nt, Mycobacterium tuberculosis H37Rv
ucccgauguaugacagguc

SEQ ID NO: 1257687 - RNA, 18 nt, Mycobacterium tuberculosis H37Rv
ucccgcggacagcccgga

SEQ ID NO: 1257688 - RNA, 21 nt, Mycobacterium tuberculosis H37Rv
ucccgcggcaacgcggucugc

SEQ ID NO: 1257689 - RNA, 21 nt, Mycobacterium tuberculosis H37Rv
uccccgaucugcuccucgguc

SEQ ID NO: 1257690 - RNA, 17 nt, Mycobacterium tuberculosis H37Rv
uccccgaccgccaccgc

SEQ ID NO: 1257691 - RNA, 20 nt, Mycobacterium tuberculosis H37Rv
ucccccgcuacgcgcgcucg

SEQ ID NO: 1257692 - RNA, 12 nt, Mycobacterium tuberculosis H37Rv
ucccccgcagcc

SEQ ID NO: 1257693 - RNA, 22 nt, Mycobacterium tuberculosis H37Rv
uccccaugcagcgcgucgccga

SEQ ID NO: 1257694 - RNA, 14 nt, Mycobacterium tuberculosis H37Rv
uccccgcuuggcga

SEQ ID NO: 1257695 - RNA, 16 nt, Mycobacterium tuberculosis H37Rv
uccccggauuccucgu

SEQ ID NO: 1257696 - RNA, 14 nt, Mycobacterium tuberculosis H37Rv
uccccgcggcggua

SEQ ID NO: 1257697 - RNA, 21 nt, Mycobacterium tuberculosis H37Rv
uccccggauuccucgucaccg

SEQ ID NO: 1257698 - RNA, 17 nt, Mycobacterium tuberculosis H37Rv
uccccggucgccgcguc

SEQ ID NO: 1257699 - RNA, 19 nt, Mycobacterium tuberculosis H37Rv
uccccggcugccagcgccg

SEQ ID NO: 1257700 - RNA, 17 nt, Mycobacterium tuberculosis H37Rv
ucccaggacuccggccg

SEQ ID NO: 1257701 - RNA, 16 nt, Mycobacterium tuberculosis H37Rv
ucccaugcugcgcaac

SEQ ID NO: 1257702 - RNA, 15 nt, Mycobacterium tuberculosis H37Rv
ucccauaucgaucgg

SEQ ID NO: 1257703 - RNA, 18 nt, Mycobacterium tuberculosis H37Rv
ucccaguccaggacgguc

SEQ ID NO: 1257704 - RNA, 16 nt, Mycobacterium tuberculosis H37Rv
ucccagugagcaugcg

SEQ ID NO: 1257705 - RNA, 18 nt, Mycobacterium tuberculosis H37Rv
uccccacaaucagcccga

SEQ ID NO: 1257706 - RNA, 16 nt, Mycobacterium tuberculosis H37Rv
uccccaccacaccucg

SEQ ID NO: 1257707 - RNA, 16 nt, Mycobacterium tuberculosis H37Rv
uccccaccgacgccga

SEQ ID NO: 1257708 - RNA, 15 nt, Mycobacterium tuberculosis H37Rv
uccccaccgucgucg

SEQ ID NO: 1257709 - RNA, 14 nt, Mycobacterium tuberculosis H37Rv
ucccacugcgcguc

SEQ ID NO: 1257710 - RNA, 17 nt, Mycobacterium tuberculosis H37Rv
ucccacuggaggucguc

SEQ ID NO: 1257711 - RNA, 20 nt, Mycobacterium tuberculosis H37Rv
ucccacgagcggguccgacg

SEQ ID NO: 1257712 - RNA, 20 nt, Mycobacterium tuberculosis H37Rv
ucccacaggcuuuuccggcg

SEQ ID NO: 1257713 - RNA, 18 nt, Mycobacterium tuberculosis H37Rv
ucccacagguagaccguc

SEQ ID NO: 1257714 - RNA, 15 nt, Mycobacterium tuberculosis H37Rv
ucccaacacggcgac

SEQ ID NO: 1257715 - RNA, 15 nt, Mycobacterium tuberculosis H37Rv
ucccaaccgcccgug

SEQ ID NO: 1257716 - RNA, 19 nt, Mycobacterium tuberculosis H37Rv
ucggccccgaaacgauggc

SEQ ID NO: 1257717 - RNA, 19 nt, Mycobacterium tuberculosis H37Rv
ucggcccaucuuuccggcg

SEQ ID NO: 1257718 - RNA, 20 nt, Mycobacterium tuberculosis H37Rv
ucggcccacacggucgucgc

SEQ ID NO: 1257719 - RNA, 14 nt, Mycobacterium tuberculosis H37Rv
ucggccgcaaggcg

SEQ ID NO: 1257720 - RNA, 14 nt, Mycobacterium tuberculosis H37Rv
ucggcccuccaccg

SEQ ID NO: 1257721 - RNA, 14 nt, Mycobacterium tuberculosis H37Rv
ucggcccgcucacc

SEQ ID NO: 1257722 - RNA, 17 nt, Mycobacterium tuberculosis H37Rv
ucggccagaucacgcac

SEQ ID NO: 1257723 - RNA, 14 nt, Mycobacterium tuberculosis H37Rv
ucggcauugcgcag

SEQ ID NO: 1257724 - RNA, 15 nt, Mycobacterium tuberculosis H37Rv
ucggccauccaccgc

SEQ ID NO: 1257725 - RNA, 20 nt, Mycobacterium tuberculosis H37Rv
ucggccauccaccgcagauc

SEQ ID NO: 1257726 - RNA, 14 nt, Mycobacterium tuberculosis H37Rv
ucggccauccaccg

SEQ ID NO: 1257727 - RNA, 15 nt, Mycobacterium tuberculosis H37Rv
ucggccaucugcucg

SEQ ID NO: 1257728 - RNA, 13 nt, Mycobacterium tuberculosis H37Rv
ucggccaucgagu

SEQ ID NO: 1257729 - RNA, 18 nt, Mycobacterium tuberculosis H37Rv
ucggcauccaggcugucg

SEQ ID NO: 1257730 - RNA, 13 nt, Mycobacterium tuberculosis H37Rv
ucggcaucgacgc

SEQ ID NO: 1257731 - RNA, 12 nt, Mycobacterium tuberculosis H37Rv
ucggcagcagcg

SEQ ID NO: 1257732 - RNA, 22 nt, Mycobacterium tuberculosis H37Rv
ucggcagcagcgcaacggccag

SEQ ID NO: 1257733 - RNA, 16 nt, Mycobacterium tuberculosis H37Rv
ucggcagcagcgcaac

SEQ ID NO: 1257734 - RNA, 19 nt, Mycobacterium tuberculosis H37Rv
ucggcagcagcggugcagc

SEQ ID NO: 1257735 - RNA, 15 nt, Mycobacterium tuberculosis H37Rv
ucggcauccaggcug

SEQ ID NO: 1257736 - RNA, 17 nt, Mycobacterium tuberculosis H37Rv
ucggcacgacccgggaa

SEQ ID NO: 1257737 - RNA, 18 nt, Mycobacterium tuberculosis H37Rv
ucggcacuuagcccgaug

SEQ ID NO: 1257738 - RNA, 22 nt, Mycobacterium tuberculosis H37Rv
ucggcacuuagcccgauggugc

SEQ ID NO: 1257739 - RNA, 17 nt, Mycobacterium tuberculosis H37Rv
ucggcacccucggcguu

SEQ ID NO: 1257740 - RNA, 20 nt, Mycobacterium tuberculosis H37Rv
ucggaggugaccucgauggc

SEQ ID NO: 1257741 - RNA, 17 nt, Mycobacterium tuberculosis H37Rv
ucggaggcgaccacguc

SEQ ID NO: 1257742 - RNA, 20 nt, Mycobacterium tuberculosis H37Rv
ucgcggaccucggcgaccug

SEQ ID NO: 1257743 - RNA, 19 nt, Mycobacterium tuberculosis H37Rv
ucgcggacccgcgcgucgc

SEQ ID NO: 1257744 - RNA, 23 nt, Mycobacterium tuberculosis H37Rv
ucgcggagccgucgcaucagguc

SEQ ID NO: 1257745 - RNA, 24 nt, Mycobacterium tuberculosis H37Rv
ucgcgcugcggcccacaccagcgc

SEQ ID NO: 1257746 - RNA, 12 nt, Mycobacterium tuberculosis H37Rv
ucgcgcugcggc

SEQ ID NO: 1257747 - RNA, 21 nt, Mycobacterium tuberculosis H37Rv
ucgcgcuggcaaguucggccg

SEQ ID NO: 1257748 - RNA, 18 nt, Mycobacterium tuberculosis H37Rv
ucgcucagggugucgaca

SEQ ID NO: 1257749 - RNA, 13 nt, Mycobacterium tuberculosis H37Rv
ucgcucaccggcg

SEQ ID NO: 1257750 - RNA, 13 nt, Mycobacterium tuberculosis H37Rv
ucgcucaccggcu

SEQ ID NO: 1257751 - RNA, 15 nt, Mycobacterium tuberculosis H37Rv
ucgcugcaaccgccg

SEQ ID NO: 1257752 - RNA, 14 nt, Mycobacterium tuberculosis H37Rv
ucgcugcaccagcu

SEQ ID NO: 1257753 - RNA, 17 nt, Mycobacterium tuberculosis H37Rv
ucgcugcugcgaucgcc

SEQ ID NO: 1257754 - RNA, 16 nt, Mycobacterium tuberculosis H37Rv
ucgcugcugcgaucgc

SEQ ID NO: 1257755 - RNA, 14 nt, Mycobacterium tuberculosis H37Rv
ucgcuggccgcgag

SEQ ID NO: 1257756 - RNA, 17 nt, Mycobacterium tuberculosis H37Rv
ucgcugcgaugcugauc

SEQ ID NO: 1257757 - RNA, 23 nt, Mycobacterium tuberculosis H37Rv
ucggacaaggacugaccgucugc

SEQ ID NO: 1257758 - RNA, 20 nt, Mycobacterium tuberculosis H37Rv
ucggacaaggacugaccguc

SEQ ID NO: 1257759 - RNA, 16 nt, Mycobacterium tuberculosis H37Rv
ucgcuggcgaugccga

SEQ ID NO: 1257760 - RNA, 21 nt, Mycobacterium tuberculosis H37Rv
ucggaccacaucuggucacgg

SEQ ID NO: 1257761 - RNA, 14 nt, Mycobacterium tuberculosis H37Rv
ucggacagcgucuc

SEQ ID NO: 1257762 - RNA, 19 nt, Mycobacterium tuberculosis H37Rv
ucggacagguaacgcgguu

SEQ ID NO: 1257763 - RNA, 14 nt, Mycobacterium tuberculosis H37Rv
ucggagacgucuuc

SEQ ID NO: 1257764 - RNA, 22 nt, Mycobacterium tuberculosis H37Rv
ucggacucgccgacgucgacgc

SEQ ID NO: 1257765 - RNA, 18 nt, Mycobacterium tuberculosis H37Rv
ucggaccuuccgggugaa

SEQ ID NO: 1257766 - RNA, 18 nt, Mycobacterium tuberculosis H37Rv
ucggacggccaucgccag

SEQ ID NO: 1257767 - RNA, 21 nt, Mycobacterium tuberculosis H37Rv
ucggaccagcugccggcgacc

SEQ ID NO: 1257768 - RNA, 21 nt, Mycobacterium tuberculosis H37Rv
ucgggacgaaaaaaucgugcg

SEQ ID NO: 1257769 - RNA, 15 nt, Mycobacterium tuberculosis H37Rv
ucgggacgcgagugc

SEQ ID NO: 1257770 - RNA, 23 nt, Mycobacterium tuberculosis H37Rv
ucgggacaaagccgaacgacagc

SEQ ID NO: 1257771 - RNA, 18 nt, Mycobacterium tuberculosis H37Rv
ucgggacaucugcccacc

SEQ ID NO: 1257772 - RNA, 22 nt, Mycobacterium tuberculosis H37Rv
ucgggacaucugcccaccgcag

SEQ ID NO: 1257773 - RNA, 19 nt, Mycobacterium tuberculosis H37Rv
ucgggaccaccgaccgcgu

SEQ ID NO: 1257774 - RNA, 14 nt, Mycobacterium tuberculosis H37Rv
ucggcugcggcguc

SEQ ID NO: 1257775 - RNA, 23 nt, Mycobacterium tuberculosis H37Rv
ucggcugccgcaaacgcggcguc

SEQ ID NO: 1257776 - RNA, 18 nt, Mycobacterium tuberculosis H37Rv
ucggcuuccuccucggcg

SEQ ID NO: 1257777 - RNA, 13 nt, Mycobacterium tuberculosis H37Rv
ucgggcaacucgg

SEQ ID NO: 1257778 - RNA, 14 nt, Mycobacterium tuberculosis H37Rv
ucgggcaaagucgg

SEQ ID NO: 1257779 - RNA, 14 nt, Mycobacterium tuberculosis H37Rv
ucgggcacaccgac

SEQ ID NO: 1257780 - RNA, 15 nt, Mycobacterium tuberculosis H37Rv
ucgggcacaccgacg

SEQ ID NO: 1257781 - RNA, 22 nt, Mycobacterium tuberculosis H37Rv
ucgggcacaccgaacggugugc

SEQ ID NO: 1257782 - RNA, 18 nt, Mycobacterium tuberculosis H37Rv
ucgggaccggggacgcgc

SEQ ID NO: 1257783 - RNA, 14 nt, Mycobacterium tuberculosis H37Rv
ucggcuuccggugc

SEQ ID NO: 1257784 - RNA, 17 nt, Mycobacterium tuberculosis H37Rv
ucgggauaggacaccgu

SEQ ID NO: 1257785 - RNA, 16 nt, Mycobacterium tuberculosis H37Rv
ucggcgugcagcagcu

SEQ ID NO: 1257786 - RNA, 21 nt, Mycobacterium tuberculosis H37Rv
ucggcgucguggcuuccggug

SEQ ID NO: 1257787 - RNA, 19 nt, Mycobacterium tuberculosis H37Rv
ucggcgucguauucgaugc

SEQ ID NO: 1257788 - RNA, 17 nt, Mycobacterium tuberculosis H37Rv
ucggcgucgucgauggc

SEQ ID NO: 1257789 - RNA, 22 nt, Mycobacterium tuberculosis H37Rv
ucggcguggcaguacaccggcg

SEQ ID NO: 1257790 - RNA, 15 nt, Mycobacterium tuberculosis H37Rv
ucggcugcgcgcucg

SEQ ID NO: 1257791 - RNA, 20 nt, Mycobacterium tuberculosis H37Rv
ucggcugauuggcccaccgc

SEQ ID NO: 1257792 - RNA, 20 nt, Mycobacterium tuberculosis H37Rv
ucggcggccgugucgggcgc

SEQ ID NO: 1257793 - RNA, 14 nt, Mycobacterium tuberculosis H37Rv
ucggcggccagcgc

SEQ ID NO: 1257794 - RNA, 23 nt, Mycobacterium tuberculosis H37Rv
ucggcggccggcgccggcgcguc

SEQ ID NO: 1257795 - RNA, 21 nt, Mycobacterium tuberculosis H37Rv
ucggcggcccggccgaacgcc

SEQ ID NO: 1257796 - RNA, 20 nt, Mycobacterium tuberculosis H37Rv
ucggcggccagcgcgucgcc

SEQ ID NO: 1257797 - RNA, 18 nt, Mycobacterium tuberculosis H37Rv
ucggcgcguccgcaggcg

SEQ ID NO: 1257798 - RNA, 14 nt, Mycobacterium tuberculosis H37Rv
ucggcgcucgucgc

SEQ ID NO: 1257799 - RNA, 16 nt, Mycobacterium tuberculosis H37Rv
ucggcgaucaacgcgc

SEQ ID NO: 1257800 - RNA, 19 nt, Mycobacterium tuberculosis H37Rv
ucggcgaucaagccucuau

SEQ ID NO: 1257801 - RNA, 15 nt, Mycobacterium tuberculosis H37Rv
ucggcgaucucgucg

SEQ ID NO: 1257802 - RNA, 16 nt, Mycobacterium tuberculosis H37Rv
ucggcgaucucgucgc

SEQ ID NO: 1257803 - RNA, 14 nt, Mycobacterium tuberculosis H37Rv
ucggcgacgccguc

SEQ ID NO: 1257804 - RNA, 20 nt, Mycobacterium tuberculosis H37Rv
ucggcgagcacgucacgcgc

SEQ ID NO: 1257805 - RNA, 18 nt, Mycobacterium tuberculosis H37Rv
ucggcgagcagacgccgc

SEQ ID NO: 1257806 - RNA, 15 nt, Mycobacterium tuberculosis H37Rv
ucggcgagcaccgug

SEQ ID NO: 1257807 - RNA, 15 nt, Mycobacterium tuberculosis H37Rv
ucggccuguccaccg

SEQ ID NO: 1257808 - RNA, 19 nt, Mycobacterium tuberculosis H37Rv
ucggccuggauggguugac

SEQ ID NO: 1257809 - RNA, 19 nt, Mycobacterium tuberculosis H37Rv
ucggcgcgcaccucggcga

SEQ ID NO: 1257810 - RNA, 16 nt, Mycobacterium tuberculosis H37Rv
ucggcgaugucgaagc

SEQ ID NO: 1257811 - RNA, 16 nt, Mycobacterium tuberculosis H37Rv
ucggcgaugcguccgc

SEQ ID NO: 1257812 - RNA, 17 nt, Mycobacterium tuberculosis H37Rv
ucggcgcacagcgagca

SEQ ID NO: 1257813 - RNA, 17 nt, Mycobacterium tuberculosis H37Rv
ucggcgcagccggugag

SEQ ID NO: 1257814 - RNA, 19 nt, Mycobacterium tuberculosis H37Rv
ucggcgccagaucgacgcc

SEQ ID NO: 1257815 - RNA, 18 nt, Mycobacterium tuberculosis H37Rv
ucggugugcggcgcaugc

SEQ ID NO: 1257816 - RNA, 18 nt, Mycobacterium tuberculosis H37Rv
ucgguguggacugggcca

SEQ ID NO: 1257817 - RNA, 15 nt, Mycobacterium tuberculosis H37Rv
ucggugugcaucgcc

SEQ ID NO: 1257818 - RNA, 13 nt, Mycobacterium tuberculosis H37Rv
ucggugugcaucg

SEQ ID NO: 1257819 - RNA, 20 nt, Mycobacterium tuberculosis H37Rv
ucggugucuuccuccucgac

SEQ ID NO: 1257820 - RNA, 22 nt, Mycobacterium tuberculosis H37Rv
ucgguggcgaugcgauaggccc

SEQ ID NO: 1257821 - RNA, 21 nt, Mycobacterium tuberculosis H37Rv
ucgguggcaaggccaaccggg

SEQ ID NO: 1257822 - RNA, 15 nt, Mycobacterium tuberculosis H37Rv
ucggugcgcuggcgg

SEQ ID NO: 1257823 - RNA, 16 nt, Mycobacterium tuberculosis H37Rv
ucggugcggucaucgc

SEQ ID NO: 1257824 - RNA, 23 nt, Mycobacterium tuberculosis H37Rv
ucggugcgguucgcugcggcggu

SEQ ID NO: 1257825 - RNA, 17 nt, Mycobacterium tuberculosis H37Rv
ucggucagggugggcuc

SEQ ID NO: 1257826 - RNA, 16 nt, Mycobacterium tuberculosis H37Rv
ucgguagcgaucgugc

SEQ ID NO: 1257827 - RNA, 17 nt, Mycobacterium tuberculosis H37Rv
ucggucaucgguugacc

SEQ ID NO: 1257828 - RNA, 14 nt, Mycobacterium tuberculosis H37Rv
ucggucaguuccuc

SEQ ID NO: 1257829 - RNA, 14 nt, Mycobacterium tuberculosis H37Rv
ucggucgccaccgc

SEQ ID NO: 1257830 - RNA, 19 nt, Mycobacterium tuberculosis H37Rv
ucggugcgcgcagacucgc

SEQ ID NO: 1257831 - RNA, 20 nt, Mycobacterium tuberculosis H37Rv
ucgucacgccccucacgugg

SEQ ID NO: 1257832 - RNA, 21 nt, Mycobacterium tuberculosis H37Rv
ucgucacgcggguugcgcggc

SEQ ID NO: 1257833 - RNA, 17 nt, Mycobacterium tuberculosis H37Rv
ucgucaccgaugcgccg

SEQ ID NO: 1257834 - RNA, 14 nt, Mycobacterium tuberculosis H37Rv
ucgucacauugcca

SEQ ID NO: 1257835 - RNA, 17 nt, Mycobacterium tuberculosis H37Rv
ucgucaaccugcgcauc

SEQ ID NO: 1257836 - RNA, 18 nt, Mycobacterium tuberculosis H37Rv
ucguaugauucacgcucg

SEQ ID NO: 1257837 - RNA, 16 nt, Mycobacterium tuberculosis H37Rv
ucguaugcggugacga

SEQ ID NO: 1257838 - RNA, 15 nt, Mycobacterium tuberculosis H37Rv
ucguagggacgccga

SEQ ID NO: 1257839 - RNA, 13 nt, Mycobacterium tuberculosis H37Rv
ucguaggccgcau

SEQ ID NO: 1257840 - RNA, 13 nt, Mycobacterium tuberculosis H37Rv
ucguaggcgauga

SEQ ID NO: 1257841 - RNA, 15 nt, Mycobacterium tuberculosis H37Rv
ucguagacggcgaaa

SEQ ID NO: 1257842 - RNA, 20 nt, Mycobacterium tuberculosis H37Rv
ucguagacgguuaccgcgaa

SEQ ID NO: 1257843 - RNA, 12 nt, Mycobacterium tuberculosis H37Rv
ucggguugcagc

SEQ ID NO: 1257844 - RNA, 21 nt, Mycobacterium tuberculosis H37Rv
ucggguugguuggcucgcugg

SEQ ID NO: 1257845 - RNA, 12 nt, Mycobacterium tuberculosis H37Rv
ucggguucguca

SEQ ID NO: 1257846 - RNA, 20 nt, Mycobacterium tuberculosis H37Rv
ucgggggcuuaugcgucugc

SEQ ID NO: 1257847 - RNA, 21 nt, Mycobacterium tuberculosis H37Rv
ucgggugguacagggugugcg

SEQ ID NO: 1257848 - RNA, 21 nt, Mycobacterium tuberculosis H37Rv
ucggggggcaggucgagcgcc

SEQ ID NO: 1257849 - RNA, 13 nt, Mycobacterium tuberculosis H37Rv
ucggggguccagu

SEQ ID NO: 1257850 - RNA, 17 nt, Mycobacterium tuberculosis H37Rv
ucgggguaaccggcgga

SEQ ID NO: 1257851 - RNA, 19 nt, Mycobacterium tuberculosis H37Rv
ucgggguaguugaggccgu

SEQ ID NO: 1257852 - RNA, 19 nt, Mycobacterium tuberculosis H37Rv
ucggggucguugaggccgg

SEQ ID NO: 1257853 - RNA, 20 nt, Mycobacterium tuberculosis H37Rv
ucgggcugucaggcucacac

SEQ ID NO: 1257854 - RNA, 17 nt, Mycobacterium tuberculosis H37Rv
ucgggcuccagcagcgc

SEQ ID NO: 1257855 - RNA, 14 nt, Mycobacterium tuberculosis H37Rv
ucgggcggcgucgc

SEQ ID NO: 1257856 - RNA, 15 nt, Mycobacterium tuberculosis H37Rv
ucggggagcugcggc

SEQ ID NO: 1257857 - RNA, 15 nt, Mycobacterium tuberculosis H37Rv
ucggggaacgcggcg

SEQ ID NO: 1257858 - RNA, 21 nt, Mycobacterium tuberculosis H37Rv
ucggggcaccacgccagcccg

SEQ ID NO: 1257859 - RNA, 14 nt, Mycobacterium tuberculosis H37Rv
ucggggcgaugagc

SEQ ID NO: 1257860 - RNA, 16 nt, Mycobacterium tuberculosis H37Rv
ucggggcgucguucgc

SEQ ID NO: 1257861 - RNA, 19 nt, Mycobacterium tuberculosis H37Rv
ucgggggauuucgcgucug

SEQ ID NO: 1257862 - RNA, 22 nt, Mycobacterium tuberculosis H37Rv
ucggggcgcugcagcucacgac

SEQ ID NO: 1257863 - RNA, 20 nt, Mycobacterium tuberculosis H37Rv
ucgggggauuucgcgucugc

SEQ ID NO: 1257864 - RNA, 19 nt, Mycobacterium tuberculosis H37Rv
ucgggggcuuaugcgucug

SEQ ID NO: 1257865 - RNA, 16 nt, Mycobacterium tuberculosis H37Rv
ucgggggcggucgcgu

SEQ ID NO: 1257866 - RNA, 14 nt, Mycobacterium tuberculosis H37Rv
ucgggccaggcgaa

SEQ ID NO: 1257867 - RNA, 12 nt, Mycobacterium tuberculosis H37Rv
ucgggcccagca

SEQ ID NO: 1257868 - RNA, 15 nt, Mycobacterium tuberculosis H37Rv
ucgggcccagcagcg

SEQ ID NO: 1257869 - RNA, 13 nt, Mycobacterium tuberculosis H37Rv
ucgggccacagca

SEQ ID NO: 1257870 - RNA, 14 nt, Mycobacterium tuberculosis H37Rv
ucgggcagcgucac

SEQ ID NO: 1257871 - RNA, 17 nt, Mycobacterium tuberculosis H37Rv
ucgggcaggccgucgag

SEQ ID NO: 1257872 - RNA, 23 nt, Mycobacterium tuberculosis H37Rv
ucgggcgucagcaguucggcgau

SEQ ID NO: 1257873 - RNA, 15 nt, Mycobacterium tuberculosis H37Rv
ucgggcgucccggcg

SEQ ID NO: 1257874 - RNA, 13 nt, Mycobacterium tuberculosis H37Rv
ucgggcgcgcugc

SEQ ID NO: 1257875 - RNA, 16 nt, Mycobacterium tuberculosis H37Rv
ucgggcgcgggugacc

SEQ ID NO: 1257876 - RNA, 21 nt, Mycobacterium tuberculosis H37Rv
ucgggcgcgaggacgcugauc

SEQ ID NO: 1257877 - RNA, 16 nt, Mycobacterium tuberculosis H37Rv
ucgggcgcccgcguga

SEQ ID NO: 1257878 - RNA, 22 nt, Mycobacterium tuberculosis H37Rv
ucgggcgagaucuuuucaccac

SEQ ID NO: 1257879 - RNA, 16 nt, Mycobacterium tuberculosis H37Rv
ucgggcgaagcuagcg

SEQ ID NO: 1257880 - RNA, 17 nt, Mycobacterium tuberculosis H37Rv
ucgggccgccgagcucg

SEQ ID NO: 1257881 - RNA, 14 nt, Mycobacterium tuberculosis H37Rv
ucgggccguugugc

SEQ ID NO: 1257882 - RNA, 20 nt, Mycobacterium tuberculosis H37Rv
ucgucggcuuuggacagguc

SEQ ID NO: 1257883 - RNA, 13 nt, Mycobacterium tuberculosis H37Rv
ucgucggcgucgc

SEQ ID NO: 1257884 - RNA, 13 nt, Mycobacterium tuberculosis H37Rv
ucgucgggcaugc

SEQ ID NO: 1257885 - RNA, 13 nt, Mycobacterium tuberculosis H37Rv
ucgucgaccaggc

SEQ ID NO: 1257886 - RNA, 19 nt, Mycobacterium tuberculosis H37Rv
ucgucggccaugguguucg

SEQ ID NO: 1257887 - RNA, 20 nt, Mycobacterium tuberculosis H37Rv
ucgucggccgacaccgccac

SEQ ID NO: 1257888 - RNA, 17 nt, Mycobacterium tuberculosis H37Rv
ucguccaccgccgacau

SEQ ID NO: 1257889 - RNA, 14 nt, Mycobacterium tuberculosis H37Rv
ucguccaccgcgau

SEQ ID NO: 1257890 - RNA, 17 nt, Mycobacterium tuberculosis H37Rv
ucgucgaccacgacguu

SEQ ID NO: 1257891 - RNA, 15 nt, Mycobacterium tuberculosis H37Rv
ucgucgacacgguga

SEQ ID NO: 1257892 - RNA, 16 nt, Mycobacterium tuberculosis H37Rv
ucgucgaaagccugga

SEQ ID NO: 1257893 - RNA, 18 nt, Mycobacterium tuberculosis H37Rv
ucgucguggagcucacgu

SEQ ID NO: 1257894 - RNA, 20 nt, Mycobacterium tuberculosis H37Rv
ucgucgucucgaugcauggc

SEQ ID NO: 1257895 - RNA, 14 nt, Mycobacterium tuberculosis H37Rv
ucgucgucggcgua

SEQ ID NO: 1257896 - RNA, 22 nt, Mycobacterium tuberculosis H37Rv
ucgucguugugugccagcgugg

SEQ ID NO: 1257897 - RNA, 13 nt, Mycobacterium tuberculosis H37Rv
ucgugacagcggc

SEQ ID NO: 1257898 - RNA, 16 nt, Mycobacterium tuberculosis H37Rv
ucgugaacacgucgcg

SEQ ID NO: 1257899 - RNA, 14 nt, Mycobacterium tuberculosis H37Rv
ucgugaacaacucc

SEQ ID NO: 1257900 - RNA, 20 nt, Mycobacterium tuberculosis H37Rv
ucgucuugcguccauccgca

SEQ ID NO: 1257901 - RNA, 22 nt, Mycobacterium tuberculosis H37Rv
ucgugcaaugcuuccagcauca

SEQ ID NO: 1257902 - RNA, 16 nt, Mycobacterium tuberculosis H37Rv
ucgugcacgcacagcc

SEQ ID NO: 1257903 - RNA, 18 nt, Mycobacterium tuberculosis H37Rv
ucgugccacuuccacggc

SEQ ID NO: 1257904 - RNA, 18 nt, Mycobacterium tuberculosis H37Rv
ucgugccgccgucgucgu

SEQ ID NO: 1257905 - RNA, 16 nt, Mycobacterium tuberculosis H37Rv
ucgugcgugcggcgaa

SEQ ID NO: 1257906 - RNA, 22 nt, Mycobacterium tuberculosis H37Rv
ucgugcggggguggucucgaua

SEQ ID NO: 1257907 - RNA, 20 nt, Mycobacterium tuberculosis H37Rv
ucgugccgggaccggugugc

SEQ ID NO: 1257908 - RNA, 12 nt, Mycobacterium tuberculosis H37Rv
ucguggguccgu

SEQ ID NO: 1257909 - RNA, 21 nt, Mycobacterium tuberculosis H37Rv
ucguuggccaugccacaacgc

SEQ ID NO: 1257910 - RNA, 15 nt, Mycobacterium tuberculosis H37Rv
ucguugcgcggucuc

SEQ ID NO: 1257911 - RNA, 16 nt, Mycobacterium tuberculosis H37Rv
ucgugggaaccaccag

SEQ ID NO: 1257912 - RNA, 20 nt, Mycobacterium tuberculosis H37Rv
ucguggcgguggccgucggg

SEQ ID NO: 1257913 - RNA, 15 nt, Mycobacterium tuberculosis H37Rv
ucguggcgcucggcg

SEQ ID NO: 1257914 - RNA, 14 nt, Mycobacterium tuberculosis H37Rv
ucgugggucaacgu

SEQ ID NO: 1257915 - RNA, 12 nt, Mycobacterium tuberculosis H37Rv
ucguugcgcggu

SEQ ID NO: 1257916 - RNA, 13 nt, Mycobacterium tuberculosis H37Rv
ucguugugccggu

SEQ ID NO: 1257917 - RNA, 19 nt, Mycobacterium tuberculosis H37Rv
ucguugggcaugucgccga

SEQ ID NO: 1257918 - RNA, 13 nt, Mycobacterium tuberculosis H37Rv
ucuccaccgcgau

SEQ ID NO: 1257919 - RNA, 19 nt, Mycobacterium tuberculosis H37Rv
ucuccagauccacgccgac

SEQ ID NO: 1257920 - RNA, 18 nt, Mycobacterium tuberculosis H37Rv
ucucauccuccugcgccg

SEQ ID NO: 1257921 - RNA, 18 nt, Mycobacterium tuberculosis H37Rv
ucuagcaaagccagcgca

SEQ ID NO: 1257922 - RNA, 24 nt, Mycobacterium tuberculosis H37Rv
ucuagguucaguuccaccgcgcag

SEQ ID NO: 1257923 - RNA, 16 nt, Mycobacterium tuberculosis H37Rv
ucgcgccucaucggcu

SEQ ID NO: 1257924 - RNA, 15 nt, Mycobacterium tuberculosis H37Rv
ucgcgccgucggcga

SEQ ID NO: 1257925 - RNA, 22 nt, Mycobacterium tuberculosis H37Rv
ucgcgcucauguucucgaccgc

SEQ ID NO: 1257926 - RNA, 20 nt, Mycobacterium tuberculosis H37Rv
ucgcgcucgcucacgccguc

SEQ ID NO: 1257927 - RNA, 18 nt, Mycobacterium tuberculosis H37Rv
ucgcgcugaagguggcga

SEQ ID NO: 1257928 - RNA, 17 nt, Mycobacterium tuberculosis H37Rv
ucgcgcugaacgcugua

SEQ ID NO: 1257929 - RNA, 19 nt, Mycobacterium tuberculosis H37Rv
ucgcgcagcgucaucgcgu

SEQ ID NO: 1257930 - RNA, 18 nt, Mycobacterium tuberculosis H37Rv
ucgcgcagcgcgaucgcg

SEQ ID NO: 1257931 - RNA, 13 nt, Mycobacterium tuberculosis H37Rv
ucgcgcaggaagc

SEQ ID NO: 1257932 - RNA, 22 nt, Mycobacterium tuberculosis H37Rv
ucgcgcaggaagcccacgaucg

SEQ ID NO: 1257933 - RNA, 14 nt, Mycobacterium tuberculosis H37Rv
ucgcgcaucaacgg

SEQ ID NO: 1257934 - RNA, 19 nt, Mycobacterium tuberculosis H37Rv
ucgcgcaucgccuccucga

SEQ ID NO: 1257935 - RNA, 20 nt, Mycobacterium tuberculosis H37Rv
ucgcgaagaacgacgccacc

SEQ ID NO: 1257936 - RNA, 14 nt, Mycobacterium tuberculosis H37Rv
ucgcgcacgcccug

SEQ ID NO: 1257937 - RNA, 17 nt, Mycobacterium tuberculosis H37Rv
ucgcgcagcgcgaucgc

SEQ ID NO: 1257938 - RNA, 14 nt, Mycobacterium tuberculosis H37Rv
ucgcgaaaccgccg

SEQ ID NO: 1257939 - RNA, 16 nt, Mycobacterium tuberculosis H37Rv
ucgcgaacaucgccag

SEQ ID NO: 1257940 - RNA, 14 nt, Mycobacterium tuberculosis H37Rv
ucgcgaacaucgcc

SEQ ID NO: 1257941 - RNA, 22 nt, Mycobacterium tuberculosis H37Rv
ucgccuggaagaucacgcgucg

SEQ ID NO: 1257942 - RNA, 21 nt, Mycobacterium tuberculosis H37Rv
ucgccuggaagaucacgcguc

SEQ ID NO: 1257943 - RNA, 17 nt, Mycobacterium tuberculosis H37Rv
ucgccguuggagacguc

SEQ ID NO: 1257944 - RNA, 13 nt, Mycobacterium tuberculosis H37Rv
ucgccugcaagcu

SEQ ID NO: 1257945 - RNA, 18 nt, Mycobacterium tuberculosis H37Rv
ucgccugcaagcuaagcg

SEQ ID NO: 1257946 - RNA, 18 nt, Mycobacterium tuberculosis H37Rv
ucgccugcacccggcgau

SEQ ID NO: 1257947 - RNA, 17 nt, Mycobacterium tuberculosis H37Rv
ucgccucggcguaggcg

SEQ ID NO: 1257948 - RNA, 20 nt, Mycobacterium tuberculosis H37Rv
ucgccucggcguaggcgaug

SEQ ID NO: 1257949 - RNA, 13 nt, Mycobacterium tuberculosis H37Rv
ucgccguggugga

SEQ ID NO: 1257950 - RNA, 23 nt, Mycobacterium tuberculosis H37Rv
ucgccgugcgccgugcgaucguc

SEQ ID NO: 1257951 - RNA, 15 nt, Mycobacterium tuberculosis H37Rv
ucgccgugcgccgug

SEQ ID NO: 1257952 - RNA, 19 nt, Mycobacterium tuberculosis H37Rv
ucgccgugcgccgugcgau

SEQ ID NO: 1257953 - RNA, 14 nt, Mycobacterium tuberculosis H37Rv
ucgccgugaccagg

SEQ ID NO: 1257954 - RNA, 16 nt, Mycobacterium tuberculosis H37Rv
ucgccgucgugccacc

SEQ ID NO: 1257955 - RNA, 18 nt, Mycobacterium tuberculosis H37Rv
ucgccgucgucgaucgac

SEQ ID NO: 1257956 - RNA, 11 nt, Mycobacterium tuberculosis H37Rv
ucgccggugac

SEQ ID NO: 1257957 - RNA, 20 nt, Mycobacterium tuberculosis H37Rv
ucgccgucguacucgaccgc

SEQ ID NO: 1257958 - RNA, 13 nt, Mycobacterium tuberculosis H37Rv
ucgccgucggguc

SEQ ID NO: 1257959 - RNA, 16 nt, Mycobacterium tuberculosis H37Rv
ucgccggggacgccgc

SEQ ID NO: 1257960 - RNA, 19 nt, Mycobacterium tuberculosis H37Rv
ucgccgggcugcaaaucgu

SEQ ID NO: 1257961 - RNA, 13 nt, Mycobacterium tuberculosis H37Rv
ucgccggccguca

SEQ ID NO: 1257962 - RNA, 18 nt, Mycobacterium tuberculosis H37Rv
ucgccggcauacaccgug

SEQ ID NO: 1257963 - RNA, 14 nt, Mycobacterium tuberculosis H37Rv
ucgccggccacccg

SEQ ID NO: 1257964 - RNA, 17 nt, Mycobacterium tuberculosis H37Rv
ucgccggccaacugggc

SEQ ID NO: 1257965 - RNA, 15 nt, Mycobacterium tuberculosis H37Rv
ucgccggcacgguga

SEQ ID NO: 1257966 - RNA, 16 nt, Mycobacterium tuberculosis H37Rv
ucgccggcaccggaug

SEQ ID NO: 1257967 - RNA, 16 nt, Mycobacterium tuberculosis H37Rv
ucgcccagugcgcaac

SEQ ID NO: 1257968 - RNA, 17 nt, Mycobacterium tuberculosis H37Rv
ucgcccagugcgcaacc

SEQ ID NO: 1257969 - RNA, 16 nt, Mycobacterium tuberculosis H37Rv
ucgccccugcacagca

SEQ ID NO: 1257970 - RNA, 19 nt, Mycobacterium tuberculosis H37Rv
ucgccccguuucggucgac

SEQ ID NO: 1257971 - RNA, 18 nt, Mycobacterium tuberculosis H37Rv
ucgccccguucacgcucg

SEQ ID NO: 1257972 - RNA, 16 nt, Mycobacterium tuberculosis H37Rv
ucgccccgaugaccgc

SEQ ID NO: 1257973 - RNA, 18 nt, Mycobacterium tuberculosis H37Rv
ucgccccgaggaugccga

SEQ ID NO: 1257974 - RNA, 12 nt, Mycobacterium tuberculosis H37Rv
ucgccccacccg

SEQ ID NO: 1257975 - RNA, 14 nt, Mycobacterium tuberculosis H37Rv
ucgccccacccgag

SEQ ID NO: 1257976 - RNA, 21 nt, Mycobacterium tuberculosis H37Rv
ucgccagccggccgcgaccgc

SEQ ID NO: 1257977 - RNA, 18 nt, Mycobacterium tuberculosis H37Rv
ucgccagcaggaagccga

SEQ ID NO: 1257978 - RNA, 21 nt, Mycobacterium tuberculosis H37Rv
ucgccagccugugcugccaac

SEQ ID NO: 1257979 - RNA, 17 nt, Mycobacterium tuberculosis H37Rv
ucgccagggucgcgagc

SEQ ID NO: 1257980 - RNA, 19 nt, Mycobacterium tuberculosis H37Rv
ucgccagcggggcuagucg

SEQ ID NO: 1257981 - RNA, 17 nt, Mycobacterium tuberculosis H37Rv
ucgccgagaacgauguc

SEQ ID NO: 1257982 - RNA, 17 nt, Mycobacterium tuberculosis H37Rv
ucgccgacgucgacgcc

SEQ ID NO: 1257983 - RNA, 16 nt, Mycobacterium tuberculosis H37Rv
ucgcccggcugcgccg

SEQ ID NO: 1257984 - RNA, 20 nt, Mycobacterium tuberculosis H37Rv
ucgcccgguccgccgcagac

SEQ ID NO: 1257985 - RNA, 16 nt, Mycobacterium tuberculosis H37Rv
ucgcccggguggcguc

SEQ ID NO: 1257986 - RNA, 20 nt, Mycobacterium tuberculosis H37Rv
ucgccgaggccucggccagc

SEQ ID NO: 1257987 - RNA, 19 nt, Mycobacterium tuberculosis H37Rv
ucgccgaggcagcgucguc

SEQ ID NO: 1257988 - RNA, 18 nt, Mycobacterium tuberculosis H37Rv
ucgccgaguaccggccag

SEQ ID NO: 1257989 - RNA, 16 nt, Mycobacterium tuberculosis H37Rv
ucgccgcacgccggca

SEQ ID NO: 1257990 - RNA, 18 nt, Mycobacterium tuberculosis H37Rv
ucgccaccggcgccaccg

SEQ ID NO: 1257991 - RNA, 19 nt, Mycobacterium tuberculosis H37Rv
ucgccaccaucaccgccuu

SEQ ID NO: 1257992 - RNA, 12 nt, Mycobacterium tuberculosis H37Rv
ucgccaccggcg

SEQ ID NO: 1257993 - RNA, 16 nt, Mycobacterium tuberculosis H37Rv
ucgccacggucgccga

SEQ ID NO: 1257994 - RNA, 18 nt, Mycobacterium tuberculosis H37Rv
ucgccaacgccagcacca

SEQ ID NO: 1257995 - RNA, 19 nt, Mycobacterium tuberculosis H37Rv
ucgccaagcccaggcgauc

SEQ ID NO: 1257996 - RNA, 19 nt, Mycobacterium tuberculosis H37Rv
ucgccaagugcagggcugc

SEQ ID NO: 1257997 - RNA, 14 nt, Mycobacterium tuberculosis H37Rv
ucgccaaugcccag

SEQ ID NO: 1257998 - RNA, 21 nt, Mycobacterium tuberculosis H37Rv
ucgccacauuucaccaccgug

SEQ ID NO: 1257999 - RNA, 22 nt, Mycobacterium tuberculosis H37Rv
ucgccacauuucaccaccgugg

SEQ ID NO: 1258000 - RNA, 17 nt, Mycobacterium tuberculosis H37Rv
ucgccaccagagucaac

SEQ ID NO: 1258001 - RNA, 15 nt, Mycobacterium tuberculosis H37Rv
ucgcauggucgacga

SEQ ID NO: 1258002 - RNA, 21 nt, Mycobacterium tuberculosis H37Rv
ucgcaucaggucgguggucuc

SEQ ID NO: 1258003 - RNA, 20 nt, Mycobacterium tuberculosis H37Rv
ucgcaguggcguuacgcucg

SEQ ID NO: 1258004 - RNA, 19 nt, Mycobacterium tuberculosis H37Rv
ucgcagugacguuccgcuc

SEQ ID NO: 1258005 - RNA, 18 nt, Mycobacterium tuberculosis H37Rv
ucgcaguccgguuacgcu

SEQ ID NO: 1258006 - RNA, 21 nt, Mycobacterium tuberculosis H37Rv
ucgcaguccgguuacgcucgc

SEQ ID NO: 1258007 - RNA, 20 nt, Mycobacterium tuberculosis H37Rv
ucgcaguccgguuacgcucg

SEQ ID NO: 1258008 - RNA, 19 nt, Mycobacterium tuberculosis H37Rv
ucgcagcgguggucggcgc

SEQ ID NO: 1258009 - RNA, 21 nt, Mycobacterium tuberculosis H37Rv
ucgcagcgcacacuaccgccg

SEQ ID NO: 1258010 - RNA, 12 nt, Mycobacterium tuberculosis H37Rv
ucgcagcgcaca

SEQ ID NO: 1258011 - RNA, 13 nt, Mycobacterium tuberculosis H37Rv
ucgcagcgacacg

SEQ ID NO: 1258012 - RNA, 19 nt, Mycobacterium tuberculosis H37Rv
ucgcacucauagaacucgc

SEQ ID NO: 1258013 - RNA, 22 nt, Mycobacterium tuberculosis H37Rv
ucgcagacggcugccacgcguc

SEQ ID NO: 1258014 - RNA, 15 nt, Mycobacterium tuberculosis H37Rv
ucgcagccgcaccgg

SEQ ID NO: 1258015 - RNA, 17 nt, Mycobacterium tuberculosis H37Rv
ucgagcuucaucccgga

SEQ ID NO: 1258016 - RNA, 14 nt, Mycobacterium tuberculosis H37Rv
ucgaggaacucgga

SEQ ID NO: 1258017 - RNA, 20 nt, Mycobacterium tuberculosis H37Rv
ucgagcgcuucgucgccgaa

SEQ ID NO: 1258018 - RNA, 21 nt, Mycobacterium tuberculosis H37Rv
ucgagcgcgccuucacgcugg

SEQ ID NO: 1258019 - RNA, 15 nt, Mycobacterium tuberculosis H37Rv
ucgagcgguggcguc

SEQ ID NO: 1258020 - RNA, 19 nt, Mycobacterium tuberculosis H37Rv
ucgagcgucugcgaucccg

SEQ ID NO: 1258021 - RNA, 15 nt, Mycobacterium tuberculosis H37Rv
ucgagcugcuggcgc

SEQ ID NO: 1258022 - RNA, 18 nt, Mycobacterium tuberculosis H37Rv
ucgagcucgaagcccgga

SEQ ID NO: 1258023 - RNA, 18 nt, Mycobacterium tuberculosis H37Rv
ucgagguacaacgggcac

SEQ ID NO: 1258024 - RNA, 17 nt, Mycobacterium tuberculosis H37Rv
ucgagguggcgggcgau

SEQ ID NO: 1258025 - RNA, 23 nt, Mycobacterium tuberculosis H37Rv
ucgagguucucccgcgcuuggcu

SEQ ID NO: 1258026 - RNA, 15 nt, Mycobacterium tuberculosis H37Rv
ucgaguagguaacgc

SEQ ID NO: 1258027 - RNA, 18 nt, Mycobacterium tuberculosis H37Rv
ucgaggucagugggcggu

SEQ ID NO: 1258028 - RNA, 19 nt, Mycobacterium tuberculosis H37Rv
ucgagguccucgucgucga

SEQ ID NO: 1258029 - RNA, 19 nt, Mycobacterium tuberculosis H37Rv
ucgagguggcgcacaucgc

SEQ ID NO: 1258030 - RNA, 22 nt, Mycobacterium tuberculosis H37Rv
ucgagcagugccucggcgaugg

SEQ ID NO: 1258031 - RNA, 13 nt, Mycobacterium tuberculosis H37Rv
ucgagcaggcugg

SEQ ID NO: 1258032 - RNA, 20 nt, Mycobacterium tuberculosis H37Rv
ucgagcacgccaacguugcg

SEQ ID NO: 1258033 - RNA, 19 nt, Mycobacterium tuberculosis H37Rv
ucgagcacgaugucgaugc

SEQ ID NO: 1258034 - RNA, 17 nt, Mycobacterium tuberculosis H37Rv
ucgagcaccucggccuc

SEQ ID NO: 1258035 - RNA, 14 nt, Mycobacterium tuberculosis H37Rv
ucgagcaccucggc

SEQ ID NO: 1258036 - RNA, 16 nt, Mycobacterium tuberculosis H37Rv
ucgagcaccgacaccg

SEQ ID NO: 1258037 - RNA, 17 nt, Mycobacterium tuberculosis H37Rv
ucgagcgcgaucgggcc

SEQ ID NO: 1258038 - RNA, 17 nt, Mycobacterium tuberculosis H37Rv
ucgagccgugccucgag

SEQ ID NO: 1258039 - RNA, 18 nt, Mycobacterium tuberculosis H37Rv
ucgagcccggacgagugc

SEQ ID NO: 1258040 - RNA, 19 nt, Mycobacterium tuberculosis H37Rv
ucgagcaguuccagcucgc

SEQ ID NO: 1258041 - RNA, 18 nt, Mycobacterium tuberculosis H37Rv
ucgacggugccgucugcg

SEQ ID NO: 1258042 - RNA, 17 nt, Mycobacterium tuberculosis H37Rv
ucgacgggcacgcggcg

SEQ ID NO: 1258043 - RNA, 17 nt, Mycobacterium tuberculosis H37Rv
ucgacgggagcgacguc

SEQ ID NO: 1258044 - RNA, 18 nt, Mycobacterium tuberculosis H37Rv
ucgacguaggacugccag

SEQ ID NO: 1258045 - RNA, 20 nt, Mycobacterium tuberculosis H37Rv
ucgacgcuguggcucgacga

SEQ ID NO: 1258046 - RNA, 19 nt, Mycobacterium tuberculosis H37Rv
ucgacggcaagcgcaucgc

SEQ ID NO: 1258047 - RNA, 17 nt, Mycobacterium tuberculosis H37Rv
ucgacggccucgucgau

SEQ ID NO: 1258048 - RNA, 21 nt, Mycobacterium tuberculosis H37Rv
ucgacggccucgucgauguuc

SEQ ID NO: 1258049 - RNA, 18 nt, Mycobacterium tuberculosis H37Rv
uccgggcucggcgucgcc

SEQ ID NO: 1258050 - RNA, 22 nt, Mycobacterium tuberculosis H37Rv
uccgggccgcggccacaucgcc

SEQ ID NO: 1258051 - RNA, 17 nt, Mycobacterium tuberculosis H37Rv
uccggcucaccgauccc

SEQ ID NO: 1258052 - RNA, 17 nt, Mycobacterium tuberculosis H37Rv
ucgacgcggcgaccguc

SEQ ID NO: 1258053 - RNA, 17 nt, Mycobacterium tuberculosis H37Rv
ucgacgcgggagucauc

SEQ ID NO: 1258054 - RNA, 23 nt, Mycobacterium tuberculosis H37Rv
ucgacgcggccaacgaacgugcc

SEQ ID NO: 1258055 - RNA, 16 nt, Mycobacterium tuberculosis H37Rv
uccgggugcagaucgc

SEQ ID NO: 1258056 - RNA, 17 nt, Mycobacterium tuberculosis H37Rv
ucgacguucgguggcga

SEQ ID NO: 1258057 - RNA, 20 nt, Mycobacterium tuberculosis H37Rv
ucgacugaucgccacccggu

SEQ ID NO: 1258058 - RNA, 16 nt, Mycobacterium tuberculosis H37Rv
ucgacugaucgccacc

SEQ ID NO: 1258059 - RNA, 12 nt, Mycobacterium tuberculosis H37Rv
ucgacugaucga

SEQ ID NO: 1258060 - RNA, 20 nt, Mycobacterium tuberculosis H37Rv
ucgacgucgguaagcgccaa

SEQ ID NO: 1258061 - RNA, 21 nt, Mycobacterium tuberculosis H37Rv
ucgacgucgauuucggcgacc

SEQ ID NO: 1258062 - RNA, 16 nt, Mycobacterium tuberculosis H37Rv
ucgacgucggcgagca

SEQ ID NO: 1258063 - RNA, 14 nt, Mycobacterium tuberculosis H37Rv
ucgacgugcacggu

SEQ ID NO: 1258064 - RNA, 16 nt, Mycobacterium tuberculosis H37Rv
ucgacgugaucgcggu

SEQ ID NO: 1258065 - RNA, 19 nt, Mycobacterium tuberculosis H37Rv
ucgagaccccgacgaugcg

SEQ ID NO: 1258066 - RNA, 19 nt, Mycobacterium tuberculosis H37Rv
ucgagcaacugcucgacga

SEQ ID NO: 1258067 - RNA, 14 nt, Mycobacterium tuberculosis H37Rv
ucgagcacaccgag

SEQ ID NO: 1258068 - RNA, 22 nt, Mycobacterium tuberculosis H37Rv
ucgagagccccgaccagcagac

SEQ ID NO: 1258069 - RNA, 22 nt, Mycobacterium tuberculosis H37Rv
ucgagagcgaucaacggaucga

SEQ ID NO: 1258070 - RNA, 18 nt, Mycobacterium tuberculosis H37Rv
ucgauggaaaacgccaug

SEQ ID NO: 1258071 - RNA, 15 nt, Mycobacterium tuberculosis H37Rv
ucgauggaccgccag

SEQ ID NO: 1258072 - RNA, 17 nt, Mycobacterium tuberculosis H37Rv
ucgaugccggcuggcgg

SEQ ID NO: 1258073 - RNA, 16 nt, Mycobacterium tuberculosis H37Rv
ucgaugccggcuggcg

SEQ ID NO: 1258074 - RNA, 22 nt, Mycobacterium tuberculosis H37Rv
ucgaugccacaucccacggugg

SEQ ID NO: 1258075 - RNA, 18 nt, Mycobacterium tuberculosis H37Rv
ucgauguggcgcuccggc

SEQ ID NO: 1258076 - RNA, 17 nt, Mycobacterium tuberculosis H37Rv
ucgauguccacgccgug

SEQ ID NO: 1258077 - RNA, 21 nt, Mycobacterium tuberculosis H37Rv
ucgauguccaaugcaccguug

SEQ ID NO: 1258078 - RNA, 18 nt, Mycobacterium tuberculosis H37Rv
ucgaugggugcaccgaag

SEQ ID NO: 1258079 - RNA, 20 nt, Mycobacterium tuberculosis H37Rv
ucgcacgacgcgacacgccg

SEQ ID NO: 1258080 - RNA, 17 nt, Mycobacterium tuberculosis H37Rv
ucgcacgacgcgacacg

SEQ ID NO: 1258081 - RNA, 16 nt, Mycobacterium tuberculosis H37Rv
ucgcaccggagucggc

SEQ ID NO: 1258082 - RNA, 19 nt, Mycobacterium tuberculosis H37Rv
ucgcaccggagucggcguc

SEQ ID NO: 1258083 - RNA, 16 nt, Mycobacterium tuberculosis H37Rv
ucgcacccgcucggcg

SEQ ID NO: 1258084 - RNA, 16 nt, Mycobacterium tuberculosis H37Rv
ucgcacaccaacaccg

SEQ ID NO: 1258085 - RNA, 15 nt, Mycobacterium tuberculosis H37Rv
ucgauugccaccgag

SEQ ID NO: 1258086 - RNA, 16 nt, Mycobacterium tuberculosis H37Rv
ucgcaauaugccacag

SEQ ID NO: 1258087 - RNA, 17 nt, Mycobacterium tuberculosis H37Rv
ucgcaagucuccucgaa

SEQ ID NO: 1258088 - RNA, 16 nt, Mycobacterium tuberculosis H37Rv
ucgcaauauccggccg

SEQ ID NO: 1258089 - RNA, 17 nt, Mycobacterium tuberculosis H37Rv
ucgcaaugggcucacac

SEQ ID NO: 1258090 - RNA, 12 nt, Mycobacterium tuberculosis H37Rv
ucgcaaccggcg

SEQ ID NO: 1258091 - RNA, 23 nt, Mycobacterium tuberculosis H37Rv
ucgcaagcgcggcgaagccgggu

SEQ ID NO: 1258092 - RNA, 14 nt, Mycobacterium tuberculosis H37Rv
ucgcaacgcaucga

SEQ ID NO: 1258093 - RNA, 22 nt, Mycobacterium tuberculosis H37Rv
ucgcaacgcaucgaugcgugcc

SEQ ID NO: 1258094 - RNA, 14 nt, Mycobacterium tuberculosis H37Rv
ucgaucgucgacgc

SEQ ID NO: 1258095 - RNA, 15 nt, Mycobacterium tuberculosis H37Rv
ucgauccacugccgc

SEQ ID NO: 1258096 - RNA, 12 nt, Mycobacterium tuberculosis H37Rv
ucgauccggcuc

SEQ ID NO: 1258097 - RNA, 14 nt, Mycobacterium tuberculosis H37Rv
ucgaugaucugcuu

SEQ ID NO: 1258098 - RNA, 21 nt, Mycobacterium tuberculosis H37Rv
ucgaugacccauacgaacuca

SEQ ID NO: 1258099 - RNA, 15 nt, Mycobacterium tuberculosis H37Rv
ucgaucuucuccucg

SEQ ID NO: 1258100 - RNA, 16 nt, Mycobacterium tuberculosis H37Rv
ucgauaaccuggcggu

SEQ ID NO: 1258101 - RNA, 17 nt, Mycobacterium tuberculosis H37Rv
ucgaguuucucggcgug

SEQ ID NO: 1258102 - RNA, 16 nt, Mycobacterium tuberculosis H37Rv
ucgaguuccgcaucgg

SEQ ID NO: 1258103 - RNA, 15 nt, Mycobacterium tuberculosis H37Rv
ucgaguuccgcaucg

SEQ ID NO: 1258104 - RNA, 17 nt, Mycobacterium tuberculosis H37Rv
ucgagugccgccaccgc

SEQ ID NO: 1258105 - RNA, 20 nt, Mycobacterium tuberculosis H37Rv
ucgaguagugcaggugcccg

SEQ ID NO: 1258106 - RNA, 19 nt, Mycobacterium tuberculosis H37Rv
ucgaguaucucggcuccac

SEQ ID NO: 1258107 - RNA, 23 nt, Mycobacterium tuberculosis H37Rv
ucgaucacuguuccgggugccgc

SEQ ID NO: 1258108 - RNA, 15 nt, Mycobacterium tuberculosis H37Rv
ugcccgacgagucgc

SEQ ID NO: 1258109 - RNA, 16 nt, Mycobacterium tuberculosis H37Rv
ugcccggcaaccugga

SEQ ID NO: 1258110 - RNA, 17 nt, Mycobacterium tuberculosis H37Rv
ugcccggcaaccuggac

SEQ ID NO: 1258111 - RNA, 13 nt, Mycobacterium tuberculosis H37Rv
ugccgaccguggu

SEQ ID NO: 1258112 - RNA, 21 nt, Mycobacterium tuberculosis H37Rv
ugcccggcucucagcgacagc

SEQ ID NO: 1258113 - RNA, 19 nt, Mycobacterium tuberculosis H37Rv
ugcccgggcccgucgucgu

SEQ ID NO: 1258114 - RNA, 22 nt, Mycobacterium tuberculosis H37Rv
ugcccgggcccgucgucgucga

SEQ ID NO: 1258115 - RNA, 14 nt, Mycobacterium tuberculosis H37Rv
ugccgacucaucgg

SEQ ID NO: 1258116 - RNA, 16 nt, Mycobacterium tuberculosis H37Rv
ugccgacucaucggcc

SEQ ID NO: 1258117 - RNA, 19 nt, Mycobacterium tuberculosis H37Rv
ugccgagaagugggcggua

SEQ ID NO: 1258118 - RNA, 14 nt, Mycobacterium tuberculosis H37Rv
ugccgacucagguc

SEQ ID NO: 1258119 - RNA, 17 nt, Mycobacterium tuberculosis H37Rv
ugccgacggcaucaacg

SEQ ID NO: 1258120 - RNA, 19 nt, Mycobacterium tuberculosis H37Rv
ugccgacgcucacgcugcu

SEQ ID NO: 1258121 - RNA, 23 nt, Mycobacterium tuberculosis H37Rv
ugccgacgccccgaucggccacc

SEQ ID NO: 1258122 - RNA, 14 nt, Mycobacterium tuberculosis H37Rv
ugccgagcccaggu

SEQ ID NO: 1258123 - RNA, 20 nt, Mycobacterium tuberculosis H37Rv
ugccgagcacucggccacga

SEQ ID NO: 1258124 - RNA, 18 nt, Mycobacterium tuberculosis H37Rv
ugccgagagccucguuca

SEQ ID NO: 1258125 - RNA, 18 nt, Mycobacterium tuberculosis H37Rv
ugccgaggcggaugcggu

SEQ ID NO: 1258126 - RNA, 17 nt, Mycobacterium tuberculosis H37Rv
ugccgagguugcggacg

SEQ ID NO: 1258127 - RNA, 16 nt, Mycobacterium tuberculosis H37Rv
ugccgaucagcccggc

SEQ ID NO: 1258128 - RNA, 20 nt, Mycobacterium tuberculosis H37Rv
ugccgauuacggugaucgcc

SEQ ID NO: 1258129 - RNA, 17 nt, Mycobacterium tuberculosis H37Rv
ugccgcagcauccccgc

SEQ ID NO: 1258130 - RNA, 15 nt, Mycobacterium tuberculosis H37Rv
ugccgcaaccggcga

SEQ ID NO: 1258131 - RNA, 21 nt, Mycobacterium tuberculosis H37Rv
ugccgcaccagucgcgcagcg

SEQ ID NO: 1258132 - RNA, 14 nt, Mycobacterium tuberculosis H37Rv
ugccgcaagccucg

SEQ ID NO: 1258133 - RNA, 18 nt, Mycobacterium tuberculosis H37Rv
ugccgccggcgccacccg

SEQ ID NO: 1258134 - RNA, 21 nt, Mycobacterium tuberculosis H37Rv
ugccgcccuugauguccgcga

SEQ ID NO: 1258135 - RNA, 16 nt, Mycobacterium tuberculosis H37Rv
ugccgcccgagccggu

SEQ ID NO: 1258136 - RNA, 23 nt, Mycobacterium tuberculosis H37Rv
ugccgcccgcuccugcucgucga

SEQ ID NO: 1258137 - RNA, 14 nt, Mycobacterium tuberculosis H37Rv
ugccgcccgccucu

SEQ ID NO: 1258138 - RNA, 15 nt, Mycobacterium tuberculosis H37Rv
ugccgcccucaccgc

SEQ ID NO: 1258139 - RNA, 20 nt, Mycobacterium tuberculosis H37Rv
ugccgcccccauaacugcgg

SEQ ID NO: 1258140 - RNA, 19 nt, Mycobacterium tuberculosis H37Rv
ugccgccccgcagcugcgu

SEQ ID NO: 1258141 - RNA, 22 nt, Mycobacterium tuberculosis H37Rv
ugccgcagcggcggcaacccug

SEQ ID NO: 1258142 - RNA, 18 nt, Mycobacterium tuberculosis H37Rv
ugccgcccacgcugccca

SEQ ID NO: 1258143 - RNA, 18 nt, Mycobacterium tuberculosis H37Rv
ugccggaguugucgacgg

SEQ ID NO: 1258144 - RNA, 13 nt, Mycobacterium tuberculosis H37Rv
ugccggcagcggu

SEQ ID NO: 1258145 - RNA, 17 nt, Mycobacterium tuberculosis H37Rv
ugccggcaacagcucgc

SEQ ID NO: 1258146 - RNA, 22 nt, Mycobacterium tuberculosis H37Rv
ugccggccgcguaaaccggcug

SEQ ID NO: 1258147 - RNA, 22 nt, Mycobacterium tuberculosis H37Rv
ugccggcgacgcuaccgccgga

SEQ ID NO: 1258148 - RNA, 14 nt, Mycobacterium tuberculosis H37Rv
ugccggcgacgaua

SEQ ID NO: 1258149 - RNA, 11 nt, Mycobacterium tuberculosis H37Rv
ugccggcgacc

SEQ ID NO: 1258150 - RNA, 16 nt, Mycobacterium tuberculosis H37Rv
ugccggcccaccgccg

SEQ ID NO: 1258151 - RNA, 19 nt, Mycobacterium tuberculosis H37Rv
ugccggcggaucugaucgg

SEQ ID NO: 1258152 - RNA, 21 nt, Mycobacterium tuberculosis H37Rv
ugccggcgccuuggucgccgc

SEQ ID NO: 1258153 - RNA, 13 nt, Mycobacterium tuberculosis H37Rv
ugccggagacguc

SEQ ID NO: 1258154 - RNA, 18 nt, Mycobacterium tuberculosis H37Rv
ugccggacgccaugcccg

SEQ ID NO: 1258155 - RNA, 19 nt, Mycobacterium tuberculosis H37Rv
ugccgcucggcaaccugcg

SEQ ID NO: 1258156 - RNA, 23 nt, Mycobacterium tuberculosis H37Rv
ugccgcugaagccaaaugcgcug

SEQ ID NO: 1258157 - RNA, 20 nt, Mycobacterium tuberculosis H37Rv
ugccgccgucgccgccguug

SEQ ID NO: 1258158 - RNA, 20 nt, Mycobacterium tuberculosis H37Rv
ugccgccguugccgccguug

SEQ ID NO: 1258159 - RNA, 14 nt, Mycobacterium tuberculosis H37Rv
ugccgccggugccg

SEQ ID NO: 1258160 - RNA, 20 nt, Mycobacterium tuberculosis H37Rv
ugccgccgucaccgccguug

SEQ ID NO: 1258161 - RNA, 20 nt, Mycobacterium tuberculosis H37Rv
ugccgccguccccaccgacg

SEQ ID NO: 1258162 - RNA, 16 nt, Mycobacterium tuberculosis H37Rv
ugccgccggugccacc

SEQ ID NO: 1258163 - RNA, 20 nt, Mycobacterium tuberculosis H37Rv
ugcccacgcacagcaacgcc

SEQ ID NO: 1258164 - RNA, 21 nt, Mycobacterium tuberculosis H37Rv
ugcccacgcacagcaacgccc

SEQ ID NO: 1258165 - RNA, 12 nt, Mycobacterium tuberculosis H37Rv
ugcccagcaccc

SEQ ID NO: 1258166 - RNA, 21 nt, Mycobacterium tuberculosis H37Rv
ugcccaccaccgacagcaccc

SEQ ID NO: 1258167 - RNA, 15 nt, Mycobacterium tuberculosis H37Rv
ugcccacgcgcagaa

SEQ ID NO: 1258168 - RNA, 18 nt, Mycobacterium tuberculosis H37Rv
ugccacgcucggugcugc

SEQ ID NO: 1258169 - RNA, 23 nt, Mycobacterium tuberculosis H37Rv
ugccacgaacugauuuucgugua

SEQ ID NO: 1258170 - RNA, 19 nt, Mycobacterium tuberculosis H37Rv
ugccagaucagcaccgaca

SEQ ID NO: 1258171 - RNA, 17 nt, Mycobacterium tuberculosis H37Rv
ugccagcaggccgaaga

SEQ ID NO: 1258172 - RNA, 19 nt, Mycobacterium tuberculosis H37Rv
ugccagcaccacgucgacg

SEQ ID NO: 1258173 - RNA, 12 nt, Mycobacterium tuberculosis H37Rv
ugccagccgguc

SEQ ID NO: 1258174 - RNA, 23 nt, Mycobacterium tuberculosis H37Rv
ugccagcggcacacccaucaccg

SEQ ID NO: 1258175 - RNA, 18 nt, Mycobacterium tuberculosis H37Rv
ugcccaggcucgcaccgu

SEQ ID NO: 1258176 - RNA, 12 nt, Mycobacterium tuberculosis H37Rv
ugcccagcgugg

SEQ ID NO: 1258177 - RNA, 22 nt, Mycobacterium tuberculosis H37Rv
ugcccaggaaggcgacgccgaa

SEQ ID NO: 1258178 - RNA, 21 nt, Mycobacterium tuberculosis H37Rv
ugcccaggaaggcgacgccga

SEQ ID NO: 1258179 - RNA, 20 nt, Mycobacterium tuberculosis H37Rv
ugcccccguugccgcccguc

SEQ ID NO: 1258180 - RNA, 21 nt, Mycobacterium tuberculosis H37Rv
ugcccgaaccaccaccggcaa

SEQ ID NO: 1258181 - RNA, 20 nt, Mycobacterium tuberculosis H37Rv
ugcccgacccgccgacgccg

SEQ ID NO: 1258182 - RNA, 17 nt, Mycobacterium tuberculosis H37Rv
ugccccgggcccagguu

SEQ ID NO: 1258183 - RNA, 19 nt, Mycobacterium tuberculosis H37Rv
ugcacgacgacaucgagcc

SEQ ID NO: 1258184 - RNA, 14 nt, Mycobacterium tuberculosis H37Rv
ugcacgaucgcggu

SEQ ID NO: 1258185 - RNA, 20 nt, Mycobacterium tuberculosis H37Rv
ugcacgcaccacaauccacg

SEQ ID NO: 1258186 - RNA, 17 nt, Mycobacterium tuberculosis H37Rv
ugcacgauacucaccga

SEQ ID NO: 1258187 - RNA, 18 nt, Mycobacterium tuberculosis H37Rv
ugcaggucauugcacgcc

SEQ ID NO: 1258188 - RNA, 17 nt, Mycobacterium tuberculosis H37Rv
ugcagguggccgucgcc

SEQ ID NO: 1258189 - RNA, 12 nt, Mycobacterium tuberculosis H37Rv
ugcaggugcugg

SEQ ID NO: 1258190 - RNA, 19 nt, Mycobacterium tuberculosis H37Rv
ugcaguaacuucaccggcu

SEQ ID NO: 1258191 - RNA, 19 nt, Mycobacterium tuberculosis H37Rv
ugcagguugcccucaccga

SEQ ID NO: 1258192 - RNA, 17 nt, Mycobacterium tuberculosis H37Rv
ugcauccuccucgucga

SEQ ID NO: 1258193 - RNA, 14 nt, Mycobacterium tuberculosis H37Rv
ugcauaggcgcggu

SEQ ID NO: 1258194 - RNA, 16 nt, Mycobacterium tuberculosis H37Rv
ugcauccagcugcugc

SEQ ID NO: 1258195 - RNA, 15 nt, Mycobacterium tuberculosis H37Rv
ugcaugaacugcucg

SEQ ID NO: 1258196 - RNA, 14 nt, Mycobacterium tuberculosis H37Rv
ugccaccacgcucc

SEQ ID NO: 1258197 - RNA, 23 nt, Mycobacterium tuberculosis H37Rv
ugccaccagacaacgccgucgau

SEQ ID NO: 1258198 - RNA, 23 nt, Mycobacterium tuberculosis H37Rv
ugccaccgcggccgcggucgaug

SEQ ID NO: 1258199 - RNA, 21 nt, Mycobacterium tuberculosis H37Rv
ugccacgcguuccuccagcag

SEQ ID NO: 1258200 - RNA, 12 nt, Mycobacterium tuberculosis H37Rv
ugccaccggcug

SEQ ID NO: 1258201 - RNA, 18 nt, Mycobacterium tuberculosis H37Rv
ugccaccggugccggcga

SEQ ID NO: 1258202 - RNA, 20 nt, Mycobacterium tuberculosis H37Rv
ugccaccggugccggcgacg

SEQ ID NO: 1258203 - RNA, 19 nt, Mycobacterium tuberculosis H37Rv
ugccaccucgacgcaccua

SEQ ID NO: 1258204 - RNA, 15 nt, Mycobacterium tuberculosis H37Rv
ugcggcaggugcggu

SEQ ID NO: 1258205 - RNA, 20 nt, Mycobacterium tuberculosis H37Rv
ugcggcgucgaacugccgga

SEQ ID NO: 1258206 - RNA, 19 nt, Mycobacterium tuberculosis H37Rv
ugcggcgucaaauccagcg

SEQ ID NO: 1258207 - RNA, 22 nt, Mycobacterium tuberculosis H37Rv
ugcggcgucguugaggaagccc

SEQ ID NO: 1258208 - RNA, 16 nt, Mycobacterium tuberculosis H37Rv
ugcggcggcugccggu

SEQ ID NO: 1258209 - RNA, 23 nt, Mycobacterium tuberculosis H37Rv
ugcggcggcgcucgucgaucucc

SEQ ID NO: 1258210 - RNA, 14 nt, Mycobacterium tuberculosis H37Rv
ugcggccccgagga

SEQ ID NO: 1258211 - RNA, 20 nt, Mycobacterium tuberculosis H37Rv
ugcggcccaugaucucggcg

SEQ ID NO: 1258212 - RNA, 18 nt, Mycobacterium tuberculosis H37Rv
ugcggaggcgggugcggc

SEQ ID NO: 1258213 - RNA, 21 nt, Mycobacterium tuberculosis H37Rv
ugcgcucguugguucagcucg

SEQ ID NO: 1258214 - RNA, 14 nt, Mycobacterium tuberculosis H37Rv
ugcggacugacguc

SEQ ID NO: 1258215 - RNA, 20 nt, Mycobacterium tuberculosis H37Rv
ugcgcucguugguucagcuc

SEQ ID NO: 1258216 - RNA, 16 nt, Mycobacterium tuberculosis H37Rv
ugcgcguuggucauca

SEQ ID NO: 1258217 - RNA, 13 nt, Mycobacterium tuberculosis H37Rv
ugcgcguugaccg

SEQ ID NO: 1258218 - RNA, 23 nt, Mycobacterium tuberculosis H37Rv
ugcggauuucgugucgcugcggc

SEQ ID NO: 1258219 - RNA, 19 nt, Mycobacterium tuberculosis H37Rv
ugcggauguccuugcgguc

SEQ ID NO: 1258220 - RNA, 22 nt, Mycobacterium tuberculosis H37Rv
ugcggauacuguucugcuggcu

SEQ ID NO: 1258221 - RNA, 20 nt, Mycobacterium tuberculosis H37Rv
ugcgcgguugugacggugaa

SEQ ID NO: 1258222 - RNA, 12 nt, Mycobacterium tuberculosis H37Rv
ugcgcggugcgc

SEQ ID NO: 1258223 - RNA, 20 nt, Mycobacterium tuberculosis H37Rv
ugcgcgggugguucaccucg

SEQ ID NO: 1258224 - RNA, 17 nt, Mycobacterium tuberculosis H37Rv
ugcgcgguagcucgucg

SEQ ID NO: 1258225 - RNA, 19 nt, Mycobacterium tuberculosis H37Rv
ugcgcggugaugguuaccg

SEQ ID NO: 1258226 - RNA, 18 nt, Mycobacterium tuberculosis H37Rv
ugcgcggucugaccgcgu

SEQ ID NO: 1258227 - RNA, 14 nt, Mycobacterium tuberculosis H37Rv
ugcgcgcgcagauc

SEQ ID NO: 1258228 - RNA, 13 nt, Mycobacterium tuberculosis H37Rv
ugcgccuuggucg

SEQ ID NO: 1258229 - RNA, 16 nt, Mycobacterium tuberculosis H37Rv
ugcgccuuggucgccg

SEQ ID NO: 1258230 - RNA, 15 nt, Mycobacterium tuberculosis H37Rv
ugcgccuucgccagc

SEQ ID NO: 1258231 - RNA, 15 nt, Mycobacterium tuberculosis H37Rv
ugcgccgcacgccga

SEQ ID NO: 1258232 - RNA, 17 nt, Mycobacterium tuberculosis H37Rv
ugcgccgcacggcgacg

SEQ ID NO: 1258233 - RNA, 21 nt, Mycobacterium tuberculosis H37Rv
ugcgccagcgguggaccaccg

SEQ ID NO: 1258234 - RNA, 21 nt, Mycobacterium tuberculosis H37Rv
ugcgccgggugaggcggugac

SEQ ID NO: 1258235 - RNA, 14 nt, Mycobacterium tuberculosis H37Rv
ugcgccgucgcagc

SEQ ID NO: 1258236 - RNA, 18 nt, Mycobacterium tuberculosis H37Rv
ugcgccgccggcggcggu

SEQ ID NO: 1258237 - RNA, 20 nt, Mycobacterium tuberculosis H37Rv
ugcgacaggacgucggcgaa

SEQ ID NO: 1258238 - RNA, 19 nt, Mycobacterium tuberculosis H37Rv
ugcgaauggugcaacgcgc

SEQ ID NO: 1258239 - RNA, 22 nt, Mycobacterium tuberculosis H37Rv
ugcgaaucggcccgugccacag

SEQ ID NO: 1258240 - RNA, 19 nt, Mycobacterium tuberculosis H37Rv
ugccuggaaucgcggagcc

SEQ ID NO: 1258241 - RNA, 17 nt, Mycobacterium tuberculosis H37Rv
ugcgaccggcuccggac

SEQ ID NO: 1258242 - RNA, 14 nt, Mycobacterium tuberculosis H37Rv
ugcgaccccggcug

SEQ ID NO: 1258243 - RNA, 18 nt, Mycobacterium tuberculosis H37Rv
ugcgacucugcgucugcu

SEQ ID NO: 1258244 - RNA, 20 nt, Mycobacterium tuberculosis H37Rv
ugcgacucugcgucugcuca

SEQ ID NO: 1258245 - RNA, 20 nt, Mycobacterium tuberculosis H37Rv
ugcgacguugguugcguccg

SEQ ID NO: 1258246 - RNA, 22 nt, Mycobacterium tuberculosis H37Rv
ugcgacuaagggcacuccaccg

SEQ ID NO: 1258247 - RNA, 18 nt, Mycobacterium tuberculosis H37Rv
ugcgagaucgcggcgacc

SEQ ID NO: 1258248 - RNA, 20 nt, Mycobacterium tuberculosis H37Rv
ugcgauucugugucugcucg

SEQ ID NO: 1258249 - RNA, 19 nt, Mycobacterium tuberculosis H37Rv
ugcgauucugugucugcuc

SEQ ID NO: 1258250 - RNA, 20 nt, Mycobacterium tuberculosis H37Rv
ugcgauucugcgucugcucg

SEQ ID NO: 1258251 - RNA, 19 nt, Mycobacterium tuberculosis H37Rv
ugcgauucugcgucugcuu

SEQ ID NO: 1258252 - RNA, 20 nt, Mycobacterium tuberculosis H37Rv
ugcgauucugcgucugcuug

SEQ ID NO: 1258253 - RNA, 15 nt, Mycobacterium tuberculosis H37Rv
ugcgauggccgacgc

SEQ ID NO: 1258254 - RNA, 20 nt, Mycobacterium tuberculosis H37Rv
ugcgauuccgcgucugcucg

SEQ ID NO: 1258255 - RNA, 19 nt, Mycobacterium tuberculosis H37Rv
ugcgauuccgcgucugcuc

SEQ ID NO: 1258256 - RNA, 12 nt, Mycobacterium tuberculosis H37Rv
ugcgaucggcac

SEQ ID NO: 1258257 - RNA, 13 nt, Mycobacterium tuberculosis H37Rv
ugcgcaucgucga

SEQ ID NO: 1258258 - RNA, 13 nt, Mycobacterium tuberculosis H37Rv
ugcgcaucgccga

SEQ ID NO: 1258259 - RNA, 21 nt, Mycobacterium tuberculosis H37Rv
ugcgcauggacaacagcuugg

SEQ ID NO: 1258260 - RNA, 23 nt, Mycobacterium tuberculosis H37Rv
ugcgccagcgggcuguaggcgau

SEQ ID NO: 1258261 - RNA, 18 nt, Mycobacterium tuberculosis H37Rv
ugccggugcaggucgucc

SEQ ID NO: 1258262 - RNA, 21 nt, Mycobacterium tuberculosis H37Rv
ugccggucgcauggucgacga

SEQ ID NO: 1258263 - RNA, 13 nt, Mycobacterium tuberculosis H37Rv
ugccggugcgcua

SEQ ID NO: 1258264 - RNA, 17 nt, Mycobacterium tuberculosis H37Rv
ugccgguaacgaacagc

SEQ ID NO: 1258265 - RNA, 20 nt, Mycobacterium tuberculosis H37Rv
ugccggucacgucgaucucc

SEQ ID NO: 1258266 - RNA, 18 nt, Mycobacterium tuberculosis H37Rv
ugccggggccccaugccg

SEQ ID NO: 1258267 - RNA, 14 nt, Mycobacterium tuberculosis H37Rv
ugccgggccgccga

SEQ ID NO: 1258268 - RNA, 21 nt, Mycobacterium tuberculosis H37Rv
ugccgggcgcacgcccgcacu

SEQ ID NO: 1258269 - RNA, 14 nt, Mycobacterium tuberculosis H37Rv
ugccgggagacgcu

SEQ ID NO: 1258270 - RNA, 13 nt, Mycobacterium tuberculosis H37Rv
ugccgggaccggu

SEQ ID NO: 1258271 - RNA, 13 nt, Mycobacterium tuberculosis H37Rv
ugccggcuuggcc

SEQ ID NO: 1258272 - RNA, 16 nt, Mycobacterium tuberculosis H37Rv
ugccgggaacgaggua

SEQ ID NO: 1258273 - RNA, 22 nt, Mycobacterium tuberculosis H37Rv
ugccggcggaucugaucggcgc

SEQ ID NO: 1258274 - RNA, 22 nt, Mycobacterium tuberculosis H37Rv
ugccggcguaggcaggaucgcc

SEQ ID NO: 1258275 - RNA, 22 nt, Mycobacterium tuberculosis H37Rv
ugccggcgguguuggcgccagc

SEQ ID NO: 1258276 - RNA, 14 nt, Mycobacterium tuberculosis H37Rv
ugccuccgacacca

SEQ ID NO: 1258277 - RNA, 17 nt, Mycobacterium tuberculosis H37Rv
ugccuacuugcucgacg

SEQ ID NO: 1258278 - RNA, 18 nt, Mycobacterium tuberculosis H37Rv
ugccgguugcggcugcgu

SEQ ID NO: 1258279 - RNA, 17 nt, Mycobacterium tuberculosis H37Rv
ugccgguuuccgucuga

SEQ ID NO: 1258280 - RNA, 15 nt, Mycobacterium tuberculosis H37Rv
ugccgucggugccgc

SEQ ID NO: 1258281 - RNA, 13 nt, Mycobacterium tuberculosis H37Rv
ugccgucggcgua

SEQ ID NO: 1258282 - RNA, 15 nt, Mycobacterium tuberculosis H37Rv
ugccgucgcugcccc

SEQ ID NO: 1258283 - RNA, 15 nt, Mycobacterium tuberculosis H37Rv
ugccgucgcugacgc

SEQ ID NO: 1258284 - RNA, 13 nt, Mycobacterium tuberculosis H37Rv
ugccgucgcugac

SEQ ID NO: 1258285 - RNA, 23 nt, Mycobacterium tuberculosis H37Rv
ugccgucgcccuuagggucgccg

SEQ ID NO: 1258286 - RNA, 16 nt, Mycobacterium tuberculosis H37Rv
ugacgccgguccccgc

SEQ ID NO: 1258287 - RNA, 23 nt, Mycobacterium tuberculosis H37Rv
ugacgccauucaucggcaucgac

SEQ ID NO: 1258288 - RNA, 17 nt, Mycobacterium tuberculosis H37Rv
ugacgcgucagcggcga

SEQ ID NO: 1258289 - RNA, 12 nt, Mycobacterium tuberculosis H37Rv
ugacgcgcucgc

SEQ ID NO: 1258290 - RNA, 16 nt, Mycobacterium tuberculosis H37Rv
ugacgccucgacaccc

SEQ ID NO: 1258291 - RNA, 16 nt, Mycobacterium tuberculosis H37Rv
ugacgccgucggcgcg

SEQ ID NO: 1258292 - RNA, 22 nt, Mycobacterium tuberculosis H37Rv
ugacgcacgacugugcgccgca

SEQ ID NO: 1258293 - RNA, 22 nt, Mycobacterium tuberculosis H37Rv
ugacgauucgagcaacugcucg

SEQ ID NO: 1258294 - RNA, 13 nt, Mycobacterium tuberculosis H37Rv
ugacgcaacaucg

SEQ ID NO: 1258295 - RNA, 21 nt, Mycobacterium tuberculosis H37Rv
ugacgaguucgcgcaucaacg

SEQ ID NO: 1258296 - RNA, 15 nt, Mycobacterium tuberculosis H37Rv
ugacgaugccgccga

SEQ ID NO: 1258297 - RNA, 13 nt, Mycobacterium tuberculosis H37Rv
ugacgaucgcggc

SEQ ID NO: 1258298 - RNA, 21 nt, Mycobacterium tuberculosis H37Rv
ugacgguggggucgccgucga

SEQ ID NO: 1258299 - RNA, 19 nt, Mycobacterium tuberculosis H37Rv
ugacgguguacucgaagcg

SEQ ID NO: 1258300 - RNA, 14 nt, Mycobacterium tuberculosis H37Rv
ugacgguuccgguc

SEQ ID NO: 1258301 - RNA, 17 nt, Mycobacterium tuberculosis H37Rv
ugacggugccgaccgcg

SEQ ID NO: 1258302 - RNA, 22 nt, Mycobacterium tuberculosis H37Rv
ugacggugcgauaccgacaccc

SEQ ID NO: 1258303 - RNA, 16 nt, Mycobacterium tuberculosis H37Rv
ugacgguccccagguc

SEQ ID NO: 1258304 - RNA, 19 nt, Mycobacterium tuberculosis H37Rv
ugacgggguugaccgccac

SEQ ID NO: 1258305 - RNA, 20 nt, Mycobacterium tuberculosis H37Rv
ugacgggguugaccgccacc

SEQ ID NO: 1258306 - RNA, 18 nt, Mycobacterium tuberculosis H37Rv
ugacggcggggcggcggu

SEQ ID NO: 1258307 - RNA, 22 nt, Mycobacterium tuberculosis H37Rv
ugacgcucggucgccaccgccg

SEQ ID NO: 1258308 - RNA, 18 nt, Mycobacterium tuberculosis H37Rv
ugacggcagaccaugguc

SEQ ID NO: 1258309 - RNA, 20 nt, Mycobacterium tuberculosis H37Rv
ugacggcgccaggcaccacg

SEQ ID NO: 1258310 - RNA, 18 nt, Mycobacterium tuberculosis H37Rv
ugagcuacucacggugau

SEQ ID NO: 1258311 - RNA, 14 nt, Mycobacterium tuberculosis H37Rv
ugagcuagaccgcu

SEQ ID NO: 1258312 - RNA, 22 nt, Mycobacterium tuberculosis H37Rv
ugagcucaauggcuucgaagcg

SEQ ID NO: 1258313 - RNA, 15 nt, Mycobacterium tuberculosis H37Rv
ugagcgugucgagcg

SEQ ID NO: 1258314 - RNA, 22 nt, Mycobacterium tuberculosis H37Rv
ugagcgccgauguggccggcga

SEQ ID NO: 1258315 - RNA, 19 nt, Mycobacterium tuberculosis H37Rv
ugagcggacucgagucugc

SEQ ID NO: 1258316 - RNA, 22 nt, Mycobacterium tuberculosis H37Rv
ugagguaggacucacgcagcgc

SEQ ID NO: 1258317 - RNA, 14 nt, Mycobacterium tuberculosis H37Rv
ugagguaucccggu

SEQ ID NO: 1258318 - RNA, 20 nt, Mycobacterium tuberculosis H37Rv
ugaggucacccaucaacgcc

SEQ ID NO: 1258319 - RNA, 23 nt, Mycobacterium tuberculosis H37Rv
ugagguacuucauauaccgcucg

SEQ ID NO: 1258320 - RNA, 19 nt, Mycobacterium tuberculosis H37Rv
ugacugcgaccgguucggc

SEQ ID NO: 1258321 - RNA, 17 nt, Mycobacterium tuberculosis H37Rv
ugacucugcguccacca

SEQ ID NO: 1258322 - RNA, 17 nt, Mycobacterium tuberculosis H37Rv
ugacucugcguccaccg

SEQ ID NO: 1258323 - RNA, 16 nt, Mycobacterium tuberculosis H37Rv
ugacguccaacagcgc

SEQ ID NO: 1258324 - RNA, 15 nt, Mycobacterium tuberculosis H37Rv
ugacguccaacagcg

SEQ ID NO: 1258325 - RNA, 19 nt, Mycobacterium tuberculosis H37Rv
ugacguagugcaccgccug

SEQ ID NO: 1258326 - RNA, 17 nt, Mycobacterium tuberculosis H37Rv
ugacguagugcaccgcc

SEQ ID NO: 1258327 - RNA, 20 nt, Mycobacterium tuberculosis H37Rv
ugacucgggcacgggugacg

SEQ ID NO: 1258328 - RNA, 15 nt, Mycobacterium tuberculosis H37Rv
ugagcaugucgucgu

SEQ ID NO: 1258329 - RNA, 21 nt, Mycobacterium tuberculosis H37Rv
ugagcgagcgcgcguagcggg

SEQ ID NO: 1258330 - RNA, 14 nt, Mycobacterium tuberculosis H37Rv
ugcaccgcgaccgc

SEQ ID NO: 1258331 - RNA, 15 nt, Mycobacterium tuberculosis H37Rv
ugcacccgaucgacg

SEQ ID NO: 1258332 - RNA, 22 nt, Mycobacterium tuberculosis H37Rv
ugcacaggucagcgcugccacc

SEQ ID NO: 1258333 - RNA, 14 nt, Mycobacterium tuberculosis H37Rv
ugcacccagccgug

SEQ ID NO: 1258334 - RNA, 12 nt, Mycobacterium tuberculosis H37Rv
ugcacaccaccg

SEQ ID NO: 1258335 - RNA, 13 nt, Mycobacterium tuberculosis H37Rv
ugcacaccggcac

SEQ ID NO: 1258336 - RNA, 15 nt, Mycobacterium tuberculosis H37Rv
ugcacaggccgacga

SEQ ID NO: 1258337 - RNA, 17 nt, Mycobacterium tuberculosis H37Rv
ugcacagcagcgguuga

SEQ ID NO: 1258338 - RNA, 15 nt, Mycobacterium tuberculosis H37Rv
ugcaaugcuggcggc

SEQ ID NO: 1258339 - RNA, 14 nt, Mycobacterium tuberculosis H37Rv
ugaugcucgaugcg

SEQ ID NO: 1258340 - RNA, 16 nt, Mycobacterium tuberculosis H37Rv
ugaugcgggcucggcu

SEQ ID NO: 1258341 - RNA, 13 nt, Mycobacterium tuberculosis H37Rv
ugauucggcgacg

SEQ ID NO: 1258342 - RNA, 14 nt, Mycobacterium tuberculosis H37Rv
ugauucggcgacga

SEQ ID NO: 1258343 - RNA, 23 nt, Mycobacterium tuberculosis H37Rv
ugauuccguaugucccggugcgg

SEQ ID NO: 1258344 - RNA, 14 nt, Mycobacterium tuberculosis H37Rv
ugcaaaucgucgau

SEQ ID NO: 1258345 - RNA, 19 nt, Mycobacterium tuberculosis H37Rv
ugaucggcgaggucccggc

SEQ ID NO: 1258346 - RNA, 21 nt, Mycobacterium tuberculosis H37Rv
ugaucgcccgguucagcgcug

SEQ ID NO: 1258347 - RNA, 17 nt, Mycobacterium tuberculosis H37Rv
ugaucgcacaggaagcc

SEQ ID NO: 1258348 - RNA, 12 nt, Mycobacterium tuberculosis H37Rv
ugaucgcaucga

SEQ ID NO: 1258349 - RNA, 19 nt, Mycobacterium tuberculosis H37Rv
ugaucgcauuggcggcggu

SEQ ID NO: 1258350 - RNA, 13 nt, Mycobacterium tuberculosis H37Rv
ugaucucggcgaa

SEQ ID NO: 1258351 - RNA, 13 nt, Mycobacterium tuberculosis H37Rv
ugauccggucgua

SEQ ID NO: 1258352 - RNA, 12 nt, Mycobacterium tuberculosis H37Rv
ugauccagucga

SEQ ID NO: 1258353 - RNA, 21 nt, Mycobacterium tuberculosis H37Rv
ugauccgccgacagcccacga

SEQ ID NO: 1258354 - RNA, 23 nt, Mycobacterium tuberculosis H37Rv
ugaggucauuggcgaucaaugcg

SEQ ID NO: 1258355 - RNA, 19 nt, Mycobacterium tuberculosis H37Rv
ugaguguguuugaguugcc

SEQ ID NO: 1258356 - RNA, 14 nt, Mycobacterium tuberculosis H37Rv
ugaguuucggcgca

SEQ ID NO: 1258357 - RNA, 15 nt, Mycobacterium tuberculosis H37Rv
ugaguuucggcgcau

SEQ ID NO: 1258358 - RNA, 14 nt, Mycobacterium tuberculosis H37Rv
ugaccgccgccgga

SEQ ID NO: 1258359 - RNA, 17 nt, Mycobacterium tuberculosis H37Rv
ugaccgccaucgccaac

SEQ ID NO: 1258360 - RNA, 13 nt, Mycobacterium tuberculosis H37Rv
ugaccgccagcag

SEQ ID NO: 1258361 - RNA, 21 nt, Mycobacterium tuberculosis H37Rv
ugaccgcaaccgguaucgccg

SEQ ID NO: 1258362 - RNA, 12 nt, Mycobacterium tuberculosis H37Rv
ugaccgcaccgg

SEQ ID NO: 1258363 - RNA, 20 nt, Mycobacterium tuberculosis H37Rv
ugaccgagaucgucgcgacc

SEQ ID NO: 1258364 - RNA, 14 nt, Mycobacterium tuberculosis H37Rv
ugaccgagccgcga

SEQ ID NO: 1258365 - RNA, 15 nt, Mycobacterium tuberculosis H37Rv
ugaccgaccacgcga

SEQ ID NO: 1258366 - RNA, 13 nt, Mycobacterium tuberculosis H37Rv
ugaccgacgccgu

SEQ ID NO: 1258367 - RNA, 16 nt, Mycobacterium tuberculosis H37Rv
ugaccgacgccgucga

SEQ ID NO: 1258368 - RNA, 14 nt, Mycobacterium tuberculosis H37Rv
ugaccgacgccguc

SEQ ID NO: 1258369 - RNA, 14 nt, Mycobacterium tuberculosis H37Rv
ugaccgcgaugauc

SEQ ID NO: 1258370 - RNA, 22 nt, Mycobacterium tuberculosis H37Rv
ugaccgcgaugaucgcaucgac

SEQ ID NO: 1258371 - RNA, 22 nt, Mycobacterium tuberculosis H37Rv
ugaccgggucgaugacgccguc

SEQ ID NO: 1258372 - RNA, 17 nt, Mycobacterium tuberculosis H37Rv
ugaccgggucgccgaug

SEQ ID NO: 1258373 - RNA, 18 nt, Mycobacterium tuberculosis H37Rv
ugaccgggucgccgauga

SEQ ID NO: 1258374 - RNA, 21 nt, Mycobacterium tuberculosis H37Rv
ugaccgggucgaugacgccgu

SEQ ID NO: 1258375 - RNA, 17 nt, Mycobacterium tuberculosis H37Rv
ugaccucgucggcgacg

SEQ ID NO: 1258376 - RNA, 18 nt, Mycobacterium tuberculosis H37Rv
ugaccuucccgucgacga

SEQ ID NO: 1258377 - RNA, 21 nt, Mycobacterium tuberculosis H37Rv
ugaccuucccgucgacgagcg

SEQ ID NO: 1258378 - RNA, 15 nt, Mycobacterium tuberculosis H37Rv
ugaccuucaccugga

SEQ ID NO: 1258379 - RNA, 17 nt, Mycobacterium tuberculosis H37Rv
ugaccugcuggcgcacg

SEQ ID NO: 1258380 - RNA, 17 nt, Mycobacterium tuberculosis H37Rv
ugacgaagagcaccgcg

SEQ ID NO: 1258381 - RNA, 18 nt, Mycobacterium tuberculosis H37Rv
ugaccuuguugaccacca

SEQ ID NO: 1258382 - RNA, 20 nt, Mycobacterium tuberculosis H37Rv
ugacgagacgacgaccggcu

SEQ ID NO: 1258383 - RNA, 14 nt, Mycobacterium tuberculosis H37Rv
ugacgagacgacga

SEQ ID NO: 1258384 - RNA, 19 nt, Mycobacterium tuberculosis H37Rv
ugacgacgcgacacgccga

SEQ ID NO: 1258385 - RNA, 12 nt, Mycobacterium tuberculosis H37Rv
ugacgacggcau

SEQ ID NO: 1258386 - RNA, 15 nt, Mycobacterium tuberculosis H37Rv
ugacgacggugaccg

SEQ ID NO: 1258387 - RNA, 18 nt, Mycobacterium tuberculosis H37Rv
ugacgacaaacggcgacc

SEQ ID NO: 1258388 - RNA, 23 nt, Mycobacterium tuberculosis H37Rv
ugaccagugaucagcgcaucgcc

SEQ ID NO: 1258389 - RNA, 23 nt, Mycobacterium tuberculosis H37Rv
ugaccaggcggcgcgggucggcg

SEQ ID NO: 1258390 - RNA, 14 nt, Mycobacterium tuberculosis H37Rv
ugaccagaucgacg

SEQ ID NO: 1258391 - RNA, 14 nt, Mycobacterium tuberculosis H37Rv
ugaccagcaaccac

SEQ ID NO: 1258392 - RNA, 20 nt, Mycobacterium tuberculosis H37Rv
ugaccacgcugcuggugacg

SEQ ID NO: 1258393 - RNA, 12 nt, Mycobacterium tuberculosis H37Rv
ugaccacgucgg

SEQ ID NO: 1258394 - RNA, 18 nt, Mycobacterium tuberculosis H37Rv
ugaccgaacgcacgucga

SEQ ID NO: 1258395 - RNA, 22 nt, Mycobacterium tuberculosis H37Rv
ugaccgaagucugcagacgguc

SEQ ID NO: 1258396 - RNA, 14 nt, Mycobacterium tuberculosis H37Rv
ugacccgccgacga

SEQ ID NO: 1258397 - RNA, 15 nt, Mycobacterium tuberculosis H37Rv
ugacccacgagagcg

SEQ ID NO: 1258398 - RNA, 19 nt, Mycobacterium tuberculosis H37Rv
ugaccccguaggcgccgaa

SEQ ID NO: 1258399 - RNA, 22 nt, Mycobacterium tuberculosis H37Rv
ugacccauacgaacucaccgcc

SEQ ID NO: 1258400 - RNA, 15 nt, Mycobacterium tuberculosis H37Rv
ugacaccggccacca

SEQ ID NO: 1258401 - RNA, 18 nt, Mycobacterium tuberculosis H37Rv
ugacaccggggacgucga

SEQ ID NO: 1258402 - RNA, 17 nt, Mycobacterium tuberculosis H37Rv
ugacacuggggugcugc

SEQ ID NO: 1258403 - RNA, 20 nt, Mycobacterium tuberculosis H37Rv
ugacacugccuuaaccgagc

SEQ ID NO: 1258404 - RNA, 23 nt, Mycobacterium tuberculosis H37Rv
ugacacgcgcugcgucgucgacg

SEQ ID NO: 1258405 - RNA, 15 nt, Mycobacterium tuberculosis H37Rv
ugacacccgggccac

SEQ ID NO: 1258406 - RNA, 17 nt, Mycobacterium tuberculosis H37Rv
ugacacccacggcgcca

SEQ ID NO: 1258407 - RNA, 21 nt, Mycobacterium tuberculosis H37Rv
ugacaccagggggcgagagcg

SEQ ID NO: 1258408 - RNA, 20 nt, Mycobacterium tuberculosis H37Rv
ugaccacaaccgugagcacc

SEQ ID NO: 1258409 - RNA, 14 nt, Mycobacterium tuberculosis H37Rv
ugaccaccacgaug

SEQ ID NO: 1258410 - RNA, 22 nt, Mycobacterium tuberculosis H37Rv
ugaccaccacgaugaccgggga

SEQ ID NO: 1258411 - RNA, 22 nt, Mycobacterium tuberculosis H37Rv
ugaccaauccacugaucaaggc

SEQ ID NO: 1258412 - RNA, 15 nt, Mycobacterium tuberculosis H37Rv
ugaccacaaccguga

SEQ ID NO: 1258413 - RNA, 13 nt, Mycobacterium tuberculosis H37Rv
ugaccaacccucg

SEQ ID NO: 1258414 - RNA, 18 nt, Mycobacterium tuberculosis H37Rv
ugaccaacgucgcuccga

SEQ ID NO: 1258415 - RNA, 17 nt, Mycobacterium tuberculosis H37Rv
ugaacgagaugccgcga

SEQ ID NO: 1258416 - RNA, 23 nt, Mycobacterium tuberculosis H37Rv
ugaacgacccgcuggcucaucga

SEQ ID NO: 1258417 - RNA, 17 nt, Mycobacterium tuberculosis H37Rv
ugaaccaaucgcacgcc

SEQ ID NO: 1258418 - RNA, 22 nt, Mycobacterium tuberculosis H37Rv
ugaaccaguucgugggucaacg

SEQ ID NO: 1258419 - RNA, 14 nt, Mycobacterium tuberculosis H37Rv
ugaaccggccgcga

SEQ ID NO: 1258420 - RNA, 22 nt, Mycobacterium tuberculosis H37Rv
ugaaccggccgcgacgacacgc

SEQ ID NO: 1258421 - RNA, 17 nt, Mycobacterium tuberculosis H37Rv
ugaaccugcugagccgu

SEQ ID NO: 1258422 - RNA, 14 nt, Mycobacterium tuberculosis H37Rv
ucuuuggucgccgg

SEQ ID NO: 1258423 - RNA, 22 nt, Mycobacterium tuberculosis H37Rv
ugaaacguaugacgcccaccga

SEQ ID NO: 1258424 - RNA, 17 nt, Mycobacterium tuberculosis H37Rv
ugaaggucaccgucgag

SEQ ID NO: 1258425 - RNA, 18 nt, Mycobacterium tuberculosis H37Rv
ugaagucuuucgcuucgc

SEQ ID NO: 1258426 - RNA, 22 nt, Mycobacterium tuberculosis H37Rv
ugaaggcaaacaccagcccggc

SEQ ID NO: 1258427 - RNA, 17 nt, Mycobacterium tuberculosis H37Rv
ugaauuuccccgguagc

SEQ ID NO: 1258428 - RNA, 20 nt, Mycobacterium tuberculosis H37Rv
ugaauucgccgaacgguugc

SEQ ID NO: 1258429 - RNA, 23 nt, Mycobacterium tuberculosis H37Rv
ugaauaggaagguugaacgccgc

SEQ ID NO: 1258430 - RNA, 19 nt, Mycobacterium tuberculosis H37Rv
ugaaucggaccgaccggcu

SEQ ID NO: 1258431 - RNA, 17 nt, Mycobacterium tuberculosis H37Rv
gcggccgggcguccucg

SEQ ID NO: 1258432 - RNA, 14 nt, Mycobacterium tuberculosis H37Rv
gcggccggcgucgg

SEQ ID NO: 1258433 - RNA, 15 nt, Mycobacterium tuberculosis H37Rv
gcggccugacgcugc

SEQ ID NO: 1258434 - RNA, 14 nt, Mycobacterium tuberculosis H37Rv
gcggccucgucgag

SEQ ID NO: 1258435 - RNA, 13 nt, Mycobacterium tuberculosis H37Rv
gcggccugcucgc

SEQ ID NO: 1258436 - RNA, 17 nt, Mycobacterium tuberculosis H37Rv
gcggccuguugacccau

SEQ ID NO: 1258437 - RNA, 19 nt, Mycobacterium tuberculosis H37Rv
gcggccuggucggccaggu

SEQ ID NO: 1258438 - RNA, 17 nt, Mycobacterium tuberculosis H37Rv
gcggccuggucggccag

SEQ ID NO: 1258439 - RNA, 21 nt, Mycobacterium tuberculosis H37Rv
gcggccugggccagccgcuca

SEQ ID NO: 1258440 - RNA, 19 nt, Mycobacterium tuberculosis H37Rv
gcggccugggccagccgcu

SEQ ID NO: 1258441 - RNA, 18 nt, Mycobacterium tuberculosis H37Rv
gcggccucgcugcucagc

SEQ ID NO: 1258442 - RNA, 15 nt, Mycobacterium tuberculosis H37Rv
gcggccucgcugcuc

SEQ ID NO: 1258443 - RNA, 20 nt, Mycobacterium tuberculosis H37Rv
gcggccuccaccacgucggg

SEQ ID NO: 1258444 - RNA, 22 nt, Mycobacterium tuberculosis H37Rv
gcggccuccgcggacgauuacg

SEQ ID NO: 1258445 - RNA, 13 nt, Mycobacterium tuberculosis H37Rv
gcggcccgcaucg

SEQ ID NO: 1258446 - RNA, 21 nt, Mycobacterium tuberculosis H37Rv
gcggcccggguuggccgaaca

SEQ ID NO: 1258447 - RNA, 17 nt, Mycobacterium tuberculosis H37Rv
gcggcccgcugcgcggc

SEQ ID NO: 1258448 - RNA, 22 nt, Mycobacterium tuberculosis H37Rv
gcggcccggucuacgccaccga

SEQ ID NO: 1258449 - RNA, 13 nt, Mycobacterium tuberculosis H37Rv
gcggcccgcucca

SEQ ID NO: 1258450 - RNA, 17 nt, Mycobacterium tuberculosis H37Rv
gcggccgaacucgaggu

SEQ ID NO: 1258451 - RNA, 20 nt, Mycobacterium tuberculosis H37Rv
gcggccgagcgcaccgcuga

SEQ ID NO: 1258452 - RNA, 21 nt, Mycobacterium tuberculosis H37Rv
gcggcccugcuugcaggcgau

SEQ ID NO: 1258453 - RNA, 14 nt, Mycobacterium tuberculosis H37Rv
gcggcccucgagca

SEQ ID NO: 1258454 - RNA, 14 nt, Mycobacterium tuberculosis H37Rv
gcggccgcuccacc

SEQ ID NO: 1258455 - RNA, 13 nt, Mycobacterium tuberculosis H37Rv
gcggccgcgguga

SEQ ID NO: 1258456 - RNA, 16 nt, Mycobacterium tuberculosis H37Rv
gcggccgcgcgcucga

SEQ ID NO: 1258457 - RNA, 13 nt, Mycobacterium tuberculosis H37Rv
gcggccgccgcgu

SEQ ID NO: 1258458 - RNA, 19 nt, Mycobacterium tuberculosis H37Rv
gcggccgccaucagccgcu

SEQ ID NO: 1258459 - RNA, 20 nt, Mycobacterium tuberculosis H37Rv
gcggccgaggucacccggua

SEQ ID NO: 1258460 - RNA, 18 nt, Mycobacterium tuberculosis H37Rv
gcggccgagggauugccg

SEQ ID NO: 1258461 - RNA, 16 nt, Mycobacterium tuberculosis H37Rv
gcggaacaccgacgac

SEQ ID NO: 1258462 - RNA, 21 nt, Mycobacterium tuberculosis H37Rv
gcggaacaccgacgacaccag

SEQ ID NO: 1258463 - RNA, 14 nt, Mycobacterium tuberculosis H37Rv
gcggaacaccagca

SEQ ID NO: 1258464 - RNA, 20 nt, Mycobacterium tuberculosis H37Rv
gcggaaaacccagaucggcg

SEQ ID NO: 1258465 - RNA, 20 nt, Mycobacterium tuberculosis H37Rv
gcggcauagccgaacagcgg

SEQ ID NO: 1258466 - RNA, 19 nt, Mycobacterium tuberculosis H37Rv
gcggcauccugcacgaccc

SEQ ID NO: 1258467 - RNA, 17 nt, Mycobacterium tuberculosis H37Rv
gcggcaucgaguucggc

SEQ ID NO: 1258468 - RNA, 14 nt, Mycobacterium tuberculosis H37Rv
gcggcaucgaggcc

SEQ ID NO: 1258469 - RNA, 16 nt, Mycobacterium tuberculosis H37Rv
gcggcauccacaccga

SEQ ID NO: 1258470 - RNA, 20 nt, Mycobacterium tuberculosis H37Rv
gcggcauccugcacgacccg

SEQ ID NO: 1258471 - RNA, 23 nt, Mycobacterium tuberculosis H37Rv
gcggcauucucgagcacccgcaa

SEQ ID NO: 1258472 - RNA, 19 nt, Mycobacterium tuberculosis H37Rv
gcggccaacgacgacccgu

SEQ ID NO: 1258473 - RNA, 22 nt, Mycobacterium tuberculosis H37Rv
gcggcaugaagcaguuggccga

SEQ ID NO: 1258474 - RNA, 14 nt, Mycobacterium tuberculosis H37Rv
gcggcaucggccag

SEQ ID NO: 1258475 - RNA, 13 nt, Mycobacterium tuberculosis H37Rv
gcggcaucgucgc

SEQ ID NO: 1258476 - RNA, 23 nt, Mycobacterium tuberculosis H37Rv
gcggccaccaccgagcgcaaccc

SEQ ID NO: 1258477 - RNA, 15 nt, Mycobacterium tuberculosis H37Rv
gcggccacaaccucg

SEQ ID NO: 1258478 - RNA, 17 nt, Mycobacterium tuberculosis H37Rv
gcggccaaugacgucgg

SEQ ID NO: 1258479 - RNA, 19 nt, Mycobacterium tuberculosis H37Rv
gcggccacauaccaccacg

SEQ ID NO: 1258480 - RNA, 14 nt, Mycobacterium tuberculosis H37Rv
gcggccaccgccgc

SEQ ID NO: 1258481 - RNA, 15 nt, Mycobacterium tuberculosis H37Rv
gcggccaccgucagc

SEQ ID NO: 1258482 - RNA, 14 nt, Mycobacterium tuberculosis H37Rv
gcggccaccagauc

SEQ ID NO: 1258483 - RNA, 16 nt, Mycobacterium tuberculosis H37Rv
gcggccacccgcgacg

SEQ ID NO: 1258484 - RNA, 19 nt, Mycobacterium tuberculosis H37Rv
gcggccaguugcacaucgg

SEQ ID NO: 1258485 - RNA, 16 nt, Mycobacterium tuberculosis H37Rv
gcggccaucgccgaca

SEQ ID NO: 1258486 - RNA, 15 nt, Mycobacterium tuberculosis H37Rv
gcggccaucgccgac

SEQ ID NO: 1258487 - RNA, 13 nt, Mycobacterium tuberculosis H37Rv
gcggccaggucgc

SEQ ID NO: 1258488 - RNA, 20 nt, Mycobacterium tuberculosis H37Rv
gcggccauucuugucggugg

SEQ ID NO: 1258489 - RNA, 17 nt, Mycobacterium tuberculosis H37Rv
gcggccauuagcagcac

SEQ ID NO: 1258490 - RNA, 15 nt, Mycobacterium tuberculosis H37Rv
gcggccccgccguug

SEQ ID NO: 1258491 - RNA, 20 nt, Mycobacterium tuberculosis H37Rv
gcggccccgacauacgucgg

SEQ ID NO: 1258492 - RNA, 19 nt, Mycobacterium tuberculosis H37Rv
gcggcccgagaagcguugc

SEQ ID NO: 1258493 - RNA, 19 nt, Mycobacterium tuberculosis H37Rv
gcggccagcgcaccgccga

SEQ ID NO: 1258494 - RNA, 19 nt, Mycobacterium tuberculosis H37Rv
gcggccagcuccagcgccg

SEQ ID NO: 1258495 - RNA, 21 nt, Mycobacterium tuberculosis H37Rv
gcggccaggaugccugccacc

SEQ ID NO: 1258496 - RNA, 24 nt, Mycobacterium tuberculosis H37Rv
gcggccagagccgcgcgccgguug

SEQ ID NO: 1258497 - RNA, 23 nt, Mycobacterium tuberculosis H37Rv
gcggccagcagcaacgacccgaa

SEQ ID NO: 1258498 - RNA, 17 nt, Mycobacterium tuberculosis H37Rv
gcggccagcaucgcggu

SEQ ID NO: 1258499 - RNA, 22 nt, Mycobacterium tuberculosis H37Rv
gcggccacuuggaugcgacccg

SEQ ID NO: 1258500 - RNA, 17 nt, Mycobacterium tuberculosis H37Rv
gcggccacucgcccgau

SEQ ID NO: 1258501 - RNA, 16 nt, Mycobacterium tuberculosis H37Rv
gcggccacgguggcgc

SEQ ID NO: 1258502 - RNA, 16 nt, Mycobacterium tuberculosis H37Rv
gcggccacguggucgg

SEQ ID NO: 1258503 - RNA, 15 nt, Mycobacterium tuberculosis H37Rv
gcggccacgccgauc

SEQ ID NO: 1258504 - RNA, 17 nt, Mycobacterium tuberculosis H37Rv
gcggcggccuccaccac

SEQ ID NO: 1258505 - RNA, 15 nt, Mycobacterium tuberculosis H37Rv
gcggcggcgaacucg

SEQ ID NO: 1258506 - RNA, 16 nt, Mycobacterium tuberculosis H37Rv
gcggcgggcucgcuuc

SEQ ID NO: 1258507 - RNA, 21 nt, Mycobacterium tuberculosis H37Rv
gcggcgggcaccgugauggcg

SEQ ID NO: 1258508 - RNA, 16 nt, Mycobacterium tuberculosis H37Rv
gcggcgggcaccguga

SEQ ID NO: 1258509 - RNA, 14 nt, Mycobacterium tuberculosis H37Rv
gcggcggcggcacg

SEQ ID NO: 1258510 - RNA, 13 nt, Mycobacterium tuberculosis H37Rv
gcggcggcgucgg

SEQ ID NO: 1258511 - RNA, 15 nt, Mycobacterium tuberculosis H37Rv
gcggcguccagcagc

SEQ ID NO: 1258512 - RNA, 12 nt, Mycobacterium tuberculosis H37Rv
gcggcguccaga

SEQ ID NO: 1258513 - RNA, 12 nt, Mycobacterium tuberculosis H37Rv
gcggcguccagc

SEQ ID NO: 1258514 - RNA, 18 nt, Mycobacterium tuberculosis H37Rv
gcggcgucaaaugugcga

SEQ ID NO: 1258515 - RNA, 18 nt, Mycobacterium tuberculosis H37Rv
gcggcguacucggcaucc

SEQ ID NO: 1258516 - RNA, 14 nt, Mycobacterium tuberculosis H37Rv
gcggcguggucucg

SEQ ID NO: 1258517 - RNA, 22 nt, Mycobacterium tuberculosis H37Rv
gcggcgugcuccugcccgaacu

SEQ ID NO: 1258518 - RNA, 19 nt, Mycobacterium tuberculosis H37Rv
gcggcguguacgucgauca

SEQ ID NO: 1258519 - RNA, 17 nt, Mycobacterium tuberculosis H37Rv
gcggcguguacgucgau

SEQ ID NO: 1258520 - RNA, 23 nt, Mycobacterium tuberculosis H37Rv
gcggcguuaagguacccggucgg

SEQ ID NO: 1258521 - RNA, 22 nt, Mycobacterium tuberculosis H37Rv
gcggcguuaccaccgucaccgc

SEQ ID NO: 1258522 - RNA, 20 nt, Mycobacterium tuberculosis H37Rv
gcggcguuccgggccgauca

SEQ ID NO: 1258523 - RNA, 14 nt, Mycobacterium tuberculosis H37Rv
gcggcguucgaugc

SEQ ID NO: 1258524 - RNA, 16 nt, Mycobacterium tuberculosis H37Rv
gcggcguaggcgguca

SEQ ID NO: 1258525 - RNA, 14 nt, Mycobacterium tuberculosis H37Rv
gcggcguucgccgg

SEQ ID NO: 1258526 - RNA, 21 nt, Mycobacterium tuberculosis H37Rv
gcggccuuggcgacgucgcgg

SEQ ID NO: 1258527 - RNA, 20 nt, Mycobacterium tuberculosis H37Rv
gcggccuuggcggccgcgac

SEQ ID NO: 1258528 - RNA, 18 nt, Mycobacterium tuberculosis H37Rv
gcggccuuggcgacgucg

SEQ ID NO: 1258529 - RNA, 16 nt, Mycobacterium tuberculosis H37Rv
gcggcgcagcacggcg

SEQ ID NO: 1258530 - RNA, 20 nt, Mycobacterium tuberculosis H37Rv
gcggcgccccgguuggccgu

SEQ ID NO: 1258531 - RNA, 13 nt, Mycobacterium tuberculosis H37Rv
gcggcgcagcgac

SEQ ID NO: 1258532 - RNA, 21 nt, Mycobacterium tuberculosis H37Rv
gcggcgccauggaucccacga

SEQ ID NO: 1258533 - RNA, 13 nt, Mycobacterium tuberculosis H37Rv
gcggcgcccagga

SEQ ID NO: 1258534 - RNA, 16 nt, Mycobacterium tuberculosis H37Rv
gcggcgcgccgaucga

SEQ ID NO: 1258535 - RNA, 14 nt, Mycobacterium tuberculosis H37Rv
gcggcgcccggcuu

SEQ ID NO: 1258536 - RNA, 17 nt, Mycobacterium tuberculosis H37Rv
gcggcgcccggucgagc

SEQ ID NO: 1258537 - RNA, 23 nt, Mycobacterium tuberculosis H37Rv
gcggcggcagcggcgaucaggcg

SEQ ID NO: 1258538 - RNA, 20 nt, Mycobacterium tuberculosis H37Rv
gcggcggcauagugcgacug

SEQ ID NO: 1258539 - RNA, 14 nt, Mycobacterium tuberculosis H37Rv
gcggcggcaucggu

SEQ ID NO: 1258540 - RNA, 14 nt, Mycobacterium tuberculosis H37Rv
gcggcggcaagugc

SEQ ID NO: 1258541 - RNA, 13 nt, Mycobacterium tuberculosis H37Rv
gcggcgcgguuuc

SEQ ID NO: 1258542 - RNA, 13 nt, Mycobacterium tuberculosis H37Rv
gcggcgcggcgac

SEQ ID NO: 1258543 - RNA, 18 nt, Mycobacterium tuberculosis H37Rv
gcgggcgccucggugacg

SEQ ID NO: 1258544 - RNA, 20 nt, Mycobacterium tuberculosis H37Rv
gcgggcgccuuggucgccgc

SEQ ID NO: 1258545 - RNA, 16 nt, Mycobacterium tuberculosis H37Rv
gcgggcgccuuggucg

SEQ ID NO: 1258546 - RNA, 17 nt, Mycobacterium tuberculosis H37Rv
gcgggcgaucucggcga

SEQ ID NO: 1258547 - RNA, 22 nt, Mycobacterium tuberculosis H37Rv
gcgggcgaugagcgcgaucucc

SEQ ID NO: 1258548 - RNA, 14 nt, Mycobacterium tuberculosis H37Rv
gcgggcguccacgc

SEQ ID NO: 1258549 - RNA, 14 nt, Mycobacterium tuberculosis H37Rv
gcgggcggcccugg

SEQ ID NO: 1258550 - RNA, 15 nt, Mycobacterium tuberculosis H37Rv
gcgggcggaucgccg

SEQ ID NO: 1258551 - RNA, 17 nt, Mycobacterium tuberculosis H37Rv
gcgggcggcaucgccga

SEQ ID NO: 1258552 - RNA, 13 nt, Mycobacterium tuberculosis H37Rv
gcgggcgacccgu

SEQ ID NO: 1258553 - RNA, 15 nt, Mycobacterium tuberculosis H37Rv
gcgggccucggcgac

SEQ ID NO: 1258554 - RNA, 17 nt, Mycobacterium tuberculosis H37Rv
gcgggccuccugcuggc

SEQ ID NO: 1258555 - RNA, 21 nt, Mycobacterium tuberculosis H37Rv
gcgggccgcucgguaggacag

SEQ ID NO: 1258556 - RNA, 14 nt, Mycobacterium tuberculosis H37Rv
gcgggccggcaucg

SEQ ID NO: 1258557 - RNA, 20 nt, Mycobacterium tuberculosis H37Rv
gcgggccggaugacgcccag

SEQ ID NO: 1258558 - RNA, 13 nt, Mycobacterium tuberculosis H37Rv
gcgggccggcgac

SEQ ID NO: 1258559 - RNA, 16 nt, Mycobacterium tuberculosis H37Rv
gcgggccgcgucgaac

SEQ ID NO: 1258560 - RNA, 17 nt, Mycobacterium tuberculosis H37Rv
gcgggcccgcaggucgg

SEQ ID NO: 1258561 - RNA, 21 nt, Mycobacterium tuberculosis H37Rv
gcgggccgaccagagcuucgc

SEQ ID NO: 1258562 - RNA, 18 nt, Mycobacterium tuberculosis H37Rv
gcgggacaaaaucagcag

SEQ ID NO: 1258563 - RNA, 22 nt, Mycobacterium tuberculosis H37Rv
gcgggacaucaccgcagcaccg

SEQ ID NO: 1258564 - RNA, 18 nt, Mycobacterium tuberculosis H37Rv
gcgggacgcgacucggcg

SEQ ID NO: 1258565 - RNA, 13 nt, Mycobacterium tuberculosis H37Rv
gcgggacgucgcc

SEQ ID NO: 1258566 - RNA, 17 nt, Mycobacterium tuberculosis H37Rv
gcgggacugacccugau

SEQ ID NO: 1258567 - RNA, 22 nt, Mycobacterium tuberculosis H37Rv
gcgggacugcagcgcggugguc

SEQ ID NO: 1258568 - RNA, 19 nt, Mycobacterium tuberculosis H37Rv
gcgggacugcagcgcggug

SEQ ID NO: 1258569 - RNA, 13 nt, Mycobacterium tuberculosis H37Rv
gcgggcccgauga

SEQ ID NO: 1258570 - RNA, 16 nt, Mycobacterium tuberculosis H37Rv
gcgggcaugauguuga

SEQ ID NO: 1258571 - RNA, 12 nt, Mycobacterium tuberculosis H37Rv
gcgggcaucgcg

SEQ ID NO: 1258572 - RNA, 19 nt, Mycobacterium tuberculosis H37Rv
gcgggcauaacccgcaccg

SEQ ID NO: 1258573 - RNA, 20 nt, Mycobacterium tuberculosis H37Rv
gcgggcauaacccgcaccgg

SEQ ID NO: 1258574 - RNA, 17 nt, Mycobacterium tuberculosis H37Rv
gcgggcaguugacccau

SEQ ID NO: 1258575 - RNA, 18 nt, Mycobacterium tuberculosis H37Rv
gcgggcagcguguaaccg

SEQ ID NO: 1258576 - RNA, 19 nt, Mycobacterium tuberculosis H37Rv
gcgggcagcguguaaccga

SEQ ID NO: 1258577 - RNA, 21 nt, Mycobacterium tuberculosis H37Rv
gcgggcagcuguucggccaac

SEQ ID NO: 1258578 - RNA, 17 nt, Mycobacterium tuberculosis H37Rv
gcgggaguucggggugc

SEQ ID NO: 1258579 - RNA, 21 nt, Mycobacterium tuberculosis H37Rv
gcggcuuccucgagcgaaccg

SEQ ID NO: 1258580 - RNA, 21 nt, Mycobacterium tuberculosis H37Rv
gcggcuucgccccgaggaugc

SEQ ID NO: 1258581 - RNA, 15 nt, Mycobacterium tuberculosis H37Rv
gcggcuucgucgaca

SEQ ID NO: 1258582 - RNA, 15 nt, Mycobacterium tuberculosis H37Rv
gcgggaagucccgag

SEQ ID NO: 1258583 - RNA, 19 nt, Mycobacterium tuberculosis H37Rv
gcgggaaguccgucggucg

SEQ ID NO: 1258584 - RNA, 13 nt, Mycobacterium tuberculosis H37Rv
gcggcuuggccgc

SEQ ID NO: 1258585 - RNA, 21 nt, Mycobacterium tuberculosis H37Rv
gcggcguuguggcguguggcu

SEQ ID NO: 1258586 - RNA, 23 nt, Mycobacterium tuberculosis H37Rv
gcggcguuguugcggaucgagca

SEQ ID NO: 1258587 - RNA, 16 nt, Mycobacterium tuberculosis H37Rv
gcggcguugugaccgc

SEQ ID NO: 1258588 - RNA, 12 nt, Mycobacterium tuberculosis H37Rv
gcggcguucggc

SEQ ID NO: 1258589 - RNA, 17 nt, Mycobacterium tuberculosis H37Rv
gcggcguuguggcgugu

SEQ ID NO: 1258590 - RNA, 20 nt, Mycobacterium tuberculosis H37Rv
gcgugagccaugccgcucgg

SEQ ID NO: 1258591 - RNA, 12 nt, Mycobacterium tuberculosis H37Rv
gcgugaucccgc

SEQ ID NO: 1258592 - RNA, 19 nt, Mycobacterium tuberculosis H37Rv
gcgugauagcccuugccgu

SEQ ID NO: 1258593 - RNA, 14 nt, Mycobacterium tuberculosis H37Rv
gcgugccgacccgc

SEQ ID NO: 1258594 - RNA, 15 nt, Mycobacterium tuberculosis H37Rv
gcgugccgacccgcu

SEQ ID NO: 1258595 - RNA, 23 nt, Mycobacterium tuberculosis H37Rv
gcgugccggggauaucacgacgc

SEQ ID NO: 1258596 - RNA, 21 nt, Mycobacterium tuberculosis H37Rv
gcgucuucagguccaccgcug

SEQ ID NO: 1258597 - RNA, 20 nt, Mycobacterium tuberculosis H37Rv
gcgucuuccucggccacccg

SEQ ID NO: 1258598 - RNA, 16 nt, Mycobacterium tuberculosis H37Rv
gcgucuugcaucagcg

SEQ ID NO: 1258599 - RNA, 14 nt, Mycobacterium tuberculosis H37Rv
gcgugaacugaggg

SEQ ID NO: 1258600 - RNA, 21 nt, Mycobacterium tuberculosis H37Rv
gcgugaaccuuacgacgccgu

SEQ ID NO: 1258601 - RNA, 19 nt, Mycobacterium tuberculosis H37Rv
gcgugaccagggccugagu

SEQ ID NO: 1258602 - RNA, 17 nt, Mycobacterium tuberculosis H37Rv
gcgucugcucgccagcg

SEQ ID NO: 1258603 - RNA, 16 nt, Mycobacterium tuberculosis H37Rv
gcgucugcugaccgga

SEQ ID NO: 1258604 - RNA, 22 nt, Mycobacterium tuberculosis H37Rv
gcgucugcucgcgcagggaucg

SEQ ID NO: 1258605 - RNA, 21 nt, Mycobacterium tuberculosis H37Rv
gcgucugcgaucccgaucgcg

SEQ ID NO: 1258606 - RNA, 16 nt, Mycobacterium tuberculosis H37Rv
gcgucguugucgucgc

SEQ ID NO: 1258607 - RNA, 16 nt, Mycobacterium tuberculosis H37Rv
gcgucugcgguggccu

SEQ ID NO: 1258608 - RNA, 12 nt, Mycobacterium tuberculosis H37Rv
gcgucugcucgc

SEQ ID NO: 1258609 - RNA, 17 nt, Mycobacterium tuberculosis H37Rv
gcgucggugccaccacg

SEQ ID NO: 1258610 - RNA, 11 nt, Mycobacterium tuberculosis H37Rv
gcgucggcgaa

SEQ ID NO: 1258611 - RNA, 16 nt, Mycobacterium tuberculosis H37Rv
gcgucgggcacaucgc

SEQ ID NO: 1258612 - RNA, 19 nt, Mycobacterium tuberculosis H37Rv
gcgucggucggguggaucu

SEQ ID NO: 1258613 - RNA, 16 nt, Mycobacterium tuberculosis H37Rv
gcgucggugccgcuga

SEQ ID NO: 1258614 - RNA, 16 nt, Mycobacterium tuberculosis H37Rv
gcgucguagcgcucgu

SEQ ID NO: 1258615 - RNA, 22 nt, Mycobacterium tuberculosis H37Rv
gcgucguucgagaccccgacga

SEQ ID NO: 1258616 - RNA, 16 nt, Mycobacterium tuberculosis H37Rv
gcgucguggucggcga

SEQ ID NO: 1258617 - RNA, 13 nt, Mycobacterium tuberculosis H37Rv
gcgucgugguggc

SEQ ID NO: 1258618 - RNA, 22 nt, Mycobacterium tuberculosis H37Rv
gcgucgugguggcuauuccgac

SEQ ID NO: 1258619 - RNA, 15 nt, Mycobacterium tuberculosis H37Rv
gcgucguggucggcg

SEQ ID NO: 1258620 - RNA, 18 nt, Mycobacterium tuberculosis H37Rv
gcgucguauucgaugccg

SEQ ID NO: 1258621 - RNA, 16 nt, Mycobacterium tuberculosis H37Rv
gcguccgaaccaccug

SEQ ID NO: 1258622 - RNA, 19 nt, Mycobacterium tuberculosis H37Rv
gcguccauggucgcgccac

SEQ ID NO: 1258623 - RNA, 18 nt, Mycobacterium tuberculosis H37Rv
gcgucccaaucgggaucg

SEQ ID NO: 1258624 - RNA, 18 nt, Mycobacterium tuberculosis H37Rv
gcguccauggucgcgcca

SEQ ID NO: 1258625 - RNA, 13 nt, Mycobacterium tuberculosis H37Rv
gcgucggccggca

SEQ ID NO: 1258626 - RNA, 16 nt, Mycobacterium tuberculosis H37Rv
gcgucgccgccgggca

SEQ ID NO: 1258627 - RNA, 14 nt, Mycobacterium tuberculosis H37Rv
gcgucgccggccuu

SEQ ID NO: 1258628 - RNA, 19 nt, Mycobacterium tuberculosis H37Rv
gcguggcaguacaccggcg

SEQ ID NO: 1258629 - RNA, 23 nt, Mycobacterium tuberculosis H37Rv
gcguggaucuuggccagcagcgc

SEQ ID NO: 1258630 - RNA, 16 nt, Mycobacterium tuberculosis H37Rv
gcguggccaauccggc

SEQ ID NO: 1258631 - RNA, 24 nt, Mycobacterium tuberculosis H37Rv
gcguggccaacucuucagcaagcc

SEQ ID NO: 1258632 - RNA, 13 nt, Mycobacterium tuberculosis H37Rv
gcgugcggcgaag

SEQ ID NO: 1258633 - RNA, 14 nt, Mycobacterium tuberculosis H37Rv
gcguggacgcccgc

SEQ ID NO: 1258634 - RNA, 12 nt, Mycobacterium tuberculosis H37Rv
gcguguggcgca

SEQ ID NO: 1258635 - RNA, 12 nt, Mycobacterium tuberculosis H37Rv
gcgugucgccgc

SEQ ID NO: 1258636 - RNA, 14 nt, Mycobacterium tuberculosis H37Rv
gcgugucgacuccg

SEQ ID NO: 1258637 - RNA, 13 nt, Mycobacterium tuberculosis H37Rv
gcgugucgccgau

SEQ ID NO: 1258638 - RNA, 20 nt, Mycobacterium tuberculosis H37Rv
gcgugucgggaacgaguacg

SEQ ID NO: 1258639 - RNA, 17 nt, Mycobacterium tuberculosis H37Rv
gcgugucgcgucgugcg

SEQ ID NO: 1258640 - RNA, 17 nt, Mycobacterium tuberculosis H37Rv
gcgugucuugucgcgca

SEQ ID NO: 1258641 - RNA, 21 nt, Mycobacterium tuberculosis H37Rv
gcgugucuguacaacgacacg

SEQ ID NO: 1258642 - RNA, 14 nt, Mycobacterium tuberculosis H37Rv
gcgugucuggcgaa

SEQ ID NO: 1258643 - RNA, 13 nt, Mycobacterium tuberculosis H37Rv
gcguugaccugca

SEQ ID NO: 1258644 - RNA, 20 nt, Mycobacterium tuberculosis H37Rv
gcguugacucugcguccacc

SEQ ID NO: 1258645 - RNA, 15 nt, Mycobacterium tuberculosis H37Rv
gcguugccgccguug

SEQ ID NO: 1258646 - RNA, 16 nt, Mycobacterium tuberculosis H37Rv
gcguugacgucgagca

SEQ ID NO: 1258647 - RNA, 23 nt, Mycobacterium tuberculosis H37Rv
gcguucgccggaauacaccagcg

SEQ ID NO: 1258648 - RNA, 23 nt, Mycobacterium tuberculosis H37Rv
gcguuccugaucgagcgccagcg

SEQ ID NO: 1258649 - RNA, 14 nt, Mycobacterium tuberculosis H37Rv
gcguucccgcucgg

SEQ ID NO: 1258650 - RNA, 16 nt, Mycobacterium tuberculosis H37Rv
gcguuccgcgacagcg

SEQ ID NO: 1258651 - RNA, 23 nt, Mycobacterium tuberculosis H37Rv
gcguucgagagccccgaccagca

SEQ ID NO: 1258652 - RNA, 15 nt, Mycobacterium tuberculosis H37Rv
gcguucaccacgauc

SEQ ID NO: 1258653 - RNA, 22 nt, Mycobacterium tuberculosis H37Rv
gcguuuauaccucgccgcccug

SEQ ID NO: 1258654 - RNA, 16 nt, Mycobacterium tuberculosis H37Rv
gcguuguugaccagca

SEQ ID NO: 1258655 - RNA, 14 nt, Mycobacterium tuberculosis H37Rv
gcguugguggucgg

SEQ ID NO: 1258656 - RNA, 19 nt, Mycobacterium tuberculosis H37Rv
gcguugguggucugccaaa

SEQ ID NO: 1258657 - RNA, 17 nt, Mycobacterium tuberculosis H37Rv
gcguuggggcacgacgc

SEQ ID NO: 1258658 - RNA, 14 nt, Mycobacterium tuberculosis H37Rv
gcguuggaugaagu

SEQ ID NO: 1258659 - RNA, 22 nt, Mycobacterium tuberculosis H37Rv
gcguuggaugaagucgucggca

SEQ ID NO: 1258660 - RNA, 19 nt, Mycobacterium tuberculosis H37Rv
gcguuggaaaagucgggca

SEQ ID NO: 1258661 - RNA, 13 nt, Mycobacterium tuberculosis H37Rv
gcguugccggucg

SEQ ID NO: 1258662 - RNA, 21 nt, Mycobacterium tuberculosis H37Rv
gcguugccgccguugccgcca

SEQ ID NO: 1258663 - RNA, 17 nt, Mycobacterium tuberculosis H37Rv
gcguugcggcaacagcg

SEQ ID NO: 1258664 - RNA, 17 nt, Mycobacterium tuberculosis H37Rv
gcuaaggugggcacagc

SEQ ID NO: 1258665 - RNA, 15 nt, Mycobacterium tuberculosis H37Rv
gcuaacaccgcaggc

SEQ ID NO: 1258666 - RNA, 22 nt, Mycobacterium tuberculosis H37Rv
gcguuugagaacaacgggaucc

SEQ ID NO: 1258667 - RNA, 15 nt, Mycobacterium tuberculosis H37Rv
gcguuuggacgggcg

SEQ ID NO: 1258668 - RNA, 21 nt, Mycobacterium tuberculosis H37Rv
gcguuuucaauuucacugcga

SEQ ID NO: 1258669 - RNA, 19 nt, Mycobacterium tuberculosis H37Rv
gcuaaagcccccgacacgc

SEQ ID NO: 1258670 - RNA, 24 nt, Mycobacterium tuberculosis H37Rv
gcuaaagcccccgacacgccgugc

SEQ ID NO: 1258671 - RNA, 20 nt, Mycobacterium tuberculosis H37Rv
gcuaaacuccgugccgagcg

SEQ ID NO: 1258672 - RNA, 18 nt, Mycobacterium tuberculosis H37Rv
gcguaggccuugcucagc

SEQ ID NO: 1258673 - RNA, 21 nt, Mycobacterium tuberculosis H37Rv
gcguaggccuugcucagccgg

SEQ ID NO: 1258674 - RNA, 15 nt, Mycobacterium tuberculosis H37Rv
gcguagggccagcgc

SEQ ID NO: 1258675 - RNA, 22 nt, Mycobacterium tuberculosis H37Rv
gcguagcuggccagguugccgu

SEQ ID NO: 1258676 - RNA, 22 nt, Mycobacterium tuberculosis H37Rv
gcguagguggccagcgcggcga

SEQ ID NO: 1258677 - RNA, 17 nt, Mycobacterium tuberculosis H37Rv
gcguagguggccagcgc

SEQ ID NO: 1258678 - RNA, 20 nt, Mycobacterium tuberculosis H37Rv
gcguaguccgcauccgcgac

SEQ ID NO: 1258679 - RNA, 23 nt, Mycobacterium tuberculosis H37Rv
gcguauagcaugccgcggcggaa

SEQ ID NO: 1258680 - RNA, 17 nt, Mycobacterium tuberculosis H37Rv
gcguaucgggcccccug

SEQ ID NO: 1258681 - RNA, 22 nt, Mycobacterium tuberculosis H37Rv
gcguaucgacccgcgcaaccgg

SEQ ID NO: 1258682 - RNA, 15 nt, Mycobacterium tuberculosis H37Rv
gcguagcacggcgau

SEQ ID NO: 1258683 - RNA, 16 nt, Mycobacterium tuberculosis H37Rv
gcguagagcagcagcg

SEQ ID NO: 1258684 - RNA, 13 nt, Mycobacterium tuberculosis H37Rv
gcguacagcaccg

SEQ ID NO: 1258685 - RNA, 18 nt, Mycobacterium tuberculosis H37Rv
gcguaccaguugauuccg

SEQ ID NO: 1258686 - RNA, 19 nt, Mycobacterium tuberculosis H37Rv
gcguccacgcugaccaacg

SEQ ID NO: 1258687 - RNA, 23 nt, Mycobacterium tuberculosis H37Rv
gcguccaucagagacagcagcgu

SEQ ID NO: 1258688 - RNA, 20 nt, Mycobacterium tuberculosis H37Rv
gcgucaugaugucgacaucg

SEQ ID NO: 1258689 - RNA, 17 nt, Mycobacterium tuberculosis H37Rv
gcgucaugaugucgaca

SEQ ID NO: 1258690 - RNA, 20 nt, Mycobacterium tuberculosis H37Rv
gcgucaggugcgcgaccagg

SEQ ID NO: 1258691 - RNA, 15 nt, Mycobacterium tuberculosis H37Rv
gcgucaguccucauc

SEQ ID NO: 1258692 - RNA, 21 nt, Mycobacterium tuberculosis H37Rv
gcgucacaccagcgggcaucg

SEQ ID NO: 1258693 - RNA, 13 nt, Mycobacterium tuberculosis H37Rv
gcgucacaccacg

SEQ ID NO: 1258694 - RNA, 13 nt, Mycobacterium tuberculosis H37Rv
gcgucacauccga

SEQ ID NO: 1258695 - RNA, 14 nt, Mycobacterium tuberculosis H37Rv
gcgucacaccagcg

SEQ ID NO: 1258696 - RNA, 15 nt, Mycobacterium tuberculosis H37Rv
gcgucacccugucgc

SEQ ID NO: 1258697 - RNA, 18 nt, Mycobacterium tuberculosis H37Rv
gcgucagauccggccguu

SEQ ID NO: 1258698 - RNA, 15 nt, Mycobacterium tuberculosis H37Rv
gcgucagcggcgagc

SEQ ID NO: 1258699 - RNA, 18 nt, Mycobacterium tuberculosis H37Rv
gcgucaggccagagucgc

SEQ ID NO: 1258700 - RNA, 15 nt, Mycobacterium tuberculosis H37Rv
gcgucagccccgacu

SEQ ID NO: 1258701 - RNA, 16 nt, Mycobacterium tuberculosis H37Rv
gcgucagcgcggcguc

SEQ ID NO: 1258702 - RNA, 16 nt, Mycobacterium tuberculosis H37Rv
gcggugcugcuucaac

SEQ ID NO: 1258703 - RNA, 21 nt, Mycobacterium tuberculosis H37Rv
gcggugcucuucggcaccacc

SEQ ID NO: 1258704 - RNA, 17 nt, Mycobacterium tuberculosis H37Rv
gcggugcggcaacagcg

SEQ ID NO: 1258705 - RNA, 19 nt, Mycobacterium tuberculosis H37Rv
gcggugcggaucagaggac

SEQ ID NO: 1258706 - RNA, 20 nt, Mycobacterium tuberculosis H37Rv
gcgguggaaaaagcccgaca

SEQ ID NO: 1258707 - RNA, 12 nt, Mycobacterium tuberculosis H37Rv
gcgguggccacc

SEQ ID NO: 1258708 - RNA, 21 nt, Mycobacterium tuberculosis H37Rv
gcggugcgcaccaccgagccg

SEQ ID NO: 1258709 - RNA, 22 nt, Mycobacterium tuberculosis H37Rv
gcggugcaggauucggcggucg

SEQ ID NO: 1258710 - RNA, 18 nt, Mycobacterium tuberculosis H37Rv
gcggugccgugguggacg

SEQ ID NO: 1258711 - RNA, 16 nt, Mycobacterium tuberculosis H37Rv
gcggugaguccgcuga

SEQ ID NO: 1258712 - RNA, 18 nt, Mycobacterium tuberculosis H37Rv
gcggugauauccgugaau

SEQ ID NO: 1258713 - RNA, 19 nt, Mycobacterium tuberculosis H37Rv
gcggucugcuccaggcgcg

SEQ ID NO: 1258714 - RNA, 17 nt, Mycobacterium tuberculosis H37Rv
gcguacaaaccgucggg

SEQ ID NO: 1258715 - RNA, 16 nt, Mycobacterium tuberculosis H37Rv
gcgguuguccggucgc

SEQ ID NO: 1258716 - RNA, 15 nt, Mycobacterium tuberculosis H37Rv
gcgguuguccggucg

SEQ ID NO: 1258717 - RNA, 17 nt, Mycobacterium tuberculosis H37Rv
gcgguugccuucuuggc

SEQ ID NO: 1258718 - RNA, 16 nt, Mycobacterium tuberculosis H37Rv
gcgguuguccuccgac

SEQ ID NO: 1258719 - RNA, 13 nt, Mycobacterium tuberculosis H37Rv
gcgguuggugcag

SEQ ID NO: 1258720 - RNA, 16 nt, Mycobacterium tuberculosis H37Rv
gcgguggccgucgggu

SEQ ID NO: 1258721 - RNA, 21 nt, Mycobacterium tuberculosis H37Rv
gcgguggccucccacggcgcg

SEQ ID NO: 1258722 - RNA, 20 nt, Mycobacterium tuberculosis H37Rv
gcgguggccagaucgaacgc

SEQ ID NO: 1258723 - RNA, 19 nt, Mycobacterium tuberculosis H37Rv
gcgguggugagugcgucuc

SEQ ID NO: 1258724 - RNA, 21 nt, Mycobacterium tuberculosis H37Rv
gcgguggugcgcaaucgacac

SEQ ID NO: 1258725 - RNA, 12 nt, Mycobacterium tuberculosis H37Rv
gcgguggugccg

SEQ ID NO: 1258726 - RNA, 19 nt, Mycobacterium tuberculosis H37Rv
gcggucagcucggcagcau

SEQ ID NO: 1258727 - RNA, 18 nt, Mycobacterium tuberculosis H37Rv
gcgguccaacagcgccag

SEQ ID NO: 1258728 - RNA, 19 nt, Mycobacterium tuberculosis H37Rv
gcggucaccgcgucaccgg

SEQ ID NO: 1258729 - RNA, 16 nt, Mycobacterium tuberculosis H37Rv
gcggucagcagcgccg

SEQ ID NO: 1258730 - RNA, 16 nt, Mycobacterium tuberculosis H37Rv
gcgggcuugagcgccg

SEQ ID NO: 1258731 - RNA, 15 nt, Mycobacterium tuberculosis H37Rv
gcgggcuuaugcacg

SEQ ID NO: 1258732 - RNA, 14 nt, Mycobacterium tuberculosis H37Rv
gcgguccggcuucg

SEQ ID NO: 1258733 - RNA, 13 nt, Mycobacterium tuberculosis H37Rv
gcggucgacgugu

SEQ ID NO: 1258734 - RNA, 18 nt, Mycobacterium tuberculosis H37Rv
gcgguccucgaucggugg

SEQ ID NO: 1258735 - RNA, 13 nt, Mycobacterium tuberculosis H37Rv
gcggucgagcucg

SEQ ID NO: 1258736 - RNA, 12 nt, Mycobacterium tuberculosis H37Rv
gcggucgagcag

SEQ ID NO: 1258737 - RNA, 20 nt, Mycobacterium tuberculosis H37Rv
gcggucggcgaccaccagcg

SEQ ID NO: 1258738 - RNA, 18 nt, Mycobacterium tuberculosis H37Rv
gcggucucagugcucgcc

SEQ ID NO: 1258739 - RNA, 22 nt, Mycobacterium tuberculosis H37Rv
gcggucuccccagagcuggucc

SEQ ID NO: 1258740 - RNA, 17 nt, Mycobacterium tuberculosis H37Rv
gcggucugcagugcagc

SEQ ID NO: 1258741 - RNA, 19 nt, Mycobacterium tuberculosis H37Rv
gcggucugaccgcgucggc

SEQ ID NO: 1258742 - RNA, 21 nt, Mycobacterium tuberculosis H37Rv
gcggucugagacucgucgaug

SEQ ID NO: 1258743 - RNA, 21 nt, Mycobacterium tuberculosis H37Rv
gcggucucggugccgagcacu

SEQ ID NO: 1258744 - RNA, 14 nt, Mycobacterium tuberculosis H37Rv
gcggucucggugcc

SEQ ID NO: 1258745 - RNA, 12 nt, Mycobacterium tuberculosis H37Rv
gcggucugcucc

SEQ ID NO: 1258746 - RNA, 22 nt, Mycobacterium tuberculosis H37Rv
gcggucgugaucagcaggacga

SEQ ID NO: 1258747 - RNA, 16 nt, Mycobacterium tuberculosis H37Rv
gcggucggucaccaug

SEQ ID NO: 1258748 - RNA, 12 nt, Mycobacterium tuberculosis H37Rv
gcugggcagacc

SEQ ID NO: 1258749 - RNA, 19 nt, Mycobacterium tuberculosis H37Rv
gcugggauguucuugguca

SEQ ID NO: 1258750 - RNA, 23 nt, Mycobacterium tuberculosis H37Rv
gcugggucccgcuggcauauccc

SEQ ID NO: 1258751 - RNA, 13 nt, Mycobacterium tuberculosis H37Rv
gcugggucgccgu

SEQ ID NO: 1258752 - RNA, 23 nt, Mycobacterium tuberculosis H37Rv
gcugggucagguugucggcgauc

SEQ ID NO: 1258753 - RNA, 20 nt, Mycobacterium tuberculosis H37Rv
gcugggaagcucgguccaau

SEQ ID NO: 1258754 - RNA, 20 nt, Mycobacterium tuberculosis H37Rv
gcugggacgggcgcgucggc

SEQ ID NO: 1258755 - RNA, 16 nt, Mycobacterium tuberculosis H37Rv
gcugggaaaucccgac

SEQ ID NO: 1258756 - RNA, 21 nt, Mycobacterium tuberculosis H37Rv
gcugguaggucaccggucacc

SEQ ID NO: 1258757 - RNA, 15 nt, Mycobacterium tuberculosis H37Rv
gcugguaggucaccg

SEQ ID NO: 1258758 - RNA, 16 nt, Mycobacterium tuberculosis H37Rv
gcugguaggucaccgg

SEQ ID NO: 1258759 - RNA, 12 nt, Mycobacterium tuberculosis H37Rv
gcugguagcugc

SEQ ID NO: 1258760 - RNA, 16 nt, Mycobacterium tuberculosis H37Rv
gcugguaucgagcacc

SEQ ID NO: 1258761 - RNA, 23 nt, Mycobacterium tuberculosis H37Rv
gcuggucaagaucagcgguuugc

SEQ ID NO: 1258762 - RNA, 12 nt, Mycobacterium tuberculosis H37Rv
gcugggugacca

SEQ ID NO: 1258763 - RNA, 18 nt, Mycobacterium tuberculosis H37Rv
gcugguaaccggcggcag

SEQ ID NO: 1258764 - RNA, 14 nt, Mycobacterium tuberculosis H37Rv
gcugcugcagcgau

SEQ ID NO: 1258765 - RNA, 14 nt, Mycobacterium tuberculosis H37Rv
gcugcugccgcacc

SEQ ID NO: 1258766 - RNA, 15 nt, Mycobacterium tuberculosis H37Rv
gcugcugccgcaccg

SEQ ID NO: 1258767 - RNA, 22 nt, Mycobacterium tuberculosis H37Rv
gcugcugccgcaccggugcucg

SEQ ID NO: 1258768 - RNA, 17 nt, Mycobacterium tuberculosis H37Rv
gcugcugcgcggugccg

SEQ ID NO: 1258769 - RNA, 13 nt, Mycobacterium tuberculosis H37Rv
gcuggcggcagcg

SEQ ID NO: 1258770 - RNA, 17 nt, Mycobacterium tuberculosis H37Rv
gcuggcugacaccgauc

SEQ ID NO: 1258771 - RNA, 23 nt, Mycobacterium tuberculosis H37Rv
gcuggcguuguugacgaucaccc

SEQ ID NO: 1258772 - RNA, 15 nt, Mycobacterium tuberculosis H37Rv
gcuggcucaccgaca

SEQ ID NO: 1258773 - RNA, 15 nt, Mycobacterium tuberculosis H37Rv
gcuggcuacccaccg

SEQ ID NO: 1258774 - RNA, 13 nt, Mycobacterium tuberculosis H37Rv
gcuggcggcgacc

SEQ ID NO: 1258775 - RNA, 15 nt, Mycobacterium tuberculosis H37Rv
gcugucgacgucggc

SEQ ID NO: 1258776 - RNA, 17 nt, Mycobacterium tuberculosis H37Rv
gcuguccgaaccgacgu

SEQ ID NO: 1258777 - RNA, 13 nt, Mycobacterium tuberculosis H37Rv
gcuguccgggcug

SEQ ID NO: 1258778 - RNA, 19 nt, Mycobacterium tuberculosis H37Rv
gcuguggcccgucauacuc

SEQ ID NO: 1258779 - RNA, 20 nt, Mycobacterium tuberculosis H37Rv
gcuguggccgccguaacucu

SEQ ID NO: 1258780 - RNA, 18 nt, Mycobacterium tuberculosis H37Rv
gcugugcucacgagcaaa

SEQ ID NO: 1258781 - RNA, 14 nt, Mycobacterium tuberculosis H37Rv
gcugugcucgacga

SEQ ID NO: 1258782 - RNA, 15 nt, Mycobacterium tuberculosis H37Rv
gcuguugaagccgcc

SEQ ID NO: 1258783 - RNA, 15 nt, Mycobacterium tuberculosis H37Rv
gcuguggucggugcc

SEQ ID NO: 1258784 - RNA, 17 nt, Mycobacterium tuberculosis H37Rv
gcuguggucgcugcugc

SEQ ID NO: 1258785 - RNA, 15 nt, Mycobacterium tuberculosis H37Rv
gcuguggcucgacga

SEQ ID NO: 1258786 - RNA, 18 nt, Mycobacterium tuberculosis H37Rv
gcugguggcggcgacacg

SEQ ID NO: 1258787 - RNA, 16 nt, Mycobacterium tuberculosis H37Rv
gcugguggaguucgcg

SEQ ID NO: 1258788 - RNA, 18 nt, Mycobacterium tuberculosis H37Rv
gcugguccaggcggugac

SEQ ID NO: 1258789 - RNA, 19 nt, Mycobacterium tuberculosis H37Rv
gcugguccaggcggugacg

SEQ ID NO: 1258790 - RNA, 18 nt, Mycobacterium tuberculosis H37Rv
gcuggucaugcggaucac

SEQ ID NO: 1258791 - RNA, 15 nt, Mycobacterium tuberculosis H37Rv
gcuguacugcggugc

SEQ ID NO: 1258792 - RNA, 23 nt, Mycobacterium tuberculosis H37Rv
gcuguaacacccggccgccgaaa

SEQ ID NO: 1258793 - RNA, 22 nt, Mycobacterium tuberculosis H37Rv
gcugguuucggccgcauccccg

SEQ ID NO: 1258794 - RNA, 20 nt, Mycobacterium tuberculosis H37Rv
gcuguacaacgccgucgucg

SEQ ID NO: 1258795 - RNA, 16 nt, Mycobacterium tuberculosis H37Rv
gcuguacccgaccagc

SEQ ID NO: 1258796 - RNA, 17 nt, Mycobacterium tuberculosis H37Rv
gcuguacccgaccagca

SEQ ID NO: 1258797 - RNA, 17 nt, Mycobacterium tuberculosis H37Rv
gcuuccuccgacgcgau

SEQ ID NO: 1258798 - RNA, 20 nt, Mycobacterium tuberculosis H37Rv
gcuuccguggcccaacccgg

SEQ ID NO: 1258799 - RNA, 17 nt, Mycobacterium tuberculosis H37Rv
gcuucgccacaccauga

SEQ ID NO: 1258800 - RNA, 17 nt, Mycobacterium tuberculosis H37Rv
gcuucgcccggcugcgc

SEQ ID NO: 1258801 - RNA, 17 nt, Mycobacterium tuberculosis H37Rv
gcuucgacggcggccaa

SEQ ID NO: 1258802 - RNA, 18 nt, Mycobacterium tuberculosis H37Rv
gcuucgacggcggccaag

SEQ ID NO: 1258803 - RNA, 17 nt, Mycobacterium tuberculosis H37Rv
gcuucucagcaccaugc

SEQ ID NO: 1258804 - RNA, 21 nt, Mycobacterium tuberculosis H37Rv
gcuucggagccgacaacgacg

SEQ ID NO: 1258805 - RNA, 13 nt, Mycobacterium tuberculosis H37Rv
gcuucggcagacc

SEQ ID NO: 1258806 - RNA, 19 nt, Mycobacterium tuberculosis H37Rv
gcuucggcggucagcggcu

SEQ ID NO: 1258807 - RNA, 15 nt, Mycobacterium tuberculosis H37Rv
gcuucggcggccgag

SEQ ID NO: 1258808 - RNA, 20 nt, Mycobacterium tuberculosis H37Rv
gcuucggcagaccggcaucg

SEQ ID NO: 1258809 - RNA, 15 nt, Mycobacterium tuberculosis H37Rv
gcuucggcgaacccu

SEQ ID NO: 1258810 - RNA, 11 nt, Mycobacterium tuberculosis H37Rv
gcuucggcgag

SEQ ID NO: 1258811 - RNA, 16 nt, Mycobacterium tuberculosis H37Rv
gcuucggugacccggg

SEQ ID NO: 1258812 - RNA, 14 nt, Mycobacterium tuberculosis H37Rv
gcuucggcggucgc

SEQ ID NO: 1258813 - RNA, 16 nt, Mycobacterium tuberculosis H37Rv
gcuucgggcgucaucc

SEQ ID NO: 1258814 - RNA, 18 nt, Mycobacterium tuberculosis H37Rv
gcuuacuugaucucggcg

SEQ ID NO: 1258815 - RNA, 20 nt, Mycobacterium tuberculosis H37Rv
gcuuagcugccgucggugcc

SEQ ID NO: 1258816 - RNA, 20 nt, Mycobacterium tuberculosis H37Rv
gcuuaugcgucugcucgccg

SEQ ID NO: 1258817 - RNA, 15 nt, Mycobacterium tuberculosis H37Rv
gcuuaugcacgacgg

SEQ ID NO: 1258818 - RNA, 19 nt, Mycobacterium tuberculosis H37Rv
gcuguugacgccacgacgc

SEQ ID NO: 1258819 - RNA, 22 nt, Mycobacterium tuberculosis H37Rv
gcuuaacgacgggaaccagcgg

SEQ ID NO: 1258820 - RNA, 24 nt, Mycobacterium tuberculosis H37Rv
gcuucacagccaccagccgggcaa

SEQ ID NO: 1258821 - RNA, 15 nt, Mycobacterium tuberculosis H37Rv
gcuucaggaucggcg

SEQ ID NO: 1258822 - RNA, 18 nt, Mycobacterium tuberculosis H37Rv
gcuucaggaucggcgauu

SEQ ID NO: 1258823 - RNA, 14 nt, Mycobacterium tuberculosis H37Rv
gcuuccacgccgga

SEQ ID NO: 1258824 - RNA, 16 nt, Mycobacterium tuberculosis H37Rv
ggacugcagcgcggug

SEQ ID NO: 1258825 - RNA, 21 nt, Mycobacterium tuberculosis H37Rv
ggacucguucauguagcagcg

SEQ ID NO: 1258826 - RNA, 15 nt, Mycobacterium tuberculosis H37Rv
ggacucuucggaccg

SEQ ID NO: 1258827 - RNA, 17 nt, Mycobacterium tuberculosis H37Rv
ggacucgccgacgucga

SEQ ID NO: 1258828 - RNA, 14 nt, Mycobacterium tuberculosis H37Rv
ggacucaucggcgu

SEQ ID NO: 1258829 - RNA, 17 nt, Mycobacterium tuberculosis H37Rv
ggacuugauaucggcgg

SEQ ID NO: 1258830 - RNA, 13 nt, Mycobacterium tuberculosis H37Rv
ggagaccagcguc

SEQ ID NO: 1258831 - RNA, 14 nt, Mycobacterium tuberculosis H37Rv
ggacgcgccggcgu

SEQ ID NO: 1258832 - RNA, 16 nt, Mycobacterium tuberculosis H37Rv
ggacggcguagacguc

SEQ ID NO: 1258833 - RNA, 16 nt, Mycobacterium tuberculosis H37Rv
ggacggccaucgccag

SEQ ID NO: 1258834 - RNA, 21 nt, Mycobacterium tuberculosis H37Rv
ggacggagcccaaaaccgcga

SEQ ID NO: 1258835 - RNA, 15 nt, Mycobacterium tuberculosis H37Rv
ggacgucggcgaauc

SEQ ID NO: 1258836 - RNA, 20 nt, Mycobacterium tuberculosis H37Rv
ggacguacugucgucgcccu

SEQ ID NO: 1258837 - RNA, 21 nt, Mycobacterium tuberculosis H37Rv
ggacgguguacaggucgccgg

SEQ ID NO: 1258838 - RNA, 14 nt, Mycobacterium tuberculosis H37Rv
ggacggugucagcc

SEQ ID NO: 1258839 - RNA, 20 nt, Mycobacterium tuberculosis H37Rv
ggacgucaccgucaguucgg

SEQ ID NO: 1258840 - RNA, 12 nt, Mycobacterium tuberculosis H37Rv
ggacggucgcca

SEQ ID NO: 1258841 - RNA, 23 nt, Mycobacterium tuberculosis H37Rv
ggacggugaucuugccggccagc

SEQ ID NO: 1258842 - RNA, 13 nt, Mycobacterium tuberculosis H37Rv
ggacggucgccag

SEQ ID NO: 1258843 - RNA, 16 nt, Mycobacterium tuberculosis H37Rv
ggacggucgcucggca

SEQ ID NO: 1258844 - RNA, 19 nt, Mycobacterium tuberculosis H37Rv
ggacgggggcuguccaccg

SEQ ID NO: 1258845 - RNA, 17 nt, Mycobacterium tuberculosis H37Rv
ggacgggcgcgucggcg

SEQ ID NO: 1258846 - RNA, 19 nt, Mycobacterium tuberculosis H37Rv
ggacgagguucugccgcga

SEQ ID NO: 1258847 - RNA, 16 nt, Mycobacterium tuberculosis H37Rv
ggacgauacgcgcacc

SEQ ID NO: 1258848 - RNA, 16 nt, Mycobacterium tuberculosis H37Rv
ggacgauaccgggcua

SEQ ID NO: 1258849 - RNA, 11 nt, Mycobacterium tuberculosis H37Rv
ggacgaugcgg

SEQ ID NO: 1258850 - RNA, 21 nt, Mycobacterium tuberculosis H37Rv
ggacgcccgcccgcacgacga

SEQ ID NO: 1258851 - RNA, 12 nt, Mycobacterium tuberculosis H37Rv
ggacgccacgga

SEQ ID NO: 1258852 - RNA, 15 nt, Mycobacterium tuberculosis H37Rv
ggaccgggaucguca

SEQ ID NO: 1258853 - RNA, 17 nt, Mycobacterium tuberculosis H37Rv
ggaccgcggucauggcg

SEQ ID NO: 1258854 - RNA, 14 nt, Mycobacterium tuberculosis H37Rv
ggaccgcucgucgc

SEQ ID NO: 1258855 - RNA, 21 nt, Mycobacterium tuberculosis H37Rv
ggaccgcggugacccggaagc

SEQ ID NO: 1258856 - RNA, 16 nt, Mycobacterium tuberculosis H37Rv
ggaccggcgucggcug

SEQ ID NO: 1258857 - RNA, 24 nt, Mycobacterium tuberculosis H37Rv
ggacccagccagcuggacuccggu

SEQ ID NO: 1258858 - RNA, 15 nt, Mycobacterium tuberculosis H37Rv
ggaccccucgaccga

SEQ ID NO: 1258859 - RNA, 15 nt, Mycobacterium tuberculosis H37Rv
ggacccgaccgucgu

SEQ ID NO: 1258860 - RNA, 13 nt, Mycobacterium tuberculosis H37Rv
ggacccagcggcg

SEQ ID NO: 1258861 - RNA, 14 nt, Mycobacterium tuberculosis H37Rv
ggacagggugcgcu

SEQ ID NO: 1258862 - RNA, 17 nt, Mycobacterium tuberculosis H37Rv
ggacagguaacgcgguu

SEQ ID NO: 1258863 - RNA, 18 nt, Mycobacterium tuberculosis H37Rv
ggacaguuacgcuggcac

SEQ ID NO: 1258864 - RNA, 18 nt, Mycobacterium tuberculosis H37Rv
ggacagguaacgcgguuc

SEQ ID NO: 1258865 - RNA, 21 nt, Mycobacterium tuberculosis H37Rv
ggaccaggccgcgcgcaccgg

SEQ ID NO: 1258866 - RNA, 16 nt, Mycobacterium tuberculosis H37Rv
ggacauccagugcggu

SEQ ID NO: 1258867 - RNA, 12 nt, Mycobacterium tuberculosis H37Rv
ggacaucaccgc

SEQ ID NO: 1258868 - RNA, 13 nt, Mycobacterium tuberculosis H37Rv
ggacaucaccgca

SEQ ID NO: 1258869 - RNA, 22 nt, Mycobacterium tuberculosis H37Rv
ggacauccgggccgagcgcacc

SEQ ID NO: 1258870 - RNA, 14 nt, Mycobacterium tuberculosis H37Rv
ggacaaaagaacgc

SEQ ID NO: 1258871 - RNA, 17 nt, Mycobacterium tuberculosis H37Rv
ggaauucgaucuggcgg

SEQ ID NO: 1258872 - RNA, 18 nt, Mycobacterium tuberculosis H37Rv
ggaauuccccaccgucgu

SEQ ID NO: 1258873 - RNA, 18 nt, Mycobacterium tuberculosis H37Rv
ggaauagcaacgcugcag

SEQ ID NO: 1258874 - RNA, 18 nt, Mycobacterium tuberculosis H37Rv
ggaaugucagccgguucc

SEQ ID NO: 1258875 - RNA, 16 nt, Mycobacterium tuberculosis H37Rv
ggaaugccgucgccgg

SEQ ID NO: 1258876 - RNA, 22 nt, Mycobacterium tuberculosis H37Rv
ggaaucaccgaaugcacgacgg

SEQ ID NO: 1258877 - RNA, 21 nt, Mycobacterium tuberculosis H37Rv
ggaagccgaccuucucggcgu

SEQ ID NO: 1258878 - RNA, 15 nt, Mycobacterium tuberculosis H37Rv
ggaagccgaccaccg

SEQ ID NO: 1258879 - RNA, 17 nt, Mycobacterium tuberculosis H37Rv
ggaagcccacgaucgcg

SEQ ID NO: 1258880 - RNA, 23 nt, Mycobacterium tuberculosis H37Rv
ggaagccgaccuucucggcguac

SEQ ID NO: 1258881 - RNA, 20 nt, Mycobacterium tuberculosis H37Rv
ggaacuuguugacgaaccca

SEQ ID NO: 1258882 - RNA, 23 nt, Mycobacterium tuberculosis H37Rv
ggaagaacaucaccucgaugccg

SEQ ID NO: 1258883 - RNA, 14 nt, Mycobacterium tuberculosis H37Rv
ggaagaucacgcgu

SEQ ID NO: 1258884 - RNA, 20 nt, Mycobacterium tuberculosis H37Rv
ggaagugcggugagauggcg

SEQ ID NO: 1258885 - RNA, 12 nt, Mycobacterium tuberculosis H37Rv
ggaagugcggug

SEQ ID NO: 1258886 - RNA, 18 nt, Mycobacterium tuberculosis H37Rv
ggaagcgggauugccgag

SEQ ID NO: 1258887 - RNA, 16 nt, Mycobacterium tuberculosis H37Rv
ggaagcgccggccgau

SEQ ID NO: 1258888 - RNA, 19 nt, Mycobacterium tuberculosis H37Rv
ggaacaucgucaucgacga

SEQ ID NO: 1258889 - RNA, 21 nt, Mycobacterium tuberculosis H37Rv
ggaacccacaguggcucgcgg

SEQ ID NO: 1258890 - RNA, 15 nt, Mycobacterium tuberculosis H37Rv
ggaaccauugcccga

SEQ ID NO: 1258891 - RNA, 20 nt, Mycobacterium tuberculosis H37Rv
ggaaccauugcccgacgaug

SEQ ID NO: 1258892 - RNA, 17 nt, Mycobacterium tuberculosis H37Rv
ggaaccccgagcugcca

SEQ ID NO: 1258893 - RNA, 21 nt, Mycobacterium tuberculosis H37Rv
ggaaccaaccucggaucgcca

SEQ ID NO: 1258894 - RNA, 19 nt, Mycobacterium tuberculosis H37Rv
ggaaccacccaccggccac

SEQ ID NO: 1258895 - RNA, 21 nt, Mycobacterium tuberculosis H37Rv
ggaacaccaccaggcugucgu

SEQ ID NO: 1258896 - RNA, 20 nt, Mycobacterium tuberculosis H37Rv
ggaacaccgaggcgaccgga

SEQ ID NO: 1258897 - RNA, 21 nt, Mycobacterium tuberculosis H37Rv
ggaacaccgcccggcccggcu

SEQ ID NO: 1258898 - RNA, 21 nt, Mycobacterium tuberculosis H37Rv
ggaaaacugaguugagcgcca

SEQ ID NO: 1258899 - RNA, 16 nt, Mycobacterium tuberculosis H37Rv
gcuuugccgucgagca

SEQ ID NO: 1258900 - RNA, 13 nt, Mycobacterium tuberculosis H37Rv
gcuuugcucgcca

SEQ ID NO: 1258901 - RNA, 19 nt, Mycobacterium tuberculosis H37Rv
gcuuugcacagcggcaucg

SEQ ID NO: 1258902 - RNA, 14 nt, Mycobacterium tuberculosis H37Rv
gcuuugagccgcuc

SEQ ID NO: 1258903 - RNA, 21 nt, Mycobacterium tuberculosis H37Rv
ggaaacaucguucugacggcu

SEQ ID NO: 1258904 - RNA, 16 nt, Mycobacterium tuberculosis H37Rv
ggaaagaucucgguca

SEQ ID NO: 1258905 - RNA, 20 nt, Mycobacterium tuberculosis H37Rv
ggaaacuccgcggcgcgcaa

SEQ ID NO: 1258906 - RNA, 21 nt, Mycobacterium tuberculosis H37Rv
gcuuuccgccgcaccggauca

SEQ ID NO: 1258907 - RNA, 21 nt, Mycobacterium tuberculosis H37Rv
gcuucuuaccgcgggccgcca

SEQ ID NO: 1258908 - RNA, 14 nt, Mycobacterium tuberculosis H37Rv
gcugcguucgccgg

SEQ ID NO: 1258909 - RNA, 16 nt, Mycobacterium tuberculosis H37Rv
gcugcucacgcagcag

SEQ ID NO: 1258910 - RNA, 17 nt, Mycobacterium tuberculosis H37Rv
gcugcggauccaccacg

SEQ ID NO: 1258911 - RNA, 16 nt, Mycobacterium tuberculosis H37Rv
gcugcgcuuugcacag

SEQ ID NO: 1258912 - RNA, 12 nt, Mycobacterium tuberculosis H37Rv
gcugcggcgacg

SEQ ID NO: 1258913 - RNA, 14 nt, Mycobacterium tuberculosis H37Rv
gcugcgcgcccacc

SEQ ID NO: 1258914 - RNA, 21 nt, Mycobacterium tuberculosis H37Rv
gcugcgcgaugucguucgcgu

SEQ ID NO: 1258915 - RNA, 16 nt, Mycobacterium tuberculosis H37Rv
gcugcgccgggcucgc

SEQ ID NO: 1258916 - RNA, 24 nt, Mycobacterium tuberculosis H37Rv
gcugcgccgggcucgcgaucguca

SEQ ID NO: 1258917 - RNA, 14 nt, Mycobacterium tuberculosis H37Rv
gcugcgccgucgca

SEQ ID NO: 1258918 - RNA, 15 nt, Mycobacterium tuberculosis H37Rv
gcugccgcaucggca

SEQ ID NO: 1258919 - RNA, 20 nt, Mycobacterium tuberculosis H37Rv
gcugcccagcgucaucccga

SEQ ID NO: 1258920 - RNA, 22 nt, Mycobacterium tuberculosis H37Rv
gcugccaguucuuggcgaccuu

SEQ ID NO: 1258921 - RNA, 18 nt, Mycobacterium tuberculosis H37Rv
gcugcccaaaagcgcggc

SEQ ID NO: 1258922 - RNA, 23 nt, Mycobacterium tuberculosis H37Rv
gcugcagcauggcuccgaagucc

SEQ ID NO: 1258923 - RNA, 15 nt, Mycobacterium tuberculosis H37Rv
gcugccuccaugacg

SEQ ID NO: 1258924 - RNA, 16 nt, Mycobacterium tuberculosis H37Rv
gcugccgucgcugccc

SEQ ID NO: 1258925 - RNA, 17 nt, Mycobacterium tuberculosis H37Rv
gcugccgucgcugcccc

SEQ ID NO: 1258926 - RNA, 21 nt, Mycobacterium tuberculosis H37Rv
gcugccgguagcacagcagca

SEQ ID NO: 1258927 - RNA, 16 nt, Mycobacterium tuberculosis H37Rv
gcugccgguagcacag

SEQ ID NO: 1258928 - RNA, 17 nt, Mycobacterium tuberculosis H37Rv
gcugccguauccaggcg

SEQ ID NO: 1258929 - RNA, 21 nt, Mycobacterium tuberculosis H37Rv
gcugcgaaagccacucgcgca

SEQ ID NO: 1258930 - RNA, 20 nt, Mycobacterium tuberculosis H37Rv
gcugcgaagccgagcaucag

SEQ ID NO: 1258931 - RNA, 22 nt, Mycobacterium tuberculosis H37Rv
gcugcgacaggacgucggcgaa

SEQ ID NO: 1258932 - RNA, 17 nt, Mycobacterium tuberculosis H37Rv
gcugaggcggcgacgac

SEQ ID NO: 1258933 - RNA, 15 nt, Mycobacterium tuberculosis H37Rv
gcugagcaggucucg

SEQ ID NO: 1258934 - RNA, 22 nt, Mycobacterium tuberculosis H37Rv
gcugagcaggucucguaucgca

SEQ ID NO: 1258935 - RNA, 16 nt, Mycobacterium tuberculosis H37Rv
gcugacgaucuccacc

SEQ ID NO: 1258936 - RNA, 21 nt, Mycobacterium tuberculosis H37Rv
gcugagacgguguugcucgcc

SEQ ID NO: 1258937 - RNA, 22 nt, Mycobacterium tuberculosis H37Rv
gcugagcacucaugaugccgga

SEQ ID NO: 1258938 - RNA, 17 nt, Mycobacterium tuberculosis H37Rv
gcugaccgcguagacca

SEQ ID NO: 1258939 - RNA, 15 nt, Mycobacterium tuberculosis H37Rv
gcugaccgccagcgg

SEQ ID NO: 1258940 - RNA, 17 nt, Mycobacterium tuberculosis H37Rv
gcugaccgacccggacc

SEQ ID NO: 1258941 - RNA, 23 nt, Mycobacterium tuberculosis H37Rv
gcugaccggggucggccugcggc

SEQ ID NO: 1258942 - RNA, 19 nt, Mycobacterium tuberculosis H37Rv
gcugaccggaucugacggc

SEQ ID NO: 1258943 - RNA, 23 nt, Mycobacterium tuberculosis H37Rv
gcugaccuucaggcccugccgac

SEQ ID NO: 1258944 - RNA, 23 nt, Mycobacterium tuberculosis H37Rv
gcugaccugggguguagccagcg

SEQ ID NO: 1258945 - RNA, 18 nt, Mycobacterium tuberculosis H37Rv
gcugaugggucaggccga

SEQ ID NO: 1258946 - RNA, 20 nt, Mycobacterium tuberculosis H37Rv
gcugaugcgguagucgccga

SEQ ID NO: 1258947 - RNA, 20 nt, Mycobacterium tuberculosis H37Rv
gcugauagcggucggucacc

SEQ ID NO: 1258948 - RNA, 14 nt, Mycobacterium tuberculosis H37Rv
gcugcaccgauucg

SEQ ID NO: 1258949 - RNA, 18 nt, Mycobacterium tuberculosis H37Rv
gcugaugucgccgguguc

SEQ ID NO: 1258950 - RNA, 18 nt, Mycobacterium tuberculosis H37Rv
gcugauguacccggcgac

SEQ ID NO: 1258951 - RNA, 14 nt, Mycobacterium tuberculosis H37Rv
gcugauggugccga

SEQ ID NO: 1258952 - RNA, 17 nt, Mycobacterium tuberculosis H37Rv
gcugcaaugacuggacc

SEQ ID NO: 1258953 - RNA, 15 nt, Mycobacterium tuberculosis H37Rv
gcugaacacgaaucc

SEQ ID NO: 1258954 - RNA, 17 nt, Mycobacterium tuberculosis H37Rv
gcucucgaguccaggca

SEQ ID NO: 1258955 - RNA, 19 nt, Mycobacterium tuberculosis H37Rv
gcugaacauuccggcaccu

SEQ ID NO: 1258956 - RNA, 21 nt, Mycobacterium tuberculosis H37Rv
gcugaauuggcgccgaugacc

SEQ ID NO: 1258957 - RNA, 19 nt, Mycobacterium tuberculosis H37Rv
gcugacacgacaugaccga

SEQ ID NO: 1258958 - RNA, 16 nt, Mycobacterium tuberculosis H37Rv
gcugaauuucgaugag

SEQ ID NO: 1258959 - RNA, 18 nt, Mycobacterium tuberculosis H37Rv
gcugacccauggucacca

SEQ ID NO: 1258960 - RNA, 14 nt, Mycobacterium tuberculosis H37Rv
gcugacccgcggua

SEQ ID NO: 1258961 - RNA, 18 nt, Mycobacterium tuberculosis H37Rv
gcugaccaugaccgggcu

SEQ ID NO: 1258962 - RNA, 18 nt, Mycobacterium tuberculosis H37Rv
gcucguuugcgagcaggg

SEQ ID NO: 1258963 - RNA, 21 nt, Mycobacterium tuberculosis H37Rv
gcucguggucgacgugaucgc

SEQ ID NO: 1258964 - RNA, 15 nt, Mycobacterium tuberculosis H37Rv
gcucgucgugaguca

SEQ ID NO: 1258965 - RNA, 14 nt, Mycobacterium tuberculosis H37Rv
gcucgucggucacc

SEQ ID NO: 1258966 - RNA, 13 nt, Mycobacterium tuberculosis H37Rv
gcucgucggucac

SEQ ID NO: 1258967 - RNA, 15 nt, Mycobacterium tuberculosis H37Rv
gcucgucgucggcgu

SEQ ID NO: 1258968 - RNA, 19 nt, Mycobacterium tuberculosis H37Rv
gcucgucguccggccacgg

SEQ ID NO: 1258969 - RNA, 19 nt, Mycobacterium tuberculosis H37Rv
gcucgucgucgauccagcc

SEQ ID NO: 1258970 - RNA, 15 nt, Mycobacterium tuberculosis H37Rv
gcucgucggucaccg

SEQ ID NO: 1258971 - RNA, 17 nt, Mycobacterium tuberculosis H37Rv
gcucgucguacaugggc

SEQ ID NO: 1258972 - RNA, 15 nt, Mycobacterium tuberculosis H37Rv
gcucgucgucaccga

SEQ ID NO: 1258973 - RNA, 12 nt, Mycobacterium tuberculosis H37Rv
gcucgugaccga

SEQ ID NO: 1258974 - RNA, 19 nt, Mycobacterium tuberculosis H37Rv
gcucgugaucuucggcgau

SEQ ID NO: 1258975 - RNA, 11 nt, Mycobacterium tuberculosis H37Rv
gcucgcugcag

SEQ ID NO: 1258976 - RNA, 19 nt, Mycobacterium tuberculosis H37Rv
gcucggccagcacgccgcc

SEQ ID NO: 1258977 - RNA, 20 nt, Mycobacterium tuberculosis H37Rv
gcucgcuucaggcaccggau

SEQ ID NO: 1258978 - RNA, 17 nt, Mycobacterium tuberculosis H37Rv
gcucgcugaaccggauc

SEQ ID NO: 1258979 - RNA, 17 nt, Mycobacterium tuberculosis H37Rv
gcucggccagccagcgg

SEQ ID NO: 1258980 - RNA, 10 nt, Mycobacterium tuberculosis H37Rv
gcucggcgau

SEQ ID NO: 1258981 - RNA, 20 nt, Mycobacterium tuberculosis H37Rv
gcucgcgccaggucggugac

SEQ ID NO: 1258982 - RNA, 12 nt, Mycobacterium tuberculosis H37Rv
gcucgcgcgcug

SEQ ID NO: 1258983 - RNA, 20 nt, Mycobacterium tuberculosis H37Rv
gcucgcgcucguuagcggcg

SEQ ID NO: 1258984 - RNA, 21 nt, Mycobacterium tuberculosis H37Rv
gcucgcgguaguuaacccagg

SEQ ID NO: 1258985 - RNA, 23 nt, Mycobacterium tuberculosis H37Rv
gcucgccgguaggcggccagcgc

SEQ ID NO: 1258986 - RNA, 16 nt, Mycobacterium tuberculosis H37Rv
gcucgcgcacgucgac

SEQ ID NO: 1258987 - RNA, 16 nt, Mycobacterium tuberculosis H37Rv
gcucgcgcaccgucau

SEQ ID NO: 1258988 - RNA, 20 nt, Mycobacterium tuberculosis H37Rv
gcucgcgaaggggcgguuac

SEQ ID NO: 1258989 - RNA, 21 nt, Mycobacterium tuberculosis H37Rv
gcucgccguaagcaccagcca

SEQ ID NO: 1258990 - RNA, 20 nt, Mycobacterium tuberculosis H37Rv
gcucgccguaagcaccagcc

SEQ ID NO: 1258991 - RNA, 17 nt, Mycobacterium tuberculosis H37Rv
gcucgccgugaccaggu

SEQ ID NO: 1258992 - RNA, 17 nt, Mycobacterium tuberculosis H37Rv
gcucgccguuauccgac

SEQ ID NO: 1258993 - RNA, 19 nt, Mycobacterium tuberculosis H37Rv
gcucgccguuauccgacga

SEQ ID NO: 1258994 - RNA, 21 nt, Mycobacterium tuberculosis H37Rv
gcucgccguuauccgacgaac

SEQ ID NO: 1258995 - RNA, 15 nt, Mycobacterium tuberculosis H37Rv
gcucgccagggucgc

SEQ ID NO: 1258996 - RNA, 16 nt, Mycobacterium tuberculosis H37Rv
gcucgcaaacaagauc

SEQ ID NO: 1258997 - RNA, 22 nt, Mycobacterium tuberculosis H37Rv
gcucgcccagugaaucggaccg

SEQ ID NO: 1258998 - RNA, 18 nt, Mycobacterium tuberculosis H37Rv
gcucgccgauaucugcca

SEQ ID NO: 1258999 - RNA, 14 nt, Mycobacterium tuberculosis H37Rv
gcucgccgaccagc

SEQ ID NO: 1259000 - RNA, 15 nt, Mycobacterium tuberculosis H37Rv
gcucgccgaggaaau

SEQ ID NO: 1259001 - RNA, 12 nt, Mycobacterium tuberculosis H37Rv
gcucgccagcac

SEQ ID NO: 1259002 - RNA, 14 nt, Mycobacterium tuberculosis H37Rv
gcucgccgggcagc

SEQ ID NO: 1259003 - RNA, 20 nt, Mycobacterium tuberculosis H37Rv
gcucgccgagcagacacaga

SEQ ID NO: 1259004 - RNA, 14 nt, Mycobacterium tuberculosis H37Rv
gcucgccggcgaac

SEQ ID NO: 1259005 - RNA, 13 nt, Mycobacterium tuberculosis H37Rv
gcucgccggcgaa

SEQ ID NO: 1259006 - RNA, 18 nt, Mycobacterium tuberculosis H37Rv
gcucgccgauuuggccgu

SEQ ID NO: 1259007 - RNA, 21 nt, Mycobacterium tuberculosis H37Rv
gcucgagcuacgacgaguggu

SEQ ID NO: 1259008 - RNA, 14 nt, Mycobacterium tuberculosis H37Rv
gcucgaggaccacc

SEQ ID NO: 1259009 - RNA, 20 nt, Mycobacterium tuberculosis H37Rv
gcucgaucugcccggugauc

SEQ ID NO: 1259010 - RNA, 14 nt, Mycobacterium tuberculosis H37Rv
gcucgaucugucgc

SEQ ID NO: 1259011 - RNA, 16 nt, Mycobacterium tuberculosis H37Rv
gcucgaucacuagcgc

SEQ ID NO: 1259012 - RNA, 22 nt, Mycobacterium tuberculosis H37Rv
gcucgaucacuagcgccccugg

SEQ ID NO: 1259013 - RNA, 19 nt, Mycobacterium tuberculosis H37Rv
gcucgauaucguuggcgac

SEQ ID NO: 1259014 - RNA, 16 nt, Mycobacterium tuberculosis H37Rv
gcucgaugcgaucgac

SEQ ID NO: 1259015 - RNA, 17 nt, Mycobacterium tuberculosis H37Rv
gcucgaugucagcggcc

SEQ ID NO: 1259016 - RNA, 12 nt, Mycobacterium tuberculosis H37Rv
gcucgcacagcc

SEQ ID NO: 1259017 - RNA, 15 nt, Mycobacterium tuberculosis H37Rv
gcucgcaccaccacg

SEQ ID NO: 1259018 - RNA, 17 nt, Mycobacterium tuberculosis H37Rv
gcucgcacagcaccacg

SEQ ID NO: 1259019 - RNA, 19 nt, Mycobacterium tuberculosis H37Rv
gcucgcacucguugccgac

SEQ ID NO: 1259020 - RNA, 20 nt, Mycobacterium tuberculosis H37Rv
gcucgcaggccggcggcggu

SEQ ID NO: 1259021 - RNA, 15 nt, Mycobacterium tuberculosis H37Rv
gcuccucgcgguagu

SEQ ID NO: 1259022 - RNA, 12 nt, Mycobacterium tuberculosis H37Rv
gcuccggccagg

SEQ ID NO: 1259023 - RNA, 21 nt, Mycobacterium tuberculosis H37Rv
gcuccgggaugaagcucgacc

SEQ ID NO: 1259024 - RNA, 16 nt, Mycobacterium tuberculosis H37Rv
gcuccgggucgacgac

SEQ ID NO: 1259025 - RNA, 19 nt, Mycobacterium tuberculosis H37Rv
gcuccuuggcccagcggua

SEQ ID NO: 1259026 - RNA, 14 nt, Mycobacterium tuberculosis H37Rv
gcuccuugagguca

SEQ ID NO: 1259027 - RNA, 23 nt, Mycobacterium tuberculosis H37Rv
gcucgaaacggauuggucgaccg

SEQ ID NO: 1259028 - RNA, 15 nt, Mycobacterium tuberculosis H37Rv
gcucgaaauccuggu

SEQ ID NO: 1259029 - RNA, 16 nt, Mycobacterium tuberculosis H37Rv
gcucgaaacgcccuug

SEQ ID NO: 1259030 - RNA, 18 nt, Mycobacterium tuberculosis H37Rv
gcucgacguacagcgcgg

SEQ ID NO: 1259031 - RNA, 19 nt, Mycobacterium tuberculosis H37Rv
gcucgacggcuccgauucc

SEQ ID NO: 1259032 - RNA, 20 nt, Mycobacterium tuberculosis H37Rv
gcucgacgaucugcagcacu

SEQ ID NO: 1259033 - RNA, 17 nt, Mycobacterium tuberculosis H37Rv
gcucgacgaucugcagc

SEQ ID NO: 1259034 - RNA, 20 nt, Mycobacterium tuberculosis H37Rv
gcucgaccugaggcaccucg

SEQ ID NO: 1259035 - RNA, 16 nt, Mycobacterium tuberculosis H37Rv
gcucgaauacaccuug

SEQ ID NO: 1259036 - RNA, 12 nt, Mycobacterium tuberculosis H37Rv
gcucgaaggacc

SEQ ID NO: 1259037 - RNA, 18 nt, Mycobacterium tuberculosis H37Rv
gcucgaaaucgcacagcg

SEQ ID NO: 1259038 - RNA, 17 nt, Mycobacterium tuberculosis H37Rv
gcucgacaaccacggca

SEQ ID NO: 1259039 - RNA, 12 nt, Mycobacterium tuberculosis H37Rv
gcucgacaacug

SEQ ID NO: 1259040 - RNA, 17 nt, Mycobacterium tuberculosis H37Rv
gcucgaccagacgcugc

SEQ ID NO: 1259041 - RNA, 11 nt, Mycobacterium tuberculosis H37Rv
gcucgacaacc

SEQ ID NO: 1259042 - RNA, 21 nt, Mycobacterium tuberculosis H37Rv
gcucgaccagacgcugcccaa

SEQ ID NO: 1259043 - RNA, 12 nt, Mycobacterium tuberculosis H37Rv
gcucgaccagga

SEQ ID NO: 1259044 - RNA, 16 nt, Mycobacterium tuberculosis H37Rv
gcuccgaaguccacgc

SEQ ID NO: 1259045 - RNA, 20 nt, Mycobacterium tuberculosis H37Rv
gcucccugggcgucgaccac

SEQ ID NO: 1259046 - RNA, 18 nt, Mycobacterium tuberculosis H37Rv
gcuccgaugcaucggugc

SEQ ID NO: 1259047 - RNA, 21 nt, Mycobacterium tuberculosis H37Rv
gcuccgagggcugcguggcgg

SEQ ID NO: 1259048 - RNA, 23 nt, Mycobacterium tuberculosis H37Rv
gcuccgauuccgaacuggucgac

SEQ ID NO: 1259049 - RNA, 20 nt, Mycobacterium tuberculosis H37Rv
gcuccccggauuccucguca

SEQ ID NO: 1259050 - RNA, 15 nt, Mycobacterium tuberculosis H37Rv
gcucccggccgccga

SEQ ID NO: 1259051 - RNA, 13 nt, Mycobacterium tuberculosis H37Rv
gcucccgccggca

SEQ ID NO: 1259052 - RNA, 20 nt, Mycobacterium tuberculosis H37Rv
gcucccggcuucuugaccac

SEQ ID NO: 1259053 - RNA, 23 nt, Mycobacterium tuberculosis H37Rv
gcucccgucucgacaguggcgac

SEQ ID NO: 1259054 - RNA, 15 nt, Mycobacterium tuberculosis H37Rv
gcuccgcgccgcuca

SEQ ID NO: 1259055 - RNA, 19 nt, Mycobacterium tuberculosis H37Rv
gcuccgcgccgcucaucgg

SEQ ID NO: 1259056 - RNA, 19 nt, Mycobacterium tuberculosis H37Rv
gcuccgccguugacgccgu

SEQ ID NO: 1259057 - RNA, 14 nt, Mycobacterium tuberculosis H37Rv
gcuccgccgucgcc

SEQ ID NO: 1259058 - RNA, 14 nt, Mycobacterium tuberculosis H37Rv
gcuccggcucgaca

SEQ ID NO: 1259059 - RNA, 12 nt, Mycobacterium tuberculosis H37Rv
gcucccacggca

SEQ ID NO: 1259060 - RNA, 23 nt, Mycobacterium tuberculosis H37Rv
gcuacacccguagaccuucgagu

SEQ ID NO: 1259061 - RNA, 21 nt, Mycobacterium tuberculosis H37Rv
gcgccacugaccgcgaucgcc

SEQ ID NO: 1259062 - RNA, 16 nt, Mycobacterium tuberculosis H37Rv
gcgccacugcuuccgg

SEQ ID NO: 1259063 - RNA, 14 nt, Mycobacterium tuberculosis H37Rv
gcgccacggcagcg

SEQ ID NO: 1259064 - RNA, 18 nt, Mycobacterium tuberculosis H37Rv
gcgccagaucaccgucga

SEQ ID NO: 1259065 - RNA, 20 nt, Mycobacterium tuberculosis H37Rv
gcgccagaucaccgucgaca

SEQ ID NO: 1259066 - RNA, 21 nt, Mycobacterium tuberculosis H37Rv
gcgccagaucaccgucgacag

SEQ ID NO: 1259067 - RNA, 17 nt, Mycobacterium tuberculosis H37Rv
gcgccagaucaccgucg

SEQ ID NO: 1259068 - RNA, 21 nt, Mycobacterium tuberculosis H37Rv
gcgccagcacaaccaucgcga

SEQ ID NO: 1259069 - RNA, 20 nt, Mycobacterium tuberculosis H37Rv
gcgccacggcagcgcccaga

SEQ ID NO: 1259070 - RNA, 14 nt, Mycobacterium tuberculosis H37Rv
gcgccacgucgacg

SEQ ID NO: 1259071 - RNA, 19 nt, Mycobacterium tuberculosis H37Rv
gcgccacggugucgucgac

SEQ ID NO: 1259072 - RNA, 21 nt, Mycobacterium tuberculosis H37Rv
gcgcaucugucgcgcggcaau

SEQ ID NO: 1259073 - RNA, 13 nt, Mycobacterium tuberculosis H37Rv
gcgcaucugucgc

SEQ ID NO: 1259074 - RNA, 18 nt, Mycobacterium tuberculosis H37Rv
gcgcaucggccagcagcg

SEQ ID NO: 1259075 - RNA, 14 nt, Mycobacterium tuberculosis H37Rv
gcgcaucugcucgg

SEQ ID NO: 1259076 - RNA, 13 nt, Mycobacterium tuberculosis H37Rv
gcgccagcgccgc

SEQ ID NO: 1259077 - RNA, 15 nt, Mycobacterium tuberculosis H37Rv
gcgccaggcaccacg

SEQ ID NO: 1259078 - RNA, 21 nt, Mycobacterium tuberculosis H37Rv
gcgccaguaacgcccacaaug

SEQ ID NO: 1259079 - RNA, 17 nt, Mycobacterium tuberculosis H37Rv
gcgccaggccgcacagc

SEQ ID NO: 1259080 - RNA, 22 nt, Mycobacterium tuberculosis H37Rv
gcgccaggccacguagcagcgc

SEQ ID NO: 1259081 - RNA, 12 nt, Mycobacterium tuberculosis H37Rv
gcgccaggccgu

SEQ ID NO: 1259082 - RNA, 14 nt, Mycobacterium tuberculosis H37Rv
gcgcccagcgaccc

SEQ ID NO: 1259083 - RNA, 17 nt, Mycobacterium tuberculosis H37Rv
gcgcccagcucgucgag

SEQ ID NO: 1259084 - RNA, 19 nt, Mycobacterium tuberculosis H37Rv
gcgcccaggccgaucagcg

SEQ ID NO: 1259085 - RNA, 22 nt, Mycobacterium tuberculosis H37Rv
gcgcccaucgcgacggcccgau

SEQ ID NO: 1259086 - RNA, 20 nt, Mycobacterium tuberculosis H37Rv
gcgcccaucgcgacggcccg

SEQ ID NO: 1259087 - RNA, 18 nt, Mycobacterium tuberculosis H37Rv
gcgcccgacggaguucga

SEQ ID NO: 1259088 - RNA, 14 nt, Mycobacterium tuberculosis H37Rv
gcgcccccagcagc

SEQ ID NO: 1259089 - RNA, 14 nt, Mycobacterium tuberculosis H37Rv
gcgcccgagccggu

SEQ ID NO: 1259090 - RNA, 22 nt, Mycobacterium tuberculosis H37Rv
gcgccaguucggcgggagcugc

SEQ ID NO: 1259091 - RNA, 18 nt, Mycobacterium tuberculosis H37Rv
gcgccaguggccaccauc

SEQ ID NO: 1259092 - RNA, 13 nt, Mycobacterium tuberculosis H37Rv
gcgccagugcggu

SEQ ID NO: 1259093 - RNA, 14 nt, Mycobacterium tuberculosis H37Rv
gcgccaguagcacg

SEQ ID NO: 1259094 - RNA, 13 nt, Mycobacterium tuberculosis H37Rv
gcgccagugccuc

SEQ ID NO: 1259095 - RNA, 17 nt, Mycobacterium tuberculosis H37Rv
gcgccauucgccccacc

SEQ ID NO: 1259096 - RNA, 21 nt, Mycobacterium tuberculosis H37Rv
gcgccauucgcccggccgcag

SEQ ID NO: 1259097 - RNA, 19 nt, Mycobacterium tuberculosis H37Rv
gcgccauagccgcgacccg

SEQ ID NO: 1259098 - RNA, 18 nt, Mycobacterium tuberculosis H37Rv
gcgccauuggcgucccgc

SEQ ID NO: 1259099 - RNA, 20 nt, Mycobacterium tuberculosis H37Rv
gcgccauugcgggaacguca

SEQ ID NO: 1259100 - RNA, 12 nt, Mycobacterium tuberculosis H37Rv
gcgccauuucga

SEQ ID NO: 1259101 - RNA, 16 nt, Mycobacterium tuberculosis H37Rv
gcgcccagaucgccga

SEQ ID NO: 1259102 - RNA, 18 nt, Mycobacterium tuberculosis H37Rv
gcgcccaccccggccgca

SEQ ID NO: 1259103 - RNA, 14 nt, Mycobacterium tuberculosis H37Rv
gcgcccaccgaaac

SEQ ID NO: 1259104 - RNA, 15 nt, Mycobacterium tuberculosis H37Rv
gcgcccaauccaccg

SEQ ID NO: 1259105 - RNA, 23 nt, Mycobacterium tuberculosis H37Rv
gcgcccaauccaccgauucggcg

SEQ ID NO: 1259106 - RNA, 19 nt, Mycobacterium tuberculosis H37Rv
gcgccgaaguagccgaccg

SEQ ID NO: 1259107 - RNA, 15 nt, Mycobacterium tuberculosis H37Rv
gcgccgaaugccacc

SEQ ID NO: 1259108 - RNA, 15 nt, Mycobacterium tuberculosis H37Rv
gcgccgacagccgau

SEQ ID NO: 1259109 - RNA, 14 nt, Mycobacterium tuberculosis H37Rv
gcgccgacagccga

SEQ ID NO: 1259110 - RNA, 12 nt, Mycobacterium tuberculosis H37Rv
gcgccgacaccg

SEQ ID NO: 1259111 - RNA, 14 nt, Mycobacterium tuberculosis H37Rv
gcgcccgcaccacc

SEQ ID NO: 1259112 - RNA, 20 nt, Mycobacterium tuberculosis H37Rv
gcgcccggccacuccaguac

SEQ ID NO: 1259113 - RNA, 12 nt, Mycobacterium tuberculosis H37Rv
gcgcccggccac

SEQ ID NO: 1259114 - RNA, 19 nt, Mycobacterium tuberculosis H37Rv
gcgcccggauguccgccga

SEQ ID NO: 1259115 - RNA, 12 nt, Mycobacterium tuberculosis H37Rv
gcgcccgcucgg

SEQ ID NO: 1259116 - RNA, 19 nt, Mycobacterium tuberculosis H37Rv
gcgccgauuccaccgccga

SEQ ID NO: 1259117 - RNA, 15 nt, Mycobacterium tuberculosis H37Rv
gcgccgcauccagcc

SEQ ID NO: 1259118 - RNA, 20 nt, Mycobacterium tuberculosis H37Rv
gcgccgauguggccggcgau

SEQ ID NO: 1259119 - RNA, 17 nt, Mycobacterium tuberculosis H37Rv
gcgccgaugccggccaa

SEQ ID NO: 1259120 - RNA, 15 nt, Mycobacterium tuberculosis H37Rv
gcgccgagcucggcg

SEQ ID NO: 1259121 - RNA, 15 nt, Mycobacterium tuberculosis H37Rv
gcgccgagcgugaag

SEQ ID NO: 1259122 - RNA, 21 nt, Mycobacterium tuberculosis H37Rv
gcgccgagaucgacaucguug

SEQ ID NO: 1259123 - RNA, 17 nt, Mycobacterium tuberculosis H37Rv
gcgccgagauccacgcc

SEQ ID NO: 1259124 - RNA, 16 nt, Mycobacterium tuberculosis H37Rv
gcgccgagauccacgc

SEQ ID NO: 1259125 - RNA, 20 nt, Mycobacterium tuberculosis H37Rv
gcgccgcgacaaaucggucg

SEQ ID NO: 1259126 - RNA, 21 nt, Mycobacterium tuberculosis H37Rv
gcgccgcgacaaaucggucga

SEQ ID NO: 1259127 - RNA, 19 nt, Mycobacterium tuberculosis H37Rv
gcgccgccucgggcaccug

SEQ ID NO: 1259128 - RNA, 15 nt, Mycobacterium tuberculosis H37Rv
gcgccgcgcccacca

SEQ ID NO: 1259129 - RNA, 17 nt, Mycobacterium tuberculosis H37Rv
gcgccgcgcccaccaug

SEQ ID NO: 1259130 - RNA, 16 nt, Mycobacterium tuberculosis H37Rv
gcgccgccguugccga

SEQ ID NO: 1259131 - RNA, 17 nt, Mycobacterium tuberculosis H37Rv
gcgccgccguugccgau

SEQ ID NO: 1259132 - RNA, 15 nt, Mycobacterium tuberculosis H37Rv
gcgccgccguccagc

SEQ ID NO: 1259133 - RNA, 20 nt, Mycobacterium tuberculosis H37Rv
gcgccgccaacuccucagcc

SEQ ID NO: 1259134 - RNA, 14 nt, Mycobacterium tuberculosis H37Rv
gcgccgcauucgcg

SEQ ID NO: 1259135 - RNA, 15 nt, Mycobacterium tuberculosis H37Rv
gcgccgcauucgcga

SEQ ID NO: 1259136 - RNA, 18 nt, Mycobacterium tuberculosis H37Rv
gcgccgcauucgcgacaa

SEQ ID NO: 1259137 - RNA, 18 nt, Mycobacterium tuberculosis H37Rv
gcgccgcggcccgcucca

SEQ ID NO: 1259138 - RNA, 12 nt, Mycobacterium tuberculosis H37Rv
gcgccgcggcua

SEQ ID NO: 1259139 - RNA, 17 nt, Mycobacterium tuberculosis H37Rv
gcgccgcguugucggcg

SEQ ID NO: 1259140 - RNA, 20 nt, Mycobacterium tuberculosis H37Rv
gcgccgcggcuacaucggcg

SEQ ID NO: 1259141 - RNA, 21 nt, Mycobacterium tuberculosis H37Rv
gcgccgcguggcuggcggcga

SEQ ID NO: 1259142 - RNA, 13 nt, Mycobacterium tuberculosis H37Rv
gcgcaucaacgga

SEQ ID NO: 1259143 - RNA, 17 nt, Mycobacterium tuberculosis H37Rv
gcgcaucaucgcccacc

SEQ ID NO: 1259144 - RNA, 14 nt, Mycobacterium tuberculosis H37Rv
gcgcauccacaauc

SEQ ID NO: 1259145 - RNA, 18 nt, Mycobacterium tuberculosis H37Rv
gcgcaguuggcaccagcc

SEQ ID NO: 1259146 - RNA, 18 nt, Mycobacterium tuberculosis H37Rv
gcgcaguuguacggcacu

SEQ ID NO: 1259147 - RNA, 17 nt, Mycobacterium tuberculosis H37Rv
gcgcaucgccgacagcg

SEQ ID NO: 1259148 - RNA, 14 nt, Mycobacterium tuberculosis H37Rv
gcgcaucgccgaca

SEQ ID NO: 1259149 - RNA, 17 nt, Mycobacterium tuberculosis H37Rv
gcgcaucggccagcagc

SEQ ID NO: 1259150 - RNA, 18 nt, Mycobacterium tuberculosis H37Rv
gcgcaguagccgaccagg

SEQ ID NO: 1259151 - RNA, 13 nt, Mycobacterium tuberculosis H37Rv
gcgcaggugcugg

SEQ ID NO: 1259152 - RNA, 17 nt, Mycobacterium tuberculosis H37Rv
gcgcaguuggcaccagc

SEQ ID NO: 1259153 - RNA, 15 nt, Mycobacterium tuberculosis H37Rv
gcgcagugcagguca

SEQ ID NO: 1259154 - RNA, 22 nt, Mycobacterium tuberculosis H37Rv
gcgcagguagccaucggugcgc

SEQ ID NO: 1259155 - RNA, 18 nt, Mycobacterium tuberculosis H37Rv
gcgcagggcgucggcgaa

SEQ ID NO: 1259156 - RNA, 16 nt, Mycobacterium tuberculosis H37Rv
gcgcagggcgucggcg

SEQ ID NO: 1259157 - RNA, 22 nt, Mycobacterium tuberculosis H37Rv
gcgcaggaagcccacgaucgcg

SEQ ID NO: 1259158 - RNA, 19 nt, Mycobacterium tuberculosis H37Rv
gcgcagcuaugucaccugg

SEQ ID NO: 1259159 - RNA, 17 nt, Mycobacterium tuberculosis H37Rv
gcgcagcuuggccagcc

SEQ ID NO: 1259160 - RNA, 22 nt, Mycobacterium tuberculosis H37Rv
gcgcaggagcgcgaugaccucg

SEQ ID NO: 1259161 - RNA, 14 nt, Mycobacterium tuberculosis H37Rv
gcgcagcgccagcg

SEQ ID NO: 1259162 - RNA, 13 nt, Mycobacterium tuberculosis H37Rv
gcgcagcgccagc

SEQ ID NO: 1259163 - RNA, 16 nt, Mycobacterium tuberculosis H37Rv
gcgcagcgacgcggug

SEQ ID NO: 1259164 - RNA, 21 nt, Mycobacterium tuberculosis H37Rv
gcgcagcgccugcggcagcac

SEQ ID NO: 1259165 - RNA, 16 nt, Mycobacterium tuberculosis H37Rv
gcgcagcgcgaucgcg

SEQ ID NO: 1259166 - RNA, 16 nt, Mycobacterium tuberculosis H37Rv
gcgcagcgccggcagc

SEQ ID NO: 1259167 - RNA, 22 nt, Mycobacterium tuberculosis H37Rv
gcgcacccgcgggucguccggc

SEQ ID NO: 1259168 - RNA, 15 nt, Mycobacterium tuberculosis H37Rv
gcgcaccccggcaua

SEQ ID NO: 1259169 - RNA, 15 nt, Mycobacterium tuberculosis H37Rv
gcgcacccggucggc

SEQ ID NO: 1259170 - RNA, 17 nt, Mycobacterium tuberculosis H37Rv
gcgcaccgaccgcaccg

SEQ ID NO: 1259171 - RNA, 18 nt, Mycobacterium tuberculosis H37Rv
gcgcacccugcgugcggc

SEQ ID NO: 1259172 - RNA, 20 nt, Mycobacterium tuberculosis H37Rv
gcgcacccggucggcggcau

SEQ ID NO: 1259173 - RNA, 13 nt, Mycobacterium tuberculosis H37Rv
gcgauaucgcaca

SEQ ID NO: 1259174 - RNA, 22 nt, Mycobacterium tuberculosis H37Rv
gcgauauccacaauccgcucgg

SEQ ID NO: 1259175 - RNA, 19 nt, Mycobacterium tuberculosis H37Rv
gcgaucaaccgcugucacc

SEQ ID NO: 1259176 - RNA, 15 nt, Mycobacterium tuberculosis H37Rv
gcgaucaacggaucg

SEQ ID NO: 1259177 - RNA, 18 nt, Mycobacterium tuberculosis H37Rv
gcgaucacccccuggacu

SEQ ID NO: 1259178 - RNA, 15 nt, Mycobacterium tuberculosis H37Rv
gcgcaccggucaacg

SEQ ID NO: 1259179 - RNA, 17 nt, Mycobacterium tuberculosis H37Rv
gcgcaccucggcgaagu

SEQ ID NO: 1259180 - RNA, 12 nt, Mycobacterium tuberculosis H37Rv
gcgcaccgucgc

SEQ ID NO: 1259181 - RNA, 22 nt, Mycobacterium tuberculosis H37Rv
gcgcaccggaucgccgucgcga

SEQ ID NO: 1259182 - RNA, 18 nt, Mycobacterium tuberculosis H37Rv
gcgcaccuugaccgucgc

SEQ ID NO: 1259183 - RNA, 11 nt, Mycobacterium tuberculosis H37Rv
gcgcagcagcg

SEQ ID NO: 1259184 - RNA, 14 nt, Mycobacterium tuberculosis H37Rv
gcgcagcagcggca

SEQ ID NO: 1259185 - RNA, 15 nt, Mycobacterium tuberculosis H37Rv
gcgcagcaucggcga

SEQ ID NO: 1259186 - RNA, 21 nt, Mycobacterium tuberculosis H37Rv
gcgcagcaucuccgccggucc

SEQ ID NO: 1259187 - RNA, 15 nt, Mycobacterium tuberculosis H37Rv
gcgcagcagugccgu

SEQ ID NO: 1259188 - RNA, 14 nt, Mycobacterium tuberculosis H37Rv
gcgcagcaucggcg

SEQ ID NO: 1259189 - RNA, 23 nt, Mycobacterium tuberculosis H37Rv
gcgcagauuccucuucaggcccu

SEQ ID NO: 1259190 - RNA, 23 nt, Mycobacterium tuberculosis H37Rv
gcgcagcaacgcaaucgucgccu

SEQ ID NO: 1259191 - RNA, 15 nt, Mycobacterium tuberculosis H37Rv
gcgcagaucguccac

SEQ ID NO: 1259192 - RNA, 16 nt, Mycobacterium tuberculosis H37Rv
gcgcagaucguccacc

SEQ ID NO: 1259193 - RNA, 13 nt, Mycobacterium tuberculosis H37Rv
gcgcagcaccagg

SEQ ID NO: 1259194 - RNA, 18 nt, Mycobacterium tuberculosis H37Rv
gcgcagcacugcggcagc

SEQ ID NO: 1259195 - RNA, 22 nt, Mycobacterium tuberculosis H37Rv
gcgcagcaccgucggcaccagc

SEQ ID NO: 1259196 - RNA, 14 nt, Mycobacterium tuberculosis H37Rv
gcgcacgucgacga

SEQ ID NO: 1259197 - RNA, 15 nt, Mycobacterium tuberculosis H37Rv
gcgcacggcgucggc

SEQ ID NO: 1259198 - RNA, 18 nt, Mycobacterium tuberculosis H37Rv
gcgcacggcgucggccac

SEQ ID NO: 1259199 - RNA, 18 nt, Mycobacterium tuberculosis H37Rv
gcgcacggcggcccacgc

SEQ ID NO: 1259200 - RNA, 23 nt, Mycobacterium tuberculosis H37Rv
gcgcacuggggaggccaacccug

SEQ ID NO: 1259201 - RNA, 23 nt, Mycobacterium tuberculosis H37Rv
gcgcacucuuuccuuccgcgaug

SEQ ID NO: 1259202 - RNA, 13 nt, Mycobacterium tuberculosis H37Rv
gcgcacuaccgcc

SEQ ID NO: 1259203 - RNA, 16 nt, Mycobacterium tuberculosis H37Rv
gcgcagacucgccacc

SEQ ID NO: 1259204 - RNA, 22 nt, Mycobacterium tuberculosis H37Rv
gcgcagaaagucgcgcgcgaac

SEQ ID NO: 1259205 - RNA, 16 nt, Mycobacterium tuberculosis H37Rv
gcgcagauagcgcucg

SEQ ID NO: 1259206 - RNA, 22 nt, Mycobacterium tuberculosis H37Rv
gcgcagauagcgcucgaacucg

SEQ ID NO: 1259207 - RNA, 17 nt, Mycobacterium tuberculosis H37Rv
gcgcagagucaacgucg

SEQ ID NO: 1259208 - RNA, 19 nt, Mycobacterium tuberculosis H37Rv
gcgccuuaggcguccgagc

SEQ ID NO: 1259209 - RNA, 15 nt, Mycobacterium tuberculosis H37Rv
gcgccuuccacggag

SEQ ID NO: 1259210 - RNA, 13 nt, Mycobacterium tuberculosis H37Rv
gcgccucggugac

SEQ ID NO: 1259211 - RNA, 19 nt, Mycobacterium tuberculosis H37Rv
gcgccucggugacgucgcc

SEQ ID NO: 1259212 - RNA, 19 nt, Mycobacterium tuberculosis H37Rv
gcgccucgccggccacccg

SEQ ID NO: 1259213 - RNA, 14 nt, Mycobacterium tuberculosis H37Rv
gcgccucgcccagc

SEQ ID NO: 1259214 - RNA, 15 nt, Mycobacterium tuberculosis H37Rv
gcgccguggcaucgc

SEQ ID NO: 1259215 - RNA, 21 nt, Mycobacterium tuberculosis H37Rv
gcgccggauacaccggcaccg

SEQ ID NO: 1259216 - RNA, 17 nt, Mycobacterium tuberculosis H37Rv
gcgccggagaucgucgc

SEQ ID NO: 1259217 - RNA, 15 nt, Mycobacterium tuberculosis H37Rv
gcgccggaccagcuc

SEQ ID NO: 1259218 - RNA, 16 nt, Mycobacterium tuberculosis H37Rv
gcgccgcuggucgugg

SEQ ID NO: 1259219 - RNA, 14 nt, Mycobacterium tuberculosis H37Rv
gcgccggaccgucu

SEQ ID NO: 1259220 - RNA, 15 nt, Mycobacterium tuberculosis H37Rv
gcgccgcuuggcgau

SEQ ID NO: 1259221 - RNA, 20 nt, Mycobacterium tuberculosis H37Rv
gcgccguugucggcggugaa

SEQ ID NO: 1259222 - RNA, 16 nt, Mycobacterium tuberculosis H37Rv
gcgccguuggcgccaa

SEQ ID NO: 1259223 - RNA, 19 nt, Mycobacterium tuberculosis H37Rv
gcgccuaaccccggcucga

SEQ ID NO: 1259224 - RNA, 22 nt, Mycobacterium tuberculosis H37Rv
gcgccguugccgccgucgccgc

SEQ ID NO: 1259225 - RNA, 21 nt, Mycobacterium tuberculosis H37Rv
gcgccguugccgcccacgcug

SEQ ID NO: 1259226 - RNA, 14 nt, Mycobacterium tuberculosis H37Rv
gcgccguugccgcc

SEQ ID NO: 1259227 - RNA, 13 nt, Mycobacterium tuberculosis H37Rv
gcgccguugccgc

SEQ ID NO: 1259228 - RNA, 17 nt, Mycobacterium tuberculosis H37Rv
gcgccuaccagcaccgg

SEQ ID NO: 1259229 - RNA, 13 nt, Mycobacterium tuberculosis H37Rv
gcgcgcacggcgu

SEQ ID NO: 1259230 - RNA, 15 nt, Mycobacterium tuberculosis H37Rv
gcgcgagccgcacga

SEQ ID NO: 1259231 - RNA, 17 nt, Mycobacterium tuberculosis H37Rv
gcgcgagcagacgcaga

SEQ ID NO: 1259232 - RNA, 13 nt, Mycobacterium tuberculosis H37Rv
gcgcgagcagacg

SEQ ID NO: 1259233 - RNA, 14 nt, Mycobacterium tuberculosis H37Rv
gcgcgacguccacc

SEQ ID NO: 1259234 - RNA, 22 nt, Mycobacterium tuberculosis H37Rv
gcgcgacguagacgacgucggc

SEQ ID NO: 1259235 - RNA, 24 nt, Mycobacterium tuberculosis H37Rv
gcgcgaccuccgcgaucaccgacg

SEQ ID NO: 1259236 - RNA, 16 nt, Mycobacterium tuberculosis H37Rv
gcgcgaccgaccagcc

SEQ ID NO: 1259237 - RNA, 18 nt, Mycobacterium tuberculosis H37Rv
gcgcgaccgaccagccgu

SEQ ID NO: 1259238 - RNA, 14 nt, Mycobacterium tuberculosis H37Rv
gcgcgacgagcaug

SEQ ID NO: 1259239 - RNA, 19 nt, Mycobacterium tuberculosis H37Rv
gcgcgaccucgcuggccgc

SEQ ID NO: 1259240 - RNA, 15 nt, Mycobacterium tuberculosis H37Rv
gcgcgaccgaccagc

SEQ ID NO: 1259241 - RNA, 14 nt, Mycobacterium tuberculosis H37Rv
gcgcgaccagaauc

SEQ ID NO: 1259242 - RNA, 15 nt, Mycobacterium tuberculosis H37Rv
gcgccuuggccagcg

SEQ ID NO: 1259243 - RNA, 22 nt, Mycobacterium tuberculosis H37Rv
gcgccuuggccagcgcguuguc

SEQ ID NO: 1259244 - RNA, 13 nt, Mycobacterium tuberculosis H37Rv
gcgccuuggucgc

SEQ ID NO: 1259245 - RNA, 12 nt, Mycobacterium tuberculosis H37Rv
gcgccuugacgc

SEQ ID NO: 1259246 - RNA, 16 nt, Mycobacterium tuberculosis H37Rv
gcgccuugaagcggug

SEQ ID NO: 1259247 - RNA, 14 nt, Mycobacterium tuberculosis H37Rv
gcgccuucgccagc

SEQ ID NO: 1259248 - RNA, 16 nt, Mycobacterium tuberculosis H37Rv
gcgcgccgcagcgcgu

SEQ ID NO: 1259249 - RNA, 14 nt, Mycobacterium tuberculosis H37Rv
gcgcgccgaucgag

SEQ ID NO: 1259250 - RNA, 14 nt, Mycobacterium tuberculosis H37Rv
gcgcgccgaguugc

SEQ ID NO: 1259251 - RNA, 16 nt, Mycobacterium tuberculosis H37Rv
gcgcgccgaccagaac

SEQ ID NO: 1259252 - RNA, 21 nt, Mycobacterium tuberculosis H37Rv
gcgcgccaaacaccccggccu

SEQ ID NO: 1259253 - RNA, 20 nt, Mycobacterium tuberculosis H37Rv
gcgcgcauuuuucgccagcu

SEQ ID NO: 1259254 - RNA, 20 nt, Mycobacterium tuberculosis H37Rv
gcgcgcccggaucucggcgu

SEQ ID NO: 1259255 - RNA, 22 nt, Mycobacterium tuberculosis H37Rv
gcgcgccaaucgcccagugugc

SEQ ID NO: 1259256 - RNA, 16 nt, Mycobacterium tuberculosis H37Rv
gcgcgccugugccacc

SEQ ID NO: 1259257 - RNA, 20 nt, Mycobacterium tuberculosis H37Rv
gcgcgccuuggccagcgcgu

SEQ ID NO: 1259258 - RNA, 13 nt, Mycobacterium tuberculosis H37Rv
gcgcgccgucggg

SEQ ID NO: 1259259 - RNA, 14 nt, Mycobacterium tuberculosis H37Rv
gcgcgccgucgggu

SEQ ID NO: 1259260 - RNA, 19 nt, Mycobacterium tuberculosis H37Rv
gcgcgccggcgacccgggu

SEQ ID NO: 1259261 - RNA, 19 nt, Mycobacterium tuberculosis H37Rv
gcgcgccgguuggccagug

SEQ ID NO: 1259262 - RNA, 23 nt, Mycobacterium tuberculosis H37Rv
gcgcgcuacgcggccgaggucac

SEQ ID NO: 1259263 - RNA, 16 nt, Mycobacterium tuberculosis H37Rv
gcgcgcucaucgaccg

SEQ ID NO: 1259264 - RNA, 18 nt, Mycobacterium tuberculosis H37Rv
gcgcgcucaacggcgaaa

SEQ ID NO: 1259265 - RNA, 15 nt, Mycobacterium tuberculosis H37Rv
gcgcgcucggccagc

SEQ ID NO: 1259266 - RNA, 18 nt, Mycobacterium tuberculosis H37Rv
gcgcgcugagcucgaugu

SEQ ID NO: 1259267 - RNA, 19 nt, Mycobacterium tuberculosis H37Rv
gcgcgcugggaagcucggu

SEQ ID NO: 1259268 - RNA, 21 nt, Mycobacterium tuberculosis H37Rv
gcgcgcugggaggcggcgcca

SEQ ID NO: 1259269 - RNA, 15 nt, Mycobacterium tuberculosis H37Rv
gcgcgcuggccagcc

SEQ ID NO: 1259270 - RNA, 12 nt, Mycobacterium tuberculosis H37Rv
gcgcgcggcgac

SEQ ID NO: 1259271 - RNA, 15 nt, Mycobacterium tuberculosis H37Rv
gcgcgcggcucgggu

SEQ ID NO: 1259272 - RNA, 20 nt, Mycobacterium tuberculosis H37Rv
gcgcgcgaccauacccgcgc

SEQ ID NO: 1259273 - RNA, 14 nt, Mycobacterium tuberculosis H37Rv
gcgcgcgacacgag

SEQ ID NO: 1259274 - RNA, 14 nt, Mycobacterium tuberculosis H37Rv
gcgcgggucggcga

SEQ ID NO: 1259275 - RNA, 15 nt, Mycobacterium tuberculosis H37Rv
gcgcgggccaccacg

SEQ ID NO: 1259276 - RNA, 15 nt, Mycobacterium tuberculosis H37Rv
gcgcggggcggccug

SEQ ID NO: 1259277 - RNA, 16 nt, Mycobacterium tuberculosis H37Rv
gcgcggugaccggguu

SEQ ID NO: 1259278 - RNA, 19 nt, Mycobacterium tuberculosis H37Rv
gcgcggguugucggcgacc

SEQ ID NO: 1259279 - RNA, 19 nt, Mycobacterium tuberculosis H37Rv
gcgcgggugcaaccggauu

SEQ ID NO: 1259280 - RNA, 23 nt, Mycobacterium tuberculosis H37Rv
gcgcgggugguucaccucggcga

SEQ ID NO: 1259281 - RNA, 16 nt, Mycobacterium tuberculosis H37Rv
gcgcggguggcgccag

SEQ ID NO: 1259282 - RNA, 14 nt, Mycobacterium tuberculosis H37Rv
gcgcguacccgauc

SEQ ID NO: 1259283 - RNA, 15 nt, Mycobacterium tuberculosis H37Rv
gcgcguacccgauca

SEQ ID NO: 1259284 - RNA, 21 nt, Mycobacterium tuberculosis H37Rv
gcgcgguggccaacucgacau

SEQ ID NO: 1259285 - RNA, 18 nt, Mycobacterium tuberculosis H37Rv
gcgcggugaugguuaccg

SEQ ID NO: 1259286 - RNA, 12 nt, Mycobacterium tuberculosis H37Rv
gcgcggugccgc

SEQ ID NO: 1259287 - RNA, 21 nt, Mycobacterium tuberculosis H37Rv
gcgcggcaccagcaccgucgg

SEQ ID NO: 1259288 - RNA, 22 nt, Mycobacterium tuberculosis H37Rv
gcgcggcugugcccgaucagcc

SEQ ID NO: 1259289 - RNA, 19 nt, Mycobacterium tuberculosis H37Rv
gcgcggcuuguaccgcaau

SEQ ID NO: 1259290 - RNA, 12 nt, Mycobacterium tuberculosis H37Rv
gcgcggcuucgu

SEQ ID NO: 1259291 - RNA, 19 nt, Mycobacterium tuberculosis H37Rv
gcgcggcaaaguuggccgc

SEQ ID NO: 1259292 - RNA, 13 nt, Mycobacterium tuberculosis H37Rv
gcgcggaucgucg

SEQ ID NO: 1259293 - RNA, 17 nt, Mycobacterium tuberculosis H37Rv
gcgcggaucgucgaggc

SEQ ID NO: 1259294 - RNA, 14 nt, Mycobacterium tuberculosis H37Rv
gcgcggaucggcgg

SEQ ID NO: 1259295 - RNA, 19 nt, Mycobacterium tuberculosis H37Rv
gcgcggaucaacaggccgg

SEQ ID NO: 1259296 - RNA, 16 nt, Mycobacterium tuberculosis H37Rv
gcgcgucucgagcgcg

SEQ ID NO: 1259297 - RNA, 16 nt, Mycobacterium tuberculosis H37Rv
gcgcgugacagugacc

SEQ ID NO: 1259298 - RNA, 16 nt, Mycobacterium tuberculosis H37Rv
gcgcgugacgaccagc

SEQ ID NO: 1259299 - RNA, 19 nt, Mycobacterium tuberculosis H37Rv
gcgcguugcguaucgaccc

SEQ ID NO: 1259300 - RNA, 15 nt, Mycobacterium tuberculosis H37Rv
gcgcuaaaccgucgc

SEQ ID NO: 1259301 - RNA, 13 nt, Mycobacterium tuberculosis H37Rv
gcgcguccgucgg

SEQ ID NO: 1259302 - RNA, 21 nt, Mycobacterium tuberculosis H37Rv
gcgcguaguaaugcucgacgu

SEQ ID NO: 1259303 - RNA, 14 nt, Mycobacterium tuberculosis H37Rv
gcgcguccccagcg

SEQ ID NO: 1259304 - RNA, 13 nt, Mycobacterium tuberculosis H37Rv
gcgcgucgagcag

SEQ ID NO: 1259305 - RNA, 21 nt, Mycobacterium tuberculosis H37Rv
gcgcgucgucgcgcugaacgc

SEQ ID NO: 1259306 - RNA, 13 nt, Mycobacterium tuberculosis H37Rv
gcgcgucggucac

SEQ ID NO: 1259307 - RNA, 16 nt, Mycobacterium tuberculosis H37Rv
gcgcgucgccgucgau

SEQ ID NO: 1259308 - RNA, 13 nt, Mycobacterium tuberculosis H37Rv
gcgcucgucgcgg

SEQ ID NO: 1259309 - RNA, 22 nt, Mycobacterium tuberculosis H37Rv
gcgcucguggucgacgugaucg

SEQ ID NO: 1259310 - RNA, 14 nt, Mycobacterium tuberculosis H37Rv
gcgcugaucgcgcg

SEQ ID NO: 1259311 - RNA, 14 nt, Mycobacterium tuberculosis H37Rv
gcgcugagcgacug

SEQ ID NO: 1259312 - RNA, 21 nt, Mycobacterium tuberculosis H37Rv
gcgcucggucuccaccaccga

SEQ ID NO: 1259313 - RNA, 22 nt, Mycobacterium tuberculosis H37Rv
gcgcucggugccgcccaggagc

SEQ ID NO: 1259314 - RNA, 17 nt, Mycobacterium tuberculosis H37Rv
gcgcucccguacgccgg

SEQ ID NO: 1259315 - RNA, 23 nt, Mycobacterium tuberculosis H37Rv
gcgcuggaucgagcuaguucggc

SEQ ID NO: 1259316 - RNA, 20 nt, Mycobacterium tuberculosis H37Rv
gcgcugggucgugucgccac

SEQ ID NO: 1259317 - RNA, 19 nt, Mycobacterium tuberculosis H37Rv
gcgcugcaccgggucaacg

SEQ ID NO: 1259318 - RNA, 17 nt, Mycobacterium tuberculosis H37Rv
gcgcugauccggucggc

SEQ ID NO: 1259319 - RNA, 14 nt, Mycobacterium tuberculosis H37Rv
gcgcugcgcgacga

SEQ ID NO: 1259320 - RNA, 15 nt, Mycobacterium tuberculosis H37Rv
gcgcuguucggcacg

SEQ ID NO: 1259321 - RNA, 14 nt, Mycobacterium tuberculosis H37Rv
gcgcuguccacgau

SEQ ID NO: 1259322 - RNA, 21 nt, Mycobacterium tuberculosis H37Rv
gcgcuguccacgaugacgucg

SEQ ID NO: 1259323 - RNA, 13 nt, Mycobacterium tuberculosis H37Rv
gcgcuguccacga

SEQ ID NO: 1259324 - RNA, 13 nt, Mycobacterium tuberculosis H37Rv
gcgcuggucagcc

SEQ ID NO: 1259325 - RNA, 16 nt, Mycobacterium tuberculosis H37Rv
gcgcuucggcggucgc

SEQ ID NO: 1259326 - RNA, 12 nt, Mycobacterium tuberculosis H37Rv
gcgcuucggcca

SEQ ID NO: 1259327 - RNA, 19 nt, Mycobacterium tuberculosis H37Rv
gcgcuuggucgaccgccga

SEQ ID NO: 1259328 - RNA, 18 nt, Mycobacterium tuberculosis H37Rv
gcgcuuuccucaccagcc

SEQ ID NO: 1259329 - RNA, 17 nt, Mycobacterium tuberculosis H37Rv
gcgcuugaugccggcca

SEQ ID NO: 1259330 - RNA, 23 nt, Mycobacterium tuberculosis H37Rv
gcgcuugcgaucgccgcuaacgc

SEQ ID NO: 1259331 - RNA, 19 nt, Mycobacterium tuberculosis H37Rv
gccggggauaucacgacgc

SEQ ID NO: 1259332 - RNA, 22 nt, Mycobacterium tuberculosis H37Rv
gccgggcugcaaaucgucgaug

SEQ ID NO: 1259333 - RNA, 24 nt, Mycobacterium tuberculosis H37Rv
gccgggcucuaucagacgauucgg

SEQ ID NO: 1259334 - RNA, 14 nt, Mycobacterium tuberculosis H37Rv
gccggggaccacgg

SEQ ID NO: 1259335 - RNA, 18 nt, Mycobacterium tuberculosis H37Rv
gccgggcuucagcacgcg

SEQ ID NO: 1259336 - RNA, 21 nt, Mycobacterium tuberculosis H37Rv
gccgggguaggggucgagguc

SEQ ID NO: 1259337 - RNA, 18 nt, Mycobacterium tuberculosis H37Rv
gccgggguuggucgucgc

SEQ ID NO: 1259338 - RNA, 22 nt, Mycobacterium tuberculosis H37Rv
gccggguccggaaccgguaucg

SEQ ID NO: 1259339 - RNA, 18 nt, Mycobacterium tuberculosis H37Rv
gccgggguucaccgucga

SEQ ID NO: 1259340 - RNA, 21 nt, Mycobacterium tuberculosis H37Rv
gccgggucucuugcggggucg

SEQ ID NO: 1259341 - RNA, 16 nt, Mycobacterium tuberculosis H37Rv
gccgggugaguucggc

SEQ ID NO: 1259342 - RNA, 19 nt, Mycobacterium tuberculosis H37Rv
gccgggugaggcggugacg

SEQ ID NO: 1259343 - RNA, 21 nt, Mycobacterium tuberculosis H37Rv
gccgggugcaacggcguuggc

SEQ ID NO: 1259344 - RNA, 20 nt, Mycobacterium tuberculosis H37Rv
gccgggugcgagcgacaccg

SEQ ID NO: 1259345 - RNA, 19 nt, Mycobacterium tuberculosis H37Rv
gccggguggcccggcgaaa

SEQ ID NO: 1259346 - RNA, 20 nt, Mycobacterium tuberculosis H37Rv
gccgggucgucuuccaggag

SEQ ID NO: 1259347 - RNA, 15 nt, Mycobacterium tuberculosis H37Rv
gccgggucggugacg

SEQ ID NO: 1259348 - RNA, 21 nt, Mycobacterium tuberculosis H37Rv
gccgggcgcccuuaagccggc

SEQ ID NO: 1259349 - RNA, 22 nt, Mycobacterium tuberculosis H37Rv
gccgggcgcccuuaagccggcg

SEQ ID NO: 1259350 - RNA, 17 nt, Mycobacterium tuberculosis H37Rv
gccgggcguccucgucg

SEQ ID NO: 1259351 - RNA, 22 nt, Mycobacterium tuberculosis H37Rv
gccgggcggccaggcgcgacgu

SEQ ID NO: 1259352 - RNA, 16 nt, Mycobacterium tuberculosis H37Rv
gccgggccguguccgc

SEQ ID NO: 1259353 - RNA, 16 nt, Mycobacterium tuberculosis H37Rv
gccgggccggccacgu

SEQ ID NO: 1259354 - RNA, 22 nt, Mycobacterium tuberculosis H37Rv
gccgggcccuuccuggccgaau

SEQ ID NO: 1259355 - RNA, 21 nt, Mycobacterium tuberculosis H37Rv
gccgggcccuccacugcgagc

SEQ ID NO: 1259356 - RNA, 21 nt, Mycobacterium tuberculosis H37Rv
gccgggccaggccgaugccga

SEQ ID NO: 1259357 - RNA, 14 nt, Mycobacterium tuberculosis H37Rv
gccgggcccgacgu

SEQ ID NO: 1259358 - RNA, 20 nt, Mycobacterium tuberculosis H37Rv
gccgggcaauacguagucgc

SEQ ID NO: 1259359 - RNA, 18 nt, Mycobacterium tuberculosis H37Rv
gccgggcaaggccaccgu

SEQ ID NO: 1259360 - RNA, 17 nt, Mycobacterium tuberculosis H37Rv
gccgggcagugcgcggc

SEQ ID NO: 1259361 - RNA, 18 nt, Mycobacterium tuberculosis H37Rv
gccgggcaguuuggcggc

SEQ ID NO: 1259362 - RNA, 18 nt, Mycobacterium tuberculosis H37Rv
gccgggcagucaggccua

SEQ ID NO: 1259363 - RNA, 20 nt, Mycobacterium tuberculosis H37Rv
gccgggaugguuucgacucg

SEQ ID NO: 1259364 - RNA, 16 nt, Mycobacterium tuberculosis H37Rv
gccgggcaaccagcag

SEQ ID NO: 1259365 - RNA, 14 nt, Mycobacterium tuberculosis H37Rv
gccgggauugccgc

SEQ ID NO: 1259366 - RNA, 20 nt, Mycobacterium tuberculosis H37Rv
gccggccccaccggugccgc

SEQ ID NO: 1259367 - RNA, 19 nt, Mycobacterium tuberculosis H37Rv
gccggccccgccgucaccg

SEQ ID NO: 1259368 - RNA, 23 nt, Mycobacterium tuberculosis H37Rv
gccggccccgccgucaccgccgu

SEQ ID NO: 1259369 - RNA, 16 nt, Mycobacterium tuberculosis H37Rv
gccgguccucgucggc

SEQ ID NO: 1259370 - RNA, 14 nt, Mycobacterium tuberculosis H37Rv
gccggucgaugacc

SEQ ID NO: 1259371 - RNA, 20 nt, Mycobacterium tuberculosis H37Rv
gccggucgaugucggcgaac

SEQ ID NO: 1259372 - RNA, 16 nt, Mycobacterium tuberculosis H37Rv
gccggucggcgucgag

SEQ ID NO: 1259373 - RNA, 22 nt, Mycobacterium tuberculosis H37Rv
gccggucaucccaagcguccgc

SEQ ID NO: 1259374 - RNA, 22 nt, Mycobacterium tuberculosis H37Rv
gccggucauccgggcgaccacc

SEQ ID NO: 1259375 - RNA, 13 nt, Mycobacterium tuberculosis H37Rv
gccggucauacca

SEQ ID NO: 1259376 - RNA, 19 nt, Mycobacterium tuberculosis H37Rv
gccggucaggcaguccacc

SEQ ID NO: 1259377 - RNA, 20 nt, Mycobacterium tuberculosis H37Rv
gccgguccccccguugccgc

SEQ ID NO: 1259378 - RNA, 18 nt, Mycobacterium tuberculosis H37Rv
gccgguccccucggugcc

SEQ ID NO: 1259379 - RNA, 13 nt, Mycobacterium tuberculosis H37Rv
gccgguccgguac

SEQ ID NO: 1259380 - RNA, 21 nt, Mycobacterium tuberculosis H37Rv
gccgguccgguacucguccgc

SEQ ID NO: 1259381 - RNA, 15 nt, Mycobacterium tuberculosis H37Rv
gccggucacguccgc

SEQ ID NO: 1259382 - RNA, 17 nt, Mycobacterium tuberculosis H37Rv
gccgguauuucggcgac

SEQ ID NO: 1259383 - RNA, 19 nt, Mycobacterium tuberculosis H37Rv
gccggucacgacguccgau

SEQ ID NO: 1259384 - RNA, 20 nt, Mycobacterium tuberculosis H37Rv
gccgguagaucuucggccgc

SEQ ID NO: 1259385 - RNA, 15 nt, Mycobacterium tuberculosis H37Rv
gccgguagaucagcg

SEQ ID NO: 1259386 - RNA, 17 nt, Mycobacterium tuberculosis H37Rv
gccgguaggcggccagc

SEQ ID NO: 1259387 - RNA, 22 nt, Mycobacterium tuberculosis H37Rv
gccgguaguagcugaccaucgu

SEQ ID NO: 1259388 - RNA, 16 nt, Mycobacterium tuberculosis H37Rv
gccgguaccggcgauc

SEQ ID NO: 1259389 - RNA, 17 nt, Mycobacterium tuberculosis H37Rv
gccggguuugaucagcu

SEQ ID NO: 1259390 - RNA, 20 nt, Mycobacterium tuberculosis H37Rv
gccggguuugaucagcucgg

SEQ ID NO: 1259391 - RNA, 22 nt, Mycobacterium tuberculosis H37Rv
gccggguuugaucagcucgguc

SEQ ID NO: 1259392 - RNA, 16 nt, Mycobacterium tuberculosis H37Rv
gccggguuggucuucg

SEQ ID NO: 1259393 - RNA, 14 nt, Mycobacterium tuberculosis H37Rv
gccggguucgccgg

SEQ ID NO: 1259394 - RNA, 13 nt, Mycobacterium tuberculosis H37Rv
gccggguuggcgc

SEQ ID NO: 1259395 - RNA, 12 nt, Mycobacterium tuberculosis H37Rv
gccgggugggca

SEQ ID NO: 1259396 - RNA, 20 nt, Mycobacterium tuberculosis H37Rv
gccggucuugcaucgccgau

SEQ ID NO: 1259397 - RNA, 12 nt, Mycobacterium tuberculosis H37Rv
gccggugaccgc

SEQ ID NO: 1259398 - RNA, 17 nt, Mycobacterium tuberculosis H37Rv
gccggugaacgucacgu

SEQ ID NO: 1259399 - RNA, 12 nt, Mycobacterium tuberculosis H37Rv
gccggugccgau

SEQ ID NO: 1259400 - RNA, 13 nt, Mycobacterium tuberculosis H37Rv
gccggugccaccc

SEQ ID NO: 1259401 - RNA, 15 nt, Mycobacterium tuberculosis H37Rv
gccggugccgguaug

SEQ ID NO: 1259402 - RNA, 19 nt, Mycobacterium tuberculosis H37Rv
gccggugccggucgagugc

SEQ ID NO: 1259403 - RNA, 20 nt, Mycobacterium tuberculosis H37Rv
gccggugccggcguugccgc

SEQ ID NO: 1259404 - RNA, 16 nt, Mycobacterium tuberculosis H37Rv
gccggugccgcgguag

SEQ ID NO: 1259405 - RNA, 16 nt, Mycobacterium tuberculosis H37Rv
gccggugccgccguuc

SEQ ID NO: 1259406 - RNA, 18 nt, Mycobacterium tuberculosis H37Rv
gccggugccgccggugcc

SEQ ID NO: 1259407 - RNA, 18 nt, Mycobacterium tuberculosis H37Rv
gccggugccgccgggugc

SEQ ID NO: 1259408 - RNA, 17 nt, Mycobacterium tuberculosis H37Rv
gccggugccgccaucgc

SEQ ID NO: 1259409 - RNA, 23 nt, Mycobacterium tuberculosis H37Rv
gccggugccaguacucggccagc

SEQ ID NO: 1259410 - RNA, 16 nt, Mycobacterium tuberculosis H37Rv
gccggugucguucggc

SEQ ID NO: 1259411 - RNA, 17 nt, Mycobacterium tuberculosis H37Rv
gccgguggugggcggga

SEQ ID NO: 1259412 - RNA, 22 nt, Mycobacterium tuberculosis H37Rv
gccgguggggcccucguagcgu

SEQ ID NO: 1259413 - RNA, 21 nt, Mycobacterium tuberculosis H37Rv
gccgguggucugcgcggugcc

SEQ ID NO: 1259414 - RNA, 20 nt, Mycobacterium tuberculosis H37Rv
gccgguggcgccgccgccaa

SEQ ID NO: 1259415 - RNA, 21 nt, Mycobacterium tuberculosis H37Rv
gccgguggcacccgcgucgag

SEQ ID NO: 1259416 - RNA, 23 nt, Mycobacterium tuberculosis H37Rv
gccggugcuccucggcaggccga

SEQ ID NO: 1259417 - RNA, 19 nt, Mycobacterium tuberculosis H37Rv
gccggugcgguggugcgca

SEQ ID NO: 1259418 - RNA, 13 nt, Mycobacterium tuberculosis H37Rv
gccggugcgucac

SEQ ID NO: 1259419 - RNA, 18 nt, Mycobacterium tuberculosis H37Rv
gccggugcggcgggcucg

SEQ ID NO: 1259420 - RNA, 15 nt, Mycobacterium tuberculosis H37Rv
gccucaaugaccacc

SEQ ID NO: 1259421 - RNA, 15 nt, Mycobacterium tuberculosis H37Rv
gccucaccacgucga

SEQ ID NO: 1259422 - RNA, 13 nt, Mycobacterium tuberculosis H37Rv
gccucacuggacc

SEQ ID NO: 1259423 - RNA, 17 nt, Mycobacterium tuberculosis H37Rv
gccuccggcaccuccag

SEQ ID NO: 1259424 - RNA, 15 nt, Mycobacterium tuberculosis H37Rv
gccuccggauccucg

SEQ ID NO: 1259425 - RNA, 18 nt, Mycobacterium tuberculosis H37Rv
gccuccggcgccgcccga

SEQ ID NO: 1259426 - RNA, 22 nt, Mycobacterium tuberculosis H37Rv
gccuccucgugcaggaccagca

SEQ ID NO: 1259427 - RNA, 22 nt, Mycobacterium tuberculosis H37Rv
gccuccucuuggguccacaacg

SEQ ID NO: 1259428 - RNA, 20 nt, Mycobacterium tuberculosis H37Rv
gccuccucgacgucggcgag

SEQ ID NO: 1259429 - RNA, 16 nt, Mycobacterium tuberculosis H37Rv
gccuccucgauagcgg

SEQ ID NO: 1259430 - RNA, 17 nt, Mycobacterium tuberculosis H37Rv
gccuccucgugcaggac

SEQ ID NO: 1259431 - RNA, 16 nt, Mycobacterium tuberculosis H37Rv
gccucgaccgccagcc

SEQ ID NO: 1259432 - RNA, 19 nt, Mycobacterium tuberculosis H37Rv
gccucgauuguggccagcg

SEQ ID NO: 1259433 - RNA, 15 nt, Mycobacterium tuberculosis H37Rv
gccucgauguccgau

SEQ ID NO: 1259434 - RNA, 19 nt, Mycobacterium tuberculosis H37Rv
gccucgaugucgcggucgc

SEQ ID NO: 1259435 - RNA, 16 nt, Mycobacterium tuberculosis H37Rv
gccucgaucgacucga

SEQ ID NO: 1259436 - RNA, 20 nt, Mycobacterium tuberculosis H37Rv
gccucgaguaucucggcucc

SEQ ID NO: 1259437 - RNA, 17 nt, Mycobacterium tuberculosis H37Rv
gccucgcgggcagggcc

SEQ ID NO: 1259438 - RNA, 15 nt, Mycobacterium tuberculosis H37Rv
gccguugucgucggc

SEQ ID NO: 1259439 - RNA, 21 nt, Mycobacterium tuberculosis H37Rv
gccguugucgucggcggcgaa

SEQ ID NO: 1259440 - RNA, 22 nt, Mycobacterium tuberculosis H37Rv
gccguugucgucggcggcgaac

SEQ ID NO: 1259441 - RNA, 14 nt, Mycobacterium tuberculosis H37Rv
gccguuggugccgc

SEQ ID NO: 1259442 - RNA, 16 nt, Mycobacterium tuberculosis H37Rv
gccguuggagccgcca

SEQ ID NO: 1259443 - RNA, 21 nt, Mycobacterium tuberculosis H37Rv
gccguugcuauucgccagcgc

SEQ ID NO: 1259444 - RNA, 18 nt, Mycobacterium tuberculosis H37Rv
gccuaugcugcccggcaa

SEQ ID NO: 1259445 - RNA, 19 nt, Mycobacterium tuberculosis H37Rv
gccuaugcugcccggcaac

SEQ ID NO: 1259446 - RNA, 20 nt, Mycobacterium tuberculosis H37Rv
gccuaguccuggcucggcau

SEQ ID NO: 1259447 - RNA, 18 nt, Mycobacterium tuberculosis H37Rv
gccuagguucgcccagcc

SEQ ID NO: 1259448 - RNA, 17 nt, Mycobacterium tuberculosis H37Rv
gccuaguacgccgagca

SEQ ID NO: 1259449 - RNA, 15 nt, Mycobacterium tuberculosis H37Rv
gccuagccgauggcu

SEQ ID NO: 1259450 - RNA, 20 nt, Mycobacterium tuberculosis H37Rv
gccguugcacggccgggacg

SEQ ID NO: 1259451 - RNA, 18 nt, Mycobacterium tuberculosis H37Rv
gccguugacuugugccac

SEQ ID NO: 1259452 - RNA, 20 nt, Mycobacterium tuberculosis H37Rv
gccguugacgccguugccgc

SEQ ID NO: 1259453 - RNA, 19 nt, Mycobacterium tuberculosis H37Rv
gccguugccgccggugcca

SEQ ID NO: 1259454 - RNA, 17 nt, Mycobacterium tuberculosis H37Rv
gccguugccgccgucac

SEQ ID NO: 1259455 - RNA, 20 nt, Mycobacterium tuberculosis H37Rv
gccguugccgccauggccgc

SEQ ID NO: 1259456 - RNA, 13 nt, Mycobacterium tuberculosis H37Rv
gccguugccaccg

SEQ ID NO: 1259457 - RNA, 13 nt, Mycobacterium tuberculosis H37Rv
gccgugcggucgc

SEQ ID NO: 1259458 - RNA, 14 nt, Mycobacterium tuberculosis H37Rv
gccgugcugcggcg

SEQ ID NO: 1259459 - RNA, 16 nt, Mycobacterium tuberculosis H37Rv
gccgugcugcggcgac

SEQ ID NO: 1259460 - RNA, 20 nt, Mycobacterium tuberculosis H37Rv
gccguucucgucgaggaucu

SEQ ID NO: 1259461 - RNA, 22 nt, Mycobacterium tuberculosis H37Rv
gccgugcgaucgucaacgacga

SEQ ID NO: 1259462 - RNA, 18 nt, Mycobacterium tuberculosis H37Rv
gccgugcgccgugcgauc

SEQ ID NO: 1259463 - RNA, 12 nt, Mycobacterium tuberculosis H37Rv
gccgugccguac

SEQ ID NO: 1259464 - RNA, 22 nt, Mycobacterium tuberculosis H37Rv
gccgugcaccucguguccgggg

SEQ ID NO: 1259465 - RNA, 12 nt, Mycobacterium tuberculosis H37Rv
gccguccaccga

SEQ ID NO: 1259466 - RNA, 21 nt, Mycobacterium tuberculosis H37Rv
gccgucagccaggugcccaag

SEQ ID NO: 1259467 - RNA, 14 nt, Mycobacterium tuberculosis H37Rv
gccgucagccaggu

SEQ ID NO: 1259468 - RNA, 13 nt, Mycobacterium tuberculosis H37Rv
gccgucaccgcga

SEQ ID NO: 1259469 - RNA, 14 nt, Mycobacterium tuberculosis H37Rv
gccgucaccgccga

SEQ ID NO: 1259470 - RNA, 16 nt, Mycobacterium tuberculosis H37Rv
gccgucaccgccguug

SEQ ID NO: 1259471 - RNA, 15 nt, Mycobacterium tuberculosis H37Rv
gccgucaccgaucga

SEQ ID NO: 1259472 - RNA, 19 nt, Mycobacterium tuberculosis H37Rv
gccgucaccgccauugcca

SEQ ID NO: 1259473 - RNA, 21 nt, Mycobacterium tuberculosis H37Rv
gccgucaccgccauugccacc

SEQ ID NO: 1259474 - RNA, 22 nt, Mycobacterium tuberculosis H37Rv
gccgguguuuccgaaacccgcc

SEQ ID NO: 1259475 - RNA, 22 nt, Mycobacterium tuberculosis H37Rv
gccgguguugccgaagcccgag

SEQ ID NO: 1259476 - RNA, 15 nt, Mycobacterium tuberculosis H37Rv
gccgguguugccgaa

SEQ ID NO: 1259477 - RNA, 23 nt, Mycobacterium tuberculosis H37Rv
gccgucacccccgauagcgaccg

SEQ ID NO: 1259478 - RNA, 23 nt, Mycobacterium tuberculosis H37Rv
gccgucaagauugaacgaguagc

SEQ ID NO: 1259479 - RNA, 23 nt, Mycobacterium tuberculosis H37Rv
gccgucaacgccucugcucagcc

SEQ ID NO: 1259480 - RNA, 18 nt, Mycobacterium tuberculosis H37Rv
gccguaucggacgggaug

SEQ ID NO: 1259481 - RNA, 18 nt, Mycobacterium tuberculosis H37Rv
gccguccaggacggaucg

SEQ ID NO: 1259482 - RNA, 20 nt, Mycobacterium tuberculosis H37Rv
gccguccgguggaccgccga

SEQ ID NO: 1259483 - RNA, 19 nt, Mycobacterium tuberculosis H37Rv
gccguccgguccgucgggu

SEQ ID NO: 1259484 - RNA, 18 nt, Mycobacterium tuberculosis H37Rv
gccguccggcuuggcggc

SEQ ID NO: 1259485 - RNA, 19 nt, Mycobacterium tuberculosis H37Rv
gccgucgaaccaguccucg

SEQ ID NO: 1259486 - RNA, 23 nt, Mycobacterium tuberculosis H37Rv
gccgucgaagacgaacgugucgg

SEQ ID NO: 1259487 - RNA, 22 nt, Mycobacterium tuberculosis H37Rv
gccgucgaugaucugcuugcca

SEQ ID NO: 1259488 - RNA, 12 nt, Mycobacterium tuberculosis H37Rv
gccgucgaccac

SEQ ID NO: 1259489 - RNA, 18 nt, Mycobacterium tuberculosis H37Rv
gccguccuagcgugccgc

SEQ ID NO: 1259490 - RNA, 19 nt, Mycobacterium tuberculosis H37Rv
gccguccuagcgugccgcc

SEQ ID NO: 1259491 - RNA, 22 nt, Mycobacterium tuberculosis H37Rv
gccgugacaaggugcgcugggu

SEQ ID NO: 1259492 - RNA, 16 nt, Mycobacterium tuberculosis H37Rv
gccgugaauucgccga

SEQ ID NO: 1259493 - RNA, 15 nt, Mycobacterium tuberculosis H37Rv
gccgugaacggcgcg

SEQ ID NO: 1259494 - RNA, 21 nt, Mycobacterium tuberculosis H37Rv
gccgugaacggaugugguugc

SEQ ID NO: 1259495 - RNA, 16 nt, Mycobacterium tuberculosis H37Rv
gccgucugacagcauc

SEQ ID NO: 1259496 - RNA, 20 nt, Mycobacterium tuberculosis H37Rv
gccgucguugugccggucga

SEQ ID NO: 1259497 - RNA, 14 nt, Mycobacterium tuberculosis H37Rv
gccgucucgucggc

SEQ ID NO: 1259498 - RNA, 17 nt, Mycobacterium tuberculosis H37Rv
gccgucucgucggcaac

SEQ ID NO: 1259499 - RNA, 14 nt, Mycobacterium tuberculosis H37Rv
gccgucucgcggug

SEQ ID NO: 1259500 - RNA, 23 nt, Mycobacterium tuberculosis H37Rv
gccgugaguagguccacguucgg

SEQ ID NO: 1259501 - RNA, 22 nt, Mycobacterium tuberculosis H37Rv
gccgugaugccacggcgucgcu

SEQ ID NO: 1259502 - RNA, 22 nt, Mycobacterium tuberculosis H37Rv
gccgugaugcuggucgugccgc

SEQ ID NO: 1259503 - RNA, 21 nt, Mycobacterium tuberculosis H37Rv
gccgugaucagcucgcgcacg

SEQ ID NO: 1259504 - RNA, 19 nt, Mycobacterium tuberculosis H37Rv
gccgugauugucggcgaaa

SEQ ID NO: 1259505 - RNA, 18 nt, Mycobacterium tuberculosis H37Rv
gccgugaucgcuggcgac

SEQ ID NO: 1259506 - RNA, 16 nt, Mycobacterium tuberculosis H37Rv
gccgugaucagcucgc

SEQ ID NO: 1259507 - RNA, 17 nt, Mycobacterium tuberculosis H37Rv
gccgucguugcccgacc

SEQ ID NO: 1259508 - RNA, 16 nt, Mycobacterium tuberculosis H37Rv
gccgucgugccaccgu

SEQ ID NO: 1259509 - RNA, 12 nt, Mycobacterium tuberculosis H37Rv
gccgucgucggu

SEQ ID NO: 1259510 - RNA, 16 nt, Mycobacterium tuberculosis H37Rv
gccgucguccgcugac

SEQ ID NO: 1259511 - RNA, 17 nt, Mycobacterium tuberculosis H37Rv
gccgucgucgaccacga

SEQ ID NO: 1259512 - RNA, 14 nt, Mycobacterium tuberculosis H37Rv
gccgucgucgagcc

SEQ ID NO: 1259513 - RNA, 14 nt, Mycobacterium tuberculosis H37Rv
gccgucgcggcacg

SEQ ID NO: 1259514 - RNA, 23 nt, Mycobacterium tuberculosis H37Rv
gccgucgcuagggugagcccggg

SEQ ID NO: 1259515 - RNA, 23 nt, Mycobacterium tuberculosis H37Rv
gccgucgccacgcccagcgcccg

SEQ ID NO: 1259516 - RNA, 15 nt, Mycobacterium tuberculosis H37Rv
gccgucgcccagcgu

SEQ ID NO: 1259517 - RNA, 23 nt, Mycobacterium tuberculosis H37Rv
gccgucgccaccgguaccgauca

SEQ ID NO: 1259518 - RNA, 20 nt, Mycobacterium tuberculosis H37Rv
gccgucgccaccgguaccga

SEQ ID NO: 1259519 - RNA, 19 nt, Mycobacterium tuberculosis H37Rv
gccgucgauguugccgaga

SEQ ID NO: 1259520 - RNA, 18 nt, Mycobacterium tuberculosis H37Rv
gccgucgauguugcccag

SEQ ID NO: 1259521 - RNA, 15 nt, Mycobacterium tuberculosis H37Rv
gccuggccaccuggu

SEQ ID NO: 1259522 - RNA, 16 nt, Mycobacterium tuberculosis H37Rv
gccuggcccgucggcg

SEQ ID NO: 1259523 - RNA, 16 nt, Mycobacterium tuberculosis H37Rv
gccugcgccgccagcg

SEQ ID NO: 1259524 - RNA, 17 nt, Mycobacterium tuberculosis H37Rv
gccugcgccgacccgcg

SEQ ID NO: 1259525 - RNA, 18 nt, Mycobacterium tuberculosis H37Rv
gccugcgccgacccgcgc

SEQ ID NO: 1259526 - RNA, 15 nt, Mycobacterium tuberculosis H37Rv
gccugcgcgaccgac

SEQ ID NO: 1259527 - RNA, 15 nt, Mycobacterium tuberculosis H37Rv
gccugcgacagcacg

SEQ ID NO: 1259528 - RNA, 14 nt, Mycobacterium tuberculosis H37Rv
gccugccucggcga

SEQ ID NO: 1259529 - RNA, 13 nt, Mycobacterium tuberculosis H37Rv
gccugccgcucgc

SEQ ID NO: 1259530 - RNA, 21 nt, Mycobacterium tuberculosis H37Rv
gccugccgacggcaucaacgc

SEQ ID NO: 1259531 - RNA, 13 nt, Mycobacterium tuberculosis H37Rv
gccucgcguucgc

SEQ ID NO: 1259532 - RNA, 18 nt, Mycobacterium tuberculosis H37Rv
gccucggacacggcagcc

SEQ ID NO: 1259533 - RNA, 13 nt, Mycobacterium tuberculosis H37Rv
gccuguccacguc

SEQ ID NO: 1259534 - RNA, 14 nt, Mycobacterium tuberculosis H37Rv
gccuguacgagcag

SEQ ID NO: 1259535 - RNA, 16 nt, Mycobacterium tuberculosis H37Rv
gccuucagcguccagg

SEQ ID NO: 1259536 - RNA, 14 nt, Mycobacterium tuberculosis H37Rv
gccuuauuggacgu

SEQ ID NO: 1259537 - RNA, 22 nt, Mycobacterium tuberculosis H37Rv
gccugugccaccgcuggaucga

SEQ ID NO: 1259538 - RNA, 15 nt, Mycobacterium tuberculosis H37Rv
gccuugaucggcgag

SEQ ID NO: 1259539 - RNA, 19 nt, Mycobacterium tuberculosis H37Rv
gccuugaggcccugcggcc

SEQ ID NO: 1259540 - RNA, 17 nt, Mycobacterium tuberculosis H37Rv
gccuugacccuccgcau

SEQ ID NO: 1259541 - RNA, 18 nt, Mycobacterium tuberculosis H37Rv
gccuucuucgcggcgguc

SEQ ID NO: 1259542 - RNA, 14 nt, Mycobacterium tuberculosis H37Rv
gcgaacucggcgau

SEQ ID NO: 1259543 - RNA, 15 nt, Mycobacterium tuberculosis H37Rv
gcgaacucgggcgac

SEQ ID NO: 1259544 - RNA, 18 nt, Mycobacterium tuberculosis H37Rv
gcgaacucgcgccgagcc

SEQ ID NO: 1259545 - RNA, 16 nt, Mycobacterium tuberculosis H37Rv
gcgaacggcgcaguug

SEQ ID NO: 1259546 - RNA, 23 nt, Mycobacterium tuberculosis H37Rv
gcgaacggauucccgcccagcag

SEQ ID NO: 1259547 - RNA, 22 nt, Mycobacterium tuberculosis H37Rv
gcgaacgcuucaccucgucgac

SEQ ID NO: 1259548 - RNA, 16 nt, Mycobacterium tuberculosis H37Rv
gcgaacgcguccagcg

SEQ ID NO: 1259549 - RNA, 23 nt, Mycobacterium tuberculosis H37Rv
gcgaacugguagcccggaccgcc

SEQ ID NO: 1259550 - RNA, 14 nt, Mycobacterium tuberculosis H37Rv
gcgaagcccgacau

SEQ ID NO: 1259551 - RNA, 14 nt, Mycobacterium tuberculosis H37Rv
gcgaagcaucgcgu

SEQ ID NO: 1259552 - RNA, 17 nt, Mycobacterium tuberculosis H37Rv
gcgaagaacgacgccac

SEQ ID NO: 1259553 - RNA, 15 nt, Mycobacterium tuberculosis H37Rv
gcgaagaagccggca

SEQ ID NO: 1259554 - RNA, 19 nt, Mycobacterium tuberculosis H37Rv
gcgaacaucgccagcgccg

SEQ ID NO: 1259555 - RNA, 14 nt, Mycobacterium tuberculosis H37Rv
gcgaacaucgccag

SEQ ID NO: 1259556 - RNA, 21 nt, Mycobacterium tuberculosis H37Rv
gcgaacagcggcacgaucggc

SEQ ID NO: 1259557 - RNA, 20 nt, Mycobacterium tuberculosis H37Rv
gcgaacccgagccgccgugg

SEQ ID NO: 1259558 - RNA, 15 nt, Mycobacterium tuberculosis H37Rv
gcgaaccgcggaucg

SEQ ID NO: 1259559 - RNA, 17 nt, Mycobacterium tuberculosis H37Rv
gcgaaccgcuccgagca

SEQ ID NO: 1259560 - RNA, 13 nt, Mycobacterium tuberculosis H37Rv
gcgaaccggccgu

SEQ ID NO: 1259561 - RNA, 18 nt, Mycobacterium tuberculosis H37Rv
gcgaaccgaagccgucga

SEQ ID NO: 1259562 - RNA, 14 nt, Mycobacterium tuberculosis H37Rv
gcgaacccgccgau

SEQ ID NO: 1259563 - RNA, 17 nt, Mycobacterium tuberculosis H37Rv
gcgaacccgccgaugcc

SEQ ID NO: 1259564 - RNA, 18 nt, Mycobacterium tuberculosis H37Rv
gcgaaccgucucggcgac

SEQ ID NO: 1259565 - RNA, 18 nt, Mycobacterium tuberculosis H37Rv
gcgaacgaauccgcucga

SEQ ID NO: 1259566 - RNA, 17 nt, Mycobacterium tuberculosis H37Rv
gcgaaccggcccaccga

SEQ ID NO: 1259567 - RNA, 17 nt, Mycobacterium tuberculosis H37Rv
gcgaacgaagucgacga

SEQ ID NO: 1259568 - RNA, 12 nt, Mycobacterium tuberculosis H37Rv
gcgaacgccgug

SEQ ID NO: 1259569 - RNA, 24 nt, Mycobacterium tuberculosis H37Rv
gcgaacgccguggugcgcauggcc

SEQ ID NO: 1259570 - RNA, 13 nt, Mycobacterium tuberculosis H37Rv
gcgaacaacuugg

SEQ ID NO: 1259571 - RNA, 21 nt, Mycobacterium tuberculosis H37Rv
gcgaaaucgacagcagcgcga

SEQ ID NO: 1259572 - RNA, 18 nt, Mycobacterium tuberculosis H37Rv
gcgaacaaguggccagcg

SEQ ID NO: 1259573 - RNA, 17 nt, Mycobacterium tuberculosis H37Rv
gcgaacacgucggccag

SEQ ID NO: 1259574 - RNA, 19 nt, Mycobacterium tuberculosis H37Rv
gcgaacacgcgaugacgag

SEQ ID NO: 1259575 - RNA, 19 nt, Mycobacterium tuberculosis H37Rv
gcgaacagacaugcgcacc

SEQ ID NO: 1259576 - RNA, 14 nt, Mycobacterium tuberculosis H37Rv
gcgaaacgcuggcc

SEQ ID NO: 1259577 - RNA, 23 nt, Mycobacterium tuberculosis H37Rv
gcgaaacccugaaaagggcuggu

SEQ ID NO: 1259578 - RNA, 16 nt, Mycobacterium tuberculosis H37Rv
gcgaaacaccggccag

SEQ ID NO: 1259579 - RNA, 12 nt, Mycobacterium tuberculosis H37Rv
gccuugccaccg

SEQ ID NO: 1259580 - RNA, 13 nt, Mycobacterium tuberculosis H37Rv
gccuugcccagcg

SEQ ID NO: 1259581 - RNA, 22 nt, Mycobacterium tuberculosis H37Rv
gccuugcgcacaggcgcgaucg

SEQ ID NO: 1259582 - RNA, 19 nt, Mycobacterium tuberculosis H37Rv
gccuuugggcuguggccgc

SEQ ID NO: 1259583 - RNA, 13 nt, Mycobacterium tuberculosis H37Rv
gcgaaaauucguc

SEQ ID NO: 1259584 - RNA, 17 nt, Mycobacterium tuberculosis H37Rv
gcgaaaauucgucgcgu

SEQ ID NO: 1259585 - RNA, 19 nt, Mycobacterium tuberculosis H37Rv
gcgaaaaucgcgcgcgaaa

SEQ ID NO: 1259586 - RNA, 20 nt, Mycobacterium tuberculosis H37Rv
gcgacugugaaucucacgac

SEQ ID NO: 1259587 - RNA, 14 nt, Mycobacterium tuberculosis H37Rv
gcgacggcgcucgg

SEQ ID NO: 1259588 - RNA, 21 nt, Mycobacterium tuberculosis H37Rv
gcgacuggaccgauuucgccu

SEQ ID NO: 1259589 - RNA, 18 nt, Mycobacterium tuberculosis H37Rv
gcgacucugugacgggca

SEQ ID NO: 1259590 - RNA, 15 nt, Mycobacterium tuberculosis H37Rv
gcgacggcgcucggc

SEQ ID NO: 1259591 - RNA, 20 nt, Mycobacterium tuberculosis H37Rv
gcgacucugcgucugcucac

SEQ ID NO: 1259592 - RNA, 23 nt, Mycobacterium tuberculosis H37Rv
gcgacucgugucugccucggggc

SEQ ID NO: 1259593 - RNA, 23 nt, Mycobacterium tuberculosis H37Rv
gcgacggcgcccauagcaccucg

SEQ ID NO: 1259594 - RNA, 15 nt, Mycobacterium tuberculosis H37Rv
gcgacggcgccggca

SEQ ID NO: 1259595 - RNA, 13 nt, Mycobacterium tuberculosis H37Rv
gcgacggccggca

SEQ ID NO: 1259596 - RNA, 12 nt, Mycobacterium tuberculosis H37Rv
gcgacggccuug

SEQ ID NO: 1259597 - RNA, 16 nt, Mycobacterium tuberculosis H37Rv
gcgacggcccgauccc

SEQ ID NO: 1259598 - RNA, 20 nt, Mycobacterium tuberculosis H37Rv
gcgagcagacacagaaucgc

SEQ ID NO: 1259599 - RNA, 17 nt, Mycobacterium tuberculosis H37Rv
gcgagcagacgcagaau

SEQ ID NO: 1259600 - RNA, 21 nt, Mycobacterium tuberculosis H37Rv
gcgagcagacgcagagucgca

SEQ ID NO: 1259601 - RNA, 20 nt, Mycobacterium tuberculosis H37Rv
gcgagcagacgcagaaucgc

SEQ ID NO: 1259602 - RNA, 15 nt, Mycobacterium tuberculosis H37Rv
gcgagcagacgcaaa

SEQ ID NO: 1259603 - RNA, 22 nt, Mycobacterium tuberculosis H37Rv
gcgagcagagaacuccgccacc

SEQ ID NO: 1259604 - RNA, 21 nt, Mycobacterium tuberculosis H37Rv
gcgagcagacgcggaaucgca

SEQ ID NO: 1259605 - RNA, 20 nt, Mycobacterium tuberculosis H37Rv
gcgagcagacgcggaaucgc

SEQ ID NO: 1259606 - RNA, 14 nt, Mycobacterium tuberculosis H37Rv
gcgagcccgcaucg

SEQ ID NO: 1259607 - RNA, 19 nt, Mycobacterium tuberculosis H37Rv
gcgagcccgcaucgcacca

SEQ ID NO: 1259608 - RNA, 13 nt, Mycobacterium tuberculosis H37Rv
gcgagccgcucgc

SEQ ID NO: 1259609 - RNA, 12 nt, Mycobacterium tuberculosis H37Rv
gcgagcccgcau

SEQ ID NO: 1259610 - RNA, 15 nt, Mycobacterium tuberculosis H37Rv
gcgagccggcgaagu

SEQ ID NO: 1259611 - RNA, 14 nt, Mycobacterium tuberculosis H37Rv
gcgagcagcacagc

SEQ ID NO: 1259612 - RNA, 16 nt, Mycobacterium tuberculosis H37Rv
gcgagcaucgacgaac

SEQ ID NO: 1259613 - RNA, 19 nt, Mycobacterium tuberculosis H37Rv
gcgagcagggcgucgaccg

SEQ ID NO: 1259614 - RNA, 20 nt, Mycobacterium tuberculosis H37Rv
gcgaguuucugcucgaccgu

SEQ ID NO: 1259615 - RNA, 21 nt, Mycobacterium tuberculosis H37Rv
gcgagugucagcagaugggcg

SEQ ID NO: 1259616 - RNA, 19 nt, Mycobacterium tuberculosis H37Rv
gcgagugcggcacgaucgc

SEQ ID NO: 1259617 - RNA, 16 nt, Mycobacterium tuberculosis H37Rv
gcgagugucagcagau

SEQ ID NO: 1259618 - RNA, 16 nt, Mycobacterium tuberculosis H37Rv
gcgauacagacgggga

SEQ ID NO: 1259619 - RNA, 16 nt, Mycobacterium tuberculosis H37Rv
gcgauacagcgacagg

SEQ ID NO: 1259620 - RNA, 15 nt, Mycobacterium tuberculosis H37Rv
gcgauaccgacaccc

SEQ ID NO: 1259621 - RNA, 20 nt, Mycobacterium tuberculosis H37Rv
gcgauaacuccgcggcgaac

SEQ ID NO: 1259622 - RNA, 19 nt, Mycobacterium tuberculosis H37Rv
gcgauaacuccgcggcgaa

SEQ ID NO: 1259623 - RNA, 17 nt, Mycobacterium tuberculosis H37Rv
gcgauaggcccggucuu

SEQ ID NO: 1259624 - RNA, 17 nt, Mycobacterium tuberculosis H37Rv
gcgaguagucgacgucg

SEQ ID NO: 1259625 - RNA, 15 nt, Mycobacterium tuberculosis H37Rv
gcgaguaaucgaccg

SEQ ID NO: 1259626 - RNA, 14 nt, Mycobacterium tuberculosis H37Rv
gcgagucgacgaac

SEQ ID NO: 1259627 - RNA, 18 nt, Mycobacterium tuberculosis H37Rv
gcgaguccaggcugaucc

SEQ ID NO: 1259628 - RNA, 20 nt, Mycobacterium tuberculosis H37Rv
gcgagcuguaggucagcgcg

SEQ ID NO: 1259629 - RNA, 20 nt, Mycobacterium tuberculosis H37Rv
gcgaggaauuccgcuaccgc

SEQ ID NO: 1259630 - RNA, 12 nt, Mycobacterium tuberculosis H37Rv
gcgagcgcgcgu

SEQ ID NO: 1259631 - RNA, 14 nt, Mycobacterium tuberculosis H37Rv
gcgagcgcccgcag

SEQ ID NO: 1259632 - RNA, 17 nt, Mycobacterium tuberculosis H37Rv
gcgacacaacggguguc

SEQ ID NO: 1259633 - RNA, 21 nt, Mycobacterium tuberculosis H37Rv
gcgacagcugccugaccggcg

SEQ ID NO: 1259634 - RNA, 16 nt, Mycobacterium tuberculosis H37Rv
gcgacaggacgucggc

SEQ ID NO: 1259635 - RNA, 14 nt, Mycobacterium tuberculosis H37Rv
gcgacagcggcgac

SEQ ID NO: 1259636 - RNA, 17 nt, Mycobacterium tuberculosis H37Rv
gcgacagcggcgucggu

SEQ ID NO: 1259637 - RNA, 15 nt, Mycobacterium tuberculosis H37Rv
gcgacaccacgaauc

SEQ ID NO: 1259638 - RNA, 23 nt, Mycobacterium tuberculosis H37Rv
gcgacaccggaaacggucagggc

SEQ ID NO: 1259639 - RNA, 21 nt, Mycobacterium tuberculosis H37Rv
gcgacaagccgagcccgucga

SEQ ID NO: 1259640 - RNA, 22 nt, Mycobacterium tuberculosis H37Rv
gcgaagcccgacaugaggcugc

SEQ ID NO: 1259641 - RNA, 17 nt, Mycobacterium tuberculosis H37Rv
gcgaagccgggugcugg

SEQ ID NO: 1259642 - RNA, 13 nt, Mycobacterium tuberculosis H37Rv
gcgaagcccgaga

SEQ ID NO: 1259643 - RNA, 21 nt, Mycobacterium tuberculosis H37Rv
gcgacauuggucaccugcugc

SEQ ID NO: 1259644 - RNA, 13 nt, Mycobacterium tuberculosis H37Rv
gcgaccaccagcg

SEQ ID NO: 1259645 - RNA, 14 nt, Mycobacterium tuberculosis H37Rv
gcgaccaccagcgc

SEQ ID NO: 1259646 - RNA, 17 nt, Mycobacterium tuberculosis H37Rv
gcgaccaccagcgccga

SEQ ID NO: 1259647 - RNA, 14 nt, Mycobacterium tuberculosis H37Rv
gcgacccggucgcg

SEQ ID NO: 1259648 - RNA, 14 nt, Mycobacterium tuberculosis H37Rv
gcgacccgucgaac

SEQ ID NO: 1259649 - RNA, 16 nt, Mycobacterium tuberculosis H37Rv
gcgaccccgccgagcg

SEQ ID NO: 1259650 - RNA, 15 nt, Mycobacterium tuberculosis H37Rv
gcgaccgagacggcg

SEQ ID NO: 1259651 - RNA, 13 nt, Mycobacterium tuberculosis H37Rv
gcgaccgaccagc

SEQ ID NO: 1259652 - RNA, 13 nt, Mycobacterium tuberculosis H37Rv
gcgaccgacgcca

SEQ ID NO: 1259653 - RNA, 21 nt, Mycobacterium tuberculosis H37Rv
gcgaccgcauugagcuggcgc

SEQ ID NO: 1259654 - RNA, 19 nt, Mycobacterium tuberculosis H37Rv
gcgacgacccgggucggca

SEQ ID NO: 1259655 - RNA, 15 nt, Mycobacterium tuberculosis H37Rv
gcgaccgcaucucgg

SEQ ID NO: 1259656 - RNA, 14 nt, Mycobacterium tuberculosis H37Rv
gcgacgacgagguc

SEQ ID NO: 1259657 - RNA, 14 nt, Mycobacterium tuberculosis H37Rv
gcgacgagaucagc

SEQ ID NO: 1259658 - RNA, 14 nt, Mycobacterium tuberculosis H37Rv
gcgacgagcagcaa

SEQ ID NO: 1259659 - RNA, 17 nt, Mycobacterium tuberculosis H37Rv
gcgacgagaucugcgau

SEQ ID NO: 1259660 - RNA, 15 nt, Mycobacterium tuberculosis H37Rv
gcgacgagaucugcg

SEQ ID NO: 1259661 - RNA, 23 nt, Mycobacterium tuberculosis H37Rv
gcgacgagcccaccgucgcauac

SEQ ID NO: 1259662 - RNA, 19 nt, Mycobacterium tuberculosis H37Rv
gcgacgagcccaccgucgc

SEQ ID NO: 1259663 - RNA, 20 nt, Mycobacterium tuberculosis H37Rv
gcgacgaugaucucgcccac

SEQ ID NO: 1259664 - RNA, 14 nt, Mycobacterium tuberculosis H37Rv
gcgacgaucgucca

SEQ ID NO: 1259665 - RNA, 13 nt, Mycobacterium tuberculosis H37Rv
gcgacgacggccu

SEQ ID NO: 1259666 - RNA, 17 nt, Mycobacterium tuberculosis H37Rv
gcgacgcagaccgucca

SEQ ID NO: 1259667 - RNA, 20 nt, Mycobacterium tuberculosis H37Rv
gcgacgccggccuuggcgau

SEQ ID NO: 1259668 - RNA, 13 nt, Mycobacterium tuberculosis H37Rv
gcgacgcggccag

SEQ ID NO: 1259669 - RNA, 12 nt, Mycobacterium tuberculosis H37Rv
gcgacgcguagc

SEQ ID NO: 1259670 - RNA, 15 nt, Mycobacterium tuberculosis H37Rv
gcgacgcguagcacg

SEQ ID NO: 1259671 - RNA, 18 nt, Mycobacterium tuberculosis H37Rv
gcgacgcccgccuucgau

SEQ ID NO: 1259672 - RNA, 15 nt, Mycobacterium tuberculosis H37Rv
gcgacgcgaccgcga

SEQ ID NO: 1259673 - RNA, 15 nt, Mycobacterium tuberculosis H37Rv
gcgacgcggcgucgg

SEQ ID NO: 1259674 - RNA, 14 nt, Mycobacterium tuberculosis H37Rv
gcgacgcugccgcc

SEQ ID NO: 1259675 - RNA, 13 nt, Mycobacterium tuberculosis H37Rv
ggcgcggucaccg

SEQ ID NO: 1259676 - RNA, 13 nt, Mycobacterium tuberculosis H37Rv
ggcgcggucgacc

SEQ ID NO: 1259677 - RNA, 16 nt, Mycobacterium tuberculosis H37Rv
ggcgcggucgaccuga

SEQ ID NO: 1259678 - RNA, 21 nt, Mycobacterium tuberculosis H37Rv
ggcgcgguuucggcgucaccg

SEQ ID NO: 1259679 - RNA, 19 nt, Mycobacterium tuberculosis H37Rv
ggcgcgguuugcucguuca

SEQ ID NO: 1259680 - RNA, 18 nt, Mycobacterium tuberculosis H37Rv
ggcgcgguucgucggcga

SEQ ID NO: 1259681 - RNA, 16 nt, Mycobacterium tuberculosis H37Rv
ggcgcgggucggcgac

SEQ ID NO: 1259682 - RNA, 15 nt, Mycobacterium tuberculosis H37Rv
ggcgcgggcgacguc

SEQ ID NO: 1259683 - RNA, 16 nt, Mycobacterium tuberculosis H37Rv
ggcgcgggcaggucgu

SEQ ID NO: 1259684 - RNA, 16 nt, Mycobacterium tuberculosis H37Rv
ggcgcgggccggcgac

SEQ ID NO: 1259685 - RNA, 19 nt, Mycobacterium tuberculosis H37Rv
ggcgccuuggucgccgccu

SEQ ID NO: 1259686 - RNA, 18 nt, Mycobacterium tuberculosis H37Rv
ggcgcgaaacgccgcaau

SEQ ID NO: 1259687 - RNA, 20 nt, Mycobacterium tuberculosis H37Rv
ggcgcgaagucuugaccgca

SEQ ID NO: 1259688 - RNA, 18 nt, Mycobacterium tuberculosis H37Rv
ggcgcgaccuccgcgauc

SEQ ID NO: 1259689 - RNA, 17 nt, Mycobacterium tuberculosis H37Rv
ggcgcgacguagacgac

SEQ ID NO: 1259690 - RNA, 23 nt, Mycobacterium tuberculosis H37Rv
ggcgcggcacccggucggccauc

SEQ ID NO: 1259691 - RNA, 22 nt, Mycobacterium tuberculosis H37Rv
ggcgcggagugcccagggccga

SEQ ID NO: 1259692 - RNA, 14 nt, Mycobacterium tuberculosis H37Rv
ggcgcgcggcgagc

SEQ ID NO: 1259693 - RNA, 16 nt, Mycobacterium tuberculosis H37Rv
ggcgcggagcugauug

SEQ ID NO: 1259694 - RNA, 12 nt, Mycobacterium tuberculosis H37Rv
ggcggacgcccg

SEQ ID NO: 1259695 - RNA, 17 nt, Mycobacterium tuberculosis H37Rv
ggcggacgcgggugcca

SEQ ID NO: 1259696 - RNA, 13 nt, Mycobacterium tuberculosis H37Rv
ggcggacucacga

SEQ ID NO: 1259697 - RNA, 20 nt, Mycobacterium tuberculosis H37Rv
ggcggauaugaugaucgguu

SEQ ID NO: 1259698 - RNA, 13 nt, Mycobacterium tuberculosis H37Rv
ggcggaucccgag

SEQ ID NO: 1259699 - RNA, 18 nt, Mycobacterium tuberculosis H37Rv
ggcggauaaccggcaugc

SEQ ID NO: 1259700 - RNA, 21 nt, Mycobacterium tuberculosis H37Rv
ggcgcuuggccggauccucga

SEQ ID NO: 1259701 - RNA, 22 nt, Mycobacterium tuberculosis H37Rv
ggcgcuugcaccaggggcgcgu

SEQ ID NO: 1259702 - RNA, 22 nt, Mycobacterium tuberculosis H37Rv
ggcgcuggaccgggucgggcac

SEQ ID NO: 1259703 - RNA, 17 nt, Mycobacterium tuberculosis H37Rv
ggcgcucccgccggcag

SEQ ID NO: 1259704 - RNA, 13 nt, Mycobacterium tuberculosis H37Rv
ggcgcuccggcgu

SEQ ID NO: 1259705 - RNA, 14 nt, Mycobacterium tuberculosis H37Rv
ggcgcucaucgcgu

SEQ ID NO: 1259706 - RNA, 13 nt, Mycobacterium tuberculosis H37Rv
ggcgcucagcgcg

SEQ ID NO: 1259707 - RNA, 14 nt, Mycobacterium tuberculosis H37Rv
ggcgcucagcgcgg

SEQ ID NO: 1259708 - RNA, 20 nt, Mycobacterium tuberculosis H37Rv
ggcggccgggucggugacga

SEQ ID NO: 1259709 - RNA, 18 nt, Mycobacterium tuberculosis H37Rv
ggcggccgucgucggcca

SEQ ID NO: 1259710 - RNA, 19 nt, Mycobacterium tuberculosis H37Rv
ggcggccgucgucggccag

SEQ ID NO: 1259711 - RNA, 19 nt, Mycobacterium tuberculosis H37Rv
ggcggccuaacucgccugc

SEQ ID NO: 1259712 - RNA, 17 nt, Mycobacterium tuberculosis H37Rv
ggcggccugcccgccgu

SEQ ID NO: 1259713 - RNA, 15 nt, Mycobacterium tuberculosis H37Rv
ggcggccucgcugcu

SEQ ID NO: 1259714 - RNA, 14 nt, Mycobacterium tuberculosis H37Rv
ggcggccucggucu

SEQ ID NO: 1259715 - RNA, 15 nt, Mycobacterium tuberculosis H37Rv
ggcggccucggucug

SEQ ID NO: 1259716 - RNA, 14 nt, Mycobacterium tuberculosis H37Rv
ggcggcgaugaccg

SEQ ID NO: 1259717 - RNA, 22 nt, Mycobacterium tuberculosis H37Rv
ggcggcgaucaacucgggcagc

SEQ ID NO: 1259718 - RNA, 20 nt, Mycobacterium tuberculosis H37Rv
ggcggcgauacccaucgauc

SEQ ID NO: 1259719 - RNA, 15 nt, Mycobacterium tuberculosis H37Rv
ggcggcgagcagcag

SEQ ID NO: 1259720 - RNA, 16 nt, Mycobacterium tuberculosis H37Rv
ggcggccaguucggcg

SEQ ID NO: 1259721 - RNA, 21 nt, Mycobacterium tuberculosis H37Rv
ggcggcaaacacugcggccug

SEQ ID NO: 1259722 - RNA, 22 nt, Mycobacterium tuberculosis H37Rv
ggcggcaaacacugcggccugc

SEQ ID NO: 1259723 - RNA, 16 nt, Mycobacterium tuberculosis H37Rv
ggcggauucggcgcug

SEQ ID NO: 1259724 - RNA, 16 nt, Mycobacterium tuberculosis H37Rv
ggcggaucgugcccug

SEQ ID NO: 1259725 - RNA, 13 nt, Mycobacterium tuberculosis H37Rv
ggcggaucgcgag

SEQ ID NO: 1259726 - RNA, 12 nt, Mycobacterium tuberculosis H37Rv
ggcggaucgccg

SEQ ID NO: 1259727 - RNA, 18 nt, Mycobacterium tuberculosis H37Rv
ggcggauggcgucgacca

SEQ ID NO: 1259728 - RNA, 19 nt, Mycobacterium tuberculosis H37Rv
ggcggccgcgucgucgaga

SEQ ID NO: 1259729 - RNA, 23 nt, Mycobacterium tuberculosis H37Rv
ggcggccgcgucgucgagaaucg

SEQ ID NO: 1259730 - RNA, 16 nt, Mycobacterium tuberculosis H37Rv
ggcggcccaucgaccg

SEQ ID NO: 1259731 - RNA, 23 nt, Mycobacterium tuberculosis H37Rv
ggcggcccacgcgcacucgacca

SEQ ID NO: 1259732 - RNA, 21 nt, Mycobacterium tuberculosis H37Rv
ggcggccaugucagcggccug

SEQ ID NO: 1259733 - RNA, 13 nt, Mycobacterium tuberculosis H37Rv
ggcgggugccgag

SEQ ID NO: 1259734 - RNA, 21 nt, Mycobacterium tuberculosis H37Rv
ggcgguaaaugccugcccacc

SEQ ID NO: 1259735 - RNA, 17 nt, Mycobacterium tuberculosis H37Rv
ggcgguaaaugccugcc

SEQ ID NO: 1259736 - RNA, 16 nt, Mycobacterium tuberculosis H37Rv
ggcgguaaagcucacc

SEQ ID NO: 1259737 - RNA, 16 nt, Mycobacterium tuberculosis H37Rv
ggcgguaccucgucga

SEQ ID NO: 1259738 - RNA, 18 nt, Mycobacterium tuberculosis H37Rv
ggcgggguugaucaccga

SEQ ID NO: 1259739 - RNA, 17 nt, Mycobacterium tuberculosis H37Rv
ggcgggguugaucaccg

SEQ ID NO: 1259740 - RNA, 14 nt, Mycobacterium tuberculosis H37Rv
ggcgggucagcgcg

SEQ ID NO: 1259741 - RNA, 14 nt, Mycobacterium tuberculosis H37Rv
ggcgggugaacgcg

SEQ ID NO: 1259742 - RNA, 13 nt, Mycobacterium tuberculosis H37Rv
ggcgguacggguc

SEQ ID NO: 1259743 - RNA, 17 nt, Mycobacterium tuberculosis H37Rv
ggcgguaccucgucgag

SEQ ID NO: 1259744 - RNA, 18 nt, Mycobacterium tuberculosis H37Rv
ggcgguaguacucgcgca

SEQ ID NO: 1259745 - RNA, 17 nt, Mycobacterium tuberculosis H37Rv
ggcgguccaaucgccgg

SEQ ID NO: 1259746 - RNA, 12 nt, Mycobacterium tuberculosis H37Rv
ggcggucagaug

SEQ ID NO: 1259747 - RNA, 12 nt, Mycobacterium tuberculosis H37Rv
ggcggcugcacg

SEQ ID NO: 1259748 - RNA, 14 nt, Mycobacterium tuberculosis H37Rv
ggcggcgcugcgcg

SEQ ID NO: 1259749 - RNA, 20 nt, Mycobacterium tuberculosis H37Rv
ggcggcgcguucgucgucgc

SEQ ID NO: 1259750 - RNA, 17 nt, Mycobacterium tuberculosis H37Rv
ggcggcgcggucgaagc

SEQ ID NO: 1259751 - RNA, 14 nt, Mycobacterium tuberculosis H37Rv
ggcggcuucgacgu

SEQ ID NO: 1259752 - RNA, 22 nt, Mycobacterium tuberculosis H37Rv
ggcggcuuccucgagcgaaccg

SEQ ID NO: 1259753 - RNA, 19 nt, Mycobacterium tuberculosis H37Rv
ggcggcuguggucgcugcu

SEQ ID NO: 1259754 - RNA, 13 nt, Mycobacterium tuberculosis H37Rv
ggcggcugcagcc

SEQ ID NO: 1259755 - RNA, 12 nt, Mycobacterium tuberculosis H37Rv
ggcggggcagaa

SEQ ID NO: 1259756 - RNA, 12 nt, Mycobacterium tuberculosis H37Rv
ggcggggaccgc

SEQ ID NO: 1259757 - RNA, 15 nt, Mycobacterium tuberculosis H37Rv
ggcgggccugcgcga

SEQ ID NO: 1259758 - RNA, 23 nt, Mycobacterium tuberculosis H37Rv
ggcgggcaguugacccaugccga

SEQ ID NO: 1259759 - RNA, 19 nt, Mycobacterium tuberculosis H37Rv
ggcgccaugcgccaacccg

SEQ ID NO: 1259760 - RNA, 22 nt, Mycobacterium tuberculosis H37Rv
ggcgcccacaaauauccugcgg

SEQ ID NO: 1259761 - RNA, 13 nt, Mycobacterium tuberculosis H37Rv
ggcgccagcgccg

SEQ ID NO: 1259762 - RNA, 14 nt, Mycobacterium tuberculosis H37Rv
ggcgccagcagauc

SEQ ID NO: 1259763 - RNA, 11 nt, Mycobacterium tuberculosis H37Rv
ggcgccagcag

SEQ ID NO: 1259764 - RNA, 18 nt, Mycobacterium tuberculosis H37Rv
ggcgccacugaccgcgau

SEQ ID NO: 1259765 - RNA, 13 nt, Mycobacterium tuberculosis H37Rv
ggcgccacguggu

SEQ ID NO: 1259766 - RNA, 19 nt, Mycobacterium tuberculosis H37Rv
ggcgccacguggucgagca

SEQ ID NO: 1259767 - RNA, 23 nt, Mycobacterium tuberculosis H37Rv
ggcgccacggcagcgcccagauc

SEQ ID NO: 1259768 - RNA, 17 nt, Mycobacterium tuberculosis H37Rv
ggcgccaccagucacgc

SEQ ID NO: 1259769 - RNA, 20 nt, Mycobacterium tuberculosis H37Rv
ggcgccaauucagcggcaac

SEQ ID NO: 1259770 - RNA, 18 nt, Mycobacterium tuberculosis H37Rv
ggcgcauagggccaccgc

SEQ ID NO: 1259771 - RNA, 18 nt, Mycobacterium tuberculosis H37Rv
ggcgcauaggcggccauc

SEQ ID NO: 1259772 - RNA, 16 nt, Mycobacterium tuberculosis H37Rv
ggcgcauaccggcguc

SEQ ID NO: 1259773 - RNA, 18 nt, Mycobacterium tuberculosis H37Rv
ggcgcagguucucggugc

SEQ ID NO: 1259774 - RNA, 21 nt, Mycobacterium tuberculosis H37Rv
ggcgcagguuggcaagcacgg

SEQ ID NO: 1259775 - RNA, 14 nt, Mycobacterium tuberculosis H37Rv
ggcgcaguagccga

SEQ ID NO: 1259776 - RNA, 13 nt, Mycobacterium tuberculosis H37Rv
ggcgcagcucacc

SEQ ID NO: 1259777 - RNA, 23 nt, Mycobacterium tuberculosis H37Rv
ggcgcagauagcgcucgaacucg

SEQ ID NO: 1259778 - RNA, 18 nt, Mycobacterium tuberculosis H37Rv
ggcgcacugguugggcga

SEQ ID NO: 1259779 - RNA, 13 nt, Mycobacterium tuberculosis H37Rv
ggcgcagcgacgc

SEQ ID NO: 1259780 - RNA, 15 nt, Mycobacterium tuberculosis H37Rv
ggcgcagcgcggcaa

SEQ ID NO: 1259781 - RNA, 22 nt, Mycobacterium tuberculosis H37Rv
ggcgcaacgccauaccagcguu

SEQ ID NO: 1259782 - RNA, 13 nt, Mycobacterium tuberculosis H37Rv
ggcgcaagcgccg

SEQ ID NO: 1259783 - RNA, 16 nt, Mycobacterium tuberculosis H37Rv
ggcgcaagcagcccgg

SEQ ID NO: 1259784 - RNA, 21 nt, Mycobacterium tuberculosis H37Rv
ggcgcaagaaugccgccgacg

SEQ ID NO: 1259785 - RNA, 22 nt, Mycobacterium tuberculosis H37Rv
ggcgcacgaaaccgcagcgcga

SEQ ID NO: 1259786 - RNA, 14 nt, Mycobacterium tuberculosis H37Rv
ggcgcacgaaaccg

SEQ ID NO: 1259787 - RNA, 13 nt, Mycobacterium tuberculosis H37Rv
ggcgcaccggcgu

SEQ ID NO: 1259788 - RNA, 19 nt, Mycobacterium tuberculosis H37Rv
ggcgcacgcccgcacucgg

SEQ ID NO: 1259789 - RNA, 17 nt, Mycobacterium tuberculosis H37Rv
ggcgauggccagcacgg

SEQ ID NO: 1259790 - RNA, 13 nt, Mycobacterium tuberculosis H37Rv
ggcgaugcugggc

SEQ ID NO: 1259791 - RNA, 23 nt, Mycobacterium tuberculosis H37Rv
ggcgcaacaaccgguuggcgauc

SEQ ID NO: 1259792 - RNA, 21 nt, Mycobacterium tuberculosis H37Rv
ggcgauuaccggcacgccggc

SEQ ID NO: 1259793 - RNA, 15 nt, Mycobacterium tuberculosis H37Rv
ggcgauggucuccuc

SEQ ID NO: 1259794 - RNA, 14 nt, Mycobacterium tuberculosis H37Rv
ggcgcccagcgaca

SEQ ID NO: 1259795 - RNA, 14 nt, Mycobacterium tuberculosis H37Rv
ggcgcccagcgccu

SEQ ID NO: 1259796 - RNA, 13 nt, Mycobacterium tuberculosis H37Rv
ggcgcccagcucg

SEQ ID NO: 1259797 - RNA, 13 nt, Mycobacterium tuberculosis H37Rv
ggcgcccagccgg

SEQ ID NO: 1259798 - RNA, 20 nt, Mycobacterium tuberculosis H37Rv
ggcgcccaugcugacacgac

SEQ ID NO: 1259799 - RNA, 15 nt, Mycobacterium tuberculosis H37Rv
ggcgcccaggccgau

SEQ ID NO: 1259800 - RNA, 20 nt, Mycobacterium tuberculosis H37Rv
ggcgcccauagcaccucgau

SEQ ID NO: 1259801 - RNA, 15 nt, Mycobacterium tuberculosis H37Rv
ggcgccccugucgac

SEQ ID NO: 1259802 - RNA, 15 nt, Mycobacterium tuberculosis H37Rv
ggcgcccccgacgac

SEQ ID NO: 1259803 - RNA, 17 nt, Mycobacterium tuberculosis H37Rv
ggcgcccccgacgacgg

SEQ ID NO: 1259804 - RNA, 22 nt, Mycobacterium tuberculosis H37Rv
ggcgcccccgacgacggcaccg

SEQ ID NO: 1259805 - RNA, 18 nt, Mycobacterium tuberculosis H37Rv
ggcgcccuugccggcgag

SEQ ID NO: 1259806 - RNA, 20 nt, Mycobacterium tuberculosis H37Rv
ggcgcccgggucccggcagc

SEQ ID NO: 1259807 - RNA, 15 nt, Mycobacterium tuberculosis H37Rv
ggcgcccgugccgcc

SEQ ID NO: 1259808 - RNA, 12 nt, Mycobacterium tuberculosis H37Rv
ggcgcccgggau

SEQ ID NO: 1259809 - RNA, 20 nt, Mycobacterium tuberculosis H37Rv
ggcgcccgggaucgggucac

SEQ ID NO: 1259810 - RNA, 15 nt, Mycobacterium tuberculosis H37Rv
ggcgcccggcggauc

SEQ ID NO: 1259811 - RNA, 15 nt, Mycobacterium tuberculosis H37Rv
ggcgcccgccggcaa

SEQ ID NO: 1259812 - RNA, 21 nt, Mycobacterium tuberculosis H37Rv
ggcgccgccgccaaugccacc

SEQ ID NO: 1259813 - RNA, 22 nt, Mycobacterium tuberculosis H37Rv
ggcgccgccgaccagaacgcca

SEQ ID NO: 1259814 - RNA, 19 nt, Mycobacterium tuberculosis H37Rv
ggcgccgcagcgcucgcgu

SEQ ID NO: 1259815 - RNA, 17 nt, Mycobacterium tuberculosis H37Rv
ggcgccgcauaccagua

SEQ ID NO: 1259816 - RNA, 15 nt, Mycobacterium tuberculosis H37Rv
ggcgccgcauaccag

SEQ ID NO: 1259817 - RNA, 18 nt, Mycobacterium tuberculosis H37Rv
ggcgccgcccuugccgcc

SEQ ID NO: 1259818 - RNA, 13 nt, Mycobacterium tuberculosis H37Rv
ggcgccgaucacg

SEQ ID NO: 1259819 - RNA, 17 nt, Mycobacterium tuberculosis H37Rv
ggcgccgagauccuggu

SEQ ID NO: 1259820 - RNA, 21 nt, Mycobacterium tuberculosis H37Rv
ggcgccgacgacuccggcaag

SEQ ID NO: 1259821 - RNA, 23 nt, Mycobacterium tuberculosis H37Rv
ggcgccgacaccggcugaccgac

SEQ ID NO: 1259822 - RNA, 17 nt, Mycobacterium tuberculosis H37Rv
ggcgccgaaccagcgau

SEQ ID NO: 1259823 - RNA, 13 nt, Mycobacterium tuberculosis H37Rv
ggcgccgaaaccg

SEQ ID NO: 1259824 - RNA, 20 nt, Mycobacterium tuberculosis H37Rv
ggcgccgaaaccgccgggau

SEQ ID NO: 1259825 - RNA, 15 nt, Mycobacterium tuberculosis H37Rv
ggcgccgucggccga

SEQ ID NO: 1259826 - RNA, 15 nt, Mycobacterium tuberculosis H37Rv
ggcgccguugccgcc

SEQ ID NO: 1259827 - RNA, 17 nt, Mycobacterium tuberculosis H37Rv
ggcgccguuaccgccgu

SEQ ID NO: 1259828 - RNA, 13 nt, Mycobacterium tuberculosis H37Rv
ggcgccgugucac

SEQ ID NO: 1259829 - RNA, 18 nt, Mycobacterium tuberculosis H37Rv
ggcgccgugucaccgggu

SEQ ID NO: 1259830 - RNA, 20 nt, Mycobacterium tuberculosis H37Rv
ggcgccgguuacccggaccg

SEQ ID NO: 1259831 - RNA, 12 nt, Mycobacterium tuberculosis H37Rv
ggcgccggucgc

SEQ ID NO: 1259832 - RNA, 15 nt, Mycobacterium tuberculosis H37Rv
ggcgccuuccaggcg

SEQ ID NO: 1259833 - RNA, 13 nt, Mycobacterium tuberculosis H37Rv
ggcgccuuggucg

SEQ ID NO: 1259834 - RNA, 14 nt, Mycobacterium tuberculosis H37Rv
ggcgccuguccugc

SEQ ID NO: 1259835 - RNA, 16 nt, Mycobacterium tuberculosis H37Rv
ggcgccucguugccgu

SEQ ID NO: 1259836 - RNA, 12 nt, Mycobacterium tuberculosis H37Rv
ggcgccugcugc

SEQ ID NO: 1259837 - RNA, 17 nt, Mycobacterium tuberculosis H37Rv
ggcgccucggaccagac

SEQ ID NO: 1259838 - RNA, 23 nt, Mycobacterium tuberculosis H37Rv
ggcgccucggaccagacccacga

SEQ ID NO: 1259839 - RNA, 18 nt, Mycobacterium tuberculosis H37Rv
ggcgccggggccgccgau

SEQ ID NO: 1259840 - RNA, 17 nt, Mycobacterium tuberculosis H37Rv
ggcgccgggucgauggg

SEQ ID NO: 1259841 - RNA, 18 nt, Mycobacterium tuberculosis H37Rv
ggcgccggcgcgucggca

SEQ ID NO: 1259842 - RNA, 14 nt, Mycobacterium tuberculosis H37Rv
ggcgccggcgcaga

SEQ ID NO: 1259843 - RNA, 15 nt, Mycobacterium tuberculosis H37Rv
ggcgccggacaaacc

SEQ ID NO: 1259844 - RNA, 14 nt, Mycobacterium tuberculosis H37Rv
ggcgccgcgcucga

SEQ ID NO: 1259845 - RNA, 17 nt, Mycobacterium tuberculosis H37Rv
ggcgccgcgcucgacga

SEQ ID NO: 1259846 - RNA, 19 nt, Mycobacterium tuberculosis H37Rv
ggcgccgcgcucgacgagc

SEQ ID NO: 1259847 - RNA, 16 nt, Mycobacterium tuberculosis H37Rv
ggcgccgcgccgauuc

SEQ ID NO: 1259848 - RNA, 13 nt, Mycobacterium tuberculosis H37Rv
ggcgccgccguug

SEQ ID NO: 1259849 - RNA, 18 nt, Mycobacterium tuberculosis H37Rv
gggccgcucuucgacauc

SEQ ID NO: 1259850 - RNA, 21 nt, Mycobacterium tuberculosis H37Rv
gggccggaccuuguuggccau

SEQ ID NO: 1259851 - RNA, 20 nt, Mycobacterium tuberculosis H37Rv
gggcgacccguucucgguga

SEQ ID NO: 1259852 - RNA, 14 nt, Mycobacterium tuberculosis H37Rv
gggcgaccaccgcg

SEQ ID NO: 1259853 - RNA, 16 nt, Mycobacterium tuberculosis H37Rv
gggccugggccgcaca

SEQ ID NO: 1259854 - RNA, 21 nt, Mycobacterium tuberculosis H37Rv
gggccugccaguccugaugac

SEQ ID NO: 1259855 - RNA, 23 nt, Mycobacterium tuberculosis H37Rv
gggccucaaguugguucaccgcg

SEQ ID NO: 1259856 - RNA, 20 nt, Mycobacterium tuberculosis H37Rv
gggcaggagcagcacgucga

SEQ ID NO: 1259857 - RNA, 22 nt, Mycobacterium tuberculosis H37Rv
gggcaggaucgaggcgucggca

SEQ ID NO: 1259858 - RNA, 20 nt, Mycobacterium tuberculosis H37Rv
gggcaggaucuccgggucga

SEQ ID NO: 1259859 - RNA, 19 nt, Mycobacterium tuberculosis H37Rv
gggcagcgggcccggacaa

SEQ ID NO: 1259860 - RNA, 18 nt, Mycobacterium tuberculosis H37Rv
gggcagcugguaggucac

SEQ ID NO: 1259861 - RNA, 14 nt, Mycobacterium tuberculosis H37Rv
gggcaggccgucga

SEQ ID NO: 1259862 - RNA, 14 nt, Mycobacterium tuberculosis H37Rv
gggcaucaccgacg

SEQ ID NO: 1259863 - RNA, 14 nt, Mycobacterium tuberculosis H37Rv
gggccgccucgcgg

SEQ ID NO: 1259864 - RNA, 13 nt, Mycobacterium tuberculosis H37Rv
gggccgccgcgau

SEQ ID NO: 1259865 - RNA, 22 nt, Mycobacterium tuberculosis H37Rv
gggcccgucgucgucgacacgg

SEQ ID NO: 1259866 - RNA, 20 nt, Mycobacterium tuberculosis H37Rv
gggcccgccgucaccgccgu

SEQ ID NO: 1259867 - RNA, 19 nt, Mycobacterium tuberculosis H37Rv
gggcgacggaaucauguac

SEQ ID NO: 1259868 - RNA, 11 nt, Mycobacterium tuberculosis H37Rv
gggcgacgauc

SEQ ID NO: 1259869 - RNA, 16 nt, Mycobacterium tuberculosis H37Rv
gggcgaucgucagcca

SEQ ID NO: 1259870 - RNA, 17 nt, Mycobacterium tuberculosis H37Rv
gggcgaucgucagccag

SEQ ID NO: 1259871 - RNA, 18 nt, Mycobacterium tuberculosis H37Rv
gggcgaucgacaccguga

SEQ ID NO: 1259872 - RNA, 20 nt, Mycobacterium tuberculosis H37Rv
gggcgaguagucgacgucga

SEQ ID NO: 1259873 - RNA, 13 nt, Mycobacterium tuberculosis H37Rv
gggcgcgccggcu

SEQ ID NO: 1259874 - RNA, 19 nt, Mycobacterium tuberculosis H37Rv
gggcgcgcguagccgugga

SEQ ID NO: 1259875 - RNA, 17 nt, Mycobacterium tuberculosis H37Rv
gggcggcagcgagucga

SEQ ID NO: 1259876 - RNA, 20 nt, Mycobacterium tuberculosis H37Rv
gggcgcguugcguaucgacc

SEQ ID NO: 1259877 - RNA, 14 nt, Mycobacterium tuberculosis H37Rv
gggcggcucgucga

SEQ ID NO: 1259878 - RNA, 12 nt, Mycobacterium tuberculosis H37Rv
gggcggcgucgg

SEQ ID NO: 1259879 - RNA, 18 nt, Mycobacterium tuberculosis H37Rv
gggcggcgcuggcgucgu

SEQ ID NO: 1259880 - RNA, 19 nt, Mycobacterium tuberculosis H37Rv
gggcggugcacaccgucgc

SEQ ID NO: 1259881 - RNA, 15 nt, Mycobacterium tuberculosis H37Rv
gggcggugaggcagc

SEQ ID NO: 1259882 - RNA, 16 nt, Mycobacterium tuberculosis H37Rv
gggcggucggccggcu

SEQ ID NO: 1259883 - RNA, 13 nt, Mycobacterium tuberculosis H37Rv
gggcgggcgucga

SEQ ID NO: 1259884 - RNA, 21 nt, Mycobacterium tuberculosis H37Rv
gggcgggcuggugucagcuga

SEQ ID NO: 1259885 - RNA, 21 nt, Mycobacterium tuberculosis H37Rv
gggcgggaucgacuccggugu

SEQ ID NO: 1259886 - RNA, 21 nt, Mycobacterium tuberculosis H37Rv
gggcggccagcugcagcagac

SEQ ID NO: 1259887 - RNA, 18 nt, Mycobacterium tuberculosis H37Rv
gggcggaucggcccagau

SEQ ID NO: 1259888 - RNA, 16 nt, Mycobacterium tuberculosis H37Rv
gggcagccugcugcau

SEQ ID NO: 1259889 - RNA, 11 nt, Mycobacterium tuberculosis H37Rv
gggcagcucgu

SEQ ID NO: 1259890 - RNA, 18 nt, Mycobacterium tuberculosis H37Rv
gggcagaccgaucggcag

SEQ ID NO: 1259891 - RNA, 18 nt, Mycobacterium tuberculosis H37Rv
gggcagcacccgcgccag

SEQ ID NO: 1259892 - RNA, 17 nt, Mycobacterium tuberculosis H37Rv
gggcacguggcgguaca

SEQ ID NO: 1259893 - RNA, 12 nt, Mycobacterium tuberculosis H37Rv
gggcaccgucgg

SEQ ID NO: 1259894 - RNA, 22 nt, Mycobacterium tuberculosis H37Rv
gggcaccgagcugagcggccag

SEQ ID NO: 1259895 - RNA, 18 nt, Mycobacterium tuberculosis H37Rv
gggcaccagcgaauccag

SEQ ID NO: 1259896 - RNA, 16 nt, Mycobacterium tuberculosis H37Rv
gggcaaagucgguguc

SEQ ID NO: 1259897 - RNA, 22 nt, Mycobacterium tuberculosis H37Rv
gggcacgaacaucagaucgccg

SEQ ID NO: 1259898 - RNA, 20 nt, Mycobacterium tuberculosis H37Rv
gggcaccuggucggccgcaa

SEQ ID NO: 1259899 - RNA, 18 nt, Mycobacterium tuberculosis H37Rv
gggcaccguuaccgccgu

SEQ ID NO: 1259900 - RNA, 15 nt, Mycobacterium tuberculosis H37Rv
gggcacgcgaggcgc

SEQ ID NO: 1259901 - RNA, 16 nt, Mycobacterium tuberculosis H37Rv
gggcacggaacgcgag

SEQ ID NO: 1259902 - RNA, 16 nt, Mycobacterium tuberculosis H37Rv
gggcacgucggugguc

SEQ ID NO: 1259903 - RNA, 16 nt, Mycobacterium tuberculosis H37Rv
gggacgauucucgagu

SEQ ID NO: 1259904 - RNA, 15 nt, Mycobacterium tuberculosis H37Rv
gggacgacggcaaga

SEQ ID NO: 1259905 - RNA, 12 nt, Mycobacterium tuberculosis H37Rv
gggacggcgaau

SEQ ID NO: 1259906 - RNA, 14 nt, Mycobacterium tuberculosis H37Rv
gggacgucuccacc

SEQ ID NO: 1259907 - RNA, 23 nt, Mycobacterium tuberculosis H37Rv
gggacgucuccaccgcgaugacg

SEQ ID NO: 1259908 - RNA, 16 nt, Mycobacterium tuberculosis H37Rv
gggacguuguccaccg

SEQ ID NO: 1259909 - RNA, 13 nt, Mycobacterium tuberculosis H37Rv
gggacuggcguga

SEQ ID NO: 1259910 - RNA, 22 nt, Mycobacterium tuberculosis H37Rv
gggacugcggauaggugccgcg

SEQ ID NO: 1259911 - RNA, 13 nt, Mycobacterium tuberculosis H37Rv
gggauucguuguc

SEQ ID NO: 1259912 - RNA, 13 nt, Mycobacterium tuberculosis H37Rv
gggauucggccag

SEQ ID NO: 1259913 - RNA, 21 nt, Mycobacterium tuberculosis H37Rv
gggaucgcccaggcgcgacgu

SEQ ID NO: 1259914 - RNA, 15 nt, Mycobacterium tuberculosis H37Rv
gggaucaugaccauc

SEQ ID NO: 1259915 - RNA, 15 nt, Mycobacterium tuberculosis H37Rv
gggaucgcugccagc

SEQ ID NO: 1259916 - RNA, 20 nt, Mycobacterium tuberculosis H37Rv
ggcuggucaggaucgcaccg

SEQ ID NO: 1259917 - RNA, 16 nt, Mycobacterium tuberculosis H37Rv
ggcugguuucggccgc

SEQ ID NO: 1259918 - RNA, 19 nt, Mycobacterium tuberculosis H37Rv
ggcugguugaccgaguuga

SEQ ID NO: 1259919 - RNA, 15 nt, Mycobacterium tuberculosis H37Rv
ggcugguuucggccg

SEQ ID NO: 1259920 - RNA, 15 nt, Mycobacterium tuberculosis H37Rv
ggcuguaacacccgg

SEQ ID NO: 1259921 - RNA, 19 nt, Mycobacterium tuberculosis H37Rv
ggcuguaaaaaugcuucgc

SEQ ID NO: 1259922 - RNA, 20 nt, Mycobacterium tuberculosis H37Rv
ggcugguccgggugccggug

SEQ ID NO: 1259923 - RNA, 17 nt, Mycobacterium tuberculosis H37Rv
ggcugguaucgagcacc

SEQ ID NO: 1259924 - RNA, 22 nt, Mycobacterium tuberculosis H37Rv
ggcuggucacccguaucggguu

SEQ ID NO: 1259925 - RNA, 18 nt, Mycobacterium tuberculosis H37Rv
ggcugggcgccaccaucg

SEQ ID NO: 1259926 - RNA, 23 nt, Mycobacterium tuberculosis H37Rv
ggcuggcggguuggucccgauga

SEQ ID NO: 1259927 - RNA, 17 nt, Mycobacterium tuberculosis H37Rv
ggcugggggccggcagc

SEQ ID NO: 1259928 - RNA, 20 nt, Mycobacterium tuberculosis H37Rv
ggcuucgucggccagcagca

SEQ ID NO: 1259929 - RNA, 21 nt, Mycobacterium tuberculosis H37Rv
ggcuucuucuucuugaccgcg

SEQ ID NO: 1259930 - RNA, 15 nt, Mycobacterium tuberculosis H37Rv
ggcuucggcggccga

SEQ ID NO: 1259931 - RNA, 20 nt, Mycobacterium tuberculosis H37Rv
ggcuuggggucccgccgggu

SEQ ID NO: 1259932 - RNA, 16 nt, Mycobacterium tuberculosis H37Rv
ggcuuggugcccagcg

SEQ ID NO: 1259933 - RNA, 20 nt, Mycobacterium tuberculosis H37Rv
ggcuugacugcacaccaccg

SEQ ID NO: 1259934 - RNA, 15 nt, Mycobacterium tuberculosis H37Rv
ggcuugacugcacac

SEQ ID NO: 1259935 - RNA, 16 nt, Mycobacterium tuberculosis H37Rv
gggacacgucgcgcca

SEQ ID NO: 1259936 - RNA, 18 nt, Mycobacterium tuberculosis H37Rv
gggaauggcccuugcucg

SEQ ID NO: 1259937 - RNA, 17 nt, Mycobacterium tuberculosis H37Rv
gggaaggaaccgggcaa

SEQ ID NO: 1259938 - RNA, 14 nt, Mycobacterium tuberculosis H37Rv
gggaaacccggcca

SEQ ID NO: 1259939 - RNA, 22 nt, Mycobacterium tuberculosis H37Rv
ggcuugugcccaauagccggau

SEQ ID NO: 1259940 - RNA, 18 nt, Mycobacterium tuberculosis H37Rv
ggcuuucagcaccggauc

SEQ ID NO: 1259941 - RNA, 18 nt, Mycobacterium tuberculosis H37Rv
ggcuuuuacgucugcucg

SEQ ID NO: 1259942 - RNA, 17 nt, Mycobacterium tuberculosis H37Rv
ggcuuuuacgucugcuc

SEQ ID NO: 1259943 - RNA, 15 nt, Mycobacterium tuberculosis H37Rv
ggcuuuggacagguc

SEQ ID NO: 1259944 - RNA, 17 nt, Mycobacterium tuberculosis H37Rv
ggcuuuugcgucugcuc

SEQ ID NO: 1259945 - RNA, 17 nt, Mycobacterium tuberculosis H37Rv
ggcuuugccgucgagca

SEQ ID NO: 1259946 - RNA, 18 nt, Mycobacterium tuberculosis H37Rv
ggcguucccccacucgga

SEQ ID NO: 1259947 - RNA, 21 nt, Mycobacterium tuberculosis H37Rv
ggcguucccgccauugccgcc

SEQ ID NO: 1259948 - RNA, 17 nt, Mycobacterium tuberculosis H37Rv
ggcguugguggucugcc

SEQ ID NO: 1259949 - RNA, 20 nt, Mycobacterium tuberculosis H37Rv
ggcguugguagccagggcga

SEQ ID NO: 1259950 - RNA, 15 nt, Mycobacterium tuberculosis H37Rv
ggcguucgucggcug

SEQ ID NO: 1259951 - RNA, 13 nt, Mycobacterium tuberculosis H37Rv
ggcgugcucgaca

SEQ ID NO: 1259952 - RNA, 15 nt, Mycobacterium tuberculosis H37Rv
ggcgugccgaccagc

SEQ ID NO: 1259953 - RNA, 17 nt, Mycobacterium tuberculosis H37Rv
ggcgugacgucgucggu

SEQ ID NO: 1259954 - RNA, 21 nt, Mycobacterium tuberculosis H37Rv
ggcgugacgucgucggugcgc

SEQ ID NO: 1259955 - RNA, 19 nt, Mycobacterium tuberculosis H37Rv
ggcgugacagggcggcaac

SEQ ID NO: 1259956 - RNA, 17 nt, Mycobacterium tuberculosis H37Rv
ggcuacggcugcccguu

SEQ ID NO: 1259957 - RNA, 17 nt, Mycobacterium tuberculosis H37Rv
ggcuacgacggcgccau

SEQ ID NO: 1259958 - RNA, 22 nt, Mycobacterium tuberculosis H37Rv
ggcguuuucaauuucacugcga

SEQ ID NO: 1259959 - RNA, 17 nt, Mycobacterium tuberculosis H37Rv
ggcguuguugcggaucg

SEQ ID NO: 1259960 - RNA, 22 nt, Mycobacterium tuberculosis H37Rv
ggcguugguagccagggcgauc

SEQ ID NO: 1259961 - RNA, 19 nt, Mycobacterium tuberculosis H37Rv
ggcguuguugaccagcacg

SEQ ID NO: 1259962 - RNA, 18 nt, Mycobacterium tuberculosis H37Rv
ggcuaucguggcggcguc

SEQ ID NO: 1259963 - RNA, 17 nt, Mycobacterium tuberculosis H37Rv
ggcuagguagucgacga

SEQ ID NO: 1259964 - RNA, 19 nt, Mycobacterium tuberculosis H37Rv
ggcucacagcacagcgcag

SEQ ID NO: 1259965 - RNA, 18 nt, Mycobacterium tuberculosis H37Rv
ggcucacagcacagcgca

SEQ ID NO: 1259966 - RNA, 22 nt, Mycobacterium tuberculosis H37Rv
ggcucacaugcccgcaccgucg

SEQ ID NO: 1259967 - RNA, 22 nt, Mycobacterium tuberculosis H37Rv
ggcucacacauagcgauucgcg

SEQ ID NO: 1259968 - RNA, 23 nt, Mycobacterium tuberculosis H37Rv
ggcggugaaaucgcacagcgcga

SEQ ID NO: 1259969 - RNA, 23 nt, Mycobacterium tuberculosis H37Rv
ggcgucgcgguuguggcugaucc

SEQ ID NO: 1259970 - RNA, 21 nt, Mycobacterium tuberculosis H37Rv
ggcgucgccgccguugccgcc

SEQ ID NO: 1259971 - RNA, 18 nt, Mycobacterium tuberculosis H37Rv
ggcgucgccgccguugcc

SEQ ID NO: 1259972 - RNA, 17 nt, Mycobacterium tuberculosis H37Rv
ggcggucucgucaaccu

SEQ ID NO: 1259973 - RNA, 23 nt, Mycobacterium tuberculosis H37Rv
ggcggucugagacucgucgaugc

SEQ ID NO: 1259974 - RNA, 22 nt, Mycobacterium tuberculosis H37Rv
ggcggucugggugagcaccugg

SEQ ID NO: 1259975 - RNA, 22 nt, Mycobacterium tuberculosis H37Rv
ggcggucuguaagacagcuauc

SEQ ID NO: 1259976 - RNA, 14 nt, Mycobacterium tuberculosis H37Rv
ggcggucggccugc

SEQ ID NO: 1259977 - RNA, 15 nt, Mycobacterium tuberculosis H37Rv
ggcggucggccggcu

SEQ ID NO: 1259978 - RNA, 12 nt, Mycobacterium tuberculosis H37Rv
ggcggucggccg

SEQ ID NO: 1259979 - RNA, 13 nt, Mycobacterium tuberculosis H37Rv
ggcggucgccgcg

SEQ ID NO: 1259980 - RNA, 14 nt, Mycobacterium tuberculosis H37Rv
ggcgucugcccgcc

SEQ ID NO: 1259981 - RNA, 16 nt, Mycobacterium tuberculosis H37Rv
ggcgucgugguggcua

SEQ ID NO: 1259982 - RNA, 18 nt, Mycobacterium tuberculosis H37Rv
ggcgucgucggcggcgac

SEQ ID NO: 1259983 - RNA, 15 nt, Mycobacterium tuberculosis H37Rv
ggcgugacagggcgg

SEQ ID NO: 1259984 - RNA, 23 nt, Mycobacterium tuberculosis H37Rv
ggcgucuuaccugaagccgcgcu

SEQ ID NO: 1259985 - RNA, 16 nt, Mycobacterium tuberculosis H37Rv
ggcgucguccgcgcca

SEQ ID NO: 1259986 - RNA, 19 nt, Mycobacterium tuberculosis H37Rv
ggcgucggugccgcugaug

SEQ ID NO: 1259987 - RNA, 20 nt, Mycobacterium tuberculosis H37Rv
ggcgucggugaaugccgucg

SEQ ID NO: 1259988 - RNA, 22 nt, Mycobacterium tuberculosis H37Rv
ggcuggcggccuaacucgccug

SEQ ID NO: 1259989 - RNA, 14 nt, Mycobacterium tuberculosis H37Rv
ggcuggcgucaccg

SEQ ID NO: 1259990 - RNA, 21 nt, Mycobacterium tuberculosis H37Rv
ggcugggcagaccgaucggca

SEQ ID NO: 1259991 - RNA, 22 nt, Mycobacterium tuberculosis H37Rv
ggcuggcccaccuccucgccgg

SEQ ID NO: 1259992 - RNA, 15 nt, Mycobacterium tuberculosis H37Rv
ggcuggcccagcgac

SEQ ID NO: 1259993 - RNA, 16 nt, Mycobacterium tuberculosis H37Rv
ggcugcgcagugacgc

SEQ ID NO: 1259994 - RNA, 13 nt, Mycobacterium tuberculosis H37Rv
ggcugcgccggaa

SEQ ID NO: 1259995 - RNA, 19 nt, Mycobacterium tuberculosis H37Rv
ggcugcgccgggcucgcga

SEQ ID NO: 1259996 - RNA, 21 nt, Mycobacterium tuberculosis H37Rv
ggcugcgccgggcucgcgauc

SEQ ID NO: 1259997 - RNA, 18 nt, Mycobacterium tuberculosis H37Rv
ggcugcgcuucgaccgag

SEQ ID NO: 1259998 - RNA, 16 nt, Mycobacterium tuberculosis H37Rv
ggcugcgggucggcca

SEQ ID NO: 1259999 - RNA, 20 nt, Mycobacterium tuberculosis H37Rv
ggcugccgaacagcgaaccg

SEQ ID NO: 1260000 - RNA, 23 nt, Mycobacterium tuberculosis H37Rv
ggcugccgaacaguucggcgagc

SEQ ID NO: 1260001 - RNA, 22 nt, Mycobacterium tuberculosis H37Rv
ggcugccgaacaguucggcgag

SEQ ID NO: 1260002 - RNA, 12 nt, Mycobacterium tuberculosis H37Rv
ggcugcccgaga

SEQ ID NO: 1260003 - RNA, 18 nt, Mycobacterium tuberculosis H37Rv
ggcugcgaccggcuccgg

SEQ ID NO: 1260004 - RNA, 21 nt, Mycobacterium tuberculosis H37Rv
ggcugccgcccaugccgggau

SEQ ID NO: 1260005 - RNA, 19 nt, Mycobacterium tuberculosis H37Rv
ggcugccgcgcgcugccgc

SEQ ID NO: 1260006 - RNA, 16 nt, Mycobacterium tuberculosis H37Rv
ggcugccgucagccgu

SEQ ID NO: 1260007 - RNA, 14 nt, Mycobacterium tuberculosis H37Rv
ggcugcaccggcuu

SEQ ID NO: 1260008 - RNA, 15 nt, Mycobacterium tuberculosis H37Rv
ggcugcacgcucguu

SEQ ID NO: 1260009 - RNA, 16 nt, Mycobacterium tuberculosis H37Rv
ggcugaucuaccagug

SEQ ID NO: 1260010 - RNA, 23 nt, Mycobacterium tuberculosis H37Rv
ggcugcauccuccucgucgacgu

SEQ ID NO: 1260011 - RNA, 22 nt, Mycobacterium tuberculosis H37Rv
ggcugcagugacucgaucacca

SEQ ID NO: 1260012 - RNA, 16 nt, Mycobacterium tuberculosis H37Rv
ggcugccagugccgcc

SEQ ID NO: 1260013 - RNA, 14 nt, Mycobacterium tuberculosis H37Rv
ggcugccaccgcag

SEQ ID NO: 1260014 - RNA, 21 nt, Mycobacterium tuberculosis H37Rv
ggcugccagaaugggcggcau

SEQ ID NO: 1260015 - RNA, 14 nt, Mycobacterium tuberculosis H37Rv
ggcugaucccggcc

SEQ ID NO: 1260016 - RNA, 18 nt, Mycobacterium tuberculosis H37Rv
ggcugagcccgccgcgac

SEQ ID NO: 1260017 - RNA, 21 nt, Mycobacterium tuberculosis H37Rv
ggcugaaggacggcagcuugg

SEQ ID NO: 1260018 - RNA, 16 nt, Mycobacterium tuberculosis H37Rv
ggcucuguagcgucgc

SEQ ID NO: 1260019 - RNA, 22 nt, Mycobacterium tuberculosis H37Rv
ggcucuucgcagcgguggucgg

SEQ ID NO: 1260020 - RNA, 18 nt, Mycobacterium tuberculosis H37Rv
ggcugaaaccuugcggca

SEQ ID NO: 1260021 - RNA, 16 nt, Mycobacterium tuberculosis H37Rv
ggcugaaacauccccg

SEQ ID NO: 1260022 - RNA, 13 nt, Mycobacterium tuberculosis H37Rv
ggcugaacaccgc

SEQ ID NO: 1260023 - RNA, 14 nt, Mycobacterium tuberculosis H37Rv
ggcugaacaccgcg

SEQ ID NO: 1260024 - RNA, 13 nt, Mycobacterium tuberculosis H37Rv
ggcuccgcccagg

SEQ ID NO: 1260025 - RNA, 21 nt, Mycobacterium tuberculosis H37Rv
ggcuccccggauuccucguca

SEQ ID NO: 1260026 - RNA, 15 nt, Mycobacterium tuberculosis H37Rv
ggcucccccaccagg

SEQ ID NO: 1260027 - RNA, 23 nt, Mycobacterium tuberculosis H37Rv
ggcuccagguccacauccagggu

SEQ ID NO: 1260028 - RNA, 14 nt, Mycobacterium tuberculosis H37Rv
ggcucucagcgaca

SEQ ID NO: 1260029 - RNA, 17 nt, Mycobacterium tuberculosis H37Rv
ggcucucagcgacagcu

SEQ ID NO: 1260030 - RNA, 21 nt, Mycobacterium tuberculosis H37Rv
ggcucugaggucaccggcgac

SEQ ID NO: 1260031 - RNA, 15 nt, Mycobacterium tuberculosis H37Rv
ggcuccggcggcagc

SEQ ID NO: 1260032 - RNA, 20 nt, Mycobacterium tuberculosis H37Rv
ggcuccgcccggcgugucgc

SEQ ID NO: 1260033 - RNA, 13 nt, Mycobacterium tuberculosis H37Rv
ggcuccgcaacca

SEQ ID NO: 1260034 - RNA, 12 nt, Mycobacterium tuberculosis H37Rv
ggcuccgccguu

SEQ ID NO: 1260035 - RNA, 16 nt, Mycobacterium tuberculosis H37Rv
ggccucaacgccagcu

SEQ ID NO: 1260036 - RNA, 19 nt, Mycobacterium tuberculosis H37Rv
ggccucagacaacggguug

SEQ ID NO: 1260037 - RNA, 21 nt, Mycobacterium tuberculosis H37Rv
ggccuccacccgccacgguuc

SEQ ID NO: 1260038 - RNA, 17 nt, Mycobacterium tuberculosis H37Rv
ggccuccaccacgucgg

SEQ ID NO: 1260039 - RNA, 12 nt, Mycobacterium tuberculosis H37Rv
ggccucggcgac

SEQ ID NO: 1260040 - RNA, 13 nt, Mycobacterium tuberculosis H37Rv
ggccucggcgaua

SEQ ID NO: 1260041 - RNA, 16 nt, Mycobacterium tuberculosis H37Rv
ggccucggcgccgucg

SEQ ID NO: 1260042 - RNA, 16 nt, Mycobacterium tuberculosis H37Rv
ggccucggccagcguc

SEQ ID NO: 1260043 - RNA, 15 nt, Mycobacterium tuberculosis H37Rv
ggccucgcugcucag

SEQ ID NO: 1260044 - RNA, 20 nt, Mycobacterium tuberculosis H37Rv
ggccugguacucccgcgauc

SEQ ID NO: 1260045 - RNA, 23 nt, Mycobacterium tuberculosis H37Rv
ggccugcgcuucguccagcgauc

SEQ ID NO: 1260046 - RNA, 18 nt, Mycobacterium tuberculosis H37Rv
ggccugcacggcgcugac

SEQ ID NO: 1260047 - RNA, 17 nt, Mycobacterium tuberculosis H37Rv
ggccugcaccacggcgg

SEQ ID NO: 1260048 - RNA, 20 nt, Mycobacterium tuberculosis H37Rv
ggccugcaccagcgaguuga

SEQ ID NO: 1260049 - RNA, 19 nt, Mycobacterium tuberculosis H37Rv
ggccucggggaucgcaagc

SEQ ID NO: 1260050 - RNA, 23 nt, Mycobacterium tuberculosis H37Rv
ggccucggucugguggucggcga

SEQ ID NO: 1260051 - RNA, 15 nt, Mycobacterium tuberculosis H37Rv
ggccucgucgugcac

SEQ ID NO: 1260052 - RNA, 15 nt, Mycobacterium tuberculosis H37Rv
ggccuugugcucgau

SEQ ID NO: 1260053 - RNA, 18 nt, Mycobacterium tuberculosis H37Rv
ggccuuugucgccuucuu

SEQ ID NO: 1260054 - RNA, 22 nt, Mycobacterium tuberculosis H37Rv
ggccugguuguccguaucgggc

SEQ ID NO: 1260055 - RNA, 14 nt, Mycobacterium tuberculosis H37Rv
ggccugucgaagau

SEQ ID NO: 1260056 - RNA, 14 nt, Mycobacterium tuberculosis H37Rv
ggccuggucggcca

SEQ ID NO: 1260057 - RNA, 21 nt, Mycobacterium tuberculosis H37Rv
ggcgaagaacaacaucgccau

SEQ ID NO: 1260058 - RNA, 16 nt, Mycobacterium tuberculosis H37Rv
ggcgaacucgaggucg

SEQ ID NO: 1260059 - RNA, 17 nt, Mycobacterium tuberculosis H37Rv
ggcgaaccgucagcgcg

SEQ ID NO: 1260060 - RNA, 14 nt, Mycobacterium tuberculosis H37Rv
ggcgaaucgggcaa

SEQ ID NO: 1260061 - RNA, 23 nt, Mycobacterium tuberculosis H37Rv
ggcgaaucuuugguagucugcac

SEQ ID NO: 1260062 - RNA, 16 nt, Mycobacterium tuberculosis H37Rv
ggcgaaugacggccag

SEQ ID NO: 1260063 - RNA, 23 nt, Mycobacterium tuberculosis H37Rv
ggcgaaggccagcagaaacaucg

SEQ ID NO: 1260064 - RNA, 18 nt, Mycobacterium tuberculosis H37Rv
ggcgaaggucuggccugc

SEQ ID NO: 1260065 - RNA, 14 nt, Mycobacterium tuberculosis H37Rv
ggccguacgacggc

SEQ ID NO: 1260066 - RNA, 15 nt, Mycobacterium tuberculosis H37Rv
ggccguagcccacga

SEQ ID NO: 1260067 - RNA, 18 nt, Mycobacterium tuberculosis H37Rv
ggccguacaacagcgcgc

SEQ ID NO: 1260068 - RNA, 16 nt, Mycobacterium tuberculosis H37Rv
ggccguaggcggcgac

SEQ ID NO: 1260069 - RNA, 24 nt, Mycobacterium tuberculosis H37Rv
ggccguagucggcgaugcgcacca

SEQ ID NO: 1260070 - RNA, 17 nt, Mycobacterium tuberculosis H37Rv
ggccguaguggccggcu

SEQ ID NO: 1260071 - RNA, 21 nt, Mycobacterium tuberculosis H37Rv
ggccgucagccaggugcccaa

SEQ ID NO: 1260072 - RNA, 15 nt, Mycobacterium tuberculosis H37Rv
ggccgucaucgccgg

SEQ ID NO: 1260073 - RNA, 16 nt, Mycobacterium tuberculosis H37Rv
ggccguaucgucgagc

SEQ ID NO: 1260074 - RNA, 21 nt, Mycobacterium tuberculosis H37Rv
ggccgucaaucgcaaugaccu

SEQ ID NO: 1260075 - RNA, 17 nt, Mycobacterium tuberculosis H37Rv
ggccgucgacgaucagc

SEQ ID NO: 1260076 - RNA, 12 nt, Mycobacterium tuberculosis H37Rv
ggccgucgccga

SEQ ID NO: 1260077 - RNA, 22 nt, Mycobacterium tuberculosis H37Rv
ggccgucgaacgguagcacggu

SEQ ID NO: 1260078 - RNA, 20 nt, Mycobacterium tuberculosis H37Rv
ggccgucgaagacgaacgug

SEQ ID NO: 1260079 - RNA, 22 nt, Mycobacterium tuberculosis H37Rv
ggccgucccgcgagcagcccgg

SEQ ID NO: 1260080 - RNA, 17 nt, Mycobacterium tuberculosis H37Rv
ggccgucaucgccgggu

SEQ ID NO: 1260081 - RNA, 16 nt, Mycobacterium tuberculosis H37Rv
ggccgguuggccagcc

SEQ ID NO: 1260082 - RNA, 14 nt, Mycobacterium tuberculosis H37Rv
ggccgguucgcccg

SEQ ID NO: 1260083 - RNA, 15 nt, Mycobacterium tuberculosis H37Rv
ggccguaacgcggau

SEQ ID NO: 1260084 - RNA, 14 nt, Mycobacterium tuberculosis H37Rv
ggccguaacggcga

SEQ ID NO: 1260085 - RNA, 13 nt, Mycobacterium tuberculosis H37Rv
ggccggugcgcau

SEQ ID NO: 1260086 - RNA, 16 nt, Mycobacterium tuberculosis H37Rv
ggccggugcgcaugga

SEQ ID NO: 1260087 - RNA, 15 nt, Mycobacterium tuberculosis H37Rv
ggccgggcuggcgac

SEQ ID NO: 1260088 - RNA, 17 nt, Mycobacterium tuberculosis H37Rv
ggccgggcgaucgccug

SEQ ID NO: 1260089 - RNA, 15 nt, Mycobacterium tuberculosis H37Rv
ggccgggccugcacc

SEQ ID NO: 1260090 - RNA, 14 nt, Mycobacterium tuberculosis H37Rv
ggccggugccaguc

SEQ ID NO: 1260091 - RNA, 19 nt, Mycobacterium tuberculosis H37Rv
ggccgggccgagugcccag

SEQ ID NO: 1260092 - RNA, 15 nt, Mycobacterium tuberculosis H37Rv
ggccgggccggccac

SEQ ID NO: 1260093 - RNA, 17 nt, Mycobacterium tuberculosis H37Rv
ggccgggcaguucacgg

SEQ ID NO: 1260094 - RNA, 13 nt, Mycobacterium tuberculosis H37Rv
ggccgggccgagu

SEQ ID NO: 1260095 - RNA, 15 nt, Mycobacterium tuberculosis H37Rv
ggccgggcagugcgc

SEQ ID NO: 1260096 - RNA, 13 nt, Mycobacterium tuberculosis H37Rv
ggccggcgguagc

SEQ ID NO: 1260097 - RNA, 16 nt, Mycobacterium tuberculosis H37Rv
ggccggcggcucgggu

SEQ ID NO: 1260098 - RNA, 14 nt, Mycobacterium tuberculosis H37Rv
ggccggcggcucgg

SEQ ID NO: 1260099 - RNA, 17 nt, Mycobacterium tuberculosis H37Rv
ggccggauccucgauau

SEQ ID NO: 1260100 - RNA, 22 nt, Mycobacterium tuberculosis H37Rv
ggccggaugucgacgagcaccg

SEQ ID NO: 1260101 - RNA, 18 nt, Mycobacterium tuberculosis H37Rv
ggccggaugucgacgagc

SEQ ID NO: 1260102 - RNA, 21 nt, Mycobacterium tuberculosis H37Rv
ggccggacaacagagucaccg

SEQ ID NO: 1260103 - RNA, 17 nt, Mycobacterium tuberculosis H37Rv
ggccggcaucgucgggu

SEQ ID NO: 1260104 - RNA, 17 nt, Mycobacterium tuberculosis H37Rv
ggccggccaccaccgcg

SEQ ID NO: 1260105 - RNA, 18 nt, Mycobacterium tuberculosis H37Rv
ggccggcaccgcagcgga

SEQ ID NO: 1260106 - RNA, 19 nt, Mycobacterium tuberculosis H37Rv
ggccgcuucggcggucagc

SEQ ID NO: 1260107 - RNA, 17 nt, Mycobacterium tuberculosis H37Rv
ggccgcuucggcgguca

SEQ ID NO: 1260108 - RNA, 22 nt, Mycobacterium tuberculosis H37Rv
ggccgcugugcggucgucaccg

SEQ ID NO: 1260109 - RNA, 20 nt, Mycobacterium tuberculosis H37Rv
ggccgcgauccagcgcugac

SEQ ID NO: 1260110 - RNA, 22 nt, Mycobacterium tuberculosis H37Rv
ggccgcgagacgcaugucgggc

SEQ ID NO: 1260111 - RNA, 23 nt, Mycobacterium tuberculosis H37Rv
ggccgccuucuccggcgucacgg

SEQ ID NO: 1260112 - RNA, 22 nt, Mycobacterium tuberculosis H37Rv
ggccgccuucgccgccgccgau

SEQ ID NO: 1260113 - RNA, 23 nt, Mycobacterium tuberculosis H37Rv
ggccgccuucgccgccgccgauc

SEQ ID NO: 1260114 - RNA, 17 nt, Mycobacterium tuberculosis H37Rv
ggccgaccagucgacgu

SEQ ID NO: 1260115 - RNA, 22 nt, Mycobacterium tuberculosis H37Rv
ggccgaccgggcucuggccagu

SEQ ID NO: 1260116 - RNA, 23 nt, Mycobacterium tuberculosis H37Rv
ggccgaccucguucgucaccacg

SEQ ID NO: 1260117 - RNA, 21 nt, Mycobacterium tuberculosis H37Rv
ggcccuuguggaguacggcga

SEQ ID NO: 1260118 - RNA, 17 nt, Mycobacterium tuberculosis H37Rv
ggccgaacgggucggcg

SEQ ID NO: 1260119 - RNA, 22 nt, Mycobacterium tuberculosis H37Rv
ggccgaaagccaggcggcaagg

SEQ ID NO: 1260120 - RNA, 15 nt, Mycobacterium tuberculosis H37Rv
ggccgaacacaccgg

SEQ ID NO: 1260121 - RNA, 23 nt, Mycobacterium tuberculosis H37Rv
ggccgaacagcugcccgccagcg

SEQ ID NO: 1260122 - RNA, 14 nt, Mycobacterium tuberculosis H37Rv
ggcccgguccagcc

SEQ ID NO: 1260123 - RNA, 16 nt, Mycobacterium tuberculosis H37Rv
ggcccgggugacggga

SEQ ID NO: 1260124 - RNA, 20 nt, Mycobacterium tuberculosis H37Rv
ggcccgggcggccagcugca

SEQ ID NO: 1260125 - RNA, 14 nt, Mycobacterium tuberculosis H37Rv
ggcccggaacaccg

SEQ ID NO: 1260126 - RNA, 19 nt, Mycobacterium tuberculosis H37Rv
ggcccgggaggcguugcac

SEQ ID NO: 1260127 - RNA, 15 nt, Mycobacterium tuberculosis H37Rv
ggcccggcucggugc

SEQ ID NO: 1260128 - RNA, 15 nt, Mycobacterium tuberculosis H37Rv
ggcccgggccaccgg

SEQ ID NO: 1260129 - RNA, 17 nt, Mycobacterium tuberculosis H37Rv
ggcccgcucccugcacc

SEQ ID NO: 1260130 - RNA, 23 nt, Mycobacterium tuberculosis H37Rv
ggcccgcgcguacccgaucagcg

SEQ ID NO: 1260131 - RNA, 20 nt, Mycobacterium tuberculosis H37Rv
ggcccgagccgcuaggacgg

SEQ ID NO: 1260132 - RNA, 18 nt, Mycobacterium tuberculosis H37Rv
ggccccgcgccggccgca

SEQ ID NO: 1260133 - RNA, 18 nt, Mycobacterium tuberculosis H37Rv
ggccccgccgaugccgcc

SEQ ID NO: 1260134 - RNA, 21 nt, Mycobacterium tuberculosis H37Rv
ggcccgcaacgcgucggucgc

SEQ ID NO: 1260135 - RNA, 15 nt, Mycobacterium tuberculosis H37Rv
ggcccgcacgaaccg

SEQ ID NO: 1260136 - RNA, 12 nt, Mycobacterium tuberculosis H37Rv
ggcccgaucccg

SEQ ID NO: 1260137 - RNA, 17 nt, Mycobacterium tuberculosis H37Rv
ggcccgauaaaugccgc

SEQ ID NO: 1260138 - RNA, 15 nt, Mycobacterium tuberculosis H37Rv
ggcccgaucggcaac

SEQ ID NO: 1260139 - RNA, 16 nt, Mycobacterium tuberculosis H37Rv
ggcccgaugccgagga

SEQ ID NO: 1260140 - RNA, 18 nt, Mycobacterium tuberculosis H37Rv
ggccccgccgucaccgcc

SEQ ID NO: 1260141 - RNA, 18 nt, Mycobacterium tuberculosis H37Rv
ggccccgccguugccgcc

SEQ ID NO: 1260142 - RNA, 16 nt, Mycobacterium tuberculosis H37Rv
ggccccgcgcagcguc

SEQ ID NO: 1260143 - RNA, 18 nt, Mycobacterium tuberculosis H37Rv
ggccccgccagcggcagc

SEQ ID NO: 1260144 - RNA, 22 nt, Mycobacterium tuberculosis H37Rv
ggcccauucaucuugcggcagc

SEQ ID NO: 1260145 - RNA, 18 nt, Mycobacterium tuberculosis H37Rv
ggcccagguugcggucuu

SEQ ID NO: 1260146 - RNA, 22 nt, Mycobacterium tuberculosis H37Rv
ggcccagugggacaggucggca

SEQ ID NO: 1260147 - RNA, 20 nt, Mycobacterium tuberculosis H37Rv
ggcccagcuagguccgaacu

SEQ ID NO: 1260148 - RNA, 17 nt, Mycobacterium tuberculosis H37Rv
ggccaggcgaagucgac

SEQ ID NO: 1260149 - RNA, 22 nt, Mycobacterium tuberculosis H37Rv
ggccgccaguccgaucgccgag

SEQ ID NO: 1260150 - RNA, 14 nt, Mycobacterium tuberculosis H37Rv
ggccgccaguucgg

SEQ ID NO: 1260151 - RNA, 15 nt, Mycobacterium tuberculosis H37Rv
ggccgccaguccgau

SEQ ID NO: 1260152 - RNA, 21 nt, Mycobacterium tuberculosis H37Rv
ggccgccagcugcgcagcgca

SEQ ID NO: 1260153 - RNA, 22 nt, Mycobacterium tuberculosis H37Rv
ggccgccagcgcgccgaucacg

SEQ ID NO: 1260154 - RNA, 14 nt, Mycobacterium tuberculosis H37Rv
ggccgccagccggu

SEQ ID NO: 1260155 - RNA, 18 nt, Mycobacterium tuberculosis H37Rv
ggccgccgccccggcgcu

SEQ ID NO: 1260156 - RNA, 14 nt, Mycobacterium tuberculosis H37Rv
ggccgccgacaacc

SEQ ID NO: 1260157 - RNA, 21 nt, Mycobacterium tuberculosis H37Rv
ggccgccgaauccgacgucga

SEQ ID NO: 1260158 - RNA, 17 nt, Mycobacterium tuberculosis H37Rv
ggccgccgaugccaccg

SEQ ID NO: 1260159 - RNA, 19 nt, Mycobacterium tuberculosis H37Rv
ggccgcccgcucgaugucg

SEQ ID NO: 1260160 - RNA, 17 nt, Mycobacterium tuberculosis H37Rv
ggccgcccgcucgaugu

SEQ ID NO: 1260161 - RNA, 23 nt, Mycobacterium tuberculosis H37Rv
ggccgccccaggcugguccgggu

SEQ ID NO: 1260162 - RNA, 20 nt, Mycobacterium tuberculosis H37Rv
ggccgcccuggccgcccaga

SEQ ID NO: 1260163 - RNA, 15 nt, Mycobacterium tuberculosis H37Rv
ggccgccucgaucga

SEQ ID NO: 1260164 - RNA, 19 nt, Mycobacterium tuberculosis H37Rv
ggccgccucguacggaccg

SEQ ID NO: 1260165 - RNA, 16 nt, Mycobacterium tuberculosis H37Rv
ggccgccuccgcggca

SEQ ID NO: 1260166 - RNA, 15 nt, Mycobacterium tuberculosis H37Rv
ggccgccguugccgu

SEQ ID NO: 1260167 - RNA, 21 nt, Mycobacterium tuberculosis H37Rv
ggccgccguccccgccgucgc

SEQ ID NO: 1260168 - RNA, 20 nt, Mycobacterium tuberculosis H37Rv
ggccgccggguccggaaccg

SEQ ID NO: 1260169 - RNA, 17 nt, Mycobacterium tuberculosis H37Rv
ggccgccggcgcuggcg

SEQ ID NO: 1260170 - RNA, 17 nt, Mycobacterium tuberculosis H37Rv
ggccgccggccagcguc

SEQ ID NO: 1260171 - RNA, 15 nt, Mycobacterium tuberculosis H37Rv
ggccgccgcugccgc

SEQ ID NO: 1260172 - RNA, 18 nt, Mycobacterium tuberculosis H37Rv
ggccgccggaucaggauc

SEQ ID NO: 1260173 - RNA, 13 nt, Mycobacterium tuberculosis H37Rv
ggccgccgcugcc

SEQ ID NO: 1260174 - RNA, 14 nt, Mycobacterium tuberculosis H37Rv
ggccgccgcgucga

SEQ ID NO: 1260175 - RNA, 16 nt, Mycobacterium tuberculosis H37Rv
ggccgccgcgaggaug

SEQ ID NO: 1260176 - RNA, 20 nt, Mycobacterium tuberculosis H37Rv
ggccgccgccgucggcgagc

SEQ ID NO: 1260177 - RNA, 22 nt, Mycobacterium tuberculosis H37Rv
ggccgccgcgcaccgcgggauc

SEQ ID NO: 1260178 - RNA, 20 nt, Mycobacterium tuberculosis H37Rv
ggccgcaagccgcgagucgc

SEQ ID NO: 1260179 - RNA, 15 nt, Mycobacterium tuberculosis H37Rv
ggccgcaagccgcga

SEQ ID NO: 1260180 - RNA, 21 nt, Mycobacterium tuberculosis H37Rv
ggccgcaaggcgccgauaccg

SEQ ID NO: 1260181 - RNA, 13 nt, Mycobacterium tuberculosis H37Rv
ggccgcaccagca

SEQ ID NO: 1260182 - RNA, 16 nt, Mycobacterium tuberculosis H37Rv
ggccgcacgccgacca

SEQ ID NO: 1260183 - RNA, 18 nt, Mycobacterium tuberculosis H37Rv
ggccgcacgccgaccagc

SEQ ID NO: 1260184 - RNA, 15 nt, Mycobacterium tuberculosis H37Rv
ggccgcacgggcgac

SEQ ID NO: 1260185 - RNA, 20 nt, Mycobacterium tuberculosis H37Rv
ggccgcacgggcgaccugcg

SEQ ID NO: 1260186 - RNA, 23 nt, Mycobacterium tuberculosis H37Rv
ggccgcacggucagcgcgcacga

SEQ ID NO: 1260187 - RNA, 21 nt, Mycobacterium tuberculosis H37Rv
ggccgauuccgcgcguccguc

SEQ ID NO: 1260188 - RNA, 19 nt, Mycobacterium tuberculosis H37Rv
ggccgaugacgaugccgcc

SEQ ID NO: 1260189 - RNA, 14 nt, Mycobacterium tuberculosis H37Rv
ggccgacgaugugc

SEQ ID NO: 1260190 - RNA, 16 nt, Mycobacterium tuberculosis H37Rv
ggccgcacgccuacga

SEQ ID NO: 1260191 - RNA, 15 nt, Mycobacterium tuberculosis H37Rv
ggccgcacgucgacc

SEQ ID NO: 1260192 - RNA, 16 nt, Mycobacterium tuberculosis H37Rv
ggccgcacugcugguc

SEQ ID NO: 1260193 - RNA, 17 nt, Mycobacterium tuberculosis H37Rv
ggccgcacugcugguca

SEQ ID NO: 1260194 - RNA, 16 nt, Mycobacterium tuberculosis H37Rv
ggccgcagccagcaag

SEQ ID NO: 1260195 - RNA, 13 nt, Mycobacterium tuberculosis H37Rv
ggccgcaggccag

SEQ ID NO: 1260196 - RNA, 22 nt, Mycobacterium tuberculosis H37Rv
ggccgcagccagcaagucugcc

SEQ ID NO: 1260197 - RNA, 15 nt, Mycobacterium tuberculosis H37Rv
ggccgcagcggccag

SEQ ID NO: 1260198 - RNA, 19 nt, Mycobacterium tuberculosis H37Rv
ggccgccaccgcgacgagc

SEQ ID NO: 1260199 - RNA, 17 nt, Mycobacterium tuberculosis H37Rv
ggccgccaccgucaccg

SEQ ID NO: 1260200 - RNA, 19 nt, Mycobacterium tuberculosis H37Rv
ggccgccaccgucaccgcc

SEQ ID NO: 1260201 - RNA, 21 nt, Mycobacterium tuberculosis H37Rv
ggccgccaccgucaccgccgu

SEQ ID NO: 1260202 - RNA, 17 nt, Mycobacterium tuberculosis H37Rv
ggccgccaccucccagg

SEQ ID NO: 1260203 - RNA, 20 nt, Mycobacterium tuberculosis H37Rv
ggccgccacaccgccgccaa

SEQ ID NO: 1260204 - RNA, 15 nt, Mycobacterium tuberculosis H37Rv
ggccgcaugccacgg

SEQ ID NO: 1260205 - RNA, 13 nt, Mycobacterium tuberculosis H37Rv
ggccgccaccagc

SEQ ID NO: 1260206 - RNA, 14 nt, Mycobacterium tuberculosis H37Rv
ggccgcaucgguca

SEQ ID NO: 1260207 - RNA, 15 nt, Mycobacterium tuberculosis H37Rv
ggccgcaucgacgcu

SEQ ID NO: 1260208 - RNA, 23 nt, Mycobacterium tuberculosis H37Rv
ggccgcagugcgacucugcgucu

SEQ ID NO: 1260209 - RNA, 24 nt, Mycobacterium tuberculosis H37Rv
ggccacuccaguacgguccggcgu

SEQ ID NO: 1260210 - RNA, 19 nt, Mycobacterium tuberculosis H37Rv
ggccagcaccacggccagc

SEQ ID NO: 1260211 - RNA, 14 nt, Mycobacterium tuberculosis H37Rv
ggccagcacggcga

SEQ ID NO: 1260212 - RNA, 15 nt, Mycobacterium tuberculosis H37Rv
ggccagcacggcgac

SEQ ID NO: 1260213 - RNA, 16 nt, Mycobacterium tuberculosis H37Rv
ggccagcaccucgacc

SEQ ID NO: 1260214 - RNA, 16 nt, Mycobacterium tuberculosis H37Rv
ggccagcaagacgaug

SEQ ID NO: 1260215 - RNA, 20 nt, Mycobacterium tuberculosis H37Rv
ggccagcacaccgucgacga

SEQ ID NO: 1260216 - RNA, 23 nt, Mycobacterium tuberculosis H37Rv
ggccacgggaguacgggagccgg

SEQ ID NO: 1260217 - RNA, 18 nt, Mycobacterium tuberculosis H37Rv
ggccacgguagaacacgu

SEQ ID NO: 1260218 - RNA, 16 nt, Mycobacterium tuberculosis H37Rv
ggccacggucagccag

SEQ ID NO: 1260219 - RNA, 19 nt, Mycobacterium tuberculosis H37Rv
ggccaccgaccgcacgauc

SEQ ID NO: 1260220 - RNA, 22 nt, Mycobacterium tuberculosis H37Rv
ggccaccggacgaaacgaucgc

SEQ ID NO: 1260221 - RNA, 14 nt, Mycobacterium tuberculosis H37Rv
ggccaccggcgguc

SEQ ID NO: 1260222 - RNA, 23 nt, Mycobacterium tuberculosis H37Rv
ggccaccucggugcggaacaccg

SEQ ID NO: 1260223 - RNA, 11 nt, Mycobacterium tuberculosis H37Rv
ggccaccguca

SEQ ID NO: 1260224 - RNA, 23 nt, Mycobacterium tuberculosis H37Rv
ggccaacauccgguggugcucgu

SEQ ID NO: 1260225 - RNA, 13 nt, Mycobacterium tuberculosis H37Rv
ggccaacagucgc

SEQ ID NO: 1260226 - RNA, 14 nt, Mycobacterium tuberculosis H37Rv
ggccaacauccggu

SEQ ID NO: 1260227 - RNA, 15 nt, Mycobacterium tuberculosis H37Rv
ggccacccgcgcgau

SEQ ID NO: 1260228 - RNA, 15 nt, Mycobacterium tuberculosis H37Rv
ggccacccgguggcg

SEQ ID NO: 1260229 - RNA, 13 nt, Mycobacterium tuberculosis H37Rv
ggccaaaauggcg

SEQ ID NO: 1260230 - RNA, 14 nt, Mycobacterium tuberculosis H37Rv
ggccaaagcgcggg

SEQ ID NO: 1260231 - RNA, 15 nt, Mycobacterium tuberculosis H37Rv
ggccaacaccgccag

SEQ ID NO: 1260232 - RNA, 19 nt, Mycobacterium tuberculosis H37Rv
ggccaacagguuccacgga

SEQ ID NO: 1260233 - RNA, 12 nt, Mycobacterium tuberculosis H37Rv
ggcaugcucugg

SEQ ID NO: 1260234 - RNA, 20 nt, Mycobacterium tuberculosis H37Rv
ggccagcgggugaaucgaca

SEQ ID NO: 1260235 - RNA, 23 nt, Mycobacterium tuberculosis H37Rv
ggccagcgguaaugccagcggca

SEQ ID NO: 1260236 - RNA, 22 nt, Mycobacterium tuberculosis H37Rv
ggccagcgugucccaacgccac

SEQ ID NO: 1260237 - RNA, 22 nt, Mycobacterium tuberculosis H37Rv
ggccagcuccucagccaccgcg

SEQ ID NO: 1260238 - RNA, 23 nt, Mycobacterium tuberculosis H37Rv
ggccagcuucccgguagcggcgg

SEQ ID NO: 1260239 - RNA, 23 nt, Mycobacterium tuberculosis H37Rv
ggccagccagcgggcgaugagcg

SEQ ID NO: 1260240 - RNA, 12 nt, Mycobacterium tuberculosis H37Rv
ggccagccaugg

SEQ ID NO: 1260241 - RNA, 18 nt, Mycobacterium tuberculosis H37Rv
ggccagcgccucggcauc

SEQ ID NO: 1260242 - RNA, 22 nt, Mycobacterium tuberculosis H37Rv
ggccagcaucagcucgaugccg

SEQ ID NO: 1260243 - RNA, 23 nt, Mycobacterium tuberculosis H37Rv
ggccagcaucagcgccagcgagc

SEQ ID NO: 1260244 - RNA, 21 nt, Mycobacterium tuberculosis H37Rv
ggccagcaucagcucgaugcc

SEQ ID NO: 1260245 - RNA, 22 nt, Mycobacterium tuberculosis H37Rv
ggccagcagaaacaucgacagc

SEQ ID NO: 1260246 - RNA, 11 nt, Mycobacterium tuberculosis H37Rv
ggccagcggcc

SEQ ID NO: 1260247 - RNA, 15 nt, Mycobacterium tuberculosis H37Rv
ggccagcgcucaccg

SEQ ID NO: 1260248 - RNA, 21 nt, Mycobacterium tuberculosis H37Rv
ggccagcgcgucgccgucgau

SEQ ID NO: 1260249 - RNA, 15 nt, Mycobacterium tuberculosis H37Rv
ggccagcgcggcguc

SEQ ID NO: 1260250 - RNA, 14 nt, Mycobacterium tuberculosis H37Rv
ggccagcgcgcuca

SEQ ID NO: 1260251 - RNA, 12 nt, Mycobacterium tuberculosis H37Rv
ggcauccugcac

SEQ ID NO: 1260252 - RNA, 19 nt, Mycobacterium tuberculosis H37Rv
ggcaucgaggccagcagcu

SEQ ID NO: 1260253 - RNA, 16 nt, Mycobacterium tuberculosis H37Rv
ggcaucgacugccagc

SEQ ID NO: 1260254 - RNA, 13 nt, Mycobacterium tuberculosis H37Rv
ggcaucgacgcgu

SEQ ID NO: 1260255 - RNA, 22 nt, Mycobacterium tuberculosis H37Rv
ggcagucgcgguaccaucaccg

SEQ ID NO: 1260256 - RNA, 14 nt, Mycobacterium tuberculosis H37Rv
ggcaguccagccgg

SEQ ID NO: 1260257 - RNA, 13 nt, Mycobacterium tuberculosis H37Rv
ggcaguccaggca

SEQ ID NO: 1260258 - RNA, 14 nt, Mycobacterium tuberculosis H37Rv
ggcaguccaccgcg

SEQ ID NO: 1260259 - RNA, 17 nt, Mycobacterium tuberculosis H37Rv
ggcaggguggccagcag

SEQ ID NO: 1260260 - RNA, 12 nt, Mycobacterium tuberculosis H37Rv
ggcaugccacac

SEQ ID NO: 1260261 - RNA, 21 nt, Mycobacterium tuberculosis H37Rv
ggcaugaagcaguuggccgag

SEQ ID NO: 1260262 - RNA, 19 nt, Mycobacterium tuberculosis H37Rv
ggcaucgucgacgaugucg

SEQ ID NO: 1260263 - RNA, 14 nt, Mycobacterium tuberculosis H37Rv
ggcaucgucgacgc

SEQ ID NO: 1260264 - RNA, 18 nt, Mycobacterium tuberculosis H37Rv
ggcaucggugcgguucgc

SEQ ID NO: 1260265 - RNA, 17 nt, Mycobacterium tuberculosis H37Rv
ggcaucggcggagucga

SEQ ID NO: 1260266 - RNA, 15 nt, Mycobacterium tuberculosis H37Rv
ggcaucggcggcguc

SEQ ID NO: 1260267 - RNA, 23 nt, Mycobacterium tuberculosis H37Rv
ggcaucggccuguucgccgucgc

SEQ ID NO: 1260268 - RNA, 15 nt, Mycobacterium tuberculosis H37Rv
ggcacugaccgcgau

SEQ ID NO: 1260269 - RNA, 15 nt, Mycobacterium tuberculosis H37Rv
ggcacugcgaucgcg

SEQ ID NO: 1260270 - RNA, 16 nt, Mycobacterium tuberculosis H37Rv
ggcacugcgaucgcga

SEQ ID NO: 1260271 - RNA, 20 nt, Mycobacterium tuberculosis H37Rv
ggcacugcccagcagaccaa

SEQ ID NO: 1260272 - RNA, 17 nt, Mycobacterium tuberculosis H37Rv
ggcacuuccagcccggc

SEQ ID NO: 1260273 - RNA, 22 nt, Mycobacterium tuberculosis H37Rv
ggcagaaucggugggcgggcaa

SEQ ID NO: 1260274 - RNA, 15 nt, Mycobacterium tuberculosis H37Rv
ggcagaccaacgcuc

SEQ ID NO: 1260275 - RNA, 13 nt, Mycobacterium tuberculosis H37Rv
ggcagcggcgauc

SEQ ID NO: 1260276 - RNA, 16 nt, Mycobacterium tuberculosis H37Rv
ggcagcggcgcgguuu

SEQ ID NO: 1260277 - RNA, 21 nt, Mycobacterium tuberculosis H37Rv
ggcagcggaccgcugccugcc

SEQ ID NO: 1260278 - RNA, 14 nt, Mycobacterium tuberculosis H37Rv
ggcagcgcggcacc

SEQ ID NO: 1260279 - RNA, 21 nt, Mycobacterium tuberculosis H37Rv
ggcagcgcggaugucggcauc

SEQ ID NO: 1260280 - RNA, 16 nt, Mycobacterium tuberculosis H37Rv
ggcagcgcgaucaccg

SEQ ID NO: 1260281 - RNA, 16 nt, Mycobacterium tuberculosis H37Rv
ggcagaccggcaucga

SEQ ID NO: 1260282 - RNA, 13 nt, Mycobacterium tuberculosis H37Rv
ggcagaccgguga

SEQ ID NO: 1260283 - RNA, 14 nt, Mycobacterium tuberculosis H37Rv
ggcaggccggcguc

SEQ ID NO: 1260284 - RNA, 18 nt, Mycobacterium tuberculosis H37Rv
ggcaggccggcgucgauc

SEQ ID NO: 1260285 - RNA, 19 nt, Mycobacterium tuberculosis H37Rv
ggcaggccggcgucgauca

SEQ ID NO: 1260286 - RNA, 22 nt, Mycobacterium tuberculosis H37Rv
ggcagcgucacccugucgcgca

SEQ ID NO: 1260287 - RNA, 19 nt, Mycobacterium tuberculosis H37Rv
ggcagcgggacugcggaag

SEQ ID NO: 1260288 - RNA, 22 nt, Mycobacterium tuberculosis H37Rv
ggcagcggugcugguggcggca

SEQ ID NO: 1260289 - RNA, 20 nt, Mycobacterium tuberculosis H37Rv
ggcagcgguaagcgcaucga

SEQ ID NO: 1260290 - RNA, 20 nt, Mycobacterium tuberculosis H37Rv
ggcagcgggacugcggaagc

SEQ ID NO: 1260291 - RNA, 14 nt, Mycobacterium tuberculosis H37Rv
ggcagcggcgucgu

SEQ ID NO: 1260292 - RNA, 15 nt, Mycobacterium tuberculosis H37Rv
ggcagggcggugcca

SEQ ID NO: 1260293 - RNA, 21 nt, Mycobacterium tuberculosis H37Rv
ggcagggcccccaguucggcg

SEQ ID NO: 1260294 - RNA, 17 nt, Mycobacterium tuberculosis H37Rv
ggcagggaccgcaucgg

SEQ ID NO: 1260295 - RNA, 23 nt, Mycobacterium tuberculosis H37Rv
ggcaggccuuuuggcgaaccgca

SEQ ID NO: 1260296 - RNA, 19 nt, Mycobacterium tuberculosis H37Rv
ggcaccccacgccugccga

SEQ ID NO: 1260297 - RNA, 16 nt, Mycobacterium tuberculosis H37Rv
ggcaccccacggccag

SEQ ID NO: 1260298 - RNA, 23 nt, Mycobacterium tuberculosis H37Rv
ggcacccaucccguucagcgacc

SEQ ID NO: 1260299 - RNA, 21 nt, Mycobacterium tuberculosis H37Rv
ggcacccacuuuucgguggcg

SEQ ID NO: 1260300 - RNA, 21 nt, Mycobacterium tuberculosis H37Rv
ggcaccauguacaggcugucc

SEQ ID NO: 1260301 - RNA, 14 nt, Mycobacterium tuberculosis H37Rv
ggcaccacgaccga

SEQ ID NO: 1260302 - RNA, 13 nt, Mycobacterium tuberculosis H37Rv
ggcaccacgccag

SEQ ID NO: 1260303 - RNA, 19 nt, Mycobacterium tuberculosis H37Rv
ggcaccagaaaacauugcg

SEQ ID NO: 1260304 - RNA, 20 nt, Mycobacterium tuberculosis H37Rv
ggcaccagcaccgucggggu

SEQ ID NO: 1260305 - RNA, 12 nt, Mycobacterium tuberculosis H37Rv
ggcaccagccgg

SEQ ID NO: 1260306 - RNA, 20 nt, Mycobacterium tuberculosis H37Rv
ggcacaucaugggcgcugcc

SEQ ID NO: 1260307 - RNA, 16 nt, Mycobacterium tuberculosis H37Rv
ggcacaucgcacaacu

SEQ ID NO: 1260308 - RNA, 21 nt, Mycobacterium tuberculosis H37Rv
ggcaccaccacaccggagccg

SEQ ID NO: 1260309 - RNA, 20 nt, Mycobacterium tuberculosis H37Rv
ggcaccaacgagauccagcg

SEQ ID NO: 1260310 - RNA, 16 nt, Mycobacterium tuberculosis H37Rv
ggcaccacccggcgaa

SEQ ID NO: 1260311 - RNA, 18 nt, Mycobacterium tuberculosis H37Rv
ggcaccacuacaucgauc

SEQ ID NO: 1260312 - RNA, 16 nt, Mycobacterium tuberculosis H37Rv
ggcacaggcggccagc

SEQ ID NO: 1260313 - RNA, 15 nt, Mycobacterium tuberculosis H37Rv
ggcacaccgguggcg

SEQ ID NO: 1260314 - RNA, 20 nt, Mycobacterium tuberculosis H37Rv
ggcacccgcuggcgguaagc

SEQ ID NO: 1260315 - RNA, 14 nt, Mycobacterium tuberculosis H37Rv
ggcaccgcagcgga

SEQ ID NO: 1260316 - RNA, 20 nt, Mycobacterium tuberculosis H37Rv
ggcaccgccaaaaacgccag

SEQ ID NO: 1260317 - RNA, 14 nt, Mycobacterium tuberculosis H37Rv
ggcacccgcuggcg

SEQ ID NO: 1260318 - RNA, 18 nt, Mycobacterium tuberculosis H37Rv
ggcacccgugccgccgau

SEQ ID NO: 1260319 - RNA, 19 nt, Mycobacterium tuberculosis H37Rv
ggcacccgcggcgaaccgu

SEQ ID NO: 1260320 - RNA, 19 nt, Mycobacterium tuberculosis H37Rv
ggcaccccguuccacgauc

SEQ ID NO: 1260321 - RNA, 16 nt, Mycobacterium tuberculosis H37Rv
ggcaccccuuugacgc

SEQ ID NO: 1260322 - RNA, 14 nt, Mycobacterium tuberculosis H37Rv
ggcaccgccgagca

SEQ ID NO: 1260323 - RNA, 23 nt, Mycobacterium tuberculosis H37Rv
ggcaccgccggcgccgccgucgc

SEQ ID NO: 1260324 - RNA, 15 nt, Mycobacterium tuberculosis H37Rv
ggcaccgcggccagc

SEQ ID NO: 1260325 - RNA, 21 nt, Mycobacterium tuberculosis H37Rv
ggcaccggccgugccgccgac

SEQ ID NO: 1260326 - RNA, 18 nt, Mycobacterium tuberculosis H37Rv
ggcacggucacacgccag

SEQ ID NO: 1260327 - RNA, 18 nt, Mycobacterium tuberculosis H37Rv
ggcacgggugacgauguc

SEQ ID NO: 1260328 - RNA, 11 nt, Mycobacterium tuberculosis H37Rv
ggcacgggugu

SEQ ID NO: 1260329 - RNA, 22 nt, Mycobacterium tuberculosis H37Rv
ggcacggucgcccgaucggcgg

SEQ ID NO: 1260330 - RNA, 19 nt, Mycobacterium tuberculosis H37Rv
ggcacggugaacggcaagg

SEQ ID NO: 1260331 - RNA, 14 nt, Mycobacterium tuberculosis H37Rv
ggcacggccgucga

SEQ ID NO: 1260332 - RNA, 17 nt, Mycobacterium tuberculosis H37Rv
ggcacggccgucgacga

SEQ ID NO: 1260333 - RNA, 14 nt, Mycobacterium tuberculosis H37Rv
ggcacgggcgucgu

SEQ ID NO: 1260334 - RNA, 23 nt, Mycobacterium tuberculosis H37Rv
ggcacgcucggugaaggucaccg

SEQ ID NO: 1260335 - RNA, 19 nt, Mycobacterium tuberculosis H37Rv
ggcacgcugagcguccgac

SEQ ID NO: 1260336 - RNA, 20 nt, Mycobacterium tuberculosis H37Rv
ggcacggaguuuagcaacua

SEQ ID NO: 1260337 - RNA, 18 nt, Mycobacterium tuberculosis H37Rv
ggcacuagacugcugguc

SEQ ID NO: 1260338 - RNA, 15 nt, Mycobacterium tuberculosis H37Rv
ggcacuccagcggcg

SEQ ID NO: 1260339 - RNA, 13 nt, Mycobacterium tuberculosis H37Rv
ggcacuccaccgg

SEQ ID NO: 1260340 - RNA, 16 nt, Mycobacterium tuberculosis H37Rv
ggcacuccagcggcgg

SEQ ID NO: 1260341 - RNA, 18 nt, Mycobacterium tuberculosis H37Rv
ggcacguccgaucggcgc

SEQ ID NO: 1260342 - RNA, 13 nt, Mycobacterium tuberculosis H37Rv
ggcacggugucgc

SEQ ID NO: 1260343 - RNA, 15 nt, Mycobacterium tuberculosis H37Rv
ggcacggugucgcgc

SEQ ID NO: 1260344 - RNA, 18 nt, Mycobacterium tuberculosis H37Rv
ggcaccuggucggccgca

SEQ ID NO: 1260345 - RNA, 20 nt, Mycobacterium tuberculosis H37Rv
ggcaccugguccaaucgcga

SEQ ID NO: 1260346 - RNA, 22 nt, Mycobacterium tuberculosis H37Rv
ggcacgaacaucagaucgccga

SEQ ID NO: 1260347 - RNA, 20 nt, Mycobacterium tuberculosis H37Rv
ggcaccuuguagcgggcaag

SEQ ID NO: 1260348 - RNA, 22 nt, Mycobacterium tuberculosis H37Rv
ggcacgaaucccccggacggca

SEQ ID NO: 1260349 - RNA, 16 nt, Mycobacterium tuberculosis H37Rv
ggcaccuccggcaccg

SEQ ID NO: 1260350 - RNA, 20 nt, Mycobacterium tuberculosis H37Rv
ggcaccguuaccgccgucgc

SEQ ID NO: 1260351 - RNA, 22 nt, Mycobacterium tuberculosis H37Rv
ggcaccguuaccgccgucgcca

SEQ ID NO: 1260352 - RNA, 21 nt, Mycobacterium tuberculosis H37Rv
ggcaccgucucgcaccgcguu

SEQ ID NO: 1260353 - RNA, 19 nt, Mycobacterium tuberculosis H37Rv
ggcaccgucggaacugacc

SEQ ID NO: 1260354 - RNA, 20 nt, Mycobacterium tuberculosis H37Rv
ggcaccggugcccaccaccg

SEQ ID NO: 1260355 - RNA, 20 nt, Mycobacterium tuberculosis H37Rv
ggcaccgguuugacguccag

SEQ ID NO: 1260356 - RNA, 18 nt, Mycobacterium tuberculosis H37Rv
ggcacgcccucgucgauc

SEQ ID NO: 1260357 - RNA, 22 nt, Mycobacterium tuberculosis H37Rv
ggcacgcccucgucgaucgccg

SEQ ID NO: 1260358 - RNA, 18 nt, Mycobacterium tuberculosis H37Rv
ggcacgcaacaccgccaa

SEQ ID NO: 1260359 - RNA, 20 nt, Mycobacterium tuberculosis H37Rv
ggcacgccgggcaucggcgg

SEQ ID NO: 1260360 - RNA, 13 nt, Mycobacterium tuberculosis H37Rv
ggcacgccgccga

SEQ ID NO: 1260361 - RNA, 18 nt, Mycobacterium tuberculosis H37Rv
ggcacgcaugccggugau

SEQ ID NO: 1260362 - RNA, 13 nt, Mycobacterium tuberculosis H37Rv
ggcacgaucgcca

SEQ ID NO: 1260363 - RNA, 14 nt, Mycobacterium tuberculosis H37Rv
ggcacgaucgucgc

SEQ ID NO: 1260364 - RNA, 18 nt, Mycobacterium tuberculosis H37Rv
ggcacgagccaucgucga

SEQ ID NO: 1260365 - RNA, 18 nt, Mycobacterium tuberculosis H37Rv
ggcaagaacccgauaaca

SEQ ID NO: 1260366 - RNA, 20 nt, Mycobacterium tuberculosis H37Rv
ggcaagaaaguuccacgaca

SEQ ID NO: 1260367 - RNA, 17 nt, Mycobacterium tuberculosis H37Rv
ggcaacggcgcgccgac

SEQ ID NO: 1260368 - RNA, 22 nt, Mycobacterium tuberculosis H37Rv
ggcaagcacggcgucgaugucg

SEQ ID NO: 1260369 - RNA, 16 nt, Mycobacterium tuberculosis H37Rv
ggcaagcacaccgcca

SEQ ID NO: 1260370 - RNA, 23 nt, Mycobacterium tuberculosis H37Rv
ggcaagaguugccggaucgacgu

SEQ ID NO: 1260371 - RNA, 14 nt, Mycobacterium tuberculosis H37Rv
ggcaagcacggcgu

SEQ ID NO: 1260372 - RNA, 22 nt, Mycobacterium tuberculosis H37Rv
ggcaagcacaccgccagcggca

SEQ ID NO: 1260373 - RNA, 15 nt, Mycobacterium tuberculosis H37Rv
ggcaagggccgacgu

SEQ ID NO: 1260374 - RNA, 14 nt, Mycobacterium tuberculosis H37Rv
ggcaagucgacgcc

SEQ ID NO: 1260375 - RNA, 14 nt, Mycobacterium tuberculosis H37Rv
ggcaagucaacacc

SEQ ID NO: 1260376 - RNA, 20 nt, Mycobacterium tuberculosis H37Rv
ggcaaguccggucgcggaga

SEQ ID NO: 1260377 - RNA, 14 nt, Mycobacterium tuberculosis H37Rv
ggcaagcgcacgcu

SEQ ID NO: 1260378 - RNA, 23 nt, Mycobacterium tuberculosis H37Rv
ggcaagcgugacccgccggcgac

SEQ ID NO: 1260379 - RNA, 14 nt, Mycobacterium tuberculosis H37Rv
ggcaagcucguccg

SEQ ID NO: 1260380 - RNA, 15 nt, Mycobacterium tuberculosis H37Rv
ggcaaggacguggcg

SEQ ID NO: 1260381 - RNA, 21 nt, Mycobacterium tuberculosis H37Rv
ggcaaggacaagccgcugaug

SEQ ID NO: 1260382 - RNA, 16 nt, Mycobacterium tuberculosis H37Rv
ggcaaggcauccaacg

SEQ ID NO: 1260383 - RNA, 17 nt, Mycobacterium tuberculosis H37Rv
ggcacaacaucgccgca

SEQ ID NO: 1260384 - RNA, 19 nt, Mycobacterium tuberculosis H37Rv
ggcacacccgcaccggauc

SEQ ID NO: 1260385 - RNA, 16 nt, Mycobacterium tuberculosis H37Rv
ggcacaccgacgccgc

SEQ ID NO: 1260386 - RNA, 18 nt, Mycobacterium tuberculosis H37Rv
ggcacacccaucaccgcc

SEQ ID NO: 1260387 - RNA, 19 nt, Mycobacterium tuberculosis H37Rv
ggcacacccaucaccgcca

SEQ ID NO: 1260388 - RNA, 14 nt, Mycobacterium tuberculosis H37Rv
ggcacaaucggcgc

SEQ ID NO: 1260389 - RNA, 16 nt, Mycobacterium tuberculosis H37Rv
ggcaauugcgguucga

SEQ ID NO: 1260390 - RNA, 20 nt, Mycobacterium tuberculosis H37Rv
ggcaaugcuccuaucugccg

SEQ ID NO: 1260391 - RNA, 22 nt, Mycobacterium tuberculosis H37Rv
ggcaauggccagcaccacggcc

SEQ ID NO: 1260392 - RNA, 19 nt, Mycobacterium tuberculosis H37Rv
ggcaaucgcucugugucgc

SEQ ID NO: 1260393 - RNA, 14 nt, Mycobacterium tuberculosis H37Rv
ggcaauauccggga

SEQ ID NO: 1260394 - RNA, 18 nt, Mycobacterium tuberculosis H37Rv
ggcaaugccgcggccagu

SEQ ID NO: 1260395 - RNA, 21 nt, Mycobacterium tuberculosis H37Rv
ggcaaucucccgaaucgugcg

SEQ ID NO: 1260396 - RNA, 19 nt, Mycobacterium tuberculosis H37Rv
ggauucccgcccagcagca

SEQ ID NO: 1260397 - RNA, 16 nt, Mycobacterium tuberculosis H37Rv
ggagacgguacgccag

SEQ ID NO: 1260398 - RNA, 20 nt, Mycobacterium tuberculosis H37Rv
ggagacgaucgccaggccga

SEQ ID NO: 1260399 - RNA, 23 nt, Mycobacterium tuberculosis H37Rv
ggagacgagcacaagauccgcca

SEQ ID NO: 1260400 - RNA, 17 nt, Mycobacterium tuberculosis H37Rv
ggauucgguaucagggg

SEQ ID NO: 1260401 - RNA, 15 nt, Mycobacterium tuberculosis H37Rv
ggauucggcggucgc

SEQ ID NO: 1260402 - RNA, 15 nt, Mycobacterium tuberculosis H37Rv
ggauucugcugacca

SEQ ID NO: 1260403 - RNA, 18 nt, Mycobacterium tuberculosis H37Rv
ggauucuucagcgcggca

SEQ ID NO: 1260404 - RNA, 17 nt, Mycobacterium tuberculosis H37Rv
ggauugcgggccugcac

SEQ ID NO: 1260405 - RNA, 21 nt, Mycobacterium tuberculosis H37Rv
ggcaaaacacaccgaacacgg

SEQ ID NO: 1260406 - RNA, 17 nt, Mycobacterium tuberculosis H37Rv
ggcaaacaccagcccgg

SEQ ID NO: 1260407 - RNA, 18 nt, Mycobacterium tuberculosis H37Rv
ggcaacgacucucaucga

SEQ ID NO: 1260408 - RNA, 14 nt, Mycobacterium tuberculosis H37Rv
ggcaacgaucgaca

SEQ ID NO: 1260409 - RNA, 19 nt, Mycobacterium tuberculosis H37Rv
ggcaacgcgaaccggccau

SEQ ID NO: 1260410 - RNA, 17 nt, Mycobacterium tuberculosis H37Rv
ggcaacgccgcgccguu

SEQ ID NO: 1260411 - RNA, 17 nt, Mycobacterium tuberculosis H37Rv
ggcaacgcggucugcuc

SEQ ID NO: 1260412 - RNA, 14 nt, Mycobacterium tuberculosis H37Rv
ggcaacgcuggcaa

SEQ ID NO: 1260413 - RNA, 23 nt, Mycobacterium tuberculosis H37Rv
ggcaaccuggacugggucgccuc

SEQ ID NO: 1260414 - RNA, 18 nt, Mycobacterium tuberculosis H37Rv
ggcaaccuguuccagcgu

SEQ ID NO: 1260415 - RNA, 12 nt, Mycobacterium tuberculosis H37Rv
ggcaaccggaga

SEQ ID NO: 1260416 - RNA, 14 nt, Mycobacterium tuberculosis H37Rv
ggcaaccgaugacg

SEQ ID NO: 1260417 - RNA, 17 nt, Mycobacterium tuberculosis H37Rv
ggcaaccgaauugaacu

SEQ ID NO: 1260418 - RNA, 19 nt, Mycobacterium tuberculosis H37Rv
ggcaaccgccgugugccac

SEQ ID NO: 1260419 - RNA, 23 nt, Mycobacterium tuberculosis H37Rv
ggcaaccaggaugguugcgacgg

SEQ ID NO: 1260420 - RNA, 18 nt, Mycobacterium tuberculosis H37Rv
ggcaaccauuagcgccaa

SEQ ID NO: 1260421 - RNA, 14 nt, Mycobacterium tuberculosis H37Rv
ggcaaccagcagca

SEQ ID NO: 1260422 - RNA, 16 nt, Mycobacterium tuberculosis H37Rv
ggcaaccacaucaccg

SEQ ID NO: 1260423 - RNA, 22 nt, Mycobacterium tuberculosis H37Rv
ggcaaccacaucaccggcgauc

SEQ ID NO: 1260424 - RNA, 17 nt, Mycobacterium tuberculosis H37Rv
ggcaacaucgagcgcca

SEQ ID NO: 1260425 - RNA, 22 nt, Mycobacterium tuberculosis H37Rv
ggcaacaucgagcgccagccgg

SEQ ID NO: 1260426 - RNA, 21 nt, Mycobacterium tuberculosis H37Rv
ggcaacacgauaucgggcuca

SEQ ID NO: 1260427 - RNA, 22 nt, Mycobacterium tuberculosis H37Rv
ggcaaaucaagcacagcccggc

SEQ ID NO: 1260428 - RNA, 16 nt, Mycobacterium tuberculosis H37Rv
ggcaaaggacgucgac

SEQ ID NO: 1260429 - RNA, 18 nt, Mycobacterium tuberculosis H37Rv
ggcaaacgacaucauggu

SEQ ID NO: 1260430 - RNA, 19 nt, Mycobacterium tuberculosis H37Rv
ggcaaacuccugcaggauc

SEQ ID NO: 1260431 - RNA, 18 nt, Mycobacterium tuberculosis H37Rv
ggucagcccggcgcgauc

SEQ ID NO: 1260432 - RNA, 15 nt, Mycobacterium tuberculosis H37Rv
ggucagcacgcugac

SEQ ID NO: 1260433 - RNA, 20 nt, Mycobacterium tuberculosis H37Rv
ggucagcgaccucacugcgg

SEQ ID NO: 1260434 - RNA, 14 nt, Mycobacterium tuberculosis H37Rv
ggucaggucgaggu

SEQ ID NO: 1260435 - RNA, 14 nt, Mycobacterium tuberculosis H37Rv
ggucagcgaccuca

SEQ ID NO: 1260436 - RNA, 15 nt, Mycobacterium tuberculosis H37Rv
ggucagccgugccgu

SEQ ID NO: 1260437 - RNA, 14 nt, Mycobacterium tuberculosis H37Rv
ggucagccggccau

SEQ ID NO: 1260438 - RNA, 20 nt, Mycobacterium tuberculosis H37Rv
ggucagugggacgggcgcgu

SEQ ID NO: 1260439 - RNA, 19 nt, Mycobacterium tuberculosis H37Rv
ggucagguuggcacgcugu

SEQ ID NO: 1260440 - RNA, 14 nt, Mycobacterium tuberculosis H37Rv
gguccaaugccuug

SEQ ID NO: 1260441 - RNA, 17 nt, Mycobacterium tuberculosis H37Rv
ggucaucaugucgaggu

SEQ ID NO: 1260442 - RNA, 15 nt, Mycobacterium tuberculosis H37Rv
ggucaucagcgugca

SEQ ID NO: 1260443 - RNA, 13 nt, Mycobacterium tuberculosis H37Rv
gguccaacagcgc

SEQ ID NO: 1260444 - RNA, 14 nt, Mycobacterium tuberculosis H37Rv
gguccaaagcacgu

SEQ ID NO: 1260445 - RNA, 15 nt, Mycobacterium tuberculosis H37Rv
gguccgacgggccac

SEQ ID NO: 1260446 - RNA, 20 nt, Mycobacterium tuberculosis H37Rv
gguccgccagaucucgcgcg

SEQ ID NO: 1260447 - RNA, 18 nt, Mycobacterium tuberculosis H37Rv
gguccgcgugcugccgua

SEQ ID NO: 1260448 - RNA, 14 nt, Mycobacterium tuberculosis H37Rv
gguccugcgccgca

SEQ ID NO: 1260449 - RNA, 18 nt, Mycobacterium tuberculosis H37Rv
gguccuucugccgggaga

SEQ ID NO: 1260450 - RNA, 18 nt, Mycobacterium tuberculosis H37Rv
gguccugcggucgcggag

SEQ ID NO: 1260451 - RNA, 12 nt, Mycobacterium tuberculosis H37Rv
gguccuugccgu

SEQ ID NO: 1260452 - RNA, 16 nt, Mycobacterium tuberculosis H37Rv
gguccaccccgccgau

SEQ ID NO: 1260453 - RNA, 18 nt, Mycobacterium tuberculosis H37Rv
ggucccgugcgcgcgcag

SEQ ID NO: 1260454 - RNA, 19 nt, Mycobacterium tuberculosis H37Rv
gguccaccuuggucgccaa

SEQ ID NO: 1260455 - RNA, 14 nt, Mycobacterium tuberculosis H37Rv
gguccacgcgcucg

SEQ ID NO: 1260456 - RNA, 19 nt, Mycobacterium tuberculosis H37Rv
ggucccugaagccagcgca

SEQ ID NO: 1260457 - RNA, 22 nt, Mycobacterium tuberculosis H37Rv
ggucccuuguggucugccagca

SEQ ID NO: 1260458 - RNA, 15 nt, Mycobacterium tuberculosis H37Rv
gguccgccaacggca

SEQ ID NO: 1260459 - RNA, 16 nt, Mycobacterium tuberculosis H37Rv
gguccgccaacggcac

SEQ ID NO: 1260460 - RNA, 13 nt, Mycobacterium tuberculosis H37Rv
gguccgaccagcg

SEQ ID NO: 1260461 - RNA, 23 nt, Mycobacterium tuberculosis H37Rv
ggucgcugcgaugcugaucaccg

SEQ ID NO: 1260462 - RNA, 18 nt, Mycobacterium tuberculosis H37Rv
ggucgcugcccgcggugu

SEQ ID NO: 1260463 - RNA, 22 nt, Mycobacterium tuberculosis H37Rv
ggucgcugcccgcggugugcac

SEQ ID NO: 1260464 - RNA, 22 nt, Mycobacterium tuberculosis H37Rv
ggucgcugauccgggcgccgau

SEQ ID NO: 1260465 - RNA, 21 nt, Mycobacterium tuberculosis H37Rv
ggucgcugcuugcgggcucgu

SEQ ID NO: 1260466 - RNA, 22 nt, Mycobacterium tuberculosis H37Rv
ggucgcugcugcgaucgccgcg

SEQ ID NO: 1260467 - RNA, 15 nt, Mycobacterium tuberculosis H37Rv
ggucgcugcugccgc

SEQ ID NO: 1260468 - RNA, 16 nt, Mycobacterium tuberculosis H37Rv
ggucgcuucagcgcca

SEQ ID NO: 1260469 - RNA, 22 nt, Mycobacterium tuberculosis H37Rv
ggucgcucgacgaccacggugu

SEQ ID NO: 1260470 - RNA, 18 nt, Mycobacterium tuberculosis H37Rv
ggucgccuccucgugcag

SEQ ID NO: 1260471 - RNA, 19 nt, Mycobacterium tuberculosis H37Rv
ggucgccuggaagaucacg

SEQ ID NO: 1260472 - RNA, 19 nt, Mycobacterium tuberculosis H37Rv
ggucgccggucaucgccga

SEQ ID NO: 1260473 - RNA, 13 nt, Mycobacterium tuberculosis H37Rv
ggucgccggcguc

SEQ ID NO: 1260474 - RNA, 14 nt, Mycobacterium tuberculosis H37Rv
ggucgcaccgccgg

SEQ ID NO: 1260475 - RNA, 17 nt, Mycobacterium tuberculosis H37Rv
ggucgaggucggcgauc

SEQ ID NO: 1260476 - RNA, 15 nt, Mycobacterium tuberculosis H37Rv
ggucgccaacgccag

SEQ ID NO: 1260477 - RNA, 15 nt, Mycobacterium tuberculosis H37Rv
ggucgccaacccgau

SEQ ID NO: 1260478 - RNA, 22 nt, Mycobacterium tuberculosis H37Rv
ggucgccaacgccagcaccagc

SEQ ID NO: 1260479 - RNA, 20 nt, Mycobacterium tuberculosis H37Rv
ggucgccaccuucgacgaug

SEQ ID NO: 1260480 - RNA, 16 nt, Mycobacterium tuberculosis H37Rv
ggucgcagcagaccac

SEQ ID NO: 1260481 - RNA, 19 nt, Mycobacterium tuberculosis H37Rv
ggucgcauggucgacgaac

SEQ ID NO: 1260482 - RNA, 14 nt, Mycobacterium tuberculosis H37Rv
ggucgagcggucgc

SEQ ID NO: 1260483 - RNA, 18 nt, Mycobacterium tuberculosis H37Rv
ggucgagcaggcgaguga

SEQ ID NO: 1260484 - RNA, 21 nt, Mycobacterium tuberculosis H37Rv
ggucgaaugggggcuggucgc

SEQ ID NO: 1260485 - RNA, 12 nt, Mycobacterium tuberculosis H37Rv
ggucgacaccgc

SEQ ID NO: 1260486 - RNA, 13 nt, Mycobacterium tuberculosis H37Rv
ggucgacaccgcg

SEQ ID NO: 1260487 - RNA, 21 nt, Mycobacterium tuberculosis H37Rv
ggucgaaucgcugccgccgau

SEQ ID NO: 1260488 - RNA, 17 nt, Mycobacterium tuberculosis H37Rv
ggucgaaucgcugccgc

SEQ ID NO: 1260489 - RNA, 23 nt, Mycobacterium tuberculosis H37Rv
ggucgaauaguugaccaggccga

SEQ ID NO: 1260490 - RNA, 20 nt, Mycobacterium tuberculosis H37Rv
ggucgaacuugaucaccgcg

SEQ ID NO: 1260491 - RNA, 15 nt, Mycobacterium tuberculosis H37Rv
ggucgaacagcgaac

SEQ ID NO: 1260492 - RNA, 18 nt, Mycobacterium tuberculosis H37Rv
ggucgaacagcucgaaca

SEQ ID NO: 1260493 - RNA, 18 nt, Mycobacterium tuberculosis H37Rv
ggucgaacaucaucgggu

SEQ ID NO: 1260494 - RNA, 15 nt, Mycobacterium tuberculosis H37Rv
ggucguucaccgauc

SEQ ID NO: 1260495 - RNA, 17 nt, Mycobacterium tuberculosis H37Rv
ggucguugccggacaac

SEQ ID NO: 1260496 - RNA, 16 nt, Mycobacterium tuberculosis H37Rv
ggucguugaggccggu

SEQ ID NO: 1260497 - RNA, 21 nt, Mycobacterium tuberculosis H37Rv
ggucguuggugcagaccaccg

SEQ ID NO: 1260498 - RNA, 15 nt, Mycobacterium tuberculosis H37Rv
ggucgucggcgucgc

SEQ ID NO: 1260499 - RNA, 12 nt, Mycobacterium tuberculosis H37Rv
ggucgugccgcc

SEQ ID NO: 1260500 - RNA, 21 nt, Mycobacterium tuberculosis H37Rv
ggucgugcgacaacacgaccu

SEQ ID NO: 1260501 - RNA, 18 nt, Mycobacterium tuberculosis H37Rv
ggucuggcgcggagcuga

SEQ ID NO: 1260502 - RNA, 14 nt, Mycobacterium tuberculosis H37Rv
ggucugcuccaggc

SEQ ID NO: 1260503 - RNA, 17 nt, Mycobacterium tuberculosis H37Rv
ggucguuugugaacacc

SEQ ID NO: 1260504 - RNA, 15 nt, Mycobacterium tuberculosis H37Rv
ggucuguuggugaca

SEQ ID NO: 1260505 - RNA, 15 nt, Mycobacterium tuberculosis H37Rv
ggucuugaacccgau

SEQ ID NO: 1260506 - RNA, 18 nt, Mycobacterium tuberculosis H37Rv
ggucggccugcggcaccg

SEQ ID NO: 1260507 - RNA, 22 nt, Mycobacterium tuberculosis H37Rv
ggucggacggccaucgccagcc

SEQ ID NO: 1260508 - RNA, 16 nt, Mycobacterium tuberculosis H37Rv
ggucgcuugcugucgu

SEQ ID NO: 1260509 - RNA, 20 nt, Mycobacterium tuberculosis H37Rv
ggucggcgaugaugacggcg

SEQ ID NO: 1260510 - RNA, 21 nt, Mycobacterium tuberculosis H37Rv
ggucggcgaugaugcucgaca

SEQ ID NO: 1260511 - RNA, 15 nt, Mycobacterium tuberculosis H37Rv
ggucggcgaucugcg

SEQ ID NO: 1260512 - RNA, 20 nt, Mycobacterium tuberculosis H37Rv
ggucggcgaccaccagcgcc

SEQ ID NO: 1260513 - RNA, 18 nt, Mycobacterium tuberculosis H37Rv
ggucguccaucgcgucgu

SEQ ID NO: 1260514 - RNA, 21 nt, Mycobacterium tuberculosis H37Rv
ggucgucaugccagucgccga

SEQ ID NO: 1260515 - RNA, 14 nt, Mycobacterium tuberculosis H37Rv
ggucgucauugccc

SEQ ID NO: 1260516 - RNA, 13 nt, Mycobacterium tuberculosis H37Rv
ggucggucacgac

SEQ ID NO: 1260517 - RNA, 20 nt, Mycobacterium tuberculosis H37Rv
ggucgguccgcacugugccc

SEQ ID NO: 1260518 - RNA, 19 nt, Mycobacterium tuberculosis H37Rv
ggucggucgcuucagcgcc

SEQ ID NO: 1260519 - RNA, 17 nt, Mycobacterium tuberculosis H37Rv
ggucggugauggucagc

SEQ ID NO: 1260520 - RNA, 17 nt, Mycobacterium tuberculosis H37Rv
ggucgggucgaucaccg

SEQ ID NO: 1260521 - RNA, 23 nt, Mycobacterium tuberculosis H37Rv
ggucgguaccccagcgcugucgu

SEQ ID NO: 1260522 - RNA, 14 nt, Mycobacterium tuberculosis H37Rv
ggucgggucgcacc

SEQ ID NO: 1260523 - RNA, 16 nt, Mycobacterium tuberculosis H37Rv
ggucgggcggcgucga

SEQ ID NO: 1260524 - RNA, 17 nt, Mycobacterium tuberculosis H37Rv
ggugaacugguugacgu

SEQ ID NO: 1260525 - RNA, 21 nt, Mycobacterium tuberculosis H37Rv
ggugaacucguucagcgucga

SEQ ID NO: 1260526 - RNA, 17 nt, Mycobacterium tuberculosis H37Rv
ggucuugcaucgccgau

SEQ ID NO: 1260527 - RNA, 20 nt, Mycobacterium tuberculosis H37Rv
ggugaaguagucggcgccga

SEQ ID NO: 1260528 - RNA, 17 nt, Mycobacterium tuberculosis H37Rv
ggugaauaaggcugcag

SEQ ID NO: 1260529 - RNA, 18 nt, Mycobacterium tuberculosis H37Rv
ggugaaucgacugaucgc

SEQ ID NO: 1260530 - RNA, 20 nt, Mycobacterium tuberculosis H37Rv
ggugaccucgucgaccggga

SEQ ID NO: 1260531 - RNA, 19 nt, Mycobacterium tuberculosis H37Rv
ggugacgguggccggcaac

SEQ ID NO: 1260532 - RNA, 16 nt, Mycobacterium tuberculosis H37Rv
ggugacgauugccacc

SEQ ID NO: 1260533 - RNA, 16 nt, Mycobacterium tuberculosis H37Rv
ggugacgcaacaucgg

SEQ ID NO: 1260534 - RNA, 19 nt, Mycobacterium tuberculosis H37Rv
ggugacgccgccagcaccu

SEQ ID NO: 1260535 - RNA, 22 nt, Mycobacterium tuberculosis H37Rv
ggugcagcacgugugcgggcac

SEQ ID NO: 1260536 - RNA, 18 nt, Mycobacterium tuberculosis H37Rv
ggugcagcccgccgcuga

SEQ ID NO: 1260537 - RNA, 24 nt, Mycobacterium tuberculosis H37Rv
ggugcagcccgccggauccgccag

SEQ ID NO: 1260538 - RNA, 12 nt, Mycobacterium tuberculosis H37Rv
ggugaugccgau

SEQ ID NO: 1260539 - RNA, 23 nt, Mycobacterium tuberculosis H37Rv
ggugaugggggagccggugacgg

SEQ ID NO: 1260540 - RNA, 22 nt, Mycobacterium tuberculosis H37Rv
ggugagggguugcggucgacgu

SEQ ID NO: 1260541 - RNA, 16 nt, Mycobacterium tuberculosis H37Rv
ggugaugcccagcgcc

SEQ ID NO: 1260542 - RNA, 16 nt, Mycobacterium tuberculosis H37Rv
ggugaugccaucaacg

SEQ ID NO: 1260543 - RNA, 22 nt, Mycobacterium tuberculosis H37Rv
ggugauggaugggucgaccgga

SEQ ID NO: 1260544 - RNA, 18 nt, Mycobacterium tuberculosis H37Rv
ggugaucgagguugacgu

SEQ ID NO: 1260545 - RNA, 19 nt, Mycobacterium tuberculosis H37Rv
ggugaucccgauggucacu

SEQ ID NO: 1260546 - RNA, 22 nt, Mycobacterium tuberculosis H37Rv
gguacgccucgacagcggcaau

SEQ ID NO: 1260547 - RNA, 14 nt, Mycobacterium tuberculosis H37Rv
gguaccggcggcaa

SEQ ID NO: 1260548 - RNA, 13 nt, Mycobacterium tuberculosis H37Rv
gguacggacagcg

SEQ ID NO: 1260549 - RNA, 15 nt, Mycobacterium tuberculosis H37Rv
gguacucccgcgauc

SEQ ID NO: 1260550 - RNA, 15 nt, Mycobacterium tuberculosis H37Rv
gguagcacagcagca

SEQ ID NO: 1260551 - RNA, 15 nt, Mycobacterium tuberculosis H37Rv
gguagccgaccagcg

SEQ ID NO: 1260552 - RNA, 16 nt, Mycobacterium tuberculosis H37Rv
gguagacaccgcgauc

SEQ ID NO: 1260553 - RNA, 18 nt, Mycobacterium tuberculosis H37Rv
gguacuugccacggcgau

SEQ ID NO: 1260554 - RNA, 19 nt, Mycobacterium tuberculosis H37Rv
gguacuugccacggcgauu

SEQ ID NO: 1260555 - RNA, 17 nt, Mycobacterium tuberculosis H37Rv
gguagcucauugccgau

SEQ ID NO: 1260556 - RNA, 13 nt, Mycobacterium tuberculosis H37Rv
gguagcgacgaug

SEQ ID NO: 1260557 - RNA, 18 nt, Mycobacterium tuberculosis H37Rv
gguagcgguucaucaccg

SEQ ID NO: 1260558 - RNA, 13 nt, Mycobacterium tuberculosis H37Rv
gguagccgucgau

SEQ ID NO: 1260559 - RNA, 12 nt, Mycobacterium tuberculosis H37Rv
gguagccggcgu

SEQ ID NO: 1260560 - RNA, 16 nt, Mycobacterium tuberculosis H37Rv
gguagucguugccgau

SEQ ID NO: 1260561 - RNA, 20 nt, Mycobacterium tuberculosis H37Rv
gguaucaaccggccggugau

SEQ ID NO: 1260562 - RNA, 17 nt, Mycobacterium tuberculosis H37Rv
gguagucgccgucgggu

SEQ ID NO: 1260563 - RNA, 14 nt, Mycobacterium tuberculosis H37Rv
ggucaacgugaacu

SEQ ID NO: 1260564 - RNA, 13 nt, Mycobacterium tuberculosis H37Rv
ggucaacggccga

SEQ ID NO: 1260565 - RNA, 21 nt, Mycobacterium tuberculosis H37Rv
ggucaacggcagaucccacgc

SEQ ID NO: 1260566 - RNA, 15 nt, Mycobacterium tuberculosis H37Rv
ggucaaccgcgucga

SEQ ID NO: 1260567 - RNA, 21 nt, Mycobacterium tuberculosis H37Rv
ggucaacgacguugaucccca

SEQ ID NO: 1260568 - RNA, 14 nt, Mycobacterium tuberculosis H37Rv
ggucaacagcggca

SEQ ID NO: 1260569 - RNA, 22 nt, Mycobacterium tuberculosis H37Rv
ggucaaucggguuugucgucgu

SEQ ID NO: 1260570 - RNA, 13 nt, Mycobacterium tuberculosis H37Rv
ggucaacgcugac

SEQ ID NO: 1260571 - RNA, 17 nt, Mycobacterium tuberculosis H37Rv
gguaucggcgaccagcu

SEQ ID NO: 1260572 - RNA, 19 nt, Mycobacterium tuberculosis H37Rv
gguaucgagggcagccgcc

SEQ ID NO: 1260573 - RNA, 16 nt, Mycobacterium tuberculosis H37Rv
gguaucgucauugcga

SEQ ID NO: 1260574 - RNA, 16 nt, Mycobacterium tuberculosis H37Rv
ggucagcaccaccagc

SEQ ID NO: 1260575 - RNA, 22 nt, Mycobacterium tuberculosis H37Rv
ggucacgcgacuugcaccccgu

SEQ ID NO: 1260576 - RNA, 20 nt, Mycobacterium tuberculosis H37Rv
ggucacgccgucaccgcuga

SEQ ID NO: 1260577 - RNA, 19 nt, Mycobacterium tuberculosis H37Rv
ggucacgcagucgggcagc

SEQ ID NO: 1260578 - RNA, 20 nt, Mycobacterium tuberculosis H37Rv
ggucacccccggccagcguc

SEQ ID NO: 1260579 - RNA, 21 nt, Mycobacterium tuberculosis H37Rv
ggucaccaggccgaaauccag

SEQ ID NO: 1260580 - RNA, 19 nt, Mycobacterium tuberculosis H37Rv
ggucaccggacuggugguc

SEQ ID NO: 1260581 - RNA, 20 nt, Mycobacterium tuberculosis H37Rv
ggucaccggcgcaccggagu

SEQ ID NO: 1260582 - RNA, 16 nt, Mycobacterium tuberculosis H37Rv
ggucaccggucaccgc

SEQ ID NO: 1260583 - RNA, 12 nt, Mycobacterium tuberculosis H37Rv
ggucaccgucga

SEQ ID NO: 1260584 - RNA, 20 nt, Mycobacterium tuberculosis H37Rv
ggucaccgucgagucgacgg

SEQ ID NO: 1260585 - RNA, 19 nt, Mycobacterium tuberculosis H37Rv
ggucaccgcgcagcgaauc

SEQ ID NO: 1260586 - RNA, 13 nt, Mycobacterium tuberculosis H37Rv
gggugcgcugcag

SEQ ID NO: 1260587 - RNA, 17 nt, Mycobacterium tuberculosis H37Rv
gggugcuuccucgcgag

SEQ ID NO: 1260588 - RNA, 21 nt, Mycobacterium tuberculosis H37Rv
gggugcuuucgcgucugcucg

SEQ ID NO: 1260589 - RNA, 20 nt, Mycobacterium tuberculosis H37Rv
gggugcuuucgcgucugcuc

SEQ ID NO: 1260590 - RNA, 15 nt, Mycobacterium tuberculosis H37Rv
ggguggaccggucga

SEQ ID NO: 1260591 - RNA, 17 nt, Mycobacterium tuberculosis H37Rv
ggguggccaucaccgcg

SEQ ID NO: 1260592 - RNA, 18 nt, Mycobacterium tuberculosis H37Rv
ggguggaucuucaccucg

SEQ ID NO: 1260593 - RNA, 21 nt, Mycobacterium tuberculosis H37Rv
gggugguagcugacgcugcuc

SEQ ID NO: 1260594 - RNA, 14 nt, Mycobacterium tuberculosis H37Rv
gggugggagcagcc

SEQ ID NO: 1260595 - RNA, 14 nt, Mycobacterium tuberculosis H37Rv
gggugggcgagcga

SEQ ID NO: 1260596 - RNA, 14 nt, Mycobacterium tuberculosis H37Rv
ggguggcgucgcgg

SEQ ID NO: 1260597 - RNA, 13 nt, Mycobacterium tuberculosis H37Rv
ggguguccgucga

SEQ ID NO: 1260598 - RNA, 12 nt, Mycobacterium tuberculosis H37Rv
gggugggcguga

SEQ ID NO: 1260599 - RNA, 12 nt, Mycobacterium tuberculosis H37Rv
gggugguccagc

SEQ ID NO: 1260600 - RNA, 16 nt, Mycobacterium tuberculosis H37Rv
gggcguccacgcugac

SEQ ID NO: 1260601 - RNA, 23 nt, Mycobacterium tuberculosis H37Rv
gggcgucaugaugucgacaucga

SEQ ID NO: 1260602 - RNA, 20 nt, Mycobacterium tuberculosis H37Rv
gggcgucaagcaaguccacc

SEQ ID NO: 1260603 - RNA, 14 nt, Mycobacterium tuberculosis H37Rv
gggcgucauccgcg

SEQ ID NO: 1260604 - RNA, 13 nt, Mycobacterium tuberculosis H37Rv
gggugagcgaccu

SEQ ID NO: 1260605 - RNA, 22 nt, Mycobacterium tuberculosis H37Rv
gggugauagaggauaucgccga

SEQ ID NO: 1260606 - RNA, 12 nt, Mycobacterium tuberculosis H37Rv
gggugcgagcga

SEQ ID NO: 1260607 - RNA, 20 nt, Mycobacterium tuberculosis H37Rv
gggugccguugcgucugcuc

SEQ ID NO: 1260608 - RNA, 22 nt, Mycobacterium tuberculosis H37Rv
gggugcgcccggccaagccggc

SEQ ID NO: 1260609 - RNA, 13 nt, Mycobacterium tuberculosis H37Rv
gggugccgaucga

SEQ ID NO: 1260610 - RNA, 19 nt, Mycobacterium tuberculosis H37Rv
gggugcccccggugccgcc

SEQ ID NO: 1260611 - RNA, 20 nt, Mycobacterium tuberculosis H37Rv
gggugcagcacguccgcgga

SEQ ID NO: 1260612 - RNA, 16 nt, Mycobacterium tuberculosis H37Rv
ggguuaucggcagcag

SEQ ID NO: 1260613 - RNA, 17 nt, Mycobacterium tuberculosis H37Rv
ggguguuugucgcggug

SEQ ID NO: 1260614 - RNA, 18 nt, Mycobacterium tuberculosis H37Rv
ggguuacucgcagcgccg

SEQ ID NO: 1260615 - RNA, 16 nt, Mycobacterium tuberculosis H37Rv
ggguguugucgucgag

SEQ ID NO: 1260616 - RNA, 13 nt, Mycobacterium tuberculosis H37Rv
ggguugaggaucc

SEQ ID NO: 1260617 - RNA, 20 nt, Mycobacterium tuberculosis H37Rv
ggguucuuuugcgucugcuc

SEQ ID NO: 1260618 - RNA, 11 nt, Mycobacterium tuberculosis H37Rv
ggguugaucgc

SEQ ID NO: 1260619 - RNA, 12 nt, Mycobacterium tuberculosis H37Rv
ggguuggcguca

SEQ ID NO: 1260620 - RNA, 17 nt, Mycobacterium tuberculosis H37Rv
ggguuucgaucuucucg

SEQ ID NO: 1260621 - RNA, 14 nt, Mycobacterium tuberculosis H37Rv
ggguugaucaccga

SEQ ID NO: 1260622 - RNA, 15 nt, Mycobacterium tuberculosis H37Rv
gguacacccgcucgc

SEQ ID NO: 1260623 - RNA, 21 nt, Mycobacterium tuberculosis H37Rv
gguaccccccagcgacggcaa

SEQ ID NO: 1260624 - RNA, 21 nt, Mycobacterium tuberculosis H37Rv
gguaccaacgcuucugccugc

SEQ ID NO: 1260625 - RNA, 20 nt, Mycobacterium tuberculosis H37Rv
gguacagacacgcgcgcucg

SEQ ID NO: 1260626 - RNA, 19 nt, Mycobacterium tuberculosis H37Rv
gguaauucuugacgccgau

SEQ ID NO: 1260627 - RNA, 16 nt, Mycobacterium tuberculosis H37Rv
gguaacgcagcggcaa

SEQ ID NO: 1260628 - RNA, 14 nt, Mycobacterium tuberculosis H37Rv
gguaaagcgauggg

SEQ ID NO: 1260629 - RNA, 15 nt, Mycobacterium tuberculosis H37Rv
gguaacaccggcgag

SEQ ID NO: 1260630 - RNA, 17 nt, Mycobacterium tuberculosis H37Rv
gguaaaguucuccaaca

SEQ ID NO: 1260631 - RNA, 21 nt, Mycobacterium tuberculosis H37Rv
gguaagugccucgcgggaagu

SEQ ID NO: 1260632 - RNA, 14 nt, Mycobacterium tuberculosis H37Rv
gguaagacgccgaa

SEQ ID NO: 1260633 - RNA, 22 nt, Mycobacterium tuberculosis H37Rv
gucaccgaugcgccggaccagc

SEQ ID NO: 1260634 - RNA, 16 nt, Mycobacterium tuberculosis H37Rv
gucaccggcgcaccgg

SEQ ID NO: 1260635 - RNA, 15 nt, Mycobacterium tuberculosis H37Rv
gucaccgcgacggaa

SEQ ID NO: 1260636 - RNA, 13 nt, Mycobacterium tuberculosis H37Rv
gucaccgccggga

SEQ ID NO: 1260637 - RNA, 14 nt, Mycobacterium tuberculosis H37Rv
gucaccgccgggau

SEQ ID NO: 1260638 - RNA, 16 nt, Mycobacterium tuberculosis H37Rv
gucaccgccgaccagg

SEQ ID NO: 1260639 - RNA, 16 nt, Mycobacterium tuberculosis H37Rv
gucacgccccucacgu

SEQ ID NO: 1260640 - RNA, 12 nt, Mycobacterium tuberculosis H37Rv
gucacgcaccgc

SEQ ID NO: 1260641 - RNA, 18 nt, Mycobacterium tuberculosis H37Rv
gucacgcacccggcgcaa

SEQ ID NO: 1260642 - RNA, 14 nt, Mycobacterium tuberculosis H37Rv
gucaccgggugcac

SEQ ID NO: 1260643 - RNA, 14 nt, Mycobacterium tuberculosis H37Rv
gucaccggcgucgc

SEQ ID NO: 1260644 - RNA, 12 nt, Mycobacterium tuberculosis H37Rv
gucaccgcugag

SEQ ID NO: 1260645 - RNA, 20 nt, Mycobacterium tuberculosis H37Rv
gucaccaccaccgccgcacg

SEQ ID NO: 1260646 - RNA, 17 nt, Mycobacterium tuberculosis H37Rv
gucaccagcgcaucggc

SEQ ID NO: 1260647 - RNA, 16 nt, Mycobacterium tuberculosis H37Rv
gucaccagcgcaucgg

SEQ ID NO: 1260648 - RNA, 16 nt, Mycobacterium tuberculosis H37Rv
gucacaagucgacacg

SEQ ID NO: 1260649 - RNA, 21 nt, Mycobacterium tuberculosis H37Rv
gucacaagucgacacgccgaa

SEQ ID NO: 1260650 - RNA, 19 nt, Mycobacterium tuberculosis H37Rv
gucacaccacgacgcgaug

SEQ ID NO: 1260651 - RNA, 20 nt, Mycobacterium tuberculosis H37Rv
gucaacagggccaggacaac

SEQ ID NO: 1260652 - RNA, 16 nt, Mycobacterium tuberculosis H37Rv
gucaacagcggcaaga

SEQ ID NO: 1260653 - RNA, 20 nt, Mycobacterium tuberculosis H37Rv
gucaaccgguguaauugccg

SEQ ID NO: 1260654 - RNA, 22 nt, Mycobacterium tuberculosis H37Rv
guaugggggugcuuccucgcga

SEQ ID NO: 1260655 - RNA, 18 nt, Mycobacterium tuberculosis H37Rv
guaugccguggccgccau

SEQ ID NO: 1260656 - RNA, 18 nt, Mycobacterium tuberculosis H37Rv
gucaacaccgcggccgag

SEQ ID NO: 1260657 - RNA, 17 nt, Mycobacterium tuberculosis H37Rv
gucaaauccagcagcca

SEQ ID NO: 1260658 - RNA, 14 nt, Mycobacterium tuberculosis H37Rv
gucaaacgccguca

SEQ ID NO: 1260659 - RNA, 21 nt, Mycobacterium tuberculosis H37Rv
gucaaacgccgucacggcagu

SEQ ID NO: 1260660 - RNA, 20 nt, Mycobacterium tuberculosis H37Rv
guaucgagaugccaucggug

SEQ ID NO: 1260661 - RNA, 11 nt, Mycobacterium tuberculosis H37Rv
guauccaccgc

SEQ ID NO: 1260662 - RNA, 22 nt, Mycobacterium tuberculosis H37Rv
guauccgacuggccccgccagc

SEQ ID NO: 1260663 - RNA, 13 nt, Mycobacterium tuberculosis H37Rv
guaguugcgcggc

SEQ ID NO: 1260664 - RNA, 16 nt, Mycobacterium tuberculosis H37Rv
guaguuggcgaccugc

SEQ ID NO: 1260665 - RNA, 15 nt, Mycobacterium tuberculosis H37Rv
guauagcgugaccgu

SEQ ID NO: 1260666 - RNA, 15 nt, Mycobacterium tuberculosis H37Rv
guaguugccggcuuc

SEQ ID NO: 1260667 - RNA, 21 nt, Mycobacterium tuberculosis H37Rv
guaguucagccaggccgcaau

SEQ ID NO: 1260668 - RNA, 14 nt, Mycobacterium tuberculosis H37Rv
guagugcucgccgg

SEQ ID NO: 1260669 - RNA, 22 nt, Mycobacterium tuberculosis H37Rv
guaguccgcgccgacggccagc

SEQ ID NO: 1260670 - RNA, 14 nt, Mycobacterium tuberculosis H37Rv
guaguccucggugg

SEQ ID NO: 1260671 - RNA, 16 nt, Mycobacterium tuberculosis H37Rv
guagucugcacgucgg

SEQ ID NO: 1260672 - RNA, 14 nt, Mycobacterium tuberculosis H37Rv
guagucacggucgu

SEQ ID NO: 1260673 - RNA, 17 nt, Mycobacterium tuberculosis H37Rv
guaguaaugcucgacgu

SEQ ID NO: 1260674 - RNA, 19 nt, Mycobacterium tuberculosis H37Rv
guaggacugccagcguugc

SEQ ID NO: 1260675 - RNA, 14 nt, Mycobacterium tuberculosis H37Rv
guaggacgccagca

SEQ ID NO: 1260676 - RNA, 19 nt, Mycobacterium tuberculosis H37Rv
guagcuggcgaucuggucg

SEQ ID NO: 1260677 - RNA, 16 nt, Mycobacterium tuberculosis H37Rv
guaggacacguggugg

SEQ ID NO: 1260678 - RNA, 17 nt, Mycobacterium tuberculosis H37Rv
guaccgguccagugugu

SEQ ID NO: 1260679 - RNA, 15 nt, Mycobacterium tuberculosis H37Rv
guaccggcgccgcaa

SEQ ID NO: 1260680 - RNA, 16 nt, Mycobacterium tuberculosis H37Rv
guaccggcgccgcaau

SEQ ID NO: 1260681 - RNA, 21 nt, Mycobacterium tuberculosis H37Rv
guaccggcugguugaccgagu

SEQ ID NO: 1260682 - RNA, 16 nt, Mycobacterium tuberculosis H37Rv
guaccggcugguugac

SEQ ID NO: 1260683 - RNA, 13 nt, Mycobacterium tuberculosis H37Rv
guaccgcggaucg

SEQ ID NO: 1260684 - RNA, 21 nt, Mycobacterium tuberculosis H37Rv
guaccgcgcguugaagucgcc

SEQ ID NO: 1260685 - RNA, 19 nt, Mycobacterium tuberculosis H37Rv
guaccaucaccgcgccagc

SEQ ID NO: 1260686 - RNA, 22 nt, Mycobacterium tuberculosis H37Rv
guacccacgcauguuggugauc

SEQ ID NO: 1260687 - RNA, 23 nt, Mycobacterium tuberculosis H37Rv
guacccagcgcggccaccaccga

SEQ ID NO: 1260688 - RNA, 17 nt, Mycobacterium tuberculosis H37Rv
guaccagcccagcggcu

SEQ ID NO: 1260689 - RNA, 21 nt, Mycobacterium tuberculosis H37Rv
guaccagacgaacgaccaggc

SEQ ID NO: 1260690 - RNA, 23 nt, Mycobacterium tuberculosis H37Rv
guaccagccgaagaaccggucgc

SEQ ID NO: 1260691 - RNA, 15 nt, Mycobacterium tuberculosis H37Rv
guacccgaucagcga

SEQ ID NO: 1260692 - RNA, 23 nt, Mycobacterium tuberculosis H37Rv
guaccgacgaagaucgcugcgaa

SEQ ID NO: 1260693 - RNA, 15 nt, Mycobacterium tuberculosis H37Rv
guaccgacgaagauc

SEQ ID NO: 1260694 - RNA, 23 nt, Mycobacterium tuberculosis H37Rv
guacucaucgacguuccagcagu

SEQ ID NO: 1260695 - RNA, 15 nt, Mycobacterium tuberculosis H37Rv
guacucccgcgaucg

SEQ ID NO: 1260696 - RNA, 15 nt, Mycobacterium tuberculosis H37Rv
guacgcgaccgcgau

SEQ ID NO: 1260697 - RNA, 16 nt, Mycobacterium tuberculosis H37Rv
guacgcgaucagcgcg

SEQ ID NO: 1260698 - RNA, 14 nt, Mycobacterium tuberculosis H37Rv
guacgccgagcaga

SEQ ID NO: 1260699 - RNA, 18 nt, Mycobacterium tuberculosis H37Rv
guacgcaagcucaaggga

SEQ ID NO: 1260700 - RNA, 17 nt, Mycobacterium tuberculosis H37Rv
guagccugcggcgguca

SEQ ID NO: 1260701 - RNA, 14 nt, Mycobacterium tuberculosis H37Rv
guagccugaccagc

SEQ ID NO: 1260702 - RNA, 17 nt, Mycobacterium tuberculosis H37Rv
guagccguugccgccga

SEQ ID NO: 1260703 - RNA, 22 nt, Mycobacterium tuberculosis H37Rv
guagccguugccgccgaacagc

SEQ ID NO: 1260704 - RNA, 17 nt, Mycobacterium tuberculosis H37Rv
guagccgucgucgucga

SEQ ID NO: 1260705 - RNA, 22 nt, Mycobacterium tuberculosis H37Rv
guagccgugggccacgaugauc

SEQ ID NO: 1260706 - RNA, 19 nt, Mycobacterium tuberculosis H37Rv
guagccgucgaucccgguc

SEQ ID NO: 1260707 - RNA, 13 nt, Mycobacterium tuberculosis H37Rv
guagccgucgucg

SEQ ID NO: 1260708 - RNA, 14 nt, Mycobacterium tuberculosis H37Rv
guagcgcagcgccu

SEQ ID NO: 1260709 - RNA, 16 nt, Mycobacterium tuberculosis H37Rv
guagcgaccucgccgc

SEQ ID NO: 1260710 - RNA, 15 nt, Mycobacterium tuberculosis H37Rv
guagcgagcccacgu

SEQ ID NO: 1260711 - RNA, 18 nt, Mycobacterium tuberculosis H37Rv
guagcgcaggagcgcgau

SEQ ID NO: 1260712 - RNA, 20 nt, Mycobacterium tuberculosis H37Rv
guacuccuggguuugccgau

SEQ ID NO: 1260713 - RNA, 14 nt, Mycobacterium tuberculosis H37Rv
guagcaacgguagc

SEQ ID NO: 1260714 - RNA, 23 nt, Mycobacterium tuberculosis H37Rv
guagacaagucggcgcuggccgu

SEQ ID NO: 1260715 - RNA, 14 nt, Mycobacterium tuberculosis H37Rv
guagacaccgcgau

SEQ ID NO: 1260716 - RNA, 15 nt, Mycobacterium tuberculosis H37Rv
guagacaacagucga

SEQ ID NO: 1260717 - RNA, 13 nt, Mycobacterium tuberculosis H37Rv
guagcacaccgac

SEQ ID NO: 1260718 - RNA, 14 nt, Mycobacterium tuberculosis H37Rv
guagcacucgaugc

SEQ ID NO: 1260719 - RNA, 22 nt, Mycobacterium tuberculosis H37Rv
guagcagcagacgacgaucagc

SEQ ID NO: 1260720 - RNA, 13 nt, Mycobacterium tuberculosis H37Rv
guagcacggcgau

SEQ ID NO: 1260721 - RNA, 16 nt, Mycobacterium tuberculosis H37Rv
guagccgggaacgcug

SEQ ID NO: 1260722 - RNA, 14 nt, Mycobacterium tuberculosis H37Rv
guagccggucggca

SEQ ID NO: 1260723 - RNA, 15 nt, Mycobacterium tuberculosis H37Rv
gguggcagcggcgau

SEQ ID NO: 1260724 - RNA, 22 nt, Mycobacterium tuberculosis H37Rv
gguggauuggugccggucaccu

SEQ ID NO: 1260725 - RNA, 23 nt, Mycobacterium tuberculosis H37Rv
gguggcaccauaauggucgucgc

SEQ ID NO: 1260726 - RNA, 14 nt, Mycobacterium tuberculosis H37Rv
ggugcugucgacgu

SEQ ID NO: 1260727 - RNA, 18 nt, Mycobacterium tuberculosis H37Rv
gguggcaucggcggccug

SEQ ID NO: 1260728 - RNA, 20 nt, Mycobacterium tuberculosis H37Rv
gguggcgcugaagccgacga

SEQ ID NO: 1260729 - RNA, 15 nt, Mycobacterium tuberculosis H37Rv
gguggcggcagcagc

SEQ ID NO: 1260730 - RNA, 21 nt, Mycobacterium tuberculosis H37Rv
gguggcuuuugcgucugcucg

SEQ ID NO: 1260731 - RNA, 14 nt, Mycobacterium tuberculosis H37Rv
gguggcgugcgcgu

SEQ ID NO: 1260732 - RNA, 19 nt, Mycobacterium tuberculosis H37Rv
gguggcguggucucgguca

SEQ ID NO: 1260733 - RNA, 14 nt, Mycobacterium tuberculosis H37Rv
gguggcgucaccgc

SEQ ID NO: 1260734 - RNA, 22 nt, Mycobacterium tuberculosis H37Rv
gguggcguccagggcgccgauc

SEQ ID NO: 1260735 - RNA, 17 nt, Mycobacterium tuberculosis H37Rv
ggugggcagcaggccca

SEQ ID NO: 1260736 - RNA, 14 nt, Mycobacterium tuberculosis H37Rv
ggugggccagcagc

SEQ ID NO: 1260737 - RNA, 15 nt, Mycobacterium tuberculosis H37Rv
ggugggagcagccga

SEQ ID NO: 1260738 - RNA, 18 nt, Mycobacterium tuberculosis H37Rv
ggugggaucgcagcgcca

SEQ ID NO: 1260739 - RNA, 17 nt, Mycobacterium tuberculosis H37Rv
ggugggaucgcagcgcc

SEQ ID NO: 1260740 - RNA, 19 nt, Mycobacterium tuberculosis H37Rv
ggugggcaagcugaccgcc

SEQ ID NO: 1260741 - RNA, 14 nt, Mycobacterium tuberculosis H37Rv
ggugggcacagcga

SEQ ID NO: 1260742 - RNA, 21 nt, Mycobacterium tuberculosis H37Rv
ggugcuagcgccgccagucgu

SEQ ID NO: 1260743 - RNA, 19 nt, Mycobacterium tuberculosis H37Rv
ggugcucgcgaucugcucg

SEQ ID NO: 1260744 - RNA, 14 nt, Mycobacterium tuberculosis H37Rv
ggugcgucgaugcc

SEQ ID NO: 1260745 - RNA, 17 nt, Mycobacterium tuberculosis H37Rv
ggugcguagcagcgaua

SEQ ID NO: 1260746 - RNA, 14 nt, Mycobacterium tuberculosis H37Rv
ggugcgucacagcc

SEQ ID NO: 1260747 - RNA, 20 nt, Mycobacterium tuberculosis H37Rv
ggugcgguuucaccgacgac

SEQ ID NO: 1260748 - RNA, 15 nt, Mycobacterium tuberculosis H37Rv
ggugcagcgacuccg

SEQ ID NO: 1260749 - RNA, 23 nt, Mycobacterium tuberculosis H37Rv
ggugcagcgcaggauucugcuga

SEQ ID NO: 1260750 - RNA, 15 nt, Mycobacterium tuberculosis H37Rv
ggugcuggucaacag

SEQ ID NO: 1260751 - RNA, 21 nt, Mycobacterium tuberculosis H37Rv
ggugcugcacacugccgcgcu

SEQ ID NO: 1260752 - RNA, 17 nt, Mycobacterium tuberculosis H37Rv
ggugcucgggcggcgau

SEQ ID NO: 1260753 - RNA, 14 nt, Mycobacterium tuberculosis H37Rv
ggugcucgucacca

SEQ ID NO: 1260754 - RNA, 22 nt, Mycobacterium tuberculosis H37Rv
ggugcuagcgccgccagucguc

SEQ ID NO: 1260755 - RNA, 22 nt, Mycobacterium tuberculosis H37Rv
ggugcucgucaccaaacccgau

SEQ ID NO: 1260756 - RNA, 15 nt, Mycobacterium tuberculosis H37Rv
ggugcucgucgagca

SEQ ID NO: 1260757 - RNA, 16 nt, Mycobacterium tuberculosis H37Rv
ggugggccagcagcaa

SEQ ID NO: 1260758 - RNA, 14 nt, Mycobacterium tuberculosis H37Rv
ggugggcgggaucg

SEQ ID NO: 1260759 - RNA, 17 nt, Mycobacterium tuberculosis H37Rv
gguggucccccgcagcc

SEQ ID NO: 1260760 - RNA, 17 nt, Mycobacterium tuberculosis H37Rv
gguggugaguaccaauc

SEQ ID NO: 1260761 - RNA, 22 nt, Mycobacterium tuberculosis H37Rv
gguggugaccaaguagucgggu

SEQ ID NO: 1260762 - RNA, 15 nt, Mycobacterium tuberculosis H37Rv
gguggucgggcgcaa

SEQ ID NO: 1260763 - RNA, 16 nt, Mycobacterium tuberculosis H37Rv
gguggucggcgacguc

SEQ ID NO: 1260764 - RNA, 15 nt, Mycobacterium tuberculosis H37Rv
ggugucgaagagcag

SEQ ID NO: 1260765 - RNA, 13 nt, Mycobacterium tuberculosis H37Rv
gguggugcggaug

SEQ ID NO: 1260766 - RNA, 18 nt, Mycobacterium tuberculosis H37Rv
ggugugauacagcgccag

SEQ ID NO: 1260767 - RNA, 14 nt, Mycobacterium tuberculosis H37Rv
ggugugccggucuc

SEQ ID NO: 1260768 - RNA, 19 nt, Mycobacterium tuberculosis H37Rv
ggugugcaucgacucacgg

SEQ ID NO: 1260769 - RNA, 14 nt, Mycobacterium tuberculosis H37Rv
ggugugcugccacc

SEQ ID NO: 1260770 - RNA, 14 nt, Mycobacterium tuberculosis H37Rv
ggugugcggcagcc

SEQ ID NO: 1260771 - RNA, 19 nt, Mycobacterium tuberculosis H37Rv
ggugucgcucgcgaggauc

SEQ ID NO: 1260772 - RNA, 14 nt, Mycobacterium tuberculosis H37Rv
ggugucggugacau

SEQ ID NO: 1260773 - RNA, 19 nt, Mycobacterium tuberculosis H37Rv
gguguugugugcucgucgc

SEQ ID NO: 1260774 - RNA, 15 nt, Mycobacterium tuberculosis H37Rv
gguguuguacuggcu

SEQ ID NO: 1260775 - RNA, 15 nt, Mycobacterium tuberculosis H37Rv
ggugugcugccaccg

SEQ ID NO: 1260776 - RNA, 20 nt, Mycobacterium tuberculosis H37Rv
gguuccacgcguugacgauc

SEQ ID NO: 1260777 - RNA, 23 nt, Mycobacterium tuberculosis H37Rv
gguucaugcaaaagccgcgaucg

SEQ ID NO: 1260778 - RNA, 15 nt, Mycobacterium tuberculosis H37Rv
gguuccucagcggcc

SEQ ID NO: 1260779 - RNA, 16 nt, Mycobacterium tuberculosis H37Rv
gguuccuccucggcag

SEQ ID NO: 1260780 - RNA, 21 nt, Mycobacterium tuberculosis H37Rv
gguucccgaucaggcgggcaa

SEQ ID NO: 1260781 - RNA, 16 nt, Mycobacterium tuberculosis H37Rv
gguuccacgcugccca

SEQ ID NO: 1260782 - RNA, 22 nt, Mycobacterium tuberculosis H37Rv
gguuggcauccaaaaucgccug

SEQ ID NO: 1260783 - RNA, 19 nt, Mycobacterium tuberculosis H37Rv
gguucgacggacacccugg

SEQ ID NO: 1260784 - RNA, 17 nt, Mycobacterium tuberculosis H37Rv
gguucgaacgcgaucga

SEQ ID NO: 1260785 - RNA, 17 nt, Mycobacterium tuberculosis H37Rv
gguuguagacggcaccc

SEQ ID NO: 1260786 - RNA, 16 nt, Mycobacterium tuberculosis H37Rv
gguuggugcucagcgg

SEQ ID NO: 1260787 - RNA, 17 nt, Mycobacterium tuberculosis H37Rv
gguuguccucggcgauc

SEQ ID NO: 1260788 - RNA, 21 nt, Mycobacterium tuberculosis H37Rv
gguugucgucggugggcguga

SEQ ID NO: 1260789 - RNA, 18 nt, Mycobacterium tuberculosis H37Rv
guaaagcucaccacaucg

SEQ ID NO: 1260790 - RNA, 12 nt, Mycobacterium tuberculosis H37Rv
gguuugcggugc

SEQ ID NO: 1260791 - RNA, 17 nt, Mycobacterium tuberculosis H37Rv
gguuugcagcgggauca

SEQ ID NO: 1260792 - RNA, 15 nt, Mycobacterium tuberculosis H37Rv
gguuguucggcagcc

SEQ ID NO: 1260793 - RNA, 13 nt, Mycobacterium tuberculosis H37Rv
guaacgcggcacc

SEQ ID NO: 1260794 - RNA, 22 nt, Mycobacterium tuberculosis H37Rv
guaccaauccaggccaccccga

SEQ ID NO: 1260795 - RNA, 13 nt, Mycobacterium tuberculosis H37Rv
guacaucagcgcg

SEQ ID NO: 1260796 - RNA, 16 nt, Mycobacterium tuberculosis H37Rv
guacauacucugcgac

SEQ ID NO: 1260797 - RNA, 11 nt, Mycobacterium tuberculosis H37Rv
guacagcgccu

SEQ ID NO: 1260798 - RNA, 12 nt, Mycobacterium tuberculosis H37Rv
guacaccaggcc

SEQ ID NO: 1260799 - RNA, 14 nt, Mycobacterium tuberculosis H37Rv
guacaccaggccgu

SEQ ID NO: 1260800 - RNA, 17 nt, Mycobacterium tuberculosis H37Rv
guacaccgugcgccgaa

SEQ ID NO: 1260801 - RNA, 19 nt, Mycobacterium tuberculosis H37Rv
guacaagcauuggcgucga

SEQ ID NO: 1260802 - RNA, 23 nt, Mycobacterium tuberculosis H37Rv
guacaagcauuggcgucgacaac

SEQ ID NO: 1260803 - RNA, 15 nt, Mycobacterium tuberculosis H37Rv
guaauugccgaccgc

SEQ ID NO: 1260804 - RNA, 18 nt, Mycobacterium tuberculosis H37Rv
gugcggaacacgaugcgc

SEQ ID NO: 1260805 - RNA, 17 nt, Mycobacterium tuberculosis H37Rv
gugcggaacaccgcccg

SEQ ID NO: 1260806 - RNA, 17 nt, Mycobacterium tuberculosis H37Rv
gugcggcaacagcgcca

SEQ ID NO: 1260807 - RNA, 13 nt, Mycobacterium tuberculosis H37Rv
gugcgcgucgcgc

SEQ ID NO: 1260808 - RNA, 14 nt, Mycobacterium tuberculosis H37Rv
gugcgcgcgcagcu

SEQ ID NO: 1260809 - RNA, 20 nt, Mycobacterium tuberculosis H37Rv
gugcgcgauaggugcucgcg

SEQ ID NO: 1260810 - RNA, 13 nt, Mycobacterium tuberculosis H37Rv
gugcgucucggug

SEQ ID NO: 1260811 - RNA, 15 nt, Mycobacterium tuberculosis H37Rv
gugcgucgacccagc

SEQ ID NO: 1260812 - RNA, 18 nt, Mycobacterium tuberculosis H37Rv
gugcgucgaugccggugu

SEQ ID NO: 1260813 - RNA, 13 nt, Mycobacterium tuberculosis H37Rv
gugcgucacagcc

SEQ ID NO: 1260814 - RNA, 17 nt, Mycobacterium tuberculosis H37Rv
gugcggcauugguaccg

SEQ ID NO: 1260815 - RNA, 18 nt, Mycobacterium tuberculosis H37Rv
gugcggcaccgccgccca

SEQ ID NO: 1260816 - RNA, 16 nt, Mycobacterium tuberculosis H37Rv
gugcgccgucagccca

SEQ ID NO: 1260817 - RNA, 14 nt, Mycobacterium tuberculosis H37Rv
gugcgccgugcgau

SEQ ID NO: 1260818 - RNA, 19 nt, Mycobacterium tuberculosis H37Rv
gugcgccgugcgaucguca

SEQ ID NO: 1260819 - RNA, 13 nt, Mycobacterium tuberculosis H37Rv
gugcgcgaccagg

SEQ ID NO: 1260820 - RNA, 22 nt, Mycobacterium tuberculosis H37Rv
gugcgcagaacaccaccgccag

SEQ ID NO: 1260821 - RNA, 13 nt, Mycobacterium tuberculosis H37Rv
gugcgcacggcgg

SEQ ID NO: 1260822 - RNA, 22 nt, Mycobacterium tuberculosis H37Rv
gugcgcaccccgcuugcgcggc

SEQ ID NO: 1260823 - RNA, 19 nt, Mycobacterium tuberculosis H37Rv
gugcgauccagggccgacg

SEQ ID NO: 1260824 - RNA, 19 nt, Mycobacterium tuberculosis H37Rv
gugcgauuuugugucugcu

SEQ ID NO: 1260825 - RNA, 20 nt, Mycobacterium tuberculosis H37Rv
gugcgauuuugugucugcuc

SEQ ID NO: 1260826 - RNA, 12 nt, Mycobacterium tuberculosis H37Rv
gugccggucacc

SEQ ID NO: 1260827 - RNA, 19 nt, Mycobacterium tuberculosis H37Rv
gugccggggauaucacgac

SEQ ID NO: 1260828 - RNA, 15 nt, Mycobacterium tuberculosis H37Rv
gugccggucgaugac

SEQ ID NO: 1260829 - RNA, 22 nt, Mycobacterium tuberculosis H37Rv
gugccggugauggccgaccagc

SEQ ID NO: 1260830 - RNA, 21 nt, Mycobacterium tuberculosis H37Rv
gugccgguuuggccgaacagc

SEQ ID NO: 1260831 - RNA, 13 nt, Mycobacterium tuberculosis H37Rv
gugccguggucga

SEQ ID NO: 1260832 - RNA, 17 nt, Mycobacterium tuberculosis H37Rv
gugccguccccggccga

SEQ ID NO: 1260833 - RNA, 13 nt, Mycobacterium tuberculosis H37Rv
gugccgucggugc

SEQ ID NO: 1260834 - RNA, 17 nt, Mycobacterium tuberculosis H37Rv
gugccguguccagcaug

SEQ ID NO: 1260835 - RNA, 15 nt, Mycobacterium tuberculosis H37Rv
gugccgggaucgccg

SEQ ID NO: 1260836 - RNA, 20 nt, Mycobacterium tuberculosis H37Rv
gugccggggcugccgccguu

SEQ ID NO: 1260837 - RNA, 14 nt, Mycobacterium tuberculosis H37Rv
gugccgccggccag

SEQ ID NO: 1260838 - RNA, 23 nt, Mycobacterium tuberculosis H37Rv
gugccgccggaaucgagacggua

SEQ ID NO: 1260839 - RNA, 12 nt, Mycobacterium tuberculosis H37Rv
gugccggcguua

SEQ ID NO: 1260840 - RNA, 20 nt, Mycobacterium tuberculosis H37Rv
gugccgccauugacgccguu

SEQ ID NO: 1260841 - RNA, 20 nt, Mycobacterium tuberculosis H37Rv
gugccgcccgcgccgccgcu

SEQ ID NO: 1260842 - RNA, 13 nt, Mycobacterium tuberculosis H37Rv
gugccgccgcaga

SEQ ID NO: 1260843 - RNA, 14 nt, Mycobacterium tuberculosis H37Rv
gugccgccgcagau

SEQ ID NO: 1260844 - RNA, 20 nt, Mycobacterium tuberculosis H37Rv
gugccgccgaugucgacgac

SEQ ID NO: 1260845 - RNA, 13 nt, Mycobacterium tuberculosis H37Rv
gugccgcacagcg

SEQ ID NO: 1260846 - RNA, 14 nt, Mycobacterium tuberculosis H37Rv
gugccgcacagcgg

SEQ ID NO: 1260847 - RNA, 12 nt, Mycobacterium tuberculosis H37Rv
gugccgcaaccg

SEQ ID NO: 1260848 - RNA, 13 nt, Mycobacterium tuberculosis H37Rv
gugccgaccgcgu

SEQ ID NO: 1260849 - RNA, 20 nt, Mycobacterium tuberculosis H37Rv
gugccgaccgcguuuugcag

SEQ ID NO: 1260850 - RNA, 15 nt, Mycobacterium tuberculosis H37Rv
gugccgacgccccga

SEQ ID NO: 1260851 - RNA, 16 nt, Mycobacterium tuberculosis H37Rv
gugccgacgccccgau

SEQ ID NO: 1260852 - RNA, 14 nt, Mycobacterium tuberculosis H37Rv
gugccgacggugau

SEQ ID NO: 1260853 - RNA, 13 nt, Mycobacterium tuberculosis H37Rv
gugccgacgucgg

SEQ ID NO: 1260854 - RNA, 20 nt, Mycobacterium tuberculosis H37Rv
gugccgacccgcuucgcccg

SEQ ID NO: 1260855 - RNA, 17 nt, Mycobacterium tuberculosis H37Rv
gugccgagaucccagcg

SEQ ID NO: 1260856 - RNA, 21 nt, Mycobacterium tuberculosis H37Rv
gugccgagaucccagcgggac

SEQ ID NO: 1260857 - RNA, 19 nt, Mycobacterium tuberculosis H37Rv
gugccgagcuugucgagca

SEQ ID NO: 1260858 - RNA, 22 nt, Mycobacterium tuberculosis H37Rv
gugccgaguuccugcacgguca

SEQ ID NO: 1260859 - RNA, 21 nt, Mycobacterium tuberculosis H37Rv
gugccagcagcagcgccgcgu

SEQ ID NO: 1260860 - RNA, 15 nt, Mycobacterium tuberculosis H37Rv
gugccgaacgccaga

SEQ ID NO: 1260861 - RNA, 19 nt, Mycobacterium tuberculosis H37Rv
gugccagaccagggcagcg

SEQ ID NO: 1260862 - RNA, 21 nt, Mycobacterium tuberculosis H37Rv
gugccgaagaugaccgcucgu

SEQ ID NO: 1260863 - RNA, 14 nt, Mycobacterium tuberculosis H37Rv
gugccgaccaccag

SEQ ID NO: 1260864 - RNA, 12 nt, Mycobacterium tuberculosis H37Rv
gugccgaccagc

SEQ ID NO: 1260865 - RNA, 13 nt, Mycobacterium tuberculosis H37Rv
gugccgaccagca

SEQ ID NO: 1260866 - RNA, 15 nt, Mycobacterium tuberculosis H37Rv
gugccacgaucggcg

SEQ ID NO: 1260867 - RNA, 12 nt, Mycobacterium tuberculosis H37Rv
gugccaacgggc

SEQ ID NO: 1260868 - RNA, 20 nt, Mycobacterium tuberculosis H37Rv
gugccagcaccacgucgacg

SEQ ID NO: 1260869 - RNA, 23 nt, Mycobacterium tuberculosis H37Rv
gugccagcaccacgucgacgaug

SEQ ID NO: 1260870 - RNA, 18 nt, Mycobacterium tuberculosis H37Rv
gugccaccugggcgggcu

SEQ ID NO: 1260871 - RNA, 19 nt, Mycobacterium tuberculosis H37Rv
gugccaaaugaugacgauc

SEQ ID NO: 1260872 - RNA, 13 nt, Mycobacterium tuberculosis H37Rv
gugccaacugcgc

SEQ ID NO: 1260873 - RNA, 18 nt, Mycobacterium tuberculosis H37Rv
gugcagguuggccugcuu

SEQ ID NO: 1260874 - RNA, 17 nt, Mycobacterium tuberculosis H37Rv
gugauacagcucggugc

SEQ ID NO: 1260875 - RNA, 18 nt, Mycobacterium tuberculosis H37Rv
gugaguuccaugugcgau

SEQ ID NO: 1260876 - RNA, 13 nt, Mycobacterium tuberculosis H37Rv
gugagugaccacg

SEQ ID NO: 1260877 - RNA, 17 nt, Mycobacterium tuberculosis H37Rv
gugaggucgaucagcgg

SEQ ID NO: 1260878 - RNA, 22 nt, Mycobacterium tuberculosis H37Rv
gugaguacggugugcgugcggu

SEQ ID NO: 1260879 - RNA, 20 nt, Mycobacterium tuberculosis H37Rv
gugaguaccaauccaggcca

SEQ ID NO: 1260880 - RNA, 15 nt, Mycobacterium tuberculosis H37Rv
gugaguacggugugc

SEQ ID NO: 1260881 - RNA, 16 nt, Mycobacterium tuberculosis H37Rv
gugagucccacgccag

SEQ ID NO: 1260882 - RNA, 14 nt, Mycobacterium tuberculosis H37Rv
gugagugaaucgcg

SEQ ID NO: 1260883 - RNA, 23 nt, Mycobacterium tuberculosis H37Rv
gugauugcggccgccgagucaaa

SEQ ID NO: 1260884 - RNA, 19 nt, Mycobacterium tuberculosis H37Rv
gugauuccgggucggcgaa

SEQ ID NO: 1260885 - RNA, 13 nt, Mycobacterium tuberculosis H37Rv
gugauguagcugc

SEQ ID NO: 1260886 - RNA, 23 nt, Mycobacterium tuberculosis H37Rv
gugaugucuaccaacaccgcccg

SEQ ID NO: 1260887 - RNA, 19 nt, Mycobacterium tuberculosis H37Rv
gugauggcgcggucgcuga

SEQ ID NO: 1260888 - RNA, 18 nt, Mycobacterium tuberculosis H37Rv
gugaugaacgacauccgg

SEQ ID NO: 1260889 - RNA, 19 nt, Mycobacterium tuberculosis H37Rv
gugaucugguccggcaaca

SEQ ID NO: 1260890 - RNA, 14 nt, Mycobacterium tuberculosis H37Rv
gugaucuugccggc

SEQ ID NO: 1260891 - RNA, 22 nt, Mycobacterium tuberculosis H37Rv
gugcagaauucggcgcgacagc

SEQ ID NO: 1260892 - RNA, 14 nt, Mycobacterium tuberculosis H37Rv
gugcagcacggcgc

SEQ ID NO: 1260893 - RNA, 13 nt, Mycobacterium tuberculosis H37Rv
gugcagcacuugg

SEQ ID NO: 1260894 - RNA, 23 nt, Mycobacterium tuberculosis H37Rv
gugcacggcuuuucgacgcugug

SEQ ID NO: 1260895 - RNA, 14 nt, Mycobacterium tuberculosis H37Rv
gugcacgcgggcgu

SEQ ID NO: 1260896 - RNA, 14 nt, Mycobacterium tuberculosis H37Rv
gugcacugaccgcg

SEQ ID NO: 1260897 - RNA, 21 nt, Mycobacterium tuberculosis H37Rv
gugcacucgguaaccgcgcgu

SEQ ID NO: 1260898 - RNA, 17 nt, Mycobacterium tuberculosis H37Rv
gugcacgaucgcgguga

SEQ ID NO: 1260899 - RNA, 13 nt, Mycobacterium tuberculosis H37Rv
gugcaccgucggg

SEQ ID NO: 1260900 - RNA, 23 nt, Mycobacterium tuberculosis H37Rv
gugcaaccccaaguccagcagcg

SEQ ID NO: 1260901 - RNA, 18 nt, Mycobacterium tuberculosis H37Rv
gugcaaccacggcggcau

SEQ ID NO: 1260902 - RNA, 22 nt, Mycobacterium tuberculosis H37Rv
gugcaacacgccggcccgguga

SEQ ID NO: 1260903 - RNA, 22 nt, Mycobacterium tuberculosis H37Rv
gugcaacggcguuggcgccguu

SEQ ID NO: 1260904 - RNA, 16 nt, Mycobacterium tuberculosis H37Rv
gugcaagaccguuaca

SEQ ID NO: 1260905 - RNA, 20 nt, Mycobacterium tuberculosis H37Rv
gugcaagccgaacaccguca

SEQ ID NO: 1260906 - RNA, 16 nt, Mycobacterium tuberculosis H37Rv
gugcaccgcgaccgcg

SEQ ID NO: 1260907 - RNA, 21 nt, Mycobacterium tuberculosis H37Rv
gugaccucaccaaccgcccga

SEQ ID NO: 1260908 - RNA, 13 nt, Mycobacterium tuberculosis H37Rv
gugacgauugcca

SEQ ID NO: 1260909 - RNA, 16 nt, Mycobacterium tuberculosis H37Rv
gugacgccacgaccgc

SEQ ID NO: 1260910 - RNA, 16 nt, Mycobacterium tuberculosis H37Rv
gugacgaucgacagcc

SEQ ID NO: 1260911 - RNA, 13 nt, Mycobacterium tuberculosis H37Rv
gugacgaucccca

SEQ ID NO: 1260912 - RNA, 16 nt, Mycobacterium tuberculosis H37Rv
gugacgcgcgccggau

SEQ ID NO: 1260913 - RNA, 14 nt, Mycobacterium tuberculosis H37Rv
gugacgccggccag

SEQ ID NO: 1260914 - RNA, 23 nt, Mycobacterium tuberculosis H37Rv
gugaccugacgcucggucgccac

SEQ ID NO: 1260915 - RNA, 16 nt, Mycobacterium tuberculosis H37Rv
gugaccgucagcccga

SEQ ID NO: 1260916 - RNA, 19 nt, Mycobacterium tuberculosis H37Rv
gugaccggcaaugccacgg

SEQ ID NO: 1260917 - RNA, 16 nt, Mycobacterium tuberculosis H37Rv
gugaccgaccgccaug

SEQ ID NO: 1260918 - RNA, 19 nt, Mycobacterium tuberculosis H37Rv
gugacucgggcacggguga

SEQ ID NO: 1260919 - RNA, 17 nt, Mycobacterium tuberculosis H37Rv
gugagauggcggugagc

SEQ ID NO: 1260920 - RNA, 13 nt, Mycobacterium tuberculosis H37Rv
gugagcaacgcga

SEQ ID NO: 1260921 - RNA, 16 nt, Mycobacterium tuberculosis H37Rv
gugaggccuucgccga

SEQ ID NO: 1260922 - RNA, 17 nt, Mycobacterium tuberculosis H37Rv
gugagcaccagcagcac

SEQ ID NO: 1260923 - RNA, 15 nt, Mycobacterium tuberculosis H37Rv
gugagcacaccgaca

SEQ ID NO: 1260924 - RNA, 14 nt, Mycobacterium tuberculosis H37Rv
gugagcuuagcgca

SEQ ID NO: 1260925 - RNA, 17 nt, Mycobacterium tuberculosis H37Rv
gugacgugcucucgcuc

SEQ ID NO: 1260926 - RNA, 14 nt, Mycobacterium tuberculosis H37Rv
gugacguaccacgg

SEQ ID NO: 1260927 - RNA, 20 nt, Mycobacterium tuberculosis H37Rv
gugacgguccacgacgucga

SEQ ID NO: 1260928 - RNA, 17 nt, Mycobacterium tuberculosis H37Rv
gugacgguccacgacgu

SEQ ID NO: 1260929 - RNA, 19 nt, Mycobacterium tuberculosis H37Rv
gugacgguccguucgaugc

SEQ ID NO: 1260930 - RNA, 14 nt, Mycobacterium tuberculosis H37Rv
gugacggucgucga

SEQ ID NO: 1260931 - RNA, 18 nt, Mycobacterium tuberculosis H37Rv
gugacgguggccggcaac

SEQ ID NO: 1260932 - RNA, 14 nt, Mycobacterium tuberculosis H37Rv
gugacggcggccac

SEQ ID NO: 1260933 - RNA, 23 nt, Mycobacterium tuberculosis H37Rv
gucggucaccgaaugcgggucug

SEQ ID NO: 1260934 - RNA, 23 nt, Mycobacterium tuberculosis H37Rv
gucggugauggucagcuggccgc

SEQ ID NO: 1260935 - RNA, 18 nt, Mycobacterium tuberculosis H37Rv
gucggucaccauggcgcc

SEQ ID NO: 1260936 - RNA, 16 nt, Mycobacterium tuberculosis H37Rv
gucgguaccccagcgc

SEQ ID NO: 1260937 - RNA, 12 nt, Mycobacterium tuberculosis H37Rv
gucgggugcuga

SEQ ID NO: 1260938 - RNA, 17 nt, Mycobacterium tuberculosis H37Rv
gucgggucgaucaccga

SEQ ID NO: 1260939 - RNA, 20 nt, Mycobacterium tuberculosis H37Rv
gucgggguuucaggcggcag

SEQ ID NO: 1260940 - RNA, 17 nt, Mycobacterium tuberculosis H37Rv
gucggguccaacgccgc

SEQ ID NO: 1260941 - RNA, 19 nt, Mycobacterium tuberculosis H37Rv
gucgggguccgcggcauga

SEQ ID NO: 1260942 - RNA, 23 nt, Mycobacterium tuberculosis H37Rv
gucggcuucgacaaccucgagua

SEQ ID NO: 1260943 - RNA, 16 nt, Mycobacterium tuberculosis H37Rv
gucggcuuccggugcc

SEQ ID NO: 1260944 - RNA, 19 nt, Mycobacterium tuberculosis H37Rv
gucggcuucgacaaccucg

SEQ ID NO: 1260945 - RNA, 16 nt, Mycobacterium tuberculosis H37Rv
gucgggaacgccgaac

SEQ ID NO: 1260946 - RNA, 21 nt, Mycobacterium tuberculosis H37Rv
gucggggucguugaggccggu

SEQ ID NO: 1260947 - RNA, 23 nt, Mycobacterium tuberculosis H37Rv
gucgggguuuaguuuaucggccg

SEQ ID NO: 1260948 - RNA, 19 nt, Mycobacterium tuberculosis H37Rv
gucggcugauuggcccacc

SEQ ID NO: 1260949 - RNA, 12 nt, Mycobacterium tuberculosis H37Rv
gucggcggugcc

SEQ ID NO: 1260950 - RNA, 13 nt, Mycobacterium tuberculosis H37Rv
gucggcggugccg

SEQ ID NO: 1260951 - RNA, 22 nt, Mycobacterium tuberculosis H37Rv
gucggcguagucgcugucggca

SEQ ID NO: 1260952 - RNA, 12 nt, Mycobacterium tuberculosis H37Rv
gucggcggugac

SEQ ID NO: 1260953 - RNA, 15 nt, Mycobacterium tuberculosis H37Rv
gucggcguacagcgc

SEQ ID NO: 1260954 - RNA, 18 nt, Mycobacterium tuberculosis H37Rv
gucggcggggcgccggau

SEQ ID NO: 1260955 - RNA, 23 nt, Mycobacterium tuberculosis H37Rv
gucggccacccggacauagccgc

SEQ ID NO: 1260956 - RNA, 19 nt, Mycobacterium tuberculosis H37Rv
gucggagucuucgucgucg

SEQ ID NO: 1260957 - RNA, 18 nt, Mycobacterium tuberculosis H37Rv
gucggcagaccgaccucg

SEQ ID NO: 1260958 - RNA, 20 nt, Mycobacterium tuberculosis H37Rv
gucggcagcagcggugcagc

SEQ ID NO: 1260959 - RNA, 22 nt, Mycobacterium tuberculosis H37Rv
gucggagcuagacccgucaccg

SEQ ID NO: 1260960 - RNA, 15 nt, Mycobacterium tuberculosis H37Rv
gucggagccggccac

SEQ ID NO: 1260961 - RNA, 13 nt, Mycobacterium tuberculosis H37Rv
gucggcagcgucc

SEQ ID NO: 1260962 - RNA, 19 nt, Mycobacterium tuberculosis H37Rv
gucgguggcagcgguggcc

SEQ ID NO: 1260963 - RNA, 21 nt, Mycobacterium tuberculosis H37Rv
gucgguguuuggccgccgaau

SEQ ID NO: 1260964 - RNA, 15 nt, Mycobacterium tuberculosis H37Rv
gucggugcggugcac

SEQ ID NO: 1260965 - RNA, 14 nt, Mycobacterium tuberculosis H37Rv
gucggugccgcgga

SEQ ID NO: 1260966 - RNA, 16 nt, Mycobacterium tuberculosis H37Rv
gucggugccgcggacg

SEQ ID NO: 1260967 - RNA, 22 nt, Mycobacterium tuberculosis H37Rv
gucggugccgcggacguggucg

SEQ ID NO: 1260968 - RNA, 12 nt, Mycobacterium tuberculosis H37Rv
gucggugcgcgc

SEQ ID NO: 1260969 - RNA, 19 nt, Mycobacterium tuberculosis H37Rv
gucgguugauugugcccag

SEQ ID NO: 1260970 - RNA, 22 nt, Mycobacterium tuberculosis H37Rv
gucguacccggcaacgggaucu

SEQ ID NO: 1260971 - RNA, 16 nt, Mycobacterium tuberculosis H37Rv
gucguaccgcggaucg

SEQ ID NO: 1260972 - RNA, 15 nt, Mycobacterium tuberculosis H37Rv
gucguaugcggugac

SEQ ID NO: 1260973 - RNA, 19 nt, Mycobacterium tuberculosis H37Rv
gucguagcucgguaggccg

SEQ ID NO: 1260974 - RNA, 19 nt, Mycobacterium tuberculosis H37Rv
gucguagacagucugcgac

SEQ ID NO: 1260975 - RNA, 18 nt, Mycobacterium tuberculosis H37Rv
gucguacucggcggccac

SEQ ID NO: 1260976 - RNA, 14 nt, Mycobacterium tuberculosis H37Rv
gucguagacggcga

SEQ ID NO: 1260977 - RNA, 16 nt, Mycobacterium tuberculosis H37Rv
gucguagacgguuacc

SEQ ID NO: 1260978 - RNA, 15 nt, Mycobacterium tuberculosis H37Rv
gucguagacagucug

SEQ ID NO: 1260979 - RNA, 15 nt, Mycobacterium tuberculosis H37Rv
gucguacucggcggc

SEQ ID NO: 1260980 - RNA, 20 nt, Mycobacterium tuberculosis H37Rv
gucguaccuaaggcucacca

SEQ ID NO: 1260981 - RNA, 15 nt, Mycobacterium tuberculosis H37Rv
gucguaccgcucggc

SEQ ID NO: 1260982 - RNA, 17 nt, Mycobacterium tuberculosis H37Rv
gucgucacggaccgcca

SEQ ID NO: 1260983 - RNA, 20 nt, Mycobacterium tuberculosis H37Rv
gucgucaccgaugcgccgga

SEQ ID NO: 1260984 - RNA, 19 nt, Mycobacterium tuberculosis H37Rv
gucgucaccguacgggacg

SEQ ID NO: 1260985 - RNA, 18 nt, Mycobacterium tuberculosis H37Rv
gucgucgacacggugauc

SEQ ID NO: 1260986 - RNA, 22 nt, Mycobacterium tuberculosis H37Rv
gucgucgaccacgacguucgac

SEQ ID NO: 1260987 - RNA, 20 nt, Mycobacterium tuberculosis H37Rv
gucgucgagcaccacccggg

SEQ ID NO: 1260988 - RNA, 13 nt, Mycobacterium tuberculosis H37Rv
gucgucgagcuga

SEQ ID NO: 1260989 - RNA, 13 nt, Mycobacterium tuberculosis H37Rv
gucgucgaucgac

SEQ ID NO: 1260990 - RNA, 16 nt, Mycobacterium tuberculosis H37Rv
gucgucgaggucacgc

SEQ ID NO: 1260991 - RNA, 18 nt, Mycobacterium tuberculosis H37Rv
gucgucgguaaugccggg

SEQ ID NO: 1260992 - RNA, 18 nt, Mycobacterium tuberculosis H37Rv
gucgucguugugugccag

SEQ ID NO: 1260993 - RNA, 15 nt, Mycobacterium tuberculosis H37Rv
gucgucgaguuggcc

SEQ ID NO: 1260994 - RNA, 13 nt, Mycobacterium tuberculosis H37Rv
gucgucggcgucg

SEQ ID NO: 1260995 - RNA, 17 nt, Mycobacterium tuberculosis H37Rv
gucgucgcagugcaagc

SEQ ID NO: 1260996 - RNA, 20 nt, Mycobacterium tuberculosis H37Rv
gugaacuucuccaccagcgu

SEQ ID NO: 1260997 - RNA, 16 nt, Mycobacterium tuberculosis H37Rv
gugaaguugccgguca

SEQ ID NO: 1260998 - RNA, 16 nt, Mycobacterium tuberculosis H37Rv
gugaaggucaccgucg

SEQ ID NO: 1260999 - RNA, 17 nt, Mycobacterium tuberculosis H37Rv
gugaaggucaccgucga

SEQ ID NO: 1261000 - RNA, 23 nt, Mycobacterium tuberculosis H37Rv
gugaaggucaccgucgagucgac

SEQ ID NO: 1261001 - RNA, 21 nt, Mycobacterium tuberculosis H37Rv
gucuucgauaccgaccgaaag

SEQ ID NO: 1261002 - RNA, 21 nt, Mycobacterium tuberculosis H37Rv
gucuguacaacgacacgccgc

SEQ ID NO: 1261003 - RNA, 17 nt, Mycobacterium tuberculosis H37Rv
gucugggcuuugcagcg

SEQ ID NO: 1261004 - RNA, 22 nt, Mycobacterium tuberculosis H37Rv
gucuucuuucgccuccggaucc

SEQ ID NO: 1261005 - RNA, 20 nt, Mycobacterium tuberculosis H37Rv
gucuucgucauggccggcca

SEQ ID NO: 1261006 - RNA, 16 nt, Mycobacterium tuberculosis H37Rv
gugacauagacguugc

SEQ ID NO: 1261007 - RNA, 14 nt, Mycobacterium tuberculosis H37Rv
gugaccaacggugc

SEQ ID NO: 1261008 - RNA, 12 nt, Mycobacterium tuberculosis H37Rv
gugaccagcagg

SEQ ID NO: 1261009 - RNA, 13 nt, Mycobacterium tuberculosis H37Rv
gugaccaggccgg

SEQ ID NO: 1261010 - RNA, 19 nt, Mycobacterium tuberculosis H37Rv
gugacccgcugggccgcau

SEQ ID NO: 1261011 - RNA, 23 nt, Mycobacterium tuberculosis H37Rv
gugacccgacaugguccgaccag

SEQ ID NO: 1261012 - RNA, 22 nt, Mycobacterium tuberculosis H37Rv
gugacccucagcaccgcuggca

SEQ ID NO: 1261013 - RNA, 19 nt, Mycobacterium tuberculosis H37Rv
gugacccucagcaccgcug

SEQ ID NO: 1261014 - RNA, 17 nt, Mycobacterium tuberculosis H37Rv
gugacccgugcggccac

SEQ ID NO: 1261015 - RNA, 13 nt, Mycobacterium tuberculosis H37Rv
gugacagcggcau

SEQ ID NO: 1261016 - RNA, 22 nt, Mycobacterium tuberculosis H37Rv
gugacauaaaccucgccgguga

SEQ ID NO: 1261017 - RNA, 15 nt, Mycobacterium tuberculosis H37Rv
gugacaaauucggcg

SEQ ID NO: 1261018 - RNA, 20 nt, Mycobacterium tuberculosis H37Rv
gugaaucugacgacgcgaca

SEQ ID NO: 1261019 - RNA, 13 nt, Mycobacterium tuberculosis H37Rv
gugaaucgcacga

SEQ ID NO: 1261020 - RNA, 12 nt, Mycobacterium tuberculosis H37Rv
gugaaugccguc

SEQ ID NO: 1261021 - RNA, 20 nt, Mycobacterium tuberculosis H37Rv
gugaauuaaggugaccacgg

SEQ ID NO: 1261022 - RNA, 13 nt, Mycobacterium tuberculosis H37Rv
gugaauucgccga

SEQ ID NO: 1261023 - RNA, 20 nt, Mycobacterium tuberculosis H37Rv
gucgugaggaaccccggucg

SEQ ID NO: 1261024 - RNA, 17 nt, Mycobacterium tuberculosis H37Rv
gucgugauacagcucgg

SEQ ID NO: 1261025 - RNA, 19 nt, Mycobacterium tuberculosis H37Rv
gucgucguugugugccagc

SEQ ID NO: 1261026 - RNA, 21 nt, Mycobacterium tuberculosis H37Rv
gucgucguugugugccagcgu

SEQ ID NO: 1261027 - RNA, 14 nt, Mycobacterium tuberculosis H37Rv
gucguguaggaccu

SEQ ID NO: 1261028 - RNA, 16 nt, Mycobacterium tuberculosis H37Rv
gucguggggacuggca

SEQ ID NO: 1261029 - RNA, 14 nt, Mycobacterium tuberculosis H37Rv
gucgugaucggcgu

SEQ ID NO: 1261030 - RNA, 15 nt, Mycobacterium tuberculosis H37Rv
gucguggcgguggcc

SEQ ID NO: 1261031 - RNA, 14 nt, Mycobacterium tuberculosis H37Rv
gucguuaccaggcg

SEQ ID NO: 1261032 - RNA, 18 nt, Mycobacterium tuberculosis H37Rv
gucuccucggucaccgag

SEQ ID NO: 1261033 - RNA, 16 nt, Mycobacterium tuberculosis H37Rv
gucucgcaugcucacg

SEQ ID NO: 1261034 - RNA, 17 nt, Mycobacterium tuberculosis H37Rv
gucuggcgcggagcuga

SEQ ID NO: 1261035 - RNA, 16 nt, Mycobacterium tuberculosis H37Rv
gucuggacaucggccg

SEQ ID NO: 1261036 - RNA, 16 nt, Mycobacterium tuberculosis H37Rv
gucugcucgccgggca

SEQ ID NO: 1261037 - RNA, 13 nt, Mycobacterium tuberculosis H37Rv
gucugcucgccgu

SEQ ID NO: 1261038 - RNA, 23 nt, Mycobacterium tuberculosis H37Rv
gucucgcggugcggcaacagcgc

SEQ ID NO: 1261039 - RNA, 17 nt, Mycobacterium tuberculosis H37Rv
gucucggcgaccgacgc

SEQ ID NO: 1261040 - RNA, 13 nt, Mycobacterium tuberculosis H37Rv
gucucggcgaccg

SEQ ID NO: 1261041 - RNA, 22 nt, Mycobacterium tuberculosis H37Rv
gucucgggcgcgggugaccagg

SEQ ID NO: 1261042 - RNA, 12 nt, Mycobacterium tuberculosis H37Rv
gucugcggucau

SEQ ID NO: 1261043 - RNA, 13 nt, Mycobacterium tuberculosis H37Rv
gucucgucggcaa

SEQ ID NO: 1261044 - RNA, 12 nt, Mycobacterium tuberculosis H37Rv
gucguucgccga

SEQ ID NO: 1261045 - RNA, 17 nt, Mycobacterium tuberculosis H37Rv
gucucggggugcacgau

SEQ ID NO: 1261046 - RNA, 20 nt, Mycobacterium tuberculosis H37Rv
gucucgguggcugcgccgga

SEQ ID NO: 1261047 - RNA, 17 nt, Mycobacterium tuberculosis H37Rv
gucgaaguagccgacgu

SEQ ID NO: 1261048 - RNA, 22 nt, Mycobacterium tuberculosis H37Rv
gucgaaucgcugccgccgaucg

SEQ ID NO: 1261049 - RNA, 13 nt, Mycobacterium tuberculosis H37Rv
gucgaaggugacc

SEQ ID NO: 1261050 - RNA, 16 nt, Mycobacterium tuberculosis H37Rv
gucgaagauccagcgc

SEQ ID NO: 1261051 - RNA, 22 nt, Mycobacterium tuberculosis H37Rv
gucgaagaauaugccgaugacc

SEQ ID NO: 1261052 - RNA, 22 nt, Mycobacterium tuberculosis H37Rv
gucgaagaaccggccgacgaac

SEQ ID NO: 1261053 - RNA, 22 nt, Mycobacterium tuberculosis H37Rv
gucgaacuugaucaccgcguag

SEQ ID NO: 1261054 - RNA, 20 nt, Mycobacterium tuberculosis H37Rv
gucgaacgguagcacggucu

SEQ ID NO: 1261055 - RNA, 15 nt, Mycobacterium tuberculosis H37Rv
gucgaacugccggac

SEQ ID NO: 1261056 - RNA, 13 nt, Mycobacterium tuberculosis H37Rv
gucgaacgguagc

SEQ ID NO: 1261057 - RNA, 19 nt, Mycobacterium tuberculosis H37Rv
gucgaaccaguccucgggc

SEQ ID NO: 1261058 - RNA, 17 nt, Mycobacterium tuberculosis H37Rv
gucgaacgcaugcucga

SEQ ID NO: 1261059 - RNA, 22 nt, Mycobacterium tuberculosis H37Rv
gucgaacaugauccgccggcaa

SEQ ID NO: 1261060 - RNA, 22 nt, Mycobacterium tuberculosis H37Rv
gucgaacagcaccgccggcgac

SEQ ID NO: 1261061 - RNA, 17 nt, Mycobacterium tuberculosis H37Rv
guccugcggguagguga

SEQ ID NO: 1261062 - RNA, 22 nt, Mycobacterium tuberculosis H37Rv
guccugcuuguagcgcaucgcc

SEQ ID NO: 1261063 - RNA, 20 nt, Mycobacterium tuberculosis H37Rv
guccuggcgaacucgcgcag

SEQ ID NO: 1261064 - RNA, 20 nt, Mycobacterium tuberculosis H37Rv
guccuccccgagcgugucac

SEQ ID NO: 1261065 - RNA, 14 nt, Mycobacterium tuberculosis H37Rv
guccucgccgcacg

SEQ ID NO: 1261066 - RNA, 19 nt, Mycobacterium tuberculosis H37Rv
guccucgagguccucgucg

SEQ ID NO: 1261067 - RNA, 21 nt, Mycobacterium tuberculosis H37Rv
guccucgagguccucgucggc

SEQ ID NO: 1261068 - RNA, 16 nt, Mycobacterium tuberculosis H37Rv
guccuagcgugccgcc

SEQ ID NO: 1261069 - RNA, 20 nt, Mycobacterium tuberculosis H37Rv
guccuagcgugccgcccggu

SEQ ID NO: 1261070 - RNA, 15 nt, Mycobacterium tuberculosis H37Rv
guccguucaccgucu

SEQ ID NO: 1261071 - RNA, 18 nt, Mycobacterium tuberculosis H37Rv
guccugaaucgguucggc

SEQ ID NO: 1261072 - RNA, 18 nt, Mycobacterium tuberculosis H37Rv
guccugaugacucauccc

SEQ ID NO: 1261073 - RNA, 22 nt, Mycobacterium tuberculosis H37Rv
guccugaugacucaucccgaga

SEQ ID NO: 1261074 - RNA, 15 nt, Mycobacterium tuberculosis H37Rv
guccucgucggcguc

SEQ ID NO: 1261075 - RNA, 15 nt, Mycobacterium tuberculosis H37Rv
guccucggcgaucac

SEQ ID NO: 1261076 - RNA, 17 nt, Mycobacterium tuberculosis H37Rv
guccucgucggcgucga

SEQ ID NO: 1261077 - RNA, 13 nt, Mycobacterium tuberculosis H37Rv
guccucgucgucg

SEQ ID NO: 1261078 - RNA, 16 nt, Mycobacterium tuberculosis H37Rv
guccgucgucggcguc

SEQ ID NO: 1261079 - RNA, 17 nt, Mycobacterium tuberculosis H37Rv
guccguacuugccaccc

SEQ ID NO: 1261080 - RNA, 17 nt, Mycobacterium tuberculosis H37Rv
guccgguguggcgcuga

SEQ ID NO: 1261081 - RNA, 18 nt, Mycobacterium tuberculosis H37Rv
guccgguuacgcucgcga

SEQ ID NO: 1261082 - RNA, 17 nt, Mycobacterium tuberculosis H37Rv
guccggucgcggcgguc

SEQ ID NO: 1261083 - RNA, 20 nt, Mycobacterium tuberculosis H37Rv
guccgggcggccucccgggc

SEQ ID NO: 1261084 - RNA, 18 nt, Mycobacterium tuberculosis H37Rv
guccggguagacaugggu

SEQ ID NO: 1261085 - RNA, 17 nt, Mycobacterium tuberculosis H37Rv
guccgggucaccagcgc

SEQ ID NO: 1261086 - RNA, 16 nt, Mycobacterium tuberculosis H37Rv
guccgggucaccagcg

SEQ ID NO: 1261087 - RNA, 14 nt, Mycobacterium tuberculosis H37Rv
guccggcgugggca

SEQ ID NO: 1261088 - RNA, 14 nt, Mycobacterium tuberculosis H37Rv
guccggcgucguga

SEQ ID NO: 1261089 - RNA, 15 nt, Mycobacterium tuberculosis H37Rv
guccggcucauccga

SEQ ID NO: 1261090 - RNA, 17 nt, Mycobacterium tuberculosis H37Rv
guccggcuucggcgaac

SEQ ID NO: 1261091 - RNA, 18 nt, Mycobacterium tuberculosis H37Rv
guccggcuuggcggcgau

SEQ ID NO: 1261092 - RNA, 16 nt, Mycobacterium tuberculosis H37Rv
guccggcacugcggcc

SEQ ID NO: 1261093 - RNA, 21 nt, Mycobacterium tuberculosis H37Rv
guccggcaacaugagcgucgc

SEQ ID NO: 1261094 - RNA, 19 nt, Mycobacterium tuberculosis H37Rv
guccggcccuacgcagcgc

SEQ ID NO: 1261095 - RNA, 20 nt, Mycobacterium tuberculosis H37Rv
guccggcgcccacaucgucg

SEQ ID NO: 1261096 - RNA, 19 nt, Mycobacterium tuberculosis H37Rv
guccggcggacccucgccg

SEQ ID NO: 1261097 - RNA, 15 nt, Mycobacterium tuberculosis H37Rv
guccggcggcaggaa

SEQ ID NO: 1261098 - RNA, 17 nt, Mycobacterium tuberculosis H37Rv
guccggcgccgaggucg

SEQ ID NO: 1261099 - RNA, 17 nt, Mycobacterium tuberculosis H37Rv
guccggcccguagcugc

SEQ ID NO: 1261100 - RNA, 22 nt, Mycobacterium tuberculosis H37Rv
gucccgcgugccacucgaugcu

SEQ ID NO: 1261101 - RNA, 16 nt, Mycobacterium tuberculosis H37Rv
guccgaacacggugaa

SEQ ID NO: 1261102 - RNA, 15 nt, Mycobacterium tuberculosis H37Rv
guccgccgaacaccg

SEQ ID NO: 1261103 - RNA, 19 nt, Mycobacterium tuberculosis H37Rv
guccgaacuugacgaacuc

SEQ ID NO: 1261104 - RNA, 14 nt, Mycobacterium tuberculosis H37Rv
guccgaaccgacgu

SEQ ID NO: 1261105 - RNA, 22 nt, Mycobacterium tuberculosis H37Rv
guccgccauugucgaucuggua

SEQ ID NO: 1261106 - RNA, 16 nt, Mycobacterium tuberculosis H37Rv
guccgccgucgaccac

SEQ ID NO: 1261107 - RNA, 13 nt, Mycobacterium tuberculosis H37Rv
guccgccggcgag

SEQ ID NO: 1261108 - RNA, 15 nt, Mycobacterium tuberculosis H37Rv
guccgcgccgacggc

SEQ ID NO: 1261109 - RNA, 22 nt, Mycobacterium tuberculosis H37Rv
guccgcgccgacggccagcagg

SEQ ID NO: 1261110 - RNA, 17 nt, Mycobacterium tuberculosis H37Rv
guccgcgccgacggcca

SEQ ID NO: 1261111 - RNA, 15 nt, Mycobacterium tuberculosis H37Rv
guccauagccggcau

SEQ ID NO: 1261112 - RNA, 23 nt, Mycobacterium tuberculosis H37Rv
guccaucaaccccagcgcaaccu

SEQ ID NO: 1261113 - RNA, 19 nt, Mycobacterium tuberculosis H37Rv
guccaguccaugugcccag

SEQ ID NO: 1261114 - RNA, 17 nt, Mycobacterium tuberculosis H37Rv
guccccgcccggccagc

SEQ ID NO: 1261115 - RNA, 14 nt, Mycobacterium tuberculosis H37Rv
gucccccgcacgcg

SEQ ID NO: 1261116 - RNA, 16 nt, Mycobacterium tuberculosis H37Rv
guccccguagucguca

SEQ ID NO: 1261117 - RNA, 17 nt, Mycobacterium tuberculosis H37Rv
gucccgccgcgcgucgc

SEQ ID NO: 1261118 - RNA, 14 nt, Mycobacterium tuberculosis H37Rv
gucccgcgagcagc

SEQ ID NO: 1261119 - RNA, 17 nt, Mycobacterium tuberculosis H37Rv
gucccgcggaccgcaac

SEQ ID NO: 1261120 - RNA, 23 nt, Mycobacterium tuberculosis H37Rv
gucccgcuacaccugcggcguca

SEQ ID NO: 1261121 - RNA, 20 nt, Mycobacterium tuberculosis H37Rv
gucagaugguuggaucgcca

SEQ ID NO: 1261122 - RNA, 15 nt, Mycobacterium tuberculosis H37Rv
gucacgucgacggcg

SEQ ID NO: 1261123 - RNA, 16 nt, Mycobacterium tuberculosis H37Rv
gucacguggucggcca

SEQ ID NO: 1261124 - RNA, 16 nt, Mycobacterium tuberculosis H37Rv
gucacgccugccaccg

SEQ ID NO: 1261125 - RNA, 14 nt, Mycobacterium tuberculosis H37Rv
gucacgggguccga

SEQ ID NO: 1261126 - RNA, 18 nt, Mycobacterium tuberculosis H37Rv
gucacggcgugaccacug

SEQ ID NO: 1261127 - RNA, 22 nt, Mycobacterium tuberculosis H37Rv
guccaggcccuggccagcccga

SEQ ID NO: 1261128 - RNA, 16 nt, Mycobacterium tuberculosis H37Rv
gucagcaagaucggca

SEQ ID NO: 1261129 - RNA, 15 nt, Mycobacterium tuberculosis H37Rv
gucgaccgccgagau

SEQ ID NO: 1261130 - RNA, 21 nt, Mycobacterium tuberculosis H37Rv
gucgaccgaacccgacgucgc

SEQ ID NO: 1261131 - RNA, 15 nt, Mycobacterium tuberculosis H37Rv
gucgacccagcgcgc

SEQ ID NO: 1261132 - RNA, 21 nt, Mycobacterium tuberculosis H37Rv
gucgaccaggacgguuggucc

SEQ ID NO: 1261133 - RNA, 15 nt, Mycobacterium tuberculosis H37Rv
gucgaccccggccag

SEQ ID NO: 1261134 - RNA, 14 nt, Mycobacterium tuberculosis H37Rv
gucgacccggccag

SEQ ID NO: 1261135 - RNA, 15 nt, Mycobacterium tuberculosis H37Rv
gucgacaucggugac

SEQ ID NO: 1261136 - RNA, 13 nt, Mycobacterium tuberculosis H37Rv
gucgacaucgaca

SEQ ID NO: 1261137 - RNA, 20 nt, Mycobacterium tuberculosis H37Rv
gucgaccaagguguccagca

SEQ ID NO: 1261138 - RNA, 20 nt, Mycobacterium tuberculosis H37Rv
gucgaccaauaccaguccgu

SEQ ID NO: 1261139 - RNA, 19 nt, Mycobacterium tuberculosis H37Rv
gucgacaaacagcgccauc

SEQ ID NO: 1261140 - RNA, 15 nt, Mycobacterium tuberculosis H37Rv
gucgacacggugauc

SEQ ID NO: 1261141 - RNA, 17 nt, Mycobacterium tuberculosis H37Rv
gucgacaguucaacggg

SEQ ID NO: 1261142 - RNA, 22 nt, Mycobacterium tuberculosis H37Rv
gucgacguuaccgaccgcgugc

SEQ ID NO: 1261143 - RNA, 23 nt, Mycobacterium tuberculosis H37Rv
gucgacguuggcaaagccgaaau

SEQ ID NO: 1261144 - RNA, 17 nt, Mycobacterium tuberculosis H37Rv
gucgacucguggcgcca

SEQ ID NO: 1261145 - RNA, 18 nt, Mycobacterium tuberculosis H37Rv
gucgacuguugucuacuc

SEQ ID NO: 1261146 - RNA, 16 nt, Mycobacterium tuberculosis H37Rv
gucgagaaucggcauu

SEQ ID NO: 1261147 - RNA, 18 nt, Mycobacterium tuberculosis H37Rv
gucgacgccgcagcgucc

SEQ ID NO: 1261148 - RNA, 21 nt, Mycobacterium tuberculosis H37Rv
gucgacgccgagaccgccgcu

SEQ ID NO: 1261149 - RNA, 12 nt, Mycobacterium tuberculosis H37Rv
gucgacgccgac

SEQ ID NO: 1261150 - RNA, 13 nt, Mycobacterium tuberculosis H37Rv
gucgacgaucguc

SEQ ID NO: 1261151 - RNA, 17 nt, Mycobacterium tuberculosis H37Rv
gucgacgacaacgaugu

SEQ ID NO: 1261152 - RNA, 17 nt, Mycobacterium tuberculosis H37Rv
gucgacgacgucgcgca

SEQ ID NO: 1261153 - RNA, 14 nt, Mycobacterium tuberculosis H37Rv
gucgacgacaacga

SEQ ID NO: 1261154 - RNA, 14 nt, Mycobacterium tuberculosis H37Rv
gucgacgaaucugc

SEQ ID NO: 1261155 - RNA, 20 nt, Mycobacterium tuberculosis H37Rv
gucgaccuuauugccgagcu

SEQ ID NO: 1261156 - RNA, 20 nt, Mycobacterium tuberculosis H37Rv
gucgagguccucgagguccu

SEQ ID NO: 1261157 - RNA, 23 nt, Mycobacterium tuberculosis H37Rv
gucgagauccucgucgagguccu

SEQ ID NO: 1261158 - RNA, 16 nt, Mycobacterium tuberculosis H37Rv
gucgagauccucgucg

SEQ ID NO: 1261159 - RNA, 21 nt, Mycobacterium tuberculosis H37Rv
gucgagggcuuuagugucugc

SEQ ID NO: 1261160 - RNA, 19 nt, Mycobacterium tuberculosis H37Rv
gucgauaaccuggcggucc

SEQ ID NO: 1261161 - RNA, 19 nt, Mycobacterium tuberculosis H37Rv
gucgaguuuugcggccagg

SEQ ID NO: 1261162 - RNA, 22 nt, Mycobacterium tuberculosis H37Rv
gucgaucagaacgugacggucc

SEQ ID NO: 1261163 - RNA, 14 nt, Mycobacterium tuberculosis H37Rv
gucgaucacgucgu

SEQ ID NO: 1261164 - RNA, 16 nt, Mycobacterium tuberculosis H37Rv
gucgaucacguggucc

SEQ ID NO: 1261165 - RNA, 22 nt, Mycobacterium tuberculosis H37Rv
gucgauaaugaucucggcaagg

SEQ ID NO: 1261166 - RNA, 18 nt, Mycobacterium tuberculosis H37Rv
gucgagucgccgaggacg

SEQ ID NO: 1261167 - RNA, 22 nt, Mycobacterium tuberculosis H37Rv
gucgaguagccguagccgccgu

SEQ ID NO: 1261168 - RNA, 19 nt, Mycobacterium tuberculosis H37Rv
gucgaguccaggccggcag

SEQ ID NO: 1261169 - RNA, 17 nt, Mycobacterium tuberculosis H37Rv
gucgagugccucgaccu

SEQ ID NO: 1261170 - RNA, 15 nt, Mycobacterium tuberculosis H37Rv
gucgccaacgccagc

SEQ ID NO: 1261171 - RNA, 17 nt, Mycobacterium tuberculosis H37Rv
gucgccaaucgaguagc

SEQ ID NO: 1261172 - RNA, 13 nt, Mycobacterium tuberculosis H37Rv
gucgccaccaucg

SEQ ID NO: 1261173 - RNA, 18 nt, Mycobacterium tuberculosis H37Rv
gucgaugucgucgacauc

SEQ ID NO: 1261174 - RNA, 22 nt, Mycobacterium tuberculosis H37Rv
gucgcauacgcccacuccagca

SEQ ID NO: 1261175 - RNA, 17 nt, Mycobacterium tuberculosis H37Rv
gucgaugucgacgucgc

SEQ ID NO: 1261176 - RNA, 17 nt, Mycobacterium tuberculosis H37Rv
gucgauggucuccggac

SEQ ID NO: 1261177 - RNA, 20 nt, Mycobacterium tuberculosis H37Rv
gucgaugcgcugcucacgca

SEQ ID NO: 1261178 - RNA, 14 nt, Mycobacterium tuberculosis H37Rv
gucgaucaggccgu

SEQ ID NO: 1261179 - RNA, 13 nt, Mycobacterium tuberculosis H37Rv
gucgaucagcgcg

SEQ ID NO: 1261180 - RNA, 21 nt, Mycobacterium tuberculosis H37Rv
gucgccaccaucguugccggu

SEQ ID NO: 1261181 - RNA, 22 nt, Mycobacterium tuberculosis H37Rv
gucgccaccgccggcagcaucg

SEQ ID NO: 1261182 - RNA, 24 nt, Mycobacterium tuberculosis H37Rv
gucgcccgugucguaccagccaug

SEQ ID NO: 1261183 - RNA, 20 nt, Mycobacterium tuberculosis H37Rv
gucgcccgugucguaccagc

SEQ ID NO: 1261184 - RNA, 20 nt, Mycobacterium tuberculosis H37Rv
gucgccgaaagggucgacgu

SEQ ID NO: 1261185 - RNA, 17 nt, Mycobacterium tuberculosis H37Rv
gucgcccuuagggucgc

SEQ ID NO: 1261186 - RNA, 16 nt, Mycobacterium tuberculosis H37Rv
gucgccgaacagcgac

SEQ ID NO: 1261187 - RNA, 16 nt, Mycobacterium tuberculosis H37Rv
gucgccgcaucggcgg

SEQ ID NO: 1261188 - RNA, 20 nt, Mycobacterium tuberculosis H37Rv
gucgcccuguucggcccgag

SEQ ID NO: 1261189 - RNA, 20 nt, Mycobacterium tuberculosis H37Rv
gucgccgccgcuaccgccgg

SEQ ID NO: 1261190 - RNA, 16 nt, Mycobacterium tuberculosis H37Rv
gucgccgcccacauga

SEQ ID NO: 1261191 - RNA, 21 nt, Mycobacterium tuberculosis H37Rv
gucgcgauccacuccggcgau

SEQ ID NO: 1261192 - RNA, 23 nt, Mycobacterium tuberculosis H37Rv
gucgccugacgaaguccaccacg

SEQ ID NO: 1261193 - RNA, 21 nt, Mycobacterium tuberculosis H37Rv
gucgccuucguaaccacgacg

SEQ ID NO: 1261194 - RNA, 21 nt, Mycobacterium tuberculosis H37Rv
gucgccggcgucgagccggau

SEQ ID NO: 1261195 - RNA, 22 nt, Mycobacterium tuberculosis H37Rv
gucgccugcccccgcgcgcacg

SEQ ID NO: 1261196 - RNA, 14 nt, Mycobacterium tuberculosis H37Rv
gucgccgccgcgac

SEQ ID NO: 1261197 - RNA, 18 nt, Mycobacterium tuberculosis H37Rv
gucgccgcccgugccgcc

SEQ ID NO: 1261198 - RNA, 13 nt, Mycobacterium tuberculosis H37Rv
gucgccgcccgug

SEQ ID NO: 1261199 - RNA, 18 nt, Mycobacterium tuberculosis H37Rv
gucgcggguccaggcguu

SEQ ID NO: 1261200 - RNA, 13 nt, Mycobacterium tuberculosis H37Rv
gucgcgggugccg

SEQ ID NO: 1261201 - RNA, 18 nt, Mycobacterium tuberculosis H37Rv
gucgcgggccaccaccga

SEQ ID NO: 1261202 - RNA, 13 nt, Mycobacterium tuberculosis H37Rv
gucgcgggccaag

SEQ ID NO: 1261203 - RNA, 16 nt, Mycobacterium tuberculosis H37Rv
gucgcgcggcaccgau

SEQ ID NO: 1261204 - RNA, 15 nt, Mycobacterium tuberculosis H37Rv
gucgcggcguucggc

SEQ ID NO: 1261205 - RNA, 13 nt, Mycobacterium tuberculosis H37Rv
gucgcggcggucc

SEQ ID NO: 1261206 - RNA, 22 nt, Mycobacterium tuberculosis H37Rv
gucgcgcgccaagacgaacagc

SEQ ID NO: 1261207 - RNA, 17 nt, Mycobacterium tuberculosis H37Rv
gucgcguuguggcugaa

SEQ ID NO: 1261208 - RNA, 18 nt, Mycobacterium tuberculosis H37Rv
gucgcguuguggcugaau

SEQ ID NO: 1261209 - RNA, 21 nt, Mycobacterium tuberculosis H37Rv
gucgcgguaggcguuggacgc

SEQ ID NO: 1261210 - RNA, 15 nt, Mycobacterium tuberculosis H37Rv
gucgcguucggccga

SEQ ID NO: 1261211 - RNA, 21 nt, Mycobacterium tuberculosis H37Rv
gucgcucacggcccgagccgc

SEQ ID NO: 1261212 - RNA, 17 nt, Mycobacterium tuberculosis H37Rv
gucgcucgacgaccacg

SEQ ID NO: 1261213 - RNA, 16 nt, Mycobacterium tuberculosis H37Rv
gucgcugggugcgcga

SEQ ID NO: 1261214 - RNA, 15 nt, Mycobacterium tuberculosis H37Rv
gucggagaacgcccg

SEQ ID NO: 1261215 - RNA, 18 nt, Mycobacterium tuberculosis H37Rv
gucggagagcaugcggga

SEQ ID NO: 1261216 - RNA, 20 nt, Mycobacterium tuberculosis H37Rv
gucgcugcugaacaaccagc

SEQ ID NO: 1261217 - RNA, 16 nt, Mycobacterium tuberculosis H37Rv
gucgcugcugccgcac

SEQ ID NO: 1261218 - RNA, 19 nt, Mycobacterium tuberculosis H37Rv
gucgcugcugccgcaccgg

SEQ ID NO: 1261219 - RNA, 21 nt, Mycobacterium tuberculosis H37Rv
gucgcugcggcgcuggccagc

SEQ ID NO: 1261220 - RNA, 22 nt, Mycobacterium tuberculosis H37Rv
cggugaugacguagucgucuuc

SEQ ID NO: 1261221 - RNA, 20 nt, Mycobacterium tuberculosis H37Rv
cggugauggugaccagcagg

SEQ ID NO: 1261222 - RNA, 23 nt, Mycobacterium tuberculosis H37Rv
cggugauggccgaccagccgauc

SEQ ID NO: 1261223 - RNA, 19 nt, Mycobacterium tuberculosis H37Rv
cggugaugcccagcgccga

SEQ ID NO: 1261224 - RNA, 18 nt, Mycobacterium tuberculosis H37Rv
cggugaugcccagcgccg

SEQ ID NO: 1261225 - RNA, 21 nt, Mycobacterium tuberculosis H37Rv
cggugaugaucgcgccgggcu

SEQ ID NO: 1261226 - RNA, 16 nt, Mycobacterium tuberculosis H37Rv
cggugaucaccaugau

SEQ ID NO: 1261227 - RNA, 21 nt, Mycobacterium tuberculosis H37Rv
cggugaucagguaagcgaacg

SEQ ID NO: 1261228 - RNA, 20 nt, Mycobacterium tuberculosis H37Rv
cggugauccaacuggccgcg

SEQ ID NO: 1261229 - RNA, 16 nt, Mycobacterium tuberculosis H37Rv
cggugaggucgguguu

SEQ ID NO: 1261230 - RNA, 17 nt, Mycobacterium tuberculosis H37Rv
cggugaggaagcggccg

SEQ ID NO: 1261231 - RNA, 19 nt, Mycobacterium tuberculosis H37Rv
cggugagcugcacgccgau

SEQ ID NO: 1261232 - RNA, 21 nt, Mycobacterium tuberculosis H37Rv
cggugagcugcacgccgauac

SEQ ID NO: 1261233 - RNA, 23 nt, Mycobacterium tuberculosis H37Rv
cggugagggguugcggucgacgu

SEQ ID NO: 1261234 - RNA, 13 nt, Mycobacterium tuberculosis H37Rv
cggugaggcagcg

SEQ ID NO: 1261235 - RNA, 19 nt, Mycobacterium tuberculosis H37Rv
cggugacgggguugaccgc

SEQ ID NO: 1261236 - RNA, 13 nt, Mycobacterium tuberculosis H37Rv
cggugacgguguu

SEQ ID NO: 1261237 - RNA, 17 nt, Mycobacterium tuberculosis H37Rv
cggugagaagaagccca

SEQ ID NO: 1261238 - RNA, 15 nt, Mycobacterium tuberculosis H37Rv
cggugagaucggguu

SEQ ID NO: 1261239 - RNA, 15 nt, Mycobacterium tuberculosis H37Rv
cggugacgucgccgg

SEQ ID NO: 1261240 - RNA, 13 nt, Mycobacterium tuberculosis H37Rv
cggugagcgggca

SEQ ID NO: 1261241 - RNA, 13 nt, Mycobacterium tuberculosis H37Rv
cggugagcgagcg

SEQ ID NO: 1261242 - RNA, 22 nt, Mycobacterium tuberculosis H37Rv
cggugagccgccaggaccggga

SEQ ID NO: 1261243 - RNA, 21 nt, Mycobacterium tuberculosis H37Rv
cggugagcccguugaccugcg

SEQ ID NO: 1261244 - RNA, 17 nt, Mycobacterium tuberculosis H37Rv
cggugacgaugaccgcg

SEQ ID NO: 1261245 - RNA, 22 nt, Mycobacterium tuberculosis H37Rv
cggugacggcggcugucggccg

SEQ ID NO: 1261246 - RNA, 20 nt, Mycobacterium tuberculosis H37Rv
cggugacgggaucgucggca

SEQ ID NO: 1261247 - RNA, 18 nt, Mycobacterium tuberculosis H37Rv
cggugacgagcacaugcu

SEQ ID NO: 1261248 - RNA, 15 nt, Mycobacterium tuberculosis H37Rv
cggugacgaccauac

SEQ ID NO: 1261249 - RNA, 22 nt, Mycobacterium tuberculosis H37Rv
cggugaccuucgcuauggcggc

SEQ ID NO: 1261250 - RNA, 23 nt, Mycobacterium tuberculosis H37Rv
cggugaccuucgcuauggcggcu

SEQ ID NO: 1261251 - RNA, 18 nt, Mycobacterium tuberculosis H37Rv
cggugacgauugccacca

SEQ ID NO: 1261252 - RNA, 21 nt, Mycobacterium tuberculosis H37Rv
cggugacgcaacaucggauga

SEQ ID NO: 1261253 - RNA, 13 nt, Mycobacterium tuberculosis H37Rv
cggugccgcccga

SEQ ID NO: 1261254 - RNA, 17 nt, Mycobacterium tuberculosis H37Rv
cggugccgccaucgccg

SEQ ID NO: 1261255 - RNA, 14 nt, Mycobacterium tuberculosis H37Rv
cggugccgccgggu

SEQ ID NO: 1261256 - RNA, 22 nt, Mycobacterium tuberculosis H37Rv
cggugccgccgggugcaacggc

SEQ ID NO: 1261257 - RNA, 21 nt, Mycobacterium tuberculosis H37Rv
cggugccgccgauaccgccgg

SEQ ID NO: 1261258 - RNA, 14 nt, Mycobacterium tuberculosis H37Rv
cggugccgccgucg

SEQ ID NO: 1261259 - RNA, 20 nt, Mycobacterium tuberculosis H37Rv
cggugccgccuccgccugcc

SEQ ID NO: 1261260 - RNA, 15 nt, Mycobacterium tuberculosis H37Rv
cggugccgcgguagg

SEQ ID NO: 1261261 - RNA, 17 nt, Mycobacterium tuberculosis H37Rv
cggugccgagaucccag

SEQ ID NO: 1261262 - RNA, 14 nt, Mycobacterium tuberculosis H37Rv
cggugccgagcacu

SEQ ID NO: 1261263 - RNA, 13 nt, Mycobacterium tuberculosis H37Rv
cggugccgacggu

SEQ ID NO: 1261264 - RNA, 21 nt, Mycobacterium tuberculosis H37Rv
cggugcccugccggcagcggc

SEQ ID NO: 1261265 - RNA, 23 nt, Mycobacterium tuberculosis H37Rv
cggugccgaacgaggaaccgucg

SEQ ID NO: 1261266 - RNA, 18 nt, Mycobacterium tuberculosis H37Rv
cggugccgaagcugccca

SEQ ID NO: 1261267 - RNA, 19 nt, Mycobacterium tuberculosis H37Rv
cggugcccugccggcagcg

SEQ ID NO: 1261268 - RNA, 20 nt, Mycobacterium tuberculosis H37Rv
cggugcccgcaccacaccgu

SEQ ID NO: 1261269 - RNA, 16 nt, Mycobacterium tuberculosis H37Rv
cggugcccugccggca

SEQ ID NO: 1261270 - RNA, 12 nt, Mycobacterium tuberculosis H37Rv
cggugccaccga

SEQ ID NO: 1261271 - RNA, 14 nt, Mycobacterium tuberculosis H37Rv
cggugccaccggcu

SEQ ID NO: 1261272 - RNA, 13 nt, Mycobacterium tuberculosis H37Rv
cggugccagcagg

SEQ ID NO: 1261273 - RNA, 16 nt, Mycobacterium tuberculosis H37Rv
cggugcccgcaccaca

SEQ ID NO: 1261274 - RNA, 15 nt, Mycobacterium tuberculosis H37Rv
cggugcccagggcga

SEQ ID NO: 1261275 - RNA, 18 nt, Mycobacterium tuberculosis H37Rv
cggugcccgcggugacga

SEQ ID NO: 1261276 - RNA, 20 nt, Mycobacterium tuberculosis H37Rv
cggugcccgggcgucaagcc

SEQ ID NO: 1261277 - RNA, 20 nt, Mycobacterium tuberculosis H37Rv
cggugcaggaccagaacucg

SEQ ID NO: 1261278 - RNA, 21 nt, Mycobacterium tuberculosis H37Rv
cggugcauauuggaucgucgg

SEQ ID NO: 1261279 - RNA, 19 nt, Mycobacterium tuberculosis H37Rv
cggugcagcccgccgcuga

SEQ ID NO: 1261280 - RNA, 16 nt, Mycobacterium tuberculosis H37Rv
cggugcagaucggcuc

SEQ ID NO: 1261281 - RNA, 22 nt, Mycobacterium tuberculosis H37Rv
cggugcagcagggcgcgcaucu

SEQ ID NO: 1261282 - RNA, 22 nt, Mycobacterium tuberculosis H37Rv
cggugccaccacgcuccccagc

SEQ ID NO: 1261283 - RNA, 21 nt, Mycobacterium tuberculosis H37Rv
cggugccaccagugagcccgc

SEQ ID NO: 1261284 - RNA, 22 nt, Mycobacterium tuberculosis H37Rv
cggugccacccuugccgccggu

SEQ ID NO: 1261285 - RNA, 20 nt, Mycobacterium tuberculosis H37Rv
cggugcacaaaauacuccgc

SEQ ID NO: 1261286 - RNA, 17 nt, Mycobacterium tuberculosis H37Rv
cggugauuccagccgga

SEQ ID NO: 1261287 - RNA, 21 nt, Mycobacterium tuberculosis H37Rv
cggugauguccgcacaacgau

SEQ ID NO: 1261288 - RNA, 20 nt, Mycobacterium tuberculosis H37Rv
cggugauguagggcugcucc

SEQ ID NO: 1261289 - RNA, 21 nt, Mycobacterium tuberculosis H37Rv
cggugaugguuucggcgggaa

SEQ ID NO: 1261290 - RNA, 12 nt, Mycobacterium tuberculosis H37Rv
cggugcaccagg

SEQ ID NO: 1261291 - RNA, 13 nt, Mycobacterium tuberculosis H37Rv
cggugcacaccgu

SEQ ID NO: 1261292 - RNA, 15 nt, Mycobacterium tuberculosis H37Rv
cggugcacaccgucg

SEQ ID NO: 1261293 - RNA, 23 nt, Mycobacterium tuberculosis H37Rv
cggugcgacgauccagggucacc

SEQ ID NO: 1261294 - RNA, 13 nt, Mycobacterium tuberculosis H37Rv
cggugcgaucagg

SEQ ID NO: 1261295 - RNA, 20 nt, Mycobacterium tuberculosis H37Rv
cggugcgaucccacccucgg

SEQ ID NO: 1261296 - RNA, 15 nt, Mycobacterium tuberculosis H37Rv
cggugcgauaccgac

SEQ ID NO: 1261297 - RNA, 17 nt, Mycobacterium tuberculosis H37Rv
cggugcgauaccgacac

SEQ ID NO: 1261298 - RNA, 20 nt, Mycobacterium tuberculosis H37Rv
cggugccgucgaguccaggc

SEQ ID NO: 1261299 - RNA, 18 nt, Mycobacterium tuberculosis H37Rv
cggugccggcacccgagu

SEQ ID NO: 1261300 - RNA, 18 nt, Mycobacterium tuberculosis H37Rv
cggugccggaaacgccag

SEQ ID NO: 1261301 - RNA, 14 nt, Mycobacterium tuberculosis H37Rv
cggugccggcggug

SEQ ID NO: 1261302 - RNA, 17 nt, Mycobacterium tuberculosis H37Rv
cggugccgggcaccacc

SEQ ID NO: 1261303 - RNA, 14 nt, Mycobacterium tuberculosis H37Rv
cggugccggcguug

SEQ ID NO: 1261304 - RNA, 14 nt, Mycobacterium tuberculosis H37Rv
cggugccggcguag

SEQ ID NO: 1261305 - RNA, 21 nt, Mycobacterium tuberculosis H37Rv
cggugcgccagaucaccgucg

SEQ ID NO: 1261306 - RNA, 15 nt, Mycobacterium tuberculosis H37Rv
cggugcgcagcugcg

SEQ ID NO: 1261307 - RNA, 23 nt, Mycobacterium tuberculosis H37Rv
cggugcgauccugaccagccagg

SEQ ID NO: 1261308 - RNA, 20 nt, Mycobacterium tuberculosis H37Rv
cggugcgauuccgcgucugc

SEQ ID NO: 1261309 - RNA, 16 nt, Mycobacterium tuberculosis H37Rv
cggugcgcuggcggcg

SEQ ID NO: 1261310 - RNA, 15 nt, Mycobacterium tuberculosis H37Rv
cggugcgcgugacga

SEQ ID NO: 1261311 - RNA, 18 nt, Mycobacterium tuberculosis H37Rv
cggugcgcgcggcgacca

SEQ ID NO: 1261312 - RNA, 13 nt, Mycobacterium tuberculosis H37Rv
cggugcgcgcuga

SEQ ID NO: 1261313 - RNA, 20 nt, Mycobacterium tuberculosis H37Rv
cggugcugaccccgccggcu

SEQ ID NO: 1261314 - RNA, 15 nt, Mycobacterium tuberculosis H37Rv
cggugcugcgccgau

SEQ ID NO: 1261315 - RNA, 17 nt, Mycobacterium tuberculosis H37Rv
cggugcugcgccgauac

SEQ ID NO: 1261316 - RNA, 17 nt, Mycobacterium tuberculosis H37Rv
cggugcugcuucaacgc

SEQ ID NO: 1261317 - RNA, 16 nt, Mycobacterium tuberculosis H37Rv
cggugcucgucgagca

SEQ ID NO: 1261318 - RNA, 13 nt, Mycobacterium tuberculosis H37Rv
cggugcugacgac

SEQ ID NO: 1261319 - RNA, 19 nt, Mycobacterium tuberculosis H37Rv
cggugcgguuucaccgacg

SEQ ID NO: 1261320 - RNA, 16 nt, Mycobacterium tuberculosis H37Rv
cggugcuaccggcuug

SEQ ID NO: 1261321 - RNA, 13 nt, Mycobacterium tuberculosis H37Rv
cggugcuccucgg

SEQ ID NO: 1261322 - RNA, 23 nt, Mycobacterium tuberculosis H37Rv
cggugcgguuucaccgacgacgc

SEQ ID NO: 1261323 - RNA, 21 nt, Mycobacterium tuberculosis H37Rv
cggugcggccaaugacgucgg

SEQ ID NO: 1261324 - RNA, 19 nt, Mycobacterium tuberculosis H37Rv
cggugcggcaacagcgcca

SEQ ID NO: 1261325 - RNA, 18 nt, Mycobacterium tuberculosis H37Rv
cggugcggcagauacucg

SEQ ID NO: 1261326 - RNA, 19 nt, Mycobacterium tuberculosis H37Rv
cggugggcggcgagcgcga

SEQ ID NO: 1261327 - RNA, 20 nt, Mycobacterium tuberculosis H37Rv
cgguggcuuuugcgucugcu

SEQ ID NO: 1261328 - RNA, 12 nt, Mycobacterium tuberculosis H37Rv
cgguggcuacgc

SEQ ID NO: 1261329 - RNA, 19 nt, Mycobacterium tuberculosis H37Rv
cgguggcgccgccgccaau

SEQ ID NO: 1261330 - RNA, 21 nt, Mycobacterium tuberculosis H37Rv
cgguggcgccggggccgccga

SEQ ID NO: 1261331 - RNA, 13 nt, Mycobacterium tuberculosis H37Rv
cgguggcgcugau

SEQ ID NO: 1261332 - RNA, 18 nt, Mycobacterium tuberculosis H37Rv
cgguggcggacggcguuu

SEQ ID NO: 1261333 - RNA, 20 nt, Mycobacterium tuberculosis H37Rv
cgguggccgcacgauagccg

SEQ ID NO: 1261334 - RNA, 20 nt, Mycobacterium tuberculosis H37Rv
cggugcuguugucgaacaac

SEQ ID NO: 1261335 - RNA, 16 nt, Mycobacterium tuberculosis H37Rv
cggugcugguccaggc

SEQ ID NO: 1261336 - RNA, 20 nt, Mycobacterium tuberculosis H37Rv
cgguggacgcagagucaaca

SEQ ID NO: 1261337 - RNA, 17 nt, Mycobacterium tuberculosis H37Rv
cgguggacgauacgcgc

SEQ ID NO: 1261338 - RNA, 19 nt, Mycobacterium tuberculosis H37Rv
cgguggacgcagagucaac

SEQ ID NO: 1261339 - RNA, 13 nt, Mycobacterium tuberculosis H37Rv
cgguggacgagcc

SEQ ID NO: 1261340 - RNA, 14 nt, Mycobacterium tuberculosis H37Rv
cgguggccagaucg

SEQ ID NO: 1261341 - RNA, 13 nt, Mycobacterium tuberculosis H37Rv
cgguggccccgau

SEQ ID NO: 1261342 - RNA, 17 nt, Mycobacterium tuberculosis H37Rv
cgguggccccgauggcg

SEQ ID NO: 1261343 - RNA, 20 nt, Mycobacterium tuberculosis H37Rv
cgguggccgacaagucaaga

SEQ ID NO: 1261344 - RNA, 20 nt, Mycobacterium tuberculosis H37Rv
cgguggcagagccgccguug

SEQ ID NO: 1261345 - RNA, 17 nt, Mycobacterium tuberculosis H37Rv
cgguggcagagccgccg

SEQ ID NO: 1261346 - RNA, 18 nt, Mycobacterium tuberculosis H37Rv
cgguggcacccgcgucga

SEQ ID NO: 1261347 - RNA, 21 nt, Mycobacterium tuberculosis H37Rv
cgguggcauccuugccaaucg

SEQ ID NO: 1261348 - RNA, 17 nt, Mycobacterium tuberculosis H37Rv
cgguggccaacaccgcc

SEQ ID NO: 1261349 - RNA, 17 nt, Mycobacterium tuberculosis H37Rv
cgguggcagccugcugc

SEQ ID NO: 1261350 - RNA, 21 nt, Mycobacterium tuberculosis H37Rv
cgguucuguuccagaaggccg

SEQ ID NO: 1261351 - RNA, 15 nt, Mycobacterium tuberculosis H37Rv
cgguucuuccugguc

SEQ ID NO: 1261352 - RNA, 12 nt, Mycobacterium tuberculosis H37Rv
cgguugacccuc

SEQ ID NO: 1261353 - RNA, 19 nt, Mycobacterium tuberculosis H37Rv
cgguucggcgaucuccggc

SEQ ID NO: 1261354 - RNA, 15 nt, Mycobacterium tuberculosis H37Rv
cgguucgaacgcgau

SEQ ID NO: 1261355 - RNA, 19 nt, Mycobacterium tuberculosis H37Rv
cgguucgacccccgcaucg

SEQ ID NO: 1261356 - RNA, 15 nt, Mycobacterium tuberculosis H37Rv
cgguugaccggucga

SEQ ID NO: 1261357 - RNA, 21 nt, Mycobacterium tuberculosis H37Rv
cgguuuggccgaacagcaggc

SEQ ID NO: 1261358 - RNA, 17 nt, Mycobacterium tuberculosis H37Rv
cgguuuggaucacccgc

SEQ ID NO: 1261359 - RNA, 19 nt, Mycobacterium tuberculosis H37Rv
cgguuugcguccugguggc

SEQ ID NO: 1261360 - RNA, 23 nt, Mycobacterium tuberculosis H37Rv
cgguuugccagugauggcgcggu

SEQ ID NO: 1261361 - RNA, 18 nt, Mycobacterium tuberculosis H37Rv
cgguuugcacgcaccaca

SEQ ID NO: 1261362 - RNA, 16 nt, Mycobacterium tuberculosis H37Rv
cgguuucuucggccag

SEQ ID NO: 1261363 - RNA, 15 nt, Mycobacterium tuberculosis H37Rv
cgguuucgaccugcg

SEQ ID NO: 1261364 - RNA, 22 nt, Mycobacterium tuberculosis H37Rv
cgguuuuggucgcgaugacgau

SEQ ID NO: 1261365 - RNA, 22 nt, Mycobacterium tuberculosis H37Rv
cguaaaccgauaucgcugcgga

SEQ ID NO: 1261366 - RNA, 21 nt, Mycobacterium tuberculosis H37Rv
cguaaucaauaaucacaucgg

SEQ ID NO: 1261367 - RNA, 21 nt, Mycobacterium tuberculosis H37Rv
cguacaacagcgcgcgcucgg

SEQ ID NO: 1261368 - RNA, 18 nt, Mycobacterium tuberculosis H37Rv
cguaauuccccaggugug

SEQ ID NO: 1261369 - RNA, 16 nt, Mycobacterium tuberculosis H37Rv
cguacaggccggccac

SEQ ID NO: 1261370 - RNA, 15 nt, Mycobacterium tuberculosis H37Rv
cguacacgccauggu

SEQ ID NO: 1261371 - RNA, 16 nt, Mycobacterium tuberculosis H37Rv
cgguuccggccccguc

SEQ ID NO: 1261372 - RNA, 17 nt, Mycobacterium tuberculosis H37Rv
cgguuccgccggcccca

SEQ ID NO: 1261373 - RNA, 20 nt, Mycobacterium tuberculosis H37Rv
cgguuccggcuucguccacc

SEQ ID NO: 1261374 - RNA, 14 nt, Mycobacterium tuberculosis H37Rv
cgguuccucagcgg

SEQ ID NO: 1261375 - RNA, 15 nt, Mycobacterium tuberculosis H37Rv
cgguuccgauagccg

SEQ ID NO: 1261376 - RNA, 14 nt, Mycobacterium tuberculosis H37Rv
cgguuacccggacc

SEQ ID NO: 1261377 - RNA, 13 nt, Mycobacterium tuberculosis H37Rv
cgguuaaggugcg

SEQ ID NO: 1261378 - RNA, 17 nt, Mycobacterium tuberculosis H37Rv
cgguguuuggccgccga

SEQ ID NO: 1261379 - RNA, 16 nt, Mycobacterium tuberculosis H37Rv
cggugugcuugcucgg

SEQ ID NO: 1261380 - RNA, 23 nt, Mycobacterium tuberculosis H37Rv
cgguguggacuucagcaggccca

SEQ ID NO: 1261381 - RNA, 14 nt, Mycobacterium tuberculosis H37Rv
cggugucgacgggg

SEQ ID NO: 1261382 - RNA, 16 nt, Mycobacterium tuberculosis H37Rv
cggugucaugaacgac

SEQ ID NO: 1261383 - RNA, 15 nt, Mycobacterium tuberculosis H37Rv
cggugucagccgucg

SEQ ID NO: 1261384 - RNA, 21 nt, Mycobacterium tuberculosis H37Rv
cggugucagccgucgccacca

SEQ ID NO: 1261385 - RNA, 12 nt, Mycobacterium tuberculosis H37Rv
cgguguccagcc

SEQ ID NO: 1261386 - RNA, 20 nt, Mycobacterium tuberculosis H37Rv
cggugguuagguggcuggcu

SEQ ID NO: 1261387 - RNA, 14 nt, Mycobacterium tuberculosis H37Rv
cgguggugucagcc

SEQ ID NO: 1261388 - RNA, 15 nt, Mycobacterium tuberculosis H37Rv
cgguggucccgaugg

SEQ ID NO: 1261389 - RNA, 15 nt, Mycobacterium tuberculosis H37Rv
cgguggucacgccgu

SEQ ID NO: 1261390 - RNA, 20 nt, Mycobacterium tuberculosis H37Rv
cgguggucaggaacacucgc

SEQ ID NO: 1261391 - RNA, 19 nt, Mycobacterium tuberculosis H37Rv
cgguggucagguuggcacg

SEQ ID NO: 1261392 - RNA, 14 nt, Mycobacterium tuberculosis H37Rv
cggugguccacacg

SEQ ID NO: 1261393 - RNA, 18 nt, Mycobacterium tuberculosis H37Rv
cggugguguagcuucgau

SEQ ID NO: 1261394 - RNA, 17 nt, Mycobacterium tuberculosis H37Rv
cggugguagcgacgaug

SEQ ID NO: 1261395 - RNA, 20 nt, Mycobacterium tuberculosis H37Rv
cggugguaauacgucccgag

SEQ ID NO: 1261396 - RNA, 13 nt, Mycobacterium tuberculosis H37Rv
cggugggugacgu

SEQ ID NO: 1261397 - RNA, 17 nt, Mycobacterium tuberculosis H37Rv
cggugguaagacgccga

SEQ ID NO: 1261398 - RNA, 21 nt, Mycobacterium tuberculosis H37Rv
cggugggucugcucagcgcgg

SEQ ID NO: 1261399 - RNA, 21 nt, Mycobacterium tuberculosis H37Rv
cggugggcuugccgcgcacca

SEQ ID NO: 1261400 - RNA, 18 nt, Mycobacterium tuberculosis H37Rv
cgguggggacccgcucca

SEQ ID NO: 1261401 - RNA, 15 nt, Mycobacterium tuberculosis H37Rv
cgguggggucgacgc

SEQ ID NO: 1261402 - RNA, 16 nt, Mycobacterium tuberculosis H37Rv
cgguggggucgacgca

SEQ ID NO: 1261403 - RNA, 15 nt, Mycobacterium tuberculosis H37Rv
cguagccgcugcacg

SEQ ID NO: 1261404 - RNA, 14 nt, Mycobacterium tuberculosis H37Rv
cguaggcgaugagc

SEQ ID NO: 1261405 - RNA, 17 nt, Mycobacterium tuberculosis H37Rv
cguaggcgaucucacgc

SEQ ID NO: 1261406 - RNA, 23 nt, Mycobacterium tuberculosis H37Rv
cguaggcgauggcggcgcguucg

SEQ ID NO: 1261407 - RNA, 14 nt, Mycobacterium tuberculosis H37Rv
cguaggcgccgaac

SEQ ID NO: 1261408 - RNA, 20 nt, Mycobacterium tuberculosis H37Rv
cguagucaaccaagcgugcc

SEQ ID NO: 1261409 - RNA, 15 nt, Mycobacterium tuberculosis H37Rv
cguagucgcugucgg

SEQ ID NO: 1261410 - RNA, 17 nt, Mycobacterium tuberculosis H37Rv
cguagucgcugucggca

SEQ ID NO: 1261411 - RNA, 20 nt, Mycobacterium tuberculosis H37Rv
cguaguccaggccgucguug

SEQ ID NO: 1261412 - RNA, 16 nt, Mycobacterium tuberculosis H37Rv
cguagucccacugcca

SEQ ID NO: 1261413 - RNA, 21 nt, Mycobacterium tuberculosis H37Rv
cguagucggcgaugcgcacca

SEQ ID NO: 1261414 - RNA, 16 nt, Mycobacterium tuberculosis H37Rv
cguacagugucugcca

SEQ ID NO: 1261415 - RNA, 15 nt, Mycobacterium tuberculosis H37Rv
cguacaucagcgcga

SEQ ID NO: 1261416 - RNA, 14 nt, Mycobacterium tuberculosis H37Rv
cguagacaccuucg

SEQ ID NO: 1261417 - RNA, 20 nt, Mycobacterium tuberculosis H37Rv
cguagaccaggcccagguca

SEQ ID NO: 1261418 - RNA, 16 nt, Mycobacterium tuberculosis H37Rv
cguagccagcagcggc

SEQ ID NO: 1261419 - RNA, 18 nt, Mycobacterium tuberculosis H37Rv
cguagcccaggucgaugc

SEQ ID NO: 1261420 - RNA, 17 nt, Mycobacterium tuberculosis H37Rv
cguagcaacccaggauu

SEQ ID NO: 1261421 - RNA, 16 nt, Mycobacterium tuberculosis H37Rv
cguagcacaccggugg

SEQ ID NO: 1261422 - RNA, 22 nt, Mycobacterium tuberculosis H37Rv
cguagaccuucgaguagggcca

SEQ ID NO: 1261423 - RNA, 13 nt, Mycobacterium tuberculosis H37Rv
cgucacgucgacg

SEQ ID NO: 1261424 - RNA, 19 nt, Mycobacterium tuberculosis H37Rv
cgucacguaauuccccagg

SEQ ID NO: 1261425 - RNA, 14 nt, Mycobacterium tuberculosis H37Rv
cgucaccgccguug

SEQ ID NO: 1261426 - RNA, 17 nt, Mycobacterium tuberculosis H37Rv
cgucaccgccguugccg

SEQ ID NO: 1261427 - RNA, 12 nt, Mycobacterium tuberculosis H37Rv
cgucaccgcgcg

SEQ ID NO: 1261428 - RNA, 18 nt, Mycobacterium tuberculosis H37Rv
cgucacguggucggccac

SEQ ID NO: 1261429 - RNA, 14 nt, Mycobacterium tuberculosis H37Rv
cgucagaacaccgg

SEQ ID NO: 1261430 - RNA, 14 nt, Mycobacterium tuberculosis H37Rv
cgucacugaugggc

SEQ ID NO: 1261431 - RNA, 13 nt, Mycobacterium tuberculosis H37Rv
cgucagcgucuga

SEQ ID NO: 1261432 - RNA, 14 nt, Mycobacterium tuberculosis H37Rv
cgucagcucaccac

SEQ ID NO: 1261433 - RNA, 14 nt, Mycobacterium tuberculosis H37Rv
cgucagcgccgcug

SEQ ID NO: 1261434 - RNA, 23 nt, Mycobacterium tuberculosis H37Rv
cgucagcgccgccggaagcgccg

SEQ ID NO: 1261435 - RNA, 19 nt, Mycobacterium tuberculosis H37Rv
cgucagcggcggccacggc

SEQ ID NO: 1261436 - RNA, 22 nt, Mycobacterium tuberculosis H37Rv
cguauagccacucgaucaccgg

SEQ ID NO: 1261437 - RNA, 20 nt, Mycobacterium tuberculosis H37Rv
cguauccacggucgaccagg

SEQ ID NO: 1261438 - RNA, 23 nt, Mycobacterium tuberculosis H37Rv
cguaucacgguugccgcgaucgg

SEQ ID NO: 1261439 - RNA, 19 nt, Mycobacterium tuberculosis H37Rv
cgucaagucugugcucacg

SEQ ID NO: 1261440 - RNA, 16 nt, Mycobacterium tuberculosis H37Rv
cgucacaagcugacac

SEQ ID NO: 1261441 - RNA, 14 nt, Mycobacterium tuberculosis H37Rv
cgucacaagucgac

SEQ ID NO: 1261442 - RNA, 12 nt, Mycobacterium tuberculosis H37Rv
cgucacaccgau

SEQ ID NO: 1261443 - RNA, 19 nt, Mycobacterium tuberculosis H37Rv
cgucacaccgaugcguucg

SEQ ID NO: 1261444 - RNA, 21 nt, Mycobacterium tuberculosis H37Rv
cgucacaccgaugcguucggg

SEQ ID NO: 1261445 - RNA, 18 nt, Mycobacterium tuberculosis H37Rv
cguaucgucgagcaccuu

SEQ ID NO: 1261446 - RNA, 17 nt, Mycobacterium tuberculosis H37Rv
cgucaagaacgccacga

SEQ ID NO: 1261447 - RNA, 17 nt, Mycobacterium tuberculosis H37Rv
cguaugacgcccaccga

SEQ ID NO: 1261448 - RNA, 20 nt, Mycobacterium tuberculosis H37Rv
cgucagugccccgcagcacu

SEQ ID NO: 1261449 - RNA, 21 nt, Mycobacterium tuberculosis H37Rv
cgucagucaacucaccgucgg

SEQ ID NO: 1261450 - RNA, 17 nt, Mycobacterium tuberculosis H37Rv
cgucaggccagagucgc

SEQ ID NO: 1261451 - RNA, 18 nt, Mycobacterium tuberculosis H37Rv
cgucauacucgacaccga

SEQ ID NO: 1261452 - RNA, 17 nt, Mycobacterium tuberculosis H37Rv
cgucauacucgacaccg

SEQ ID NO: 1261453 - RNA, 16 nt, Mycobacterium tuberculosis H37Rv
cgucccagcgcggugu

SEQ ID NO: 1261454 - RNA, 17 nt, Mycobacterium tuberculosis H37Rv
cgucccggcgaccgggu

SEQ ID NO: 1261455 - RNA, 18 nt, Mycobacterium tuberculosis H37Rv
cgucccggacaauuccgc

SEQ ID NO: 1261456 - RNA, 14 nt, Mycobacterium tuberculosis H37Rv
cgucccggcucgag

SEQ ID NO: 1261457 - RNA, 19 nt, Mycobacterium tuberculosis H37Rv
cgucccggcggucagcggc

SEQ ID NO: 1261458 - RNA, 16 nt, Mycobacterium tuberculosis H37Rv
cgucccggcucgagcu

SEQ ID NO: 1261459 - RNA, 17 nt, Mycobacterium tuberculosis H37Rv
cgucccagccgaucacg

SEQ ID NO: 1261460 - RNA, 19 nt, Mycobacterium tuberculosis H37Rv
cguccaucgccaccgcguc

SEQ ID NO: 1261461 - RNA, 15 nt, Mycobacterium tuberculosis H37Rv
cguccaucucggacc

SEQ ID NO: 1261462 - RNA, 21 nt, Mycobacterium tuberculosis H37Rv
cguccugaaucgguucggcca

SEQ ID NO: 1261463 - RNA, 18 nt, Mycobacterium tuberculosis H37Rv
cguccugaaucgguucgg

SEQ ID NO: 1261464 - RNA, 20 nt, Mycobacterium tuberculosis H37Rv
cguccuccccuacugcguug

SEQ ID NO: 1261465 - RNA, 21 nt, Mycobacterium tuberculosis H37Rv
cguccggcgcccacaucgucg

SEQ ID NO: 1261466 - RNA, 23 nt, Mycobacterium tuberculosis H37Rv
cguccggagccccugucaacgcc

SEQ ID NO: 1261467 - RNA, 16 nt, Mycobacterium tuberculosis H37Rv
cguccggaucggucgg

SEQ ID NO: 1261468 - RNA, 23 nt, Mycobacterium tuberculosis H37Rv
cguccugcgagaggugcugcacc

SEQ ID NO: 1261469 - RNA, 19 nt, Mycobacterium tuberculosis H37Rv
cguccugcggguaggugac

SEQ ID NO: 1261470 - RNA, 11 nt, Mycobacterium tuberculosis H37Rv
cguccugcgag

SEQ ID NO: 1261471 - RNA, 20 nt, Mycobacterium tuberculosis H37Rv
cguccugguggcgggaucac

SEQ ID NO: 1261472 - RNA, 15 nt, Mycobacterium tuberculosis H37Rv
cguccuucgcuggua

SEQ ID NO: 1261473 - RNA, 21 nt, Mycobacterium tuberculosis H37Rv
cguccuggugagauugguggc

SEQ ID NO: 1261474 - RNA, 20 nt, Mycobacterium tuberculosis H37Rv
cgucgaaguagccgacgucg

SEQ ID NO: 1261475 - RNA, 21 nt, Mycobacterium tuberculosis H37Rv
cgucgaaguuggcgaagcccg

SEQ ID NO: 1261476 - RNA, 18 nt, Mycobacterium tuberculosis H37Rv
cgucgaagggaucacgac

SEQ ID NO: 1261477 - RNA, 17 nt, Mycobacterium tuberculosis H37Rv
cgucgaaguagccgacg

SEQ ID NO: 1261478 - RNA, 20 nt, Mycobacterium tuberculosis H37Rv
cgucgaaaaaucgaucgugu

SEQ ID NO: 1261479 - RNA, 15 nt, Mycobacterium tuberculosis H37Rv
cgucgaaauccacaa

SEQ ID NO: 1261480 - RNA, 14 nt, Mycobacterium tuberculosis H37Rv
cgucgaagcgaaca

SEQ ID NO: 1261481 - RNA, 16 nt, Mycobacterium tuberculosis H37Rv
cgucgacuucagcggc

SEQ ID NO: 1261482 - RNA, 22 nt, Mycobacterium tuberculosis H37Rv
cgucgagcgcggugccgccacc

SEQ ID NO: 1261483 - RNA, 18 nt, Mycobacterium tuberculosis H37Rv
cgucgagccgaucgcccg

SEQ ID NO: 1261484 - RNA, 17 nt, Mycobacterium tuberculosis H37Rv
cgucgagccggacaggc

SEQ ID NO: 1261485 - RNA, 16 nt, Mycobacterium tuberculosis H37Rv
cgucgacgucgacggc

SEQ ID NO: 1261486 - RNA, 12 nt, Mycobacterium tuberculosis H37Rv
cgucgaccggga

SEQ ID NO: 1261487 - RNA, 24 nt, Mycobacterium tuberculosis H37Rv
cgucgacacacccacuggaccacc

SEQ ID NO: 1261488 - RNA, 23 nt, Mycobacterium tuberculosis H37Rv
cgucgacccgaacugggcgaucg

SEQ ID NO: 1261489 - RNA, 21 nt, Mycobacterium tuberculosis H37Rv
cgucgcgacgacguagauggu

SEQ ID NO: 1261490 - RNA, 18 nt, Mycobacterium tuberculosis H37Rv
cgucgccgucggugccgc

SEQ ID NO: 1261491 - RNA, 16 nt, Mycobacterium tuberculosis H37Rv
cgucgccucgauaucg

SEQ ID NO: 1261492 - RNA, 20 nt, Mycobacterium tuberculosis H37Rv
cgucgccucgauaucgucgg

SEQ ID NO: 1261493 - RNA, 20 nt, Mycobacterium tuberculosis H37Rv
cgucgcggaaucgcgacacg

SEQ ID NO: 1261494 - RNA, 16 nt, Mycobacterium tuberculosis H37Rv
cgucgcggaaucgcga

SEQ ID NO: 1261495 - RNA, 16 nt, Mycobacterium tuberculosis H37Rv
cgucgcggaucagccc

SEQ ID NO: 1261496 - RNA, 14 nt, Mycobacterium tuberculosis H37Rv
cgucgcgacgucgg

SEQ ID NO: 1261497 - RNA, 14 nt, Mycobacterium tuberculosis H37Rv
cgucgccgccgcua

SEQ ID NO: 1261498 - RNA, 17 nt, Mycobacterium tuberculosis H37Rv
cgucgccgacgccggug

SEQ ID NO: 1261499 - RNA, 13 nt, Mycobacterium tuberculosis H37Rv
cgucgccgacggu

SEQ ID NO: 1261500 - RNA, 16 nt, Mycobacterium tuberculosis H37Rv
cgucgccgaccgucac

SEQ ID NO: 1261501 - RNA, 14 nt, Mycobacterium tuberculosis H37Rv
cgucgagcgucugc

SEQ ID NO: 1261502 - RNA, 14 nt, Mycobacterium tuberculosis H37Rv
cgucgaucggcuug

SEQ ID NO: 1261503 - RNA, 21 nt, Mycobacterium tuberculosis H37Rv
cgucgaucucgaucgacccgg

SEQ ID NO: 1261504 - RNA, 21 nt, Mycobacterium tuberculosis H37Rv
cgucgaucuugccgcgccgga

SEQ ID NO: 1261505 - RNA, 20 nt, Mycobacterium tuberculosis H37Rv
cgucgcacccagggcguugg

SEQ ID NO: 1261506 - RNA, 23 nt, Mycobacterium tuberculosis H37Rv
cgucgcacccaacuccaucagcg

SEQ ID NO: 1261507 - RNA, 14 nt, Mycobacterium tuberculosis H37Rv
cgucgaugccggcu

SEQ ID NO: 1261508 - RNA, 14 nt, Mycobacterium tuberculosis H37Rv
cgucgaugaucugc

SEQ ID NO: 1261509 - RNA, 21 nt, Mycobacterium tuberculosis H37Rv
cgucgaugagguucaucgccg

SEQ ID NO: 1261510 - RNA, 14 nt, Mycobacterium tuberculosis H37Rv
cgucgccaccagag

SEQ ID NO: 1261511 - RNA, 20 nt, Mycobacterium tuberculosis H37Rv
cgucgccaccagagucaaca

SEQ ID NO: 1261512 - RNA, 14 nt, Mycobacterium tuberculosis H37Rv
cgucgccaccggua

SEQ ID NO: 1261513 - RNA, 16 nt, Mycobacterium tuberculosis H37Rv
cgucgccaccgguacc

SEQ ID NO: 1261514 - RNA, 18 nt, Mycobacterium tuberculosis H37Rv
cgucgcaguauucacagu

SEQ ID NO: 1261515 - RNA, 17 nt, Mycobacterium tuberculosis H37Rv
cgucgcauacgcccacu

SEQ ID NO: 1261516 - RNA, 17 nt, Mycobacterium tuberculosis H37Rv
cgucggcaucgacgcgu

SEQ ID NO: 1261517 - RNA, 20 nt, Mycobacterium tuberculosis H37Rv
cgucggcauugcgcaggaug

SEQ ID NO: 1261518 - RNA, 14 nt, Mycobacterium tuberculosis H37Rv
cgucggcaucggcg

SEQ ID NO: 1261519 - RNA, 22 nt, Mycobacterium tuberculosis H37Rv
cgucggcaggcagcucggcaac

SEQ ID NO: 1261520 - RNA, 20 nt, Mycobacterium tuberculosis H37Rv
cgucggccaccgccugagcg

SEQ ID NO: 1261521 - RNA, 17 nt, Mycobacterium tuberculosis H37Rv
cgucggcaccgauccug

SEQ ID NO: 1261522 - RNA, 20 nt, Mycobacterium tuberculosis H37Rv
cgucggcaccgguuuucgcc

SEQ ID NO: 1261523 - RNA, 22 nt, Mycobacterium tuberculosis H37Rv
cgucggcagcagcggugcagcc

SEQ ID NO: 1261524 - RNA, 11 nt, Mycobacterium tuberculosis H37Rv
cgucggcaccg

SEQ ID NO: 1261525 - RNA, 16 nt, Mycobacterium tuberculosis H37Rv
cgucggcaacgcuggc

SEQ ID NO: 1261526 - RNA, 17 nt, Mycobacterium tuberculosis H37Rv
cgucggcaacgcuggca

SEQ ID NO: 1261527 - RNA, 15 nt, Mycobacterium tuberculosis H37Rv
cgucggccagcagau

SEQ ID NO: 1261528 - RNA, 20 nt, Mycobacterium tuberculosis H37Rv
cgucggccagcagaucaggu

SEQ ID NO: 1261529 - RNA, 14 nt, Mycobacterium tuberculosis H37Rv
cgucggccaggauc

SEQ ID NO: 1261530 - RNA, 23 nt, Mycobacterium tuberculosis H37Rv
cgucggccgagucgauugccacc

SEQ ID NO: 1261531 - RNA, 21 nt, Mycobacterium tuberculosis H37Rv
cgucggccgacaccgccacca

SEQ ID NO: 1261532 - RNA, 15 nt, Mycobacterium tuberculosis H37Rv
cgucggagucggugg

SEQ ID NO: 1261533 - RNA, 20 nt, Mycobacterium tuberculosis H37Rv
cgucggaguaccgcgcguug

SEQ ID NO: 1261534 - RNA, 21 nt, Mycobacterium tuberculosis H37Rv
cgucggauccgcccgccuuca

SEQ ID NO: 1261535 - RNA, 17 nt, Mycobacterium tuberculosis H37Rv
cgucggaguaccgcgcg

SEQ ID NO: 1261536 - RNA, 22 nt, Mycobacterium tuberculosis H37Rv
cgucgcuggugggaucgcagcg

SEQ ID NO: 1261537 - RNA, 21 nt, Mycobacterium tuberculosis H37Rv
cgucgcuucggcaccgacugc

SEQ ID NO: 1261538 - RNA, 19 nt, Mycobacterium tuberculosis H37Rv
cgucggaacugaccacguc

SEQ ID NO: 1261539 - RNA, 13 nt, Mycobacterium tuberculosis H37Rv
cgucggacaccgc

SEQ ID NO: 1261540 - RNA, 16 nt, Mycobacterium tuberculosis H37Rv
cgucgcuagggugagc

SEQ ID NO: 1261541 - RNA, 15 nt, Mycobacterium tuberculosis H37Rv
cgucgcuagauccca

SEQ ID NO: 1261542 - RNA, 18 nt, Mycobacterium tuberculosis H37Rv
cgucgcuaugcgccgcau

SEQ ID NO: 1261543 - RNA, 14 nt, Mycobacterium tuberculosis H37Rv
cgucgcucacggcc

SEQ ID NO: 1261544 - RNA, 19 nt, Mycobacterium tuberculosis H37Rv
cgucgcggccacggucagc

SEQ ID NO: 1261545 - RNA, 18 nt, Mycobacterium tuberculosis H37Rv
cgucgcggccacggucag

SEQ ID NO: 1261546 - RNA, 20 nt, Mycobacterium tuberculosis H37Rv
cgucgcucgucgucaccgau

SEQ ID NO: 1261547 - RNA, 15 nt, Mycobacterium tuberculosis H37Rv
cgucgcugaccgcgu

SEQ ID NO: 1261548 - RNA, 22 nt, Mycobacterium tuberculosis H37Rv
cgucgcugcccaucacacccgg

SEQ ID NO: 1261549 - RNA, 19 nt, Mycobacterium tuberculosis H37Rv
cgugccuggccggugcgca

SEQ ID NO: 1261550 - RNA, 15 nt, Mycobacterium tuberculosis H37Rv
cgugccuuccucgcc

SEQ ID NO: 1261551 - RNA, 20 nt, Mycobacterium tuberculosis H37Rv
cgugcgauucugcgucugcu

SEQ ID NO: 1261552 - RNA, 14 nt, Mycobacterium tuberculosis H37Rv
cgugcggcggccca

SEQ ID NO: 1261553 - RNA, 19 nt, Mycobacterium tuberculosis H37Rv
cgugcggguaauacggcgc

SEQ ID NO: 1261554 - RNA, 15 nt, Mycobacterium tuberculosis H37Rv
cgugcgucgauggcg

SEQ ID NO: 1261555 - RNA, 13 nt, Mycobacterium tuberculosis H37Rv
cgugcucgccgua

SEQ ID NO: 1261556 - RNA, 16 nt, Mycobacterium tuberculosis H37Rv
cgugcucgagcaccuc

SEQ ID NO: 1261557 - RNA, 17 nt, Mycobacterium tuberculosis H37Rv
cgugcuacccauucggc

SEQ ID NO: 1261558 - RNA, 20 nt, Mycobacterium tuberculosis H37Rv
cgugcguugucggcuggacg

SEQ ID NO: 1261559 - RNA, 20 nt, Mycobacterium tuberculosis H37Rv
cgugcgugggcgcggcgcca

SEQ ID NO: 1261560 - RNA, 23 nt, Mycobacterium tuberculosis H37Rv
cgugcaggcugguuucggccgca

SEQ ID NO: 1261561 - RNA, 15 nt, Mycobacterium tuberculosis H37Rv
cgugcaggcgacggc

SEQ ID NO: 1261562 - RNA, 17 nt, Mycobacterium tuberculosis H37Rv
cgugcaggcgacggcuc

SEQ ID NO: 1261563 - RNA, 13 nt, Mycobacterium tuberculosis H37Rv
cgugcaggcgacg

SEQ ID NO: 1261564 - RNA, 18 nt, Mycobacterium tuberculosis H37Rv
cgugcagguagguauagc

SEQ ID NO: 1261565 - RNA, 21 nt, Mycobacterium tuberculosis H37Rv
cgugccgcccucaccgccugu

SEQ ID NO: 1261566 - RNA, 21 nt, Mycobacterium tuberculosis H37Rv
cgugccucgaggacggcguag

SEQ ID NO: 1261567 - RNA, 18 nt, Mycobacterium tuberculosis H37Rv
cgugccgucgccuccagc

SEQ ID NO: 1261568 - RNA, 14 nt, Mycobacterium tuberculosis H37Rv
cgugccgggccaga

SEQ ID NO: 1261569 - RNA, 13 nt, Mycobacterium tuberculosis H37Rv
cgugccggcguug

SEQ ID NO: 1261570 - RNA, 16 nt, Mycobacterium tuberculosis H37Rv
cgugccgggcgacggu

SEQ ID NO: 1261571 - RNA, 17 nt, Mycobacterium tuberculosis H37Rv
cgugccgggcgacgguu

SEQ ID NO: 1261572 - RNA, 17 nt, Mycobacterium tuberculosis H37Rv
cgugaucuucggcgauc

SEQ ID NO: 1261573 - RNA, 18 nt, Mycobacterium tuberculosis H37Rv
cgugaugccacggcgucg

SEQ ID NO: 1261574 - RNA, 21 nt, Mycobacterium tuberculosis H37Rv
cgugauauccuuugccgccga

SEQ ID NO: 1261575 - RNA, 19 nt, Mycobacterium tuberculosis H37Rv
cgugauacagcucggugca

SEQ ID NO: 1261576 - RNA, 12 nt, Mycobacterium tuberculosis H37Rv
cgugaucgaccg

SEQ ID NO: 1261577 - RNA, 14 nt, Mycobacterium tuberculosis H37Rv
cgugaucggcgaac

SEQ ID NO: 1261578 - RNA, 17 nt, Mycobacterium tuberculosis H37Rv
cgugaugcguucggccg

SEQ ID NO: 1261579 - RNA, 20 nt, Mycobacterium tuberculosis H37Rv
cgugcagcacuuggccagcu

SEQ ID NO: 1261580 - RNA, 23 nt, Mycobacterium tuberculosis H37Rv
cgugcagccgcaggugggcguug

SEQ ID NO: 1261581 - RNA, 16 nt, Mycobacterium tuberculosis H37Rv
cgugcagccauugacg

SEQ ID NO: 1261582 - RNA, 17 nt, Mycobacterium tuberculosis H37Rv
cgugcaggaacacccau

SEQ ID NO: 1261583 - RNA, 19 nt, Mycobacterium tuberculosis H37Rv
cgugcaggaacacccauac

SEQ ID NO: 1261584 - RNA, 17 nt, Mycobacterium tuberculosis H37Rv
cgugcaggaucggcuug

SEQ ID NO: 1261585 - RNA, 21 nt, Mycobacterium tuberculosis H37Rv
cgucuugcaucagcggcgcca

SEQ ID NO: 1261586 - RNA, 19 nt, Mycobacterium tuberculosis H37Rv
cgucuuugacgaacugguc

SEQ ID NO: 1261587 - RNA, 19 nt, Mycobacterium tuberculosis H37Rv
cgugaaccgcccgcccuug

SEQ ID NO: 1261588 - RNA, 17 nt, Mycobacterium tuberculosis H37Rv
cgugaagggauccggaa

SEQ ID NO: 1261589 - RNA, 20 nt, Mycobacterium tuberculosis H37Rv
cgugaguacucggucaacgu

SEQ ID NO: 1261590 - RNA, 18 nt, Mycobacterium tuberculosis H37Rv
cgugaggucccggcuggg

SEQ ID NO: 1261591 - RNA, 19 nt, Mycobacterium tuberculosis H37Rv
cgucggugcaauuucagcc

SEQ ID NO: 1261592 - RNA, 21 nt, Mycobacterium tuberculosis H37Rv
cgucggugaccucggcgacca

SEQ ID NO: 1261593 - RNA, 22 nt, Mycobacterium tuberculosis H37Rv
cgucggugagcugcgccagaau

SEQ ID NO: 1261594 - RNA, 13 nt, Mycobacterium tuberculosis H37Rv
cgucggugccacc

SEQ ID NO: 1261595 - RNA, 18 nt, Mycobacterium tuberculosis H37Rv
cgucgguguaacccuggc

SEQ ID NO: 1261596 - RNA, 20 nt, Mycobacterium tuberculosis H37Rv
cgucggugggcgugacguag

SEQ ID NO: 1261597 - RNA, 18 nt, Mycobacterium tuberculosis H37Rv
cgucggugcgcgcggcga

SEQ ID NO: 1261598 - RNA, 17 nt, Mycobacterium tuberculosis H37Rv
cgucgguggcagcggug

SEQ ID NO: 1261599 - RNA, 14 nt, Mycobacterium tuberculosis H37Rv
cgucguacaugggc

SEQ ID NO: 1261600 - RNA, 21 nt, Mycobacterium tuberculosis H37Rv
cgucgguuccgggcgcgugga

SEQ ID NO: 1261601 - RNA, 17 nt, Mycobacterium tuberculosis H37Rv
cgucgguguccucggug

SEQ ID NO: 1261602 - RNA, 14 nt, Mycobacterium tuberculosis H37Rv
cgucgggaugcucg

SEQ ID NO: 1261603 - RNA, 20 nt, Mycobacterium tuberculosis H37Rv
cgucggucaugucggccacc

SEQ ID NO: 1261604 - RNA, 22 nt, Mycobacterium tuberculosis H37Rv
cgucggugaaguagugcucgca

SEQ ID NO: 1261605 - RNA, 20 nt, Mycobacterium tuberculosis H37Rv
cgucggugaacgcgucguug

SEQ ID NO: 1261606 - RNA, 20 nt, Mycobacterium tuberculosis H37Rv
cgucggcgaauccgccgccu

SEQ ID NO: 1261607 - RNA, 21 nt, Mycobacterium tuberculosis H37Rv
cgucggcgaauccgccgccua

SEQ ID NO: 1261608 - RNA, 14 nt, Mycobacterium tuberculosis H37Rv
cgucggcgccgaac

SEQ ID NO: 1261609 - RNA, 23 nt, Mycobacterium tuberculosis H37Rv
cgucggcggauucacgcacaagc

SEQ ID NO: 1261610 - RNA, 13 nt, Mycobacterium tuberculosis H37Rv
cgucuggaguucg

SEQ ID NO: 1261611 - RNA, 15 nt, Mycobacterium tuberculosis H37Rv
cgucugcucggcgcg

SEQ ID NO: 1261612 - RNA, 18 nt, Mycobacterium tuberculosis H37Rv
cgucugcucgcgccggug

SEQ ID NO: 1261613 - RNA, 15 nt, Mycobacterium tuberculosis H37Rv
cgucugcucggcgca

SEQ ID NO: 1261614 - RNA, 16 nt, Mycobacterium tuberculosis H37Rv
cgucuucgucauggcc

SEQ ID NO: 1261615 - RNA, 12 nt, Mycobacterium tuberculosis H37Rv
cgucugcucgcc

SEQ ID NO: 1261616 - RNA, 15 nt, Mycobacterium tuberculosis H37Rv
cgucuccaccgcgau

SEQ ID NO: 1261617 - RNA, 20 nt, Mycobacterium tuberculosis H37Rv
cgucugcacguacucggcca

SEQ ID NO: 1261618 - RNA, 15 nt, Mycobacterium tuberculosis H37Rv
cgucguccagggcga

SEQ ID NO: 1261619 - RNA, 15 nt, Mycobacterium tuberculosis H37Rv
cgucgucaucgagcg

SEQ ID NO: 1261620 - RNA, 23 nt, Mycobacterium tuberculosis H37Rv
cgucgucaucgagcgggaucggg

SEQ ID NO: 1261621 - RNA, 23 nt, Mycobacterium tuberculosis H37Rv
cgucgucagccaggaagcggugg

SEQ ID NO: 1261622 - RNA, 18 nt, Mycobacterium tuberculosis H37Rv
cgucguggcgcucggcga

SEQ ID NO: 1261623 - RNA, 14 nt, Mycobacterium tuberculosis H37Rv
cgucgugguagcgc

SEQ ID NO: 1261624 - RNA, 14 nt, Mycobacterium tuberculosis H37Rv
cgucguggcgcucg

SEQ ID NO: 1261625 - RNA, 21 nt, Mycobacterium tuberculosis H37Rv
cgucguggaucuucgcgcugu

SEQ ID NO: 1261626 - RNA, 20 nt, Mycobacterium tuberculosis H37Rv
cgucuccacuuucugcgguc

SEQ ID NO: 1261627 - RNA, 18 nt, Mycobacterium tuberculosis H37Rv
cgucguguggggcgggaa

SEQ ID NO: 1261628 - RNA, 17 nt, Mycobacterium tuberculosis H37Rv
cgucgugucgccgccgu

SEQ ID NO: 1261629 - RNA, 14 nt, Mycobacterium tuberculosis H37Rv
cgucgugucgccgc

SEQ ID NO: 1261630 - RNA, 21 nt, Mycobacterium tuberculosis H37Rv
cucggcgccgaacucaacgac

SEQ ID NO: 1261631 - RNA, 13 nt, Mycobacterium tuberculosis H37Rv
cucggcgccgaac

SEQ ID NO: 1261632 - RNA, 15 nt, Mycobacterium tuberculosis H37Rv
cucggcgcagccggu

SEQ ID NO: 1261633 - RNA, 18 nt, Mycobacterium tuberculosis H37Rv
cucggcgcgcgacgagca

SEQ ID NO: 1261634 - RNA, 12 nt, Mycobacterium tuberculosis H37Rv
cucggcgcugac

SEQ ID NO: 1261635 - RNA, 21 nt, Mycobacterium tuberculosis H37Rv
cucggcggagacggcggccau

SEQ ID NO: 1261636 - RNA, 15 nt, Mycobacterium tuberculosis H37Rv
cucggcgagcacguc

SEQ ID NO: 1261637 - RNA, 15 nt, Mycobacterium tuberculosis H37Rv
cucggcgagcaccgu

SEQ ID NO: 1261638 - RNA, 22 nt, Mycobacterium tuberculosis H37Rv
cucggcgaggaacuggaccggu

SEQ ID NO: 1261639 - RNA, 23 nt, Mycobacterium tuberculosis H37Rv
cucggcgagugucuuagccagca

SEQ ID NO: 1261640 - RNA, 16 nt, Mycobacterium tuberculosis H37Rv
cucggcuauggguucg

SEQ ID NO: 1261641 - RNA, 13 nt, Mycobacterium tuberculosis H37Rv
cucggcuucggag

SEQ ID NO: 1261642 - RNA, 13 nt, Mycobacterium tuberculosis H37Rv
cucgggaucggcg

SEQ ID NO: 1261643 - RNA, 19 nt, Mycobacterium tuberculosis H37Rv
cucgggcaacgccucgagc

SEQ ID NO: 1261644 - RNA, 19 nt, Mycobacterium tuberculosis H37Rv
cucggcguuuucggugagc

SEQ ID NO: 1261645 - RNA, 18 nt, Mycobacterium tuberculosis H37Rv
cucggcuagugugaccgu

SEQ ID NO: 1261646 - RNA, 14 nt, Mycobacterium tuberculosis H37Rv
cucggcguugauga

SEQ ID NO: 1261647 - RNA, 20 nt, Mycobacterium tuberculosis H37Rv
cucggcguacucgugcaccg

SEQ ID NO: 1261648 - RNA, 21 nt, Mycobacterium tuberculosis H37Rv
cucggcggcggcacgcugacc

SEQ ID NO: 1261649 - RNA, 12 nt, Mycobacterium tuberculosis H37Rv
cucggcggccag

SEQ ID NO: 1261650 - RNA, 14 nt, Mycobacterium tuberculosis H37Rv
cucggcggccacca

SEQ ID NO: 1261651 - RNA, 19 nt, Mycobacterium tuberculosis H37Rv
cucggcggcccggccgaac

SEQ ID NO: 1261652 - RNA, 14 nt, Mycobacterium tuberculosis H37Rv
cucggaauucggcg

SEQ ID NO: 1261653 - RNA, 16 nt, Mycobacterium tuberculosis H37Rv
cucgcuguuggccggu

SEQ ID NO: 1261654 - RNA, 16 nt, Mycobacterium tuberculosis H37Rv
cucggccacggcgucg

SEQ ID NO: 1261655 - RNA, 14 nt, Mycobacterium tuberculosis H37Rv
cucggaggcgauca

SEQ ID NO: 1261656 - RNA, 19 nt, Mycobacterium tuberculosis H37Rv
cucggagaugaacucggcg

SEQ ID NO: 1261657 - RNA, 19 nt, Mycobacterium tuberculosis H37Rv
cucggaggcgaucaggaug

SEQ ID NO: 1261658 - RNA, 22 nt, Mycobacterium tuberculosis H37Rv
cucggcaugagucgaaccaggu

SEQ ID NO: 1261659 - RNA, 19 nt, Mycobacterium tuberculosis H37Rv
cucgcgguuuuggucgcga

SEQ ID NO: 1261660 - RNA, 17 nt, Mycobacterium tuberculosis H37Rv
cucgcguagggccagcg

SEQ ID NO: 1261661 - RNA, 16 nt, Mycobacterium tuberculosis H37Rv
cucgcgguagcgccgu

SEQ ID NO: 1261662 - RNA, 14 nt, Mycobacterium tuberculosis H37Rv
cucgcggcgaccau

SEQ ID NO: 1261663 - RNA, 20 nt, Mycobacterium tuberculosis H37Rv
cucgcggaugagcucggcca

SEQ ID NO: 1261664 - RNA, 14 nt, Mycobacterium tuberculosis H37Rv
cucgcgcuugcgcc

SEQ ID NO: 1261665 - RNA, 14 nt, Mycobacterium tuberculosis H37Rv
cucgcgcgucgcga

SEQ ID NO: 1261666 - RNA, 15 nt, Mycobacterium tuberculosis H37Rv
cucgccguugauguc

SEQ ID NO: 1261667 - RNA, 16 nt, Mycobacterium tuberculosis H37Rv
cucgccgugaccaggu

SEQ ID NO: 1261668 - RNA, 13 nt, Mycobacterium tuberculosis H37Rv
cucgccggugacg

SEQ ID NO: 1261669 - RNA, 17 nt, Mycobacterium tuberculosis H37Rv
cucgaugucagcggccg

SEQ ID NO: 1261670 - RNA, 16 nt, Mycobacterium tuberculosis H37Rv
cucgauuguggccagc

SEQ ID NO: 1261671 - RNA, 21 nt, Mycobacterium tuberculosis H37Rv
cucccgcaaugcgagcgcgcc

SEQ ID NO: 1261672 - RNA, 19 nt, Mycobacterium tuberculosis H37Rv
cucccgcgaucgcgacacg

SEQ ID NO: 1261673 - RNA, 20 nt, Mycobacterium tuberculosis H37Rv
cucccgaacacuuugcgcac

SEQ ID NO: 1261674 - RNA, 13 nt, Mycobacterium tuberculosis H37Rv
cucccgagccaca

SEQ ID NO: 1261675 - RNA, 18 nt, Mycobacterium tuberculosis H37Rv
cucccccggcuccgcaac

SEQ ID NO: 1261676 - RNA, 16 nt, Mycobacterium tuberculosis H37Rv
cuccggucccgcauac

SEQ ID NO: 1261677 - RNA, 22 nt, Mycobacterium tuberculosis H37Rv
cuccguaaacgaggucgccgca

SEQ ID NO: 1261678 - RNA, 23 nt, Mycobacterium tuberculosis H37Rv
cuccuagccaacgagcgcgcugc

SEQ ID NO: 1261679 - RNA, 12 nt, Mycobacterium tuberculosis H37Rv
cuccgugccgag

SEQ ID NO: 1261680 - RNA, 15 nt, Mycobacterium tuberculosis H37Rv
cuccgugaucgaggc

SEQ ID NO: 1261681 - RNA, 16 nt, Mycobacterium tuberculosis H37Rv
cuccgugaucgaggcg

SEQ ID NO: 1261682 - RNA, 19 nt, Mycobacterium tuberculosis H37Rv
cuccguggugcuagcgccg

SEQ ID NO: 1261683 - RNA, 21 nt, Mycobacterium tuberculosis H37Rv
cuccugaguugcggugugccg

SEQ ID NO: 1261684 - RNA, 13 nt, Mycobacterium tuberculosis H37Rv
cuccugcagcccg

SEQ ID NO: 1261685 - RNA, 21 nt, Mycobacterium tuberculosis H37Rv
cucgaaggcguucgacucgac

SEQ ID NO: 1261686 - RNA, 19 nt, Mycobacterium tuberculosis H37Rv
cucgaaggccgccaaccgu

SEQ ID NO: 1261687 - RNA, 15 nt, Mycobacterium tuberculosis H37Rv
cucgaaggcguucga

SEQ ID NO: 1261688 - RNA, 16 nt, Mycobacterium tuberculosis H37Rv
cucgaaggcguucgac

SEQ ID NO: 1261689 - RNA, 19 nt, Mycobacterium tuberculosis H37Rv
cucgacaacugcccgauga

SEQ ID NO: 1261690 - RNA, 17 nt, Mycobacterium tuberculosis H37Rv
cucgaaugucacaccgg

SEQ ID NO: 1261691 - RNA, 12 nt, Mycobacterium tuberculosis H37Rv
cucgacaccgac

SEQ ID NO: 1261692 - RNA, 16 nt, Mycobacterium tuberculosis H37Rv
cucgacagcggcaauc

SEQ ID NO: 1261693 - RNA, 14 nt, Mycobacterium tuberculosis H37Rv
cucgagacggucga

SEQ ID NO: 1261694 - RNA, 18 nt, Mycobacterium tuberculosis H37Rv
cucgagacggucgaucac

SEQ ID NO: 1261695 - RNA, 15 nt, Mycobacterium tuberculosis H37Rv
cucgacugccaccgu

SEQ ID NO: 1261696 - RNA, 13 nt, Mycobacterium tuberculosis H37Rv
cucgacuucggcg

SEQ ID NO: 1261697 - RNA, 16 nt, Mycobacterium tuberculosis H37Rv
cucgagcaggcgcacc

SEQ ID NO: 1261698 - RNA, 21 nt, Mycobacterium tuberculosis H37Rv
cucgagcaggaugcgaucguc

SEQ ID NO: 1261699 - RNA, 21 nt, Mycobacterium tuberculosis H37Rv
cucgagcaccgcgaacauggu

SEQ ID NO: 1261700 - RNA, 17 nt, Mycobacterium tuberculosis H37Rv
cucgagcaagaucaccu

SEQ ID NO: 1261701 - RNA, 16 nt, Mycobacterium tuberculosis H37Rv
cucgauacccaggaug

SEQ ID NO: 1261702 - RNA, 13 nt, Mycobacterium tuberculosis H37Rv
cucgaggucucca

SEQ ID NO: 1261703 - RNA, 20 nt, Mycobacterium tuberculosis H37Rv
cucgaguccguacuugccac

SEQ ID NO: 1261704 - RNA, 15 nt, Mycobacterium tuberculosis H37Rv
cucgagugccgccgu

SEQ ID NO: 1261705 - RNA, 22 nt, Mycobacterium tuberculosis H37Rv
cucgaguucgaccggcgggacg

SEQ ID NO: 1261706 - RNA, 20 nt, Mycobacterium tuberculosis H37Rv
cucgaccgccagcccgguga

SEQ ID NO: 1261707 - RNA, 20 nt, Mycobacterium tuberculosis H37Rv
cucgacgucgucgucgacgg

SEQ ID NO: 1261708 - RNA, 19 nt, Mycobacterium tuberculosis H37Rv
cucgacguccaucccggcg

SEQ ID NO: 1261709 - RNA, 16 nt, Mycobacterium tuberculosis H37Rv
cucgaccagcgccgau

SEQ ID NO: 1261710 - RNA, 14 nt, Mycobacterium tuberculosis H37Rv
cucgaucgacucga

SEQ ID NO: 1261711 - RNA, 15 nt, Mycobacterium tuberculosis H37Rv
cucgaucgucgacgc

SEQ ID NO: 1261712 - RNA, 18 nt, Mycobacterium tuberculosis H37Rv
cucgaucuggucaagacc

SEQ ID NO: 1261713 - RNA, 21 nt, Mycobacterium tuberculosis H37Rv
cucgaucaucaugucggcgca

SEQ ID NO: 1261714 - RNA, 21 nt, Mycobacterium tuberculosis H37Rv
cucgauauggguugccagcga

SEQ ID NO: 1261715 - RNA, 21 nt, Mycobacterium tuberculosis H37Rv
cucgaucacuagcgccccugg

SEQ ID NO: 1261716 - RNA, 23 nt, Mycobacterium tuberculosis H37Rv
cucgauggucauccagccagcaa

SEQ ID NO: 1261717 - RNA, 23 nt, Mycobacterium tuberculosis H37Rv
cucgaugaugucgagcacaccgu

SEQ ID NO: 1261718 - RNA, 14 nt, Mycobacterium tuberculosis H37Rv
cucgaucgccugag

SEQ ID NO: 1261719 - RNA, 15 nt, Mycobacterium tuberculosis H37Rv
cugacuccugcggca

SEQ ID NO: 1261720 - RNA, 14 nt, Mycobacterium tuberculosis H37Rv
cugacgcucggucg

SEQ ID NO: 1261721 - RNA, 17 nt, Mycobacterium tuberculosis H37Rv
cugacgcucggucgcca

SEQ ID NO: 1261722 - RNA, 21 nt, Mycobacterium tuberculosis H37Rv
cugacgcucggucgccaccgc

SEQ ID NO: 1261723 - RNA, 17 nt, Mycobacterium tuberculosis H37Rv
cugacgcuacgacagug

SEQ ID NO: 1261724 - RNA, 14 nt, Mycobacterium tuberculosis H37Rv
cugacgcgucagcg

SEQ ID NO: 1261725 - RNA, 18 nt, Mycobacterium tuberculosis H37Rv
cugagaugaugcgugacc

SEQ ID NO: 1261726 - RNA, 17 nt, Mycobacterium tuberculosis H37Rv
cugagagaguaucgacc

SEQ ID NO: 1261727 - RNA, 20 nt, Mycobacterium tuberculosis H37Rv
cugaccucgucaaucaccac

SEQ ID NO: 1261728 - RNA, 15 nt, Mycobacterium tuberculosis H37Rv
cugacgccauucauc

SEQ ID NO: 1261729 - RNA, 22 nt, Mycobacterium tuberculosis H37Rv
cugaagguggcgaacccgguca

SEQ ID NO: 1261730 - RNA, 16 nt, Mycobacterium tuberculosis H37Rv
cugaagguggcgaacc

SEQ ID NO: 1261731 - RNA, 15 nt, Mycobacterium tuberculosis H37Rv
cugaagccagcgcaa

SEQ ID NO: 1261732 - RNA, 20 nt, Mycobacterium tuberculosis H37Rv
cugaagccaaaugcgcuguc

SEQ ID NO: 1261733 - RNA, 17 nt, Mycobacterium tuberculosis H37Rv
cugauggcgcugcaccg

SEQ ID NO: 1261734 - RNA, 17 nt, Mycobacterium tuberculosis H37Rv
cugauuccacugggccu

SEQ ID NO: 1261735 - RNA, 19 nt, Mycobacterium tuberculosis H37Rv
cugauuggcccaccgccgu

SEQ ID NO: 1261736 - RNA, 23 nt, Mycobacterium tuberculosis H37Rv
cugcaagacaaagccgucgacgc

SEQ ID NO: 1261737 - RNA, 21 nt, Mycobacterium tuberculosis H37Rv
cugcacaacguggugucucgg

SEQ ID NO: 1261738 - RNA, 19 nt, Mycobacterium tuberculosis H37Rv
cugcaccgucagcccgacg

SEQ ID NO: 1261739 - RNA, 16 nt, Mycobacterium tuberculosis H37Rv
cugcaccguuuccggc

SEQ ID NO: 1261740 - RNA, 17 nt, Mycobacterium tuberculosis H37Rv
cugaggcaccucggccu

SEQ ID NO: 1261741 - RNA, 14 nt, Mycobacterium tuberculosis H37Rv
cugaggaacgccgg

SEQ ID NO: 1261742 - RNA, 21 nt, Mycobacterium tuberculosis H37Rv
cugagucugauggccucgcga

SEQ ID NO: 1261743 - RNA, 13 nt, Mycobacterium tuberculosis H37Rv
cugaguucggugc

SEQ ID NO: 1261744 - RNA, 17 nt, Mycobacterium tuberculosis H37Rv
cucguagaaucggcuca

SEQ ID NO: 1261745 - RNA, 16 nt, Mycobacterium tuberculosis H37Rv
cucggugccacugccg

SEQ ID NO: 1261746 - RNA, 18 nt, Mycobacterium tuberculosis H37Rv
cucggugccacugccggu

SEQ ID NO: 1261747 - RNA, 14 nt, Mycobacterium tuberculosis H37Rv
cucggucucgucgc

SEQ ID NO: 1261748 - RNA, 20 nt, Mycobacterium tuberculosis H37Rv
cucggugagcagcucgguga

SEQ ID NO: 1261749 - RNA, 14 nt, Mycobacterium tuberculosis H37Rv
cucggugaucucgc

SEQ ID NO: 1261750 - RNA, 16 nt, Mycobacterium tuberculosis H37Rv
cucggugaucucgcgc

SEQ ID NO: 1261751 - RNA, 13 nt, Mycobacterium tuberculosis H37Rv
cucgucacccggu

SEQ ID NO: 1261752 - RNA, 19 nt, Mycobacterium tuberculosis H37Rv
cucgucaaccugcgcauca

SEQ ID NO: 1261753 - RNA, 20 nt, Mycobacterium tuberculosis H37Rv
cucguauacccgggcggucg

SEQ ID NO: 1261754 - RNA, 22 nt, Mycobacterium tuberculosis H37Rv
cucgucaaucaccaccgccagc

SEQ ID NO: 1261755 - RNA, 21 nt, Mycobacterium tuberculosis H37Rv
cucgucacgggguccgaugcg

SEQ ID NO: 1261756 - RNA, 17 nt, Mycobacterium tuberculosis H37Rv
cucgucgaucucgaucg

SEQ ID NO: 1261757 - RNA, 18 nt, Mycobacterium tuberculosis H37Rv
cucgucgaugucgacguc

SEQ ID NO: 1261758 - RNA, 12 nt, Mycobacterium tuberculosis H37Rv
cucgucgccugc

SEQ ID NO: 1261759 - RNA, 17 nt, Mycobacterium tuberculosis H37Rv
cucgucgcgggcgaugg

SEQ ID NO: 1261760 - RNA, 12 nt, Mycobacterium tuberculosis H37Rv
cucgucggccag

SEQ ID NO: 1261761 - RNA, 14 nt, Mycobacterium tuberculosis H37Rv
cucgggggccgacc

SEQ ID NO: 1261762 - RNA, 16 nt, Mycobacterium tuberculosis H37Rv
cucgggggauccggcg

SEQ ID NO: 1261763 - RNA, 22 nt, Mycobacterium tuberculosis H37Rv
cucggggcucucgaguccaggc

SEQ ID NO: 1261764 - RNA, 17 nt, Mycobacterium tuberculosis H37Rv
cucgggggcugcacgcu

SEQ ID NO: 1261765 - RNA, 23 nt, Mycobacterium tuberculosis H37Rv
cucggggaguuccaaaucggugg

SEQ ID NO: 1261766 - RNA, 13 nt, Mycobacterium tuberculosis H37Rv
cucggggcgauga

SEQ ID NO: 1261767 - RNA, 17 nt, Mycobacterium tuberculosis H37Rv
cucgggcgcgggugacc

SEQ ID NO: 1261768 - RNA, 16 nt, Mycobacterium tuberculosis H37Rv
cucgggcagcgucacc

SEQ ID NO: 1261769 - RNA, 14 nt, Mycobacterium tuberculosis H37Rv
cucgggcagcgcgg

SEQ ID NO: 1261770 - RNA, 18 nt, Mycobacterium tuberculosis H37Rv
cucggucagagccgucga

SEQ ID NO: 1261771 - RNA, 23 nt, Mycobacterium tuberculosis H37Rv
cucggucaggcggcuggcccgca

SEQ ID NO: 1261772 - RNA, 21 nt, Mycobacterium tuberculosis H37Rv
cucguggguccguuuuaccuc

SEQ ID NO: 1261773 - RNA, 19 nt, Mycobacterium tuberculosis H37Rv
cucguguccggggaccucg

SEQ ID NO: 1261774 - RNA, 20 nt, Mycobacterium tuberculosis H37Rv
cucguuagaguaggccacca

SEQ ID NO: 1261775 - RNA, 24 nt, Mycobacterium tuberculosis H37Rv
cucgucggccagugcgcgcgucac

SEQ ID NO: 1261776 - RNA, 13 nt, Mycobacterium tuberculosis H37Rv
cucgucggcgaug

SEQ ID NO: 1261777 - RNA, 15 nt, Mycobacterium tuberculosis H37Rv
cucgucggccgacac

SEQ ID NO: 1261778 - RNA, 14 nt, Mycobacterium tuberculosis H37Rv
cucgugcacgcuga

SEQ ID NO: 1261779 - RNA, 18 nt, Mycobacterium tuberculosis H37Rv
cucgugcggcgcucccgc

SEQ ID NO: 1261780 - RNA, 14 nt, Mycobacterium tuberculosis H37Rv
cucgugcgcaucgu

SEQ ID NO: 1261781 - RNA, 20 nt, Mycobacterium tuberculosis H37Rv
cucuccauggccgauuccgc

SEQ ID NO: 1261782 - RNA, 13 nt, Mycobacterium tuberculosis H37Rv
cucuggugacggu

SEQ ID NO: 1261783 - RNA, 16 nt, Mycobacterium tuberculosis H37Rv
cucuucagcaagccaa

SEQ ID NO: 1261784 - RNA, 19 nt, Mycobacterium tuberculosis H37Rv
cugaaaugccgucgucaaa

SEQ ID NO: 1261785 - RNA, 17 nt, Mycobacterium tuberculosis H37Rv
cugaaacguccuugaac

SEQ ID NO: 1261786 - RNA, 13 nt, Mycobacterium tuberculosis H37Rv
cguuguaggcuuc

SEQ ID NO: 1261787 - RNA, 13 nt, Mycobacterium tuberculosis H37Rv
cguuguagacggc

SEQ ID NO: 1261788 - RNA, 18 nt, Mycobacterium tuberculosis H37Rv
cguuguccaccgccacca

SEQ ID NO: 1261789 - RNA, 17 nt, Mycobacterium tuberculosis H37Rv
cguuguccaccgccacc

SEQ ID NO: 1261790 - RNA, 15 nt, Mycobacterium tuberculosis H37Rv
cguuggugcagacca

SEQ ID NO: 1261791 - RNA, 17 nt, Mycobacterium tuberculosis H37Rv
cguuggugcagucggug

SEQ ID NO: 1261792 - RNA, 15 nt, Mycobacterium tuberculosis H37Rv
cguugguagccggug

SEQ ID NO: 1261793 - RNA, 19 nt, Mycobacterium tuberculosis H37Rv
cguugggcguacucggcgc

SEQ ID NO: 1261794 - RNA, 20 nt, Mycobacterium tuberculosis H37Rv
cguuggcgccaccagucacg

SEQ ID NO: 1261795 - RNA, 14 nt, Mycobacterium tuberculosis H37Rv
cguuggcgaccacc

SEQ ID NO: 1261796 - RNA, 16 nt, Mycobacterium tuberculosis H37Rv
cguuggcgccaccagu

SEQ ID NO: 1261797 - RNA, 18 nt, Mycobacterium tuberculosis H37Rv
cguuggcgaacugguagc

SEQ ID NO: 1261798 - RNA, 20 nt, Mycobacterium tuberculosis H37Rv
cguugggcagcuccaccagg

SEQ ID NO: 1261799 - RNA, 14 nt, Mycobacterium tuberculosis H37Rv
cguugggauccggu

SEQ ID NO: 1261800 - RNA, 19 nt, Mycobacterium tuberculosis H37Rv
cguugggaucccagcgcag

SEQ ID NO: 1261801 - RNA, 18 nt, Mycobacterium tuberculosis H37Rv
cguugggaucccagcgca

SEQ ID NO: 1261802 - RNA, 16 nt, Mycobacterium tuberculosis H37Rv
cguugggaccagugcg

SEQ ID NO: 1261803 - RNA, 21 nt, Mycobacterium tuberculosis H37Rv
cguuggcuucuucggucaccu

SEQ ID NO: 1261804 - RNA, 17 nt, Mycobacterium tuberculosis H37Rv
cguuggcuucuucgguc

SEQ ID NO: 1261805 - RNA, 12 nt, Mycobacterium tuberculosis H37Rv
cguuggcucgug

SEQ ID NO: 1261806 - RNA, 19 nt, Mycobacterium tuberculosis H37Rv
cguugucgggcaacacgau

SEQ ID NO: 1261807 - RNA, 17 nt, Mycobacterium tuberculosis H37Rv
cguuguccaagcccucg

SEQ ID NO: 1261808 - RNA, 16 nt, Mycobacterium tuberculosis H37Rv
cguugucuagcuggug

SEQ ID NO: 1261809 - RNA, 16 nt, Mycobacterium tuberculosis H37Rv
cguugugucaccggcg

SEQ ID NO: 1261810 - RNA, 21 nt, Mycobacterium tuberculosis H37Rv
cguuguuggauccggccacca

SEQ ID NO: 1261811 - RNA, 17 nt, Mycobacterium tuberculosis H37Rv
cguuuagggugcccgcg

SEQ ID NO: 1261812 - RNA, 19 nt, Mycobacterium tuberculosis H37Rv
cguuuacggcccggcaccc

SEQ ID NO: 1261813 - RNA, 12 nt, Mycobacterium tuberculosis H37Rv
cguuguugucga

SEQ ID NO: 1261814 - RNA, 22 nt, Mycobacterium tuberculosis H37Rv
cguuuauuguccugccgacagu

SEQ ID NO: 1261815 - RNA, 16 nt, Mycobacterium tuberculosis H37Rv
cguuugggcgccggug

SEQ ID NO: 1261816 - RNA, 18 nt, Mycobacterium tuberculosis H37Rv
cguuuggcagagccgacu

SEQ ID NO: 1261817 - RNA, 14 nt, Mycobacterium tuberculosis H37Rv
cguuucggucgaca

SEQ ID NO: 1261818 - RNA, 19 nt, Mycobacterium tuberculosis H37Rv
cguuucgaaccgcacggug

SEQ ID NO: 1261819 - RNA, 17 nt, Mycobacterium tuberculosis H37Rv
cguuuccgccgccgcca

SEQ ID NO: 1261820 - RNA, 18 nt, Mycobacterium tuberculosis H37Rv
cguuggaaaagucgggca

SEQ ID NO: 1261821 - RNA, 16 nt, Mycobacterium tuberculosis H37Rv
cguugcugauggugcc

SEQ ID NO: 1261822 - RNA, 21 nt, Mycobacterium tuberculosis H37Rv
cguugcuggcggccagcaucg

SEQ ID NO: 1261823 - RNA, 16 nt, Mycobacterium tuberculosis H37Rv
cguugcuggcugggug

SEQ ID NO: 1261824 - RNA, 11 nt, Mycobacterium tuberculosis H37Rv
cguuggcagcc

SEQ ID NO: 1261825 - RNA, 13 nt, Mycobacterium tuberculosis H37Rv
cguuggcagcccu

SEQ ID NO: 1261826 - RNA, 17 nt, Mycobacterium tuberculosis H37Rv
cguugcgcugcgcgacg

SEQ ID NO: 1261827 - RNA, 17 nt, Mycobacterium tuberculosis H37Rv
cguugcggacggcguug

SEQ ID NO: 1261828 - RNA, 19 nt, Mycobacterium tuberculosis H37Rv
cguugcguuggcgccacca

SEQ ID NO: 1261829 - RNA, 22 nt, Mycobacterium tuberculosis H37Rv
cguugcguagcaggucgacggc

SEQ ID NO: 1261830 - RNA, 23 nt, Mycobacterium tuberculosis H37Rv
cguugccgccguugccgccguua

SEQ ID NO: 1261831 - RNA, 14 nt, Mycobacterium tuberculosis H37Rv
cguugccgccguug

SEQ ID NO: 1261832 - RNA, 16 nt, Mycobacterium tuberculosis H37Rv
cguugccgcagacguc

SEQ ID NO: 1261833 - RNA, 23 nt, Mycobacterium tuberculosis H37Rv
cguugccgccggcgccgccguua

SEQ ID NO: 1261834 - RNA, 14 nt, Mycobacterium tuberculosis H37Rv
cguugccgccguua

SEQ ID NO: 1261835 - RNA, 14 nt, Mycobacterium tuberculosis H37Rv
cguugccgccggug

SEQ ID NO: 1261836 - RNA, 14 nt, Mycobacterium tuberculosis H37Rv
cguugccgggguug

SEQ ID NO: 1261837 - RNA, 15 nt, Mycobacterium tuberculosis H37Rv
cguugccggcgacca

SEQ ID NO: 1261838 - RNA, 14 nt, Mycobacterium tuberculosis H37Rv
cguugccggcguug

SEQ ID NO: 1261839 - RNA, 19 nt, Mycobacterium tuberculosis H37Rv
cguugccguuggugccgcc

SEQ ID NO: 1261840 - RNA, 22 nt, Mycobacterium tuberculosis H37Rv
cguugccgucgucgccgucggu

SEQ ID NO: 1261841 - RNA, 16 nt, Mycobacterium tuberculosis H37Rv
cguugccguuggugcc

SEQ ID NO: 1261842 - RNA, 18 nt, Mycobacterium tuberculosis H37Rv
cguugccgauggugaugg

SEQ ID NO: 1261843 - RNA, 20 nt, Mycobacterium tuberculosis H37Rv
cguugccgccgaagccgacg

SEQ ID NO: 1261844 - RNA, 13 nt, Mycobacterium tuberculosis H37Rv
cguugccgaacgu

SEQ ID NO: 1261845 - RNA, 22 nt, Mycobacterium tuberculosis H37Rv
cguugccaccggugccggcgac

SEQ ID NO: 1261846 - RNA, 21 nt, Mycobacterium tuberculosis H37Rv
cguugcaggaaaguggccgac

SEQ ID NO: 1261847 - RNA, 17 nt, Mycobacterium tuberculosis H37Rv
cguugaaggcgccggug

SEQ ID NO: 1261848 - RNA, 17 nt, Mycobacterium tuberculosis H37Rv
cguucucgauugucgcc

SEQ ID NO: 1261849 - RNA, 20 nt, Mycobacterium tuberculosis H37Rv
cguucucggcacccucagcg

SEQ ID NO: 1261850 - RNA, 22 nt, Mycobacterium tuberculosis H37Rv
cguugaccgcgugagcagacgc

SEQ ID NO: 1261851 - RNA, 18 nt, Mycobacterium tuberculosis H37Rv
cguugacggcuucggcag

SEQ ID NO: 1261852 - RNA, 20 nt, Mycobacterium tuberculosis H37Rv
cguugaugaugccggcguug

SEQ ID NO: 1261853 - RNA, 22 nt, Mycobacterium tuberculosis H37Rv
cguugaugaccaggucggucag

SEQ ID NO: 1261854 - RNA, 19 nt, Mycobacterium tuberculosis H37Rv
cgugcuguggaugccgacg

SEQ ID NO: 1261855 - RNA, 15 nt, Mycobacterium tuberculosis H37Rv
cgugcuugaccgccu

SEQ ID NO: 1261856 - RNA, 15 nt, Mycobacterium tuberculosis H37Rv
cgugcugugcucacg

SEQ ID NO: 1261857 - RNA, 18 nt, Mycobacterium tuberculosis H37Rv
cgugcuguggaugccgac

SEQ ID NO: 1261858 - RNA, 19 nt, Mycobacterium tuberculosis H37Rv
cgugcugggugacaccggu

SEQ ID NO: 1261859 - RNA, 21 nt, Mycobacterium tuberculosis H37Rv
cgugcuggugguaucggcgug

SEQ ID NO: 1261860 - RNA, 21 nt, Mycobacterium tuberculosis H37Rv
cgugcucgucguacaugggca

SEQ ID NO: 1261861 - RNA, 19 nt, Mycobacterium tuberculosis H37Rv
cgugcuuuccuugcgcgcc

SEQ ID NO: 1261862 - RNA, 20 nt, Mycobacterium tuberculosis H37Rv
cguggaaaccggugguagcg

SEQ ID NO: 1261863 - RNA, 16 nt, Mycobacterium tuberculosis H37Rv
cgugcuuccauucgcg

SEQ ID NO: 1261864 - RNA, 15 nt, Mycobacterium tuberculosis H37Rv
cguuccuccagcagc

SEQ ID NO: 1261865 - RNA, 14 nt, Mycobacterium tuberculosis H37Rv
cguuccgcuggacg

SEQ ID NO: 1261866 - RNA, 17 nt, Mycobacterium tuberculosis H37Rv
cguuccgcucgccguuu

SEQ ID NO: 1261867 - RNA, 14 nt, Mycobacterium tuberculosis H37Rv
cguuccgcucgccg

SEQ ID NO: 1261868 - RNA, 17 nt, Mycobacterium tuberculosis H37Rv
cguuccgcgacagcggc

SEQ ID NO: 1261869 - RNA, 15 nt, Mycobacterium tuberculosis H37Rv
cguucgggucgagcc

SEQ ID NO: 1261870 - RNA, 16 nt, Mycobacterium tuberculosis H37Rv
cguucgucaccacgau

SEQ ID NO: 1261871 - RNA, 16 nt, Mycobacterium tuberculosis H37Rv
cuaccugcacccaggc

SEQ ID NO: 1261872 - RNA, 17 nt, Mycobacterium tuberculosis H37Rv
cuaccguacgcagcgug

SEQ ID NO: 1261873 - RNA, 13 nt, Mycobacterium tuberculosis H37Rv
cuaccuaacccgc

SEQ ID NO: 1261874 - RNA, 15 nt, Mycobacterium tuberculosis H37Rv
cuacccgcgcgaccu

SEQ ID NO: 1261875 - RNA, 14 nt, Mycobacterium tuberculosis H37Rv
cuaccccggugaca

SEQ ID NO: 1261876 - RNA, 19 nt, Mycobacterium tuberculosis H37Rv
cuaccccacaagcgauggc

SEQ ID NO: 1261877 - RNA, 13 nt, Mycobacterium tuberculosis H37Rv
cuaccagcaccgg

SEQ ID NO: 1261878 - RNA, 13 nt, Mycobacterium tuberculosis H37Rv
cuaacucgccugc

SEQ ID NO: 1261879 - RNA, 17 nt, Mycobacterium tuberculosis H37Rv
cuagucguagacggcga

SEQ ID NO: 1261880 - RNA, 19 nt, Mycobacterium tuberculosis H37Rv
cuaguucgagcugccaggc

SEQ ID NO: 1261881 - RNA, 12 nt, Mycobacterium tuberculosis H37Rv
cuaguucggcgu

SEQ ID NO: 1261882 - RNA, 23 nt, Mycobacterium tuberculosis H37Rv
cuaucgaggaggcggucgaucag

SEQ ID NO: 1261883 - RNA, 21 nt, Mycobacterium tuberculosis H37Rv
cuaucccaggggcaccgagcu

SEQ ID NO: 1261884 - RNA, 22 nt, Mycobacterium tuberculosis H37Rv
cuaucgcuagccggcucaucgc

SEQ ID NO: 1261885 - RNA, 18 nt, Mycobacterium tuberculosis H37Rv
cuaugucauagcgcacca

SEQ ID NO: 1261886 - RNA, 16 nt, Mycobacterium tuberculosis H37Rv
cuaucggccgccggau

SEQ ID NO: 1261887 - RNA, 14 nt, Mycobacterium tuberculosis H37Rv
cuauggugccggug

SEQ ID NO: 1261888 - RNA, 21 nt, Mycobacterium tuberculosis H37Rv
cuaggaucggauggcggccac

SEQ ID NO: 1261889 - RNA, 15 nt, Mycobacterium tuberculosis H37Rv
cuaggaacgccaccc

SEQ ID NO: 1261890 - RNA, 19 nt, Mycobacterium tuberculosis H37Rv
cuacggcugcccguucugc

SEQ ID NO: 1261891 - RNA, 15 nt, Mycobacterium tuberculosis H37Rv
cuagcugcugaugcg

SEQ ID NO: 1261892 - RNA, 17 nt, Mycobacterium tuberculosis H37Rv
cuaguccggcacugcgg

SEQ ID NO: 1261893 - RNA, 21 nt, Mycobacterium tuberculosis H37Rv
cuagguucgcccagcccgaca

SEQ ID NO: 1261894 - RNA, 18 nt, Mycobacterium tuberculosis H37Rv
cuaggccagcacggcgac

SEQ ID NO: 1261895 - RNA, 19 nt, Mycobacterium tuberculosis H37Rv
cuaggccaccggcgaccga

SEQ ID NO: 1261896 - RNA, 22 nt, Mycobacterium tuberculosis H37Rv
cuacgccgggaauuucgacacg

SEQ ID NO: 1261897 - RNA, 16 nt, Mycobacterium tuberculosis H37Rv
cuacggccuggccacc

SEQ ID NO: 1261898 - RNA, 19 nt, Mycobacterium tuberculosis H37Rv
cucacgaagaccgcgucgg

SEQ ID NO: 1261899 - RNA, 21 nt, Mycobacterium tuberculosis H37Rv
cucaccuuuggccgcgaccgg

SEQ ID NO: 1261900 - RNA, 21 nt, Mycobacterium tuberculosis H37Rv
cucacgaggcacaaucaccgc

SEQ ID NO: 1261901 - RNA, 13 nt, Mycobacterium tuberculosis H37Rv
cucacgaucaccc

SEQ ID NO: 1261902 - RNA, 17 nt, Mycobacterium tuberculosis H37Rv
cucacgagcggcggugg

SEQ ID NO: 1261903 - RNA, 21 nt, Mycobacterium tuberculosis H37Rv
cucacgcaggaaaaccccggc

SEQ ID NO: 1261904 - RNA, 16 nt, Mycobacterium tuberculosis H37Rv
cucagcccggccagcc

SEQ ID NO: 1261905 - RNA, 14 nt, Mycobacterium tuberculosis H37Rv
cucagcgguagagc

SEQ ID NO: 1261906 - RNA, 13 nt, Mycobacterium tuberculosis H37Rv
cucagcugcucgu

SEQ ID NO: 1261907 - RNA, 17 nt, Mycobacterium tuberculosis H37Rv
cucaguucacguucggc

SEQ ID NO: 1261908 - RNA, 20 nt, Mycobacterium tuberculosis H37Rv
cucaggccgguaccgggacg

SEQ ID NO: 1261909 - RNA, 14 nt, Mycobacterium tuberculosis H37Rv
cucaggccgguacc

SEQ ID NO: 1261910 - RNA, 17 nt, Mycobacterium tuberculosis H37Rv
cucacccgggcagccug

SEQ ID NO: 1261911 - RNA, 22 nt, Mycobacterium tuberculosis H37Rv
cucacccugcucgaacgcugag

SEQ ID NO: 1261912 - RNA, 23 nt, Mycobacterium tuberculosis H37Rv
cucacccgccgcgguuaucgccg

SEQ ID NO: 1261913 - RNA, 13 nt, Mycobacterium tuberculosis H37Rv
cuccacguccggc

SEQ ID NO: 1261914 - RNA, 21 nt, Mycobacterium tuberculosis H37Rv
cuccacgucaucuggcgcugc

SEQ ID NO: 1261915 - RNA, 14 nt, Mycobacterium tuberculosis H37Rv
cuccacgccguuga

SEQ ID NO: 1261916 - RNA, 23 nt, Mycobacterium tuberculosis H37Rv
cuccagaaccgaagccucggcau

SEQ ID NO: 1261917 - RNA, 18 nt, Mycobacterium tuberculosis H37Rv
cuccagcaccaccggaac

SEQ ID NO: 1261918 - RNA, 15 nt, Mycobacterium tuberculosis H37Rv
cuccagcaccacggc

SEQ ID NO: 1261919 - RNA, 15 nt, Mycobacterium tuberculosis H37Rv
cuccagauucgccgc

SEQ ID NO: 1261920 - RNA, 13 nt, Mycobacterium tuberculosis H37Rv
cuccaggucgaca

SEQ ID NO: 1261921 - RNA, 17 nt, Mycobacterium tuberculosis H37Rv
cuccagcaccagcacgg

SEQ ID NO: 1261922 - RNA, 21 nt, Mycobacterium tuberculosis H37Rv
cuccagcaccagcacggcaac

SEQ ID NO: 1261923 - RNA, 18 nt, Mycobacterium tuberculosis H37Rv
cuccaucagcgcgaccga

SEQ ID NO: 1261924 - RNA, 18 nt, Mycobacterium tuberculosis H37Rv
cuccaucaaccgcgcugu

SEQ ID NO: 1261925 - RNA, 14 nt, Mycobacterium tuberculosis H37Rv
cuccaguucgccgu

SEQ ID NO: 1261926 - RNA, 22 nt, Mycobacterium tuberculosis H37Rv
cuccaguucgccguugucgucg

SEQ ID NO: 1261927 - RNA, 16 nt, Mycobacterium tuberculosis H37Rv
cuccaucagcgcgacc

SEQ ID NO: 1261928 - RNA, 18 nt, Mycobacterium tuberculosis H37Rv
cuccaucgucugguggca

SEQ ID NO: 1261929 - RNA, 19 nt, Mycobacterium tuberculosis H37Rv
cuccaugaaucgcgcuuca

SEQ ID NO: 1261930 - RNA, 16 nt, Mycobacterium tuberculosis H37Rv
cuccaaaccggagucg

SEQ ID NO: 1261931 - RNA, 20 nt, Mycobacterium tuberculosis H37Rv
cuccaaaccggagucgucgg

SEQ ID NO: 1261932 - RNA, 20 nt, Mycobacterium tuberculosis H37Rv
cuccaacaacuccagcaggu

SEQ ID NO: 1261933 - RNA, 21 nt, Mycobacterium tuberculosis H37Rv
cuccaaggcggucaccaccgu

SEQ ID NO: 1261934 - RNA, 14 nt, Mycobacterium tuberculosis H37Rv
cuccaagcucgaca

SEQ ID NO: 1261935 - RNA, 18 nt, Mycobacterium tuberculosis H37Rv
cuccacccccacgcugca

SEQ ID NO: 1261936 - RNA, 17 nt, Mycobacterium tuberculosis H37Rv
cuccaccaggacguggu

SEQ ID NO: 1261937 - RNA, 23 nt, Mycobacterium tuberculosis H37Rv
cuccacauacgcggcggccugag

SEQ ID NO: 1261938 - RNA, 23 nt, Mycobacterium tuberculosis H37Rv
cuccacgagguugggccgguuga

SEQ ID NO: 1261939 - RNA, 15 nt, Mycobacterium tuberculosis H37Rv
cuccaccgcgaugac

SEQ ID NO: 1261940 - RNA, 20 nt, Mycobacterium tuberculosis H37Rv
cugggcgauauuggacgcgc

SEQ ID NO: 1261941 - RNA, 18 nt, Mycobacterium tuberculosis H37Rv
cugggcgcccgcgguccg

SEQ ID NO: 1261942 - RNA, 21 nt, Mycobacterium tuberculosis H37Rv
cugggcgcccgcgguccggcg

SEQ ID NO: 1261943 - RNA, 20 nt, Mycobacterium tuberculosis H37Rv
cugggcgccgcgcucgacga

SEQ ID NO: 1261944 - RNA, 14 nt, Mycobacterium tuberculosis H37Rv
cugggcgcgcuggc

SEQ ID NO: 1261945 - RNA, 19 nt, Mycobacterium tuberculosis H37Rv
cugggcgcgcucaucgacc

SEQ ID NO: 1261946 - RNA, 17 nt, Mycobacterium tuberculosis H37Rv
cugggcgcgcucaucga

SEQ ID NO: 1261947 - RNA, 22 nt, Mycobacterium tuberculosis H37Rv
cugggcgcccgcgguccggcga

SEQ ID NO: 1261948 - RNA, 14 nt, Mycobacterium tuberculosis H37Rv
cugggggauaccgc

SEQ ID NO: 1261949 - RNA, 13 nt, Mycobacterium tuberculosis H37Rv
cugggguagccau

SEQ ID NO: 1261950 - RNA, 21 nt, Mycobacterium tuberculosis H37Rv
cuggggcgcccgagaccgggc

SEQ ID NO: 1261951 - RNA, 23 nt, Mycobacterium tuberculosis H37Rv
cugguagucgcccguggcgguga

SEQ ID NO: 1261952 - RNA, 14 nt, Mycobacterium tuberculosis H37Rv
cugguaggucaccg

SEQ ID NO: 1261953 - RNA, 14 nt, Mycobacterium tuberculosis H37Rv
cugguaggcgcuac

SEQ ID NO: 1261954 - RNA, 18 nt, Mycobacterium tuberculosis H37Rv
cugguaggcgcuaccugu

SEQ ID NO: 1261955 - RNA, 11 nt, Mycobacterium tuberculosis H37Rv
cugguccagca

SEQ ID NO: 1261956 - RNA, 16 nt, Mycobacterium tuberculosis H37Rv
cuggucccacaccucc

SEQ ID NO: 1261957 - RNA, 15 nt, Mycobacterium tuberculosis H37Rv
cuggucaagacccgc

SEQ ID NO: 1261958 - RNA, 22 nt, Mycobacterium tuberculosis H37Rv
cuggucagccgcggcggcagca

SEQ ID NO: 1261959 - RNA, 14 nt, Mycobacterium tuberculosis H37Rv
cuggcgcugcuggc

SEQ ID NO: 1261960 - RNA, 19 nt, Mycobacterium tuberculosis H37Rv
cuggcgcugaucgccucgg

SEQ ID NO: 1261961 - RNA, 20 nt, Mycobacterium tuberculosis H37Rv
cuggccguuguucuugucgg

SEQ ID NO: 1261962 - RNA, 18 nt, Mycobacterium tuberculosis H37Rv
cuggccgguucgcccgag

SEQ ID NO: 1261963 - RNA, 18 nt, Mycobacterium tuberculosis H37Rv
cuggcuaucugauccagc

SEQ ID NO: 1261964 - RNA, 20 nt, Mycobacterium tuberculosis H37Rv
cuggcugaacauuccggcac

SEQ ID NO: 1261965 - RNA, 18 nt, Mycobacterium tuberculosis H37Rv
cuggcgugucgccgccac

SEQ ID NO: 1261966 - RNA, 17 nt, Mycobacterium tuberculosis H37Rv
cuggcgucgucuucggu

SEQ ID NO: 1261967 - RNA, 19 nt, Mycobacterium tuberculosis H37Rv
cuggcgucgucuucgguua

SEQ ID NO: 1261968 - RNA, 17 nt, Mycobacterium tuberculosis H37Rv
cuggcgugucgccgcca

SEQ ID NO: 1261969 - RNA, 19 nt, Mycobacterium tuberculosis H37Rv
cuggcguuguugacgauca

SEQ ID NO: 1261970 - RNA, 22 nt, Mycobacterium tuberculosis H37Rv
cuggcguugcugaugucgccgg

SEQ ID NO: 1261971 - RNA, 13 nt, Mycobacterium tuberculosis H37Rv
cuggcguucccgc

SEQ ID NO: 1261972 - RNA, 22 nt, Mycobacterium tuberculosis H37Rv
cuggcguagugcucgccggcac

SEQ ID NO: 1261973 - RNA, 18 nt, Mycobacterium tuberculosis H37Rv
cuggcguagugcucgccg

SEQ ID NO: 1261974 - RNA, 14 nt, Mycobacterium tuberculosis H37Rv
cuggcggcgccgca

SEQ ID NO: 1261975 - RNA, 14 nt, Mycobacterium tuberculosis H37Rv
cuggcgucgaugcc

SEQ ID NO: 1261976 - RNA, 16 nt, Mycobacterium tuberculosis H37Rv
cuggcgugcagcagga

SEQ ID NO: 1261977 - RNA, 19 nt, Mycobacterium tuberculosis H37Rv
cuggccagguugccgucgg

SEQ ID NO: 1261978 - RNA, 14 nt, Mycobacterium tuberculosis H37Rv
cuggccaaccgggu

SEQ ID NO: 1261979 - RNA, 17 nt, Mycobacterium tuberculosis H37Rv
cuggcaaaguaucgcag

SEQ ID NO: 1261980 - RNA, 13 nt, Mycobacterium tuberculosis H37Rv
cuggaccaccgcc

SEQ ID NO: 1261981 - RNA, 20 nt, Mycobacterium tuberculosis H37Rv
cuggaccgggucgggcaccg

SEQ ID NO: 1261982 - RNA, 19 nt, Mycobacterium tuberculosis H37Rv
cuggcacccggggugcccg

SEQ ID NO: 1261983 - RNA, 18 nt, Mycobacterium tuberculosis H37Rv
cuggcaacgccgcgccgu

SEQ ID NO: 1261984 - RNA, 13 nt, Mycobacterium tuberculosis H37Rv
cuggcaacgacac

SEQ ID NO: 1261985 - RNA, 20 nt, Mycobacterium tuberculosis H37Rv
cuggcaaguccggucgcgga

SEQ ID NO: 1261986 - RNA, 15 nt, Mycobacterium tuberculosis H37Rv
cuggccgcccggcga

SEQ ID NO: 1261987 - RNA, 21 nt, Mycobacterium tuberculosis H37Rv
cuggccgauguaguccggcca

SEQ ID NO: 1261988 - RNA, 19 nt, Mycobacterium tuberculosis H37Rv
cuggcccccacaccacgcu

SEQ ID NO: 1261989 - RNA, 20 nt, Mycobacterium tuberculosis H37Rv
cuggcccaccuccucgccgg

SEQ ID NO: 1261990 - RNA, 18 nt, Mycobacterium tuberculosis H37Rv
cuggcccaauugcgccga

SEQ ID NO: 1261991 - RNA, 19 nt, Mycobacterium tuberculosis H37Rv
cuggccaucgagggcaucg

SEQ ID NO: 1261992 - RNA, 20 nt, Mycobacterium tuberculosis H37Rv
cuggccaugguggcgccgac

SEQ ID NO: 1261993 - RNA, 14 nt, Mycobacterium tuberculosis H37Rv
cugcuggaucucgg

SEQ ID NO: 1261994 - RNA, 14 nt, Mycobacterium tuberculosis H37Rv
cugcugcucggccu

SEQ ID NO: 1261995 - RNA, 16 nt, Mycobacterium tuberculosis H37Rv
cugcuggccgcggccu

SEQ ID NO: 1261996 - RNA, 21 nt, Mycobacterium tuberculosis H37Rv
cugcugucgauuucgccgucg

SEQ ID NO: 1261997 - RNA, 16 nt, Mycobacterium tuberculosis H37Rv
cugcugguaccgggcu

SEQ ID NO: 1261998 - RNA, 16 nt, Mycobacterium tuberculosis H37Rv
cuggaagcggcgacua

SEQ ID NO: 1261999 - RNA, 16 nt, Mycobacterium tuberculosis H37Rv
cuggaacgugaugcgg

SEQ ID NO: 1262000 - RNA, 17 nt, Mycobacterium tuberculosis H37Rv
cuggacaaccucgucga

SEQ ID NO: 1262001 - RNA, 19 nt, Mycobacterium tuberculosis H37Rv
cugcgcucgggcugccgca

SEQ ID NO: 1262002 - RNA, 20 nt, Mycobacterium tuberculosis H37Rv
cugcggacaagucggcaccg

SEQ ID NO: 1262003 - RNA, 20 nt, Mycobacterium tuberculosis H37Rv
cugcggccacgccgaugcgg

SEQ ID NO: 1262004 - RNA, 13 nt, Mycobacterium tuberculosis H37Rv
cugcggcagcgga

SEQ ID NO: 1262005 - RNA, 14 nt, Mycobacterium tuberculosis H37Rv
cugcggcagcgcgg

SEQ ID NO: 1262006 - RNA, 20 nt, Mycobacterium tuberculosis H37Rv
cugcggcaguaccccucgca

SEQ ID NO: 1262007 - RNA, 14 nt, Mycobacterium tuberculosis H37Rv
cugcggcaccggcu

SEQ ID NO: 1262008 - RNA, 11 nt, Mycobacterium tuberculosis H37Rv
cugcggcaccg

SEQ ID NO: 1262009 - RNA, 14 nt, Mycobacterium tuberculosis H37Rv
cugcggcgaucugg

SEQ ID NO: 1262010 - RNA, 18 nt, Mycobacterium tuberculosis H37Rv
cugcggcccaugaucucg

SEQ ID NO: 1262011 - RNA, 23 nt, Mycobacterium tuberculosis H37Rv
cugcggcccacaccagcgcagca

SEQ ID NO: 1262012 - RNA, 20 nt, Mycobacterium tuberculosis H37Rv
cugcggcccacaccagcgca

SEQ ID NO: 1262013 - RNA, 15 nt, Mycobacterium tuberculosis H37Rv
cugcgcgaagccacc

SEQ ID NO: 1262014 - RNA, 16 nt, Mycobacterium tuberculosis H37Rv
cugcgcgaagccacca

SEQ ID NO: 1262015 - RNA, 15 nt, Mycobacterium tuberculosis H37Rv
cugcgcgaugcgauu

SEQ ID NO: 1262016 - RNA, 14 nt, Mycobacterium tuberculosis H37Rv
cugcgcgaugcgau

SEQ ID NO: 1262017 - RNA, 13 nt, Mycobacterium tuberculosis H37Rv
cugcgcgccagac

SEQ ID NO: 1262018 - RNA, 23 nt, Mycobacterium tuberculosis H37Rv
cugcgcggcuucgucgacaucgc

SEQ ID NO: 1262019 - RNA, 17 nt, Mycobacterium tuberculosis H37Rv
cugcgcggcuugucgcg

SEQ ID NO: 1262020 - RNA, 19 nt, Mycobacterium tuberculosis H37Rv
cugcgcggcuucgucgaca

SEQ ID NO: 1262021 - RNA, 15 nt, Mycobacterium tuberculosis H37Rv
cugcgcggcgcgggu

SEQ ID NO: 1262022 - RNA, 17 nt, Mycobacterium tuberculosis H37Rv
cugcgcgucgagcagca

SEQ ID NO: 1262023 - RNA, 22 nt, Mycobacterium tuberculosis H37Rv
cugcgcggugccggccguucgu

SEQ ID NO: 1262024 - RNA, 17 nt, Mycobacterium tuberculosis H37Rv
cugcgcaacaccaucag

SEQ ID NO: 1262025 - RNA, 18 nt, Mycobacterium tuberculosis H37Rv
cugcgaugcugaucaccg

SEQ ID NO: 1262026 - RNA, 18 nt, Mycobacterium tuberculosis H37Rv
cugcgcagccgccucaau

SEQ ID NO: 1262027 - RNA, 14 nt, Mycobacterium tuberculosis H37Rv
cugcgcaucgccac

SEQ ID NO: 1262028 - RNA, 17 nt, Mycobacterium tuberculosis H37Rv
cugcgccaaaauccgcc

SEQ ID NO: 1262029 - RNA, 20 nt, Mycobacterium tuberculosis H37Rv
cugcgcaccugggucgacga

SEQ ID NO: 1262030 - RNA, 19 nt, Mycobacterium tuberculosis H37Rv
cugcgcaccgccgcgcgac

SEQ ID NO: 1262031 - RNA, 22 nt, Mycobacterium tuberculosis H37Rv
cugcgcaccgccgcgcgacagg

SEQ ID NO: 1262032 - RNA, 18 nt, Mycobacterium tuberculosis H37Rv
cugcgcagcgcaacaucg

SEQ ID NO: 1262033 - RNA, 22 nt, Mycobacterium tuberculosis H37Rv
cugcgcagcgccugcggcagca

SEQ ID NO: 1262034 - RNA, 14 nt, Mycobacterium tuberculosis H37Rv
cugcgcagcggcau

SEQ ID NO: 1262035 - RNA, 23 nt, Mycobacterium tuberculosis H37Rv
cugcgccguucgcucccccgcua

SEQ ID NO: 1262036 - RNA, 17 nt, Mycobacterium tuberculosis H37Rv
cugcgccuucgccagcg

SEQ ID NO: 1262037 - RNA, 15 nt, Mycobacterium tuberculosis H37Rv
cugcgccuucgccag

SEQ ID NO: 1262038 - RNA, 14 nt, Mycobacterium tuberculosis H37Rv
cugcgccguucgcu

SEQ ID NO: 1262039 - RNA, 20 nt, Mycobacterium tuberculosis H37Rv
cugcgccgccacagcaccca

SEQ ID NO: 1262040 - RNA, 21 nt, Mycobacterium tuberculosis H37Rv
cugcgccgcccgcgccaccga

SEQ ID NO: 1262041 - RNA, 16 nt, Mycobacterium tuberculosis H37Rv
cugcgccgggcucgcg

SEQ ID NO: 1262042 - RNA, 21 nt, Mycobacterium tuberculosis H37Rv
cugcgccgggcucgcgaucgu

SEQ ID NO: 1262043 - RNA, 14 nt, Mycobacterium tuberculosis H37Rv
cugcgccagcaaca

SEQ ID NO: 1262044 - RNA, 17 nt, Mycobacterium tuberculosis H37Rv
cugcgccagaaucccgc

SEQ ID NO: 1262045 - RNA, 15 nt, Mycobacterium tuberculosis H37Rv
cugcgccaggcggca

SEQ ID NO: 1262046 - RNA, 14 nt, Mycobacterium tuberculosis H37Rv
cugcgccaggcggc

SEQ ID NO: 1262047 - RNA, 22 nt, Mycobacterium tuberculosis H37Rv
cugcgccaggaauugcccugac

SEQ ID NO: 1262048 - RNA, 23 nt, Mycobacterium tuberculosis H37Rv
cugcgccaguaggcuucgaccgu

SEQ ID NO: 1262049 - RNA, 13 nt, Mycobacterium tuberculosis H37Rv
cugcgccaucaca

SEQ ID NO: 1262050 - RNA, 14 nt, Mycobacterium tuberculosis H37Rv
cugcgcccguccgc

SEQ ID NO: 1262051 - RNA, 17 nt, Mycobacterium tuberculosis H37Rv
cugcgcccguccgcgcg

SEQ ID NO: 1262052 - RNA, 20 nt, Mycobacterium tuberculosis H37Rv
cugcucauccaccucgaugg

SEQ ID NO: 1262053 - RNA, 13 nt, Mycobacterium tuberculosis H37Rv
cugcucagggcgc

SEQ ID NO: 1262054 - RNA, 22 nt, Mycobacterium tuberculosis H37Rv
cugcucgaaaucgcacagcgca

SEQ ID NO: 1262055 - RNA, 17 nt, Mycobacterium tuberculosis H37Rv
cugcucgaacgcugagg

SEQ ID NO: 1262056 - RNA, 14 nt, Mycobacterium tuberculosis H37Rv
cugcucgcacagca

SEQ ID NO: 1262057 - RNA, 18 nt, Mycobacterium tuberculosis H37Rv
cugcucgcccuauacgca

SEQ ID NO: 1262058 - RNA, 16 nt, Mycobacterium tuberculosis H37Rv
cugcucgccgucucgg

SEQ ID NO: 1262059 - RNA, 12 nt, Mycobacterium tuberculosis H37Rv
cugcucggcgua

SEQ ID NO: 1262060 - RNA, 23 nt, Mycobacterium tuberculosis H37Rv
cugcucgcgguaguuaacccagg

SEQ ID NO: 1262061 - RNA, 16 nt, Mycobacterium tuberculosis H37Rv
cugcucggauccggcc

SEQ ID NO: 1262062 - RNA, 12 nt, Mycobacterium tuberculosis H37Rv
cugcugcagcaa

SEQ ID NO: 1262063 - RNA, 17 nt, Mycobacterium tuberculosis H37Rv
cugcugagcugcucgcc

SEQ ID NO: 1262064 - RNA, 23 nt, Mycobacterium tuberculosis H37Rv
cugcugcauguuaugggugacga

SEQ ID NO: 1262065 - RNA, 20 nt, Mycobacterium tuberculosis H37Rv
cugcugccagccgaagccga

SEQ ID NO: 1262066 - RNA, 13 nt, Mycobacterium tuberculosis H37Rv
cugcugcggccag

SEQ ID NO: 1262067 - RNA, 17 nt, Mycobacterium tuberculosis H37Rv
cugcugaaucacaccau

SEQ ID NO: 1262068 - RNA, 14 nt, Mycobacterium tuberculosis H37Rv
cugcucgucggcca

SEQ ID NO: 1262069 - RNA, 18 nt, Mycobacterium tuberculosis H37Rv
cugcugaccaugaccggg

SEQ ID NO: 1262070 - RNA, 12 nt, Mycobacterium tuberculosis H37Rv
cugcucggcgcu

SEQ ID NO: 1262071 - RNA, 18 nt, Mycobacterium tuberculosis H37Rv
cugcucgucgagccgacc

SEQ ID NO: 1262072 - RNA, 15 nt, Mycobacterium tuberculosis H37Rv
cugcggguucgccga

SEQ ID NO: 1262073 - RNA, 14 nt, Mycobacterium tuberculosis H37Rv
cugcggucgcccag

SEQ ID NO: 1262074 - RNA, 18 nt, Mycobacterium tuberculosis H37Rv
cugcggucaucgccucgg

SEQ ID NO: 1262075 - RNA, 16 nt, Mycobacterium tuberculosis H37Rv
cugcgguugaguugca

SEQ ID NO: 1262076 - RNA, 21 nt, Mycobacterium tuberculosis H37Rv
cugcggggugagugaccacgc

SEQ ID NO: 1262077 - RNA, 15 nt, Mycobacterium tuberculosis H37Rv
cugcgggucggccau

SEQ ID NO: 1262078 - RNA, 17 nt, Mycobacterium tuberculosis H37Rv
cugcgggucagcgccga

SEQ ID NO: 1262079 - RNA, 17 nt, Mycobacterium tuberculosis H37Rv
cugcgggucucgccgac

SEQ ID NO: 1262080 - RNA, 19 nt, Mycobacterium tuberculosis H37Rv
cugcggcuuggccaucacg

SEQ ID NO: 1262081 - RNA, 14 nt, Mycobacterium tuberculosis H37Rv
cugcgggacgucgu

SEQ ID NO: 1262082 - RNA, 16 nt, Mycobacterium tuberculosis H37Rv
cugcggcgucguucga

SEQ ID NO: 1262083 - RNA, 12 nt, Mycobacterium tuberculosis H37Rv
cugcggcucgcu

SEQ ID NO: 1262084 - RNA, 21 nt, Mycobacterium tuberculosis H37Rv
cugcggcgcccggucgagcca

SEQ ID NO: 1262085 - RNA, 13 nt, Mycobacterium tuberculosis H37Rv
cugcggcggccau

SEQ ID NO: 1262086 - RNA, 18 nt, Mycobacterium tuberculosis H37Rv
cugcguccaccggacggg

SEQ ID NO: 1262087 - RNA, 14 nt, Mycobacterium tuberculosis H37Rv
cugcguccaccgga

SEQ ID NO: 1262088 - RNA, 15 nt, Mycobacterium tuberculosis H37Rv
cugcgucucgaugag

SEQ ID NO: 1262089 - RNA, 14 nt, Mycobacterium tuberculosis H37Rv
cugcgucgucugca

SEQ ID NO: 1262090 - RNA, 23 nt, Mycobacterium tuberculosis H37Rv
cugcgucugcucgcgcagggauc

SEQ ID NO: 1262091 - RNA, 16 nt, Mycobacterium tuberculosis H37Rv
cugcgucugcucgcga

SEQ ID NO: 1262092 - RNA, 16 nt, Mycobacterium tuberculosis H37Rv
cugcgucugcucgccg

SEQ ID NO: 1262093 - RNA, 18 nt, Mycobacterium tuberculosis H37Rv
cugcgucugcucggcgcu

SEQ ID NO: 1262094 - RNA, 14 nt, Mycobacterium tuberculosis H37Rv
cugcucacgcgguc

SEQ ID NO: 1262095 - RNA, 15 nt, Mycobacterium tuberculosis H37Rv
cugcucagccguucg

SEQ ID NO: 1262096 - RNA, 13 nt, Mycobacterium tuberculosis H37Rv
cugcguucgccgg

SEQ ID NO: 1262097 - RNA, 14 nt, Mycobacterium tuberculosis H37Rv
cugcguugacguca

SEQ ID NO: 1262098 - RNA, 22 nt, Mycobacterium tuberculosis H37Rv
cugcguuggaauguccggcagc

SEQ ID NO: 1262099 - RNA, 14 nt, Mycobacterium tuberculosis H37Rv
cugcgucucgauga

SEQ ID NO: 1262100 - RNA, 18 nt, Mycobacterium tuberculosis H37Rv
cugugucccgucgaugug

SEQ ID NO: 1262101 - RNA, 16 nt, Mycobacterium tuberculosis H37Rv
cugugguaggccggug

SEQ ID NO: 1262102 - RNA, 12 nt, Mycobacterium tuberculosis H37Rv
cuguggcgcgca

SEQ ID NO: 1262103 - RNA, 15 nt, Mycobacterium tuberculosis H37Rv
cuguggccgcgucgc

SEQ ID NO: 1262104 - RNA, 20 nt, Mycobacterium tuberculosis H37Rv
cuguggcgccgccggcaccg

SEQ ID NO: 1262105 - RNA, 14 nt, Mycobacterium tuberculosis H37Rv
cuguggaugccgac

SEQ ID NO: 1262106 - RNA, 22 nt, Mycobacterium tuberculosis H37Rv
cugugaaucugacgacgcgaca

SEQ ID NO: 1262107 - RNA, 14 nt, Mycobacterium tuberculosis H37Rv
cugugcuauggccg

SEQ ID NO: 1262108 - RNA, 14 nt, Mycobacterium tuberculosis H37Rv
cugucguccccgga

SEQ ID NO: 1262109 - RNA, 22 nt, Mycobacterium tuberculosis H37Rv
cugucgagguggucgacccggc

SEQ ID NO: 1262110 - RNA, 16 nt, Mycobacterium tuberculosis H37Rv
cuguccggcauaccga

SEQ ID NO: 1262111 - RNA, 23 nt, Mycobacterium tuberculosis H37Rv
cuguccgggcuguuggccaccaa

SEQ ID NO: 1262112 - RNA, 17 nt, Mycobacterium tuberculosis H37Rv
cugucagcgauccucgc

SEQ ID NO: 1262113 - RNA, 19 nt, Mycobacterium tuberculosis H37Rv
cugucacgccugccaccgg

SEQ ID NO: 1262114 - RNA, 17 nt, Mycobacterium tuberculosis H37Rv
cuggucgaccggcguug

SEQ ID NO: 1262115 - RNA, 13 nt, Mycobacterium tuberculosis H37Rv
cuggucgaaacgg

SEQ ID NO: 1262116 - RNA, 17 nt, Mycobacterium tuberculosis H37Rv
cuguuguugucgguguc

SEQ ID NO: 1262117 - RNA, 24 nt, Mycobacterium tuberculosis H37Rv
cuguuguugccccggucggcgacg

SEQ ID NO: 1262118 - RNA, 17 nt, Mycobacterium tuberculosis H37Rv
cuguuggugccgccacc

SEQ ID NO: 1262119 - RNA, 15 nt, Mycobacterium tuberculosis H37Rv
cuguugucguccaac

SEQ ID NO: 1262120 - RNA, 15 nt, Mycobacterium tuberculosis H37Rv
cuguuguacggccca

SEQ ID NO: 1262121 - RNA, 18 nt, Mycobacterium tuberculosis H37Rv
cuguuggugccgccacca

SEQ ID NO: 1262122 - RNA, 22 nt, Mycobacterium tuberculosis H37Rv
cuucaacuuacgcgacgccguc

SEQ ID NO: 1262123 - RNA, 17 nt, Mycobacterium tuberculosis H37Rv
cuuaucgucgacgccga

SEQ ID NO: 1262124 - RNA, 14 nt, Mycobacterium tuberculosis H37Rv
cuuaugcgcgguga

SEQ ID NO: 1262125 - RNA, 21 nt, Mycobacterium tuberculosis H37Rv
cuuaucgaacgucucggccag

SEQ ID NO: 1262126 - RNA, 18 nt, Mycobacterium tuberculosis H37Rv
cuuacuugaucucggcga

SEQ ID NO: 1262127 - RNA, 23 nt, Mycobacterium tuberculosis H37Rv
cuuacuugaucucggcgagcacc

SEQ ID NO: 1262128 - RNA, 20 nt, Mycobacterium tuberculosis H37Rv
cuucggugucgccgaacacc

SEQ ID NO: 1262129 - RNA, 14 nt, Mycobacterium tuberculosis H37Rv
cuucgguguggcac

SEQ ID NO: 1262130 - RNA, 20 nt, Mycobacterium tuberculosis H37Rv
cuucucagcaccaugcucgg

SEQ ID NO: 1262131 - RNA, 20 nt, Mycobacterium tuberculosis H37Rv
cuucuccaccagcguggacg

SEQ ID NO: 1262132 - RNA, 17 nt, Mycobacterium tuberculosis H37Rv
cuucgggguaaccggcg

SEQ ID NO: 1262133 - RNA, 18 nt, Mycobacterium tuberculosis H37Rv
cuucgggcucguccagca

SEQ ID NO: 1262134 - RNA, 23 nt, Mycobacterium tuberculosis H37Rv
cuucgguggcgggcuugccgucu

SEQ ID NO: 1262135 - RNA, 17 nt, Mycobacterium tuberculosis H37Rv
cuucugcgucugcucgc

SEQ ID NO: 1262136 - RNA, 16 nt, Mycobacterium tuberculosis H37Rv
cuucugccuuggccgg

SEQ ID NO: 1262137 - RNA, 14 nt, Mycobacterium tuberculosis H37Rv
cuucugccugcgca

SEQ ID NO: 1262138 - RNA, 18 nt, Mycobacterium tuberculosis H37Rv
cuucucguaacgcggcac

SEQ ID NO: 1262139 - RNA, 16 nt, Mycobacterium tuberculosis H37Rv
cuucuuguuggcagcg

SEQ ID NO: 1262140 - RNA, 21 nt, Mycobacterium tuberculosis H37Rv
cuucuucggucaccucgaugc

SEQ ID NO: 1262141 - RNA, 13 nt, Mycobacterium tuberculosis H37Rv
cuucgccagcggc

SEQ ID NO: 1262142 - RNA, 19 nt, Mycobacterium tuberculosis H37Rv
cuuccggggugacaucgcg

SEQ ID NO: 1262143 - RNA, 16 nt, Mycobacterium tuberculosis H37Rv
cuuccgguucaucggc

SEQ ID NO: 1262144 - RNA, 14 nt, Mycobacterium tuberculosis H37Rv
cuuccggcgcgacc

SEQ ID NO: 1262145 - RNA, 14 nt, Mycobacterium tuberculosis H37Rv
cuucccgucgacga

SEQ ID NO: 1262146 - RNA, 16 nt, Mycobacterium tuberculosis H37Rv
cuuccgacgaccaggu

SEQ ID NO: 1262147 - RNA, 13 nt, Mycobacterium tuberculosis H37Rv
cuucaccacccug

SEQ ID NO: 1262148 - RNA, 15 nt, Mycobacterium tuberculosis H37Rv
cuucacccaacggug

SEQ ID NO: 1262149 - RNA, 15 nt, Mycobacterium tuberculosis H37Rv
cuucaccacgccgua

SEQ ID NO: 1262150 - RNA, 17 nt, Mycobacterium tuberculosis H37Rv
cuucccauuucggcaaa

SEQ ID NO: 1262151 - RNA, 21 nt, Mycobacterium tuberculosis H37Rv
cuucccaguagaucgccucga

SEQ ID NO: 1262152 - RNA, 16 nt, Mycobacterium tuberculosis H37Rv
cuugcagcgcguucgg

SEQ ID NO: 1262153 - RNA, 17 nt, Mycobacterium tuberculosis H37Rv
cuugcaaggucgcugcu

SEQ ID NO: 1262154 - RNA, 20 nt, Mycobacterium tuberculosis H37Rv
cuugccaccgcugccggcac

SEQ ID NO: 1262155 - RNA, 13 nt, Mycobacterium tuberculosis H37Rv
cuugaugccgcac

SEQ ID NO: 1262156 - RNA, 19 nt, Mycobacterium tuberculosis H37Rv
cuugacagcuuucuuggcg

SEQ ID NO: 1262157 - RNA, 17 nt, Mycobacterium tuberculosis H37Rv
cuugaccacagaaccgg

SEQ ID NO: 1262158 - RNA, 17 nt, Mycobacterium tuberculosis H37Rv
cuugaccgcugcccagu

SEQ ID NO: 1262159 - RNA, 21 nt, Mycobacterium tuberculosis H37Rv
cuugaccgggucgaugacgcc

SEQ ID NO: 1262160 - RNA, 22 nt, Mycobacterium tuberculosis H37Rv
cuugagcuccucacggauccgc

SEQ ID NO: 1262161 - RNA, 17 nt, Mycobacterium tuberculosis H37Rv
cuugagcacuccgucgu

SEQ ID NO: 1262162 - RNA, 14 nt, Mycobacterium tuberculosis H37Rv
cuuggcgaccaugc

SEQ ID NO: 1262163 - RNA, 14 nt, Mycobacterium tuberculosis H37Rv
cuuggcgacgucgg

SEQ ID NO: 1262164 - RNA, 19 nt, Mycobacterium tuberculosis H37Rv
cuuggccuucugaagucua

SEQ ID NO: 1262165 - RNA, 16 nt, Mycobacterium tuberculosis H37Rv
cuuggcgaucucaccu

SEQ ID NO: 1262166 - RNA, 19 nt, Mycobacterium tuberculosis H37Rv
cuuggcgccgaugccggcc

SEQ ID NO: 1262167 - RNA, 18 nt, Mycobacterium tuberculosis H37Rv
cuuggcgcggcacccggu

SEQ ID NO: 1262168 - RNA, 15 nt, Mycobacterium tuberculosis H37Rv
cuuggcgggaucgag

SEQ ID NO: 1262169 - RNA, 16 nt, Mycobacterium tuberculosis H37Rv
cuuggcgggaccguga

SEQ ID NO: 1262170 - RNA, 22 nt, Mycobacterium tuberculosis H37Rv
cuuggcugugauguuguucagc

SEQ ID NO: 1262171 - RNA, 23 nt, Mycobacterium tuberculosis H37Rv
cuuggcgucgacaucggugacgg

SEQ ID NO: 1262172 - RNA, 17 nt, Mycobacterium tuberculosis H37Rv
cuugggucggucacgac

SEQ ID NO: 1262173 - RNA, 21 nt, Mycobacterium tuberculosis H37Rv
cuugggcggcacuggauccgg

SEQ ID NO: 1262174 - RNA, 22 nt, Mycobacterium tuberculosis H37Rv
cuugggcgacgcggcgccgcca

SEQ ID NO: 1262175 - RNA, 18 nt, Mycobacterium tuberculosis H37Rv
cuuggguugauuggcccc

SEQ ID NO: 1262176 - RNA, 21 nt, Mycobacterium tuberculosis H37Rv
cuugcgugaugguugcucgag

SEQ ID NO: 1262177 - RNA, 19 nt, Mycobacterium tuberculosis H37Rv
cuuggacccugcgccgcca

SEQ ID NO: 1262178 - RNA, 17 nt, Mycobacterium tuberculosis H37Rv
cuugcgucaucggcuca

SEQ ID NO: 1262179 - RNA, 23 nt, Mycobacterium tuberculosis H37Rv
cuuggacgugguguaucgacggc

SEQ ID NO: 1262180 - RNA, 16 nt, Mycobacterium tuberculosis H37Rv
cuuggacucaucggcg

SEQ ID NO: 1262181 - RNA, 19 nt, Mycobacterium tuberculosis H37Rv
cuugcgguccaggccggca

SEQ ID NO: 1262182 - RNA, 21 nt, Mycobacterium tuberculosis H37Rv
cuugcggcgugaugucuacca

SEQ ID NO: 1262183 - RNA, 13 nt, Mycobacterium tuberculosis H37Rv
cuugccgauuccg

SEQ ID NO: 1262184 - RNA, 21 nt, Mycobacterium tuberculosis H37Rv
cuuucggaugcaacccgguga

SEQ ID NO: 1262185 - RNA, 19 nt, Mycobacterium tuberculosis H37Rv
cuuucuuggcgggcgccuu

SEQ ID NO: 1262186 - RNA, 19 nt, Mycobacterium tuberculosis H37Rv
cuuugacgcccucggcgac

SEQ ID NO: 1262187 - RNA, 20 nt, Mycobacterium tuberculosis H37Rv
cuuugaucgcccgguucagc

SEQ ID NO: 1262188 - RNA, 16 nt, Mycobacterium tuberculosis H37Rv
cuuugcacagcggcau

SEQ ID NO: 1262189 - RNA, 17 nt, Mycobacterium tuberculosis H37Rv
cuuugccgccggcaccg

SEQ ID NO: 1262190 - RNA, 15 nt, Mycobacterium tuberculosis H37Rv
cuuugcucucggucu

SEQ ID NO: 1262191 - RNA, 14 nt, Mycobacterium tuberculosis H37Rv
cuuugcuugccgca

SEQ ID NO: 1262192 - RNA, 13 nt, Mycobacterium tuberculosis H37Rv
cuuucagcgcuuc

SEQ ID NO: 1262193 - RNA, 16 nt, Mycobacterium tuberculosis H37Rv
cuuguagcgcaucgcc

SEQ ID NO: 1262194 - RNA, 11 nt, Mycobacterium tuberculosis H37Rv
gaaaccgccgu

SEQ ID NO: 1262195 - RNA, 17 nt, Mycobacterium tuberculosis H37Rv
gaaacccaugcaugcgu

SEQ ID NO: 1262196 - RNA, 15 nt, Mycobacterium tuberculosis H37Rv
gaaaccggucagcac

SEQ ID NO: 1262197 - RNA, 15 nt, Mycobacterium tuberculosis H37Rv
gaaaagcgccucggu

SEQ ID NO: 1262198 - RNA, 13 nt, Mycobacterium tuberculosis H37Rv
gaaaaagcccgac

SEQ ID NO: 1262199 - RNA, 20 nt, Mycobacterium tuberculosis H37Rv
gaaaaagaccgacagcggca

SEQ ID NO: 1262200 - RNA, 22 nt, Mycobacterium tuberculosis H37Rv
gaaaaagaccgacagcggcacc

SEQ ID NO: 1262201 - RNA, 23 nt, Mycobacterium tuberculosis H37Rv
cuuugguacccagcgcggccacc

SEQ ID NO: 1262202 - RNA, 15 nt, Mycobacterium tuberculosis H37Rv
gaaaaaccucgacgc

SEQ ID NO: 1262203 - RNA, 16 nt, Mycobacterium tuberculosis H37Rv
gaccgccgcgagcaga

SEQ ID NO: 1262204 - RNA, 21 nt, Mycobacterium tuberculosis H37Rv
gaccgccgccgacaaucacca

SEQ ID NO: 1262205 - RNA, 13 nt, Mycobacterium tuberculosis H37Rv
gaccgccucgccg

SEQ ID NO: 1262206 - RNA, 13 nt, Mycobacterium tuberculosis H37Rv
gaccgccuccucg

SEQ ID NO: 1262207 - RNA, 23 nt, Mycobacterium tuberculosis H37Rv
gaccgcgacggcgccggcaucgg

SEQ ID NO: 1262208 - RNA, 19 nt, Mycobacterium tuberculosis H37Rv
gaccgcguagagcagcaga

SEQ ID NO: 1262209 - RNA, 18 nt, Mycobacterium tuberculosis H37Rv
gaccgcguagagcagcag

SEQ ID NO: 1262210 - RNA, 17 nt, Mycobacterium tuberculosis H37Rv
gaccgcgccgaucacca

SEQ ID NO: 1262211 - RNA, 15 nt, Mycobacterium tuberculosis H37Rv
gaccgcgccgcauca

SEQ ID NO: 1262212 - RNA, 19 nt, Mycobacterium tuberculosis H37Rv
gaccgcggugacucggccu

SEQ ID NO: 1262213 - RNA, 16 nt, Mycobacterium tuberculosis H37Rv
gaccgcgguggccaga

SEQ ID NO: 1262214 - RNA, 16 nt, Mycobacterium tuberculosis H37Rv
gaccgcgccgaucacc

SEQ ID NO: 1262215 - RNA, 19 nt, Mycobacterium tuberculosis H37Rv
gaccgcgagggccagcaag

SEQ ID NO: 1262216 - RNA, 16 nt, Mycobacterium tuberculosis H37Rv
gaccgcgaucgccgac

SEQ ID NO: 1262217 - RNA, 15 nt, Mycobacterium tuberculosis H37Rv
gaccgccagcccggu

SEQ ID NO: 1262218 - RNA, 19 nt, Mycobacterium tuberculosis H37Rv
gaccgccagggcuugccgg

SEQ ID NO: 1262219 - RNA, 16 nt, Mycobacterium tuberculosis H37Rv
gaccgccgaucggcca

SEQ ID NO: 1262220 - RNA, 16 nt, Mycobacterium tuberculosis H37Rv
gaccgcccgccagcga

SEQ ID NO: 1262221 - RNA, 19 nt, Mycobacterium tuberculosis H37Rv
gaccgcccgagucucgucg

SEQ ID NO: 1262222 - RNA, 15 nt, Mycobacterium tuberculosis H37Rv
gaccgcccgugccgu

SEQ ID NO: 1262223 - RNA, 14 nt, Mycobacterium tuberculosis H37Rv
gacccuccgcaucg

SEQ ID NO: 1262224 - RNA, 21 nt, Mycobacterium tuberculosis H37Rv
gacccuccgcaucgcggcgac

SEQ ID NO: 1262225 - RNA, 21 nt, Mycobacterium tuberculosis H37Rv
gacccugaugaucguccagcc

SEQ ID NO: 1262226 - RNA, 23 nt, Mycobacterium tuberculosis H37Rv
gaccgaacaacagcggcaacgcc

SEQ ID NO: 1262227 - RNA, 15 nt, Mycobacterium tuberculosis H37Rv
gaccgaaccgucagc

SEQ ID NO: 1262228 - RNA, 21 nt, Mycobacterium tuberculosis H37Rv
gaccgccaccgccagcgucga

SEQ ID NO: 1262229 - RNA, 14 nt, Mycobacterium tuberculosis H37Rv
gaccgaaagccgca

SEQ ID NO: 1262230 - RNA, 22 nt, Mycobacterium tuberculosis H37Rv
gacccugggguugcaucaugcc

SEQ ID NO: 1262231 - RNA, 15 nt, Mycobacterium tuberculosis H37Rv
gacccgcugccaccc

SEQ ID NO: 1262232 - RNA, 18 nt, Mycobacterium tuberculosis H37Rv
gacccgcuggcucaucga

SEQ ID NO: 1262233 - RNA, 17 nt, Mycobacterium tuberculosis H37Rv
gacccgcgcgucgccca

SEQ ID NO: 1262234 - RNA, 15 nt, Mycobacterium tuberculosis H37Rv
gacccgcgcgucgcc

SEQ ID NO: 1262235 - RNA, 12 nt, Mycobacterium tuberculosis H37Rv
gacccgcgguag

SEQ ID NO: 1262236 - RNA, 17 nt, Mycobacterium tuberculosis H37Rv
gacccgggucggcacga

SEQ ID NO: 1262237 - RNA, 15 nt, Mycobacterium tuberculosis H37Rv
gacccggguggucga

SEQ ID NO: 1262238 - RNA, 13 nt, Mycobacterium tuberculosis H37Rv
gacccgcuucgcc

SEQ ID NO: 1262239 - RNA, 17 nt, Mycobacterium tuberculosis H37Rv
gacccggugacccgcug

SEQ ID NO: 1262240 - RNA, 13 nt, Mycobacterium tuberculosis H37Rv
gacccgucgagcg

SEQ ID NO: 1262241 - RNA, 19 nt, Mycobacterium tuberculosis H37Rv
gacccccgagauccguccg

SEQ ID NO: 1262242 - RNA, 22 nt, Mycobacterium tuberculosis H37Rv
gaccccgaagaugaccucggcg

SEQ ID NO: 1262243 - RNA, 15 nt, Mycobacterium tuberculosis H37Rv
gacccccugacggca

SEQ ID NO: 1262244 - RNA, 19 nt, Mycobacterium tuberculosis H37Rv
gacccccugccacagcgac

SEQ ID NO: 1262245 - RNA, 17 nt, Mycobacterium tuberculosis H37Rv
gaccccgacggcaaugc

SEQ ID NO: 1262246 - RNA, 17 nt, Mycobacterium tuberculosis H37Rv
gaccccgagaccaacgc

SEQ ID NO: 1262247 - RNA, 23 nt, Mycobacterium tuberculosis H37Rv
gaccccccuucgguguccgacgc

SEQ ID NO: 1262248 - RNA, 17 nt, Mycobacterium tuberculosis H37Rv
gacccaucucgucgucg

SEQ ID NO: 1262249 - RNA, 14 nt, Mycobacterium tuberculosis H37Rv
gacccagaccggcu

SEQ ID NO: 1262250 - RNA, 22 nt, Mycobacterium tuberculosis H37Rv
gacccagcucgucgacgucgua

SEQ ID NO: 1262251 - RNA, 21 nt, Mycobacterium tuberculosis H37Rv
gacccagccagcagcggcgag

SEQ ID NO: 1262252 - RNA, 15 nt, Mycobacterium tuberculosis H37Rv
gacccagcagcggca

SEQ ID NO: 1262253 - RNA, 16 nt, Mycobacterium tuberculosis H37Rv
gacccagcagcggcac

SEQ ID NO: 1262254 - RNA, 18 nt, Mycobacterium tuberculosis H37Rv
gacccagccagcagcggc

SEQ ID NO: 1262255 - RNA, 20 nt, Mycobacterium tuberculosis H37Rv
gacccacucggggacggcga

SEQ ID NO: 1262256 - RNA, 20 nt, Mycobacterium tuberculosis H37Rv
gacccacaucaggucggcga

SEQ ID NO: 1262257 - RNA, 18 nt, Mycobacterium tuberculosis H37Rv
gacccacgagagcgcugu

SEQ ID NO: 1262258 - RNA, 14 nt, Mycobacterium tuberculosis H37Rv
gacccaccgucacc

SEQ ID NO: 1262259 - RNA, 23 nt, Mycobacterium tuberculosis H37Rv
gacccacccgcaccgccggcaau

SEQ ID NO: 1262260 - RNA, 17 nt, Mycobacterium tuberculosis H37Rv
gacccacauuccguagc

SEQ ID NO: 1262261 - RNA, 19 nt, Mycobacterium tuberculosis H37Rv
gacccacccgcaccgccgg

SEQ ID NO: 1262262 - RNA, 15 nt, Mycobacterium tuberculosis H37Rv
gaccaccgcgucggg

SEQ ID NO: 1262263 - RNA, 21 nt, Mycobacterium tuberculosis H37Rv
gaccacccgguccugcucgca

SEQ ID NO: 1262264 - RNA, 16 nt, Mycobacterium tuberculosis H37Rv
gaccaauucgaccgcg

SEQ ID NO: 1262265 - RNA, 17 nt, Mycobacterium tuberculosis H37Rv
gaccaagcccgucgucg

SEQ ID NO: 1262266 - RNA, 16 nt, Mycobacterium tuberculosis H37Rv
gaccacccggcgcgaa

SEQ ID NO: 1262267 - RNA, 20 nt, Mycobacterium tuberculosis H37Rv
gacgacgggguuguggucga

SEQ ID NO: 1262268 - RNA, 19 nt, Mycobacterium tuberculosis H37Rv
gacgacgagggccagcagc

SEQ ID NO: 1262269 - RNA, 13 nt, Mycobacterium tuberculosis H37Rv
gacgacgaggucg

SEQ ID NO: 1262270 - RNA, 19 nt, Mycobacterium tuberculosis H37Rv
gacgacuucgaaucaggcu

SEQ ID NO: 1262271 - RNA, 21 nt, Mycobacterium tuberculosis H37Rv
gacgacgucggccgcaucgcc

SEQ ID NO: 1262272 - RNA, 15 nt, Mycobacterium tuberculosis H37Rv
gacgagcacaagauc

SEQ ID NO: 1262273 - RNA, 15 nt, Mycobacterium tuberculosis H37Rv
gacgagccgaccacc

SEQ ID NO: 1262274 - RNA, 22 nt, Mycobacterium tuberculosis H37Rv
gacgagccacggcuucgccgcg

SEQ ID NO: 1262275 - RNA, 16 nt, Mycobacterium tuberculosis H37Rv
gacgagauugccgggc

SEQ ID NO: 1262276 - RNA, 22 nt, Mycobacterium tuberculosis H37Rv
gacgaacgccucaccgacgucg

SEQ ID NO: 1262277 - RNA, 16 nt, Mycobacterium tuberculosis H37Rv
gacgaacgccgucgac

SEQ ID NO: 1262278 - RNA, 23 nt, Mycobacterium tuberculosis H37Rv
gaccuguagaucagcagcggcga

SEQ ID NO: 1262279 - RNA, 15 nt, Mycobacterium tuberculosis H37Rv
gacgaacucgccguc

SEQ ID NO: 1262280 - RNA, 20 nt, Mycobacterium tuberculosis H37Rv
gacgaacuagguucagcgac

SEQ ID NO: 1262281 - RNA, 15 nt, Mycobacterium tuberculosis H37Rv
gacgaacgcugucgu

SEQ ID NO: 1262282 - RNA, 20 nt, Mycobacterium tuberculosis H37Rv
gacgacauacgagcagugac

SEQ ID NO: 1262283 - RNA, 19 nt, Mycobacterium tuberculosis H37Rv
gacgaccaugccgaucggc

SEQ ID NO: 1262284 - RNA, 22 nt, Mycobacterium tuberculosis H37Rv
gacgaccgccugcaacacgcga

SEQ ID NO: 1262285 - RNA, 17 nt, Mycobacterium tuberculosis H37Rv
gacgacccgggucggca

SEQ ID NO: 1262286 - RNA, 17 nt, Mycobacterium tuberculosis H37Rv
gacgaccgcgcggcacu

SEQ ID NO: 1262287 - RNA, 16 nt, Mycobacterium tuberculosis H37Rv
gacgaccgcgcggcac

SEQ ID NO: 1262288 - RNA, 15 nt, Mycobacterium tuberculosis H37Rv
gacgaccgucggcuc

SEQ ID NO: 1262289 - RNA, 11 nt, Mycobacterium tuberculosis H37Rv
gaccgucagcc

SEQ ID NO: 1262290 - RNA, 12 nt, Mycobacterium tuberculosis H37Rv
gaccgucagccc

SEQ ID NO: 1262291 - RNA, 21 nt, Mycobacterium tuberculosis H37Rv
gaccguccagcaacagcgagc

SEQ ID NO: 1262292 - RNA, 16 nt, Mycobacterium tuberculosis H37Rv
gaccguccaccgacgu

SEQ ID NO: 1262293 - RNA, 16 nt, Mycobacterium tuberculosis H37Rv
gaccggccacgaccuc

SEQ ID NO: 1262294 - RNA, 13 nt, Mycobacterium tuberculosis H37Rv
gaccggcagcgau

SEQ ID NO: 1262295 - RNA, 22 nt, Mycobacterium tuberculosis H37Rv
gaccgucgauuucgacgaccac

SEQ ID NO: 1262296 - RNA, 18 nt, Mycobacterium tuberculosis H37Rv
gaccgucgcgcugccggc

SEQ ID NO: 1262297 - RNA, 17 nt, Mycobacterium tuberculosis H37Rv
gaccgucugcgacccgg

SEQ ID NO: 1262298 - RNA, 23 nt, Mycobacterium tuberculosis H37Rv
gaccgucuggaguucgucaccgu

SEQ ID NO: 1262299 - RNA, 21 nt, Mycobacterium tuberculosis H37Rv
gaccggaacguuccugcacag

SEQ ID NO: 1262300 - RNA, 19 nt, Mycobacterium tuberculosis H37Rv
gaccggagccgccggacga

SEQ ID NO: 1262301 - RNA, 18 nt, Mycobacterium tuberculosis H37Rv
gaccggaguucagugcgc

SEQ ID NO: 1262302 - RNA, 17 nt, Mycobacterium tuberculosis H37Rv
gaccggcaacgcggccu

SEQ ID NO: 1262303 - RNA, 17 nt, Mycobacterium tuberculosis H37Rv
gaccggaucugacggcg

SEQ ID NO: 1262304 - RNA, 21 nt, Mycobacterium tuberculosis H37Rv
gaccgcucugcggccacgccg

SEQ ID NO: 1262305 - RNA, 21 nt, Mycobacterium tuberculosis H37Rv
gaccgcuaccagcugggcgac

SEQ ID NO: 1262306 - RNA, 19 nt, Mycobacterium tuberculosis H37Rv
gaccgcuucgacgucguug

SEQ ID NO: 1262307 - RNA, 22 nt, Mycobacterium tuberculosis H37Rv
gaccgcguuuugcaggcccgag

SEQ ID NO: 1262308 - RNA, 16 nt, Mycobacterium tuberculosis H37Rv
gaccgcuaccagcugg

SEQ ID NO: 1262309 - RNA, 19 nt, Mycobacterium tuberculosis H37Rv
gaccgcguggucggcgaac

SEQ ID NO: 1262310 - RNA, 22 nt, Mycobacterium tuberculosis H37Rv
gaccgcgugcucgagcaccucg

SEQ ID NO: 1262311 - RNA, 16 nt, Mycobacterium tuberculosis H37Rv
gaccgcgugcaccgag

SEQ ID NO: 1262312 - RNA, 21 nt, Mycobacterium tuberculosis H37Rv
gaccugcagcgcauccgguuu

SEQ ID NO: 1262313 - RNA, 22 nt, Mycobacterium tuberculosis H37Rv
gaccugcagcgcauccgguuug

SEQ ID NO: 1262314 - RNA, 21 nt, Mycobacterium tuberculosis H37Rv
gaccugcaugggcagcuggua

SEQ ID NO: 1262315 - RNA, 17 nt, Mycobacterium tuberculosis H37Rv
gaccugcgggaucgccg

SEQ ID NO: 1262316 - RNA, 11 nt, Mycobacterium tuberculosis H37Rv
gaccugcagcg

SEQ ID NO: 1262317 - RNA, 19 nt, Mycobacterium tuberculosis H37Rv
gaccugauccggccgguug

SEQ ID NO: 1262318 - RNA, 16 nt, Mycobacterium tuberculosis H37Rv
gaccucgccgcgcgug

SEQ ID NO: 1262319 - RNA, 23 nt, Mycobacterium tuberculosis H37Rv
gaccuccggauaacccagcggcg

SEQ ID NO: 1262320 - RNA, 16 nt, Mycobacterium tuberculosis H37Rv
gaccucgaagcccagc

SEQ ID NO: 1262321 - RNA, 23 nt, Mycobacterium tuberculosis H37Rv
gaccucgagcuugccgucgcuga

SEQ ID NO: 1262322 - RNA, 20 nt, Mycobacterium tuberculosis H37Rv
gaccucgagcuugccgucgc

SEQ ID NO: 1262323 - RNA, 23 nt, Mycobacterium tuberculosis H37Rv
gaccgucgggacggccaacaggg

SEQ ID NO: 1262324 - RNA, 21 nt, Mycobacterium tuberculosis H37Rv
gaccucaauuggcucggcguc

SEQ ID NO: 1262325 - RNA, 23 nt, Mycobacterium tuberculosis H37Rv
gaccuauuggucgcucgcgguca

SEQ ID NO: 1262326 - RNA, 21 nt, Mycobacterium tuberculosis H37Rv
gaccuaccgucgaccacuagc

SEQ ID NO: 1262327 - RNA, 19 nt, Mycobacterium tuberculosis H37Rv
gaccuauuggucgcucgcg

SEQ ID NO: 1262328 - RNA, 18 nt, Mycobacterium tuberculosis H37Rv
gacgaugauguuggccgg

SEQ ID NO: 1262329 - RNA, 16 nt, Mycobacterium tuberculosis H37Rv
gacgaugaaccgggca

SEQ ID NO: 1262330 - RNA, 21 nt, Mycobacterium tuberculosis H37Rv
gacgaugacagacaucgcgac

SEQ ID NO: 1262331 - RNA, 22 nt, Mycobacterium tuberculosis H37Rv
gacgauggcaacggcaucccgg

SEQ ID NO: 1262332 - RNA, 21 nt, Mycobacterium tuberculosis H37Rv
gacgauggcaagggccgacgu

SEQ ID NO: 1262333 - RNA, 13 nt, Mycobacterium tuberculosis H37Rv
gacgauguggucc

SEQ ID NO: 1262334 - RNA, 17 nt, Mycobacterium tuberculosis H37Rv
gacgaugugguccaucg

SEQ ID NO: 1262335 - RNA, 16 nt, Mycobacterium tuberculosis H37Rv
gacgcaaaaucgcccg

SEQ ID NO: 1262336 - RNA, 16 nt, Mycobacterium tuberculosis H37Rv
gacgcaaaaucgccca

SEQ ID NO: 1262337 - RNA, 16 nt, Mycobacterium tuberculosis H37Rv
gacgcaccuaugguca

SEQ ID NO: 1262338 - RNA, 17 nt, Mycobacterium tuberculosis H37Rv
gacgccaacgccagcgg

SEQ ID NO: 1262339 - RNA, 16 nt, Mycobacterium tuberculosis H37Rv
gacgcagagucaacag

SEQ ID NO: 1262340 - RNA, 14 nt, Mycobacterium tuberculosis H37Rv
gacgcacgauccgc

SEQ ID NO: 1262341 - RNA, 18 nt, Mycobacterium tuberculosis H37Rv
gacgcagaaucgcacaaa

SEQ ID NO: 1262342 - RNA, 23 nt, Mycobacterium tuberculosis H37Rv
gacgagucgccgcgggcagcgaa

SEQ ID NO: 1262343 - RNA, 14 nt, Mycobacterium tuberculosis H37Rv
gacgagucgccgcg

SEQ ID NO: 1262344 - RNA, 20 nt, Mycobacterium tuberculosis H37Rv
gacgaggcaaugcgagcacc

SEQ ID NO: 1262345 - RNA, 19 nt, Mycobacterium tuberculosis H37Rv
gacgaggaugucgaugacc

SEQ ID NO: 1262346 - RNA, 18 nt, Mycobacterium tuberculosis H37Rv
gacgauagcggcccgauc

SEQ ID NO: 1262347 - RNA, 16 nt, Mycobacterium tuberculosis H37Rv
gacgaguucgcugacc

SEQ ID NO: 1262348 - RNA, 15 nt, Mycobacterium tuberculosis H37Rv
gacgaguucgcugac

SEQ ID NO: 1262349 - RNA, 14 nt, Mycobacterium tuberculosis H37Rv
gacgaucucggcgg

SEQ ID NO: 1262350 - RNA, 18 nt, Mycobacterium tuberculosis H37Rv
gacgaucucgccggcgaa

SEQ ID NO: 1262351 - RNA, 21 nt, Mycobacterium tuberculosis H37Rv
gacgaucggcggcgcgccgau

SEQ ID NO: 1262352 - RNA, 18 nt, Mycobacterium tuberculosis H37Rv
gacgaucaggucgccgag

SEQ ID NO: 1262353 - RNA, 17 nt, Mycobacterium tuberculosis H37Rv
gacgaucaucucgucgu

SEQ ID NO: 1262354 - RNA, 15 nt, Mycobacterium tuberculosis H37Rv
gacgauccacggcga

SEQ ID NO: 1262355 - RNA, 12 nt, Mycobacterium tuberculosis H37Rv
gacgaucgacgc

SEQ ID NO: 1262356 - RNA, 16 nt, Mycobacterium tuberculosis H37Rv
gacgaucagcacgucg

SEQ ID NO: 1262357 - RNA, 15 nt, Mycobacterium tuberculosis H37Rv
gacgcgacacgccga

SEQ ID NO: 1262358 - RNA, 14 nt, Mycobacterium tuberculosis H37Rv
gacgcgcccgacga

SEQ ID NO: 1262359 - RNA, 17 nt, Mycobacterium tuberculosis H37Rv
gacgcgaugaccgcacc

SEQ ID NO: 1262360 - RNA, 19 nt, Mycobacterium tuberculosis H37Rv
gacgcgcaacgccgccagc

SEQ ID NO: 1262361 - RNA, 17 nt, Mycobacterium tuberculosis H37Rv
gacgcgcgagaacaccc

SEQ ID NO: 1262362 - RNA, 19 nt, Mycobacterium tuberculosis H37Rv
gacgcggaaucgcaccgug

SEQ ID NO: 1262363 - RNA, 13 nt, Mycobacterium tuberculosis H37Rv
gacgcggacagga

SEQ ID NO: 1262364 - RNA, 23 nt, Mycobacterium tuberculosis H37Rv
gacgcggccacauaccaccacgu

SEQ ID NO: 1262365 - RNA, 16 nt, Mycobacterium tuberculosis H37Rv
gacgcggcaggccggu

SEQ ID NO: 1262366 - RNA, 21 nt, Mycobacterium tuberculosis H37Rv
gacgccuuccagcccgagcag

SEQ ID NO: 1262367 - RNA, 21 nt, Mycobacterium tuberculosis H37Rv
gacgcgaaaucccccgacacg

SEQ ID NO: 1262368 - RNA, 19 nt, Mycobacterium tuberculosis H37Rv
gacgcgaaaucccccgaca

SEQ ID NO: 1262369 - RNA, 17 nt, Mycobacterium tuberculosis H37Rv
gacgccguugcccacgu

SEQ ID NO: 1262370 - RNA, 15 nt, Mycobacterium tuberculosis H37Rv
gacgccguugccgcc

SEQ ID NO: 1262371 - RNA, 14 nt, Mycobacterium tuberculosis H37Rv
gacgccgucggcgc

SEQ ID NO: 1262372 - RNA, 21 nt, Mycobacterium tuberculosis H37Rv
gacgccgcuggagaucacgcc

SEQ ID NO: 1262373 - RNA, 13 nt, Mycobacterium tuberculosis H37Rv
gacgccgccaggu

SEQ ID NO: 1262374 - RNA, 15 nt, Mycobacterium tuberculosis H37Rv
gacgccacugccagc

SEQ ID NO: 1262375 - RNA, 18 nt, Mycobacterium tuberculosis H37Rv
gacgccacugccagccgu

SEQ ID NO: 1262376 - RNA, 20 nt, Mycobacterium tuberculosis H37Rv
gacgccaccugacgugcggc

SEQ ID NO: 1262377 - RNA, 12 nt, Mycobacterium tuberculosis H37Rv
gacggcccgauc

SEQ ID NO: 1262378 - RNA, 16 nt, Mycobacterium tuberculosis H37Rv
gacggcccgaucccga

SEQ ID NO: 1262379 - RNA, 17 nt, Mycobacterium tuberculosis H37Rv
gacggccaucgccagcc

SEQ ID NO: 1262380 - RNA, 21 nt, Mycobacterium tuberculosis H37Rv
gacggccacgguggagcgcgc

SEQ ID NO: 1262381 - RNA, 20 nt, Mycobacterium tuberculosis H37Rv
gacggccagcaagacgauga

SEQ ID NO: 1262382 - RNA, 12 nt, Mycobacterium tuberculosis H37Rv
gacggcaggcgg

SEQ ID NO: 1262383 - RNA, 20 nt, Mycobacterium tuberculosis H37Rv
gacgcguggcauccagcagc

SEQ ID NO: 1262384 - RNA, 17 nt, Mycobacterium tuberculosis H37Rv
gacgcguggcauccagc

SEQ ID NO: 1262385 - RNA, 14 nt, Mycobacterium tuberculosis H37Rv
gacgcgucgagccg

SEQ ID NO: 1262386 - RNA, 17 nt, Mycobacterium tuberculosis H37Rv
gacgcguccggugcacc

SEQ ID NO: 1262387 - RNA, 16 nt, Mycobacterium tuberculosis H37Rv
gacgcguugcucgaaa

SEQ ID NO: 1262388 - RNA, 17 nt, Mycobacterium tuberculosis H37Rv
gacgcguuccucgacgu

SEQ ID NO: 1262389 - RNA, 16 nt, Mycobacterium tuberculosis H37Rv
gacggcagccaccagc

SEQ ID NO: 1262390 - RNA, 17 nt, Mycobacterium tuberculosis H37Rv
gacggcgcucggcgagc

SEQ ID NO: 1262391 - RNA, 16 nt, Mycobacterium tuberculosis H37Rv
gacggcuucggcagcc

SEQ ID NO: 1262392 - RNA, 19 nt, Mycobacterium tuberculosis H37Rv
gacgggauagccguucggc

SEQ ID NO: 1262393 - RNA, 15 nt, Mycobacterium tuberculosis H37Rv
gacggcgccggcauc

SEQ ID NO: 1262394 - RNA, 17 nt, Mycobacterium tuberculosis H37Rv
gacggcgcccgcccgag

SEQ ID NO: 1262395 - RNA, 23 nt, Mycobacterium tuberculosis H37Rv
gacggcgcccgcccgagccgcug

SEQ ID NO: 1262396 - RNA, 14 nt, Mycobacterium tuberculosis H37Rv
gacggcgcucggcg

SEQ ID NO: 1262397 - RNA, 16 nt, Mycobacterium tuberculosis H37Rv
gacggcgccgucgaaa

SEQ ID NO: 1262398 - RNA, 16 nt, Mycobacterium tuberculosis H37Rv
gacggccggccgcggu

SEQ ID NO: 1262399 - RNA, 18 nt, Mycobacterium tuberculosis H37Rv
gacggccgacaacccggc

SEQ ID NO: 1262400 - RNA, 22 nt, Mycobacterium tuberculosis H37Rv
gacggcgaaaaucccgcucccc

SEQ ID NO: 1262401 - RNA, 17 nt, Mycobacterium tuberculosis H37Rv
gacggcgaaaaucccgc

SEQ ID NO: 1262402 - RNA, 18 nt, Mycobacterium tuberculosis H37Rv
gacggcgaagucgagugc

SEQ ID NO: 1262403 - RNA, 19 nt, Mycobacterium tuberculosis H37Rv
gacggcgaacccgccgaug

SEQ ID NO: 1262404 - RNA, 17 nt, Mycobacterium tuberculosis H37Rv
gacggcgauauaggacg

SEQ ID NO: 1262405 - RNA, 21 nt, Mycobacterium tuberculosis H37Rv
gacggcgaaucgguggucgau

SEQ ID NO: 1262406 - RNA, 12 nt, Mycobacterium tuberculosis H37Rv
gacggcgagggc

SEQ ID NO: 1262407 - RNA, 17 nt, Mycobacterium tuberculosis H37Rv
gacgucaccacgaucgc

SEQ ID NO: 1262408 - RNA, 19 nt, Mycobacterium tuberculosis H37Rv
gacguaucgccgcgggcga

SEQ ID NO: 1262409 - RNA, 23 nt, Mycobacterium tuberculosis H37Rv
gacgucaaacgcaaagacagcgc

SEQ ID NO: 1262410 - RNA, 19 nt, Mycobacterium tuberculosis H37Rv
gacgucaaacgggagcgac

SEQ ID NO: 1262411 - RNA, 12 nt, Mycobacterium tuberculosis H37Rv
gacguaucgccg

SEQ ID NO: 1262412 - RNA, 16 nt, Mycobacterium tuberculosis H37Rv
gacguauaucgguugc

SEQ ID NO: 1262413 - RNA, 15 nt, Mycobacterium tuberculosis H37Rv
gacgucacguucggc

SEQ ID NO: 1262414 - RNA, 16 nt, Mycobacterium tuberculosis H37Rv
gacgucaccguucuug

SEQ ID NO: 1262415 - RNA, 15 nt, Mycobacterium tuberculosis H37Rv
gacgucaucgccgac

SEQ ID NO: 1262416 - RNA, 18 nt, Mycobacterium tuberculosis H37Rv
gacgucaucgucggcgga

SEQ ID NO: 1262417 - RNA, 19 nt, Mycobacterium tuberculosis H37Rv
gacgucaucgucggcggau

SEQ ID NO: 1262418 - RNA, 15 nt, Mycobacterium tuberculosis H37Rv
gacguccaacagcgc

SEQ ID NO: 1262419 - RNA, 22 nt, Mycobacterium tuberculosis H37Rv
gacguccagggccacgaucugu

SEQ ID NO: 1262420 - RNA, 20 nt, Mycobacterium tuberculosis H37Rv
gacgucggugaacgcgucgu

SEQ ID NO: 1262421 - RNA, 18 nt, Mycobacterium tuberculosis H37Rv
gacgucgauuucggcgac

SEQ ID NO: 1262422 - RNA, 21 nt, Mycobacterium tuberculosis H37Rv
gacguccugggcccgaaucgc

SEQ ID NO: 1262423 - RNA, 18 nt, Mycobacterium tuberculosis H37Rv
gacgucgagcagcgccac

SEQ ID NO: 1262424 - RNA, 15 nt, Mycobacterium tuberculosis H37Rv
gacgucgagcagcgc

SEQ ID NO: 1262425 - RNA, 13 nt, Mycobacterium tuberculosis H37Rv
gacgucgaccugu

SEQ ID NO: 1262426 - RNA, 17 nt, Mycobacterium tuberculosis H37Rv
gacggugaagccgagcg

SEQ ID NO: 1262427 - RNA, 17 nt, Mycobacterium tuberculosis H37Rv
gacggugcaggaccaga

SEQ ID NO: 1262428 - RNA, 22 nt, Mycobacterium tuberculosis H37Rv
gacggucuggcccgcgacaucg

SEQ ID NO: 1262429 - RNA, 18 nt, Mycobacterium tuberculosis H37Rv
gacggugaaaccggccuu

SEQ ID NO: 1262430 - RNA, 17 nt, Mycobacterium tuberculosis H37Rv
gacggugaccgggaguc

SEQ ID NO: 1262431 - RNA, 18 nt, Mycobacterium tuberculosis H37Rv
gacggugccgaccgcguu

SEQ ID NO: 1262432 - RNA, 16 nt, Mycobacterium tuberculosis H37Rv
gacgggcacgcggcga

SEQ ID NO: 1262433 - RNA, 18 nt, Mycobacterium tuberculosis H37Rv
gacgggaucgucggcaac

SEQ ID NO: 1262434 - RNA, 13 nt, Mycobacterium tuberculosis H37Rv
gacgggcucggca

SEQ ID NO: 1262435 - RNA, 20 nt, Mycobacterium tuberculosis H37Rv
gacggggcaaaggagccguu

SEQ ID NO: 1262436 - RNA, 13 nt, Mycobacterium tuberculosis H37Rv
gaacuucgccgaa

SEQ ID NO: 1262437 - RNA, 17 nt, Mycobacterium tuberculosis H37Rv
gaagaacaucaccucga

SEQ ID NO: 1262438 - RNA, 18 nt, Mycobacterium tuberculosis H37Rv
gaagaaagcgaccgucgg

SEQ ID NO: 1262439 - RNA, 18 nt, Mycobacterium tuberculosis H37Rv
gaagaagaacucggcguc

SEQ ID NO: 1262440 - RNA, 18 nt, Mycobacterium tuberculosis H37Rv
gaagaacugggcaaugac

SEQ ID NO: 1262441 - RNA, 17 nt, Mycobacterium tuberculosis H37Rv
gaagaagaugaucgcga

SEQ ID NO: 1262442 - RNA, 14 nt, Mycobacterium tuberculosis H37Rv
gaagaacucggugc

SEQ ID NO: 1262443 - RNA, 18 nt, Mycobacterium tuberculosis H37Rv
gaagaacucggcgucgug

SEQ ID NO: 1262444 - RNA, 16 nt, Mycobacterium tuberculosis H37Rv
gaagaacgcgucguag

SEQ ID NO: 1262445 - RNA, 14 nt, Mycobacterium tuberculosis H37Rv
gaacugguagcccg

SEQ ID NO: 1262446 - RNA, 18 nt, Mycobacterium tuberculosis H37Rv
gaacuggucgacgccgag

SEQ ID NO: 1262447 - RNA, 20 nt, Mycobacterium tuberculosis H37Rv
gaacgugcaaccacggcggc

SEQ ID NO: 1262448 - RNA, 14 nt, Mycobacterium tuberculosis H37Rv
gaacgucucggcca

SEQ ID NO: 1262449 - RNA, 13 nt, Mycobacterium tuberculosis H37Rv
gaacgugacgguc

SEQ ID NO: 1262450 - RNA, 19 nt, Mycobacterium tuberculosis H37Rv
gaacgucacguggucggcc

SEQ ID NO: 1262451 - RNA, 22 nt, Mycobacterium tuberculosis H37Rv
gaacgucauacccagcucgucg

SEQ ID NO: 1262452 - RNA, 14 nt, Mycobacterium tuberculosis H37Rv
gaacgucaccaucg

SEQ ID NO: 1262453 - RNA, 19 nt, Mycobacterium tuberculosis H37Rv
gaacguccagccguggcgg

SEQ ID NO: 1262454 - RNA, 12 nt, Mycobacterium tuberculosis H37Rv
gaagacaccagg

SEQ ID NO: 1262455 - RNA, 17 nt, Mycobacterium tuberculosis H37Rv
gaagaccucgucgcguc

SEQ ID NO: 1262456 - RNA, 16 nt, Mycobacterium tuberculosis H37Rv
gaagaccggaucgccu

SEQ ID NO: 1262457 - RNA, 15 nt, Mycobacterium tuberculosis H37Rv
gaagaccgccgggau

SEQ ID NO: 1262458 - RNA, 21 nt, Mycobacterium tuberculosis H37Rv
gaagaccucgucgcgucgcca

SEQ ID NO: 1262459 - RNA, 20 nt, Mycobacterium tuberculosis H37Rv
gaagaccgggucguagccga

SEQ ID NO: 1262460 - RNA, 16 nt, Mycobacterium tuberculosis H37Rv
gaagacggccaccggg

SEQ ID NO: 1262461 - RNA, 23 nt, Mycobacterium tuberculosis H37Rv
gaagaguguccccccgcgcagau

SEQ ID NO: 1262462 - RNA, 22 nt, Mycobacterium tuberculosis H37Rv
gaagaucaccucccgcggcacc

SEQ ID NO: 1262463 - RNA, 18 nt, Mycobacterium tuberculosis H37Rv
gaagaucgagccgacccg

SEQ ID NO: 1262464 - RNA, 17 nt, Mycobacterium tuberculosis H37Rv
gaagaugauuucgccga

SEQ ID NO: 1262465 - RNA, 14 nt, Mycobacterium tuberculosis H37Rv
gaagaucgcugcga

SEQ ID NO: 1262466 - RNA, 15 nt, Mycobacterium tuberculosis H37Rv
gaagaucgcugcgaa

SEQ ID NO: 1262467 - RNA, 13 nt, Mycobacterium tuberculosis H37Rv
gaagaucucggcc

SEQ ID NO: 1262468 - RNA, 14 nt, Mycobacterium tuberculosis H37Rv
gaacgaugccggca

SEQ ID NO: 1262469 - RNA, 16 nt, Mycobacterium tuberculosis H37Rv
gaacgauggacgccca

SEQ ID NO: 1262470 - RNA, 19 nt, Mycobacterium tuberculosis H37Rv
gaacgaucggaccaccagg

SEQ ID NO: 1262471 - RNA, 13 nt, Mycobacterium tuberculosis H37Rv
gaacgcaccgaaa

SEQ ID NO: 1262472 - RNA, 18 nt, Mycobacterium tuberculosis H37Rv
gaacgauguccgcgcgaa

SEQ ID NO: 1262473 - RNA, 20 nt, Mycobacterium tuberculosis H37Rv
gaaacggggggcgucgccgu

SEQ ID NO: 1262474 - RNA, 14 nt, Mycobacterium tuberculosis H37Rv
gaacgacucgacgu

SEQ ID NO: 1262475 - RNA, 14 nt, Mycobacterium tuberculosis H37Rv
gaaacgccgucgcc

SEQ ID NO: 1262476 - RNA, 18 nt, Mycobacterium tuberculosis H37Rv
gaaacgccauacgucgcc

SEQ ID NO: 1262477 - RNA, 16 nt, Mycobacterium tuberculosis H37Rv
gaaacggaccuccucg

SEQ ID NO: 1262478 - RNA, 21 nt, Mycobacterium tuberculosis H37Rv
gaaacggaccuccucgcccau

SEQ ID NO: 1262479 - RNA, 14 nt, Mycobacterium tuberculosis H37Rv
gaaacggccgggca

SEQ ID NO: 1262480 - RNA, 12 nt, Mycobacterium tuberculosis H37Rv
gaaacgauggcc

SEQ ID NO: 1262481 - RNA, 18 nt, Mycobacterium tuberculosis H37Rv
gaaacgauugcugcggcu

SEQ ID NO: 1262482 - RNA, 21 nt, Mycobacterium tuberculosis H37Rv
gaacgggaucgacccgcccau

SEQ ID NO: 1262483 - RNA, 14 nt, Mycobacterium tuberculosis H37Rv
gaacgggucgacgu

SEQ ID NO: 1262484 - RNA, 19 nt, Mycobacterium tuberculosis H37Rv
gaacgggucgggacgcugc

SEQ ID NO: 1262485 - RNA, 14 nt, Mycobacterium tuberculosis H37Rv
gaacguagcgccca

SEQ ID NO: 1262486 - RNA, 19 nt, Mycobacterium tuberculosis H37Rv
gaacggugucaacggcacc

SEQ ID NO: 1262487 - RNA, 22 nt, Mycobacterium tuberculosis H37Rv
gaacgcuaggcgauccagacgg

SEQ ID NO: 1262488 - RNA, 20 nt, Mycobacterium tuberculosis H37Rv
gaacgcuucaccucgucgac

SEQ ID NO: 1262489 - RNA, 20 nt, Mycobacterium tuberculosis H37Rv
gaacgcuguaagcaugccgu

SEQ ID NO: 1262490 - RNA, 16 nt, Mycobacterium tuberculosis H37Rv
gaacgcugcccaacgg

SEQ ID NO: 1262491 - RNA, 14 nt, Mycobacterium tuberculosis H37Rv
gaacggcgucgaau

SEQ ID NO: 1262492 - RNA, 23 nt, Mycobacterium tuberculosis H37Rv
gaacggcucgggaacuucgccga

SEQ ID NO: 1262493 - RNA, 18 nt, Mycobacterium tuberculosis H37Rv
gaacgcagccagcgccau

SEQ ID NO: 1262494 - RNA, 19 nt, Mycobacterium tuberculosis H37Rv
gaacgcaccgaaacgccga

SEQ ID NO: 1262495 - RNA, 14 nt, Mycobacterium tuberculosis H37Rv
gaacgcaccgaaac

SEQ ID NO: 1262496 - RNA, 20 nt, Mycobacterium tuberculosis H37Rv
gaacgcaccgaaacgccgac

SEQ ID NO: 1262497 - RNA, 22 nt, Mycobacterium tuberculosis H37Rv
gaacgccaccaccuccgcgucg

SEQ ID NO: 1262498 - RNA, 17 nt, Mycobacterium tuberculosis H37Rv
gaacgccagcagcgcga

SEQ ID NO: 1262499 - RNA, 18 nt, Mycobacterium tuberculosis H37Rv
gaacgccagcagcgcgau

SEQ ID NO: 1262500 - RNA, 16 nt, Mycobacterium tuberculosis H37Rv
gaacgcgucggucgac

SEQ ID NO: 1262501 - RNA, 19 nt, Mycobacterium tuberculosis H37Rv
gaacgcgucggucgacugu

SEQ ID NO: 1262502 - RNA, 21 nt, Mycobacterium tuberculosis H37Rv
gaacgcggcgucgauaaccug

SEQ ID NO: 1262503 - RNA, 20 nt, Mycobacterium tuberculosis H37Rv
gaagcgucgcuucggcaccg

SEQ ID NO: 1262504 - RNA, 15 nt, Mycobacterium tuberculosis H37Rv
gaagcugaccagaca

SEQ ID NO: 1262505 - RNA, 22 nt, Mycobacterium tuberculosis H37Rv
gaagcucaucaccggcgcaccg

SEQ ID NO: 1262506 - RNA, 21 nt, Mycobacterium tuberculosis H37Rv
gaagcggcugcugcgcggugc

SEQ ID NO: 1262507 - RNA, 20 nt, Mycobacterium tuberculosis H37Rv
gaagcgggcuugagcgccga

SEQ ID NO: 1262508 - RNA, 21 nt, Mycobacterium tuberculosis H37Rv
gaagcgggcuugagcgccgau

SEQ ID NO: 1262509 - RNA, 14 nt, Mycobacterium tuberculosis H37Rv
gaaggccgaacugc

SEQ ID NO: 1262510 - RNA, 22 nt, Mycobacterium tuberculosis H37Rv
gaaggcgacaucaccaccgacc

SEQ ID NO: 1262511 - RNA, 16 nt, Mycobacterium tuberculosis H37Rv
gaaggcggcuccaccg

SEQ ID NO: 1262512 - RNA, 15 nt, Mycobacterium tuberculosis H37Rv
gaaggcggcgauacc

SEQ ID NO: 1262513 - RNA, 23 nt, Mycobacterium tuberculosis H37Rv
gaagccgauguccgacgccaccg

SEQ ID NO: 1262514 - RNA, 16 nt, Mycobacterium tuberculosis H37Rv
gaagccgguucgccca

SEQ ID NO: 1262515 - RNA, 18 nt, Mycobacterium tuberculosis H37Rv
gaagccgguucgcccagc

SEQ ID NO: 1262516 - RNA, 13 nt, Mycobacterium tuberculosis H37Rv
gaagcgaccgucg

SEQ ID NO: 1262517 - RNA, 17 nt, Mycobacterium tuberculosis H37Rv
gaagccuugcagcgccc

SEQ ID NO: 1262518 - RNA, 22 nt, Mycobacterium tuberculosis H37Rv
gaagcgaugagggugcucguca

SEQ ID NO: 1262519 - RNA, 18 nt, Mycobacterium tuberculosis H37Rv
gaagcgaacacccgguca

SEQ ID NO: 1262520 - RNA, 16 nt, Mycobacterium tuberculosis H37Rv
gaagcgaagccagauc

SEQ ID NO: 1262521 - RNA, 16 nt, Mycobacterium tuberculosis H37Rv
gaagcgccaacccggc

SEQ ID NO: 1262522 - RNA, 22 nt, Mycobacterium tuberculosis H37Rv
gaagcccccgacguugcuggcu

SEQ ID NO: 1262523 - RNA, 12 nt, Mycobacterium tuberculosis H37Rv
gaagccgacguu

SEQ ID NO: 1262524 - RNA, 13 nt, Mycobacterium tuberculosis H37Rv
gaagccaccaggu

SEQ ID NO: 1262525 - RNA, 19 nt, Mycobacterium tuberculosis H37Rv
gaagaugccuggaaucgcg

SEQ ID NO: 1262526 - RNA, 23 nt, Mycobacterium tuberculosis H37Rv
gaagaugcccuucgucggcauga

SEQ ID NO: 1262527 - RNA, 13 nt, Mycobacterium tuberculosis H37Rv
gaagaugcccuuc

SEQ ID NO: 1262528 - RNA, 14 nt, Mycobacterium tuberculosis H37Rv
gaagcacgucgucg

SEQ ID NO: 1262529 - RNA, 21 nt, Mycobacterium tuberculosis H37Rv
gaccaaaauccuucgcgcuca

SEQ ID NO: 1262530 - RNA, 13 nt, Mycobacterium tuberculosis H37Rv
gaccaacacgucg

SEQ ID NO: 1262531 - RNA, 13 nt, Mycobacterium tuberculosis H37Rv
gaccaacggugcu

SEQ ID NO: 1262532 - RNA, 13 nt, Mycobacterium tuberculosis H37Rv
gaccaaaccgcug

SEQ ID NO: 1262533 - RNA, 16 nt, Mycobacterium tuberculosis H37Rv
gaccaacggugcucgu

SEQ ID NO: 1262534 - RNA, 23 nt, Mycobacterium tuberculosis H37Rv
gaccaacugugguggaacuccgg

SEQ ID NO: 1262535 - RNA, 20 nt, Mycobacterium tuberculosis H37Rv
gacaugagcgccacgccgag

SEQ ID NO: 1262536 - RNA, 17 nt, Mycobacterium tuberculosis H37Rv
gacaucgucaucagcgc

SEQ ID NO: 1262537 - RNA, 17 nt, Mycobacterium tuberculosis H37Rv
gacaucguugacccggc

SEQ ID NO: 1262538 - RNA, 17 nt, Mycobacterium tuberculosis H37Rv
gacaggagacgguacgc

SEQ ID NO: 1262539 - RNA, 14 nt, Mycobacterium tuberculosis H37Rv
gacaggacgucggc

SEQ ID NO: 1262540 - RNA, 18 nt, Mycobacterium tuberculosis H37Rv
gacagcuuucuuggcggg

SEQ ID NO: 1262541 - RNA, 13 nt, Mycobacterium tuberculosis H37Rv
gacagcugcgggu

SEQ ID NO: 1262542 - RNA, 12 nt, Mycobacterium tuberculosis H37Rv
gacagcucgcgg

SEQ ID NO: 1262543 - RNA, 18 nt, Mycobacterium tuberculosis H37Rv
gacagcccgaacgaggcg

SEQ ID NO: 1262544 - RNA, 18 nt, Mycobacterium tuberculosis H37Rv
gacagcccuaucagccga

SEQ ID NO: 1262545 - RNA, 18 nt, Mycobacterium tuberculosis H37Rv
gacagcccuucgcgggag

SEQ ID NO: 1262546 - RNA, 13 nt, Mycobacterium tuberculosis H37Rv
gacaucaccgaac

SEQ ID NO: 1262547 - RNA, 18 nt, Mycobacterium tuberculosis H37Rv
gacaucaccaccgaccug

SEQ ID NO: 1262548 - RNA, 23 nt, Mycobacterium tuberculosis H37Rv
gacaguuuuuccgugccgaccac

SEQ ID NO: 1262549 - RNA, 16 nt, Mycobacterium tuberculosis H37Rv
gacagccacgcacaau

SEQ ID NO: 1262550 - RNA, 16 nt, Mycobacterium tuberculosis H37Rv
gacagcccacgagugc

SEQ ID NO: 1262551 - RNA, 17 nt, Mycobacterium tuberculosis H37Rv
gacagccccaucaccac

SEQ ID NO: 1262552 - RNA, 16 nt, Mycobacterium tuberculosis H37Rv
gacagccccaucacca

SEQ ID NO: 1262553 - RNA, 19 nt, Mycobacterium tuberculosis H37Rv
gacagacaucgcgacgauc

SEQ ID NO: 1262554 - RNA, 16 nt, Mycobacterium tuberculosis H37Rv
gacagaaucgaccgcc

SEQ ID NO: 1262555 - RNA, 19 nt, Mycobacterium tuberculosis H37Rv
gacagagcggguucgacgu

SEQ ID NO: 1262556 - RNA, 23 nt, Mycobacterium tuberculosis H37Rv
gacagaugugguaccagcccgcc

SEQ ID NO: 1262557 - RNA, 17 nt, Mycobacterium tuberculosis H37Rv
gacagaucaacgcgaac

SEQ ID NO: 1262558 - RNA, 19 nt, Mycobacterium tuberculosis H37Rv
gacagauagacuagccgau

SEQ ID NO: 1262559 - RNA, 22 nt, Mycobacterium tuberculosis H37Rv
gacacggccauccguaucacgg

SEQ ID NO: 1262560 - RNA, 22 nt, Mycobacterium tuberculosis H37Rv
gacacgucgcgccaggcgcgau

SEQ ID NO: 1262561 - RNA, 16 nt, Mycobacterium tuberculosis H37Rv
gacacggguacggucu

SEQ ID NO: 1262562 - RNA, 14 nt, Mycobacterium tuberculosis H37Rv
gacacgagucgcca

SEQ ID NO: 1262563 - RNA, 11 nt, Mycobacterium tuberculosis H37Rv
gacacgccgau

SEQ ID NO: 1262564 - RNA, 19 nt, Mycobacterium tuberculosis H37Rv
gacacgcgcugcgucgucg

SEQ ID NO: 1262565 - RNA, 20 nt, Mycobacterium tuberculosis H37Rv
gacacgcgcugcgucgucga

SEQ ID NO: 1262566 - RNA, 15 nt, Mycobacterium tuberculosis H37Rv
gacacugcugcggca

SEQ ID NO: 1262567 - RNA, 23 nt, Mycobacterium tuberculosis H37Rv
gacacguuucacguggucggcau

SEQ ID NO: 1262568 - RNA, 23 nt, Mycobacterium tuberculosis H37Rv
gacacguugacccaucucgucgu

SEQ ID NO: 1262569 - RNA, 24 nt, Mycobacterium tuberculosis H37Rv
gacacguugacccaucucgucguc

SEQ ID NO: 1262570 - RNA, 18 nt, Mycobacterium tuberculosis H37Rv
gacacguugacgaugugc

SEQ ID NO: 1262571 - RNA, 15 nt, Mycobacterium tuberculosis H37Rv
gacacguuggcggau

SEQ ID NO: 1262572 - RNA, 21 nt, Mycobacterium tuberculosis H37Rv
gacaccuaccgagaucaccgc

SEQ ID NO: 1262573 - RNA, 17 nt, Mycobacterium tuberculosis H37Rv
gacaccgugaccgccgc

SEQ ID NO: 1262574 - RNA, 17 nt, Mycobacterium tuberculosis H37Rv
gacaccgucaugccguu

SEQ ID NO: 1262575 - RNA, 22 nt, Mycobacterium tuberculosis H37Rv
gacaccggugcgaccaacacgg

SEQ ID NO: 1262576 - RNA, 19 nt, Mycobacterium tuberculosis H37Rv
gacaccggccgcgacggau

SEQ ID NO: 1262577 - RNA, 14 nt, Mycobacterium tuberculosis H37Rv
gacaccggcggcau

SEQ ID NO: 1262578 - RNA, 23 nt, Mycobacterium tuberculosis H37Rv
gacaaacggcgacccagcgguau

SEQ ID NO: 1262579 - RNA, 17 nt, Mycobacterium tuberculosis H37Rv
gacaaaucggucgacga

SEQ ID NO: 1262580 - RNA, 16 nt, Mycobacterium tuberculosis H37Rv
gacaacacgccgucga

SEQ ID NO: 1262581 - RNA, 14 nt, Mycobacterium tuberculosis H37Rv
gacaacacggcgaa

SEQ ID NO: 1262582 - RNA, 21 nt, Mycobacterium tuberculosis H37Rv
gacaacaucgaaucagcucgc

SEQ ID NO: 1262583 - RNA, 15 nt, Mycobacterium tuberculosis H37Rv
gacaccggccgcgac

SEQ ID NO: 1262584 - RNA, 16 nt, Mycobacterium tuberculosis H37Rv
gaagucgaggucccga

SEQ ID NO: 1262585 - RNA, 15 nt, Mycobacterium tuberculosis H37Rv
gaagucccggauacg

SEQ ID NO: 1262586 - RNA, 15 nt, Mycobacterium tuberculosis H37Rv
gaagucgucggccau

SEQ ID NO: 1262587 - RNA, 14 nt, Mycobacterium tuberculosis H37Rv
gaagucgaucgccg

SEQ ID NO: 1262588 - RNA, 20 nt, Mycobacterium tuberculosis H37Rv
gaaguugggaagugcgguga

SEQ ID NO: 1262589 - RNA, 20 nt, Mycobacterium tuberculosis H37Rv
gaaguuggcgaagcccgaca

SEQ ID NO: 1262590 - RNA, 15 nt, Mycobacterium tuberculosis H37Rv
gaagugucgcugcaa

SEQ ID NO: 1262591 - RNA, 16 nt, Mycobacterium tuberculosis H37Rv
gaaguggaucuggcgc

SEQ ID NO: 1262592 - RNA, 14 nt, Mycobacterium tuberculosis H37Rv
gaaguucucggugc

SEQ ID NO: 1262593 - RNA, 15 nt, Mycobacterium tuberculosis H37Rv
gaaguacacggcggc

SEQ ID NO: 1262594 - RNA, 14 nt, Mycobacterium tuberculosis H37Rv
gaaguacacggcgg

SEQ ID NO: 1262595 - RNA, 18 nt, Mycobacterium tuberculosis H37Rv
gaaggugacgacgagggc

SEQ ID NO: 1262596 - RNA, 16 nt, Mycobacterium tuberculosis H37Rv
gaaggucgaaucgcug

SEQ ID NO: 1262597 - RNA, 18 nt, Mycobacterium tuberculosis H37Rv
gaagguggcgaacccggu

SEQ ID NO: 1262598 - RNA, 16 nt, Mycobacterium tuberculosis H37Rv
gaaggcguucgacucg

SEQ ID NO: 1262599 - RNA, 17 nt, Mycobacterium tuberculosis H37Rv
gaagggcuugucgccgg

SEQ ID NO: 1262600 - RNA, 22 nt, Mycobacterium tuberculosis H37Rv
gaaggucagcgacuugcggugc

SEQ ID NO: 1262601 - RNA, 22 nt, Mycobacterium tuberculosis H37Rv
gaagguccgugccgaugccggc

SEQ ID NO: 1262602 - RNA, 17 nt, Mycobacterium tuberculosis H37Rv
gaaucgccuaccggccu

SEQ ID NO: 1262603 - RNA, 16 nt, Mycobacterium tuberculosis H37Rv
gaaucgaccgccgcua

SEQ ID NO: 1262604 - RNA, 21 nt, Mycobacterium tuberculosis H37Rv
gaaucaacaggaccgggaucg

SEQ ID NO: 1262605 - RNA, 17 nt, Mycobacterium tuberculosis H37Rv
gaaucgcacgacgcgac

SEQ ID NO: 1262606 - RNA, 16 nt, Mycobacterium tuberculosis H37Rv
gaaucgcacgacgcga

SEQ ID NO: 1262607 - RNA, 16 nt, Mycobacterium tuberculosis H37Rv
gaaucgacuccggaug

SEQ ID NO: 1262608 - RNA, 23 nt, Mycobacterium tuberculosis H37Rv
gaauucggcgucguggcuuccgg

SEQ ID NO: 1262609 - RNA, 18 nt, Mycobacterium tuberculosis H37Rv
gaauugccaagcgcgcga

SEQ ID NO: 1262610 - RNA, 14 nt, Mycobacterium tuberculosis H37Rv
gaauucggcgucgu

SEQ ID NO: 1262611 - RNA, 14 nt, Mycobacterium tuberculosis H37Rv
gaauucaugccggu

SEQ ID NO: 1262612 - RNA, 18 nt, Mycobacterium tuberculosis H37Rv
gaaugcgggucugcgguc

SEQ ID NO: 1262613 - RNA, 18 nt, Mycobacterium tuberculosis H37Rv
gaauguugguuugccggc

SEQ ID NO: 1262614 - RNA, 20 nt, Mycobacterium tuberculosis H37Rv
gaauguugcgaucugcggcg

SEQ ID NO: 1262615 - RNA, 17 nt, Mycobacterium tuberculosis H37Rv
gaaugccuggcccgucg

SEQ ID NO: 1262616 - RNA, 13 nt, Mycobacterium tuberculosis H37Rv
gaaugcgacaucc

SEQ ID NO: 1262617 - RNA, 20 nt, Mycobacterium tuberculosis H37Rv
gaaugaucguuccgauccgg

SEQ ID NO: 1262618 - RNA, 19 nt, Mycobacterium tuberculosis H37Rv
gaaugaucguuccgauccg

SEQ ID NO: 1262619 - RNA, 22 nt, Mycobacterium tuberculosis H37Rv
gaaugcauuggcggugcgcacc

SEQ ID NO: 1262620 - RNA, 18 nt, Mycobacterium tuberculosis H37Rv
gaggauguugugccgauc

SEQ ID NO: 1262621 - RNA, 21 nt, Mycobacterium tuberculosis H37Rv
gaggaugacgacggugaccgg

SEQ ID NO: 1262622 - RNA, 20 nt, Mycobacterium tuberculosis H37Rv
gaggauaucgccgagaacca

SEQ ID NO: 1262623 - RNA, 17 nt, Mycobacterium tuberculosis H37Rv
gaggauccgcaccacgc

SEQ ID NO: 1262624 - RNA, 16 nt, Mycobacterium tuberculosis H37Rv
gaggaauucgaucugg

SEQ ID NO: 1262625 - RNA, 15 nt, Mycobacterium tuberculosis H37Rv
gaggaaucguucggg

SEQ ID NO: 1262626 - RNA, 23 nt, Mycobacterium tuberculosis H37Rv
gaggaauacagcuugaucgccga

SEQ ID NO: 1262627 - RNA, 22 nt, Mycobacterium tuberculosis H37Rv
gaggaagccguuggcgacguug

SEQ ID NO: 1262628 - RNA, 21 nt, Mycobacterium tuberculosis H37Rv
gaggaacuugcauccggccca

SEQ ID NO: 1262629 - RNA, 12 nt, Mycobacterium tuberculosis H37Rv
gaggacggcggc

SEQ ID NO: 1262630 - RNA, 18 nt, Mycobacterium tuberculosis H37Rv
gaggagaugccgacgaac

SEQ ID NO: 1262631 - RNA, 13 nt, Mycobacterium tuberculosis H37Rv
gaggacgcugauc

SEQ ID NO: 1262632 - RNA, 15 nt, Mycobacterium tuberculosis H37Rv
gaggaccuugccggu

SEQ ID NO: 1262633 - RNA, 12 nt, Mycobacterium tuberculosis H37Rv
gaggacuugcac

SEQ ID NO: 1262634 - RNA, 20 nt, Mycobacterium tuberculosis H37Rv
gaggacccgugcacgaucgc

SEQ ID NO: 1262635 - RNA, 15 nt, Mycobacterium tuberculosis H37Rv
gagcuggcgaccugg

SEQ ID NO: 1262636 - RNA, 11 nt, Mycobacterium tuberculosis H37Rv
gagcuggcgac

SEQ ID NO: 1262637 - RNA, 21 nt, Mycobacterium tuberculosis H37Rv
gagcugccgagcggucaacga

SEQ ID NO: 1262638 - RNA, 17 nt, Mycobacterium tuberculosis H37Rv
gagcugcgccagaaucc

SEQ ID NO: 1262639 - RNA, 12 nt, Mycobacterium tuberculosis H37Rv
gagcugcucgcc

SEQ ID NO: 1262640 - RNA, 15 nt, Mycobacterium tuberculosis H37Rv
gagcuuggucgccgg

SEQ ID NO: 1262641 - RNA, 13 nt, Mycobacterium tuberculosis H37Rv
gagcuuggucgcc

SEQ ID NO: 1262642 - RNA, 15 nt, Mycobacterium tuberculosis H37Rv
gagcuuggucgccau

SEQ ID NO: 1262643 - RNA, 20 nt, Mycobacterium tuberculosis H37Rv
gagcuuuuugcgucuguucg

SEQ ID NO: 1262644 - RNA, 16 nt, Mycobacterium tuberculosis H37Rv
gagcugguugacggcg

SEQ ID NO: 1262645 - RNA, 15 nt, Mycobacterium tuberculosis H37Rv
gagcuuggcccagcg

SEQ ID NO: 1262646 - RNA, 15 nt, Mycobacterium tuberculosis H37Rv
gaggcacaaucaccg

SEQ ID NO: 1262647 - RNA, 16 nt, Mycobacterium tuberculosis H37Rv
gaggcacaaucaccgc

SEQ ID NO: 1262648 - RNA, 17 nt, Mycobacterium tuberculosis H37Rv
gaggcaauccgaucugg

SEQ ID NO: 1262649 - RNA, 17 nt, Mycobacterium tuberculosis H37Rv
gaggcaagcaaccggug

SEQ ID NO: 1262650 - RNA, 16 nt, Mycobacterium tuberculosis H37Rv
gaggccuucgccgacu

SEQ ID NO: 1262651 - RNA, 22 nt, Mycobacterium tuberculosis H37Rv
gaggcgcaccuccugcgagugc

SEQ ID NO: 1262652 - RNA, 14 nt, Mycobacterium tuberculosis H37Rv
gaggcgaucaccgc

SEQ ID NO: 1262653 - RNA, 17 nt, Mycobacterium tuberculosis H37Rv
gaggcgacgucguucuu

SEQ ID NO: 1262654 - RNA, 15 nt, Mycobacterium tuberculosis H37Rv
gaggcgaccggacga

SEQ ID NO: 1262655 - RNA, 21 nt, Mycobacterium tuberculosis H37Rv
gagggcuuuagugucugcucg

SEQ ID NO: 1262656 - RNA, 20 nt, Mycobacterium tuberculosis H37Rv
gagggcuuuagugucugcuc

SEQ ID NO: 1262657 - RNA, 23 nt, Mycobacterium tuberculosis H37Rv
gagggcuguugacgccacgacgc

SEQ ID NO: 1262658 - RNA, 14 nt, Mycobacterium tuberculosis H37Rv
gagggggacgcuga

SEQ ID NO: 1262659 - RNA, 14 nt, Mycobacterium tuberculosis H37Rv
gaguaaucgaccga

SEQ ID NO: 1262660 - RNA, 19 nt, Mycobacterium tuberculosis H37Rv
gaguagaucccaccaccgg

SEQ ID NO: 1262661 - RNA, 22 nt, Mycobacterium tuberculosis H37Rv
gaguauugcaggaaaucguccu

SEQ ID NO: 1262662 - RNA, 23 nt, Mycobacterium tuberculosis H37Rv
gaguauccggcagaccggugcug

SEQ ID NO: 1262663 - RNA, 20 nt, Mycobacterium tuberculosis H37Rv
gagucacccggccguugggc

SEQ ID NO: 1262664 - RNA, 19 nt, Mycobacterium tuberculosis H37Rv
gaguauuuuucgaccagcc

SEQ ID NO: 1262665 - RNA, 20 nt, Mycobacterium tuberculosis H37Rv
gaggucuuugcucucggucu

SEQ ID NO: 1262666 - RNA, 17 nt, Mycobacterium tuberculosis H37Rv
gaggucgccaacccgau

SEQ ID NO: 1262667 - RNA, 13 nt, Mycobacterium tuberculosis H37Rv
gaggucgccgcau

SEQ ID NO: 1262668 - RNA, 23 nt, Mycobacterium tuberculosis H37Rv
gagggucaugucgaucagcgcga

SEQ ID NO: 1262669 - RNA, 15 nt, Mycobacterium tuberculosis H37Rv
gaggggguggucgaa

SEQ ID NO: 1262670 - RNA, 23 nt, Mycobacterium tuberculosis H37Rv
gagggucgggcauuccggugugc

SEQ ID NO: 1262671 - RNA, 18 nt, Mycobacterium tuberculosis H37Rv
gaucacaccccaggcacc

SEQ ID NO: 1262672 - RNA, 16 nt, Mycobacterium tuberculosis H37Rv
gaucacacccacgucg

SEQ ID NO: 1262673 - RNA, 13 nt, Mycobacterium tuberculosis H37Rv
gaucaacgugcgc

SEQ ID NO: 1262674 - RNA, 17 nt, Mycobacterium tuberculosis H37Rv
gaucaccaccggcagau

SEQ ID NO: 1262675 - RNA, 16 nt, Mycobacterium tuberculosis H37Rv
gaucacaucguuguca

SEQ ID NO: 1262676 - RNA, 17 nt, Mycobacterium tuberculosis H37Rv
gaucacccacucgacgu

SEQ ID NO: 1262677 - RNA, 14 nt, Mycobacterium tuberculosis H37Rv
gaucacccacucga

SEQ ID NO: 1262678 - RNA, 15 nt, Mycobacterium tuberculosis H37Rv
gaucaccaugaucag

SEQ ID NO: 1262679 - RNA, 13 nt, Mycobacterium tuberculosis H37Rv
gaucaaccggguc

SEQ ID NO: 1262680 - RNA, 23 nt, Mycobacterium tuberculosis H37Rv
gaucaacaccaacgacagcgacg

SEQ ID NO: 1262681 - RNA, 15 nt, Mycobacterium tuberculosis H37Rv
gauagcggucgguca

SEQ ID NO: 1262682 - RNA, 16 nt, Mycobacterium tuberculosis H37Rv
gauacgcgucgaucaa

SEQ ID NO: 1262683 - RNA, 16 nt, Mycobacterium tuberculosis H37Rv
gauaggcgcgcaguga

SEQ ID NO: 1262684 - RNA, 20 nt, Mycobacterium tuberculosis H37Rv
gauaggcccggucuugggcg

SEQ ID NO: 1262685 - RNA, 19 nt, Mycobacterium tuberculosis H37Rv
gauauccaaugccagaucg

SEQ ID NO: 1262686 - RNA, 20 nt, Mycobacterium tuberculosis H37Rv
gaguugaagaagcccgacga

SEQ ID NO: 1262687 - RNA, 15 nt, Mycobacterium tuberculosis H37Rv
gaguugagcugucgc

SEQ ID NO: 1262688 - RNA, 15 nt, Mycobacterium tuberculosis H37Rv
gaguugccgggucga

SEQ ID NO: 1262689 - RNA, 12 nt, Mycobacterium tuberculosis H37Rv
gaguugcggugc

SEQ ID NO: 1262690 - RNA, 13 nt, Mycobacterium tuberculosis H37Rv
gauaaccggcaug

SEQ ID NO: 1262691 - RNA, 21 nt, Mycobacterium tuberculosis H37Rv
gagucgacaagccgucggcga

SEQ ID NO: 1262692 - RNA, 17 nt, Mycobacterium tuberculosis H37Rv
gagucgaacaucaccgg

SEQ ID NO: 1262693 - RNA, 18 nt, Mycobacterium tuberculosis H37Rv
gagucaucuggcgcgcca

SEQ ID NO: 1262694 - RNA, 23 nt, Mycobacterium tuberculosis H37Rv
gaguccggcucauccgacgggau

SEQ ID NO: 1262695 - RNA, 17 nt, Mycobacterium tuberculosis H37Rv
gaguucgggcugcggca

SEQ ID NO: 1262696 - RNA, 22 nt, Mycobacterium tuberculosis H37Rv
gaguugaagaaucccgggcucu

SEQ ID NO: 1262697 - RNA, 12 nt, Mycobacterium tuberculosis H37Rv
gaguucggugcu

SEQ ID NO: 1262698 - RNA, 21 nt, Mycobacterium tuberculosis H37Rv
gagccaccggcgucgacgucg

SEQ ID NO: 1262699 - RNA, 13 nt, Mycobacterium tuberculosis H37Rv
gagccacgccagc

SEQ ID NO: 1262700 - RNA, 14 nt, Mycobacterium tuberculosis H37Rv
gagccaacuccacc

SEQ ID NO: 1262701 - RNA, 15 nt, Mycobacterium tuberculosis H37Rv
gagccaggacgacgc

SEQ ID NO: 1262702 - RNA, 22 nt, Mycobacterium tuberculosis H37Rv
gagccaggacgacgccgacgau

SEQ ID NO: 1262703 - RNA, 18 nt, Mycobacterium tuberculosis H37Rv
gagccaugccgcucggca

SEQ ID NO: 1262704 - RNA, 19 nt, Mycobacterium tuberculosis H37Rv
gagccccagcgacgucgca

SEQ ID NO: 1262705 - RNA, 22 nt, Mycobacterium tuberculosis H37Rv
gagcaugcuggaccucgcgacc

SEQ ID NO: 1262706 - RNA, 15 nt, Mycobacterium tuberculosis H37Rv
gagcauaccgccgcu

SEQ ID NO: 1262707 - RNA, 20 nt, Mycobacterium tuberculosis H37Rv
gacgucggugaccucggcga

SEQ ID NO: 1262708 - RNA, 16 nt, Mycobacterium tuberculosis H37Rv
gacgucggugaccucg

SEQ ID NO: 1262709 - RNA, 20 nt, Mycobacterium tuberculosis H37Rv
gacgucguagacaccuucga

SEQ ID NO: 1262710 - RNA, 24 nt, Mycobacterium tuberculosis H37Rv
gacgucguauucccaggauucagc

SEQ ID NO: 1262711 - RNA, 15 nt, Mycobacterium tuberculosis H37Rv
gacgucguuacugga

SEQ ID NO: 1262712 - RNA, 19 nt, Mycobacterium tuberculosis H37Rv
gacgucgucggugcgccac

SEQ ID NO: 1262713 - RNA, 14 nt, Mycobacterium tuberculosis H37Rv
gagcagcacgucga

SEQ ID NO: 1262714 - RNA, 18 nt, Mycobacterium tuberculosis H37Rv
gacgucguugccguccac

SEQ ID NO: 1262715 - RNA, 21 nt, Mycobacterium tuberculosis H37Rv
gacgucguugccguccaccga

SEQ ID NO: 1262716 - RNA, 16 nt, Mycobacterium tuberculosis H37Rv
gagcagcagcgggcug

SEQ ID NO: 1262717 - RNA, 13 nt, Mycobacterium tuberculosis H37Rv
gagcagccgcgac

SEQ ID NO: 1262718 - RNA, 14 nt, Mycobacterium tuberculosis H37Rv
gagcagccggccaa

SEQ ID NO: 1262719 - RNA, 18 nt, Mycobacterium tuberculosis H37Rv
gagcaggcgcaccaggcg

SEQ ID NO: 1262720 - RNA, 13 nt, Mycobacterium tuberculosis H37Rv
gagcagcucgcac

SEQ ID NO: 1262721 - RNA, 19 nt, Mycobacterium tuberculosis H37Rv
gagcaggucucguaucgca

SEQ ID NO: 1262722 - RNA, 16 nt, Mycobacterium tuberculosis H37Rv
gagcagggcucgucca

SEQ ID NO: 1262723 - RNA, 16 nt, Mycobacterium tuberculosis H37Rv
gagccguccgaccagg

SEQ ID NO: 1262724 - RNA, 20 nt, Mycobacterium tuberculosis H37Rv
gagccguagugucggcgucu

SEQ ID NO: 1262725 - RNA, 17 nt, Mycobacterium tuberculosis H37Rv
gagccguagugucggcg

SEQ ID NO: 1262726 - RNA, 23 nt, Mycobacterium tuberculosis H37Rv
gagccgucgucgagccggaacag

SEQ ID NO: 1262727 - RNA, 20 nt, Mycobacterium tuberculosis H37Rv
gagccucggccaucugcucg

SEQ ID NO: 1262728 - RNA, 18 nt, Mycobacterium tuberculosis H37Rv
gagccgggugcgagcgac

SEQ ID NO: 1262729 - RNA, 18 nt, Mycobacterium tuberculosis H37Rv
gagccgggcuggccgacu

SEQ ID NO: 1262730 - RNA, 16 nt, Mycobacterium tuberculosis H37Rv
gagccggugccgcggu

SEQ ID NO: 1262731 - RNA, 22 nt, Mycobacterium tuberculosis H37Rv
gagccgcugcgacaaaucggcg

SEQ ID NO: 1262732 - RNA, 22 nt, Mycobacterium tuberculosis H37Rv
gagccgcucggcguagcgagcg

SEQ ID NO: 1262733 - RNA, 16 nt, Mycobacterium tuberculosis H37Rv
gagccggaacagugcc

SEQ ID NO: 1262734 - RNA, 22 nt, Mycobacterium tuberculosis H37Rv
gagccggaacagugccaccuga

SEQ ID NO: 1262735 - RNA, 14 nt, Mycobacterium tuberculosis H37Rv
gagccgcugcggca

SEQ ID NO: 1262736 - RNA, 16 nt, Mycobacterium tuberculosis H37Rv
gagccggauucggcug

SEQ ID NO: 1262737 - RNA, 18 nt, Mycobacterium tuberculosis H37Rv
gagccgggaccauagucg

SEQ ID NO: 1262738 - RNA, 15 nt, Mycobacterium tuberculosis H37Rv
gagccggcgaagugc

SEQ ID NO: 1262739 - RNA, 21 nt, Mycobacterium tuberculosis H37Rv
gagccggcgaagugcuccacc

SEQ ID NO: 1262740 - RNA, 18 nt, Mycobacterium tuberculosis H37Rv
gagccggcggcgaccaga

SEQ ID NO: 1262741 - RNA, 14 nt, Mycobacterium tuberculosis H37Rv
gagccggccgugau

SEQ ID NO: 1262742 - RNA, 21 nt, Mycobacterium tuberculosis H37Rv
gagccggcccugcucgccguc

SEQ ID NO: 1262743 - RNA, 12 nt, Mycobacterium tuberculosis H37Rv
gagcccgccagc

SEQ ID NO: 1262744 - RNA, 22 nt, Mycobacterium tuberculosis H37Rv
gagccccugucaacgccgcggu

SEQ ID NO: 1262745 - RNA, 17 nt, Mycobacterium tuberculosis H37Rv
gagcccgacucuccggc

SEQ ID NO: 1262746 - RNA, 17 nt, Mycobacterium tuberculosis H37Rv
gagcccggcggcccgau

SEQ ID NO: 1262747 - RNA, 17 nt, Mycobacterium tuberculosis H37Rv
gagcccgucgaguaggu

SEQ ID NO: 1262748 - RNA, 13 nt, Mycobacterium tuberculosis H37Rv
gagcccgucgauc

SEQ ID NO: 1262749 - RNA, 17 nt, Mycobacterium tuberculosis H37Rv
gagccgcuaggacggcg

SEQ ID NO: 1262750 - RNA, 15 nt, Mycobacterium tuberculosis H37Rv
gagccgcggucggcg

SEQ ID NO: 1262751 - RNA, 19 nt, Mycobacterium tuberculosis H37Rv
gagccgccguggaacacga

SEQ ID NO: 1262752 - RNA, 17 nt, Mycobacterium tuberculosis H37Rv
gagccgcgaaaucaccg

SEQ ID NO: 1262753 - RNA, 12 nt, Mycobacterium tuberculosis H37Rv
gagccgccggau

SEQ ID NO: 1262754 - RNA, 13 nt, Mycobacterium tuberculosis H37Rv
gagccgagccgau

SEQ ID NO: 1262755 - RNA, 23 nt, Mycobacterium tuberculosis H37Rv
gagccgaggaauacucucgcgac

SEQ ID NO: 1262756 - RNA, 13 nt, Mycobacterium tuberculosis H37Rv
gagccgaucgccc

SEQ ID NO: 1262757 - RNA, 15 nt, Mycobacterium tuberculosis H37Rv
gagcgcacucaccuu

SEQ ID NO: 1262758 - RNA, 14 nt, Mycobacterium tuberculosis H37Rv
gagcgcaucggcca

SEQ ID NO: 1262759 - RNA, 19 nt, Mycobacterium tuberculosis H37Rv
gagcgcagcuugaucccau

SEQ ID NO: 1262760 - RNA, 23 nt, Mycobacterium tuberculosis H37Rv
gagcgcaaccagcaaugccgacu

SEQ ID NO: 1262761 - RNA, 18 nt, Mycobacterium tuberculosis H37Rv
gagcgagaaucacgguca

SEQ ID NO: 1262762 - RNA, 15 nt, Mycobacterium tuberculosis H37Rv
gagcgaugcgaccga

SEQ ID NO: 1262763 - RNA, 20 nt, Mycobacterium tuberculosis H37Rv
gagcgcaacucccagcacgg

SEQ ID NO: 1262764 - RNA, 21 nt, Mycobacterium tuberculosis H37Rv
gagcgcaaucgaccacgacgu

SEQ ID NO: 1262765 - RNA, 16 nt, Mycobacterium tuberculosis H37Rv
gagcgcacaccggcuu

SEQ ID NO: 1262766 - RNA, 13 nt, Mycobacterium tuberculosis H37Rv
gagcgcagcgccg

SEQ ID NO: 1262767 - RNA, 13 nt, Mycobacterium tuberculosis H37Rv
gagccugcucgca

SEQ ID NO: 1262768 - RNA, 18 nt, Mycobacterium tuberculosis H37Rv
gagcgaacccuucgcggu

SEQ ID NO: 1262769 - RNA, 19 nt, Mycobacterium tuberculosis H37Rv
gagcgaaccgaagccgucg

SEQ ID NO: 1262770 - RNA, 20 nt, Mycobacterium tuberculosis H37Rv
gagcgaaccgaagccgucga

SEQ ID NO: 1262771 - RNA, 15 nt, Mycobacterium tuberculosis H37Rv
gagcgaacggcgcag

SEQ ID NO: 1262772 - RNA, 23 nt, Mycobacterium tuberculosis H37Rv
gagcgaccgucccagcgccgcag

SEQ ID NO: 1262773 - RNA, 17 nt, Mycobacterium tuberculosis H37Rv
gagcgaccgcgagggcc

SEQ ID NO: 1262774 - RNA, 16 nt, Mycobacterium tuberculosis H37Rv
gagcgacugcagcggc

SEQ ID NO: 1262775 - RNA, 20 nt, Mycobacterium tuberculosis H37Rv
gagcgacugcagcggcgcau

SEQ ID NO: 1262776 - RNA, 13 nt, Mycobacterium tuberculosis H37Rv
gagcgaucaacgg

SEQ ID NO: 1262777 - RNA, 12 nt, Mycobacterium tuberculosis H37Rv
gagcgccagcgc

SEQ ID NO: 1262778 - RNA, 17 nt, Mycobacterium tuberculosis H37Rv
gagcgcgccuucacgcu

SEQ ID NO: 1262779 - RNA, 15 nt, Mycobacterium tuberculosis H37Rv
gagcgcgcgcggugc

SEQ ID NO: 1262780 - RNA, 19 nt, Mycobacterium tuberculosis H37Rv
gagcgcucgaucacggcgg

SEQ ID NO: 1262781 - RNA, 15 nt, Mycobacterium tuberculosis H37Rv
gagcggagccgccga

SEQ ID NO: 1262782 - RNA, 15 nt, Mycobacterium tuberculosis H37Rv
gagcggaaaaucacc

SEQ ID NO: 1262783 - RNA, 15 nt, Mycobacterium tuberculosis H37Rv
gagcgcuucgucgcc

SEQ ID NO: 1262784 - RNA, 16 nt, Mycobacterium tuberculosis H37Rv
gagcgcuucgaggugg

SEQ ID NO: 1262785 - RNA, 17 nt, Mycobacterium tuberculosis H37Rv
gagcgcgucgcgggauu

SEQ ID NO: 1262786 - RNA, 15 nt, Mycobacterium tuberculosis H37Rv
gagcgcgccggccau

SEQ ID NO: 1262787 - RNA, 13 nt, Mycobacterium tuberculosis H37Rv
gagcgcggcaacc

SEQ ID NO: 1262788 - RNA, 16 nt, Mycobacterium tuberculosis H37Rv
gagcgcggccugcacc

SEQ ID NO: 1262789 - RNA, 19 nt, Mycobacterium tuberculosis H37Rv
gagcgcggccugcaccagc

SEQ ID NO: 1262790 - RNA, 16 nt, Mycobacterium tuberculosis H37Rv
gagcggcuugcggugg

SEQ ID NO: 1262791 - RNA, 22 nt, Mycobacterium tuberculosis H37Rv
gagcgggcgggccugcgcgauc

SEQ ID NO: 1262792 - RNA, 12 nt, Mycobacterium tuberculosis H37Rv
gagcggugccga

SEQ ID NO: 1262793 - RNA, 22 nt, Mycobacterium tuberculosis H37Rv
gagcgguaggcguugaucgccg

SEQ ID NO: 1262794 - RNA, 16 nt, Mycobacterium tuberculosis H37Rv
gagcggucgacguguu

SEQ ID NO: 1262795 - RNA, 15 nt, Mycobacterium tuberculosis H37Rv
gagcgguugaucgcg

SEQ ID NO: 1262796 - RNA, 18 nt, Mycobacterium tuberculosis H37Rv
gagcggucagcgucgauc

SEQ ID NO: 1262797 - RNA, 22 nt, Mycobacterium tuberculosis H37Rv
gagcgguugccuucuuggcggg

SEQ ID NO: 1262798 - RNA, 17 nt, Mycobacterium tuberculosis H37Rv
gagcguaacgguaaccg

SEQ ID NO: 1262799 - RNA, 16 nt, Mycobacterium tuberculosis H37Rv
gagcggccucgggacu

SEQ ID NO: 1262800 - RNA, 12 nt, Mycobacterium tuberculosis H37Rv
gagcggcagcca

SEQ ID NO: 1262801 - RNA, 19 nt, Mycobacterium tuberculosis H37Rv
gagcggaacgucacugcga

SEQ ID NO: 1262802 - RNA, 15 nt, Mycobacterium tuberculosis H37Rv
gagcggcggcacugg

SEQ ID NO: 1262803 - RNA, 20 nt, Mycobacterium tuberculosis H37Rv
gagcgggcaagucgcccagc

SEQ ID NO: 1262804 - RNA, 19 nt, Mycobacterium tuberculosis H37Rv
gagcgugaagucacggcgg

SEQ ID NO: 1262805 - RNA, 14 nt, Mycobacterium tuberculosis H37Rv
gagcgugagcgccg

SEQ ID NO: 1262806 - RNA, 17 nt, Mycobacterium tuberculosis H37Rv
gagcgugcccgucucgu

SEQ ID NO: 1262807 - RNA, 12 nt, Mycobacterium tuberculosis H37Rv
gagcgugccgca

SEQ ID NO: 1262808 - RNA, 14 nt, Mycobacterium tuberculosis H37Rv
gagcgugaaccugg

SEQ ID NO: 1262809 - RNA, 15 nt, Mycobacterium tuberculosis H37Rv
gagcguuggcuucuu

SEQ ID NO: 1262810 - RNA, 14 nt, Mycobacterium tuberculosis H37Rv
gagcguucagcacg

SEQ ID NO: 1262811 - RNA, 15 nt, Mycobacterium tuberculosis H37Rv
gagcgucgucgccgg

SEQ ID NO: 1262812 - RNA, 22 nt, Mycobacterium tuberculosis H37Rv
gagcgugaaccuggcgacgcga

SEQ ID NO: 1262813 - RNA, 13 nt, Mycobacterium tuberculosis H37Rv
gagcguaggccag

SEQ ID NO: 1262814 - RNA, 20 nt, Mycobacterium tuberculosis H37Rv
gagcuauucggugucgccac

SEQ ID NO: 1262815 - RNA, 20 nt, Mycobacterium tuberculosis H37Rv
gagcuagacccgucaccgcc

SEQ ID NO: 1262816 - RNA, 14 nt, Mycobacterium tuberculosis H37Rv
gagcuccgcggcga

SEQ ID NO: 1262817 - RNA, 14 nt, Mycobacterium tuberculosis H37Rv
gagcuccgucgcgg

SEQ ID NO: 1262818 - RNA, 21 nt, Mycobacterium tuberculosis H37Rv
gagcugauccggguggcguca

SEQ ID NO: 1262819 - RNA, 22 nt, Mycobacterium tuberculosis H37Rv
gagcugauuguguuccaccagc

SEQ ID NO: 1262820 - RNA, 16 nt, Mycobacterium tuberculosis H37Rv
gagcucggucaccacg

SEQ ID NO: 1262821 - RNA, 22 nt, Mycobacterium tuberculosis H37Rv
gagcucguagaggucaucagcg

SEQ ID NO: 1262822 - RNA, 17 nt, Mycobacterium tuberculosis H37Rv
gagcucggcugcucgac

SEQ ID NO: 1262823 - RNA, 22 nt, Mycobacterium tuberculosis H37Rv
gagcucggcgaacggcaccaga

SEQ ID NO: 1262824 - RNA, 12 nt, Mycobacterium tuberculosis H37Rv
gaugaugccgga

SEQ ID NO: 1262825 - RNA, 16 nt, Mycobacterium tuberculosis H37Rv
gaugaugccggcguug

SEQ ID NO: 1262826 - RNA, 17 nt, Mycobacterium tuberculosis H37Rv
gaugaugcgugaccagu

SEQ ID NO: 1262827 - RNA, 15 nt, Mycobacterium tuberculosis H37Rv
gaugaugugcgguga

SEQ ID NO: 1262828 - RNA, 22 nt, Mycobacterium tuberculosis H37Rv
gaugauguggugugccugcguc

SEQ ID NO: 1262829 - RNA, 15 nt, Mycobacterium tuberculosis H37Rv
gaugaucccggucuu

SEQ ID NO: 1262830 - RNA, 19 nt, Mycobacterium tuberculosis H37Rv
gaugaugcccaacgacaug

SEQ ID NO: 1262831 - RNA, 19 nt, Mycobacterium tuberculosis H37Rv
gaugcagcugcccggcgug

SEQ ID NO: 1262832 - RNA, 16 nt, Mycobacterium tuberculosis H37Rv
gaugcagugcgacccg

SEQ ID NO: 1262833 - RNA, 16 nt, Mycobacterium tuberculosis H37Rv
gaugcaacgccaaaau

SEQ ID NO: 1262834 - RNA, 15 nt, Mycobacterium tuberculosis H37Rv
gaugcaacgcggcga

SEQ ID NO: 1262835 - RNA, 16 nt, Mycobacterium tuberculosis H37Rv
gaugauuucgccgagc

SEQ ID NO: 1262836 - RNA, 16 nt, Mycobacterium tuberculosis H37Rv
gaugcacaggccgacg

SEQ ID NO: 1262837 - RNA, 17 nt, Mycobacterium tuberculosis H37Rv
gaugcacaggccgacga

SEQ ID NO: 1262838 - RNA, 21 nt, Mycobacterium tuberculosis H37Rv
gaugacguugcagccggcaua

SEQ ID NO: 1262839 - RNA, 20 nt, Mycobacterium tuberculosis H37Rv
gaugagcucguagaggucau

SEQ ID NO: 1262840 - RNA, 17 nt, Mycobacterium tuberculosis H37Rv
gaugacgcagucgccca

SEQ ID NO: 1262841 - RNA, 14 nt, Mycobacterium tuberculosis H37Rv
gaugacggugccga

SEQ ID NO: 1262842 - RNA, 13 nt, Mycobacterium tuberculosis H37Rv
gaugaaacgccgu

SEQ ID NO: 1262843 - RNA, 14 nt, Mycobacterium tuberculosis H37Rv
gaugaaacgccguc

SEQ ID NO: 1262844 - RNA, 21 nt, Mycobacterium tuberculosis H37Rv
gaugaccgguauuaccgccgu

SEQ ID NO: 1262845 - RNA, 14 nt, Mycobacterium tuberculosis H37Rv
gaugaccgucgcac

SEQ ID NO: 1262846 - RNA, 15 nt, Mycobacterium tuberculosis H37Rv
gaucgugccgggacc

SEQ ID NO: 1262847 - RNA, 14 nt, Mycobacterium tuberculosis H37Rv
gaucgugccggcga

SEQ ID NO: 1262848 - RNA, 23 nt, Mycobacterium tuberculosis H37Rv
gaucgugcuggugguaucggcgu

SEQ ID NO: 1262849 - RNA, 17 nt, Mycobacterium tuberculosis H37Rv
gaucguggcgaccacga

SEQ ID NO: 1262850 - RNA, 20 nt, Mycobacterium tuberculosis H37Rv
gaucguggcgaccacgauga

SEQ ID NO: 1262851 - RNA, 23 nt, Mycobacterium tuberculosis H37Rv
gaucgugugaggccuucgccgac

SEQ ID NO: 1262852 - RNA, 14 nt, Mycobacterium tuberculosis H37Rv
gaucggcgccgcau

SEQ ID NO: 1262853 - RNA, 20 nt, Mycobacterium tuberculosis H37Rv
gaucggcgauugcaccaugg

SEQ ID NO: 1262854 - RNA, 17 nt, Mycobacterium tuberculosis H37Rv
gaucggccugcagcgau

SEQ ID NO: 1262855 - RNA, 17 nt, Mycobacterium tuberculosis H37Rv
gaucgugaacacgucgc

SEQ ID NO: 1262856 - RNA, 13 nt, Mycobacterium tuberculosis H37Rv
gaucgucucggcu

SEQ ID NO: 1262857 - RNA, 20 nt, Mycobacterium tuberculosis H37Rv
gaucggcgcggccguagugc

SEQ ID NO: 1262858 - RNA, 22 nt, Mycobacterium tuberculosis H37Rv
gaucggcgcgccgaucggcacc

SEQ ID NO: 1262859 - RNA, 19 nt, Mycobacterium tuberculosis H37Rv
gaucguuccgauccggugg

SEQ ID NO: 1262860 - RNA, 16 nt, Mycobacterium tuberculosis H37Rv
gaucguugccucgucg

SEQ ID NO: 1262861 - RNA, 20 nt, Mycobacterium tuberculosis H37Rv
gaucguuccaggccgcgucg

SEQ ID NO: 1262862 - RNA, 12 nt, Mycobacterium tuberculosis H37Rv
gaucguguccac

SEQ ID NO: 1262863 - RNA, 20 nt, Mycobacterium tuberculosis H37Rv
gaucguugccucgucgccgc

SEQ ID NO: 1262864 - RNA, 21 nt, Mycobacterium tuberculosis H37Rv
gaucucacccagcucgcgcac

SEQ ID NO: 1262865 - RNA, 23 nt, Mycobacterium tuberculosis H37Rv
gaucucacccagcucgcgcaccc

SEQ ID NO: 1262866 - RNA, 15 nt, Mycobacterium tuberculosis H37Rv
gaucucaucgggcca

SEQ ID NO: 1262867 - RNA, 23 nt, Mycobacterium tuberculosis H37Rv
gaucuccaccuucugguccagca

SEQ ID NO: 1262868 - RNA, 22 nt, Mycobacterium tuberculosis H37Rv
gaucugggcuuucgcgugcggc

SEQ ID NO: 1262869 - RNA, 18 nt, Mycobacterium tuberculosis H37Rv
gaucuugucgcguucggc

SEQ ID NO: 1262870 - RNA, 13 nt, Mycobacterium tuberculosis H37Rv
gaucuugacgguc

SEQ ID NO: 1262871 - RNA, 22 nt, Mycobacterium tuberculosis H37Rv
gaucugcgcggcccgcuguggg

SEQ ID NO: 1262872 - RNA, 23 nt, Mycobacterium tuberculosis H37Rv
gaucugcgccaucacaucggccu

SEQ ID NO: 1262873 - RNA, 21 nt, Mycobacterium tuberculosis H37Rv
gaucugcguuugggucaucga

SEQ ID NO: 1262874 - RNA, 17 nt, Mycobacterium tuberculosis H37Rv
gaucugcuccucgguca

SEQ ID NO: 1262875 - RNA, 14 nt, Mycobacterium tuberculosis H37Rv
gaucugcugggcaa

SEQ ID NO: 1262876 - RNA, 14 nt, Mycobacterium tuberculosis H37Rv
gaucccgaugguca

SEQ ID NO: 1262877 - RNA, 19 nt, Mycobacterium tuberculosis H37Rv
gaucccgccaccgaacagu

SEQ ID NO: 1262878 - RNA, 19 nt, Mycobacterium tuberculosis H37Rv
gaucccggccaggccgaca

SEQ ID NO: 1262879 - RNA, 14 nt, Mycobacterium tuberculosis H37Rv
gauccggucggcca

SEQ ID NO: 1262880 - RNA, 23 nt, Mycobacterium tuberculosis H37Rv
gauccggugguuguggcggguca

SEQ ID NO: 1262881 - RNA, 15 nt, Mycobacterium tuberculosis H37Rv
gauccugaccagcca

SEQ ID NO: 1262882 - RNA, 14 nt, Mycobacterium tuberculosis H37Rv
gaucgacaccguga

SEQ ID NO: 1262883 - RNA, 24 nt, Mycobacterium tuberculosis H37Rv
gaucgacagccccgcggccagcag

SEQ ID NO: 1262884 - RNA, 15 nt, Mycobacterium tuberculosis H37Rv
gaucgacgcucggcu

SEQ ID NO: 1262885 - RNA, 14 nt, Mycobacterium tuberculosis H37Rv
gaucccacgaaucc

SEQ ID NO: 1262886 - RNA, 18 nt, Mycobacterium tuberculosis H37Rv
gaucccagcgcagcggac

SEQ ID NO: 1262887 - RNA, 16 nt, Mycobacterium tuberculosis H37Rv
gauccccagcaccacg

SEQ ID NO: 1262888 - RNA, 17 nt, Mycobacterium tuberculosis H37Rv
gauccauuagcacaucg

SEQ ID NO: 1262889 - RNA, 19 nt, Mycobacterium tuberculosis H37Rv
gauccagggccgacgcgaa

SEQ ID NO: 1262890 - RNA, 16 nt, Mycobacterium tuberculosis H37Rv
gaucacgucggcguug

SEQ ID NO: 1262891 - RNA, 19 nt, Mycobacterium tuberculosis H37Rv
gaucacgggcuaccggcag

SEQ ID NO: 1262892 - RNA, 15 nt, Mycobacterium tuberculosis H37Rv
gaucacgccgacgau

SEQ ID NO: 1262893 - RNA, 24 nt, Mycobacterium tuberculosis H37Rv
gaucacgcgaaugacgauccagcc

SEQ ID NO: 1262894 - RNA, 17 nt, Mycobacterium tuberculosis H37Rv
gaucaccuucgucgcgg

SEQ ID NO: 1262895 - RNA, 20 nt, Mycobacterium tuberculosis H37Rv
gaucaccgagucgacggcca

SEQ ID NO: 1262896 - RNA, 14 nt, Mycobacterium tuberculosis H37Rv
gaucaccgacaccg

SEQ ID NO: 1262897 - RNA, 22 nt, Mycobacterium tuberculosis H37Rv
gaucacccacucgacgucgucg

SEQ ID NO: 1262898 - RNA, 12 nt, Mycobacterium tuberculosis H37Rv
gaucgacggcca

SEQ ID NO: 1262899 - RNA, 12 nt, Mycobacterium tuberculosis H37Rv
gaucgacuccgg

SEQ ID NO: 1262900 - RNA, 17 nt, Mycobacterium tuberculosis H37Rv
gaucgagcagggugacc

SEQ ID NO: 1262901 - RNA, 21 nt, Mycobacterium tuberculosis H37Rv
gaucgagcaguuccagcucgc

SEQ ID NO: 1262902 - RNA, 19 nt, Mycobacterium tuberculosis H37Rv
gaucgagggggacgcugau

SEQ ID NO: 1262903 - RNA, 23 nt, Mycobacterium tuberculosis H37Rv
gaucgaggaguuggugcagcgac

SEQ ID NO: 1262904 - RNA, 20 nt, Mycobacterium tuberculosis H37Rv
gaucgagggggacgcugauc

SEQ ID NO: 1262905 - RNA, 14 nt, Mycobacterium tuberculosis H37Rv
gaucgagaucaccu

SEQ ID NO: 1262906 - RNA, 12 nt, Mycobacterium tuberculosis H37Rv
gaucgccgcgaa

SEQ ID NO: 1262907 - RNA, 15 nt, Mycobacterium tuberculosis H37Rv
gaucgccggccgcgu

SEQ ID NO: 1262908 - RNA, 19 nt, Mycobacterium tuberculosis H37Rv
gaucgcgaacaucgccagc

SEQ ID NO: 1262909 - RNA, 21 nt, Mycobacterium tuberculosis H37Rv
gaucgcgaacaucgccagcgc

SEQ ID NO: 1262910 - RNA, 21 nt, Mycobacterium tuberculosis H37Rv
gaucgcgacccgaucgcgcca

SEQ ID NO: 1262911 - RNA, 20 nt, Mycobacterium tuberculosis H37Rv
gaucgccugggcuuggcgac

SEQ ID NO: 1262912 - RNA, 13 nt, Mycobacterium tuberculosis H37Rv
gaucgccucgacg

SEQ ID NO: 1262913 - RNA, 23 nt, Mycobacterium tuberculosis H37Rv
gaucgcgcccugcggaucggaca

SEQ ID NO: 1262914 - RNA, 22 nt, Mycobacterium tuberculosis H37Rv
gaucgcgccgggcucggcguug

SEQ ID NO: 1262915 - RNA, 15 nt, Mycobacterium tuberculosis H37Rv
gaucgcgugcggugc

SEQ ID NO: 1262916 - RNA, 16 nt, Mycobacterium tuberculosis H37Rv
gaucgcguccuccucg

SEQ ID NO: 1262917 - RNA, 13 nt, Mycobacterium tuberculosis H37Rv
gaucgcgccuauc

SEQ ID NO: 1262918 - RNA, 12 nt, Mycobacterium tuberculosis H37Rv
gaucgcgccguc

SEQ ID NO: 1262919 - RNA, 13 nt, Mycobacterium tuberculosis H37Rv
gaucgccugggcu

SEQ ID NO: 1262920 - RNA, 14 nt, Mycobacterium tuberculosis H37Rv
gaucgcgcgcaccg

SEQ ID NO: 1262921 - RNA, 16 nt, Mycobacterium tuberculosis H37Rv
gaucgcuuccucguag

SEQ ID NO: 1262922 - RNA, 15 nt, Mycobacterium tuberculosis H37Rv
gaucgcugccagcgg

SEQ ID NO: 1262923 - RNA, 14 nt, Mycobacterium tuberculosis H37Rv
gaucgcuacgucga

SEQ ID NO: 1262924 - RNA, 17 nt, Mycobacterium tuberculosis H37Rv
gaucggacccgcgggau

SEQ ID NO: 1262925 - RNA, 18 nt, Mycobacterium tuberculosis H37Rv
gaugccggcugccgcacc

SEQ ID NO: 1262926 - RNA, 18 nt, Mycobacterium tuberculosis H37Rv
gaugccgcacccgaucga

SEQ ID NO: 1262927 - RNA, 13 nt, Mycobacterium tuberculosis H37Rv
gaugccgaugacc

SEQ ID NO: 1262928 - RNA, 16 nt, Mycobacterium tuberculosis H37Rv
gaugcgauucugcguc

SEQ ID NO: 1262929 - RNA, 22 nt, Mycobacterium tuberculosis H37Rv
gaugccgguggggcccucguag

SEQ ID NO: 1262930 - RNA, 16 nt, Mycobacterium tuberculosis H37Rv
gaugcgaucgacgauc

SEQ ID NO: 1262931 - RNA, 22 nt, Mycobacterium tuberculosis H37Rv
gaugccgggcugaggcggcgac

SEQ ID NO: 1262932 - RNA, 23 nt, Mycobacterium tuberculosis H37Rv
gaugcgcacucccggcucggcca

SEQ ID NO: 1262933 - RNA, 21 nt, Mycobacterium tuberculosis H37Rv
gaugcgcagugcaccgcgucg

SEQ ID NO: 1262934 - RNA, 22 nt, Mycobacterium tuberculosis H37Rv
gaugcgcacucccggcucggcc

SEQ ID NO: 1262935 - RNA, 19 nt, Mycobacterium tuberculosis H37Rv
gaugccaucaacgacuucg

SEQ ID NO: 1262936 - RNA, 21 nt, Mycobacterium tuberculosis H37Rv
gaugcccaagcccucgacguc

SEQ ID NO: 1262937 - RNA, 15 nt, Mycobacterium tuberculosis H37Rv
gaugccacggcgucg

SEQ ID NO: 1262938 - RNA, 18 nt, Mycobacterium tuberculosis H37Rv
gaugcccacggugccggc

SEQ ID NO: 1262939 - RNA, 14 nt, Mycobacterium tuberculosis H37Rv
gaugccgacggcgc

SEQ ID NO: 1262940 - RNA, 22 nt, Mycobacterium tuberculosis H37Rv
gaugcccuugagaucggaaccc

SEQ ID NO: 1262941 - RNA, 13 nt, Mycobacterium tuberculosis H37Rv
gaugcccgcgauc

SEQ ID NO: 1262942 - RNA, 14 nt, Mycobacterium tuberculosis H37Rv
gaugcccgacaccg

SEQ ID NO: 1262943 - RNA, 16 nt, Mycobacterium tuberculosis H37Rv
gaugccccacggugcg

SEQ ID NO: 1262944 - RNA, 17 nt, Mycobacterium tuberculosis H37Rv
gaugcuggucggcgaug

SEQ ID NO: 1262945 - RNA, 21 nt, Mycobacterium tuberculosis H37Rv
gaugcugucagacggcgucug

SEQ ID NO: 1262946 - RNA, 17 nt, Mycobacterium tuberculosis H37Rv
gaugcggugucgggcug

SEQ ID NO: 1262947 - RNA, 12 nt, Mycobacterium tuberculosis H37Rv
gaugcguucggc

SEQ ID NO: 1262948 - RNA, 14 nt, Mycobacterium tuberculosis H37Rv
gaugcgugccgacc

SEQ ID NO: 1262949 - RNA, 17 nt, Mycobacterium tuberculosis H37Rv
gaugcggaacgccgagc

SEQ ID NO: 1262950 - RNA, 22 nt, Mycobacterium tuberculosis H37Rv
gaugcggucgacgggcucguca

SEQ ID NO: 1262951 - RNA, 21 nt, Mycobacterium tuberculosis H37Rv
gaugcgcguuacccaucgcca

SEQ ID NO: 1262952 - RNA, 17 nt, Mycobacterium tuberculosis H37Rv
gaugcgcgucucgagcg

SEQ ID NO: 1262953 - RNA, 23 nt, Mycobacterium tuberculosis H37Rv
gaugcgcuuccaucgccacuguu

SEQ ID NO: 1262954 - RNA, 18 nt, Mycobacterium tuberculosis H37Rv
gaugcgcuuccaucgcca

SEQ ID NO: 1262955 - RNA, 13 nt, Mycobacterium tuberculosis H37Rv
gaugcgcucggcc

SEQ ID NO: 1262956 - RNA, 23 nt, Mycobacterium tuberculosis H37Rv
gauggccgccgcgaggaugcuga

SEQ ID NO: 1262957 - RNA, 13 nt, Mycobacterium tuberculosis H37Rv
gauggccgccgac

SEQ ID NO: 1262958 - RNA, 15 nt, Mycobacterium tuberculosis H37Rv
gauggccgacgcugc

SEQ ID NO: 1262959 - RNA, 13 nt, Mycobacterium tuberculosis H37Rv
gauggacucgaca

SEQ ID NO: 1262960 - RNA, 16 nt, Mycobacterium tuberculosis H37Rv
gauggacaccaccucg

SEQ ID NO: 1262961 - RNA, 15 nt, Mycobacterium tuberculosis H37Rv
gauggccaucaucga

SEQ ID NO: 1262962 - RNA, 23 nt, Mycobacterium tuberculosis H37Rv
gauggccaucagcucgccagggu

SEQ ID NO: 1262963 - RNA, 15 nt, Mycobacterium tuberculosis H37Rv
gauggcggccaccag

SEQ ID NO: 1262964 - RNA, 16 nt, Mycobacterium tuberculosis H37Rv
gauggcggcgacccgu

SEQ ID NO: 1262965 - RNA, 22 nt, Mycobacterium tuberculosis H37Rv
gauggcggcgcguucgucgucg

SEQ ID NO: 1262966 - RNA, 14 nt, Mycobacterium tuberculosis H37Rv
gauggcgucggcca

SEQ ID NO: 1262967 - RNA, 22 nt, Mycobacterium tuberculosis H37Rv
gauggcgucggugaaugccguc

SEQ ID NO: 1262968 - RNA, 20 nt, Mycobacterium tuberculosis H37Rv
gauggcguuugccggccgau

SEQ ID NO: 1262969 - RNA, 21 nt, Mycobacterium tuberculosis H37Rv
gauggcuaccccagggagugc

SEQ ID NO: 1262970 - RNA, 17 nt, Mycobacterium tuberculosis H37Rv
gaugguguccucgucga

SEQ ID NO: 1262971 - RNA, 14 nt, Mycobacterium tuberculosis H37Rv
gauguaaugcgggc

SEQ ID NO: 1262972 - RNA, 17 nt, Mycobacterium tuberculosis H37Rv
gauguacagcgggaucc

SEQ ID NO: 1262973 - RNA, 16 nt, Mycobacterium tuberculosis H37Rv
gaugguuggaucgcca

SEQ ID NO: 1262974 - RNA, 22 nt, Mycobacterium tuberculosis H37Rv
gaugguucaugaacaucggccg

SEQ ID NO: 1262975 - RNA, 16 nt, Mycobacterium tuberculosis H37Rv
gauguaccucaucgca

SEQ ID NO: 1262976 - RNA, 16 nt, Mycobacterium tuberculosis H37Rv
gaugucaacgugguca

SEQ ID NO: 1262977 - RNA, 16 nt, Mycobacterium tuberculosis H37Rv
gauguaugacagguca

SEQ ID NO: 1262978 - RNA, 16 nt, Mycobacterium tuberculosis H37Rv
gauguccccgacggac

SEQ ID NO: 1262979 - RNA, 19 nt, Mycobacterium tuberculosis H37Rv
gauguccaggagugcgggc

SEQ ID NO: 1262980 - RNA, 18 nt, Mycobacterium tuberculosis H37Rv
gauguccucgaugcgggc

SEQ ID NO: 1262981 - RNA, 15 nt, Mycobacterium tuberculosis H37Rv
gauguccuugcgguc

SEQ ID NO: 1262982 - RNA, 17 nt, Mycobacterium tuberculosis H37Rv
gauguccgcggccacca

SEQ ID NO: 1262983 - RNA, 16 nt, Mycobacterium tuberculosis H37Rv
gauguccgacgcacca

SEQ ID NO: 1262984 - RNA, 16 nt, Mycobacterium tuberculosis H37Rv
gauguccucgacaccc

SEQ ID NO: 1262985 - RNA, 14 nt, Mycobacterium tuberculosis H37Rv
gauguccccgacgg

SEQ ID NO: 1262986 - RNA, 20 nt, Mycobacterium tuberculosis H37Rv
gauguugcagaacucgcgua

SEQ ID NO: 1262987 - RNA, 16 nt, Mycobacterium tuberculosis H37Rv
gaugucucggcaccac

SEQ ID NO: 1262988 - RNA, 15 nt, Mycobacterium tuberculosis H37Rv
gaugugaguccagcc

SEQ ID NO: 1262989 - RNA, 19 nt, Mycobacterium tuberculosis H37Rv
gaugugacuuauccggcca

SEQ ID NO: 1262990 - RNA, 14 nt, Mycobacterium tuberculosis H37Rv
gaugugaccgaaca

SEQ ID NO: 1262991 - RNA, 14 nt, Mycobacterium tuberculosis H37Rv
gaugucggcaggua

SEQ ID NO: 1262992 - RNA, 19 nt, Mycobacterium tuberculosis H37Rv
gaugucgcggucgaggucc

SEQ ID NO: 1262993 - RNA, 15 nt, Mycobacterium tuberculosis H37Rv
gaugucggugcgucc

SEQ ID NO: 1262994 - RNA, 17 nt, Mycobacterium tuberculosis H37Rv
gaugucgucgacaucaa

SEQ ID NO: 1262995 - RNA, 23 nt, Mycobacterium tuberculosis H37Rv
gaugucggggccgucgucgguca

SEQ ID NO: 1262996 - RNA, 23 nt, Mycobacterium tuberculosis H37Rv
gaugucggcgaaccacggcagcc

SEQ ID NO: 1262997 - RNA, 22 nt, Mycobacterium tuberculosis H37Rv
gauugaccaacccucgccgguc

SEQ ID NO: 1262998 - RNA, 22 nt, Mycobacterium tuberculosis H37Rv
gauuccgcacccccgucgauca

SEQ ID NO: 1262999 - RNA, 22 nt, Mycobacterium tuberculosis H37Rv
gauuccaauugggcgaugcggc

SEQ ID NO: 1263000 - RNA, 15 nt, Mycobacterium tuberculosis H37Rv
gauuaccagcggcac

SEQ ID NO: 1263001 - RNA, 20 nt, Mycobacterium tuberculosis H37Rv
gauugcggcacggaugcgau

SEQ ID NO: 1263002 - RNA, 20 nt, Mycobacterium tuberculosis H37Rv
gauugcgcgcugagcucgau

SEQ ID NO: 1263003 - RNA, 19 nt, Mycobacterium tuberculosis H37Rv
gauugcgcgggcaucgucg

SEQ ID NO: 1263004 - RNA, 23 nt, Mycobacterium tuberculosis H37Rv
gauugcgaagggcaccggcgauc

SEQ ID NO: 1263005 - RNA, 23 nt, Mycobacterium tuberculosis H37Rv
gauugcaccauggcgcgaccucc

SEQ ID NO: 1263006 - RNA, 21 nt, Mycobacterium tuberculosis H37Rv
gauugaggcuggucugcaggc

SEQ ID NO: 1263007 - RNA, 17 nt, Mycobacterium tuberculosis H37Rv
gauugcccgcgcucgca

SEQ ID NO: 1263008 - RNA, 13 nt, Mycobacterium tuberculosis H37Rv
gauugccccgcau

SEQ ID NO: 1263009 - RNA, 14 nt, Mycobacterium tuberculosis H37Rv
gauuggcucgagca

SEQ ID NO: 1263010 - RNA, 14 nt, Mycobacterium tuberculosis H37Rv
gauuggcucgccga

SEQ ID NO: 1263011 - RNA, 15 nt, Mycobacterium tuberculosis H37Rv
gauuggcucgccgaa

SEQ ID NO: 1263012 - RNA, 15 nt, Mycobacterium tuberculosis H37Rv
gauuuggaucggcug

SEQ ID NO: 1263013 - RNA, 20 nt, Mycobacterium tuberculosis H37Rv
gauuuugcgucugcucgcgc

SEQ ID NO: 1263014 - RNA, 18 nt, Mycobacterium tuberculosis H37Rv
gcaaaaucgucagcgccg

SEQ ID NO: 1263015 - RNA, 23 nt, Mycobacterium tuberculosis H37Rv
gcaaaccgaucaauccgcccuug

SEQ ID NO: 1263016 - RNA, 18 nt, Mycobacterium tuberculosis H37Rv
gcaaaccgaucaauccgc

SEQ ID NO: 1263017 - RNA, 21 nt, Mycobacterium tuberculosis H37Rv
gcaaaaacgcugccgccguuc

SEQ ID NO: 1263018 - RNA, 15 nt, Mycobacterium tuberculosis H37Rv
gcagcgaguggccga

SEQ ID NO: 1263019 - RNA, 18 nt, Mycobacterium tuberculosis H37Rv
gcagcgaguggccgagua

SEQ ID NO: 1263020 - RNA, 16 nt, Mycobacterium tuberculosis H37Rv
gcagccuggucgcgca

SEQ ID NO: 1263021 - RNA, 22 nt, Mycobacterium tuberculosis H37Rv
gcagccugcgccgcgcgagauc

SEQ ID NO: 1263022 - RNA, 14 nt, Mycobacterium tuberculosis H37Rv
gcagcgacuccagc

SEQ ID NO: 1263023 - RNA, 17 nt, Mycobacterium tuberculosis H37Rv
gcagccagggcgccgaa

SEQ ID NO: 1263024 - RNA, 16 nt, Mycobacterium tuberculosis H37Rv
gcagccagcggcgaag

SEQ ID NO: 1263025 - RNA, 16 nt, Mycobacterium tuberculosis H37Rv
gcagccaggagccgau

SEQ ID NO: 1263026 - RNA, 18 nt, Mycobacterium tuberculosis H37Rv
gcagccagcugaacacga

SEQ ID NO: 1263027 - RNA, 21 nt, Mycobacterium tuberculosis H37Rv
gcagccucgaguucgaccggc

SEQ ID NO: 1263028 - RNA, 22 nt, Mycobacterium tuberculosis H37Rv
gcagcgccgacagccgauccga

SEQ ID NO: 1263029 - RNA, 16 nt, Mycobacterium tuberculosis H37Rv
gcagcgccgacagccg

SEQ ID NO: 1263030 - RNA, 18 nt, Mycobacterium tuberculosis H37Rv
gcagcgccgacagccgau

SEQ ID NO: 1263031 - RNA, 15 nt, Mycobacterium tuberculosis H37Rv
gcagcgccgacagcc

SEQ ID NO: 1263032 - RNA, 14 nt, Mycobacterium tuberculosis H37Rv
gcagcgccgacagc

SEQ ID NO: 1263033 - RNA, 20 nt, Mycobacterium tuberculosis H37Rv
gcagcgcccuuggacgcgau

SEQ ID NO: 1263034 - RNA, 13 nt, Mycobacterium tuberculosis H37Rv
gcagcgccagcgg

SEQ ID NO: 1263035 - RNA, 20 nt, Mycobacterium tuberculosis H37Rv
gcagcgcggaugucggcauc

SEQ ID NO: 1263036 - RNA, 18 nt, Mycobacterium tuberculosis H37Rv
gcagcgcgcccgacaccc

SEQ ID NO: 1263037 - RNA, 14 nt, Mycobacterium tuberculosis H37Rv
gcagcgccgucagc

SEQ ID NO: 1263038 - RNA, 13 nt, Mycobacterium tuberculosis H37Rv
gcagcgccggcag

SEQ ID NO: 1263039 - RNA, 20 nt, Mycobacterium tuberculosis H37Rv
gcagcgccggcgggcucggu

SEQ ID NO: 1263040 - RNA, 22 nt, Mycobacterium tuberculosis H37Rv
gcagcgccggcgggcucggucc

SEQ ID NO: 1263041 - RNA, 21 nt, Mycobacterium tuberculosis H37Rv
gcagcgccucauccuccaguu

SEQ ID NO: 1263042 - RNA, 15 nt, Mycobacterium tuberculosis H37Rv
gcagcgccuaccagc

SEQ ID NO: 1263043 - RNA, 14 nt, Mycobacterium tuberculosis H37Rv
gcagcgccucgauc

SEQ ID NO: 1263044 - RNA, 14 nt, Mycobacterium tuberculosis H37Rv
gcagcgcgauggcc

SEQ ID NO: 1263045 - RNA, 19 nt, Mycobacterium tuberculosis H37Rv
gcagcgguccagacaucag

SEQ ID NO: 1263046 - RNA, 16 nt, Mycobacterium tuberculosis H37Rv
gcagcguccgaaccac

SEQ ID NO: 1263047 - RNA, 22 nt, Mycobacterium tuberculosis H37Rv
gcagcgugugcucgugggcgac

SEQ ID NO: 1263048 - RNA, 16 nt, Mycobacterium tuberculosis H37Rv
gcagcgcggauucggu

SEQ ID NO: 1263049 - RNA, 23 nt, Mycobacterium tuberculosis H37Rv
gcagcggcaaggucaacgggagg

SEQ ID NO: 1263050 - RNA, 15 nt, Mycobacterium tuberculosis H37Rv
gcagcggcauccagc

SEQ ID NO: 1263051 - RNA, 17 nt, Mycobacterium tuberculosis H37Rv
gcagcggcauccagcuu

SEQ ID NO: 1263052 - RNA, 19 nt, Mycobacterium tuberculosis H37Rv
gcagcugcgauauggucac

SEQ ID NO: 1263053 - RNA, 18 nt, Mycobacterium tuberculosis H37Rv
gcagcugcuccaguucgc

SEQ ID NO: 1263054 - RNA, 19 nt, Mycobacterium tuberculosis H37Rv
gcagcugacgucaccacga

SEQ ID NO: 1263055 - RNA, 15 nt, Mycobacterium tuberculosis H37Rv
gcagcugacgucacc

SEQ ID NO: 1263056 - RNA, 16 nt, Mycobacterium tuberculosis H37Rv
gcagcugaaucgggau

SEQ ID NO: 1263057 - RNA, 14 nt, Mycobacterium tuberculosis H37Rv
gcagcucguccagc

SEQ ID NO: 1263058 - RNA, 15 nt, Mycobacterium tuberculosis H37Rv
gcagcucaccgacgg

SEQ ID NO: 1263059 - RNA, 16 nt, Mycobacterium tuberculosis H37Rv
gcagcuauuucgcgac

SEQ ID NO: 1263060 - RNA, 14 nt, Mycobacterium tuberculosis H37Rv
gcagcguuggccgc

SEQ ID NO: 1263061 - RNA, 14 nt, Mycobacterium tuberculosis H37Rv
gcagcuccaccagg

SEQ ID NO: 1263062 - RNA, 21 nt, Mycobacterium tuberculosis H37Rv
gcagcucaccgacggagaucg

SEQ ID NO: 1263063 - RNA, 19 nt, Mycobacterium tuberculosis H37Rv
gcagcucccgccacgucgc

SEQ ID NO: 1263064 - RNA, 22 nt, Mycobacterium tuberculosis H37Rv
gcagcucccgccacgucgccgg

SEQ ID NO: 1263065 - RNA, 13 nt, Mycobacterium tuberculosis H37Rv
gcagcacccgcgc

SEQ ID NO: 1263066 - RNA, 21 nt, Mycobacterium tuberculosis H37Rv
gcagcacaggcuggcgauggc

SEQ ID NO: 1263067 - RNA, 18 nt, Mycobacterium tuberculosis H37Rv
gcagaucuuccgagcacu

SEQ ID NO: 1263068 - RNA, 15 nt, Mycobacterium tuberculosis H37Rv
gcagaugaugccguu

SEQ ID NO: 1263069 - RNA, 17 nt, Mycobacterium tuberculosis H37Rv
gcagauccccgccaccg

SEQ ID NO: 1263070 - RNA, 12 nt, Mycobacterium tuberculosis H37Rv
gcagaucgcccc

SEQ ID NO: 1263071 - RNA, 18 nt, Mycobacterium tuberculosis H37Rv
gcagaucggccggauacg

SEQ ID NO: 1263072 - RNA, 20 nt, Mycobacterium tuberculosis H37Rv
gcagauacuccgcgguuguu

SEQ ID NO: 1263073 - RNA, 22 nt, Mycobacterium tuberculosis H37Rv
gcagaucagcacguugauucgg

SEQ ID NO: 1263074 - RNA, 16 nt, Mycobacterium tuberculosis H37Rv
gcagaucaggacgcga

SEQ ID NO: 1263075 - RNA, 14 nt, Mycobacterium tuberculosis H37Rv
gcagaucgauaccg

SEQ ID NO: 1263076 - RNA, 12 nt, Mycobacterium tuberculosis H37Rv
gcagaucagggu

SEQ ID NO: 1263077 - RNA, 13 nt, Mycobacterium tuberculosis H37Rv
gcagagucgccga

SEQ ID NO: 1263078 - RNA, 17 nt, Mycobacterium tuberculosis H37Rv
gcacucggggcugucgg

SEQ ID NO: 1263079 - RNA, 19 nt, Mycobacterium tuberculosis H37Rv
gcacucggggcugucggcg

SEQ ID NO: 1263080 - RNA, 20 nt, Mycobacterium tuberculosis H37Rv
gcacucggggcugucggcga

SEQ ID NO: 1263081 - RNA, 17 nt, Mycobacterium tuberculosis H37Rv
gcacucggcgguuccgg

SEQ ID NO: 1263082 - RNA, 15 nt, Mycobacterium tuberculosis H37Rv
gcacucgggauucgg

SEQ ID NO: 1263083 - RNA, 15 nt, Mycobacterium tuberculosis H37Rv
gcagagccgccguug

SEQ ID NO: 1263084 - RNA, 15 nt, Mycobacterium tuberculosis H37Rv
gcagcauggccaucg

SEQ ID NO: 1263085 - RNA, 20 nt, Mycobacterium tuberculosis H37Rv
gcagcaugucguaguagcgg

SEQ ID NO: 1263086 - RNA, 14 nt, Mycobacterium tuberculosis H37Rv
gcagcauauccgcc

SEQ ID NO: 1263087 - RNA, 23 nt, Mycobacterium tuberculosis H37Rv
gcagcaucggcacgucguugggc

SEQ ID NO: 1263088 - RNA, 14 nt, Mycobacterium tuberculosis H37Rv
gcagcaucgucgcc

SEQ ID NO: 1263089 - RNA, 19 nt, Mycobacterium tuberculosis H37Rv
gcagccacgcgggcgcggu

SEQ ID NO: 1263090 - RNA, 15 nt, Mycobacterium tuberculosis H37Rv
gcagccagccaccga

SEQ ID NO: 1263091 - RNA, 15 nt, Mycobacterium tuberculosis H37Rv
gcagccaccagcgac

SEQ ID NO: 1263092 - RNA, 13 nt, Mycobacterium tuberculosis H37Rv
gcagccacccgac

SEQ ID NO: 1263093 - RNA, 19 nt, Mycobacterium tuberculosis H37Rv
gcagccaccagcgacgacc

SEQ ID NO: 1263094 - RNA, 13 nt, Mycobacterium tuberculosis H37Rv
gcagccaccguca

SEQ ID NO: 1263095 - RNA, 20 nt, Mycobacterium tuberculosis H37Rv
gcagccaccgucaugccgac

SEQ ID NO: 1263096 - RNA, 22 nt, Mycobacterium tuberculosis H37Rv
gcagcacuuccaagccgaccug

SEQ ID NO: 1263097 - RNA, 20 nt, Mycobacterium tuberculosis H37Rv
gcagcacuuccaagccgacc

SEQ ID NO: 1263098 - RNA, 14 nt, Mycobacterium tuberculosis H37Rv
gcagcacgucgaac

SEQ ID NO: 1263099 - RNA, 13 nt, Mycobacterium tuberculosis H37Rv
gcagcaccgucgg

SEQ ID NO: 1263100 - RNA, 13 nt, Mycobacterium tuberculosis H37Rv
gcagcaccgguca

SEQ ID NO: 1263101 - RNA, 16 nt, Mycobacterium tuberculosis H37Rv
gcagcaccggugaccu

SEQ ID NO: 1263102 - RNA, 13 nt, Mycobacterium tuberculosis H37Rv
gcagcacguccgc

SEQ ID NO: 1263103 - RNA, 18 nt, Mycobacterium tuberculosis H37Rv
gcagcagacccgguggcg

SEQ ID NO: 1263104 - RNA, 20 nt, Mycobacterium tuberculosis H37Rv
gcagcagaaacggcgacucg

SEQ ID NO: 1263105 - RNA, 17 nt, Mycobacterium tuberculosis H37Rv
gcagcagaaacggcgac

SEQ ID NO: 1263106 - RNA, 16 nt, Mycobacterium tuberculosis H37Rv
gcagcagaaacggcga

SEQ ID NO: 1263107 - RNA, 15 nt, Mycobacterium tuberculosis H37Rv
gcagcagacccggug

SEQ ID NO: 1263108 - RNA, 22 nt, Mycobacterium tuberculosis H37Rv
gcagcagugcgaacucaucgug

SEQ ID NO: 1263109 - RNA, 22 nt, Mycobacterium tuberculosis H37Rv
gcagcaggucgaugcugccagc

SEQ ID NO: 1263110 - RNA, 17 nt, Mycobacterium tuberculosis H37Rv
gcagcaggcgaugcgcc

SEQ ID NO: 1263111 - RNA, 20 nt, Mycobacterium tuberculosis H37Rv
gcaggagcagcacgucgaac

SEQ ID NO: 1263112 - RNA, 20 nt, Mycobacterium tuberculosis H37Rv
gcaggacgaugaugaucacc

SEQ ID NO: 1263113 - RNA, 22 nt, Mycobacterium tuberculosis H37Rv
gcaggaagaaaccgcagucgcg

SEQ ID NO: 1263114 - RNA, 17 nt, Mycobacterium tuberculosis H37Rv
gcaggauaccgaaauca

SEQ ID NO: 1263115 - RNA, 23 nt, Mycobacterium tuberculosis H37Rv
gcaggaucggcggauagucgcgg

SEQ ID NO: 1263116 - RNA, 19 nt, Mycobacterium tuberculosis H37Rv
gcaggaucgaguugcggug

SEQ ID NO: 1263117 - RNA, 16 nt, Mycobacterium tuberculosis H37Rv
gcagcuguaauuccuc

SEQ ID NO: 1263118 - RNA, 12 nt, Mycobacterium tuberculosis H37Rv
gcagcuggcgac

SEQ ID NO: 1263119 - RNA, 14 nt, Mycobacterium tuberculosis H37Rv
gcagcuggaccacc

SEQ ID NO: 1263120 - RNA, 14 nt, Mycobacterium tuberculosis H37Rv
gcagcuggcgaaug

SEQ ID NO: 1263121 - RNA, 17 nt, Mycobacterium tuberculosis H37Rv
gcagcugggcaucaccg

SEQ ID NO: 1263122 - RNA, 16 nt, Mycobacterium tuberculosis H37Rv
gcagcuuagucagggc

SEQ ID NO: 1263123 - RNA, 15 nt, Mycobacterium tuberculosis H37Rv
gcagcuucucgccga

SEQ ID NO: 1263124 - RNA, 18 nt, Mycobacterium tuberculosis H37Rv
gcagcuugacaucgguca

SEQ ID NO: 1263125 - RNA, 15 nt, Mycobacterium tuberculosis H37Rv
gcagcuugguggcgu

SEQ ID NO: 1263126 - RNA, 18 nt, Mycobacterium tuberculosis H37Rv
gcagcuugccaaucaccg

SEQ ID NO: 1263127 - RNA, 19 nt, Mycobacterium tuberculosis H37Rv
gcagcuugccaaucaccgu

SEQ ID NO: 1263128 - RNA, 21 nt, Mycobacterium tuberculosis H37Rv
gcagcuuggccucagccaccg

SEQ ID NO: 1263129 - RNA, 19 nt, Mycobacterium tuberculosis H37Rv
gcaggaaaaccccggccac

SEQ ID NO: 1263130 - RNA, 23 nt, Mycobacterium tuberculosis H37Rv
gcaggaacacccauaccuucggc

SEQ ID NO: 1263131 - RNA, 13 nt, Mycobacterium tuberculosis H37Rv
gcaggcaccccga

SEQ ID NO: 1263132 - RNA, 15 nt, Mycobacterium tuberculosis H37Rv
gcaggcacaucgcga

SEQ ID NO: 1263133 - RNA, 20 nt, Mycobacterium tuberculosis H37Rv
gcaggcaccccgaucacccg

SEQ ID NO: 1263134 - RNA, 17 nt, Mycobacterium tuberculosis H37Rv
gcaggcccgccaucaug

SEQ ID NO: 1263135 - RNA, 20 nt, Mycobacterium tuberculosis H37Rv
gcaggccuuuuggcgaaccg

SEQ ID NO: 1263136 - RNA, 17 nt, Mycobacterium tuberculosis H37Rv
gcaggcggccagcgaac

SEQ ID NO: 1263137 - RNA, 15 nt, Mycobacterium tuberculosis H37Rv
gcaggcggccagcga

SEQ ID NO: 1263138 - RNA, 23 nt, Mycobacterium tuberculosis H37Rv
gcaggcgaguuaggccgccagcc

SEQ ID NO: 1263139 - RNA, 12 nt, Mycobacterium tuberculosis H37Rv
gcaggcugucga

SEQ ID NO: 1263140 - RNA, 18 nt, Mycobacterium tuberculosis H37Rv
gcaggcugucaauccgcc

SEQ ID NO: 1263141 - RNA, 19 nt, Mycobacterium tuberculosis H37Rv
gcaggcgggggaucggugg

SEQ ID NO: 1263142 - RNA, 16 nt, Mycobacterium tuberculosis H37Rv
gcaggcggcugaacgg

SEQ ID NO: 1263143 - RNA, 21 nt, Mycobacterium tuberculosis H37Rv
gcaggcgggaacgaucgauga

SEQ ID NO: 1263144 - RNA, 17 nt, Mycobacterium tuberculosis H37Rv
gcagggccgccgcgaac

SEQ ID NO: 1263145 - RNA, 16 nt, Mycobacterium tuberculosis H37Rv
gcaguccacgagcacg

SEQ ID NO: 1263146 - RNA, 20 nt, Mycobacterium tuberculosis H37Rv
gcaguagugaucgaucgcgg

SEQ ID NO: 1263147 - RNA, 21 nt, Mycobacterium tuberculosis H37Rv
gcagguuguaguccgcgccga

SEQ ID NO: 1263148 - RNA, 23 nt, Mycobacterium tuberculosis H37Rv
gcagggggacccggaccuucggc

SEQ ID NO: 1263149 - RNA, 16 nt, Mycobacterium tuberculosis H37Rv
gcagucccgucgucgu

SEQ ID NO: 1263150 - RNA, 12 nt, Mycobacterium tuberculosis H37Rv
gcagucgcacgg

SEQ ID NO: 1263151 - RNA, 12 nt, Mycobacterium tuberculosis H37Rv
gcagucgcccac

SEQ ID NO: 1263152 - RNA, 19 nt, Mycobacterium tuberculosis H37Rv
gcagugggcaauccgguca

SEQ ID NO: 1263153 - RNA, 23 nt, Mycobacterium tuberculosis H37Rv
gcagugacagcaggaaaaagggc

SEQ ID NO: 1263154 - RNA, 18 nt, Mycobacterium tuberculosis H37Rv
gcaguguggugacguugu

SEQ ID NO: 1263155 - RNA, 20 nt, Mycobacterium tuberculosis H37Rv
gcaguggcguuacgcucggc

SEQ ID NO: 1263156 - RNA, 16 nt, Mycobacterium tuberculosis H37Rv
gcaguggcgcggcgag

SEQ ID NO: 1263157 - RNA, 21 nt, Mycobacterium tuberculosis H37Rv
gcagugacguuccgcucgccg

SEQ ID NO: 1263158 - RNA, 19 nt, Mycobacterium tuberculosis H37Rv
gcagugacguuccgcucgc

SEQ ID NO: 1263159 - RNA, 19 nt, Mycobacterium tuberculosis H37Rv
gcagugaccucgucggcga

SEQ ID NO: 1263160 - RNA, 17 nt, Mycobacterium tuberculosis H37Rv
gcagugaccucgucggc

SEQ ID NO: 1263161 - RNA, 13 nt, Mycobacterium tuberculosis H37Rv
gcagucugacgaa

SEQ ID NO: 1263162 - RNA, 21 nt, Mycobacterium tuberculosis H37Rv
gcagucuuucccggggcuggg

SEQ ID NO: 1263163 - RNA, 13 nt, Mycobacterium tuberculosis H37Rv
gcauacaucgccu

SEQ ID NO: 1263164 - RNA, 19 nt, Mycobacterium tuberculosis H37Rv
gcauacgcggcuuugacgc

SEQ ID NO: 1263165 - RNA, 13 nt, Mycobacterium tuberculosis H37Rv
gcauacgguugau

SEQ ID NO: 1263166 - RNA, 14 nt, Mycobacterium tuberculosis H37Rv
gcauaccggcgucg

SEQ ID NO: 1263167 - RNA, 17 nt, Mycobacterium tuberculosis H37Rv
gcauauccgccggcgac

SEQ ID NO: 1263168 - RNA, 15 nt, Mycobacterium tuberculosis H37Rv
gcauaucaaccccgg

SEQ ID NO: 1263169 - RNA, 20 nt, Mycobacterium tuberculosis H37Rv
gcauaucaaccccggugcag

SEQ ID NO: 1263170 - RNA, 17 nt, Mycobacterium tuberculosis H37Rv
gcauaugccgccggcag

SEQ ID NO: 1263171 - RNA, 13 nt, Mycobacterium tuberculosis H37Rv
gcaucaucgccca

SEQ ID NO: 1263172 - RNA, 14 nt, Mycobacterium tuberculosis H37Rv
gcaucaucaagccg

SEQ ID NO: 1263173 - RNA, 15 nt, Mycobacterium tuberculosis H37Rv
gcaucagcgccagcg

SEQ ID NO: 1263174 - RNA, 22 nt, Mycobacterium tuberculosis H37Rv
gcaucagcggcgccaguauggc

SEQ ID NO: 1263175 - RNA, 16 nt, Mycobacterium tuberculosis H37Rv
gcaucagcucgaugcc

SEQ ID NO: 1263176 - RNA, 18 nt, Mycobacterium tuberculosis H37Rv
gcacccagacgauggcca

SEQ ID NO: 1263177 - RNA, 17 nt, Mycobacterium tuberculosis H37Rv
gcacccccgucgccacc

SEQ ID NO: 1263178 - RNA, 16 nt, Mycobacterium tuberculosis H37Rv
gcacccccgucgccac

SEQ ID NO: 1263179 - RNA, 14 nt, Mycobacterium tuberculosis H37Rv
gcacccccgucgcc

SEQ ID NO: 1263180 - RNA, 12 nt, Mycobacterium tuberculosis H37Rv
gcacccgcagcc

SEQ ID NO: 1263181 - RNA, 15 nt, Mycobacterium tuberculosis H37Rv
gcacccgcacggccu

SEQ ID NO: 1263182 - RNA, 15 nt, Mycobacterium tuberculosis H37Rv
gcacccgacucgucg

SEQ ID NO: 1263183 - RNA, 18 nt, Mycobacterium tuberculosis H37Rv
gcacccgagccgcacagc

SEQ ID NO: 1263184 - RNA, 23 nt, Mycobacterium tuberculosis H37Rv
gcacccgaguuauagaagccgac

SEQ ID NO: 1263185 - RNA, 14 nt, Mycobacterium tuberculosis H37Rv
gcacccgaucgacg

SEQ ID NO: 1263186 - RNA, 21 nt, Mycobacterium tuberculosis H37Rv
gcaccccuuugacgccgagca

SEQ ID NO: 1263187 - RNA, 21 nt, Mycobacterium tuberculosis H37Rv
gcaccccggugcccgcgguga

SEQ ID NO: 1263188 - RNA, 21 nt, Mycobacterium tuberculosis H37Rv
gcacccgaauuugucggcgaa

SEQ ID NO: 1263189 - RNA, 18 nt, Mycobacterium tuberculosis H37Rv
gcaccgacaucgucaucc

SEQ ID NO: 1263190 - RNA, 18 nt, Mycobacterium tuberculosis H37Rv
gcaccgagcuuguccagc

SEQ ID NO: 1263191 - RNA, 16 nt, Mycobacterium tuberculosis H37Rv
gcaccgaggccgccga

SEQ ID NO: 1263192 - RNA, 22 nt, Mycobacterium tuberculosis H37Rv
gcaccgagcaucucgucgucga

SEQ ID NO: 1263193 - RNA, 18 nt, Mycobacterium tuberculosis H37Rv
gcaccgaggccgccgaga

SEQ ID NO: 1263194 - RNA, 22 nt, Mycobacterium tuberculosis H37Rv
gcacccgcgccaguaacgccca

SEQ ID NO: 1263195 - RNA, 19 nt, Mycobacterium tuberculosis H37Rv
gcaccgaaaaacaccagcg

SEQ ID NO: 1263196 - RNA, 18 nt, Mycobacterium tuberculosis H37Rv
gcaccgaaaaacaccagc

SEQ ID NO: 1263197 - RNA, 20 nt, Mycobacterium tuberculosis H37Rv
gcaccgaacccgccaccgcg

SEQ ID NO: 1263198 - RNA, 14 nt, Mycobacterium tuberculosis H37Rv
gcaccgaacccgcc

SEQ ID NO: 1263199 - RNA, 16 nt, Mycobacterium tuberculosis H37Rv
gcaccgaaacgccgac

SEQ ID NO: 1263200 - RNA, 20 nt, Mycobacterium tuberculosis H37Rv
gcaccgaaacgccgaccuuc

SEQ ID NO: 1263201 - RNA, 20 nt, Mycobacterium tuberculosis H37Rv
gcaccgacaccggccgcgac

SEQ ID NO: 1263202 - RNA, 23 nt, Mycobacterium tuberculosis H37Rv
gcaccgaagauggccagcgcggc

SEQ ID NO: 1263203 - RNA, 15 nt, Mycobacterium tuberculosis H37Rv
gcaccgaagauggcc

SEQ ID NO: 1263204 - RNA, 22 nt, Mycobacterium tuberculosis H37Rv
gcacccgcuccauaucgucggg

SEQ ID NO: 1263205 - RNA, 13 nt, Mycobacterium tuberculosis H37Rv
gcacccgcggcga

SEQ ID NO: 1263206 - RNA, 22 nt, Mycobacterium tuberculosis H37Rv
gcacccuggguauccaccgcga

SEQ ID NO: 1263207 - RNA, 18 nt, Mycobacterium tuberculosis H37Rv
gcacccuguuccagcggg

SEQ ID NO: 1263208 - RNA, 16 nt, Mycobacterium tuberculosis H37Rv
gcacccuugccgauuc

SEQ ID NO: 1263209 - RNA, 23 nt, Mycobacterium tuberculosis H37Rv
gcacccuugccgauuccggcguu

SEQ ID NO: 1263210 - RNA, 16 nt, Mycobacterium tuberculosis H37Rv
gcaccggcgucggcgc

SEQ ID NO: 1263211 - RNA, 16 nt, Mycobacterium tuberculosis H37Rv
gcaccggcggcgccga

SEQ ID NO: 1263212 - RNA, 17 nt, Mycobacterium tuberculosis H37Rv
gcaccggcggcgccgaa

SEQ ID NO: 1263213 - RNA, 21 nt, Mycobacterium tuberculosis H37Rv
gcaccggcgcaacucgaccac

SEQ ID NO: 1263214 - RNA, 20 nt, Mycobacterium tuberculosis H37Rv
gcaccgcugaccccggcagc

SEQ ID NO: 1263215 - RNA, 20 nt, Mycobacterium tuberculosis H37Rv
gcaccgcguugaugaccgcc

SEQ ID NO: 1263216 - RNA, 17 nt, Mycobacterium tuberculosis H37Rv
gcaccgcucgguccagc

SEQ ID NO: 1263217 - RNA, 21 nt, Mycobacterium tuberculosis H37Rv
gcaccggcgaucguguccacc

SEQ ID NO: 1263218 - RNA, 15 nt, Mycobacterium tuberculosis H37Rv
gcaccgcccccgucg

SEQ ID NO: 1263219 - RNA, 15 nt, Mycobacterium tuberculosis H37Rv
gcaccgccgagcaga

SEQ ID NO: 1263220 - RNA, 15 nt, Mycobacterium tuberculosis H37Rv
gcaccgccgcaucgu

SEQ ID NO: 1263221 - RNA, 20 nt, Mycobacterium tuberculosis H37Rv
gcaccgccgauguggucggc

SEQ ID NO: 1263222 - RNA, 14 nt, Mycobacterium tuberculosis H37Rv
gcaccgcgucguag

SEQ ID NO: 1263223 - RNA, 16 nt, Mycobacterium tuberculosis H37Rv
gcaccgcgucguagcc

SEQ ID NO: 1263224 - RNA, 17 nt, Mycobacterium tuberculosis H37Rv
gcaccgcgguacgccgg

SEQ ID NO: 1263225 - RNA, 23 nt, Mycobacterium tuberculosis H37Rv
gcaccgguauguucggcaaugac

SEQ ID NO: 1263226 - RNA, 17 nt, Mycobacterium tuberculosis H37Rv
gcaccggugauggugac

SEQ ID NO: 1263227 - RNA, 17 nt, Mycobacterium tuberculosis H37Rv
gcaccggugcucgucga

SEQ ID NO: 1263228 - RNA, 12 nt, Mycobacterium tuberculosis H37Rv
gcaccggugcuc

SEQ ID NO: 1263229 - RNA, 20 nt, Mycobacterium tuberculosis H37Rv
gcaccguagagcaugccgcc

SEQ ID NO: 1263230 - RNA, 18 nt, Mycobacterium tuberculosis H37Rv
gcaccguccucggucacg

SEQ ID NO: 1263231 - RNA, 23 nt, Mycobacterium tuberculosis H37Rv
gcaccgucagcccgacguugcgu

SEQ ID NO: 1263232 - RNA, 15 nt, Mycobacterium tuberculosis H37Rv
gcaccucguguccgg

SEQ ID NO: 1263233 - RNA, 17 nt, Mycobacterium tuberculosis H37Rv
gcaccgucggcaccagc

SEQ ID NO: 1263234 - RNA, 18 nt, Mycobacterium tuberculosis H37Rv
gcaccgucgggcccagcc

SEQ ID NO: 1263235 - RNA, 16 nt, Mycobacterium tuberculosis H37Rv
gcaccgucgcggguca

SEQ ID NO: 1263236 - RNA, 14 nt, Mycobacterium tuberculosis H37Rv
gcaccgucggaacu

SEQ ID NO: 1263237 - RNA, 20 nt, Mycobacterium tuberculosis H37Rv
gcaccgucggaacugaccac

SEQ ID NO: 1263238 - RNA, 20 nt, Mycobacterium tuberculosis H37Rv
gcacggcuuuucgacgcugu

SEQ ID NO: 1263239 - RNA, 13 nt, Mycobacterium tuberculosis H37Rv
gcacgggaaucgc

SEQ ID NO: 1263240 - RNA, 18 nt, Mycobacterium tuberculosis H37Rv
gcacggcuugggucuccg

SEQ ID NO: 1263241 - RNA, 15 nt, Mycobacterium tuberculosis H37Rv
gcacgggcacgaucg

SEQ ID NO: 1263242 - RNA, 18 nt, Mycobacterium tuberculosis H37Rv
gcacgggcacgaucgucg

SEQ ID NO: 1263243 - RNA, 19 nt, Mycobacterium tuberculosis H37Rv
gcacgggcgaccugcggac

SEQ ID NO: 1263244 - RNA, 13 nt, Mycobacterium tuberculosis H37Rv
gcacggaugucgc

SEQ ID NO: 1263245 - RNA, 17 nt, Mycobacterium tuberculosis H37Rv
gcacggcgcuaccagcc

SEQ ID NO: 1263246 - RNA, 23 nt, Mycobacterium tuberculosis H37Rv
gcacggcggccacguccucagcc

SEQ ID NO: 1263247 - RNA, 20 nt, Mycobacterium tuberculosis H37Rv
gcacggcgugucgagggcuu

SEQ ID NO: 1263248 - RNA, 14 nt, Mycobacterium tuberculosis H37Rv
gcacggcgugucga

SEQ ID NO: 1263249 - RNA, 16 nt, Mycobacterium tuberculosis H37Rv
gcacggcuucggcgag

SEQ ID NO: 1263250 - RNA, 18 nt, Mycobacterium tuberculosis H37Rv
gcacggaugcgauggccg

SEQ ID NO: 1263251 - RNA, 18 nt, Mycobacterium tuberculosis H37Rv
gcacggaaguacuccacc

SEQ ID NO: 1263252 - RNA, 17 nt, Mycobacterium tuberculosis H37Rv
gcacggaaucgcaucua

SEQ ID NO: 1263253 - RNA, 18 nt, Mycobacterium tuberculosis H37Rv
gcacgcuugcggcugccc

SEQ ID NO: 1263254 - RNA, 19 nt, Mycobacterium tuberculosis H37Rv
gcacgcucgcgcacccugc

SEQ ID NO: 1263255 - RNA, 13 nt, Mycobacterium tuberculosis H37Rv
gcacgcuggcggg

SEQ ID NO: 1263256 - RNA, 13 nt, Mycobacterium tuberculosis H37Rv
gcacgcgugccgc

SEQ ID NO: 1263257 - RNA, 15 nt, Mycobacterium tuberculosis H37Rv
gcacgcuagccgaca

SEQ ID NO: 1263258 - RNA, 19 nt, Mycobacterium tuberculosis H37Rv
gcacggugggcgcuggguc

SEQ ID NO: 1263259 - RNA, 18 nt, Mycobacterium tuberculosis H37Rv
gcacggugaccacgccgu

SEQ ID NO: 1263260 - RNA, 22 nt, Mycobacterium tuberculosis H37Rv
gcacgguuguuguagaucugcg

SEQ ID NO: 1263261 - RNA, 18 nt, Mycobacterium tuberculosis H37Rv
gcacgguucuuggcgucu

SEQ ID NO: 1263262 - RNA, 15 nt, Mycobacterium tuberculosis H37Rv
gcacguaacgccgcu

SEQ ID NO: 1263263 - RNA, 22 nt, Mycobacterium tuberculosis H37Rv
gcacguagaaguaggcggcgac

SEQ ID NO: 1263264 - RNA, 16 nt, Mycobacterium tuberculosis H37Rv
gcacguacucggccag

SEQ ID NO: 1263265 - RNA, 22 nt, Mycobacterium tuberculosis H37Rv
gcacgucacgcaaccggcggac

SEQ ID NO: 1263266 - RNA, 18 nt, Mycobacterium tuberculosis H37Rv
gcacguauccacggucga

SEQ ID NO: 1263267 - RNA, 16 nt, Mycobacterium tuberculosis H37Rv
gcacgucaacagccag

SEQ ID NO: 1263268 - RNA, 22 nt, Mycobacterium tuberculosis H37Rv
gcacuccgggcucggcgucgcc

SEQ ID NO: 1263269 - RNA, 21 nt, Mycobacterium tuberculosis H37Rv
gcacucccugguucggcgaug

SEQ ID NO: 1263270 - RNA, 21 nt, Mycobacterium tuberculosis H37Rv
gcacgucgaaaucggugcaca

SEQ ID NO: 1263271 - RNA, 15 nt, Mycobacterium tuberculosis H37Rv
gcacguccgaucggc

SEQ ID NO: 1263272 - RNA, 23 nt, Mycobacterium tuberculosis H37Rv
gcacguccgcggagcucaaccac

SEQ ID NO: 1263273 - RNA, 16 nt, Mycobacterium tuberculosis H37Rv
gcacgcaugccgguga

SEQ ID NO: 1263274 - RNA, 23 nt, Mycobacterium tuberculosis H37Rv
gcacgccaacguugcgccagcgg

SEQ ID NO: 1263275 - RNA, 24 nt, Mycobacterium tuberculosis H37Rv
gcacgccgaccggcccgcauccgc

SEQ ID NO: 1263276 - RNA, 17 nt, Mycobacterium tuberculosis H37Rv
gcacgaugucgaugccg

SEQ ID NO: 1263277 - RNA, 17 nt, Mycobacterium tuberculosis H37Rv
gcacgcacgcgguucac

SEQ ID NO: 1263278 - RNA, 13 nt, Mycobacterium tuberculosis H37Rv
gcacgauggccgu

SEQ ID NO: 1263279 - RNA, 18 nt, Mycobacterium tuberculosis H37Rv
gcacgcgggaagugcacc

SEQ ID NO: 1263280 - RNA, 21 nt, Mycobacterium tuberculosis H37Rv
gcacgcgggcguuggccagca

SEQ ID NO: 1263281 - RNA, 13 nt, Mycobacterium tuberculosis H37Rv
gcacgcggacaug

SEQ ID NO: 1263282 - RNA, 21 nt, Mycobacterium tuberculosis H37Rv
gcacgccguagcaucgggcga

SEQ ID NO: 1263283 - RNA, 21 nt, Mycobacterium tuberculosis H37Rv
gcacgccgggugccgccacgu

SEQ ID NO: 1263284 - RNA, 15 nt, Mycobacterium tuberculosis H37Rv
gcacgccggccagcg

SEQ ID NO: 1263285 - RNA, 16 nt, Mycobacterium tuberculosis H37Rv
gcacgccggccagcga

SEQ ID NO: 1263286 - RNA, 12 nt, Mycobacterium tuberculosis H37Rv
gcacgccggcau

SEQ ID NO: 1263287 - RNA, 17 nt, Mycobacterium tuberculosis H37Rv
gcaccugggucgacgag

SEQ ID NO: 1263288 - RNA, 15 nt, Mycobacterium tuberculosis H37Rv
gcacgacgcgacacg

SEQ ID NO: 1263289 - RNA, 19 nt, Mycobacterium tuberculosis H37Rv
gcacgauacucaccgacgc

SEQ ID NO: 1263290 - RNA, 19 nt, Mycobacterium tuberculosis H37Rv
gcacgauagccaccgacga

SEQ ID NO: 1263291 - RNA, 21 nt, Mycobacterium tuberculosis H37Rv
gcacgacugugcgccgcagcc

SEQ ID NO: 1263292 - RNA, 17 nt, Mycobacterium tuberculosis H37Rv
gcacgagccaucgucga

SEQ ID NO: 1263293 - RNA, 18 nt, Mycobacterium tuberculosis H37Rv
gcacgagccaucgucgag

SEQ ID NO: 1263294 - RNA, 13 nt, Mycobacterium tuberculosis H37Rv
gcacgaucgcccg

SEQ ID NO: 1263295 - RNA, 15 nt, Mycobacterium tuberculosis H37Rv
gcacgaucgcaccga

SEQ ID NO: 1263296 - RNA, 18 nt, Mycobacterium tuberculosis H37Rv
gcacgaucgcaccgaggu

SEQ ID NO: 1263297 - RNA, 13 nt, Mycobacterium tuberculosis H37Rv
gcacgaucgccau

SEQ ID NO: 1263298 - RNA, 18 nt, Mycobacterium tuberculosis H37Rv
gcacgaucgccauccggu

SEQ ID NO: 1263299 - RNA, 21 nt, Mycobacterium tuberculosis H37Rv
gcacgaucgccauccggucgg

SEQ ID NO: 1263300 - RNA, 12 nt, Mycobacterium tuberculosis H37Rv
gcacgaucgccc

SEQ ID NO: 1263301 - RNA, 22 nt, Mycobacterium tuberculosis H37Rv
gcacgaucaucgggguggccac

SEQ ID NO: 1263302 - RNA, 13 nt, Mycobacterium tuberculosis H37Rv
gcacgaucaggga

SEQ ID NO: 1263303 - RNA, 16 nt, Mycobacterium tuberculosis H37Rv
gcacgaucgcggugac

SEQ ID NO: 1263304 - RNA, 17 nt, Mycobacterium tuberculosis H37Rv
gcaccauaauggucguc

SEQ ID NO: 1263305 - RNA, 14 nt, Mycobacterium tuberculosis H37Rv
gcacccaacccggc

SEQ ID NO: 1263306 - RNA, 19 nt, Mycobacterium tuberculosis H37Rv
gcacccaauccggcgccag

SEQ ID NO: 1263307 - RNA, 23 nt, Mycobacterium tuberculosis H37Rv
gcacccaauccggcgccagcagu

SEQ ID NO: 1263308 - RNA, 20 nt, Mycobacterium tuberculosis H37Rv
gcacccaaccaggccgcgac

SEQ ID NO: 1263309 - RNA, 17 nt, Mycobacterium tuberculosis H37Rv
gcacccaaccaggccgc

SEQ ID NO: 1263310 - RNA, 19 nt, Mycobacterium tuberculosis H37Rv
gcacccaauuucgaccaga

SEQ ID NO: 1263311 - RNA, 22 nt, Mycobacterium tuberculosis H37Rv
gcacccaauuucgaccagaauc

SEQ ID NO: 1263312 - RNA, 14 nt, Mycobacterium tuberculosis H37Rv
gcacccacgccggu

SEQ ID NO: 1263313 - RNA, 20 nt, Mycobacterium tuberculosis H37Rv
gcaccaguguggcgaugacc

SEQ ID NO: 1263314 - RNA, 18 nt, Mycobacterium tuberculosis H37Rv
gcaccaguccagcgggca

SEQ ID NO: 1263315 - RNA, 18 nt, Mycobacterium tuberculosis H37Rv
gcaccagguugccgaggu

SEQ ID NO: 1263316 - RNA, 20 nt, Mycobacterium tuberculosis H37Rv
gcaccaggggcgcgucaugg

SEQ ID NO: 1263317 - RNA, 18 nt, Mycobacterium tuberculosis H37Rv
gcaccagggagccguuca

SEQ ID NO: 1263318 - RNA, 22 nt, Mycobacterium tuberculosis H37Rv
gcaccagcauucucgccgacgg

SEQ ID NO: 1263319 - RNA, 16 nt, Mycobacterium tuberculosis H37Rv
gcaccagccggugagc

SEQ ID NO: 1263320 - RNA, 14 nt, Mycobacterium tuberculosis H37Rv
gcaccagcugucgg

SEQ ID NO: 1263321 - RNA, 21 nt, Mycobacterium tuberculosis H37Rv
gcaccagcucggugaucacca

SEQ ID NO: 1263322 - RNA, 12 nt, Mycobacterium tuberculosis H37Rv
gcaccagcucgg

SEQ ID NO: 1263323 - RNA, 12 nt, Mycobacterium tuberculosis H37Rv
gcaccagcgggu

SEQ ID NO: 1263324 - RNA, 20 nt, Mycobacterium tuberculosis H37Rv
gcaccagcgggucggcggug

SEQ ID NO: 1263325 - RNA, 18 nt, Mycobacterium tuberculosis H37Rv
gcaccacaacgucggcac

SEQ ID NO: 1263326 - RNA, 19 nt, Mycobacterium tuberculosis H37Rv
gcaccaacgccaccgucgc

SEQ ID NO: 1263327 - RNA, 20 nt, Mycobacterium tuberculosis H37Rv
gcaccaacguugugccgcuu

SEQ ID NO: 1263328 - RNA, 14 nt, Mycobacterium tuberculosis H37Rv
gcaccaacgccacc

SEQ ID NO: 1263329 - RNA, 14 nt, Mycobacterium tuberculosis H37Rv
gcaccaccacaccg

SEQ ID NO: 1263330 - RNA, 16 nt, Mycobacterium tuberculosis H37Rv
gcaccacacuggcagu

SEQ ID NO: 1263331 - RNA, 20 nt, Mycobacterium tuberculosis H37Rv
gcaccacaacgucggcaccg

SEQ ID NO: 1263332 - RNA, 12 nt, Mycobacterium tuberculosis H37Rv
gcaccacaucgg

SEQ ID NO: 1263333 - RNA, 18 nt, Mycobacterium tuberculosis H37Rv
gcaccacaucggugccac

SEQ ID NO: 1263334 - RNA, 21 nt, Mycobacterium tuberculosis H37Rv
gcacauggugggucgacgauc

SEQ ID NO: 1263335 - RNA, 19 nt, Mycobacterium tuberculosis H37Rv
gcacaucugcgggacgucg

SEQ ID NO: 1263336 - RNA, 15 nt, Mycobacterium tuberculosis H37Rv
gcacauucagcgccg

SEQ ID NO: 1263337 - RNA, 19 nt, Mycobacterium tuberculosis H37Rv
gcacauugaucgacggcca

SEQ ID NO: 1263338 - RNA, 18 nt, Mycobacterium tuberculosis H37Rv
gcacauuauucuucgcgg

SEQ ID NO: 1263339 - RNA, 19 nt, Mycobacterium tuberculosis H37Rv
gcaccaaaugccccgaacc

SEQ ID NO: 1263340 - RNA, 15 nt, Mycobacterium tuberculosis H37Rv
gcaccacggccagcg

SEQ ID NO: 1263341 - RNA, 17 nt, Mycobacterium tuberculosis H37Rv
gcaccacggccagcggg

SEQ ID NO: 1263342 - RNA, 14 nt, Mycobacterium tuberculosis H37Rv
gcaccacgaccgac

SEQ ID NO: 1263343 - RNA, 18 nt, Mycobacterium tuberculosis H37Rv
gcaccacgagcagccgau

SEQ ID NO: 1263344 - RNA, 12 nt, Mycobacterium tuberculosis H37Rv
gcaccacccgau

SEQ ID NO: 1263345 - RNA, 16 nt, Mycobacterium tuberculosis H37Rv
gcaccaccccgaggcc

SEQ ID NO: 1263346 - RNA, 13 nt, Mycobacterium tuberculosis H37Rv
gcaccacccgggc

SEQ ID NO: 1263347 - RNA, 21 nt, Mycobacterium tuberculosis H37Rv
gcaccagauagaucgugaucg

SEQ ID NO: 1263348 - RNA, 13 nt, Mycobacterium tuberculosis H37Rv
gcaccagcaccgu

SEQ ID NO: 1263349 - RNA, 23 nt, Mycobacterium tuberculosis H37Rv
gcaccagauagaucgugaucgac

SEQ ID NO: 1263350 - RNA, 15 nt, Mycobacterium tuberculosis H37Rv
gcaccacggcggcca

SEQ ID NO: 1263351 - RNA, 21 nt, Mycobacterium tuberculosis H37Rv
gcacagcagcaacgcggugcc

SEQ ID NO: 1263352 - RNA, 17 nt, Mycobacterium tuberculosis H37Rv
gcacagacacggcagcu

SEQ ID NO: 1263353 - RNA, 16 nt, Mycobacterium tuberculosis H37Rv
gcacagcaccacgugc

SEQ ID NO: 1263354 - RNA, 15 nt, Mycobacterium tuberculosis H37Rv
gcacagcaccacauc

SEQ ID NO: 1263355 - RNA, 19 nt, Mycobacterium tuberculosis H37Rv
gcacagcaccacgugcgag

SEQ ID NO: 1263356 - RNA, 16 nt, Mycobacterium tuberculosis H37Rv
gcacagcacggcaucg

SEQ ID NO: 1263357 - RNA, 17 nt, Mycobacterium tuberculosis H37Rv
gcacacugccgcgcucg

SEQ ID NO: 1263358 - RNA, 22 nt, Mycobacterium tuberculosis H37Rv
gcacacugucgauuugaucgac

SEQ ID NO: 1263359 - RNA, 22 nt, Mycobacterium tuberculosis H37Rv
gcacacuguuacuccgacggcc

SEQ ID NO: 1263360 - RNA, 23 nt, Mycobacterium tuberculosis H37Rv
gcacacuguuacuccgacggccc

SEQ ID NO: 1263361 - RNA, 17 nt, Mycobacterium tuberculosis H37Rv
gcacaaccgcugcugcu

SEQ ID NO: 1263362 - RNA, 13 nt, Mycobacterium tuberculosis H37Rv
gcacaacccgugc

SEQ ID NO: 1263363 - RNA, 17 nt, Mycobacterium tuberculosis H37Rv
gcacaacaucgccgcag

SEQ ID NO: 1263364 - RNA, 16 nt, Mycobacterium tuberculosis H37Rv
gcacacguccggcgau

SEQ ID NO: 1263365 - RNA, 22 nt, Mycobacterium tuberculosis H37Rv
gcacacuaccgccgcgaccgcg

SEQ ID NO: 1263366 - RNA, 14 nt, Mycobacterium tuberculosis H37Rv
gcacacguccggcg

SEQ ID NO: 1263367 - RNA, 19 nt, Mycobacterium tuberculosis H37Rv
gcacaggcuggcgauggcc

SEQ ID NO: 1263368 - RNA, 20 nt, Mycobacterium tuberculosis H37Rv
gcacauacgauuucgacgac

SEQ ID NO: 1263369 - RNA, 15 nt, Mycobacterium tuberculosis H37Rv
gcacagcgacgagau

SEQ ID NO: 1263370 - RNA, 20 nt, Mycobacterium tuberculosis H37Rv
gcacagcgaccaucgccgac

SEQ ID NO: 1263371 - RNA, 22 nt, Mycobacterium tuberculosis H37Rv
gcacagcgccgcguugucggcg

SEQ ID NO: 1263372 - RNA, 22 nt, Mycobacterium tuberculosis H37Rv
gcacagcggauucggcgucgaa

SEQ ID NO: 1263373 - RNA, 12 nt, Mycobacterium tuberculosis H37Rv
gcacagcggcau

SEQ ID NO: 1263374 - RNA, 14 nt, Mycobacterium tuberculosis H37Rv
gcacagcggcaucg

SEQ ID NO: 1263375 - RNA, 16 nt, Mycobacterium tuberculosis H37Rv
gcacaggcaucguccg

SEQ ID NO: 1263376 - RNA, 13 nt, Mycobacterium tuberculosis H37Rv
gcaaugccgacuc

SEQ ID NO: 1263377 - RNA, 16 nt, Mycobacterium tuberculosis H37Rv
gcaaucgugguucggc

SEQ ID NO: 1263378 - RNA, 22 nt, Mycobacterium tuberculosis H37Rv
gcaaucgcucugugucgccgau

SEQ ID NO: 1263379 - RNA, 16 nt, Mycobacterium tuberculosis H37Rv
gcaaucgcgggcgaug

SEQ ID NO: 1263380 - RNA, 23 nt, Mycobacterium tuberculosis H37Rv
gcaaugcuccuaucugccgguac

SEQ ID NO: 1263381 - RNA, 15 nt, Mycobacterium tuberculosis H37Rv
gcacaacaucgccgc

SEQ ID NO: 1263382 - RNA, 17 nt, Mycobacterium tuberculosis H37Rv
gcacaaacauacgccac

SEQ ID NO: 1263383 - RNA, 15 nt, Mycobacterium tuberculosis H37Rv
gcacaaaaucagcga

SEQ ID NO: 1263384 - RNA, 21 nt, Mycobacterium tuberculosis H37Rv
gcaauaccgccagcgccaccg

SEQ ID NO: 1263385 - RNA, 19 nt, Mycobacterium tuberculosis H37Rv
gccgcgaaaucaccgcuga

SEQ ID NO: 1263386 - RNA, 20 nt, Mycobacterium tuberculosis H37Rv
gccgcgaugacggugccgac

SEQ ID NO: 1263387 - RNA, 16 nt, Mycobacterium tuberculosis H37Rv
gccgcgaugacggugc

SEQ ID NO: 1263388 - RNA, 22 nt, Mycobacterium tuberculosis H37Rv
gccgcgaugacgaccgaucggc

SEQ ID NO: 1263389 - RNA, 20 nt, Mycobacterium tuberculosis H37Rv
gccgcgaucuccuuggccgu

SEQ ID NO: 1263390 - RNA, 20 nt, Mycobacterium tuberculosis H37Rv
gccgcgacccgcgcaaucag

SEQ ID NO: 1263391 - RNA, 17 nt, Mycobacterium tuberculosis H37Rv
gccgcgaccgcagcugg

SEQ ID NO: 1263392 - RNA, 16 nt, Mycobacterium tuberculosis H37Rv
gccgcgauggcguagc

SEQ ID NO: 1263393 - RNA, 12 nt, Mycobacterium tuberculosis H37Rv
gccgcgauggcg

SEQ ID NO: 1263394 - RNA, 16 nt, Mycobacterium tuberculosis H37Rv
gccgcgauggcggucc

SEQ ID NO: 1263395 - RNA, 13 nt, Mycobacterium tuberculosis H37Rv
gccgcgcaccgcg

SEQ ID NO: 1263396 - RNA, 19 nt, Mycobacterium tuberculosis H37Rv
gccgcgcaccgcgggaucg

SEQ ID NO: 1263397 - RNA, 13 nt, Mycobacterium tuberculosis H37Rv
gccgcgcaccgac

SEQ ID NO: 1263398 - RNA, 22 nt, Mycobacterium tuberculosis H37Rv
gccgccucguacggaccgucgc

SEQ ID NO: 1263399 - RNA, 21 nt, Mycobacterium tuberculosis H37Rv
gccgccugcuggagcagcuac

SEQ ID NO: 1263400 - RNA, 21 nt, Mycobacterium tuberculosis H37Rv
gccgccugcuccucggccagc

SEQ ID NO: 1263401 - RNA, 15 nt, Mycobacterium tuberculosis H37Rv
gccgccuucucgcga

SEQ ID NO: 1263402 - RNA, 17 nt, Mycobacterium tuberculosis H37Rv
gccgccuucuuggcggc

SEQ ID NO: 1263403 - RNA, 18 nt, Mycobacterium tuberculosis H37Rv
gccgccuuuuuucgccgc

SEQ ID NO: 1263404 - RNA, 14 nt, Mycobacterium tuberculosis H37Rv
gccgccuuggucgc

SEQ ID NO: 1263405 - RNA, 13 nt, Mycobacterium tuberculosis H37Rv
gccgcgcagccgg

SEQ ID NO: 1263406 - RNA, 17 nt, Mycobacterium tuberculosis H37Rv
gccgcgcagccgcucga

SEQ ID NO: 1263407 - RNA, 16 nt, Mycobacterium tuberculosis H37Rv
gccgcgcccgccucga

SEQ ID NO: 1263408 - RNA, 22 nt, Mycobacterium tuberculosis H37Rv
gccgcgcaggggcggcgugaag

SEQ ID NO: 1263409 - RNA, 15 nt, Mycobacterium tuberculosis H37Rv
gccgcgccagcuccg

SEQ ID NO: 1263410 - RNA, 16 nt, Mycobacterium tuberculosis H37Rv
gccgcgcccuggccuu

SEQ ID NO: 1263411 - RNA, 12 nt, Mycobacterium tuberculosis H37Rv
gccgcgccgacc

SEQ ID NO: 1263412 - RNA, 16 nt, Mycobacterium tuberculosis H37Rv
gccgcgcccggcgcaa

SEQ ID NO: 1263413 - RNA, 16 nt, Mycobacterium tuberculosis H37Rv
gccgcgccgcagagca

SEQ ID NO: 1263414 - RNA, 22 nt, Mycobacterium tuberculosis H37Rv
gccgcgccguagagccgcucgg

SEQ ID NO: 1263415 - RNA, 16 nt, Mycobacterium tuberculosis H37Rv
gccgcgccggguccgc

SEQ ID NO: 1263416 - RNA, 14 nt, Mycobacterium tuberculosis H37Rv
gccgcgccggcacg

SEQ ID NO: 1263417 - RNA, 13 nt, Mycobacterium tuberculosis H37Rv
gccgccgacacca

SEQ ID NO: 1263418 - RNA, 17 nt, Mycobacterium tuberculosis H37Rv
gccgccgacagggaccc

SEQ ID NO: 1263419 - RNA, 21 nt, Mycobacterium tuberculosis H37Rv
gccgccgagauuggugcagac

SEQ ID NO: 1263420 - RNA, 15 nt, Mycobacterium tuberculosis H37Rv
gccgccgagacgacc

SEQ ID NO: 1263421 - RNA, 15 nt, Mycobacterium tuberculosis H37Rv
gccgccgagcuggcg

SEQ ID NO: 1263422 - RNA, 21 nt, Mycobacterium tuberculosis H37Rv
gccgccgacuuccgcgucgcc

SEQ ID NO: 1263423 - RNA, 16 nt, Mycobacterium tuberculosis H37Rv
gccgccgccgacgaag

SEQ ID NO: 1263424 - RNA, 17 nt, Mycobacterium tuberculosis H37Rv
gccgccgccaucgccga

SEQ ID NO: 1263425 - RNA, 15 nt, Mycobacterium tuberculosis H37Rv
gccgccgaugccacc

SEQ ID NO: 1263426 - RNA, 23 nt, Mycobacterium tuberculosis H37Rv
gccgccgaucgacacccgcucgg

SEQ ID NO: 1263427 - RNA, 15 nt, Mycobacterium tuberculosis H37Rv
gccgccgaucccguc

SEQ ID NO: 1263428 - RNA, 13 nt, Mycobacterium tuberculosis H37Rv
gccgccgaucccg

SEQ ID NO: 1263429 - RNA, 19 nt, Mycobacterium tuberculosis H37Rv
gccgccgaugaugugcggu

SEQ ID NO: 1263430 - RNA, 15 nt, Mycobacterium tuberculosis H37Rv
gccgccggcgccacc

SEQ ID NO: 1263431 - RNA, 13 nt, Mycobacterium tuberculosis H37Rv
gccgccggcgcca

SEQ ID NO: 1263432 - RNA, 18 nt, Mycobacterium tuberculosis H37Rv
gccgccggccgccagcgc

SEQ ID NO: 1263433 - RNA, 16 nt, Mycobacterium tuberculosis H37Rv
gccgccggccgccagc

SEQ ID NO: 1263434 - RNA, 23 nt, Mycobacterium tuberculosis H37Rv
gccgccggccccgccguuuccgc

SEQ ID NO: 1263435 - RNA, 19 nt, Mycobacterium tuberculosis H37Rv
gccgccggccccgccguca

SEQ ID NO: 1263436 - RNA, 20 nt, Mycobacterium tuberculosis H37Rv
gccgccggccccgccgucac

SEQ ID NO: 1263437 - RNA, 12 nt, Mycobacterium tuberculosis H37Rv
gccgccggccau

SEQ ID NO: 1263438 - RNA, 15 nt, Mycobacterium tuberculosis H37Rv
gccgccgcggccacc

SEQ ID NO: 1263439 - RNA, 17 nt, Mycobacterium tuberculosis H37Rv
gccgccgccggcgccca

SEQ ID NO: 1263440 - RNA, 21 nt, Mycobacterium tuberculosis H37Rv
gccgcccguagaacaguucga

SEQ ID NO: 1263441 - RNA, 19 nt, Mycobacterium tuberculosis H37Rv
gccgccgaaacucaccagc

SEQ ID NO: 1263442 - RNA, 21 nt, Mycobacterium tuberculosis H37Rv
gccgccgaacgccucugcgau

SEQ ID NO: 1263443 - RNA, 17 nt, Mycobacterium tuberculosis H37Rv
gccgccgaagccgcgca

SEQ ID NO: 1263444 - RNA, 17 nt, Mycobacterium tuberculosis H37Rv
gccgccgaagccgacga

SEQ ID NO: 1263445 - RNA, 23 nt, Mycobacterium tuberculosis H37Rv
gccgccgaauccgacgucgacga

SEQ ID NO: 1263446 - RNA, 12 nt, Mycobacterium tuberculosis H37Rv
gccgccgaaucc

SEQ ID NO: 1263447 - RNA, 17 nt, Mycobacterium tuberculosis H37Rv
gccgccgaacagcugga

SEQ ID NO: 1263448 - RNA, 14 nt, Mycobacterium tuberculosis H37Rv
gccgcccgucccgc

SEQ ID NO: 1263449 - RNA, 14 nt, Mycobacterium tuberculosis H37Rv
gccgccaucgccga

SEQ ID NO: 1263450 - RNA, 13 nt, Mycobacterium tuberculosis H37Rv
gccgcccagcgga

SEQ ID NO: 1263451 - RNA, 17 nt, Mycobacterium tuberculosis H37Rv
gccgcccagcaucucgg

SEQ ID NO: 1263452 - RNA, 22 nt, Mycobacterium tuberculosis H37Rv
gccgcccaggagcaccucgaag

SEQ ID NO: 1263453 - RNA, 17 nt, Mycobacterium tuberculosis H37Rv
gccgccaucaccgccgu

SEQ ID NO: 1263454 - RNA, 22 nt, Mycobacterium tuberculosis H37Rv
gccgccauccccuggccagcag

SEQ ID NO: 1263455 - RNA, 23 nt, Mycobacterium tuberculosis H37Rv
gccgcagcgaaaacccggucggc

SEQ ID NO: 1263456 - RNA, 14 nt, Mycobacterium tuberculosis H37Rv
gccgcagcaccucg

SEQ ID NO: 1263457 - RNA, 12 nt, Mycobacterium tuberculosis H37Rv
gccgcagcaggg

SEQ ID NO: 1263458 - RNA, 13 nt, Mycobacterium tuberculosis H37Rv
gccgcagccacgu

SEQ ID NO: 1263459 - RNA, 14 nt, Mycobacterium tuberculosis H37Rv
gccgcagccugcaa

SEQ ID NO: 1263460 - RNA, 15 nt, Mycobacterium tuberculosis H37Rv
gccgccagcgccacc

SEQ ID NO: 1263461 - RNA, 13 nt, Mycobacterium tuberculosis H37Rv
gccgcgcugcgac

SEQ ID NO: 1263462 - RNA, 22 nt, Mycobacterium tuberculosis H37Rv
gccgcgcuggugauucgcagcc

SEQ ID NO: 1263463 - RNA, 15 nt, Mycobacterium tuberculosis H37Rv
gccgcgcuggucaac

SEQ ID NO: 1263464 - RNA, 15 nt, Mycobacterium tuberculosis H37Rv
gccgcgcgccggcca

SEQ ID NO: 1263465 - RNA, 22 nt, Mycobacterium tuberculosis H37Rv
gccgcgcgccaucgccuccagc

SEQ ID NO: 1263466 - RNA, 15 nt, Mycobacterium tuberculosis H37Rv
gccgcgccgauucca

SEQ ID NO: 1263467 - RNA, 19 nt, Mycobacterium tuberculosis H37Rv
gccgcgcuugcgaucggca

SEQ ID NO: 1263468 - RNA, 21 nt, Mycobacterium tuberculosis H37Rv
gccgcggcaacaccaccucga

SEQ ID NO: 1263469 - RNA, 23 nt, Mycobacterium tuberculosis H37Rv
gccgcggcaacaccaccucgacg

SEQ ID NO: 1263470 - RNA, 18 nt, Mycobacterium tuberculosis H37Rv
gccgcgcuugcgaucggc

SEQ ID NO: 1263471 - RNA, 23 nt, Mycobacterium tuberculosis H37Rv
gccgcggccacaucgccagcagc

SEQ ID NO: 1263472 - RNA, 21 nt, Mycobacterium tuberculosis H37Rv
gccgcggcagggcggugccau

SEQ ID NO: 1263473 - RNA, 20 nt, Mycobacterium tuberculosis H37Rv
gccgcggcagcauccucgac

SEQ ID NO: 1263474 - RNA, 16 nt, Mycobacterium tuberculosis H37Rv
gccgcggccaccaccg

SEQ ID NO: 1263475 - RNA, 23 nt, Mycobacterium tuberculosis H37Rv
gccgcggcaccgccgagcagacg

SEQ ID NO: 1263476 - RNA, 20 nt, Mycobacterium tuberculosis H37Rv
gccgcggcaccgccgagcag

SEQ ID NO: 1263477 - RNA, 19 nt, Mycobacterium tuberculosis H37Rv
gccgcggcaccgccgagca

SEQ ID NO: 1263478 - RNA, 16 nt, Mycobacterium tuberculosis H37Rv
gccgcggcaccgccga

SEQ ID NO: 1263479 - RNA, 17 nt, Mycobacterium tuberculosis H37Rv
gccgcggcacccggcuu

SEQ ID NO: 1263480 - RNA, 19 nt, Mycobacterium tuberculosis H37Rv
gccgcgggcgccgguuacc

SEQ ID NO: 1263481 - RNA, 18 nt, Mycobacterium tuberculosis H37Rv
gccgcggggaucagcguc

SEQ ID NO: 1263482 - RNA, 19 nt, Mycobacterium tuberculosis H37Rv
gccgcgguuaucgccgaga

SEQ ID NO: 1263483 - RNA, 22 nt, Mycobacterium tuberculosis H37Rv
gccgcgguggaugcgaugcgcg

SEQ ID NO: 1263484 - RNA, 20 nt, Mycobacterium tuberculosis H37Rv
gccgcggcuugucgccccau

SEQ ID NO: 1263485 - RNA, 19 nt, Mycobacterium tuberculosis H37Rv
gccgcggccaguacgucga

SEQ ID NO: 1263486 - RNA, 22 nt, Mycobacterium tuberculosis H37Rv
gccgcggccaguacgucgauca

SEQ ID NO: 1263487 - RNA, 21 nt, Mycobacterium tuberculosis H37Rv
gccgcgucucggugcagcagc

SEQ ID NO: 1263488 - RNA, 22 nt, Mycobacterium tuberculosis H37Rv
gccgcgucucggugcagcagcg

SEQ ID NO: 1263489 - RNA, 21 nt, Mycobacterium tuberculosis H37Rv
gccgcgucuuggugcgcguca

SEQ ID NO: 1263490 - RNA, 12 nt, Mycobacterium tuberculosis H37Rv
gccgcgugccgc

SEQ ID NO: 1263491 - RNA, 20 nt, Mycobacterium tuberculosis H37Rv
gccgcguaaaccggcugacc

SEQ ID NO: 1263492 - RNA, 17 nt, Mycobacterium tuberculosis H37Rv
gccgcguggcuggcggc

SEQ ID NO: 1263493 - RNA, 16 nt, Mycobacterium tuberculosis H37Rv
gccgcgugcucgccgu

SEQ ID NO: 1263494 - RNA, 23 nt, Mycobacterium tuberculosis H37Rv
gccgcguucacgcaauuggccgu

SEQ ID NO: 1263495 - RNA, 11 nt, Mycobacterium tuberculosis H37Rv
gccgcguucgc

SEQ ID NO: 1263496 - RNA, 22 nt, Mycobacterium tuberculosis H37Rv
gccgcuaggugacgccgccagc

SEQ ID NO: 1263497 - RNA, 21 nt, Mycobacterium tuberculosis H37Rv
gccgcuaggaucggauggcgg

SEQ ID NO: 1263498 - RNA, 21 nt, Mycobacterium tuberculosis H37Rv
gccgcucacaagccgugcagc

SEQ ID NO: 1263499 - RNA, 22 nt, Mycobacterium tuberculosis H37Rv
gccgcucgguaggacaggaucg

SEQ ID NO: 1263500 - RNA, 18 nt, Mycobacterium tuberculosis H37Rv
gccgcucgggguggucgg

SEQ ID NO: 1263501 - RNA, 15 nt, Mycobacterium tuberculosis H37Rv
gccgcucggcguagc

SEQ ID NO: 1263502 - RNA, 15 nt, Mycobacterium tuberculosis H37Rv
gccgcuggaagucgg

SEQ ID NO: 1263503 - RNA, 17 nt, Mycobacterium tuberculosis H37Rv
gccgcugccgccgagcu

SEQ ID NO: 1263504 - RNA, 20 nt, Mycobacterium tuberculosis H37Rv
gccgcugccgcccuugccgc

SEQ ID NO: 1263505 - RNA, 15 nt, Mycobacterium tuberculosis H37Rv
gccgcugccgcccuu

SEQ ID NO: 1263506 - RNA, 14 nt, Mycobacterium tuberculosis H37Rv
gccgcugccagggu

SEQ ID NO: 1263507 - RNA, 19 nt, Mycobacterium tuberculosis H37Rv
gccgcugcauccgcagcac

SEQ ID NO: 1263508 - RNA, 21 nt, Mycobacterium tuberculosis H37Rv
gccgcugauguacccggcgac

SEQ ID NO: 1263509 - RNA, 22 nt, Mycobacterium tuberculosis H37Rv
gccgcugaugcuggccaggacg

SEQ ID NO: 1263510 - RNA, 22 nt, Mycobacterium tuberculosis H37Rv
gccgcucguuacgccgagcaca

SEQ ID NO: 1263511 - RNA, 21 nt, Mycobacterium tuberculosis H37Rv
gccggcaagaccgaacagcgg

SEQ ID NO: 1263512 - RNA, 16 nt, Mycobacterium tuberculosis H37Rv
gccggcaccaccguug

SEQ ID NO: 1263513 - RNA, 21 nt, Mycobacterium tuberculosis H37Rv
gccggcaccccacggccagug

SEQ ID NO: 1263514 - RNA, 20 nt, Mycobacterium tuberculosis H37Rv
gccggcaccgcagcggaacu

SEQ ID NO: 1263515 - RNA, 19 nt, Mycobacterium tuberculosis H37Rv
gccggcacccgucgggugc

SEQ ID NO: 1263516 - RNA, 13 nt, Mycobacterium tuberculosis H37Rv
gccggaguuccgc

SEQ ID NO: 1263517 - RNA, 20 nt, Mycobacterium tuberculosis H37Rv
gccggaggucgggcggcgac

SEQ ID NO: 1263518 - RNA, 15 nt, Mycobacterium tuberculosis H37Rv
gccggacgccaugcc

SEQ ID NO: 1263519 - RNA, 22 nt, Mycobacterium tuberculosis H37Rv
gccggaucgaaacucagcccgu

SEQ ID NO: 1263520 - RNA, 14 nt, Mycobacterium tuberculosis H37Rv
gccggaucguucgc

SEQ ID NO: 1263521 - RNA, 19 nt, Mycobacterium tuberculosis H37Rv
gccggaucucccguuuggc

SEQ ID NO: 1263522 - RNA, 21 nt, Mycobacterium tuberculosis H37Rv
gccggaugacaccgaccgggu

SEQ ID NO: 1263523 - RNA, 17 nt, Mycobacterium tuberculosis H37Rv
gccggaugacaccgacc

SEQ ID NO: 1263524 - RNA, 13 nt, Mycobacterium tuberculosis H37Rv
gccggaugcccgg

SEQ ID NO: 1263525 - RNA, 18 nt, Mycobacterium tuberculosis H37Rv
gccggcccaccaggccca

SEQ ID NO: 1263526 - RNA, 18 nt, Mycobacterium tuberculosis H37Rv
gccggccagcgucgcaag

SEQ ID NO: 1263527 - RNA, 15 nt, Mycobacterium tuberculosis H37Rv
gccggcaucgcgcaa

SEQ ID NO: 1263528 - RNA, 15 nt, Mycobacterium tuberculosis H37Rv
gccggcaucgucgac

SEQ ID NO: 1263529 - RNA, 16 nt, Mycobacterium tuberculosis H37Rv
gccggcaucgucgacg

SEQ ID NO: 1263530 - RNA, 15 nt, Mycobacterium tuberculosis H37Rv
gccggcaugccagcc

SEQ ID NO: 1263531 - RNA, 16 nt, Mycobacterium tuberculosis H37Rv
gccggcauggcggcau

SEQ ID NO: 1263532 - RNA, 16 nt, Mycobacterium tuberculosis H37Rv
gccggcaucuccaccg

SEQ ID NO: 1263533 - RNA, 17 nt, Mycobacterium tuberculosis H37Rv
gccggcaucgacguagc

SEQ ID NO: 1263534 - RNA, 17 nt, Mycobacterium tuberculosis H37Rv
gccggagacccgggugc

SEQ ID NO: 1263535 - RNA, 21 nt, Mycobacterium tuberculosis H37Rv
gccggaggcaagcaaccggug

SEQ ID NO: 1263536 - RNA, 17 nt, Mycobacterium tuberculosis H37Rv
gccggagucgacgacgu

SEQ ID NO: 1263537 - RNA, 23 nt, Mycobacterium tuberculosis H37Rv
gccggacgacaacaggccgucga

SEQ ID NO: 1263538 - RNA, 19 nt, Mycobacterium tuberculosis H37Rv
gccggaccguguacuggua

SEQ ID NO: 1263539 - RNA, 18 nt, Mycobacterium tuberculosis H37Rv
gccggaccagcuccugca

SEQ ID NO: 1263540 - RNA, 21 nt, Mycobacterium tuberculosis H37Rv
gccggaccccgagaccaacgc

SEQ ID NO: 1263541 - RNA, 15 nt, Mycobacterium tuberculosis H37Rv
gccggacagccacgc

SEQ ID NO: 1263542 - RNA, 23 nt, Mycobacterium tuberculosis H37Rv
gccgcuugccccgccuuggccac

SEQ ID NO: 1263543 - RNA, 16 nt, Mycobacterium tuberculosis H37Rv
gccggacagaucaacg

SEQ ID NO: 1263544 - RNA, 23 nt, Mycobacterium tuberculosis H37Rv
gccgcugucguaccgcucggcgg

SEQ ID NO: 1263545 - RNA, 20 nt, Mycobacterium tuberculosis H37Rv
gccgcugugagcuuggucgc

SEQ ID NO: 1263546 - RNA, 13 nt, Mycobacterium tuberculosis H37Rv
gccgcugugcggu

SEQ ID NO: 1263547 - RNA, 17 nt, Mycobacterium tuberculosis H37Rv
gccgcugugcggucguc

SEQ ID NO: 1263548 - RNA, 16 nt, Mycobacterium tuberculosis H37Rv
gccgcugggugaccag

SEQ ID NO: 1263549 - RNA, 23 nt, Mycobacterium tuberculosis H37Rv
gccgcuggagaucacgccgacga

SEQ ID NO: 1263550 - RNA, 16 nt, Mycobacterium tuberculosis H37Rv
gccgcuggagaucacg

SEQ ID NO: 1263551 - RNA, 22 nt, Mycobacterium tuberculosis H37Rv
gccgacaacccggccgggccug

SEQ ID NO: 1263552 - RNA, 21 nt, Mycobacterium tuberculosis H37Rv
gccgacaaccccgccaggauc

SEQ ID NO: 1263553 - RNA, 22 nt, Mycobacterium tuberculosis H37Rv
gccgaaguugaagaagccagag

SEQ ID NO: 1263554 - RNA, 21 nt, Mycobacterium tuberculosis H37Rv
gccgaaguuuuggaagcccga

SEQ ID NO: 1263555 - RNA, 23 nt, Mycobacterium tuberculosis H37Rv
gccgaauaacagcaggcauuccc

SEQ ID NO: 1263556 - RNA, 18 nt, Mycobacterium tuberculosis H37Rv
gccgacaaugucggcgau

SEQ ID NO: 1263557 - RNA, 23 nt, Mycobacterium tuberculosis H37Rv
gccgacaaugucggcgaugcguc

SEQ ID NO: 1263558 - RNA, 13 nt, Mycobacterium tuberculosis H37Rv
gccgacaccaccg

SEQ ID NO: 1263559 - RNA, 21 nt, Mycobacterium tuberculosis H37Rv
gccgacaacgacgucgccgac

SEQ ID NO: 1263560 - RNA, 18 nt, Mycobacterium tuberculosis H37Rv
gccgacaaccuuggcgac

SEQ ID NO: 1263561 - RNA, 17 nt, Mycobacterium tuberculosis H37Rv
gccgacaacgacgucgc

SEQ ID NO: 1263562 - RNA, 14 nt, Mycobacterium tuberculosis H37Rv
gccgacaccaccgg

SEQ ID NO: 1263563 - RNA, 18 nt, Mycobacterium tuberculosis H37Rv
gccgacaccgccaccacg

SEQ ID NO: 1263564 - RNA, 18 nt, Mycobacterium tuberculosis H37Rv
gccgacauugcugcucgu

SEQ ID NO: 1263565 - RNA, 13 nt, Mycobacterium tuberculosis H37Rv
gccgacauggcgg

SEQ ID NO: 1263566 - RNA, 17 nt, Mycobacterium tuberculosis H37Rv
gccgacaccggcugacc

SEQ ID NO: 1263567 - RNA, 22 nt, Mycobacterium tuberculosis H37Rv
gccgacaccgccaccacgccgu

SEQ ID NO: 1263568 - RNA, 21 nt, Mycobacterium tuberculosis H37Rv
gccgacacgccgaugccgaac

SEQ ID NO: 1263569 - RNA, 20 nt, Mycobacterium tuberculosis H37Rv
gccgacccgccacaucgugg

SEQ ID NO: 1263570 - RNA, 17 nt, Mycobacterium tuberculosis H37Rv
gccgacccaacccgauc

SEQ ID NO: 1263571 - RNA, 17 nt, Mycobacterium tuberculosis H37Rv
gccgaccagaacgccag

SEQ ID NO: 1263572 - RNA, 23 nt, Mycobacterium tuberculosis H37Rv
gccgaccccggaaugcccgagca

SEQ ID NO: 1263573 - RNA, 18 nt, Mycobacterium tuberculosis H37Rv
gccgaccgacaccaccag

SEQ ID NO: 1263574 - RNA, 14 nt, Mycobacterium tuberculosis H37Rv
gccgaccgacacca

SEQ ID NO: 1263575 - RNA, 22 nt, Mycobacterium tuberculosis H37Rv
gccgaccggcacccgcggcgaa

SEQ ID NO: 1263576 - RNA, 15 nt, Mycobacterium tuberculosis H37Rv
gccgaccgaaucagc

SEQ ID NO: 1263577 - RNA, 21 nt, Mycobacterium tuberculosis H37Rv
gccgacccgcgcgccggcgac

SEQ ID NO: 1263578 - RNA, 13 nt, Mycobacterium tuberculosis H37Rv
gccgaccucgagu

SEQ ID NO: 1263579 - RNA, 13 nt, Mycobacterium tuberculosis H37Rv
gccgacgaccagc

SEQ ID NO: 1263580 - RNA, 19 nt, Mycobacterium tuberculosis H37Rv
gccgacgaaggauugcgga

SEQ ID NO: 1263581 - RNA, 16 nt, Mycobacterium tuberculosis H37Rv
gccgacgaccagcaga

SEQ ID NO: 1263582 - RNA, 18 nt, Mycobacterium tuberculosis H37Rv
gccgacgaccagcagauc

SEQ ID NO: 1263583 - RNA, 14 nt, Mycobacterium tuberculosis H37Rv
gccgacgaccagca

SEQ ID NO: 1263584 - RNA, 17 nt, Mycobacterium tuberculosis H37Rv
gccgaccucaucggcac

SEQ ID NO: 1263585 - RNA, 19 nt, Mycobacterium tuberculosis H37Rv
gccgaccucgaacggggug

SEQ ID NO: 1263586 - RNA, 20 nt, Mycobacterium tuberculosis H37Rv
gccgaccggcccgcauccgc

SEQ ID NO: 1263587 - RNA, 17 nt, Mycobacterium tuberculosis H37Rv
gccgaccggcggcaaac

SEQ ID NO: 1263588 - RNA, 18 nt, Mycobacterium tuberculosis H37Rv
gccgaccggccacgaccu

SEQ ID NO: 1263589 - RNA, 23 nt, Mycobacterium tuberculosis H37Rv
gccgacgccgccggcaccguaga

SEQ ID NO: 1263590 - RNA, 15 nt, Mycobacterium tuberculosis H37Rv
gccgacggccagcag

SEQ ID NO: 1263591 - RNA, 12 nt, Mycobacterium tuberculosis H37Rv
gccgacgggaac

SEQ ID NO: 1263592 - RNA, 16 nt, Mycobacterium tuberculosis H37Rv
gccgacuaucggccgc

SEQ ID NO: 1263593 - RNA, 15 nt, Mycobacterium tuberculosis H37Rv
gccgacuaucggccg

SEQ ID NO: 1263594 - RNA, 18 nt, Mycobacterium tuberculosis H37Rv
gccgacuagcugggguca

SEQ ID NO: 1263595 - RNA, 15 nt, Mycobacterium tuberculosis H37Rv
gccgacgauuaccag

SEQ ID NO: 1263596 - RNA, 16 nt, Mycobacterium tuberculosis H37Rv
gccgacgaugugccag

SEQ ID NO: 1263597 - RNA, 21 nt, Mycobacterium tuberculosis H37Rv
gccgacgccccgaucggccac

SEQ ID NO: 1263598 - RNA, 17 nt, Mycobacterium tuberculosis H37Rv
gccgacgccaacgccag

SEQ ID NO: 1263599 - RNA, 12 nt, Mycobacterium tuberculosis H37Rv
gccgacgaugac

SEQ ID NO: 1263600 - RNA, 14 nt, Mycobacterium tuberculosis H37Rv
gccgacgauagcgg

SEQ ID NO: 1263601 - RNA, 15 nt, Mycobacterium tuberculosis H37Rv
gccgacgaucgacgc

SEQ ID NO: 1263602 - RNA, 21 nt, Mycobacterium tuberculosis H37Rv
gccgagaugcuggucggcgau

SEQ ID NO: 1263603 - RNA, 21 nt, Mycobacterium tuberculosis H37Rv
gccgagaugcugcacccggag

SEQ ID NO: 1263604 - RNA, 14 nt, Mycobacterium tuberculosis H37Rv
gccgagauccacgc

SEQ ID NO: 1263605 - RNA, 17 nt, Mycobacterium tuberculosis H37Rv
gccgagauccacgccag

SEQ ID NO: 1263606 - RNA, 13 nt, Mycobacterium tuberculosis H37Rv
gccgacucagguc

SEQ ID NO: 1263607 - RNA, 22 nt, Mycobacterium tuberculosis H37Rv
gccgagcgcaacucccagcacg

SEQ ID NO: 1263608 - RNA, 15 nt, Mycobacterium tuberculosis H37Rv
gccgagcggucaacg

SEQ ID NO: 1263609 - RNA, 21 nt, Mycobacterium tuberculosis H37Rv
gccgagcgugaaccuggcgac

SEQ ID NO: 1263610 - RNA, 18 nt, Mycobacterium tuberculosis H37Rv
gccgagcgugaaccuggc

SEQ ID NO: 1263611 - RNA, 22 nt, Mycobacterium tuberculosis H37Rv
gccgagccucgcucuccauggc

SEQ ID NO: 1263612 - RNA, 14 nt, Mycobacterium tuberculosis H37Rv
gccgagccguugcg

SEQ ID NO: 1263613 - RNA, 18 nt, Mycobacterium tuberculosis H37Rv
gccgagccgauauaccag

SEQ ID NO: 1263614 - RNA, 21 nt, Mycobacterium tuberculosis H37Rv
gccgagccgauauaccagggc

SEQ ID NO: 1263615 - RNA, 16 nt, Mycobacterium tuberculosis H37Rv
gccgaucccggcgagc

SEQ ID NO: 1263616 - RNA, 21 nt, Mycobacterium tuberculosis H37Rv
gccgaucgacacccgcucggc

SEQ ID NO: 1263617 - RNA, 23 nt, Mycobacterium tuberculosis H37Rv
gccgaucgccgaguccggcgagc

SEQ ID NO: 1263618 - RNA, 14 nt, Mycobacterium tuberculosis H37Rv
gccgaucgacaccc

SEQ ID NO: 1263619 - RNA, 23 nt, Mycobacterium tuberculosis H37Rv
gccgaucaacagcaccguacggc

SEQ ID NO: 1263620 - RNA, 13 nt, Mycobacterium tuberculosis H37Rv
gccgauagcgcgg

SEQ ID NO: 1263621 - RNA, 20 nt, Mycobacterium tuberculosis H37Rv
gccgauacuaaacaggccgc

SEQ ID NO: 1263622 - RNA, 15 nt, Mycobacterium tuberculosis H37Rv
gccgauauaccaggg

SEQ ID NO: 1263623 - RNA, 23 nt, Mycobacterium tuberculosis H37Rv
gccgaucaacaugccggucaucc

SEQ ID NO: 1263624 - RNA, 13 nt, Mycobacterium tuberculosis H37Rv
gccgagcuagauc

SEQ ID NO: 1263625 - RNA, 19 nt, Mycobacterium tuberculosis H37Rv
gccgagcucggucaccacg

SEQ ID NO: 1263626 - RNA, 23 nt, Mycobacterium tuberculosis H37Rv
gccgagcucguugaccaggaaug

SEQ ID NO: 1263627 - RNA, 16 nt, Mycobacterium tuberculosis H37Rv
gccgagcucguugacc

SEQ ID NO: 1263628 - RNA, 20 nt, Mycobacterium tuberculosis H37Rv
gccgaggcagcgucgucgac

SEQ ID NO: 1263629 - RNA, 21 nt, Mycobacterium tuberculosis H37Rv
gccgaggcagcgucgucgacg

SEQ ID NO: 1263630 - RNA, 16 nt, Mycobacterium tuberculosis H37Rv
gccgagcuucagcgcg

SEQ ID NO: 1263631 - RNA, 12 nt, Mycobacterium tuberculosis H37Rv
gccgagcugguu

SEQ ID NO: 1263632 - RNA, 16 nt, Mycobacterium tuberculosis H37Rv
gccgaggccgccguug

SEQ ID NO: 1263633 - RNA, 20 nt, Mycobacterium tuberculosis H37Rv
gccgaggccuaccaggcgcg

SEQ ID NO: 1263634 - RNA, 18 nt, Mycobacterium tuberculosis H37Rv
gccgaggccucggccagc

SEQ ID NO: 1263635 - RNA, 14 nt, Mycobacterium tuberculosis H37Rv
gccgagguugcgga

SEQ ID NO: 1263636 - RNA, 17 nt, Mycobacterium tuberculosis H37Rv
gccgaggucgguucggc

SEQ ID NO: 1263637 - RNA, 18 nt, Mycobacterium tuberculosis H37Rv
gccgcacaaguggucgau

SEQ ID NO: 1263638 - RNA, 14 nt, Mycobacterium tuberculosis H37Rv
gccgcacgauagcc

SEQ ID NO: 1263639 - RNA, 19 nt, Mycobacterium tuberculosis H37Rv
gccgcacgauggccgucga

SEQ ID NO: 1263640 - RNA, 14 nt, Mycobacterium tuberculosis H37Rv
gccgcacgauggcc

SEQ ID NO: 1263641 - RNA, 13 nt, Mycobacterium tuberculosis H37Rv
gccgcacgaugcc

SEQ ID NO: 1263642 - RNA, 17 nt, Mycobacterium tuberculosis H37Rv
gccgcacgccggcaugc

SEQ ID NO: 1263643 - RNA, 20 nt, Mycobacterium tuberculosis H37Rv
gccgcacgauggccgucgau

SEQ ID NO: 1263644 - RNA, 22 nt, Mycobacterium tuberculosis H37Rv
gccgcacgccgaccggcccgca

SEQ ID NO: 1263645 - RNA, 17 nt, Mycobacterium tuberculosis H37Rv
gccgcacgccggccagc

SEQ ID NO: 1263646 - RNA, 18 nt, Mycobacterium tuberculosis H37Rv
gccgcacgggcgaccugc

SEQ ID NO: 1263647 - RNA, 19 nt, Mycobacterium tuberculosis H37Rv
gccgcaauggaccgaacga

SEQ ID NO: 1263648 - RNA, 18 nt, Mycobacterium tuberculosis H37Rv
gccgcaaugacgucgucg

SEQ ID NO: 1263649 - RNA, 21 nt, Mycobacterium tuberculosis H37Rv
gccgcaagugucuccggcaac

SEQ ID NO: 1263650 - RNA, 14 nt, Mycobacterium tuberculosis H37Rv
gccgcaauacccga

SEQ ID NO: 1263651 - RNA, 19 nt, Mycobacterium tuberculosis H37Rv
gccgaugucaacgcccagc

SEQ ID NO: 1263652 - RNA, 13 nt, Mycobacterium tuberculosis H37Rv
gccgauccaggag

SEQ ID NO: 1263653 - RNA, 15 nt, Mycobacterium tuberculosis H37Rv
gccgaugaccgaaga

SEQ ID NO: 1263654 - RNA, 15 nt, Mycobacterium tuberculosis H37Rv
gccgaugacguacgg

SEQ ID NO: 1263655 - RNA, 16 nt, Mycobacterium tuberculosis H37Rv
gccgaugacguacggc

SEQ ID NO: 1263656 - RNA, 23 nt, Mycobacterium tuberculosis H37Rv
gccgaucugguaagucagcucga

SEQ ID NO: 1263657 - RNA, 17 nt, Mycobacterium tuberculosis H37Rv
gccgaugggaaccgaau

SEQ ID NO: 1263658 - RNA, 18 nt, Mycobacterium tuberculosis H37Rv
gccgaugcugcgggcggu

SEQ ID NO: 1263659 - RNA, 14 nt, Mycobacterium tuberculosis H37Rv
gccgaugcugcggg

SEQ ID NO: 1263660 - RNA, 14 nt, Mycobacterium tuberculosis H37Rv
gccgaugcggugcg

SEQ ID NO: 1263661 - RNA, 14 nt, Mycobacterium tuberculosis H37Rv
gcccguacacgauc

SEQ ID NO: 1263662 - RNA, 15 nt, Mycobacterium tuberculosis H37Rv
gcccguagccgagcu

SEQ ID NO: 1263663 - RNA, 13 nt, Mycobacterium tuberculosis H37Rv
gcccgucaccgcg

SEQ ID NO: 1263664 - RNA, 19 nt, Mycobacterium tuberculosis H37Rv
gcccgucgucgucgacacg

SEQ ID NO: 1263665 - RNA, 16 nt, Mycobacterium tuberculosis H37Rv
gcccgucgugaccgac

SEQ ID NO: 1263666 - RNA, 22 nt, Mycobacterium tuberculosis H37Rv
gcccggugcuaaccgacgcuga

SEQ ID NO: 1263667 - RNA, 19 nt, Mycobacterium tuberculosis H37Rv
gcccggugauccacgcucg

SEQ ID NO: 1263668 - RNA, 15 nt, Mycobacterium tuberculosis H37Rv
gcccgccucgcagcg

SEQ ID NO: 1263669 - RNA, 17 nt, Mycobacterium tuberculosis H37Rv
gcccgccucgaccgcca

SEQ ID NO: 1263670 - RNA, 16 nt, Mycobacterium tuberculosis H37Rv
gcccgccucaucggca

SEQ ID NO: 1263671 - RNA, 15 nt, Mycobacterium tuberculosis H37Rv
gcccgccugaccgcc

SEQ ID NO: 1263672 - RNA, 18 nt, Mycobacterium tuberculosis H37Rv
gcccuccggcgcagcgac

SEQ ID NO: 1263673 - RNA, 22 nt, Mycobacterium tuberculosis H37Rv
gcccucccuggggccguccggc

SEQ ID NO: 1263674 - RNA, 22 nt, Mycobacterium tuberculosis H37Rv
gcccuccggguauggcggcgac

SEQ ID NO: 1263675 - RNA, 19 nt, Mycobacterium tuberculosis H37Rv
gcccguuugccgguucggc

SEQ ID NO: 1263676 - RNA, 22 nt, Mycobacterium tuberculosis H37Rv
gcccguucgaaguucucggugc

SEQ ID NO: 1263677 - RNA, 20 nt, Mycobacterium tuberculosis H37Rv
gcccguuguccagaacggcg

SEQ ID NO: 1263678 - RNA, 17 nt, Mycobacterium tuberculosis H37Rv
gcccguuggcagcacag

SEQ ID NO: 1263679 - RNA, 15 nt, Mycobacterium tuberculosis H37Rv
gcccguucgugccgu

SEQ ID NO: 1263680 - RNA, 15 nt, Mycobacterium tuberculosis H37Rv
gcccguucugcccag

SEQ ID NO: 1263681 - RNA, 16 nt, Mycobacterium tuberculosis H37Rv
gcccguggucgaucau

SEQ ID NO: 1263682 - RNA, 22 nt, Mycobacterium tuberculosis H37Rv
gcccgugccacagcucgccgug

SEQ ID NO: 1263683 - RNA, 20 nt, Mycobacterium tuberculosis H37Rv
gcccugagaacacguucggc

SEQ ID NO: 1263684 - RNA, 21 nt, Mycobacterium tuberculosis H37Rv
gcccugacgucacguucggcg

SEQ ID NO: 1263685 - RNA, 20 nt, Mycobacterium tuberculosis H37Rv
gcccugacgucacguucggc

SEQ ID NO: 1263686 - RNA, 17 nt, Mycobacterium tuberculosis H37Rv
gcccugauugaagcccc

SEQ ID NO: 1263687 - RNA, 16 nt, Mycobacterium tuberculosis H37Rv
gcccugcgcagccgcc

SEQ ID NO: 1263688 - RNA, 21 nt, Mycobacterium tuberculosis H37Rv
gcccugcauaggcgcggucac

SEQ ID NO: 1263689 - RNA, 20 nt, Mycobacterium tuberculosis H37Rv
gcccugacacaacaccggcg

SEQ ID NO: 1263690 - RNA, 20 nt, Mycobacterium tuberculosis H37Rv
gcccugacacccaucgaccg

SEQ ID NO: 1263691 - RNA, 17 nt, Mycobacterium tuberculosis H37Rv
gcccucguuaucgaccg

SEQ ID NO: 1263692 - RNA, 21 nt, Mycobacterium tuberculosis H37Rv
gcccucggccgccugacggua

SEQ ID NO: 1263693 - RNA, 17 nt, Mycobacterium tuberculosis H37Rv
gcccucgacgccgcgca

SEQ ID NO: 1263694 - RNA, 20 nt, Mycobacterium tuberculosis H37Rv
gcccuugggacugcggacac

SEQ ID NO: 1263695 - RNA, 15 nt, Mycobacterium tuberculosis H37Rv
gccgaaaaugccgcc

SEQ ID NO: 1263696 - RNA, 22 nt, Mycobacterium tuberculosis H37Rv
gccgaaaacaacccgaacacgc

SEQ ID NO: 1263697 - RNA, 23 nt, Mycobacterium tuberculosis H37Rv
gccgaaaacaacccgaacacgcu

SEQ ID NO: 1263698 - RNA, 19 nt, Mycobacterium tuberculosis H37Rv
gccgaacacgcacacgauc

SEQ ID NO: 1263699 - RNA, 18 nt, Mycobacterium tuberculosis H37Rv
gccgaacagcagcccgcc

SEQ ID NO: 1263700 - RNA, 19 nt, Mycobacterium tuberculosis H37Rv
gccgaacaccgucagcguc

SEQ ID NO: 1263701 - RNA, 21 nt, Mycobacterium tuberculosis H37Rv
gccgaacaauaaggccgcacg

SEQ ID NO: 1263702 - RNA, 21 nt, Mycobacterium tuberculosis H37Rv
gccgaaagccaggcggcaagg

SEQ ID NO: 1263703 - RNA, 18 nt, Mycobacterium tuberculosis H37Rv
gccgaacaguucggcgag

SEQ ID NO: 1263704 - RNA, 19 nt, Mycobacterium tuberculosis H37Rv
gccgaacagugucgauagc

SEQ ID NO: 1263705 - RNA, 14 nt, Mycobacterium tuberculosis H37Rv
gccgaacaguucgg

SEQ ID NO: 1263706 - RNA, 17 nt, Mycobacterium tuberculosis H37Rv
gccgaacagggaggucg

SEQ ID NO: 1263707 - RNA, 16 nt, Mycobacterium tuberculosis H37Rv
gccgaacagccgagcc

SEQ ID NO: 1263708 - RNA, 14 nt, Mycobacterium tuberculosis H37Rv
gccgaacagcgaac

SEQ ID NO: 1263709 - RNA, 15 nt, Mycobacterium tuberculosis H37Rv
gccgaacagcaggcc

SEQ ID NO: 1263710 - RNA, 23 nt, Mycobacterium tuberculosis H37Rv
gccgaaccgcgcguaauccgagc

SEQ ID NO: 1263711 - RNA, 19 nt, Mycobacterium tuberculosis H37Rv
gccgaaccggcaccagcgg

SEQ ID NO: 1263712 - RNA, 20 nt, Mycobacterium tuberculosis H37Rv
gccgaacccgccgucaccgc

SEQ ID NO: 1263713 - RNA, 21 nt, Mycobacterium tuberculosis H37Rv
gccgaacccgccgucaccgcg

SEQ ID NO: 1263714 - RNA, 15 nt, Mycobacterium tuberculosis H37Rv
gccgaaccacgcgcc

SEQ ID NO: 1263715 - RNA, 22 nt, Mycobacterium tuberculosis H37Rv
gccgaagaaggugacgaucgac

SEQ ID NO: 1263716 - RNA, 22 nt, Mycobacterium tuberculosis H37Rv
gccgaagcgcccguuggccaag

SEQ ID NO: 1263717 - RNA, 24 nt, Mycobacterium tuberculosis H37Rv
gccgaacucaacgacaccauaggc

SEQ ID NO: 1263718 - RNA, 12 nt, Mycobacterium tuberculosis H37Rv
gccgaacuccgc

SEQ ID NO: 1263719 - RNA, 15 nt, Mycobacterium tuberculosis H37Rv
gccgaacuccgcgga

SEQ ID NO: 1263720 - RNA, 20 nt, Mycobacterium tuberculosis H37Rv
gccgaacgugcaaccacggc

SEQ ID NO: 1263721 - RNA, 19 nt, Mycobacterium tuberculosis H37Rv
gccgaacgggucggcgacc

SEQ ID NO: 1263722 - RNA, 21 nt, Mycobacterium tuberculosis H37Rv
gcccuuaucuccggcuucggc

SEQ ID NO: 1263723 - RNA, 22 nt, Mycobacterium tuberculosis H37Rv
gcccuguucgauaagcagcucg

SEQ ID NO: 1263724 - RNA, 14 nt, Mycobacterium tuberculosis H37Rv
gcccuguucuccgu

SEQ ID NO: 1263725 - RNA, 17 nt, Mycobacterium tuberculosis H37Rv
gcccuucagcacgguga

SEQ ID NO: 1263726 - RNA, 13 nt, Mycobacterium tuberculosis H37Rv
gcccuucagcacg

SEQ ID NO: 1263727 - RNA, 22 nt, Mycobacterium tuberculosis H37Rv
gcccuuccggccgacacgccga

SEQ ID NO: 1263728 - RNA, 17 nt, Mycobacterium tuberculosis H37Rv
gcccuucuucgaccgcg

SEQ ID NO: 1263729 - RNA, 15 nt, Mycobacterium tuberculosis H37Rv
gcccuucgucggcau

SEQ ID NO: 1263730 - RNA, 20 nt, Mycobacterium tuberculosis H37Rv
gcccuuguggaguacggcga

SEQ ID NO: 1263731 - RNA, 14 nt, Mycobacterium tuberculosis H37Rv
gcccuuguagcaca

SEQ ID NO: 1263732 - RNA, 20 nt, Mycobacterium tuberculosis H37Rv
gcccuuguagcacaccgaca

SEQ ID NO: 1263733 - RNA, 16 nt, Mycobacterium tuberculosis H37Rv
gcccuuggccagcagg

SEQ ID NO: 1263734 - RNA, 19 nt, Mycobacterium tuberculosis H37Rv
gcccuugcggaagaagugc

SEQ ID NO: 1263735 - RNA, 22 nt, Mycobacterium tuberculosis H37Rv
gcccuugccgccagccccagcg

SEQ ID NO: 1263736 - RNA, 14 nt, Mycobacterium tuberculosis H37Rv
gcccuggaccagcg

SEQ ID NO: 1263737 - RNA, 13 nt, Mycobacterium tuberculosis H37Rv
gcccuggacgucg

SEQ ID NO: 1263738 - RNA, 16 nt, Mycobacterium tuberculosis H37Rv
gcccauagcaccucga

SEQ ID NO: 1263739 - RNA, 20 nt, Mycobacterium tuberculosis H37Rv
gcccaucgcgacuagacgcc

SEQ ID NO: 1263740 - RNA, 20 nt, Mycobacterium tuberculosis H37Rv
gcccaguaagccgcgggcac

SEQ ID NO: 1263741 - RNA, 23 nt, Mycobacterium tuberculosis H37Rv
gcccagguugccuuggcggccaa

SEQ ID NO: 1263742 - RNA, 18 nt, Mycobacterium tuberculosis H37Rv
gcccaggugcguccaggc

SEQ ID NO: 1263743 - RNA, 16 nt, Mycobacterium tuberculosis H37Rv
gcccaggugaucgcga

SEQ ID NO: 1263744 - RNA, 15 nt, Mycobacterium tuberculosis H37Rv
gcccaggugaucgcg

SEQ ID NO: 1263745 - RNA, 21 nt, Mycobacterium tuberculosis H37Rv
gcccagcgacccggccagcgg

SEQ ID NO: 1263746 - RNA, 15 nt, Mycobacterium tuberculosis H37Rv
gcccagcucgauacc

SEQ ID NO: 1263747 - RNA, 16 nt, Mycobacterium tuberculosis H37Rv
gcccaggcgaucgccc

SEQ ID NO: 1263748 - RNA, 17 nt, Mycobacterium tuberculosis H37Rv
gcccaggccgaucagcg

SEQ ID NO: 1263749 - RNA, 16 nt, Mycobacterium tuberculosis H37Rv
gcccaggccgaucagc

SEQ ID NO: 1263750 - RNA, 14 nt, Mycobacterium tuberculosis H37Rv
gcccaggccgauca

SEQ ID NO: 1263751 - RNA, 19 nt, Mycobacterium tuberculosis H37Rv
gccccaggggcaccagcga

SEQ ID NO: 1263752 - RNA, 18 nt, Mycobacterium tuberculosis H37Rv
gcccccgcacgcucggcg

SEQ ID NO: 1263753 - RNA, 17 nt, Mycobacterium tuberculosis H37Rv
gcccccgcacgcucggc

SEQ ID NO: 1263754 - RNA, 17 nt, Mycobacterium tuberculosis H37Rv
gcccccgccauugccgc

SEQ ID NO: 1263755 - RNA, 16 nt, Mycobacterium tuberculosis H37Rv
gcccccgacacgccgu

SEQ ID NO: 1263756 - RNA, 13 nt, Mycobacterium tuberculosis H37Rv
gcccccgcacgca

SEQ ID NO: 1263757 - RNA, 19 nt, Mycobacterium tuberculosis H37Rv
gcccccgcacgcacggcgu

SEQ ID NO: 1263758 - RNA, 13 nt, Mycobacterium tuberculosis H37Rv
gcccccgcacgcu

SEQ ID NO: 1263759 - RNA, 12 nt, Mycobacterium tuberculosis H37Rv
gccccgcaucgc

SEQ ID NO: 1263760 - RNA, 15 nt, Mycobacterium tuberculosis H37Rv
gccccgcaucgccca

SEQ ID NO: 1263761 - RNA, 14 nt, Mycobacterium tuberculosis H37Rv
gccccgaucggcca

SEQ ID NO: 1263762 - RNA, 19 nt, Mycobacterium tuberculosis H37Rv
gccccgaugaccgccuugg

SEQ ID NO: 1263763 - RNA, 15 nt, Mycobacterium tuberculosis H37Rv
gccccgaccagcaga

SEQ ID NO: 1263764 - RNA, 16 nt, Mycobacterium tuberculosis H37Rv
gccccgaggaugccga

SEQ ID NO: 1263765 - RNA, 16 nt, Mycobacterium tuberculosis H37Rv
gcccaugccgucgggu

SEQ ID NO: 1263766 - RNA, 18 nt, Mycobacterium tuberculosis H37Rv
gcccaugaucucggcgaa

SEQ ID NO: 1263767 - RNA, 18 nt, Mycobacterium tuberculosis H37Rv
gccccacuggugcagcgc

SEQ ID NO: 1263768 - RNA, 17 nt, Mycobacterium tuberculosis H37Rv
gcccauggccaccaggg

SEQ ID NO: 1263769 - RNA, 23 nt, Mycobacterium tuberculosis H37Rv
gccccagcacauucugcagcguc

SEQ ID NO: 1263770 - RNA, 19 nt, Mycobacterium tuberculosis H37Rv
gccccaggcugguccgggu

SEQ ID NO: 1263771 - RNA, 15 nt, Mycobacterium tuberculosis H37Rv
gccccagggcagugc

SEQ ID NO: 1263772 - RNA, 15 nt, Mycobacterium tuberculosis H37Rv
gccccugccacgacg

SEQ ID NO: 1263773 - RNA, 21 nt, Mycobacterium tuberculosis H37Rv
gccccugcacagcaggcucga

SEQ ID NO: 1263774 - RNA, 18 nt, Mycobacterium tuberculosis H37Rv
gccccugcacagcaggcu

SEQ ID NO: 1263775 - RNA, 13 nt, Mycobacterium tuberculosis H37Rv
gccccugcacagc

SEQ ID NO: 1263776 - RNA, 15 nt, Mycobacterium tuberculosis H37Rv
gccccugccgauccc

SEQ ID NO: 1263777 - RNA, 22 nt, Mycobacterium tuberculosis H37Rv
gccccguggaaagugcguccac

SEQ ID NO: 1263778 - RNA, 14 nt, Mycobacterium tuberculosis H37Rv
gccccugaaggcca

SEQ ID NO: 1263779 - RNA, 14 nt, Mycobacterium tuberculosis H37Rv
gccccucgucguca

SEQ ID NO: 1263780 - RNA, 21 nt, Mycobacterium tuberculosis H37Rv
gccccgugggccucgaucagc

SEQ ID NO: 1263781 - RNA, 14 nt, Mycobacterium tuberculosis H37Rv
gccccgucgaccuc

SEQ ID NO: 1263782 - RNA, 11 nt, Mycobacterium tuberculosis H37Rv
gccccggucgg

SEQ ID NO: 1263783 - RNA, 17 nt, Mycobacterium tuberculosis H37Rv
gccccgccgaugccgcc

SEQ ID NO: 1263784 - RNA, 16 nt, Mycobacterium tuberculosis H37Rv
gccccgcaucgcccaa

SEQ ID NO: 1263785 - RNA, 13 nt, Mycobacterium tuberculosis H37Rv
gccccgcagcugc

SEQ ID NO: 1263786 - RNA, 19 nt, Mycobacterium tuberculosis H37Rv
gccccgccagcgccgguca

SEQ ID NO: 1263787 - RNA, 16 nt, Mycobacterium tuberculosis H37Rv
gccccgccgagcaccg

SEQ ID NO: 1263788 - RNA, 13 nt, Mycobacterium tuberculosis H37Rv
gccccgccgagcg

SEQ ID NO: 1263789 - RNA, 18 nt, Mycobacterium tuberculosis H37Rv
gcccgagucgaaaccgcc

SEQ ID NO: 1263790 - RNA, 18 nt, Mycobacterium tuberculosis H37Rv
gcccgagcaggacgguga

SEQ ID NO: 1263791 - RNA, 20 nt, Mycobacterium tuberculosis H37Rv
gcccgagcaggacggugauc

SEQ ID NO: 1263792 - RNA, 22 nt, Mycobacterium tuberculosis H37Rv
gcccgacugccguucagcggcg

SEQ ID NO: 1263793 - RNA, 19 nt, Mycobacterium tuberculosis H37Rv
gcccgacggguaucccguc

SEQ ID NO: 1263794 - RNA, 13 nt, Mycobacterium tuberculosis H37Rv
gcccgagaucgcg

SEQ ID NO: 1263795 - RNA, 18 nt, Mycobacterium tuberculosis H37Rv
gcccgaguuugaccagcc

SEQ ID NO: 1263796 - RNA, 22 nt, Mycobacterium tuberculosis H37Rv
gcccgaguugaagaagccggug

SEQ ID NO: 1263797 - RNA, 21 nt, Mycobacterium tuberculosis H37Rv
gcccgagugugaaucgcacga

SEQ ID NO: 1263798 - RNA, 21 nt, Mycobacterium tuberculosis H37Rv
gcccgaguucgcgaaucccgu

SEQ ID NO: 1263799 - RNA, 18 nt, Mycobacterium tuberculosis H37Rv
gcccgagucucgucgggu

SEQ ID NO: 1263800 - RNA, 15 nt, Mycobacterium tuberculosis H37Rv
gcccgaucaccagcc

SEQ ID NO: 1263801 - RNA, 14 nt, Mycobacterium tuberculosis H37Rv
gcccgaucgaccgc

SEQ ID NO: 1263802 - RNA, 18 nt, Mycobacterium tuberculosis H37Rv
gcccgacggguaucccgu

SEQ ID NO: 1263803 - RNA, 18 nt, Mycobacterium tuberculosis H37Rv
gcccgacggcgcccagcg

SEQ ID NO: 1263804 - RNA, 13 nt, Mycobacterium tuberculosis H37Rv
gcccgacgacgac

SEQ ID NO: 1263805 - RNA, 22 nt, Mycobacterium tuberculosis H37Rv
gcccgacgaggaugucgaugac

SEQ ID NO: 1263806 - RNA, 18 nt, Mycobacterium tuberculosis H37Rv
gcccgacgaacagcgguc

SEQ ID NO: 1263807 - RNA, 13 nt, Mycobacterium tuberculosis H37Rv
gcccgcaaacagu

SEQ ID NO: 1263808 - RNA, 20 nt, Mycobacterium tuberculosis H37Rv
gcccgcagcgcuuccagguc

SEQ ID NO: 1263809 - RNA, 17 nt, Mycobacterium tuberculosis H37Rv
gcccgauggugccgacc

SEQ ID NO: 1263810 - RNA, 21 nt, Mycobacterium tuberculosis H37Rv
gcccgauggugccgacccgcc

SEQ ID NO: 1263811 - RNA, 20 nt, Mycobacterium tuberculosis H37Rv
gcccgauggugccgacccgc

SEQ ID NO: 1263812 - RNA, 20 nt, Mycobacterium tuberculosis H37Rv
gcccgaugguggugccgacc

SEQ ID NO: 1263813 - RNA, 20 nt, Mycobacterium tuberculosis H37Rv
gcccgcagggccgccgcgaa

SEQ ID NO: 1263814 - RNA, 15 nt, Mycobacterium tuberculosis H37Rv
gcccgcagcgucagc

SEQ ID NO: 1263815 - RNA, 12 nt, Mycobacterium tuberculosis H37Rv
gcccgcagggcc

SEQ ID NO: 1263816 - RNA, 17 nt, Mycobacterium tuberculosis H37Rv
gcccgcaucgcggcauc

SEQ ID NO: 1263817 - RNA, 19 nt, Mycobacterium tuberculosis H37Rv
gcccgcaucgucgccgacc

SEQ ID NO: 1263818 - RNA, 22 nt, Mycobacterium tuberculosis H37Rv
gcccgcaucgccucgagguauu

SEQ ID NO: 1263819 - RNA, 12 nt, Mycobacterium tuberculosis H37Rv
gcccgcaucgca

SEQ ID NO: 1263820 - RNA, 14 nt, Mycobacterium tuberculosis H37Rv
gcccgccauccgcc

SEQ ID NO: 1263821 - RNA, 15 nt, Mycobacterium tuberculosis H37Rv
gcccgccaggccguu

SEQ ID NO: 1263822 - RNA, 13 nt, Mycobacterium tuberculosis H37Rv
gcccgccgcgacc

SEQ ID NO: 1263823 - RNA, 15 nt, Mycobacterium tuberculosis H37Rv
gcccgccgcgaccac

SEQ ID NO: 1263824 - RNA, 15 nt, Mycobacterium tuberculosis H37Rv
gcccgcccagcccgg

SEQ ID NO: 1263825 - RNA, 19 nt, Mycobacterium tuberculosis H37Rv
gcccgcccagcccggcguu

SEQ ID NO: 1263826 - RNA, 15 nt, Mycobacterium tuberculosis H37Rv
gcccgcccaccucga

SEQ ID NO: 1263827 - RNA, 16 nt, Mycobacterium tuberculosis H37Rv
gcccgccgcgaccacg

SEQ ID NO: 1263828 - RNA, 15 nt, Mycobacterium tuberculosis H37Rv
gcccgccgcgucacc

SEQ ID NO: 1263829 - RNA, 13 nt, Mycobacterium tuberculosis H37Rv
gcccgccgcguca

SEQ ID NO: 1263830 - RNA, 14 nt, Mycobacterium tuberculosis H37Rv
gcccgccguuacgg

SEQ ID NO: 1263831 - RNA, 13 nt, Mycobacterium tuberculosis H37Rv
gcccgccguccgg

SEQ ID NO: 1263832 - RNA, 13 nt, Mycobacterium tuberculosis H37Rv
gcccgccgucggc

SEQ ID NO: 1263833 - RNA, 18 nt, Mycobacterium tuberculosis H37Rv
gcccgccgucggcaucga

SEQ ID NO: 1263834 - RNA, 15 nt, Mycobacterium tuberculosis H37Rv
gcccgccguagacca

SEQ ID NO: 1263835 - RNA, 13 nt, Mycobacterium tuberculosis H37Rv
gcccgccgucacc

SEQ ID NO: 1263836 - RNA, 19 nt, Mycobacterium tuberculosis H37Rv
gcccgccggacccgcccuu

SEQ ID NO: 1263837 - RNA, 20 nt, Mycobacterium tuberculosis H37Rv
gcccagacaauugcagcgac

SEQ ID NO: 1263838 - RNA, 18 nt, Mycobacterium tuberculosis H37Rv
gcccacuugugacccggc

SEQ ID NO: 1263839 - RNA, 15 nt, Mycobacterium tuberculosis H37Rv
gcccacuccagcagc

SEQ ID NO: 1263840 - RNA, 16 nt, Mycobacterium tuberculosis H37Rv
gcccacguuggccagg

SEQ ID NO: 1263841 - RNA, 21 nt, Mycobacterium tuberculosis H37Rv
gcccacguuggccaggcccga

SEQ ID NO: 1263842 - RNA, 15 nt, Mycobacterium tuberculosis H37Rv
gcccacgugggcacu

SEQ ID NO: 1263843 - RNA, 14 nt, Mycobacterium tuberculosis H37Rv
gcccacgguguccc

SEQ ID NO: 1263844 - RNA, 16 nt, Mycobacterium tuberculosis H37Rv
gcccacggcgaccacg

SEQ ID NO: 1263845 - RNA, 20 nt, Mycobacterium tuberculosis H37Rv
gcccacgggccggccgagcg

SEQ ID NO: 1263846 - RNA, 21 nt, Mycobacterium tuberculosis H37Rv
gcccagcaaccgcucggcgau

SEQ ID NO: 1263847 - RNA, 18 nt, Mycobacterium tuberculosis H37Rv
gcccagcaaccgcucggc

SEQ ID NO: 1263848 - RNA, 17 nt, Mycobacterium tuberculosis H37Rv
gcccagcaaccgcucgg

SEQ ID NO: 1263849 - RNA, 21 nt, Mycobacterium tuberculosis H37Rv
gcccagaucgguugaucggcc

SEQ ID NO: 1263850 - RNA, 23 nt, Mycobacterium tuberculosis H37Rv
gcccagauguuuagcguccgagc

SEQ ID NO: 1263851 - RNA, 19 nt, Mycobacterium tuberculosis H37Rv
gcccagccgagcguggcgu

SEQ ID NO: 1263852 - RNA, 22 nt, Mycobacterium tuberculosis H37Rv
gcccagccggaaggugaggucg

SEQ ID NO: 1263853 - RNA, 15 nt, Mycobacterium tuberculosis H37Rv
gcccagccgccagcc

SEQ ID NO: 1263854 - RNA, 21 nt, Mycobacterium tuberculosis H37Rv
gcccagccgagcggcggcacu

SEQ ID NO: 1263855 - RNA, 16 nt, Mycobacterium tuberculosis H37Rv
gcccagccgagcggcg

SEQ ID NO: 1263856 - RNA, 13 nt, Mycobacterium tuberculosis H37Rv
gcccagccgagcg

SEQ ID NO: 1263857 - RNA, 22 nt, Mycobacterium tuberculosis H37Rv
gcccagcaucucggcggccaac

SEQ ID NO: 1263858 - RNA, 19 nt, Mycobacterium tuberculosis H37Rv
gcccagcagaccaaguccg

SEQ ID NO: 1263859 - RNA, 19 nt, Mycobacterium tuberculosis H37Rv
gcccagcaggucgucggcg

SEQ ID NO: 1263860 - RNA, 21 nt, Mycobacterium tuberculosis H37Rv
gcccagcaucucggcggccaa

SEQ ID NO: 1263861 - RNA, 18 nt, Mycobacterium tuberculosis H37Rv
gcccagcaggucgucggc

SEQ ID NO: 1263862 - RNA, 16 nt, Mycobacterium tuberculosis H37Rv
gcccagcacgcuggcg

SEQ ID NO: 1263863 - RNA, 15 nt, Mycobacterium tuberculosis H37Rv
gcccacggcgaccac

SEQ ID NO: 1263864 - RNA, 18 nt, Mycobacterium tuberculosis H37Rv
gcccacgcgccaccgagc

SEQ ID NO: 1263865 - RNA, 19 nt, Mycobacterium tuberculosis H37Rv
gccaugcuggucagcggcg

SEQ ID NO: 1263866 - RNA, 22 nt, Mycobacterium tuberculosis H37Rv
gccaugcuaggaccaccagcgc

SEQ ID NO: 1263867 - RNA, 21 nt, Mycobacterium tuberculosis H37Rv
gccaugcgcaccaguccagcg

SEQ ID NO: 1263868 - RNA, 22 nt, Mycobacterium tuberculosis H37Rv
gccauggaucccacgaguuggc

SEQ ID NO: 1263869 - RNA, 20 nt, Mycobacterium tuberculosis H37Rv
gcccacaaauauccugcggu

SEQ ID NO: 1263870 - RNA, 16 nt, Mycobacterium tuberculosis H37Rv
gcccacacggucgucg

SEQ ID NO: 1263871 - RNA, 13 nt, Mycobacterium tuberculosis H37Rv
gcccacacgcuca

SEQ ID NO: 1263872 - RNA, 22 nt, Mycobacterium tuberculosis H37Rv
gcccacagcugacgagccggug

SEQ ID NO: 1263873 - RNA, 16 nt, Mycobacterium tuberculosis H37Rv
gcccacaggcggcgcu

SEQ ID NO: 1263874 - RNA, 13 nt, Mycobacterium tuberculosis H37Rv
gccagugauggcg

SEQ ID NO: 1263875 - RNA, 20 nt, Mycobacterium tuberculosis H37Rv
gccagugauggcgcggucgc

SEQ ID NO: 1263876 - RNA, 21 nt, Mycobacterium tuberculosis H37Rv
gccagugauggcgcggucgcu

SEQ ID NO: 1263877 - RNA, 16 nt, Mycobacterium tuberculosis H37Rv
gccagugaggaucaug

SEQ ID NO: 1263878 - RNA, 23 nt, Mycobacterium tuberculosis H37Rv
gccaguggucgauuucggcgcgu

SEQ ID NO: 1263879 - RNA, 17 nt, Mycobacterium tuberculosis H37Rv
gccagugucagcacgac

SEQ ID NO: 1263880 - RNA, 22 nt, Mycobacterium tuberculosis H37Rv
gccagugcucgcaaucguuggc

SEQ ID NO: 1263881 - RNA, 22 nt, Mycobacterium tuberculosis H37Rv
gccaguugaucaggccgaugcg

SEQ ID NO: 1263882 - RNA, 19 nt, Mycobacterium tuberculosis H37Rv
gccaguugcacaucggugg

SEQ ID NO: 1263883 - RNA, 22 nt, Mycobacterium tuberculosis H37Rv
gccaguucggcggccgccgcgu

SEQ ID NO: 1263884 - RNA, 22 nt, Mycobacterium tuberculosis H37Rv
gccaguucggcgucguccgcgc

SEQ ID NO: 1263885 - RNA, 17 nt, Mycobacterium tuberculosis H37Rv
gccagguugccgucggc

SEQ ID NO: 1263886 - RNA, 19 nt, Mycobacterium tuberculosis H37Rv
gccagguugaucguggcga

SEQ ID NO: 1263887 - RNA, 12 nt, Mycobacterium tuberculosis H37Rv
gccaguacgucg

SEQ ID NO: 1263888 - RNA, 14 nt, Mycobacterium tuberculosis H37Rv
gccagucgccgaaa

SEQ ID NO: 1263889 - RNA, 14 nt, Mycobacterium tuberculosis H37Rv
gccaguacgucgau

SEQ ID NO: 1263890 - RNA, 14 nt, Mycobacterium tuberculosis H37Rv
gccagucgaucgcg

SEQ ID NO: 1263891 - RNA, 17 nt, Mycobacterium tuberculosis H37Rv
gccaggacauucccgag

SEQ ID NO: 1263892 - RNA, 16 nt, Mycobacterium tuberculosis H37Rv
gccaggacauucccga

SEQ ID NO: 1263893 - RNA, 19 nt, Mycobacterium tuberculosis H37Rv
gccaggaccgcgccgauca

SEQ ID NO: 1263894 - RNA, 15 nt, Mycobacterium tuberculosis H37Rv
gccaggaagucccgg

SEQ ID NO: 1263895 - RNA, 22 nt, Mycobacterium tuberculosis H37Rv
gccaggacuggcaccgccagcc

SEQ ID NO: 1263896 - RNA, 16 nt, Mycobacterium tuberculosis H37Rv
gccaugcccucggcgc

SEQ ID NO: 1263897 - RNA, 16 nt, Mycobacterium tuberculosis H37Rv
gccaugccaagcucca

SEQ ID NO: 1263898 - RNA, 22 nt, Mycobacterium tuberculosis H37Rv
gccaugcccgcacgcucggcgg

SEQ ID NO: 1263899 - RNA, 15 nt, Mycobacterium tuberculosis H37Rv
gccaugccgcucggc

SEQ ID NO: 1263900 - RNA, 19 nt, Mycobacterium tuberculosis H37Rv
gccaugccgcucggcaacc

SEQ ID NO: 1263901 - RNA, 17 nt, Mycobacterium tuberculosis H37Rv
gccaucgaguccaccac

SEQ ID NO: 1263902 - RNA, 16 nt, Mycobacterium tuberculosis H37Rv
gccaucgucgagcgcg

SEQ ID NO: 1263903 - RNA, 13 nt, Mycobacterium tuberculosis H37Rv
gccaucgugcggc

SEQ ID NO: 1263904 - RNA, 22 nt, Mycobacterium tuberculosis H37Rv
gccauccuuaugcgcggugacc

SEQ ID NO: 1263905 - RNA, 23 nt, Mycobacterium tuberculosis H37Rv
gccauccggucggucucggcgag

SEQ ID NO: 1263906 - RNA, 17 nt, Mycobacterium tuberculosis H37Rv
gccauccguaucacggu

SEQ ID NO: 1263907 - RNA, 21 nt, Mycobacterium tuberculosis H37Rv
gccauccggucggucucggcg

SEQ ID NO: 1263908 - RNA, 20 nt, Mycobacterium tuberculosis H37Rv
gccauaaaugcgcguucgac

SEQ ID NO: 1263909 - RNA, 14 nt, Mycobacterium tuberculosis H37Rv
gccauccgauggcc

SEQ ID NO: 1263910 - RNA, 21 nt, Mycobacterium tuberculosis H37Rv
gccauccgccgaaagcaucac

SEQ ID NO: 1263911 - RNA, 16 nt, Mycobacterium tuberculosis H37Rv
gccauaccucggcgac

SEQ ID NO: 1263912 - RNA, 21 nt, Mycobacterium tuberculosis H37Rv
gccauaccugccggaccaccg

SEQ ID NO: 1263913 - RNA, 18 nt, Mycobacterium tuberculosis H37Rv
gccagcccguugcaggac

SEQ ID NO: 1263914 - RNA, 13 nt, Mycobacterium tuberculosis H37Rv
gccagcaggccga

SEQ ID NO: 1263915 - RNA, 13 nt, Mycobacterium tuberculosis H37Rv
gccagcagcggcu

SEQ ID NO: 1263916 - RNA, 16 nt, Mycobacterium tuberculosis H37Rv
gccagcagcggcgagc

SEQ ID NO: 1263917 - RNA, 18 nt, Mycobacterium tuberculosis H37Rv
gccagcgcaucggucacc

SEQ ID NO: 1263918 - RNA, 16 nt, Mycobacterium tuberculosis H37Rv
gccagcgcaccgccga

SEQ ID NO: 1263919 - RNA, 11 nt, Mycobacterium tuberculosis H37Rv
gccagcgcccc

SEQ ID NO: 1263920 - RNA, 18 nt, Mycobacterium tuberculosis H37Rv
gccagccggucgaugccg

SEQ ID NO: 1263921 - RNA, 14 nt, Mycobacterium tuberculosis H37Rv
gccagccggcgcac

SEQ ID NO: 1263922 - RNA, 20 nt, Mycobacterium tuberculosis H37Rv
gccagcugggcagccagauc

SEQ ID NO: 1263923 - RNA, 16 nt, Mycobacterium tuberculosis H37Rv
gccagcuugcggagcc

SEQ ID NO: 1263924 - RNA, 15 nt, Mycobacterium tuberculosis H37Rv
gccaggaacccgugg

SEQ ID NO: 1263925 - RNA, 14 nt, Mycobacterium tuberculosis H37Rv
gccagcucaaccac

SEQ ID NO: 1263926 - RNA, 12 nt, Mycobacterium tuberculosis H37Rv
gccagcguuggc

SEQ ID NO: 1263927 - RNA, 15 nt, Mycobacterium tuberculosis H37Rv
gccagcuccucagcc

SEQ ID NO: 1263928 - RNA, 15 nt, Mycobacterium tuberculosis H37Rv
gccagcugcagcaga

SEQ ID NO: 1263929 - RNA, 16 nt, Mycobacterium tuberculosis H37Rv
gccagcgcgccgauca

SEQ ID NO: 1263930 - RNA, 12 nt, Mycobacterium tuberculosis H37Rv
gccagcgggaac

SEQ ID NO: 1263931 - RNA, 20 nt, Mycobacterium tuberculosis H37Rv
gccagcgguaaugccagcgg

SEQ ID NO: 1263932 - RNA, 22 nt, Mycobacterium tuberculosis H37Rv
gccagcgggugaaucgacaccg

SEQ ID NO: 1263933 - RNA, 21 nt, Mycobacterium tuberculosis H37Rv
gccagcggggcuagucggggu

SEQ ID NO: 1263934 - RNA, 18 nt, Mycobacterium tuberculosis H37Rv
gccagcgggaacacaccg

SEQ ID NO: 1263935 - RNA, 20 nt, Mycobacterium tuberculosis H37Rv
gccagagccgcgcgccgguu

SEQ ID NO: 1263936 - RNA, 16 nt, Mycobacterium tuberculosis H37Rv
gccagaguuaccaggu

SEQ ID NO: 1263937 - RNA, 20 nt, Mycobacterium tuberculosis H37Rv
gccacuucccccggguccgc

SEQ ID NO: 1263938 - RNA, 20 nt, Mycobacterium tuberculosis H37Rv
gccacuucuucacuggcgaa

SEQ ID NO: 1263939 - RNA, 15 nt, Mycobacterium tuberculosis H37Rv
gccagcaacgucggu

SEQ ID NO: 1263940 - RNA, 15 nt, Mycobacterium tuberculosis H37Rv
gccagcaccagcuca

SEQ ID NO: 1263941 - RNA, 16 nt, Mycobacterium tuberculosis H37Rv
gccagcaacagcgcgg

SEQ ID NO: 1263942 - RNA, 20 nt, Mycobacterium tuberculosis H37Rv
gccagauuugacgacaaacg

SEQ ID NO: 1263943 - RNA, 15 nt, Mycobacterium tuberculosis H37Rv
gccagcacgaccucg

SEQ ID NO: 1263944 - RNA, 18 nt, Mycobacterium tuberculosis H37Rv
gccagcaccucgaccgcc

SEQ ID NO: 1263945 - RNA, 17 nt, Mycobacterium tuberculosis H37Rv
gccagcacggcuugggu

SEQ ID NO: 1263946 - RNA, 14 nt, Mycobacterium tuberculosis H37Rv
gccagcacggcgac

SEQ ID NO: 1263947 - RNA, 15 nt, Mycobacterium tuberculosis H37Rv
gccagcacggcgacg

SEQ ID NO: 1263948 - RNA, 19 nt, Mycobacterium tuberculosis H37Rv
gccagcagcagcgccgcgu

SEQ ID NO: 1263949 - RNA, 16 nt, Mycobacterium tuberculosis H37Rv
gccagcagcaaccgcc

SEQ ID NO: 1263950 - RNA, 17 nt, Mycobacterium tuberculosis H37Rv
gccagcagccacccgac

SEQ ID NO: 1263951 - RNA, 22 nt, Mycobacterium tuberculosis H37Rv
gccagcagccacccgacaacgc

SEQ ID NO: 1263952 - RNA, 13 nt, Mycobacterium tuberculosis H37Rv
gccagcagcagcg

SEQ ID NO: 1263953 - RNA, 22 nt, Mycobacterium tuberculosis H37Rv
gccaccuguugcccuugcgcaa

SEQ ID NO: 1263954 - RNA, 18 nt, Mycobacterium tuberculosis H37Rv
gccaccucuucucggaca

SEQ ID NO: 1263955 - RNA, 23 nt, Mycobacterium tuberculosis H37Rv
gccaccucggugcggaacaccgc

SEQ ID NO: 1263956 - RNA, 16 nt, Mycobacterium tuberculosis H37Rv
gccaccugacaaacgg

SEQ ID NO: 1263957 - RNA, 23 nt, Mycobacterium tuberculosis H37Rv
gccacgcucggugcugcgccgau

SEQ ID NO: 1263958 - RNA, 15 nt, Mycobacterium tuberculosis H37Rv
gccacgcugucccgc

SEQ ID NO: 1263959 - RNA, 14 nt, Mycobacterium tuberculosis H37Rv
gccacgccgaugcg

SEQ ID NO: 1263960 - RNA, 14 nt, Mycobacterium tuberculosis H37Rv
gccacgcccgacgc

SEQ ID NO: 1263961 - RNA, 18 nt, Mycobacterium tuberculosis H37Rv
gccacucgcccgauccgg

SEQ ID NO: 1263962 - RNA, 16 nt, Mycobacterium tuberculosis H37Rv
gccacugccgaccagc

SEQ ID NO: 1263963 - RNA, 21 nt, Mycobacterium tuberculosis H37Rv
gccacugaccgcgaucgccga

SEQ ID NO: 1263964 - RNA, 16 nt, Mycobacterium tuberculosis H37Rv
gccacggcagcgccca

SEQ ID NO: 1263965 - RNA, 16 nt, Mycobacterium tuberculosis H37Rv
gccacggcaaucaacg

SEQ ID NO: 1263966 - RNA, 14 nt, Mycobacterium tuberculosis H37Rv
gccacggcaucggc

SEQ ID NO: 1263967 - RNA, 14 nt, Mycobacterium tuberculosis H37Rv
gccacggcauucga

SEQ ID NO: 1263968 - RNA, 19 nt, Mycobacterium tuberculosis H37Rv
gccacggggcugccgguga

SEQ ID NO: 1263969 - RNA, 19 nt, Mycobacterium tuberculosis H37Rv
gccacggggcuuggcgacg

SEQ ID NO: 1263970 - RNA, 22 nt, Mycobacterium tuberculosis H37Rv
gccacgguccggcccaccagcg

SEQ ID NO: 1263971 - RNA, 13 nt, Mycobacterium tuberculosis H37Rv
gccacgggugacg

SEQ ID NO: 1263972 - RNA, 13 nt, Mycobacterium tuberculosis H37Rv
gccacggucgccg

SEQ ID NO: 1263973 - RNA, 18 nt, Mycobacterium tuberculosis H37Rv
gccacguacuccaccgcg

SEQ ID NO: 1263974 - RNA, 22 nt, Mycobacterium tuberculosis H37Rv
gccacguaagcgguuguccggu

SEQ ID NO: 1263975 - RNA, 20 nt, Mycobacterium tuberculosis H37Rv
gccacggugucgucgaccac

SEQ ID NO: 1263976 - RNA, 23 nt, Mycobacterium tuberculosis H37Rv
gccaccgcgacaccccggaaucc

SEQ ID NO: 1263977 - RNA, 13 nt, Mycobacterium tuberculosis H37Rv
gccaccgcgagca

SEQ ID NO: 1263978 - RNA, 18 nt, Mycobacterium tuberculosis H37Rv
gccaccgccgccggugua

SEQ ID NO: 1263979 - RNA, 15 nt, Mycobacterium tuberculosis H37Rv
gccaccgcggcgauu

SEQ ID NO: 1263980 - RNA, 22 nt, Mycobacterium tuberculosis H37Rv
gccaccgcggcgauuacggcca

SEQ ID NO: 1263981 - RNA, 15 nt, Mycobacterium tuberculosis H37Rv
gccaccgcgccguaa

SEQ ID NO: 1263982 - RNA, 17 nt, Mycobacterium tuberculosis H37Rv
gccaccgcgggcggcau

SEQ ID NO: 1263983 - RNA, 23 nt, Mycobacterium tuberculosis H37Rv
gccaccgcgggcggcaucgccga

SEQ ID NO: 1263984 - RNA, 20 nt, Mycobacterium tuberculosis H37Rv
gccaccgcggucaccgacgc

SEQ ID NO: 1263985 - RNA, 13 nt, Mycobacterium tuberculosis H37Rv
gccaccgcaucgc

SEQ ID NO: 1263986 - RNA, 17 nt, Mycobacterium tuberculosis H37Rv
gccaccgcacgcuggcg

SEQ ID NO: 1263987 - RNA, 13 nt, Mycobacterium tuberculosis H37Rv
gccaccgcacgcu

SEQ ID NO: 1263988 - RNA, 18 nt, Mycobacterium tuberculosis H37Rv
gccaccgcaagaaucagc

SEQ ID NO: 1263989 - RNA, 13 nt, Mycobacterium tuberculosis H37Rv
gccaccgauggcg

SEQ ID NO: 1263990 - RNA, 13 nt, Mycobacterium tuberculosis H37Rv
gccacccgcgaag

SEQ ID NO: 1263991 - RNA, 19 nt, Mycobacterium tuberculosis H37Rv
gccaccgaacgcggccacc

SEQ ID NO: 1263992 - RNA, 17 nt, Mycobacterium tuberculosis H37Rv
gccaccgaacgcaccga

SEQ ID NO: 1263993 - RNA, 16 nt, Mycobacterium tuberculosis H37Rv
gccaccgaacagucga

SEQ ID NO: 1263994 - RNA, 16 nt, Mycobacterium tuberculosis H37Rv
gccaccggcugcaacc

SEQ ID NO: 1263995 - RNA, 17 nt, Mycobacterium tuberculosis H37Rv
gccaccgggcgugcggc

SEQ ID NO: 1263996 - RNA, 17 nt, Mycobacterium tuberculosis H37Rv
gccaccggcgcgaccgc

SEQ ID NO: 1263997 - RNA, 13 nt, Mycobacterium tuberculosis H37Rv
gccaccggcgacg

SEQ ID NO: 1263998 - RNA, 16 nt, Mycobacterium tuberculosis H37Rv
gccaccggcgucugcc

SEQ ID NO: 1263999 - RNA, 17 nt, Mycobacterium tuberculosis H37Rv
gccaccgcugccggcac

SEQ ID NO: 1264000 - RNA, 18 nt, Mycobacterium tuberculosis H37Rv
gccaccgcuggaucgacu

SEQ ID NO: 1264001 - RNA, 19 nt, Mycobacterium tuberculosis H37Rv
gccaccgcugccggcacgc

SEQ ID NO: 1264002 - RNA, 18 nt, Mycobacterium tuberculosis H37Rv
gccaccggcaaucggcgg

SEQ ID NO: 1264003 - RNA, 20 nt, Mycobacterium tuberculosis H37Rv
gccaccggcgccgccgucgc

SEQ ID NO: 1264004 - RNA, 18 nt, Mycobacterium tuberculosis H37Rv
gccaccggugccggcgac

SEQ ID NO: 1264005 - RNA, 24 nt, Mycobacterium tuberculosis H37Rv
gccaccgguuuggagcucaucgac

SEQ ID NO: 1264006 - RNA, 18 nt, Mycobacterium tuberculosis H37Rv
gccaccgguaccggcgac

SEQ ID NO: 1264007 - RNA, 20 nt, Mycobacterium tuberculosis H37Rv
gccaccggguucaccgaggu

SEQ ID NO: 1264008 - RNA, 19 nt, Mycobacterium tuberculosis H37Rv
gccaccgguaccgaucagc

SEQ ID NO: 1264009 - RNA, 16 nt, Mycobacterium tuberculosis H37Rv
gccaccguagccagca

SEQ ID NO: 1264010 - RNA, 23 nt, Mycobacterium tuberculosis H37Rv
gccaccguagccgaggguagacg

SEQ ID NO: 1264011 - RNA, 21 nt, Mycobacterium tuberculosis H37Rv
gccaccgguaccgccggcucc

SEQ ID NO: 1264012 - RNA, 16 nt, Mycobacterium tuberculosis H37Rv
gccaccgucaugccga

SEQ ID NO: 1264013 - RNA, 13 nt, Mycobacterium tuberculosis H37Rv
gccaccgucgcgg

SEQ ID NO: 1264014 - RNA, 19 nt, Mycobacterium tuberculosis H37Rv
gccaccgucgcggcggcac

SEQ ID NO: 1264015 - RNA, 16 nt, Mycobacterium tuberculosis H37Rv
gccaccguuaccggug

SEQ ID NO: 1264016 - RNA, 16 nt, Mycobacterium tuberculosis H37Rv
gccaccucccacgccg

SEQ ID NO: 1264017 - RNA, 15 nt, Mycobacterium tuberculosis H37Rv
gccaccuccgacggg

SEQ ID NO: 1264018 - RNA, 17 nt, Mycobacterium tuberculosis H37Rv
gccaccaguccgauggg

SEQ ID NO: 1264019 - RNA, 13 nt, Mycobacterium tuberculosis H37Rv
gccaccaggucga

SEQ ID NO: 1264020 - RNA, 14 nt, Mycobacterium tuberculosis H37Rv
gccaccaucgcccc

SEQ ID NO: 1264021 - RNA, 13 nt, Mycobacterium tuberculosis H37Rv
gccaccaggcggu

SEQ ID NO: 1264022 - RNA, 21 nt, Mycobacterium tuberculosis H37Rv
gccacccccaaccgccggcca

SEQ ID NO: 1264023 - RNA, 13 nt, Mycobacterium tuberculosis H37Rv
gccacccaucgca

SEQ ID NO: 1264024 - RNA, 13 nt, Mycobacterium tuberculosis H37Rv
gccacccggccag

SEQ ID NO: 1264025 - RNA, 16 nt, Mycobacterium tuberculosis H37Rv
gccacccggacauagc

SEQ ID NO: 1264026 - RNA, 13 nt, Mycobacterium tuberculosis H37Rv
gccacccgcgcga

SEQ ID NO: 1264027 - RNA, 22 nt, Mycobacterium tuberculosis H37Rv
gccaccccggucggagcggugc

SEQ ID NO: 1264028 - RNA, 18 nt, Mycobacterium tuberculosis H37Rv
gccacccgcaggucgcac

SEQ ID NO: 1264029 - RNA, 14 nt, Mycobacterium tuberculosis H37Rv
gccaccagcggcau

SEQ ID NO: 1264030 - RNA, 11 nt, Mycobacterium tuberculosis H37Rv
gccaccagcgc

SEQ ID NO: 1264031 - RNA, 21 nt, Mycobacterium tuberculosis H37Rv
gccaccagagucaacaucagc

SEQ ID NO: 1264032 - RNA, 17 nt, Mycobacterium tuberculosis H37Rv
gccaccagcgacgacca

SEQ ID NO: 1264033 - RNA, 23 nt, Mycobacterium tuberculosis H37Rv
gccaccaccagggcaacggccgc

SEQ ID NO: 1264034 - RNA, 16 nt, Mycobacterium tuberculosis H37Rv
gccaccaccaggucgg

SEQ ID NO: 1264035 - RNA, 17 nt, Mycobacterium tuberculosis H37Rv
gccaccaccacggccag

SEQ ID NO: 1264036 - RNA, 19 nt, Mycobacterium tuberculosis H37Rv
gccaccaccacggccagaa

SEQ ID NO: 1264037 - RNA, 14 nt, Mycobacterium tuberculosis H37Rv
gccaccaccagggc

SEQ ID NO: 1264038 - RNA, 22 nt, Mycobacterium tuberculosis H37Rv
gccaccaccagggcaacggccg

SEQ ID NO: 1264039 - RNA, 14 nt, Mycobacterium tuberculosis H37Rv
gccaccaccacggc

SEQ ID NO: 1264040 - RNA, 14 nt, Mycobacterium tuberculosis H37Rv
gccaccaccgccgc

SEQ ID NO: 1264041 - RNA, 20 nt, Mycobacterium tuberculosis H37Rv
gccacauccagcgcuucggc

SEQ ID NO: 1264042 - RNA, 14 nt, Mycobacterium tuberculosis H37Rv
gccaccacaugcga

SEQ ID NO: 1264043 - RNA, 21 nt, Mycobacterium tuberculosis H37Rv
gccacauuucaccaccguggc

SEQ ID NO: 1264044 - RNA, 15 nt, Mycobacterium tuberculosis H37Rv
gccacauuucaccac

SEQ ID NO: 1264045 - RNA, 18 nt, Mycobacterium tuberculosis H37Rv
gccacauuucaccaccgu

SEQ ID NO: 1264046 - RNA, 16 nt, Mycobacterium tuberculosis H37Rv
gccaccaacucggcga

SEQ ID NO: 1264047 - RNA, 17 nt, Mycobacterium tuberculosis H37Rv
gccacacucgccagggc

SEQ ID NO: 1264048 - RNA, 19 nt, Mycobacterium tuberculosis H37Rv
gccacacucccgcgcccga

SEQ ID NO: 1264049 - RNA, 17 nt, Mycobacterium tuberculosis H37Rv
gccacaggcguuuccgc

SEQ ID NO: 1264050 - RNA, 20 nt, Mycobacterium tuberculosis H37Rv
gccacagugcauacgguuga

SEQ ID NO: 1264051 - RNA, 17 nt, Mycobacterium tuberculosis H37Rv
gccacagcauaaagauc

SEQ ID NO: 1264052 - RNA, 20 nt, Mycobacterium tuberculosis H37Rv
gccaaugacuuggccagcag

SEQ ID NO: 1264053 - RNA, 23 nt, Mycobacterium tuberculosis H37Rv
gccaaugcccuuggccagcaggg

SEQ ID NO: 1264054 - RNA, 20 nt, Mycobacterium tuberculosis H37Rv
gccaaugcccuuggccagca

SEQ ID NO: 1264055 - RNA, 16 nt, Mycobacterium tuberculosis H37Rv
gccaaugauucggcac

SEQ ID NO: 1264056 - RNA, 17 nt, Mycobacterium tuberculosis H37Rv
gccaaugccaccauugc

SEQ ID NO: 1264057 - RNA, 15 nt, Mycobacterium tuberculosis H37Rv
gccacacacugccgg

SEQ ID NO: 1264058 - RNA, 15 nt, Mycobacterium tuberculosis H37Rv
gccacaaucgcagau

SEQ ID NO: 1264059 - RNA, 20 nt, Mycobacterium tuberculosis H37Rv
gccacaacgccucgauggcg

SEQ ID NO: 1264060 - RNA, 22 nt, Mycobacterium tuberculosis H37Rv
gccacaaaggcgccgggucacg

SEQ ID NO: 1264061 - RNA, 16 nt, Mycobacterium tuberculosis H37Rv
gccacaccuuggccgc

SEQ ID NO: 1264062 - RNA, 12 nt, Mycobacterium tuberculosis H37Rv
gccacacccggc

SEQ ID NO: 1264063 - RNA, 12 nt, Mycobacterium tuberculosis H37Rv
gccacaccauga

SEQ ID NO: 1264064 - RNA, 13 nt, Mycobacterium tuberculosis H37Rv
gccacacccgugu

SEQ ID NO: 1264065 - RNA, 18 nt, Mycobacterium tuberculosis H37Rv
gccaauagaagcacgucg

SEQ ID NO: 1264066 - RNA, 15 nt, Mycobacterium tuberculosis H37Rv
gccaagcucggccac

SEQ ID NO: 1264067 - RNA, 14 nt, Mycobacterium tuberculosis H37Rv
gccaaggucgaccc

SEQ ID NO: 1264068 - RNA, 12 nt, Mycobacterium tuberculosis H37Rv
gccaaucaccgu

SEQ ID NO: 1264069 - RNA, 17 nt, Mycobacterium tuberculosis H37Rv
gccaagccgugccgcac

SEQ ID NO: 1264070 - RNA, 20 nt, Mycobacterium tuberculosis H37Rv
gccaagccggagcccggcau

SEQ ID NO: 1264071 - RNA, 21 nt, Mycobacterium tuberculosis H37Rv
gccaagcgacucgccggcgaa

SEQ ID NO: 1264072 - RNA, 19 nt, Mycobacterium tuberculosis H37Rv
gccaagcgagcggcgaacu

SEQ ID NO: 1264073 - RNA, 15 nt, Mycobacterium tuberculosis H37Rv
gccaagcgagcgguc

SEQ ID NO: 1264074 - RNA, 20 nt, Mycobacterium tuberculosis H37Rv
gccaagcccaggcgaucgcc

SEQ ID NO: 1264075 - RNA, 23 nt, Mycobacterium tuberculosis H37Rv
gccaagcucggccaccagcgccc

SEQ ID NO: 1264076 - RNA, 15 nt, Mycobacterium tuberculosis H37Rv
gccaaggcgaugguc

SEQ ID NO: 1264077 - RNA, 21 nt, Mycobacterium tuberculosis H37Rv
gccaagcucggccaccagcgc

SEQ ID NO: 1264078 - RNA, 20 nt, Mycobacterium tuberculosis H37Rv
gcauccgucguacacgccau

SEQ ID NO: 1264079 - RNA, 12 nt, Mycobacterium tuberculosis H37Rv
gcauccucgacu

SEQ ID NO: 1264080 - RNA, 16 nt, Mycobacterium tuberculosis H37Rv
gcauccggucucggcc

SEQ ID NO: 1264081 - RNA, 19 nt, Mycobacterium tuberculosis H37Rv
gcauccaggcugucgcggg

SEQ ID NO: 1264082 - RNA, 20 nt, Mycobacterium tuberculosis H37Rv
gcauccccgguacgucgagg

SEQ ID NO: 1264083 - RNA, 16 nt, Mycobacterium tuberculosis H37Rv
gccaacuuggcggcca

SEQ ID NO: 1264084 - RNA, 22 nt, Mycobacterium tuberculosis H37Rv
gccaacuggucgccaacgccag

SEQ ID NO: 1264085 - RNA, 23 nt, Mycobacterium tuberculosis H37Rv
gccaacuggucgccaacgccagc

SEQ ID NO: 1264086 - RNA, 17 nt, Mycobacterium tuberculosis H37Rv
gccaacuuggcggccag

SEQ ID NO: 1264087 - RNA, 15 nt, Mycobacterium tuberculosis H37Rv
gccaacugggccgag

SEQ ID NO: 1264088 - RNA, 18 nt, Mycobacterium tuberculosis H37Rv
gccaagcagacgcagaau

SEQ ID NO: 1264089 - RNA, 18 nt, Mycobacterium tuberculosis H37Rv
gcauccuugccaaucgcc

SEQ ID NO: 1264090 - RNA, 18 nt, Mycobacterium tuberculosis H37Rv
gccaacguugcgccagcg

SEQ ID NO: 1264091 - RNA, 22 nt, Mycobacterium tuberculosis H37Rv
gcaucgaacgcccugacggugg

SEQ ID NO: 1264092 - RNA, 16 nt, Mycobacterium tuberculosis H37Rv
gccaacugcgccguuc

SEQ ID NO: 1264093 - RNA, 13 nt, Mycobacterium tuberculosis H37Rv
cgcgcugagcgac

SEQ ID NO: 1264094 - RNA, 22 nt, Mycobacterium tuberculosis H37Rv
cgcgcugagcgacugcagcggc

SEQ ID NO: 1264095 - RNA, 16 nt, Mycobacterium tuberculosis H37Rv
cgcgcugagcgacugc

SEQ ID NO: 1264096 - RNA, 16 nt, Mycobacterium tuberculosis H37Rv
cgcgcugagcucgaug

SEQ ID NO: 1264097 - RNA, 15 nt, Mycobacterium tuberculosis H37Rv
cgcgcugcagcacgg

SEQ ID NO: 1264098 - RNA, 20 nt, Mycobacterium tuberculosis H37Rv
cgcgcgguuuuucgcagugg

SEQ ID NO: 1264099 - RNA, 14 nt, Mycobacterium tuberculosis H37Rv
cgcgcguacccgau

SEQ ID NO: 1264100 - RNA, 17 nt, Mycobacterium tuberculosis H37Rv
cgcgcguacccgaucag

SEQ ID NO: 1264101 - RNA, 18 nt, Mycobacterium tuberculosis H37Rv
cgcgcgguuuuucgcagu

SEQ ID NO: 1264102 - RNA, 17 nt, Mycobacterium tuberculosis H37Rv
cgcgcguccgucggcga

SEQ ID NO: 1264103 - RNA, 15 nt, Mycobacterium tuberculosis H37Rv
cgcgcucaucgaccg

SEQ ID NO: 1264104 - RNA, 16 nt, Mycobacterium tuberculosis H37Rv
cgcgcucaucgaccgc

SEQ ID NO: 1264105 - RNA, 18 nt, Mycobacterium tuberculosis H37Rv
cgcgcucgcacccgcucg

SEQ ID NO: 1264106 - RNA, 20 nt, Mycobacterium tuberculosis H37Rv
cgcgcucgauggcggccacc

SEQ ID NO: 1264107 - RNA, 18 nt, Mycobacterium tuberculosis H37Rv
cgcgcucauugcaucugc

SEQ ID NO: 1264108 - RNA, 22 nt, Mycobacterium tuberculosis H37Rv
cgcgcucauguucucgaccgcg

SEQ ID NO: 1264109 - RNA, 23 nt, Mycobacterium tuberculosis H37Rv
cgcgcucauguucucgaccgcgu

SEQ ID NO: 1264110 - RNA, 22 nt, Mycobacterium tuberculosis H37Rv
cgcgcuccagauggggcucgag

SEQ ID NO: 1264111 - RNA, 14 nt, Mycobacterium tuberculosis H37Rv
cgcggacagcauca

SEQ ID NO: 1264112 - RNA, 23 nt, Mycobacterium tuberculosis H37Rv
cgcgcuuuccucaccagccguca

SEQ ID NO: 1264113 - RNA, 22 nt, Mycobacterium tuberculosis H37Rv
cgcgcuuggcuccacaauccug

SEQ ID NO: 1264114 - RNA, 14 nt, Mycobacterium tuberculosis H37Rv
cgcgcuugcgccgc

SEQ ID NO: 1264115 - RNA, 17 nt, Mycobacterium tuberculosis H37Rv
cgcgcuugcgaucgccg

SEQ ID NO: 1264116 - RNA, 13 nt, Mycobacterium tuberculosis H37Rv
cgcgcuucacagc

SEQ ID NO: 1264117 - RNA, 13 nt, Mycobacterium tuberculosis H37Rv
cgcgcugcuggcg

SEQ ID NO: 1264118 - RNA, 15 nt, Mycobacterium tuberculosis H37Rv
cgcgcugcuucuucg

SEQ ID NO: 1264119 - RNA, 20 nt, Mycobacterium tuberculosis H37Rv
cgcgcuggaucgugcuggug

SEQ ID NO: 1264120 - RNA, 21 nt, Mycobacterium tuberculosis H37Rv
cgcgcugcggcccacaccagc

SEQ ID NO: 1264121 - RNA, 16 nt, Mycobacterium tuberculosis H37Rv
cgcgcugcgucgucga

SEQ ID NO: 1264122 - RNA, 19 nt, Mycobacterium tuberculosis H37Rv
cgcgcugcgucgucgacga

SEQ ID NO: 1264123 - RNA, 15 nt, Mycobacterium tuberculosis H37Rv
cgcgcgcuccagaug

SEQ ID NO: 1264124 - RNA, 12 nt, Mycobacterium tuberculosis H37Rv
cgcgcgcggugc

SEQ ID NO: 1264125 - RNA, 17 nt, Mycobacterium tuberculosis H37Rv
cgcgcgcucgcucaccg

SEQ ID NO: 1264126 - RNA, 12 nt, Mycobacterium tuberculosis H37Rv
cgcgcgcucgag

SEQ ID NO: 1264127 - RNA, 15 nt, Mycobacterium tuberculosis H37Rv
cgcgcgcucgcgggu

SEQ ID NO: 1264128 - RNA, 21 nt, Mycobacterium tuberculosis H37Rv
cgcgcggaucggcggccgcga

SEQ ID NO: 1264129 - RNA, 18 nt, Mycobacterium tuberculosis H37Rv
cgcgcggaucgucgaggc

SEQ ID NO: 1264130 - RNA, 19 nt, Mycobacterium tuberculosis H37Rv
cgcgcggaucgucgaggca

SEQ ID NO: 1264131 - RNA, 20 nt, Mycobacterium tuberculosis H37Rv
cgcgcggaucucaccacccg

SEQ ID NO: 1264132 - RNA, 15 nt, Mycobacterium tuberculosis H37Rv
cgcgcggaucggcgg

SEQ ID NO: 1264133 - RNA, 13 nt, Mycobacterium tuberculosis H37Rv
cgcgcggauuucg

SEQ ID NO: 1264134 - RNA, 22 nt, Mycobacterium tuberculosis H37Rv
cgcgcggauggguacgacaccg

SEQ ID NO: 1264135 - RNA, 13 nt, Mycobacterium tuberculosis H37Rv
cgcgcggaacacc

SEQ ID NO: 1264136 - RNA, 14 nt, Mycobacterium tuberculosis H37Rv
cgcgcgcugggcgc

SEQ ID NO: 1264137 - RNA, 14 nt, Mycobacterium tuberculosis H37Rv
cgcgcggcgccgca

SEQ ID NO: 1264138 - RNA, 22 nt, Mycobacterium tuberculosis H37Rv
cgcgcggcgagagccucggcca

SEQ ID NO: 1264139 - RNA, 20 nt, Mycobacterium tuberculosis H37Rv
cgcgcggcagguugcguugc

SEQ ID NO: 1264140 - RNA, 23 nt, Mycobacterium tuberculosis H37Rv
cgcgcggugcccugccggcagcg

SEQ ID NO: 1264141 - RNA, 22 nt, Mycobacterium tuberculosis H37Rv
cgcggccucguuguagccgaau

SEQ ID NO: 1264142 - RNA, 14 nt, Mycobacterium tuberculosis H37Rv
cgcggccgcccgua

SEQ ID NO: 1264143 - RNA, 20 nt, Mycobacterium tuberculosis H37Rv
cgcggccgagggauugccgu

SEQ ID NO: 1264144 - RNA, 17 nt, Mycobacterium tuberculosis H37Rv
cgcggccgcagccagca

SEQ ID NO: 1264145 - RNA, 14 nt, Mycobacterium tuberculosis H37Rv
cgcggccgcagcca

SEQ ID NO: 1264146 - RNA, 24 nt, Mycobacterium tuberculosis H37Rv
cgcggccgcaagccgcgagucgcc

SEQ ID NO: 1264147 - RNA, 19 nt, Mycobacterium tuberculosis H37Rv
cgcggccgagacggcguug

SEQ ID NO: 1264148 - RNA, 19 nt, Mycobacterium tuberculosis H37Rv
cgcggccauuagcagcacc

SEQ ID NO: 1264149 - RNA, 20 nt, Mycobacterium tuberculosis H37Rv
cgcggccaguacgucgauca

SEQ ID NO: 1264150 - RNA, 14 nt, Mycobacterium tuberculosis H37Rv
cgcggcgccgcaau

SEQ ID NO: 1264151 - RNA, 14 nt, Mycobacterium tuberculosis H37Rv
cgcggcgccgccau

SEQ ID NO: 1264152 - RNA, 18 nt, Mycobacterium tuberculosis H37Rv
cgcggcgcccggcggauc

SEQ ID NO: 1264153 - RNA, 19 nt, Mycobacterium tuberculosis H37Rv
cgcggcgcgggucacgccg

SEQ ID NO: 1264154 - RNA, 17 nt, Mycobacterium tuberculosis H37Rv
cgcggcgacggcgguca

SEQ ID NO: 1264155 - RNA, 20 nt, Mycobacterium tuberculosis H37Rv
cgcggcgaacaucaccgucg

SEQ ID NO: 1264156 - RNA, 18 nt, Mycobacterium tuberculosis H37Rv
cgcggcgaacaucaccgu

SEQ ID NO: 1264157 - RNA, 14 nt, Mycobacterium tuberculosis H37Rv
cgcggaccgcgaau

SEQ ID NO: 1264158 - RNA, 16 nt, Mycobacterium tuberculosis H37Rv
cgcggaccucggcgac

SEQ ID NO: 1264159 - RNA, 19 nt, Mycobacterium tuberculosis H37Rv
cgcggcaaaguuggccgcc

SEQ ID NO: 1264160 - RNA, 19 nt, Mycobacterium tuberculosis H37Rv
cgcggcaagaguugccgga

SEQ ID NO: 1264161 - RNA, 14 nt, Mycobacterium tuberculosis H37Rv
cgcggacccgccgu

SEQ ID NO: 1264162 - RNA, 15 nt, Mycobacterium tuberculosis H37Rv
cgcggacccgcgcgu

SEQ ID NO: 1264163 - RNA, 16 nt, Mycobacterium tuberculosis H37Rv
cgcggcacccaaccag

SEQ ID NO: 1264164 - RNA, 19 nt, Mycobacterium tuberculosis H37Rv
cgcggcaccacgucgacca

SEQ ID NO: 1264165 - RNA, 16 nt, Mycobacterium tuberculosis H37Rv
cgcggcaccacgucga

SEQ ID NO: 1264166 - RNA, 12 nt, Mycobacterium tuberculosis H37Rv
cgcggcaccacg

SEQ ID NO: 1264167 - RNA, 16 nt, Mycobacterium tuberculosis H37Rv
cgcggcacgcuccagc

SEQ ID NO: 1264168 - RNA, 20 nt, Mycobacterium tuberculosis H37Rv
cgcggcaccgauggcgcacc

SEQ ID NO: 1264169 - RNA, 22 nt, Mycobacterium tuberculosis H37Rv
cgcggcaccgauggcgcaccgg

SEQ ID NO: 1264170 - RNA, 18 nt, Mycobacterium tuberculosis H37Rv
cgcggcagccggcggaga

SEQ ID NO: 1264171 - RNA, 18 nt, Mycobacterium tuberculosis H37Rv
cgcggcagcauccucgac

SEQ ID NO: 1264172 - RNA, 13 nt, Mycobacterium tuberculosis H37Rv
cgcggcaucgacg

SEQ ID NO: 1264173 - RNA, 16 nt, Mycobacterium tuberculosis H37Rv
cgcggcaucgacgcgg

SEQ ID NO: 1264174 - RNA, 18 nt, Mycobacterium tuberculosis H37Rv
cgcggcaucccgccacac

SEQ ID NO: 1264175 - RNA, 22 nt, Mycobacterium tuberculosis H37Rv
cgcggcaucgaauuccagccag

SEQ ID NO: 1264176 - RNA, 17 nt, Mycobacterium tuberculosis H37Rv
cgcggccacaaccucgu

SEQ ID NO: 1264177 - RNA, 23 nt, Mycobacterium tuberculosis H37Rv
cgcggccacaaugcggccguucg

SEQ ID NO: 1264178 - RNA, 22 nt, Mycobacterium tuberculosis H37Rv
cgcggcauucucgagcacccgc

SEQ ID NO: 1264179 - RNA, 15 nt, Mycobacterium tuberculosis H37Rv
cgcggccagagccgc

SEQ ID NO: 1264180 - RNA, 15 nt, Mycobacterium tuberculosis H37Rv
cgcggccaccagauc

SEQ ID NO: 1264181 - RNA, 22 nt, Mycobacterium tuberculosis H37Rv
cgcggccaccgccgccgccgac

SEQ ID NO: 1264182 - RNA, 15 nt, Mycobacterium tuberculosis H37Rv
cgcggccaccgccug

SEQ ID NO: 1264183 - RNA, 22 nt, Mycobacterium tuberculosis H37Rv
cgcggccaccaccaggcugacg

SEQ ID NO: 1264184 - RNA, 12 nt, Mycobacterium tuberculosis H37Rv
cgcgcaagucga

SEQ ID NO: 1264185 - RNA, 16 nt, Mycobacterium tuberculosis H37Rv
cgcgcaaggcgccgca

SEQ ID NO: 1264186 - RNA, 20 nt, Mycobacterium tuberculosis H37Rv
cgcgcaacuuccauuuucgc

SEQ ID NO: 1264187 - RNA, 19 nt, Mycobacterium tuberculosis H37Rv
cgcgcaaggcgccgcaggg

SEQ ID NO: 1264188 - RNA, 23 nt, Mycobacterium tuberculosis H37Rv
cgcgcaacuuccauuuucgccaa

SEQ ID NO: 1264189 - RNA, 13 nt, Mycobacterium tuberculosis H37Rv
cgcgcaccaccgc

SEQ ID NO: 1264190 - RNA, 17 nt, Mycobacterium tuberculosis H37Rv
cgcgcaccaacaccagc

SEQ ID NO: 1264191 - RNA, 15 nt, Mycobacterium tuberculosis H37Rv
cgcgcagaucgucca

SEQ ID NO: 1264192 - RNA, 20 nt, Mycobacterium tuberculosis H37Rv
cgcgcagaucgaaaucagcc

SEQ ID NO: 1264193 - RNA, 15 nt, Mycobacterium tuberculosis H37Rv
cgcgcagauacgcgu

SEQ ID NO: 1264194 - RNA, 17 nt, Mycobacterium tuberculosis H37Rv
cgcgcacucgaccagga

SEQ ID NO: 1264195 - RNA, 20 nt, Mycobacterium tuberculosis H37Rv
cgcgcacuugcguggcguug

SEQ ID NO: 1264196 - RNA, 19 nt, Mycobacterium tuberculosis H37Rv
cgcgcaccgaccgcaccgu

SEQ ID NO: 1264197 - RNA, 15 nt, Mycobacterium tuberculosis H37Rv
cgcgcaccgaccgca

SEQ ID NO: 1264198 - RNA, 23 nt, Mycobacterium tuberculosis H37Rv
cgcgcacccagcccagccguucg

SEQ ID NO: 1264199 - RNA, 14 nt, Mycobacterium tuberculosis H37Rv
cgcgcacgcccugg

SEQ ID NO: 1264200 - RNA, 13 nt, Mycobacterium tuberculosis H37Rv
cgcgcacggcguc

SEQ ID NO: 1264201 - RNA, 18 nt, Mycobacterium tuberculosis H37Rv
cgcgcagggaucgcaggg

SEQ ID NO: 1264202 - RNA, 16 nt, Mycobacterium tuberculosis H37Rv
cgcgcaggccgacacg

SEQ ID NO: 1264203 - RNA, 21 nt, Mycobacterium tuberculosis H37Rv
cgcgcaggggcggcgugaagu

SEQ ID NO: 1264204 - RNA, 17 nt, Mycobacterium tuberculosis H37Rv
cgcgcaggggcggcgug

SEQ ID NO: 1264205 - RNA, 20 nt, Mycobacterium tuberculosis H37Rv
cgcgcagggcgucggcgaau

SEQ ID NO: 1264206 - RNA, 18 nt, Mycobacterium tuberculosis H37Rv
cgcgcagguagcgcucga

SEQ ID NO: 1264207 - RNA, 17 nt, Mycobacterium tuberculosis H37Rv
cgcgcagguagcgcucg

SEQ ID NO: 1264208 - RNA, 14 nt, Mycobacterium tuberculosis H37Rv
cgcgcagguagcgc

SEQ ID NO: 1264209 - RNA, 21 nt, Mycobacterium tuberculosis H37Rv
cgcgcagguagccaucggugc

SEQ ID NO: 1264210 - RNA, 19 nt, Mycobacterium tuberculosis H37Rv
cgcgcagguagucgacgac

SEQ ID NO: 1264211 - RNA, 21 nt, Mycobacterium tuberculosis H37Rv
cgcgcagguagcgcucgauca

SEQ ID NO: 1264212 - RNA, 20 nt, Mycobacterium tuberculosis H37Rv
cgcgcaucaucgcccaccgc

SEQ ID NO: 1264213 - RNA, 13 nt, Mycobacterium tuberculosis H37Rv
cgcgcaucgcggc

SEQ ID NO: 1264214 - RNA, 17 nt, Mycobacterium tuberculosis H37Rv
cgcgcaucgcggccgaa

SEQ ID NO: 1264215 - RNA, 19 nt, Mycobacterium tuberculosis H37Rv
cgcgcaguacuugaccguc

SEQ ID NO: 1264216 - RNA, 17 nt, Mycobacterium tuberculosis H37Rv
cgcgcagcugccgcacc

SEQ ID NO: 1264217 - RNA, 19 nt, Mycobacterium tuberculosis H37Rv
cgcgcaggaagccggcgug

SEQ ID NO: 1264218 - RNA, 15 nt, Mycobacterium tuberculosis H37Rv
cgcgcagcugccgca

SEQ ID NO: 1264219 - RNA, 19 nt, Mycobacterium tuberculosis H37Rv
cgcgcagcugacgucacca

SEQ ID NO: 1264220 - RNA, 18 nt, Mycobacterium tuberculosis H37Rv
cgcgcagcucgggcucgu

SEQ ID NO: 1264221 - RNA, 15 nt, Mycobacterium tuberculosis H37Rv
cgcgcagcugacguc

SEQ ID NO: 1264222 - RNA, 12 nt, Mycobacterium tuberculosis H37Rv
cgcgcagcucgg

SEQ ID NO: 1264223 - RNA, 16 nt, Mycobacterium tuberculosis H37Rv
cgcgcagcgcgaucgc

SEQ ID NO: 1264224 - RNA, 16 nt, Mycobacterium tuberculosis H37Rv
cgcgcagcaucggcga

SEQ ID NO: 1264225 - RNA, 12 nt, Mycobacterium tuberculosis H37Rv
cgcgcagcaguu

SEQ ID NO: 1264226 - RNA, 20 nt, Mycobacterium tuberculosis H37Rv
cgcgcagcacugcggcagcg

SEQ ID NO: 1264227 - RNA, 22 nt, Mycobacterium tuberculosis H37Rv
cgcgcagcaccggcucgacugc

SEQ ID NO: 1264228 - RNA, 17 nt, Mycobacterium tuberculosis H37Rv
cgcgccgccagcgccgc

SEQ ID NO: 1264229 - RNA, 15 nt, Mycobacterium tuberculosis H37Rv
cgcgccgcaucggcg

SEQ ID NO: 1264230 - RNA, 20 nt, Mycobacterium tuberculosis H37Rv
cgcgccgcugggugaccagg

SEQ ID NO: 1264231 - RNA, 16 nt, Mycobacterium tuberculosis H37Rv
cgcgccggauacaccg

SEQ ID NO: 1264232 - RNA, 21 nt, Mycobacterium tuberculosis H37Rv
cgcgccggauacaccggcacc

SEQ ID NO: 1264233 - RNA, 18 nt, Mycobacterium tuberculosis H37Rv
cgcgccggauguauucca

SEQ ID NO: 1264234 - RNA, 14 nt, Mycobacterium tuberculosis H37Rv
cgcgccggcagacc

SEQ ID NO: 1264235 - RNA, 15 nt, Mycobacterium tuberculosis H37Rv
cgcgccggcgguagu

SEQ ID NO: 1264236 - RNA, 14 nt, Mycobacterium tuberculosis H37Rv
cgcgccggcgguag

SEQ ID NO: 1264237 - RNA, 13 nt, Mycobacterium tuberculosis H37Rv
cgcgccggcggua

SEQ ID NO: 1264238 - RNA, 16 nt, Mycobacterium tuberculosis H37Rv
cgcgccggcggccacc

SEQ ID NO: 1264239 - RNA, 13 nt, Mycobacterium tuberculosis H37Rv
cgcgcccaccaug

SEQ ID NO: 1264240 - RNA, 13 nt, Mycobacterium tuberculosis H37Rv
cgcgcccaccccg

SEQ ID NO: 1264241 - RNA, 21 nt, Mycobacterium tuberculosis H37Rv
cgcgccgaacacgcacacgau

SEQ ID NO: 1264242 - RNA, 20 nt, Mycobacterium tuberculosis H37Rv
cgcgcccugcggaucggaca

SEQ ID NO: 1264243 - RNA, 21 nt, Mycobacterium tuberculosis H37Rv
cgcgccagccuccaccagguc

SEQ ID NO: 1264244 - RNA, 20 nt, Mycobacterium tuberculosis H37Rv
cgcgccaggcuugcggcacc

SEQ ID NO: 1264245 - RNA, 18 nt, Mycobacterium tuberculosis H37Rv
cgcgccaccagcaccgcc

SEQ ID NO: 1264246 - RNA, 20 nt, Mycobacterium tuberculosis H37Rv
cgcgccaaguggcgcucgca

SEQ ID NO: 1264247 - RNA, 15 nt, Mycobacterium tuberculosis H37Rv
cgcgccaaguggcgc

SEQ ID NO: 1264248 - RNA, 15 nt, Mycobacterium tuberculosis H37Rv
cgcgccaaucgccca

SEQ ID NO: 1264249 - RNA, 19 nt, Mycobacterium tuberculosis H37Rv
cgcgccaccagcaccgccg

SEQ ID NO: 1264250 - RNA, 12 nt, Mycobacterium tuberculosis H37Rv
cgcgccaccgau

SEQ ID NO: 1264251 - RNA, 14 nt, Mycobacterium tuberculosis H37Rv
cgcgccaccgauac

SEQ ID NO: 1264252 - RNA, 22 nt, Mycobacterium tuberculosis H37Rv
cgcgccaccgauaccgucagcg

SEQ ID NO: 1264253 - RNA, 16 nt, Mycobacterium tuberculosis H37Rv
cgcgccaccggcaccg

SEQ ID NO: 1264254 - RNA, 18 nt, Mycobacterium tuberculosis H37Rv
cgcgccaccggcaccgcc

SEQ ID NO: 1264255 - RNA, 12 nt, Mycobacterium tuberculosis H37Rv
cgcgccacccag

SEQ ID NO: 1264256 - RNA, 19 nt, Mycobacterium tuberculosis H37Rv
cgcgccacgagcaacgggc

SEQ ID NO: 1264257 - RNA, 22 nt, Mycobacterium tuberculosis H37Rv
cgcgccaaacaccccggccuug

SEQ ID NO: 1264258 - RNA, 16 nt, Mycobacterium tuberculosis H37Rv
cgcgccaaacgccgga

SEQ ID NO: 1264259 - RNA, 15 nt, Mycobacterium tuberculosis H37Rv
cgcgccaagacgaac

SEQ ID NO: 1264260 - RNA, 14 nt, Mycobacterium tuberculosis H37Rv
cgcgcauucgccgg

SEQ ID NO: 1264261 - RNA, 19 nt, Mycobacterium tuberculosis H37Rv
cgcuccuucagggcgucga

SEQ ID NO: 1264262 - RNA, 20 nt, Mycobacterium tuberculosis H37Rv
cgcucgaaauccugguggca

SEQ ID NO: 1264263 - RNA, 14 nt, Mycobacterium tuberculosis H37Rv
cgcuccugcucguc

SEQ ID NO: 1264264 - RNA, 15 nt, Mycobacterium tuberculosis H37Rv
cgcucgaccagacgc

SEQ ID NO: 1264265 - RNA, 21 nt, Mycobacterium tuberculosis H37Rv
cgcucgaccagacgcugccca

SEQ ID NO: 1264266 - RNA, 15 nt, Mycobacterium tuberculosis H37Rv
cgcucgacgaccacg

SEQ ID NO: 1264267 - RNA, 18 nt, Mycobacterium tuberculosis H37Rv
cgcuccggcccugccgcc

SEQ ID NO: 1264268 - RNA, 19 nt, Mycobacterium tuberculosis H37Rv
cgcuccuccggcaccaacg

SEQ ID NO: 1264269 - RNA, 21 nt, Mycobacterium tuberculosis H37Rv
cgcuccgaugugccgauuggc

SEQ ID NO: 1264270 - RNA, 13 nt, Mycobacterium tuberculosis H37Rv
cgcuccgaccggu

SEQ ID NO: 1264271 - RNA, 17 nt, Mycobacterium tuberculosis H37Rv
cgcucccgccggcagcg

SEQ ID NO: 1264272 - RNA, 18 nt, Mycobacterium tuberculosis H37Rv
cgcucccucuacacccgg

SEQ ID NO: 1264273 - RNA, 17 nt, Mycobacterium tuberculosis H37Rv
cgcguuugcgaagccca

SEQ ID NO: 1264274 - RNA, 19 nt, Mycobacterium tuberculosis H37Rv
cgcguuucgcagccgcacc

SEQ ID NO: 1264275 - RNA, 12 nt, Mycobacterium tuberculosis H37Rv
cgcucaucgacc

SEQ ID NO: 1264276 - RNA, 11 nt, Mycobacterium tuberculosis H37Rv
cgcucaucgac

SEQ ID NO: 1264277 - RNA, 18 nt, Mycobacterium tuberculosis H37Rv
cgcucaucgggcacaucg

SEQ ID NO: 1264278 - RNA, 22 nt, Mycobacterium tuberculosis H37Rv
cgcucauguucucgaccgcguc

SEQ ID NO: 1264279 - RNA, 20 nt, Mycobacterium tuberculosis H37Rv
cgcuccaacgcacacaccgu

SEQ ID NO: 1264280 - RNA, 18 nt, Mycobacterium tuberculosis H37Rv
cgcuccaacaacuccagc

SEQ ID NO: 1264281 - RNA, 14 nt, Mycobacterium tuberculosis H37Rv
cgcuccaguggcgc

SEQ ID NO: 1264282 - RNA, 18 nt, Mycobacterium tuberculosis H37Rv
cgcuccaccucggcguug

SEQ ID NO: 1264283 - RNA, 17 nt, Mycobacterium tuberculosis H37Rv
cgcuccagauggggcuc

SEQ ID NO: 1264284 - RNA, 17 nt, Mycobacterium tuberculosis H37Rv
cgcugaguccccaggug

SEQ ID NO: 1264285 - RNA, 15 nt, Mycobacterium tuberculosis H37Rv
cgcugaguccccagg

SEQ ID NO: 1264286 - RNA, 20 nt, Mycobacterium tuberculosis H37Rv
cgcugaccguuucgaucucg

SEQ ID NO: 1264287 - RNA, 21 nt, Mycobacterium tuberculosis H37Rv
cgcugaccguuucgaucucga

SEQ ID NO: 1264288 - RNA, 14 nt, Mycobacterium tuberculosis H37Rv
cgcucugcugaaau

SEQ ID NO: 1264289 - RNA, 23 nt, Mycobacterium tuberculosis H37Rv
cgcucugcgccacagcagcguug

SEQ ID NO: 1264290 - RNA, 16 nt, Mycobacterium tuberculosis H37Rv
cgcucgucgucaccga

SEQ ID NO: 1264291 - RNA, 15 nt, Mycobacterium tuberculosis H37Rv
cgcucgucguccggc

SEQ ID NO: 1264292 - RNA, 14 nt, Mycobacterium tuberculosis H37Rv
cgcucgucgaucuc

SEQ ID NO: 1264293 - RNA, 18 nt, Mycobacterium tuberculosis H37Rv
cgcucuucgauggguagc

SEQ ID NO: 1264294 - RNA, 15 nt, Mycobacterium tuberculosis H37Rv
cgcucuugcucacca

SEQ ID NO: 1264295 - RNA, 14 nt, Mycobacterium tuberculosis H37Rv
cgcucugugucgcc

SEQ ID NO: 1264296 - RNA, 13 nt, Mycobacterium tuberculosis H37Rv
cgcucugugucgc

SEQ ID NO: 1264297 - RNA, 21 nt, Mycobacterium tuberculosis H37Rv
cgcucgcccgccgccaccagc

SEQ ID NO: 1264298 - RNA, 22 nt, Mycobacterium tuberculosis H37Rv
cgcucgcccgccgccaccagcu

SEQ ID NO: 1264299 - RNA, 13 nt, Mycobacterium tuberculosis H37Rv
cgcucgaucaggu

SEQ ID NO: 1264300 - RNA, 19 nt, Mycobacterium tuberculosis H37Rv
cgcucgauggcggccacca

SEQ ID NO: 1264301 - RNA, 12 nt, Mycobacterium tuberculosis H37Rv
cgcucgcacagc

SEQ ID NO: 1264302 - RNA, 16 nt, Mycobacterium tuberculosis H37Rv
cgcucgaugucccgag

SEQ ID NO: 1264303 - RNA, 14 nt, Mycobacterium tuberculosis H37Rv
cgcucgcaggccgg

SEQ ID NO: 1264304 - RNA, 18 nt, Mycobacterium tuberculosis H37Rv
cgcucgggguugcucgcg

SEQ ID NO: 1264305 - RNA, 14 nt, Mycobacterium tuberculosis H37Rv
cgcucgggcccagc

SEQ ID NO: 1264306 - RNA, 13 nt, Mycobacterium tuberculosis H37Rv
cgcucggcguagc

SEQ ID NO: 1264307 - RNA, 14 nt, Mycobacterium tuberculosis H37Rv
cgcucggcguagcg

SEQ ID NO: 1264308 - RNA, 22 nt, Mycobacterium tuberculosis H37Rv
cgcucgggguugcucgcgaucg

SEQ ID NO: 1264309 - RNA, 13 nt, Mycobacterium tuberculosis H37Rv
cgcucggucgcca

SEQ ID NO: 1264310 - RNA, 20 nt, Mycobacterium tuberculosis H37Rv
cgcucgggggauccggcgca

SEQ ID NO: 1264311 - RNA, 18 nt, Mycobacterium tuberculosis H37Rv
cgcucggucgccuccucg

SEQ ID NO: 1264312 - RNA, 14 nt, Mycobacterium tuberculosis H37Rv
cgcucggugccgcc

SEQ ID NO: 1264313 - RNA, 18 nt, Mycobacterium tuberculosis H37Rv
cgcucgguucggagucac

SEQ ID NO: 1264314 - RNA, 13 nt, Mycobacterium tuberculosis H37Rv
cgcugaucggcag

SEQ ID NO: 1264315 - RNA, 15 nt, Mycobacterium tuberculosis H37Rv
cgcugauccacgaua

SEQ ID NO: 1264316 - RNA, 20 nt, Mycobacterium tuberculosis H37Rv
cgcugaucagauccucgacu

SEQ ID NO: 1264317 - RNA, 17 nt, Mycobacterium tuberculosis H37Rv
cgcugcccgccagccca

SEQ ID NO: 1264318 - RNA, 20 nt, Mycobacterium tuberculosis H37Rv
cgcugcgccgucgcagccag

SEQ ID NO: 1264319 - RNA, 12 nt, Mycobacterium tuberculosis H37Rv
cgcugcgcgacu

SEQ ID NO: 1264320 - RNA, 21 nt, Mycobacterium tuberculosis H37Rv
cgcugccucuugcucggcgug

SEQ ID NO: 1264321 - RNA, 20 nt, Mycobacterium tuberculosis H37Rv
cgcugccgaagcggccaccg

SEQ ID NO: 1264322 - RNA, 14 nt, Mycobacterium tuberculosis H37Rv
cgcugccgguguug

SEQ ID NO: 1264323 - RNA, 20 nt, Mycobacterium tuberculosis H37Rv
cgcugccgcaguucaucgag

SEQ ID NO: 1264324 - RNA, 19 nt, Mycobacterium tuberculosis H37Rv
cgcugccgcaucggcaagg

SEQ ID NO: 1264325 - RNA, 17 nt, Mycobacterium tuberculosis H37Rv
cgcugcgcgccagacac

SEQ ID NO: 1264326 - RNA, 15 nt, Mycobacterium tuberculosis H37Rv
cgcugcggcaccacc

SEQ ID NO: 1264327 - RNA, 19 nt, Mycobacterium tuberculosis H37Rv
cgcugccucuugcucggcg

SEQ ID NO: 1264328 - RNA, 19 nt, Mycobacterium tuberculosis H37Rv
cgcugcgcggcccgcaucg

SEQ ID NO: 1264329 - RNA, 15 nt, Mycobacterium tuberculosis H37Rv
cgcugcggcgguaug

SEQ ID NO: 1264330 - RNA, 16 nt, Mycobacterium tuberculosis H37Rv
cgcugcggcggcuuug

SEQ ID NO: 1264331 - RNA, 18 nt, Mycobacterium tuberculosis H37Rv
cgcugcggcgcuggccag

SEQ ID NO: 1264332 - RNA, 15 nt, Mycobacterium tuberculosis H37Rv
cgcugcggcccacac

SEQ ID NO: 1264333 - RNA, 16 nt, Mycobacterium tuberculosis H37Rv
cgcugcugauggugac

SEQ ID NO: 1264334 - RNA, 23 nt, Mycobacterium tuberculosis H37Rv
cgcugcucuuuuagccacaaucg

SEQ ID NO: 1264335 - RNA, 22 nt, Mycobacterium tuberculosis H37Rv
cgcugcucugagcuuggucgcc

SEQ ID NO: 1264336 - RNA, 17 nt, Mycobacterium tuberculosis H37Rv
cgcugcucagcaacggc

SEQ ID NO: 1264337 - RNA, 20 nt, Mycobacterium tuberculosis H37Rv
cgcugcguugggaucccagc

SEQ ID NO: 1264338 - RNA, 15 nt, Mycobacterium tuberculosis H37Rv
cgcugcucacgcagc

SEQ ID NO: 1264339 - RNA, 16 nt, Mycobacterium tuberculosis H37Rv
cgcugcuccucgcggu

SEQ ID NO: 1264340 - RNA, 22 nt, Mycobacterium tuberculosis H37Rv
cgcugggacggucgcucggcau

SEQ ID NO: 1264341 - RNA, 18 nt, Mycobacterium tuberculosis H37Rv
cgcugggacgggcgcguc

SEQ ID NO: 1264342 - RNA, 15 nt, Mycobacterium tuberculosis H37Rv
cgcugggaggcgcgg

SEQ ID NO: 1264343 - RNA, 15 nt, Mycobacterium tuberculosis H37Rv
cgcugggaggcggcg

SEQ ID NO: 1264344 - RNA, 16 nt, Mycobacterium tuberculosis H37Rv
cgcugggccgaccgcc

SEQ ID NO: 1264345 - RNA, 20 nt, Mycobacterium tuberculosis H37Rv
cgcugggauguucgaucagc

SEQ ID NO: 1264346 - RNA, 13 nt, Mycobacterium tuberculosis H37Rv
cgcugggcgcaac

SEQ ID NO: 1264347 - RNA, 15 nt, Mycobacterium tuberculosis H37Rv
cgcugggcccaggag

SEQ ID NO: 1264348 - RNA, 13 nt, Mycobacterium tuberculosis H37Rv
cgcuggucgagca

SEQ ID NO: 1264349 - RNA, 15 nt, Mycobacterium tuberculosis H37Rv
cgcuggucgcaaugg

SEQ ID NO: 1264350 - RNA, 13 nt, Mycobacterium tuberculosis H37Rv
cgcuggucgcggu

SEQ ID NO: 1264351 - RNA, 20 nt, Mycobacterium tuberculosis H37Rv
cgcuggucgcgguggcggcg

SEQ ID NO: 1264352 - RNA, 21 nt, Mycobacterium tuberculosis H37Rv
cgcuggacaguuacgcuggca

SEQ ID NO: 1264353 - RNA, 13 nt, Mycobacterium tuberculosis H37Rv
cgcugcugccgca

SEQ ID NO: 1264354 - RNA, 16 nt, Mycobacterium tuberculosis H37Rv
cgcugcuggcagacca

SEQ ID NO: 1264355 - RNA, 15 nt, Mycobacterium tuberculosis H37Rv
cgcuggaggccacca

SEQ ID NO: 1264356 - RNA, 14 nt, Mycobacterium tuberculosis H37Rv
cgcuggaccugaug

SEQ ID NO: 1264357 - RNA, 14 nt, Mycobacterium tuberculosis H37Rv
cgcuggacggaucu

SEQ ID NO: 1264358 - RNA, 19 nt, Mycobacterium tuberculosis H37Rv
cgcugcuugcgggcucgug

SEQ ID NO: 1264359 - RNA, 20 nt, Mycobacterium tuberculosis H37Rv
cgcuggaugugggcgcucgc

SEQ ID NO: 1264360 - RNA, 18 nt, Mycobacterium tuberculosis H37Rv
cgcuggccacgauccgcg

SEQ ID NO: 1264361 - RNA, 12 nt, Mycobacterium tuberculosis H37Rv
cgcuggccacga

SEQ ID NO: 1264362 - RNA, 15 nt, Mycobacterium tuberculosis H37Rv
cgcuggcauaucccu

SEQ ID NO: 1264363 - RNA, 21 nt, Mycobacterium tuberculosis H37Rv
cgcgguuggcugaugacgcgg

SEQ ID NO: 1264364 - RNA, 23 nt, Mycobacterium tuberculosis H37Rv
cgcgguuggcaguggcgcggcga

SEQ ID NO: 1264365 - RNA, 21 nt, Mycobacterium tuberculosis H37Rv
cgcgguuguggcugaucccgg

SEQ ID NO: 1264366 - RNA, 15 nt, Mycobacterium tuberculosis H37Rv
cgcgguugcugguca

SEQ ID NO: 1264367 - RNA, 13 nt, Mycobacterium tuberculosis H37Rv
cgcggugacggcg

SEQ ID NO: 1264368 - RNA, 16 nt, Mycobacterium tuberculosis H37Rv
cgcgguucgucggcga

SEQ ID NO: 1264369 - RNA, 22 nt, Mycobacterium tuberculosis H37Rv
cgcgguucgucggcgagcgcgg

SEQ ID NO: 1264370 - RNA, 19 nt, Mycobacterium tuberculosis H37Rv
cgcggucgugaucagcagg

SEQ ID NO: 1264371 - RNA, 17 nt, Mycobacterium tuberculosis H37Rv
cgcggucugcgcgucgc

SEQ ID NO: 1264372 - RNA, 13 nt, Mycobacterium tuberculosis H37Rv
cgcggugaccggg

SEQ ID NO: 1264373 - RNA, 23 nt, Mycobacterium tuberculosis H37Rv
cgcggugacgauugccaccaaug

SEQ ID NO: 1264374 - RNA, 17 nt, Mycobacterium tuberculosis H37Rv
cgcguauucggcaucgc

SEQ ID NO: 1264375 - RNA, 19 nt, Mycobacterium tuberculosis H37Rv
cgcguauucggcaucgccg

SEQ ID NO: 1264376 - RNA, 23 nt, Mycobacterium tuberculosis H37Rv
cgcgucaacgcuguugucgucca

SEQ ID NO: 1264377 - RNA, 13 nt, Mycobacterium tuberculosis H37Rv
cgcguagucgcgg

SEQ ID NO: 1264378 - RNA, 12 nt, Mycobacterium tuberculosis H37Rv
cgcguaugccag

SEQ ID NO: 1264379 - RNA, 20 nt, Mycobacterium tuberculosis H37Rv
cgcguaguaaugcucgacgu

SEQ ID NO: 1264380 - RNA, 16 nt, Mycobacterium tuberculosis H37Rv
cgcguaguccgcaucc

SEQ ID NO: 1264381 - RNA, 17 nt, Mycobacterium tuberculosis H37Rv
cgcguagagcagcagcg

SEQ ID NO: 1264382 - RNA, 16 nt, Mycobacterium tuberculosis H37Rv
cgcguagagcagcagc

SEQ ID NO: 1264383 - RNA, 12 nt, Mycobacterium tuberculosis H37Rv
cgcguagccgug

SEQ ID NO: 1264384 - RNA, 16 nt, Mycobacterium tuberculosis H37Rv
cgcguagcgcaggauc

SEQ ID NO: 1264385 - RNA, 13 nt, Mycobacterium tuberculosis H37Rv
cgcgguuuucggc

SEQ ID NO: 1264386 - RNA, 21 nt, Mycobacterium tuberculosis H37Rv
cgcgggcgugccgaccagcau

SEQ ID NO: 1264387 - RNA, 12 nt, Mycobacterium tuberculosis H37Rv
cgcgggcucccc

SEQ ID NO: 1264388 - RNA, 18 nt, Mycobacterium tuberculosis H37Rv
cgcgggcgucccgcauac

SEQ ID NO: 1264389 - RNA, 15 nt, Mycobacterium tuberculosis H37Rv
cgcgggcgucccgca

SEQ ID NO: 1264390 - RNA, 22 nt, Mycobacterium tuberculosis H37Rv
cgcggcggaacaccgacgacac

SEQ ID NO: 1264391 - RNA, 21 nt, Mycobacterium tuberculosis H37Rv
cgcggcggaaggcgucgaaca

SEQ ID NO: 1264392 - RNA, 12 nt, Mycobacterium tuberculosis H37Rv
cgcggguaaccg

SEQ ID NO: 1264393 - RNA, 22 nt, Mycobacterium tuberculosis H37Rv
cgcggguacuuacgggucgcgg

SEQ ID NO: 1264394 - RNA, 18 nt, Mycobacterium tuberculosis H37Rv
cgcggguccagccaccga

SEQ ID NO: 1264395 - RNA, 13 nt, Mycobacterium tuberculosis H37Rv
cgcgggucggcga

SEQ ID NO: 1264396 - RNA, 22 nt, Mycobacterium tuberculosis H37Rv
cgcgggucuuggcacacagguc

SEQ ID NO: 1264397 - RNA, 16 nt, Mycobacterium tuberculosis H37Rv
cgcgguagcucgucga

SEQ ID NO: 1264398 - RNA, 13 nt, Mycobacterium tuberculosis H37Rv
cgcgguagcucgu

SEQ ID NO: 1264399 - RNA, 17 nt, Mycobacterium tuberculosis H37Rv
cgcgggugcggacaccg

SEQ ID NO: 1264400 - RNA, 14 nt, Mycobacterium tuberculosis H37Rv
cgcgggucggcgac

SEQ ID NO: 1264401 - RNA, 14 nt, Mycobacterium tuberculosis H37Rv
cgcggguggcagcg

SEQ ID NO: 1264402 - RNA, 15 nt, Mycobacterium tuberculosis H37Rv
cgcgguagccgagcu

SEQ ID NO: 1264403 - RNA, 15 nt, Mycobacterium tuberculosis H37Rv
cgcgguagacgccgc

SEQ ID NO: 1264404 - RNA, 17 nt, Mycobacterium tuberculosis H37Rv
cgcgguacugcgcagcg

SEQ ID NO: 1264405 - RNA, 13 nt, Mycobacterium tuberculosis H37Rv
cgcggucagcggg

SEQ ID NO: 1264406 - RNA, 17 nt, Mycobacterium tuberculosis H37Rv
cgcggucagcgggucga

SEQ ID NO: 1264407 - RNA, 19 nt, Mycobacterium tuberculosis H37Rv
cgcggucagcucggcagca

SEQ ID NO: 1264408 - RNA, 21 nt, Mycobacterium tuberculosis H37Rv
cgcggucauggcgacggucgu

SEQ ID NO: 1264409 - RNA, 13 nt, Mycobacterium tuberculosis H37Rv
cgcggucggcgac

SEQ ID NO: 1264410 - RNA, 12 nt, Mycobacterium tuberculosis H37Rv
cgcggucggcca

SEQ ID NO: 1264411 - RNA, 16 nt, Mycobacterium tuberculosis H37Rv
cgcggucggcagcgac

SEQ ID NO: 1264412 - RNA, 17 nt, Mycobacterium tuberculosis H37Rv
cgcguucaggaugccag

SEQ ID NO: 1264413 - RNA, 15 nt, Mycobacterium tuberculosis H37Rv
cgcgugacgaccagc

SEQ ID NO: 1264414 - RNA, 18 nt, Mycobacterium tuberculosis H37Rv
cgcgugugcgucgcacga

SEQ ID NO: 1264415 - RNA, 14 nt, Mycobacterium tuberculosis H37Rv
cgcgugguucgguc

SEQ ID NO: 1264416 - RNA, 22 nt, Mycobacterium tuberculosis H37Rv
cgcguguccuuugccaccucgg

SEQ ID NO: 1264417 - RNA, 18 nt, Mycobacterium tuberculosis H37Rv
cgcguggugcugaccgcg

SEQ ID NO: 1264418 - RNA, 15 nt, Mycobacterium tuberculosis H37Rv
cgcguugucggcgcu

SEQ ID NO: 1264419 - RNA, 20 nt, Mycobacterium tuberculosis H37Rv
cgcguuggcgagguugcgcc

SEQ ID NO: 1264420 - RNA, 22 nt, Mycobacterium tuberculosis H37Rv
cgcguuggacaauucgacgaac

SEQ ID NO: 1264421 - RNA, 19 nt, Mycobacterium tuberculosis H37Rv
cgcguugccggucgcaugg

SEQ ID NO: 1264422 - RNA, 13 nt, Mycobacterium tuberculosis H37Rv
cgcguugcacagc

SEQ ID NO: 1264423 - RNA, 14 nt, Mycobacterium tuberculosis H37Rv
cgcgucugggugca

SEQ ID NO: 1264424 - RNA, 19 nt, Mycobacterium tuberculosis H37Rv
cgcgugaccgacugcgggu

SEQ ID NO: 1264425 - RNA, 18 nt, Mycobacterium tuberculosis H37Rv
cgcgugacagugaccugg

SEQ ID NO: 1264426 - RNA, 12 nt, Mycobacterium tuberculosis H37Rv
cgcgucgucggu

SEQ ID NO: 1264427 - RNA, 19 nt, Mycobacterium tuberculosis H37Rv
cgcgucgucggucaaaccg

SEQ ID NO: 1264428 - RNA, 23 nt, Mycobacterium tuberculosis H37Rv
cgcgucgucgagaaucggcauuc

SEQ ID NO: 1264429 - RNA, 13 nt, Mycobacterium tuberculosis H37Rv
cgcgucgucgagu

SEQ ID NO: 1264430 - RNA, 16 nt, Mycobacterium tuberculosis H37Rv
cgcgucgucgagucga

SEQ ID NO: 1264431 - RNA, 16 nt, Mycobacterium tuberculosis H37Rv
cgcgucguagcgcucg

SEQ ID NO: 1264432 - RNA, 21 nt, Mycobacterium tuberculosis H37Rv
cgcgucggcguuggggcucgu

SEQ ID NO: 1264433 - RNA, 13 nt, Mycobacterium tuberculosis H37Rv
cgcgucggcguug

SEQ ID NO: 1264434 - RNA, 17 nt, Mycobacterium tuberculosis H37Rv
cgcgucggcguuggggc

SEQ ID NO: 1264435 - RNA, 17 nt, Mycobacterium tuberculosis H37Rv
cgcgucggaccguuucg

SEQ ID NO: 1264436 - RNA, 14 nt, Mycobacterium tuberculosis H37Rv
cgcgucggcgauga

SEQ ID NO: 1264437 - RNA, 17 nt, Mycobacterium tuberculosis H37Rv
cgcgucagcggcgagca

SEQ ID NO: 1264438 - RNA, 16 nt, Mycobacterium tuberculosis H37Rv
cgcgucacggaccugg

SEQ ID NO: 1264439 - RNA, 17 nt, Mycobacterium tuberculosis H37Rv
cgcgucacaccagcggg

SEQ ID NO: 1264440 - RNA, 20 nt, Mycobacterium tuberculosis H37Rv
cgcgucacaccagcgggcau

SEQ ID NO: 1264441 - RNA, 14 nt, Mycobacterium tuberculosis H37Rv
cgcgucacaccagc

SEQ ID NO: 1264442 - RNA, 23 nt, Mycobacterium tuberculosis H37Rv
cgcgucacaccagcgggcaucgc

SEQ ID NO: 1264443 - RNA, 21 nt, Mycobacterium tuberculosis H37Rv
cgcguccccagcgccaccguu

SEQ ID NO: 1264444 - RNA, 17 nt, Mycobacterium tuberculosis H37Rv
cgcguccacccacgauc

SEQ ID NO: 1264445 - RNA, 14 nt, Mycobacterium tuberculosis H37Rv
cgcgucggagccgg

SEQ ID NO: 1264446 - RNA, 12 nt, Mycobacterium tuberculosis H37Rv
cgcgucgcggga

SEQ ID NO: 1264447 - RNA, 23 nt, Mycobacterium tuberculosis H37Rv
cgcgucgcgugggaugucgagcg

SEQ ID NO: 1264448 - RNA, 14 nt, Mycobacterium tuberculosis H37Rv
cgcgucgccgauga

SEQ ID NO: 1264449 - RNA, 11 nt, Mycobacterium tuberculosis H37Rv
cgcgucgccga

SEQ ID NO: 1264450 - RNA, 23 nt, Mycobacterium tuberculosis H37Rv
cgcgucgaauuccggcucaccga

SEQ ID NO: 1264451 - RNA, 22 nt, Mycobacterium tuberculosis H37Rv
cgcgucgaauuccggcucaccg

SEQ ID NO: 1264452 - RNA, 21 nt, Mycobacterium tuberculosis H37Rv
cgcgucgaauuccggcucacc

SEQ ID NO: 1264453 - RNA, 14 nt, Mycobacterium tuberculosis H37Rv
cgcgucgacgagcg

SEQ ID NO: 1264454 - RNA, 15 nt, Mycobacterium tuberculosis H37Rv
cgccggcggccaccu

SEQ ID NO: 1264455 - RNA, 20 nt, Mycobacterium tuberculosis H37Rv
cgccggcggcaaagagcagc

SEQ ID NO: 1264456 - RNA, 23 nt, Mycobacterium tuberculosis H37Rv
cgccggcgcugcugccauugccg

SEQ ID NO: 1264457 - RNA, 15 nt, Mycobacterium tuberculosis H37Rv
cgccggcgcgccgau

SEQ ID NO: 1264458 - RNA, 14 nt, Mycobacterium tuberculosis H37Rv
cgccggcgcgcacc

SEQ ID NO: 1264459 - RNA, 15 nt, Mycobacterium tuberculosis H37Rv
cgccggcgccucgug

SEQ ID NO: 1264460 - RNA, 18 nt, Mycobacterium tuberculosis H37Rv
cgccggcgcccaggccga

SEQ ID NO: 1264461 - RNA, 19 nt, Mycobacterium tuberculosis H37Rv
cgccggcgcccaggccgau

SEQ ID NO: 1264462 - RNA, 22 nt, Mycobacterium tuberculosis H37Rv
cgccggcgccaucgggucaccc

SEQ ID NO: 1264463 - RNA, 14 nt, Mycobacterium tuberculosis H37Rv
cgccggcgccagca

SEQ ID NO: 1264464 - RNA, 17 nt, Mycobacterium tuberculosis H37Rv
cgccggcgccacccgcg

SEQ ID NO: 1264465 - RNA, 14 nt, Mycobacterium tuberculosis H37Rv
cgccggcgccaccc

SEQ ID NO: 1264466 - RNA, 22 nt, Mycobacterium tuberculosis H37Rv
cgccggcgccgccggugccacc

SEQ ID NO: 1264467 - RNA, 19 nt, Mycobacterium tuberculosis H37Rv
cgccggcgccaagucucgg

SEQ ID NO: 1264468 - RNA, 14 nt, Mycobacterium tuberculosis H37Rv
cgccggcgacggcg

SEQ ID NO: 1264469 - RNA, 20 nt, Mycobacterium tuberculosis H37Rv
cgccggcguuugggcaucau

SEQ ID NO: 1264470 - RNA, 16 nt, Mycobacterium tuberculosis H37Rv
cgccggcuccgccagc

SEQ ID NO: 1264471 - RNA, 15 nt, Mycobacterium tuberculosis H37Rv
cgccggcuccgccgu

SEQ ID NO: 1264472 - RNA, 15 nt, Mycobacterium tuberculosis H37Rv
cgccggcgucgaccc

SEQ ID NO: 1264473 - RNA, 15 nt, Mycobacterium tuberculosis H37Rv
cgccggcggcggugc

SEQ ID NO: 1264474 - RNA, 21 nt, Mycobacterium tuberculosis H37Rv
cgccggggauaccggucagca

SEQ ID NO: 1264475 - RNA, 17 nt, Mycobacterium tuberculosis H37Rv
cgccggguagcuguaca

SEQ ID NO: 1264476 - RNA, 17 nt, Mycobacterium tuberculosis H37Rv
cgccggggauaccgguc

SEQ ID NO: 1264477 - RNA, 12 nt, Mycobacterium tuberculosis H37Rv
cgccgggcugca

SEQ ID NO: 1264478 - RNA, 17 nt, Mycobacterium tuberculosis H37Rv
cgccgggcucagcuggg

SEQ ID NO: 1264479 - RNA, 16 nt, Mycobacterium tuberculosis H37Rv
cgccgggaagccgcau

SEQ ID NO: 1264480 - RNA, 16 nt, Mycobacterium tuberculosis H37Rv
cgccgggcggcggugc

SEQ ID NO: 1264481 - RNA, 23 nt, Mycobacterium tuberculosis H37Rv
cgccgggcggcggugcgucagcu

SEQ ID NO: 1264482 - RNA, 19 nt, Mycobacterium tuberculosis H37Rv
cgccgguggcagagccgcc

SEQ ID NO: 1264483 - RNA, 14 nt, Mycobacterium tuberculosis H37Rv
cgccggugccggua

SEQ ID NO: 1264484 - RNA, 21 nt, Mycobacterium tuberculosis H37Rv
cgccgguggccgcgcugguca

SEQ ID NO: 1264485 - RNA, 21 nt, Mycobacterium tuberculosis H37Rv
cgccggugcgcaacuucgacu

SEQ ID NO: 1264486 - RNA, 13 nt, Mycobacterium tuberculosis H37Rv
cgccgguggcacg

SEQ ID NO: 1264487 - RNA, 16 nt, Mycobacterium tuberculosis H37Rv
cgccggucaggccgcc

SEQ ID NO: 1264488 - RNA, 21 nt, Mycobacterium tuberculosis H37Rv
cgccggugccgaucagcagug

SEQ ID NO: 1264489 - RNA, 17 nt, Mycobacterium tuberculosis H37Rv
cgccggucacgacgucc

SEQ ID NO: 1264490 - RNA, 14 nt, Mycobacterium tuberculosis H37Rv
cgccggugccgccu

SEQ ID NO: 1264491 - RNA, 19 nt, Mycobacterium tuberculosis H37Rv
cgccggugccgccgucgcc

SEQ ID NO: 1264492 - RNA, 15 nt, Mycobacterium tuberculosis H37Rv
cgccggugccgccgu

SEQ ID NO: 1264493 - RNA, 15 nt, Mycobacterium tuberculosis H37Rv
cgccggugccgccau

SEQ ID NO: 1264494 - RNA, 15 nt, Mycobacterium tuberculosis H37Rv
cgccggugccgauga

SEQ ID NO: 1264495 - RNA, 13 nt, Mycobacterium tuberculosis H37Rv
cgccggugccgcc

SEQ ID NO: 1264496 - RNA, 13 nt, Mycobacterium tuberculosis H37Rv
cgccggucacgac

SEQ ID NO: 1264497 - RNA, 19 nt, Mycobacterium tuberculosis H37Rv
cgccgggugcaacggcguu

SEQ ID NO: 1264498 - RNA, 21 nt, Mycobacterium tuberculosis H37Rv
cgccggguccaucaaccccag

SEQ ID NO: 1264499 - RNA, 21 nt, Mycobacterium tuberculosis H37Rv
cgccgggucagcccggcgcga

SEQ ID NO: 1264500 - RNA, 12 nt, Mycobacterium tuberculosis H37Rv
cgccgggucacg

SEQ ID NO: 1264501 - RNA, 15 nt, Mycobacterium tuberculosis H37Rv
cgccgccguugccgc

SEQ ID NO: 1264502 - RNA, 19 nt, Mycobacterium tuberculosis H37Rv
cgccgccguugccgccggu

SEQ ID NO: 1264503 - RNA, 18 nt, Mycobacterium tuberculosis H37Rv
cgccgccguugccgccau

SEQ ID NO: 1264504 - RNA, 14 nt, Mycobacterium tuberculosis H37Rv
cgccgccgucggcg

SEQ ID NO: 1264505 - RNA, 13 nt, Mycobacterium tuberculosis H37Rv
cgccgccgucgcc

SEQ ID NO: 1264506 - RNA, 16 nt, Mycobacterium tuberculosis H37Rv
cgccgccgucgccgua

SEQ ID NO: 1264507 - RNA, 15 nt, Mycobacterium tuberculosis H37Rv
cgccgccggcaccgc

SEQ ID NO: 1264508 - RNA, 14 nt, Mycobacterium tuberculosis H37Rv
cgccgccggcaccg

SEQ ID NO: 1264509 - RNA, 13 nt, Mycobacterium tuberculosis H37Rv
cgccgccggcacc

SEQ ID NO: 1264510 - RNA, 15 nt, Mycobacterium tuberculosis H37Rv
cgccgccggcaccac

SEQ ID NO: 1264511 - RNA, 18 nt, Mycobacterium tuberculosis H37Rv
cgccgccggccgccagcg

SEQ ID NO: 1264512 - RNA, 16 nt, Mycobacterium tuberculosis H37Rv
cgccgccgucggguug

SEQ ID NO: 1264513 - RNA, 13 nt, Mycobacterium tuberculosis H37Rv
cgccgcuacccca

SEQ ID NO: 1264514 - RNA, 16 nt, Mycobacterium tuberculosis H37Rv
cgccgcucgguccccg

SEQ ID NO: 1264515 - RNA, 14 nt, Mycobacterium tuberculosis H37Rv
cgccgcucgguccc

SEQ ID NO: 1264516 - RNA, 18 nt, Mycobacterium tuberculosis H37Rv
cgccgcuaacgcaccugc

SEQ ID NO: 1264517 - RNA, 19 nt, Mycobacterium tuberculosis H37Rv
cgccgcguuucggucguug

SEQ ID NO: 1264518 - RNA, 16 nt, Mycobacterium tuberculosis H37Rv
cgccgcguucagggca

SEQ ID NO: 1264519 - RNA, 15 nt, Mycobacterium tuberculosis H37Rv
cgccgcuuucuuggc

SEQ ID NO: 1264520 - RNA, 21 nt, Mycobacterium tuberculosis H37Rv
cgccgcugccgguagcacagc

SEQ ID NO: 1264521 - RNA, 13 nt, Mycobacterium tuberculosis H37Rv
cgccgcugccgcg

SEQ ID NO: 1264522 - RNA, 13 nt, Mycobacterium tuberculosis H37Rv
cgccgcugccauc

SEQ ID NO: 1264523 - RNA, 18 nt, Mycobacterium tuberculosis H37Rv
cgccgcugccgccgagcu

SEQ ID NO: 1264524 - RNA, 16 nt, Mycobacterium tuberculosis H37Rv
cgccgcugccgccugc

SEQ ID NO: 1264525 - RNA, 14 nt, Mycobacterium tuberculosis H37Rv
cgccggagaugaca

SEQ ID NO: 1264526 - RNA, 14 nt, Mycobacterium tuberculosis H37Rv
cgccggaggcaagc

SEQ ID NO: 1264527 - RNA, 20 nt, Mycobacterium tuberculosis H37Rv
cgccggagccgcccaagccg

SEQ ID NO: 1264528 - RNA, 13 nt, Mycobacterium tuberculosis H37Rv
cgccggagccgcc

SEQ ID NO: 1264529 - RNA, 13 nt, Mycobacterium tuberculosis H37Rv
cgccggaggucgg

SEQ ID NO: 1264530 - RNA, 15 nt, Mycobacterium tuberculosis H37Rv
cgccggaggucgggc

SEQ ID NO: 1264531 - RNA, 15 nt, Mycobacterium tuberculosis H37Rv
cgccggauauggcag

SEQ ID NO: 1264532 - RNA, 16 nt, Mycobacterium tuberculosis H37Rv
cgccggauagcgcagc

SEQ ID NO: 1264533 - RNA, 20 nt, Mycobacterium tuberculosis H37Rv
cgccggauacgucagcccga

SEQ ID NO: 1264534 - RNA, 15 nt, Mycobacterium tuberculosis H37Rv
cgccggauccgccag

SEQ ID NO: 1264535 - RNA, 17 nt, Mycobacterium tuberculosis H37Rv
cgccggaucgccacggu

SEQ ID NO: 1264536 - RNA, 15 nt, Mycobacterium tuberculosis H37Rv
cgccggaugcuguca

SEQ ID NO: 1264537 - RNA, 18 nt, Mycobacterium tuberculosis H37Rv
cgccggaugagccggaug

SEQ ID NO: 1264538 - RNA, 13 nt, Mycobacterium tuberculosis H37Rv
cgccggccacgac

SEQ ID NO: 1264539 - RNA, 14 nt, Mycobacterium tuberculosis H37Rv
cgccggccacgacc

SEQ ID NO: 1264540 - RNA, 17 nt, Mycobacterium tuberculosis H37Rv
cgccggccacgagucgc

SEQ ID NO: 1264541 - RNA, 15 nt, Mycobacterium tuberculosis H37Rv
cgccggccacccgcg

SEQ ID NO: 1264542 - RNA, 16 nt, Mycobacterium tuberculosis H37Rv
cgccggauucgaugac

SEQ ID NO: 1264543 - RNA, 15 nt, Mycobacterium tuberculosis H37Rv
cgccggccccgccag

SEQ ID NO: 1264544 - RNA, 20 nt, Mycobacterium tuberculosis H37Rv
cgccggccccaccgguaccg

SEQ ID NO: 1264545 - RNA, 20 nt, Mycobacterium tuberculosis H37Rv
cgccggcccaguucugcagg

SEQ ID NO: 1264546 - RNA, 13 nt, Mycobacterium tuberculosis H37Rv
cgccggccaguuc

SEQ ID NO: 1264547 - RNA, 15 nt, Mycobacterium tuberculosis H37Rv
cgccggccaguccgc

SEQ ID NO: 1264548 - RNA, 21 nt, Mycobacterium tuberculosis H37Rv
cgccggcgaagaccgccggga

SEQ ID NO: 1264549 - RNA, 15 nt, Mycobacterium tuberculosis H37Rv
cgccggcgaacugau

SEQ ID NO: 1264550 - RNA, 19 nt, Mycobacterium tuberculosis H37Rv
cgccggccuggccgccaga

SEQ ID NO: 1264551 - RNA, 22 nt, Mycobacterium tuberculosis H37Rv
cgccggccuugagcacccgaua

SEQ ID NO: 1264552 - RNA, 18 nt, Mycobacterium tuberculosis H37Rv
cgccggccgucgaucuuc

SEQ ID NO: 1264553 - RNA, 15 nt, Mycobacterium tuberculosis H37Rv
cgccggccgucagca

SEQ ID NO: 1264554 - RNA, 15 nt, Mycobacterium tuberculosis H37Rv
cgccggccgcgcuga

SEQ ID NO: 1264555 - RNA, 21 nt, Mycobacterium tuberculosis H37Rv
cgccggccgcugccuuggcgc

SEQ ID NO: 1264556 - RNA, 14 nt, Mycobacterium tuberculosis H37Rv
cgccggccgccagc

SEQ ID NO: 1264557 - RNA, 20 nt, Mycobacterium tuberculosis H37Rv
cgccggccccgccgucaccg

SEQ ID NO: 1264558 - RNA, 17 nt, Mycobacterium tuberculosis H37Rv
cgccggcccggugauga

SEQ ID NO: 1264559 - RNA, 15 nt, Mycobacterium tuberculosis H37Rv
cgccggccccgccgu

SEQ ID NO: 1264560 - RNA, 17 nt, Mycobacterium tuberculosis H37Rv
cgccguggauacgcacg

SEQ ID NO: 1264561 - RNA, 19 nt, Mycobacterium tuberculosis H37Rv
cgccguggaucaucccgac

SEQ ID NO: 1264562 - RNA, 21 nt, Mycobacterium tuberculosis H37Rv
cgccguggcgcggucggaguc

SEQ ID NO: 1264563 - RNA, 21 nt, Mycobacterium tuberculosis H37Rv
cgccgucgguaaagggcucga

SEQ ID NO: 1264564 - RNA, 24 nt, Mycobacterium tuberculosis H37Rv
cgccgucgguaaagggcucgaugg

SEQ ID NO: 1264565 - RNA, 16 nt, Mycobacterium tuberculosis H37Rv
cgccgucggugccgcc

SEQ ID NO: 1264566 - RNA, 21 nt, Mycobacterium tuberculosis H37Rv
cgccgugguugcacguucggc

SEQ ID NO: 1264567 - RNA, 20 nt, Mycobacterium tuberculosis H37Rv
cgccgugguggaugagccgg

SEQ ID NO: 1264568 - RNA, 17 nt, Mycobacterium tuberculosis H37Rv
cgccguugccaccggug

SEQ ID NO: 1264569 - RNA, 16 nt, Mycobacterium tuberculosis H37Rv
cgccguugccaagcag

SEQ ID NO: 1264570 - RNA, 16 nt, Mycobacterium tuberculosis H37Rv
cgccguggcgucggcg

SEQ ID NO: 1264571 - RNA, 17 nt, Mycobacterium tuberculosis H37Rv
cgccguugccgccgaag

SEQ ID NO: 1264572 - RNA, 23 nt, Mycobacterium tuberculosis H37Rv
cgccguugccgccgaagccgacg

SEQ ID NO: 1264573 - RNA, 16 nt, Mycobacterium tuberculosis H37Rv
cgccguugccgccgac

SEQ ID NO: 1264574 - RNA, 17 nt, Mycobacterium tuberculosis H37Rv
cgccguugccgaucagc

SEQ ID NO: 1264575 - RNA, 21 nt, Mycobacterium tuberculosis H37Rv
cgccguugccauugccucccg

SEQ ID NO: 1264576 - RNA, 20 nt, Mycobacterium tuberculosis H37Rv
cgccguugccgccgucaccg

SEQ ID NO: 1264577 - RNA, 17 nt, Mycobacterium tuberculosis H37Rv
cgccguugccgccgucg

SEQ ID NO: 1264578 - RNA, 12 nt, Mycobacterium tuberculosis H37Rv
cgccguugccgg

SEQ ID NO: 1264579 - RNA, 21 nt, Mycobacterium tuberculosis H37Rv
cgccguugccgccgacgccgc

SEQ ID NO: 1264580 - RNA, 17 nt, Mycobacterium tuberculosis H37Rv
cgccguugccggccacc

SEQ ID NO: 1264581 - RNA, 14 nt, Mycobacterium tuberculosis H37Rv
cgccguugccgucg

SEQ ID NO: 1264582 - RNA, 13 nt, Mycobacterium tuberculosis H37Rv
cgccguugccguc

SEQ ID NO: 1264583 - RNA, 18 nt, Mycobacterium tuberculosis H37Rv
cgccguugccggcuuggc

SEQ ID NO: 1264584 - RNA, 14 nt, Mycobacterium tuberculosis H37Rv
cgccgucgccgaac

SEQ ID NO: 1264585 - RNA, 20 nt, Mycobacterium tuberculosis H37Rv
cgccgucgccgccaaagccg

SEQ ID NO: 1264586 - RNA, 15 nt, Mycobacterium tuberculosis H37Rv
cgccgucgccgauca

SEQ ID NO: 1264587 - RNA, 12 nt, Mycobacterium tuberculosis H37Rv
cgccgucgccgc

SEQ ID NO: 1264588 - RNA, 21 nt, Mycobacterium tuberculosis H37Rv
cgccgucggagccggccaccu

SEQ ID NO: 1264589 - RNA, 18 nt, Mycobacterium tuberculosis H37Rv
cgccgucggccgagucga

SEQ ID NO: 1264590 - RNA, 15 nt, Mycobacterium tuberculosis H37Rv
cgccgucggacaccg

SEQ ID NO: 1264591 - RNA, 13 nt, Mycobacterium tuberculosis H37Rv
cgccgucggcgcc

SEQ ID NO: 1264592 - RNA, 18 nt, Mycobacterium tuberculosis H37Rv
cgccgucggcgcgcaccu

SEQ ID NO: 1264593 - RNA, 15 nt, Mycobacterium tuberculosis H37Rv
cgccgucggcgauga

SEQ ID NO: 1264594 - RNA, 16 nt, Mycobacterium tuberculosis H37Rv
cgccgguguugccguu

SEQ ID NO: 1264595 - RNA, 17 nt, Mycobacterium tuberculosis H37Rv
cgccgguuacccggacc

SEQ ID NO: 1264596 - RNA, 13 nt, Mycobacterium tuberculosis H37Rv
cgccgucgcagcc

SEQ ID NO: 1264597 - RNA, 14 nt, Mycobacterium tuberculosis H37Rv
cgccgucgccacca

SEQ ID NO: 1264598 - RNA, 15 nt, Mycobacterium tuberculosis H37Rv
cgccgucgccaccgg

SEQ ID NO: 1264599 - RNA, 16 nt, Mycobacterium tuberculosis H37Rv
cgccggugugcgcacc

SEQ ID NO: 1264600 - RNA, 19 nt, Mycobacterium tuberculosis H37Rv
cgccggugucguucggcga

SEQ ID NO: 1264601 - RNA, 14 nt, Mycobacterium tuberculosis H37Rv
cgccggugucgggc

SEQ ID NO: 1264602 - RNA, 15 nt, Mycobacterium tuberculosis H37Rv
cgccggugucggcug

SEQ ID NO: 1264603 - RNA, 20 nt, Mycobacterium tuberculosis H37Rv
cgccgguguaacccucgaac

SEQ ID NO: 1264604 - RNA, 12 nt, Mycobacterium tuberculosis H37Rv
cgccucggcgcu

SEQ ID NO: 1264605 - RNA, 18 nt, Mycobacterium tuberculosis H37Rv
cgccucggacacggcagc

SEQ ID NO: 1264606 - RNA, 19 nt, Mycobacterium tuberculosis H37Rv
cgccuccggcaccuccagc

SEQ ID NO: 1264607 - RNA, 14 nt, Mycobacterium tuberculosis H37Rv
cgccuccagcaggu

SEQ ID NO: 1264608 - RNA, 17 nt, Mycobacterium tuberculosis H37Rv
cgccguugccgccagcg

SEQ ID NO: 1264609 - RNA, 18 nt, Mycobacterium tuberculosis H37Rv
cgccguuugggccguaca

SEQ ID NO: 1264610 - RNA, 18 nt, Mycobacterium tuberculosis H37Rv
cgccguugccgucgucgc

SEQ ID NO: 1264611 - RNA, 16 nt, Mycobacterium tuberculosis H37Rv
cgccguugucggcggu

SEQ ID NO: 1264612 - RNA, 24 nt, Mycobacterium tuberculosis H37Rv
cgccugaugcugccagaucggucg

SEQ ID NO: 1264613 - RNA, 19 nt, Mycobacterium tuberculosis H37Rv
cgccugcaacauccccaug

SEQ ID NO: 1264614 - RNA, 16 nt, Mycobacterium tuberculosis H37Rv
cgccugcgccgccagc

SEQ ID NO: 1264615 - RNA, 14 nt, Mycobacterium tuberculosis H37Rv
cgccugaugcugcc

SEQ ID NO: 1264616 - RNA, 18 nt, Mycobacterium tuberculosis H37Rv
cgccucgguaaagccgcg

SEQ ID NO: 1264617 - RNA, 19 nt, Mycobacterium tuberculosis H37Rv
cgccucguacggaccgucg

SEQ ID NO: 1264618 - RNA, 21 nt, Mycobacterium tuberculosis H37Rv
cgccuggcggcgccgcagauc

SEQ ID NO: 1264619 - RNA, 15 nt, Mycobacterium tuberculosis H37Rv
cgccugugccaccgc

SEQ ID NO: 1264620 - RNA, 13 nt, Mycobacterium tuberculosis H37Rv
cgccugugccgcc

SEQ ID NO: 1264621 - RNA, 16 nt, Mycobacterium tuberculosis H37Rv
cgccugugggugcuau

SEQ ID NO: 1264622 - RNA, 15 nt, Mycobacterium tuberculosis H37Rv
cgccuucacgcuggc

SEQ ID NO: 1264623 - RNA, 17 nt, Mycobacterium tuberculosis H37Rv
cgccuucccagccgacg

SEQ ID NO: 1264624 - RNA, 20 nt, Mycobacterium tuberculosis H37Rv
cgccuggccggaauacccgc

SEQ ID NO: 1264625 - RNA, 23 nt, Mycobacterium tuberculosis H37Rv
cgccugggugagguuggagcgcc

SEQ ID NO: 1264626 - RNA, 15 nt, Mycobacterium tuberculosis H37Rv
cgccuggcuacgcgc

SEQ ID NO: 1264627 - RNA, 22 nt, Mycobacterium tuberculosis H37Rv
cgccuggcuugucauccccgac

SEQ ID NO: 1264628 - RNA, 22 nt, Mycobacterium tuberculosis H37Rv
cgccugggcacggccgucgacg

SEQ ID NO: 1264629 - RNA, 13 nt, Mycobacterium tuberculosis H37Rv
cgccuugacgcca

SEQ ID NO: 1264630 - RNA, 19 nt, Mycobacterium tuberculosis H37Rv
cgccuucggggugcacgcg

SEQ ID NO: 1264631 - RNA, 15 nt, Mycobacterium tuberculosis H37Rv
cgccuugcagcgcgu

SEQ ID NO: 1264632 - RNA, 13 nt, Mycobacterium tuberculosis H37Rv
cgcgaacagcggg

SEQ ID NO: 1264633 - RNA, 17 nt, Mycobacterium tuberculosis H37Rv
cgcgaacccgcgagguu

SEQ ID NO: 1264634 - RNA, 18 nt, Mycobacterium tuberculosis H37Rv
cgcgaacaucgccagcgc

SEQ ID NO: 1264635 - RNA, 15 nt, Mycobacterium tuberculosis H37Rv
cgcgaagaucagcgg

SEQ ID NO: 1264636 - RNA, 19 nt, Mycobacterium tuberculosis H37Rv
cgcgaaccggccaucgacc

SEQ ID NO: 1264637 - RNA, 22 nt, Mycobacterium tuberculosis H37Rv
cgcgaaccgcggaucgaccgcc

SEQ ID NO: 1264638 - RNA, 23 nt, Mycobacterium tuberculosis H37Rv
cgcgaacgaagucgacgaacucg

SEQ ID NO: 1264639 - RNA, 17 nt, Mycobacterium tuberculosis H37Rv
cgcgaaugucgcgcugu

SEQ ID NO: 1264640 - RNA, 22 nt, Mycobacterium tuberculosis H37Rv
cgcgacaauggugcccaggaag

SEQ ID NO: 1264641 - RNA, 14 nt, Mycobacterium tuberculosis H37Rv
cgcgaaggucucga

SEQ ID NO: 1264642 - RNA, 13 nt, Mycobacterium tuberculosis H37Rv
cgcgacaacucgc

SEQ ID NO: 1264643 - RNA, 15 nt, Mycobacterium tuberculosis H37Rv
cgcgacaacccggcg

SEQ ID NO: 1264644 - RNA, 14 nt, Mycobacterium tuberculosis H37Rv
cgcgacccgaucgc

SEQ ID NO: 1264645 - RNA, 16 nt, Mycobacterium tuberculosis H37Rv
cgcgaccaugguggua

SEQ ID NO: 1264646 - RNA, 17 nt, Mycobacterium tuberculosis H37Rv
cgcgaccaucucgacgu

SEQ ID NO: 1264647 - RNA, 23 nt, Mycobacterium tuberculosis H37Rv
cgcgaccaugagcuugguggcca

SEQ ID NO: 1264648 - RNA, 14 nt, Mycobacterium tuberculosis H37Rv
cgcgaccaucucga

SEQ ID NO: 1264649 - RNA, 13 nt, Mycobacterium tuberculosis H37Rv
cgcgaccaggaag

SEQ ID NO: 1264650 - RNA, 17 nt, Mycobacterium tuberculosis H37Rv
cgcgaccacgcaccgcc

SEQ ID NO: 1264651 - RNA, 16 nt, Mycobacterium tuberculosis H37Rv
cgcgaccacgcaccgc

SEQ ID NO: 1264652 - RNA, 14 nt, Mycobacterium tuberculosis H37Rv
cgcgacacgcggcc

SEQ ID NO: 1264653 - RNA, 17 nt, Mycobacterium tuberculosis H37Rv
cgccgcccuaaggggca

SEQ ID NO: 1264654 - RNA, 15 nt, Mycobacterium tuberculosis H37Rv
cgccgccgacgugag

SEQ ID NO: 1264655 - RNA, 20 nt, Mycobacterium tuberculosis H37Rv
cgccgccgacgaaggcgacg

SEQ ID NO: 1264656 - RNA, 14 nt, Mycobacterium tuberculosis H37Rv
cgccgccgacggau

SEQ ID NO: 1264657 - RNA, 14 nt, Mycobacterium tuberculosis H37Rv
cgccgccgaucccg

SEQ ID NO: 1264658 - RNA, 13 nt, Mycobacterium tuberculosis H37Rv
cgccgccgcguuc

SEQ ID NO: 1264659 - RNA, 12 nt, Mycobacterium tuberculosis H37Rv
cgccgccgcgac

SEQ ID NO: 1264660 - RNA, 13 nt, Mycobacterium tuberculosis H37Rv
cgccgccgccgac

SEQ ID NO: 1264661 - RNA, 14 nt, Mycobacterium tuberculosis H37Rv
cgccgccgccaccg

SEQ ID NO: 1264662 - RNA, 13 nt, Mycobacterium tuberculosis H37Rv
cgccgccgccacc

SEQ ID NO: 1264663 - RNA, 21 nt, Mycobacterium tuberculosis H37Rv
cgccgcagaugggccuccacc

SEQ ID NO: 1264664 - RNA, 23 nt, Mycobacterium tuberculosis H37Rv
cgccgcagcaggugcaucgccac

SEQ ID NO: 1264665 - RNA, 12 nt, Mycobacterium tuberculosis H37Rv
cgccgcagcguc

SEQ ID NO: 1264666 - RNA, 19 nt, Mycobacterium tuberculosis H37Rv
cgccgcagcuuguccggug

SEQ ID NO: 1264667 - RNA, 22 nt, Mycobacterium tuberculosis H37Rv
cgccgcagcuccccgaccgaac

SEQ ID NO: 1264668 - RNA, 18 nt, Mycobacterium tuberculosis H37Rv
cgccgccagguugcccgg

SEQ ID NO: 1264669 - RNA, 12 nt, Mycobacterium tuberculosis H37Rv
cgccgcccagcg

SEQ ID NO: 1264670 - RNA, 22 nt, Mycobacterium tuberculosis H37Rv
cgccgauuggcaggcaaugccc

SEQ ID NO: 1264671 - RNA, 21 nt, Mycobacterium tuberculosis H37Rv
cgccgauguggucggcuguca

SEQ ID NO: 1264672 - RNA, 15 nt, Mycobacterium tuberculosis H37Rv
cgccgaugucgacga

SEQ ID NO: 1264673 - RNA, 19 nt, Mycobacterium tuberculosis H37Rv
cgccgcacacucucgguga

SEQ ID NO: 1264674 - RNA, 21 nt, Mycobacterium tuberculosis H37Rv
cgccgcaauggaccgaacgac

SEQ ID NO: 1264675 - RNA, 22 nt, Mycobacterium tuberculosis H37Rv
cgccgcaaugacgucgucggcc

SEQ ID NO: 1264676 - RNA, 18 nt, Mycobacterium tuberculosis H37Rv
cgccgcaaugacgucguc

SEQ ID NO: 1264677 - RNA, 22 nt, Mycobacterium tuberculosis H37Rv
cgccgcaagugucuccggcaac

SEQ ID NO: 1264678 - RNA, 13 nt, Mycobacterium tuberculosis H37Rv
cgccgcaaccgcc

SEQ ID NO: 1264679 - RNA, 19 nt, Mycobacterium tuberculosis H37Rv
cgccgcagaucaccgccag

SEQ ID NO: 1264680 - RNA, 21 nt, Mycobacterium tuberculosis H37Rv
cgccgcagaucaccgccagcu

SEQ ID NO: 1264681 - RNA, 17 nt, Mycobacterium tuberculosis H37Rv
cgccgcagacgccgacu

SEQ ID NO: 1264682 - RNA, 15 nt, Mycobacterium tuberculosis H37Rv
cgccgcacgccggca

SEQ ID NO: 1264683 - RNA, 21 nt, Mycobacterium tuberculosis H37Rv
cgccgcacccgggacguuguc

SEQ ID NO: 1264684 - RNA, 19 nt, Mycobacterium tuberculosis H37Rv
cgccgcaccggaucaccgc

SEQ ID NO: 1264685 - RNA, 18 nt, Mycobacterium tuberculosis H37Rv
cgccgcaccgccgcaucg

SEQ ID NO: 1264686 - RNA, 23 nt, Mycobacterium tuberculosis H37Rv
cgccgcacccacauaccggcgca

SEQ ID NO: 1264687 - RNA, 23 nt, Mycobacterium tuberculosis H37Rv
cgccgcacauugguguccaccac

SEQ ID NO: 1264688 - RNA, 14 nt, Mycobacterium tuberculosis H37Rv
cgccgcacccacau

SEQ ID NO: 1264689 - RNA, 19 nt, Mycobacterium tuberculosis H37Rv
cgccgauguagacgguggc

SEQ ID NO: 1264690 - RNA, 19 nt, Mycobacterium tuberculosis H37Rv
cgccgauguggccggcgau

SEQ ID NO: 1264691 - RNA, 17 nt, Mycobacterium tuberculosis H37Rv
cgccgaugccgccggca

SEQ ID NO: 1264692 - RNA, 18 nt, Mycobacterium tuberculosis H37Rv
cgccgaugccgccggcac

SEQ ID NO: 1264693 - RNA, 14 nt, Mycobacterium tuberculosis H37Rv
cgccgaugccgaac

SEQ ID NO: 1264694 - RNA, 17 nt, Mycobacterium tuberculosis H37Rv
cgccgaugauggacacc

SEQ ID NO: 1264695 - RNA, 17 nt, Mycobacterium tuberculosis H37Rv
cgccgaugaccgcaacc

SEQ ID NO: 1264696 - RNA, 22 nt, Mycobacterium tuberculosis H37Rv
cgccgaugaugugcggugaccg

SEQ ID NO: 1264697 - RNA, 21 nt, Mycobacterium tuberculosis H37Rv
cgccgaucagcgaaccaccgg

SEQ ID NO: 1264698 - RNA, 14 nt, Mycobacterium tuberculosis H37Rv
cgccgaaaucggcc

SEQ ID NO: 1264699 - RNA, 23 nt, Mycobacterium tuberculosis H37Rv
cgccgaaaccgggacaaucucgg

SEQ ID NO: 1264700 - RNA, 15 nt, Mycobacterium tuberculosis H37Rv
cgccgaaaucggcca

SEQ ID NO: 1264701 - RNA, 13 nt, Mycobacterium tuberculosis H37Rv
cgccgaacaccga

SEQ ID NO: 1264702 - RNA, 17 nt, Mycobacterium tuberculosis H37Rv
cgccgaagccgacgaac

SEQ ID NO: 1264703 - RNA, 13 nt, Mycobacterium tuberculosis H37Rv
cgccgaagccgac

SEQ ID NO: 1264704 - RNA, 14 nt, Mycobacterium tuberculosis H37Rv
cgccgaaggcggcc

SEQ ID NO: 1264705 - RNA, 14 nt, Mycobacterium tuberculosis H37Rv
cgccgacaccaccg

SEQ ID NO: 1264706 - RNA, 17 nt, Mycobacterium tuberculosis H37Rv
cgccgacaccacggcgc

SEQ ID NO: 1264707 - RNA, 17 nt, Mycobacterium tuberculosis H37Rv
cgccgacaauggcagcg

SEQ ID NO: 1264708 - RNA, 12 nt, Mycobacterium tuberculosis H37Rv
cgccgacaccgg

SEQ ID NO: 1264709 - RNA, 18 nt, Mycobacterium tuberculosis H37Rv
cgccgaagcucaucgccg

SEQ ID NO: 1264710 - RNA, 23 nt, Mycobacterium tuberculosis H37Rv
cgccgacaaccccgccaggaucu

SEQ ID NO: 1264711 - RNA, 15 nt, Mycobacterium tuberculosis H37Rv
cgcccggucucgacg

SEQ ID NO: 1264712 - RNA, 13 nt, Mycobacterium tuberculosis H37Rv
cgcccggucgagc

SEQ ID NO: 1264713 - RNA, 14 nt, Mycobacterium tuberculosis H37Rv
cgcccggucgagcc

SEQ ID NO: 1264714 - RNA, 14 nt, Mycobacterium tuberculosis H37Rv
cgcccgguugaccg

SEQ ID NO: 1264715 - RNA, 15 nt, Mycobacterium tuberculosis H37Rv
cgcccggucacgcug

SEQ ID NO: 1264716 - RNA, 18 nt, Mycobacterium tuberculosis H37Rv
cgcccgggucccggcagc

SEQ ID NO: 1264717 - RNA, 22 nt, Mycobacterium tuberculosis H37Rv
cgcccgggguguucgucgacca

SEQ ID NO: 1264718 - RNA, 23 nt, Mycobacterium tuberculosis H37Rv
cgcccuggacgucggcgauaucg

SEQ ID NO: 1264719 - RNA, 22 nt, Mycobacterium tuberculosis H37Rv
cgcccuggcaacgacacgccgc

SEQ ID NO: 1264720 - RNA, 18 nt, Mycobacterium tuberculosis H37Rv
cgcccuggacgucggcga

SEQ ID NO: 1264721 - RNA, 14 nt, Mycobacterium tuberculosis H37Rv
cgcccuggaaugcc

SEQ ID NO: 1264722 - RNA, 22 nt, Mycobacterium tuberculosis H37Rv
cgcccuggccgcccagaccgcc

SEQ ID NO: 1264723 - RNA, 13 nt, Mycobacterium tuberculosis H37Rv
cgccgacgccguu

SEQ ID NO: 1264724 - RNA, 12 nt, Mycobacterium tuberculosis H37Rv
cgccgacgccgc

SEQ ID NO: 1264725 - RNA, 15 nt, Mycobacterium tuberculosis H37Rv
cgccgacggccagca

SEQ ID NO: 1264726 - RNA, 20 nt, Mycobacterium tuberculosis H37Rv
cgccgacggccagcaggaug

SEQ ID NO: 1264727 - RNA, 18 nt, Mycobacterium tuberculosis H37Rv
cgccgacggccagcagga

SEQ ID NO: 1264728 - RNA, 21 nt, Mycobacterium tuberculosis H37Rv
cgccgacggccagcaggauga

SEQ ID NO: 1264729 - RNA, 20 nt, Mycobacterium tuberculosis H37Rv
cgccgaccggagccgccgga

SEQ ID NO: 1264730 - RNA, 21 nt, Mycobacterium tuberculosis H37Rv
cgccgaccgacaccaccaggu

SEQ ID NO: 1264731 - RNA, 17 nt, Mycobacterium tuberculosis H37Rv
cgccgacccgaucaccu

SEQ ID NO: 1264732 - RNA, 13 nt, Mycobacterium tuberculosis H37Rv
cgccgaccgcgcc

SEQ ID NO: 1264733 - RNA, 18 nt, Mycobacterium tuberculosis H37Rv
cgccgacaccggcugacc

SEQ ID NO: 1264734 - RNA, 15 nt, Mycobacterium tuberculosis H37Rv
cgccgacaccggcug

SEQ ID NO: 1264735 - RNA, 23 nt, Mycobacterium tuberculosis H37Rv
cgccgacagaugugguaccagcc

SEQ ID NO: 1264736 - RNA, 22 nt, Mycobacterium tuberculosis H37Rv
cgccgacagccgauccgaucgc

SEQ ID NO: 1264737 - RNA, 20 nt, Mycobacterium tuberculosis H37Rv
cgccgacaggugaaggugcc

SEQ ID NO: 1264738 - RNA, 13 nt, Mycobacterium tuberculosis H37Rv
cgccgacccguac

SEQ ID NO: 1264739 - RNA, 21 nt, Mycobacterium tuberculosis H37Rv
cgccgaggacacauugaccag

SEQ ID NO: 1264740 - RNA, 20 nt, Mycobacterium tuberculosis H37Rv
cgccgaggcagcgucgucga

SEQ ID NO: 1264741 - RNA, 22 nt, Mycobacterium tuberculosis H37Rv
cgccgaggcagcgucgucgacg

SEQ ID NO: 1264742 - RNA, 16 nt, Mycobacterium tuberculosis H37Rv
cgccgaucaccaccgg

SEQ ID NO: 1264743 - RNA, 17 nt, Mycobacterium tuberculosis H37Rv
cgccgaggccucggcca

SEQ ID NO: 1264744 - RNA, 19 nt, Mycobacterium tuberculosis H37Rv
cgccgaggccuaccaggcg

SEQ ID NO: 1264745 - RNA, 15 nt, Mycobacterium tuberculosis H37Rv
cgccgaggccgccgu

SEQ ID NO: 1264746 - RNA, 17 nt, Mycobacterium tuberculosis H37Rv
cgccgaucaacaugccg

SEQ ID NO: 1264747 - RNA, 22 nt, Mycobacterium tuberculosis H37Rv
cgccgagccagcacccgcagcc

SEQ ID NO: 1264748 - RNA, 16 nt, Mycobacterium tuberculosis H37Rv
cgccgagaacgauguc

SEQ ID NO: 1264749 - RNA, 14 nt, Mycobacterium tuberculosis H37Rv
cgccgagaccgccg

SEQ ID NO: 1264750 - RNA, 13 nt, Mycobacterium tuberculosis H37Rv
cgccgagaccgcc

SEQ ID NO: 1264751 - RNA, 16 nt, Mycobacterium tuberculosis H37Rv
cgccgagcagacgcag

SEQ ID NO: 1264752 - RNA, 14 nt, Mycobacterium tuberculosis H37Rv
cgcccagucgccgc

SEQ ID NO: 1264753 - RNA, 18 nt, Mycobacterium tuberculosis H37Rv
cgcccaggugaucgcgag

SEQ ID NO: 1264754 - RNA, 15 nt, Mycobacterium tuberculosis H37Rv
cgcccaggcguccau

SEQ ID NO: 1264755 - RNA, 18 nt, Mycobacterium tuberculosis H37Rv
cgcccagugugcgccgug

SEQ ID NO: 1264756 - RNA, 18 nt, Mycobacterium tuberculosis H37Rv
cgccccagcugcggucgc

SEQ ID NO: 1264757 - RNA, 18 nt, Mycobacterium tuberculosis H37Rv
cgcccauggccaccaggg

SEQ ID NO: 1264758 - RNA, 15 nt, Mycobacterium tuberculosis H37Rv
cgccccaugcaacac

SEQ ID NO: 1264759 - RNA, 20 nt, Mycobacterium tuberculosis H37Rv
cgccccaugaugaacagcuc

SEQ ID NO: 1264760 - RNA, 19 nt, Mycobacterium tuberculosis H37Rv
cgccccccacggcccguug

SEQ ID NO: 1264761 - RNA, 18 nt, Mycobacterium tuberculosis H37Rv
cgcccccauccggucgau

SEQ ID NO: 1264762 - RNA, 14 nt, Mycobacterium tuberculosis H37Rv
cgccccgugggccu

SEQ ID NO: 1264763 - RNA, 15 nt, Mycobacterium tuberculosis H37Rv
cgcccggcaguucgc

SEQ ID NO: 1264764 - RNA, 15 nt, Mycobacterium tuberculosis H37Rv
cgcccggccagcucg

SEQ ID NO: 1264765 - RNA, 16 nt, Mycobacterium tuberculosis H37Rv
cgcccggccagcucgg

SEQ ID NO: 1264766 - RNA, 19 nt, Mycobacterium tuberculosis H37Rv
cgcccgcuucagcacggug

SEQ ID NO: 1264767 - RNA, 18 nt, Mycobacterium tuberculosis H37Rv
cgcccgcucggccgcagc

SEQ ID NO: 1264768 - RNA, 16 nt, Mycobacterium tuberculosis H37Rv
cgcccgcugagccagc

SEQ ID NO: 1264769 - RNA, 19 nt, Mycobacterium tuberculosis H37Rv
cgcccgcugagccagcucc

SEQ ID NO: 1264770 - RNA, 13 nt, Mycobacterium tuberculosis H37Rv
cgcccgcugcaga

SEQ ID NO: 1264771 - RNA, 15 nt, Mycobacterium tuberculosis H37Rv
cgcccgcugcagacg

SEQ ID NO: 1264772 - RNA, 18 nt, Mycobacterium tuberculosis H37Rv
cgcccgcuccgccgucgc

SEQ ID NO: 1264773 - RNA, 14 nt, Mycobacterium tuberculosis H37Rv
cgcccgcuccgcgg

SEQ ID NO: 1264774 - RNA, 14 nt, Mycobacterium tuberculosis H37Rv
cgcccgcucggccg

SEQ ID NO: 1264775 - RNA, 14 nt, Mycobacterium tuberculosis H37Rv
cgcccggcgcuagc

SEQ ID NO: 1264776 - RNA, 19 nt, Mycobacterium tuberculosis H37Rv
cgcccggcgcaccaucgcg

SEQ ID NO: 1264777 - RNA, 18 nt, Mycobacterium tuberculosis H37Rv
cgcccggccaggucgaca

SEQ ID NO: 1264778 - RNA, 21 nt, Mycobacterium tuberculosis H37Rv
cgcccggccccgcaagcggau

SEQ ID NO: 1264779 - RNA, 19 nt, Mycobacterium tuberculosis H37Rv
cgcccgcaccguggacacc

SEQ ID NO: 1264780 - RNA, 12 nt, Mycobacterium tuberculosis H37Rv
cgcccgacaccc

SEQ ID NO: 1264781 - RNA, 17 nt, Mycobacterium tuberculosis H37Rv
cgcccgaaaaacgaccc

SEQ ID NO: 1264782 - RNA, 14 nt, Mycobacterium tuberculosis H37Rv
cgccccugucgacc

SEQ ID NO: 1264783 - RNA, 15 nt, Mycobacterium tuberculosis H37Rv
cgccccugucgaccg

SEQ ID NO: 1264784 - RNA, 18 nt, Mycobacterium tuberculosis H37Rv
cgccccguuucggucgac

SEQ ID NO: 1264785 - RNA, 20 nt, Mycobacterium tuberculosis H37Rv
cgcccgcacguucacgcgcg

SEQ ID NO: 1264786 - RNA, 22 nt, Mycobacterium tuberculosis H37Rv
cgcccgcaucgcggcaucgacg

SEQ ID NO: 1264787 - RNA, 13 nt, Mycobacterium tuberculosis H37Rv
cgcccgcgccacc

SEQ ID NO: 1264788 - RNA, 15 nt, Mycobacterium tuberculosis H37Rv
cgcccgcgccaccga

SEQ ID NO: 1264789 - RNA, 14 nt, Mycobacterium tuberculosis H37Rv
cgcccgcgagcugu

SEQ ID NO: 1264790 - RNA, 15 nt, Mycobacterium tuberculosis H37Rv
cgcccgcgccaccgg

SEQ ID NO: 1264791 - RNA, 16 nt, Mycobacterium tuberculosis H37Rv
cgcccgcgcccccggu

SEQ ID NO: 1264792 - RNA, 17 nt, Mycobacterium tuberculosis H37Rv
cgcccgcgccuccguug

SEQ ID NO: 1264793 - RNA, 15 nt, Mycobacterium tuberculosis H37Rv
cgcccgccaccgggu

SEQ ID NO: 1264794 - RNA, 24 nt, Mycobacterium tuberculosis H37Rv
cgcccaagccguaguaguggccgc

SEQ ID NO: 1264795 - RNA, 21 nt, Mycobacterium tuberculosis H37Rv
cgcccaauuucgucucgaaau

SEQ ID NO: 1264796 - RNA, 17 nt, Mycobacterium tuberculosis H37Rv
cgcccaauuucgucucg

SEQ ID NO: 1264797 - RNA, 20 nt, Mycobacterium tuberculosis H37Rv
cgcccaauucggcacgaaau

SEQ ID NO: 1264798 - RNA, 19 nt, Mycobacterium tuberculosis H37Rv
cgcccacagcugacgagcc

SEQ ID NO: 1264799 - RNA, 18 nt, Mycobacterium tuberculosis H37Rv
cgcccaacaacgcuucgg

SEQ ID NO: 1264800 - RNA, 19 nt, Mycobacterium tuberculosis H37Rv
cgcccaaaacgucaccgcc

SEQ ID NO: 1264801 - RNA, 13 nt, Mycobacterium tuberculosis H37Rv
cgcccaacaccgc

SEQ ID NO: 1264802 - RNA, 18 nt, Mycobacterium tuberculosis H37Rv
cgccauuggcgccgccga

SEQ ID NO: 1264803 - RNA, 22 nt, Mycobacterium tuberculosis H37Rv
cgccauuccagccggugccgcc

SEQ ID NO: 1264804 - RNA, 13 nt, Mycobacterium tuberculosis H37Rv
cgccauucaucgg

SEQ ID NO: 1264805 - RNA, 19 nt, Mycobacterium tuberculosis H37Rv
cgccauguugaagcgaagc

SEQ ID NO: 1264806 - RNA, 18 nt, Mycobacterium tuberculosis H37Rv
cgccaggaacucggccca

SEQ ID NO: 1264807 - RNA, 14 nt, Mycobacterium tuberculosis H37Rv
cgccaugcgcacca

SEQ ID NO: 1264808 - RNA, 23 nt, Mycobacterium tuberculosis H37Rv
cgccaggaucugguugaaccggu

SEQ ID NO: 1264809 - RNA, 17 nt, Mycobacterium tuberculosis H37Rv
cgccauggccgccguug

SEQ ID NO: 1264810 - RNA, 15 nt, Mycobacterium tuberculosis H37Rv
cgccaugucggccag

SEQ ID NO: 1264811 - RNA, 21 nt, Mycobacterium tuberculosis H37Rv
cgcccagccacugacggcuuc

SEQ ID NO: 1264812 - RNA, 16 nt, Mycobacterium tuberculosis H37Rv
cgcccagcgacccggc

SEQ ID NO: 1264813 - RNA, 14 nt, Mycobacterium tuberculosis H37Rv
cgcccagccgcagc

SEQ ID NO: 1264814 - RNA, 15 nt, Mycobacterium tuberculosis H37Rv
cgcccagccgagcgu

SEQ ID NO: 1264815 - RNA, 17 nt, Mycobacterium tuberculosis H37Rv
cgcccaggccgaucagc

SEQ ID NO: 1264816 - RNA, 23 nt, Mycobacterium tuberculosis H37Rv
cgcccagcguugucggguggcug

SEQ ID NO: 1264817 - RNA, 13 nt, Mycobacterium tuberculosis H37Rv
cgcccaccucgau

SEQ ID NO: 1264818 - RNA, 13 nt, Mycobacterium tuberculosis H37Rv
cgcccaccggucg

SEQ ID NO: 1264819 - RNA, 13 nt, Mycobacterium tuberculosis H37Rv
cgcccaccccggc

SEQ ID NO: 1264820 - RNA, 21 nt, Mycobacterium tuberculosis H37Rv
cgcccacaugccgguugcggc

SEQ ID NO: 1264821 - RNA, 24 nt, Mycobacterium tuberculosis H37Rv
cgcccacccgcugcgagaucgcgg

SEQ ID NO: 1264822 - RNA, 18 nt, Mycobacterium tuberculosis H37Rv
cgcccacaugcgcucgcg

SEQ ID NO: 1264823 - RNA, 22 nt, Mycobacterium tuberculosis H37Rv
cgcccaccaugaucacaccgag

SEQ ID NO: 1264824 - RNA, 14 nt, Mycobacterium tuberculosis H37Rv
cgcccaccacugug

SEQ ID NO: 1264825 - RNA, 14 nt, Mycobacterium tuberculosis H37Rv
cgcccaccacgcga

SEQ ID NO: 1264826 - RNA, 23 nt, Mycobacterium tuberculosis H37Rv
cgcccagagugaauccggcauac

SEQ ID NO: 1264827 - RNA, 14 nt, Mycobacterium tuberculosis H37Rv
cgcccagaucgccg

SEQ ID NO: 1264828 - RNA, 15 nt, Mycobacterium tuberculosis H37Rv
cgcccagaccgccga

SEQ ID NO: 1264829 - RNA, 22 nt, Mycobacterium tuberculosis H37Rv
cgcccagauguuuagcguccga

SEQ ID NO: 1264830 - RNA, 16 nt, Mycobacterium tuberculosis H37Rv
cgcccaccucgaucgc

SEQ ID NO: 1264831 - RNA, 17 nt, Mycobacterium tuberculosis H37Rv
cgcccacuccagcagcu

SEQ ID NO: 1264832 - RNA, 13 nt, Mycobacterium tuberculosis H37Rv
cgcccacgcugcc

SEQ ID NO: 1264833 - RNA, 16 nt, Mycobacterium tuberculosis H37Rv
cgcccacuauggcccg

SEQ ID NO: 1264834 - RNA, 18 nt, Mycobacterium tuberculosis H37Rv
cgggccguacacaccgag

SEQ ID NO: 1264835 - RNA, 17 nt, Mycobacterium tuberculosis H37Rv
cgggccggucggugagc

SEQ ID NO: 1264836 - RNA, 21 nt, Mycobacterium tuberculosis H37Rv
cgggcgagaucuuuucaccac

SEQ ID NO: 1264837 - RNA, 17 nt, Mycobacterium tuberculosis H37Rv
cgggcgaccaccaccgc

SEQ ID NO: 1264838 - RNA, 14 nt, Mycobacterium tuberculosis H37Rv
cgggcgaccaccgc

SEQ ID NO: 1264839 - RNA, 13 nt, Mycobacterium tuberculosis H37Rv
cgggcgacccguu

SEQ ID NO: 1264840 - RNA, 21 nt, Mycobacterium tuberculosis H37Rv
cgggcgaccuccggaaucgcc

SEQ ID NO: 1264841 - RNA, 22 nt, Mycobacterium tuberculosis H37Rv
cgggcgaccugcggacccaccg

SEQ ID NO: 1264842 - RNA, 21 nt, Mycobacterium tuberculosis H37Rv
cgggccgcugugggucgaucc

SEQ ID NO: 1264843 - RNA, 19 nt, Mycobacterium tuberculosis H37Rv
cgggccgcgucgaacuggg

SEQ ID NO: 1264844 - RNA, 19 nt, Mycobacterium tuberculosis H37Rv
cgggccgcgguacccaccu

SEQ ID NO: 1264845 - RNA, 17 nt, Mycobacterium tuberculosis H37Rv
cgggccggcaucgucgg

SEQ ID NO: 1264846 - RNA, 14 nt, Mycobacterium tuberculosis H37Rv
cgggccgaucaccc

SEQ ID NO: 1264847 - RNA, 16 nt, Mycobacterium tuberculosis H37Rv
cgggccggcaucgucg

SEQ ID NO: 1264848 - RNA, 18 nt, Mycobacterium tuberculosis H37Rv
cgggccgcggccacaucg

SEQ ID NO: 1264849 - RNA, 23 nt, Mycobacterium tuberculosis H37Rv
cgggccgagaucacgccgggcga

SEQ ID NO: 1264850 - RNA, 14 nt, Mycobacterium tuberculosis H37Rv
cgggcccagcagcg

SEQ ID NO: 1264851 - RNA, 23 nt, Mycobacterium tuberculosis H37Rv
cgggccccacaucgccccccagu

SEQ ID NO: 1264852 - RNA, 17 nt, Mycobacterium tuberculosis H37Rv
cgggcccccggcagcau

SEQ ID NO: 1264853 - RNA, 16 nt, Mycobacterium tuberculosis H37Rv
cgggccgacgcaggug

SEQ ID NO: 1264854 - RNA, 23 nt, Mycobacterium tuberculosis H37Rv
cgggccgaccagagcuucgccgc

SEQ ID NO: 1264855 - RNA, 14 nt, Mycobacterium tuberculosis H37Rv
cgggcccgacguug

SEQ ID NO: 1264856 - RNA, 15 nt, Mycobacterium tuberculosis H37Rv
cgggcccgacgacga

SEQ ID NO: 1264857 - RNA, 13 nt, Mycobacterium tuberculosis H37Rv
cgggcccgacgac

SEQ ID NO: 1264858 - RNA, 12 nt, Mycobacterium tuberculosis H37Rv
cgggcccgccgu

SEQ ID NO: 1264859 - RNA, 22 nt, Mycobacterium tuberculosis H37Rv
cgggcauuucguggcacggguc

SEQ ID NO: 1264860 - RNA, 14 nt, Mycobacterium tuberculosis H37Rv
cgggccaaagccgu

SEQ ID NO: 1264861 - RNA, 16 nt, Mycobacterium tuberculosis H37Rv
cgggcauggucgccgg

SEQ ID NO: 1264862 - RNA, 13 nt, Mycobacterium tuberculosis H37Rv
cgggcaucgcgaa

SEQ ID NO: 1264863 - RNA, 17 nt, Mycobacterium tuberculosis H37Rv
cgggcaugcucuggcaa

SEQ ID NO: 1264864 - RNA, 20 nt, Mycobacterium tuberculosis H37Rv
cgggcaugcgccguagccga

SEQ ID NO: 1264865 - RNA, 15 nt, Mycobacterium tuberculosis H37Rv
cgggcagggaccgca

SEQ ID NO: 1264866 - RNA, 12 nt, Mycobacterium tuberculosis H37Rv
cgggcaggccgu

SEQ ID NO: 1264867 - RNA, 18 nt, Mycobacterium tuberculosis H37Rv
cgggcauccuucaccagc

SEQ ID NO: 1264868 - RNA, 16 nt, Mycobacterium tuberculosis H37Rv
cgggcaucggcgguuc

SEQ ID NO: 1264869 - RNA, 21 nt, Mycobacterium tuberculosis H37Rv
cgggcagcuguucggccaacc

SEQ ID NO: 1264870 - RNA, 21 nt, Mycobacterium tuberculosis H37Rv
cgggcaggagcagcacgucga

SEQ ID NO: 1264871 - RNA, 18 nt, Mycobacterium tuberculosis H37Rv
cgggcagcgcggccagug

SEQ ID NO: 1264872 - RNA, 14 nt, Mycobacterium tuberculosis H37Rv
cgggaauccgguga

SEQ ID NO: 1264873 - RNA, 20 nt, Mycobacterium tuberculosis H37Rv
cgggcacaccgacgccgcca

SEQ ID NO: 1264874 - RNA, 14 nt, Mycobacterium tuberculosis H37Rv
cgggaagugcaccc

SEQ ID NO: 1264875 - RNA, 20 nt, Mycobacterium tuberculosis H37Rv
cgggaagucgcugaagccgu

SEQ ID NO: 1264876 - RNA, 13 nt, Mycobacterium tuberculosis H37Rv
cgggaagucgcug

SEQ ID NO: 1264877 - RNA, 18 nt, Mycobacterium tuberculosis H37Rv
cgggaaggaaccgggcaa

SEQ ID NO: 1264878 - RNA, 20 nt, Mycobacterium tuberculosis H37Rv
cgggcacucagcaggggauc

SEQ ID NO: 1264879 - RNA, 15 nt, Mycobacterium tuberculosis H37Rv
cgggcacucagcagg

SEQ ID NO: 1264880 - RNA, 20 nt, Mycobacterium tuberculosis H37Rv
cgggcacgcgaggcgcucac

SEQ ID NO: 1264881 - RNA, 22 nt, Mycobacterium tuberculosis H37Rv
cgggcacgcggcgaugauggcg

SEQ ID NO: 1264882 - RNA, 13 nt, Mycobacterium tuberculosis H37Rv
cgggcacggguga

SEQ ID NO: 1264883 - RNA, 22 nt, Mycobacterium tuberculosis H37Rv
cgggcacgcccucgucgaucgc

SEQ ID NO: 1264884 - RNA, 23 nt, Mycobacterium tuberculosis H37Rv
cgggcacgcccucgucgaucgcc

SEQ ID NO: 1264885 - RNA, 17 nt, Mycobacterium tuberculosis H37Rv
cgggcacgccgccgacg

SEQ ID NO: 1264886 - RNA, 17 nt, Mycobacterium tuberculosis H37Rv
cgggcacaucgcacaac

SEQ ID NO: 1264887 - RNA, 19 nt, Mycobacterium tuberculosis H37Rv
cgggcgaguacaggcgcag

SEQ ID NO: 1264888 - RNA, 21 nt, Mycobacterium tuberculosis H37Rv
cgggcgaguagucgacgucga

SEQ ID NO: 1264889 - RNA, 21 nt, Mycobacterium tuberculosis H37Rv
cgggcgaguacaggcgcagcg

SEQ ID NO: 1264890 - RNA, 13 nt, Mycobacterium tuberculosis H37Rv
cgggcgaucucga

SEQ ID NO: 1264891 - RNA, 19 nt, Mycobacterium tuberculosis H37Rv
cgggcgaucucggcgagca

SEQ ID NO: 1264892 - RNA, 15 nt, Mycobacterium tuberculosis H37Rv
cgggcgaucgccugg

SEQ ID NO: 1264893 - RNA, 17 nt, Mycobacterium tuberculosis H37Rv
cgggcgauuucggcgcc

SEQ ID NO: 1264894 - RNA, 17 nt, Mycobacterium tuberculosis H37Rv
cgggcgaucuuggcgac

SEQ ID NO: 1264895 - RNA, 13 nt, Mycobacterium tuberculosis H37Rv
cgggcgcaccagg

SEQ ID NO: 1264896 - RNA, 22 nt, Mycobacterium tuberculosis H37Rv
cgggcgcacgguccacgguggc

SEQ ID NO: 1264897 - RNA, 14 nt, Mycobacterium tuberculosis H37Rv
cgggcgcaccaggg

SEQ ID NO: 1264898 - RNA, 16 nt, Mycobacterium tuberculosis H37Rv
cgggcgcacgcccgca

SEQ ID NO: 1264899 - RNA, 16 nt, Mycobacterium tuberculosis H37Rv
cgggcgccgcagcgcu

SEQ ID NO: 1264900 - RNA, 15 nt, Mycobacterium tuberculosis H37Rv
cgggcgccgaucacg

SEQ ID NO: 1264901 - RNA, 19 nt, Mycobacterium tuberculosis H37Rv
cgggcgcccaugcugacac

SEQ ID NO: 1264902 - RNA, 15 nt, Mycobacterium tuberculosis H37Rv
cgggcgccaacgggc

SEQ ID NO: 1264903 - RNA, 18 nt, Mycobacterium tuberculosis H37Rv
cgggcggaaaagaacccg

SEQ ID NO: 1264904 - RNA, 19 nt, Mycobacterium tuberculosis H37Rv
cgggcggaaaagaacccgg

SEQ ID NO: 1264905 - RNA, 18 nt, Mycobacterium tuberculosis H37Rv
cgggcgcuugcaccaggg

SEQ ID NO: 1264906 - RNA, 12 nt, Mycobacterium tuberculosis H37Rv
cgggcgcguugc

SEQ ID NO: 1264907 - RNA, 17 nt, Mycobacterium tuberculosis H37Rv
cgggcgcgucggcguug

SEQ ID NO: 1264908 - RNA, 14 nt, Mycobacterium tuberculosis H37Rv
cgggcgcgaaaccg

SEQ ID NO: 1264909 - RNA, 21 nt, Mycobacterium tuberculosis H37Rv
cgggcgcggguggcgccaguu

SEQ ID NO: 1264910 - RNA, 20 nt, Mycobacterium tuberculosis H37Rv
cgggcgcguccucgccgcac

SEQ ID NO: 1264911 - RNA, 12 nt, Mycobacterium tuberculosis H37Rv
cgggcgcgcugc

SEQ ID NO: 1264912 - RNA, 15 nt, Mycobacterium tuberculosis H37Rv
cgggcgcgcucgugg

SEQ ID NO: 1264913 - RNA, 18 nt, Mycobacterium tuberculosis H37Rv
cgggcgccuuggucgccg

SEQ ID NO: 1264914 - RNA, 17 nt, Mycobacterium tuberculosis H37Rv
cgggcgccuuggucgcc

SEQ ID NO: 1264915 - RNA, 21 nt, Mycobacterium tuberculosis H37Rv
cgggcgccucggugacgucgc

SEQ ID NO: 1264916 - RNA, 15 nt, Mycobacterium tuberculosis H37Rv
cgggcucgcccgcua

SEQ ID NO: 1264917 - RNA, 15 nt, Mycobacterium tuberculosis H37Rv
cgggcucagcggcga

SEQ ID NO: 1264918 - RNA, 17 nt, Mycobacterium tuberculosis H37Rv
cgggcuccccaagucga

SEQ ID NO: 1264919 - RNA, 12 nt, Mycobacterium tuberculosis H37Rv
cgggcuccccgc

SEQ ID NO: 1264920 - RNA, 17 nt, Mycobacterium tuberculosis H37Rv
cgggcucacaugugcgc

SEQ ID NO: 1264921 - RNA, 13 nt, Mycobacterium tuberculosis H37Rv
cgggcggugaaga

SEQ ID NO: 1264922 - RNA, 21 nt, Mycobacterium tuberculosis H37Rv
cgggcgugccgaccagcaucu

SEQ ID NO: 1264923 - RNA, 18 nt, Mycobacterium tuberculosis H37Rv
cgggcgugccgaccagca

SEQ ID NO: 1264924 - RNA, 19 nt, Mycobacterium tuberculosis H37Rv
cgggcgugcuacacccgua

SEQ ID NO: 1264925 - RNA, 23 nt, Mycobacterium tuberculosis H37Rv
cgggcgucgucggugaucaccgc

SEQ ID NO: 1264926 - RNA, 14 nt, Mycobacterium tuberculosis H37Rv
cgggcgugccgacc

SEQ ID NO: 1264927 - RNA, 13 nt, Mycobacterium tuberculosis H37Rv
cgggcgucgucgg

SEQ ID NO: 1264928 - RNA, 21 nt, Mycobacterium tuberculosis H37Rv
cgggcguccacgcugaccaac

SEQ ID NO: 1264929 - RNA, 13 nt, Mycobacterium tuberculosis H37Rv
cgggcgucgaggu

SEQ ID NO: 1264930 - RNA, 23 nt, Mycobacterium tuberculosis H37Rv
cgggcgucacggugcguucgugc

SEQ ID NO: 1264931 - RNA, 21 nt, Mycobacterium tuberculosis H37Rv
cgggcgucccggcggucagcg

SEQ ID NO: 1264932 - RNA, 13 nt, Mycobacterium tuberculosis H37Rv
cgggcguccacgc

SEQ ID NO: 1264933 - RNA, 21 nt, Mycobacterium tuberculosis H37Rv
cgggcgucagcaguucggcga

SEQ ID NO: 1264934 - RNA, 16 nt, Mycobacterium tuberculosis H37Rv
cgggcggugaggcagc

SEQ ID NO: 1264935 - RNA, 15 nt, Mycobacterium tuberculosis H37Rv
cgggcgggauccacc

SEQ ID NO: 1264936 - RNA, 16 nt, Mycobacterium tuberculosis H37Rv
cgggcggucgaagacc

SEQ ID NO: 1264937 - RNA, 24 nt, Mycobacterium tuberculosis H37Rv
cgggcggucgagcuucaucccgga

SEQ ID NO: 1264938 - RNA, 17 nt, Mycobacterium tuberculosis H37Rv
cgggcgguaaucgcgag

SEQ ID NO: 1264939 - RNA, 17 nt, Mycobacterium tuberculosis H37Rv
cgggcgggacucggcga

SEQ ID NO: 1264940 - RNA, 15 nt, Mycobacterium tuberculosis H37Rv
cgggcggccucccgg

SEQ ID NO: 1264941 - RNA, 17 nt, Mycobacterium tuberculosis H37Rv
cgggcggccaggcgcga

SEQ ID NO: 1264942 - RNA, 13 nt, Mycobacterium tuberculosis H37Rv
cgggcggccagcu

SEQ ID NO: 1264943 - RNA, 14 nt, Mycobacterium tuberculosis H37Rv
cgggcggccaccgc

SEQ ID NO: 1264944 - RNA, 12 nt, Mycobacterium tuberculosis H37Rv
cgggcggcaccg

SEQ ID NO: 1264945 - RNA, 14 nt, Mycobacterium tuberculosis H37Rv
cgggcggcaucgcc

SEQ ID NO: 1264946 - RNA, 19 nt, Mycobacterium tuberculosis H37Rv
cgggcggaugcuguugacc

SEQ ID NO: 1264947 - RNA, 20 nt, Mycobacterium tuberculosis H37Rv
cgggucggcacgacccggga

SEQ ID NO: 1264948 - RNA, 18 nt, Mycobacterium tuberculosis H37Rv
cgggucggcacgacccgg

SEQ ID NO: 1264949 - RNA, 15 nt, Mycobacterium tuberculosis H37Rv
cgggucggcacgacc

SEQ ID NO: 1264950 - RNA, 14 nt, Mycobacterium tuberculosis H37Rv
cgggucguucgggu

SEQ ID NO: 1264951 - RNA, 19 nt, Mycobacterium tuberculosis H37Rv
cgggucguucgggugagca

SEQ ID NO: 1264952 - RNA, 12 nt, Mycobacterium tuberculosis H37Rv
cgggucggccau

SEQ ID NO: 1264953 - RNA, 20 nt, Mycobacterium tuberculosis H37Rv
cgggucgucggcgucggugg

SEQ ID NO: 1264954 - RNA, 15 nt, Mycobacterium tuberculosis H37Rv
cgggucgugcgacaa

SEQ ID NO: 1264955 - RNA, 19 nt, Mycobacterium tuberculosis H37Rv
cggguauugaaguucgggc

SEQ ID NO: 1264956 - RNA, 23 nt, Mycobacterium tuberculosis H37Rv
cggguaucgccaguggugcaccg

SEQ ID NO: 1264957 - RNA, 22 nt, Mycobacterium tuberculosis H37Rv
cgggucaacgccaucaccccgg

SEQ ID NO: 1264958 - RNA, 23 nt, Mycobacterium tuberculosis H37Rv
cggguccaagaaccacgacguug

SEQ ID NO: 1264959 - RNA, 17 nt, Mycobacterium tuberculosis H37Rv
cgggucccaaucgucgg

SEQ ID NO: 1264960 - RNA, 18 nt, Mycobacterium tuberculosis H37Rv
cgggucccagccuggcaa

SEQ ID NO: 1264961 - RNA, 12 nt, Mycobacterium tuberculosis H37Rv
cggguccaccgc

SEQ ID NO: 1264962 - RNA, 15 nt, Mycobacterium tuberculosis H37Rv
cggguccaggcguug

SEQ ID NO: 1264963 - RNA, 18 nt, Mycobacterium tuberculosis H37Rv
cggguagacaugggugaa

SEQ ID NO: 1264964 - RNA, 15 nt, Mycobacterium tuberculosis H37Rv
cggguagacaccgcg

SEQ ID NO: 1264965 - RNA, 15 nt, Mycobacterium tuberculosis H37Rv
cggguagccgucgau

SEQ ID NO: 1264966 - RNA, 17 nt, Mycobacterium tuberculosis H37Rv
cggguacccaucugcuc

SEQ ID NO: 1264967 - RNA, 15 nt, Mycobacterium tuberculosis H37Rv
cggguauggcggcga

SEQ ID NO: 1264968 - RNA, 17 nt, Mycobacterium tuberculosis H37Rv
cggguagugcacggaca

SEQ ID NO: 1264969 - RNA, 18 nt, Mycobacterium tuberculosis H37Rv
cggguagcacucgaugcg

SEQ ID NO: 1264970 - RNA, 21 nt, Mycobacterium tuberculosis H37Rv
cggguagcacucgaugcggug

SEQ ID NO: 1264971 - RNA, 17 nt, Mycobacterium tuberculosis H37Rv
cggguaggugacgacgu

SEQ ID NO: 1264972 - RNA, 17 nt, Mycobacterium tuberculosis H37Rv
cgggguuguucggcagc

SEQ ID NO: 1264973 - RNA, 23 nt, Mycobacterium tuberculosis H37Rv
cgggguugaucaccgacaccgug

SEQ ID NO: 1264974 - RNA, 17 nt, Mycobacterium tuberculosis H37Rv
cgggguugaucaccgac

SEQ ID NO: 1264975 - RNA, 15 nt, Mycobacterium tuberculosis H37Rv
cgggguugaucaccg

SEQ ID NO: 1264976 - RNA, 23 nt, Mycobacterium tuberculosis H37Rv
cgggguugaccguggucggaggu

SEQ ID NO: 1264977 - RNA, 20 nt, Mycobacterium tuberculosis H37Rv
cggguaacguguucacggcc

SEQ ID NO: 1264978 - RNA, 18 nt, Mycobacterium tuberculosis H37Rv
cggguacacccgcucgcc

SEQ ID NO: 1264979 - RNA, 16 nt, Mycobacterium tuberculosis H37Rv
cggguacaccacgguu

SEQ ID NO: 1264980 - RNA, 14 nt, Mycobacterium tuberculosis H37Rv
cggguacaagacga

SEQ ID NO: 1264981 - RNA, 19 nt, Mycobacterium tuberculosis H37Rv
cgggggcuuaugcgacugc

SEQ ID NO: 1264982 - RNA, 19 nt, Mycobacterium tuberculosis H37Rv
cggggguacgucaccgggu

SEQ ID NO: 1264983 - RNA, 16 nt, Mycobacterium tuberculosis H37Rv
cgggggucagacaaca

SEQ ID NO: 1264984 - RNA, 13 nt, Mycobacterium tuberculosis H37Rv
cggggguccaguu

SEQ ID NO: 1264985 - RNA, 16 nt, Mycobacterium tuberculosis H37Rv
cggggguacgucaccg

SEQ ID NO: 1264986 - RNA, 20 nt, Mycobacterium tuberculosis H37Rv
cgggggcuuuugcgucugcu

SEQ ID NO: 1264987 - RNA, 14 nt, Mycobacterium tuberculosis H37Rv
cggggggccggacu

SEQ ID NO: 1264988 - RNA, 13 nt, Mycobacterium tuberculosis H37Rv
cggggggccucgu

SEQ ID NO: 1264989 - RNA, 16 nt, Mycobacterium tuberculosis H37Rv
cggggggcgucgccgu

SEQ ID NO: 1264990 - RNA, 18 nt, Mycobacterium tuberculosis H37Rv
cgggggucgggcgugucg

SEQ ID NO: 1264991 - RNA, 20 nt, Mycobacterium tuberculosis H37Rv
cgggguacugcggcucgcug

SEQ ID NO: 1264992 - RNA, 16 nt, Mycobacterium tuberculosis H37Rv
cgggguuaggcgcagu

SEQ ID NO: 1264993 - RNA, 18 nt, Mycobacterium tuberculosis H37Rv
cggggucggccugcggca

SEQ ID NO: 1264994 - RNA, 22 nt, Mycobacterium tuberculosis H37Rv
cgggguguucgucgaccaugcg

SEQ ID NO: 1264995 - RNA, 18 nt, Mycobacterium tuberculosis H37Rv
cggggugcacaccgucgc

SEQ ID NO: 1264996 - RNA, 22 nt, Mycobacterium tuberculosis H37Rv
cggggucggggaagacgaccgu

SEQ ID NO: 1264997 - RNA, 19 nt, Mycobacterium tuberculosis H37Rv
cggggugagccauacgcgc

SEQ ID NO: 1264998 - RNA, 19 nt, Mycobacterium tuberculosis H37Rv
cggggugaaaaucgccauc

SEQ ID NO: 1264999 - RNA, 21 nt, Mycobacterium tuberculosis H37Rv
cggggucggccugcggcaccg

SEQ ID NO: 1265000 - RNA, 20 nt, Mycobacterium tuberculosis H37Rv
cggggcuaguugagcgcugc

SEQ ID NO: 1265001 - RNA, 15 nt, Mycobacterium tuberculosis H37Rv
cggggcugccgccgu

SEQ ID NO: 1265002 - RNA, 16 nt, Mycobacterium tuberculosis H37Rv
cggggcucucgagucc

SEQ ID NO: 1265003 - RNA, 20 nt, Mycobacterium tuberculosis H37Rv
cggggcgucguaaacgucgg

SEQ ID NO: 1265004 - RNA, 15 nt, Mycobacterium tuberculosis H37Rv
cggggcgauccccag

SEQ ID NO: 1265005 - RNA, 13 nt, Mycobacterium tuberculosis H37Rv
cggggcgaucccc

SEQ ID NO: 1265006 - RNA, 21 nt, Mycobacterium tuberculosis H37Rv
cggggcgaagcuugacguugc

SEQ ID NO: 1265007 - RNA, 16 nt, Mycobacterium tuberculosis H37Rv
cgggcugccgcccaug

SEQ ID NO: 1265008 - RNA, 16 nt, Mycobacterium tuberculosis H37Rv
cgggcugccgcaugcg

SEQ ID NO: 1265009 - RNA, 13 nt, Mycobacterium tuberculosis H37Rv
cgggcugccgcau

SEQ ID NO: 1265010 - RNA, 18 nt, Mycobacterium tuberculosis H37Rv
cgggcugcagugacucga

SEQ ID NO: 1265011 - RNA, 19 nt, Mycobacterium tuberculosis H37Rv
cgggcugcagugacucgau

SEQ ID NO: 1265012 - RNA, 22 nt, Mycobacterium tuberculosis H37Rv
cgggcugccacggccuucagcg

SEQ ID NO: 1265013 - RNA, 17 nt, Mycobacterium tuberculosis H37Rv
cgggcuccggcucgaca

SEQ ID NO: 1265014 - RNA, 21 nt, Mycobacterium tuberculosis H37Rv
cgggugaaacgauggcgauga

SEQ ID NO: 1265015 - RNA, 18 nt, Mycobacterium tuberculosis H37Rv
cgggucuuggcacacagg

SEQ ID NO: 1265016 - RNA, 18 nt, Mycobacterium tuberculosis H37Rv
cgggugaaggaugcggcc

SEQ ID NO: 1265017 - RNA, 13 nt, Mycobacterium tuberculosis H37Rv
cgggucugcgguc

SEQ ID NO: 1265018 - RNA, 17 nt, Mycobacterium tuberculosis H37Rv
cgggucucgccgaccuu

SEQ ID NO: 1265019 - RNA, 16 nt, Mycobacterium tuberculosis H37Rv
cgggucugggugguga

SEQ ID NO: 1265020 - RNA, 12 nt, Mycobacterium tuberculosis H37Rv
cgggucugggug

SEQ ID NO: 1265021 - RNA, 15 nt, Mycobacterium tuberculosis H37Rv
cgggugagauccgau

SEQ ID NO: 1265022 - RNA, 19 nt, Mycobacterium tuberculosis H37Rv
cgggugagcaccacgugcg

SEQ ID NO: 1265023 - RNA, 21 nt, Mycobacterium tuberculosis H37Rv
cgggugggagcagccgaaccg

SEQ ID NO: 1265024 - RNA, 17 nt, Mycobacterium tuberculosis H37Rv
cggguggcuuccggggu

SEQ ID NO: 1265025 - RNA, 13 nt, Mycobacterium tuberculosis H37Rv
cggguggcucggg

SEQ ID NO: 1265026 - RNA, 22 nt, Mycobacterium tuberculosis H37Rv
cggguggucgaugugaucaccg

SEQ ID NO: 1265027 - RNA, 17 nt, Mycobacterium tuberculosis H37Rv
cgggugggcacaccggu

SEQ ID NO: 1265028 - RNA, 23 nt, Mycobacterium tuberculosis H37Rv
cgggugguucaccucggcgacga

SEQ ID NO: 1265029 - RNA, 19 nt, Mycobacterium tuberculosis H37Rv
cggguucgccggauccgau

SEQ ID NO: 1265030 - RNA, 18 nt, Mycobacterium tuberculosis H37Rv
cggguuccagcggcaccg

SEQ ID NO: 1265031 - RNA, 16 nt, Mycobacterium tuberculosis H37Rv
cggguuccuccucggc

SEQ ID NO: 1265032 - RNA, 17 nt, Mycobacterium tuberculosis H37Rv
cggguguagcucggacc

SEQ ID NO: 1265033 - RNA, 14 nt, Mycobacterium tuberculosis H37Rv
cgguaccgcccgca

SEQ ID NO: 1265034 - RNA, 15 nt, Mycobacterium tuberculosis H37Rv
cgguaccgcccgcac

SEQ ID NO: 1265035 - RNA, 12 nt, Mycobacterium tuberculosis H37Rv
cgguaccgccgg

SEQ ID NO: 1265036 - RNA, 18 nt, Mycobacterium tuberculosis H37Rv
cggguuggccgggcuggc

SEQ ID NO: 1265037 - RNA, 19 nt, Mycobacterium tuberculosis H37Rv
cggguuggcgccggccagu

SEQ ID NO: 1265038 - RNA, 14 nt, Mycobacterium tuberculosis H37Rv
cggguuggcgucgc

SEQ ID NO: 1265039 - RNA, 17 nt, Mycobacterium tuberculosis H37Rv
cgguaccccagcgcugu

SEQ ID NO: 1265040 - RNA, 17 nt, Mycobacterium tuberculosis H37Rv
cgguacccgcacccguu

SEQ ID NO: 1265041 - RNA, 13 nt, Mycobacterium tuberculosis H37Rv
cggguugcccugg

SEQ ID NO: 1265042 - RNA, 12 nt, Mycobacterium tuberculosis H37Rv
cgguaucgccaa

SEQ ID NO: 1265043 - RNA, 20 nt, Mycobacterium tuberculosis H37Rv
cgguaucgucccggcgaccg

SEQ ID NO: 1265044 - RNA, 16 nt, Mycobacterium tuberculosis H37Rv
cgguaucggcagaugg

SEQ ID NO: 1265045 - RNA, 18 nt, Mycobacterium tuberculosis H37Rv
cgguaucgaaagccaacu

SEQ ID NO: 1265046 - RNA, 23 nt, Mycobacterium tuberculosis H37Rv
cgguauagccaagugagcgaucg

SEQ ID NO: 1265047 - RNA, 17 nt, Mycobacterium tuberculosis H37Rv
cgguaguuaacccaggg

SEQ ID NO: 1265048 - RNA, 16 nt, Mycobacterium tuberculosis H37Rv
cgguagucgccgucgg

SEQ ID NO: 1265049 - RNA, 17 nt, Mycobacterium tuberculosis H37Rv
cgguagccaagcgagcg

SEQ ID NO: 1265050 - RNA, 14 nt, Mycobacterium tuberculosis H37Rv
cgguagccauccgu

SEQ ID NO: 1265051 - RNA, 16 nt, Mycobacterium tuberculosis H37Rv
cgguagcacagcagca

SEQ ID NO: 1265052 - RNA, 14 nt, Mycobacterium tuberculosis H37Rv
cgguagcacggucu

SEQ ID NO: 1265053 - RNA, 18 nt, Mycobacterium tuberculosis H37Rv
cgguagcacugucgaggu

SEQ ID NO: 1265054 - RNA, 20 nt, Mycobacterium tuberculosis H37Rv
cgguagccgacgacacgggu

SEQ ID NO: 1265055 - RNA, 18 nt, Mycobacterium tuberculosis H37Rv
cgguagccgaccagcgcu

SEQ ID NO: 1265056 - RNA, 20 nt, Mycobacterium tuberculosis H37Rv
cgguaggggugaucccacga

SEQ ID NO: 1265057 - RNA, 13 nt, Mycobacterium tuberculosis H37Rv
cgguagucgucgc

SEQ ID NO: 1265058 - RNA, 14 nt, Mycobacterium tuberculosis H37Rv
cggucaccaccgug

SEQ ID NO: 1265059 - RNA, 20 nt, Mycobacterium tuberculosis H37Rv
cggucaccggagagccggua

SEQ ID NO: 1265060 - RNA, 17 nt, Mycobacterium tuberculosis H37Rv
cggucaccgcggcaugu

SEQ ID NO: 1265061 - RNA, 15 nt, Mycobacterium tuberculosis H37Rv
cggucaccucgaugc

SEQ ID NO: 1265062 - RNA, 16 nt, Mycobacterium tuberculosis H37Rv
cggucacgaucacgau

SEQ ID NO: 1265063 - RNA, 18 nt, Mycobacterium tuberculosis H37Rv
cggucacgaucacgaugu

SEQ ID NO: 1265064 - RNA, 15 nt, Mycobacterium tuberculosis H37Rv
cggucacucuggcga

SEQ ID NO: 1265065 - RNA, 15 nt, Mycobacterium tuberculosis H37Rv
cggucagagccgucg

SEQ ID NO: 1265066 - RNA, 18 nt, Mycobacterium tuberculosis H37Rv
cggucagagccgucgaag

SEQ ID NO: 1265067 - RNA, 13 nt, Mycobacterium tuberculosis H37Rv
cggucaccucgau

SEQ ID NO: 1265068 - RNA, 13 nt, Mycobacterium tuberculosis H37Rv
cggucacgcguuc

SEQ ID NO: 1265069 - RNA, 18 nt, Mycobacterium tuberculosis H37Rv
cggucaacgcuagcgucg

SEQ ID NO: 1265070 - RNA, 13 nt, Mycobacterium tuberculosis H37Rv
cgguauugcccgg

SEQ ID NO: 1265071 - RNA, 14 nt, Mycobacterium tuberculosis H37Rv
cggcgcuccaacgc

SEQ ID NO: 1265072 - RNA, 15 nt, Mycobacterium tuberculosis H37Rv
cggcgcuccccucgg

SEQ ID NO: 1265073 - RNA, 16 nt, Mycobacterium tuberculosis H37Rv
cggcgcuaaaccgucg

SEQ ID NO: 1265074 - RNA, 16 nt, Mycobacterium tuberculosis H37Rv
cggcgcguucgucguc

SEQ ID NO: 1265075 - RNA, 20 nt, Mycobacterium tuberculosis H37Rv
cggcgcggugcgcucacugg

SEQ ID NO: 1265076 - RNA, 22 nt, Mycobacterium tuberculosis H37Rv
cggcgcguaguaaugcucgacg

SEQ ID NO: 1265077 - RNA, 13 nt, Mycobacterium tuberculosis H37Rv
cggcgcgucggca

SEQ ID NO: 1265078 - RNA, 19 nt, Mycobacterium tuberculosis H37Rv
cggcgcauucccuugucgg

SEQ ID NO: 1265079 - RNA, 17 nt, Mycobacterium tuberculosis H37Rv
cggcgccagcgccgcca

SEQ ID NO: 1265080 - RNA, 16 nt, Mycobacterium tuberculosis H37Rv
cggcgccaggcaccac

SEQ ID NO: 1265081 - RNA, 17 nt, Mycobacterium tuberculosis H37Rv
cggcgccaccgccgcug

SEQ ID NO: 1265082 - RNA, 14 nt, Mycobacterium tuberculosis H37Rv
cggcgccaccgccg

SEQ ID NO: 1265083 - RNA, 22 nt, Mycobacterium tuberculosis H37Rv
cggcgccacccgcgccgccagc

SEQ ID NO: 1265084 - RNA, 21 nt, Mycobacterium tuberculosis H37Rv
cggcgcgggucggcgaccgcg

SEQ ID NO: 1265085 - RNA, 23 nt, Mycobacterium tuberculosis H37Rv
cggcgcgggcacgcccucgucga

SEQ ID NO: 1265086 - RNA, 15 nt, Mycobacterium tuberculosis H37Rv
cggcgcgggccacca

SEQ ID NO: 1265087 - RNA, 17 nt, Mycobacterium tuberculosis H37Rv
cggcgccaguauggccg

SEQ ID NO: 1265088 - RNA, 23 nt, Mycobacterium tuberculosis H37Rv
cggcgccauagccgcgacccgcg

SEQ ID NO: 1265089 - RNA, 21 nt, Mycobacterium tuberculosis H37Rv
cggcgccaguauggccgccac

SEQ ID NO: 1265090 - RNA, 16 nt, Mycobacterium tuberculosis H37Rv
cggcgccagugcgguc

SEQ ID NO: 1265091 - RNA, 21 nt, Mycobacterium tuberculosis H37Rv
cggcgccauagccgcgacccg

SEQ ID NO: 1265092 - RNA, 13 nt, Mycobacterium tuberculosis H37Rv
cggcgccaucggg

SEQ ID NO: 1265093 - RNA, 22 nt, Mycobacterium tuberculosis H37Rv
cggcgcugcugccauugccgau

SEQ ID NO: 1265094 - RNA, 20 nt, Mycobacterium tuberculosis H37Rv
cggcgcugcugccauugccg

SEQ ID NO: 1265095 - RNA, 13 nt, Mycobacterium tuberculosis H37Rv
cggcgcugccggg

SEQ ID NO: 1265096 - RNA, 13 nt, Mycobacterium tuberculosis H37Rv
cggcgcugcgcga

SEQ ID NO: 1265097 - RNA, 15 nt, Mycobacterium tuberculosis H37Rv
cggcgcuggcgggca

SEQ ID NO: 1265098 - RNA, 14 nt, Mycobacterium tuberculosis H37Rv
cggcgcuggcgggc

SEQ ID NO: 1265099 - RNA, 22 nt, Mycobacterium tuberculosis H37Rv
cggcgcugcccgggcugccgcc

SEQ ID NO: 1265100 - RNA, 21 nt, Mycobacterium tuberculosis H37Rv
cggcgcugacuagggucaccg

SEQ ID NO: 1265101 - RNA, 13 nt, Mycobacterium tuberculosis H37Rv
cggcgcucggcga

SEQ ID NO: 1265102 - RNA, 16 nt, Mycobacterium tuberculosis H37Rv
cggcgcucggcgagcu

SEQ ID NO: 1265103 - RNA, 18 nt, Mycobacterium tuberculosis H37Rv
cggcggaaggacggcagc

SEQ ID NO: 1265104 - RNA, 16 nt, Mycobacterium tuberculosis H37Rv
cggcggaaggcgucga

SEQ ID NO: 1265105 - RNA, 18 nt, Mycobacterium tuberculosis H37Rv
cggcggacccgcucgcgg

SEQ ID NO: 1265106 - RNA, 13 nt, Mycobacterium tuberculosis H37Rv
cggcggacccgcu

SEQ ID NO: 1265107 - RNA, 15 nt, Mycobacterium tuberculosis H37Rv
cggcggaccgcagcg

SEQ ID NO: 1265108 - RNA, 12 nt, Mycobacterium tuberculosis H37Rv
cggcggacccgg

SEQ ID NO: 1265109 - RNA, 12 nt, Mycobacterium tuberculosis H37Rv
cggcggaccgca

SEQ ID NO: 1265110 - RNA, 22 nt, Mycobacterium tuberculosis H37Rv
cggcggauucgguaucagggga

SEQ ID NO: 1265111 - RNA, 21 nt, Mycobacterium tuberculosis H37Rv
cggcggaucccgaggcgccca

SEQ ID NO: 1265112 - RNA, 18 nt, Mycobacterium tuberculosis H37Rv
cggcggaucccgaggcgc

SEQ ID NO: 1265113 - RNA, 14 nt, Mycobacterium tuberculosis H37Rv
cggcggaggcuucg

SEQ ID NO: 1265114 - RNA, 14 nt, Mycobacterium tuberculosis H37Rv
cggcggagucgacg

SEQ ID NO: 1265115 - RNA, 16 nt, Mycobacterium tuberculosis H37Rv
cggcggagucgacggu

SEQ ID NO: 1265116 - RNA, 22 nt, Mycobacterium tuberculosis H37Rv
cggcggacugagagauggucgg

SEQ ID NO: 1265117 - RNA, 13 nt, Mycobacterium tuberculosis H37Rv
cggcggacgacgu

SEQ ID NO: 1265118 - RNA, 18 nt, Mycobacterium tuberculosis H37Rv
cggcggaccgcagcguga

SEQ ID NO: 1265119 - RNA, 15 nt, Mycobacterium tuberculosis H37Rv
cggcggaccguccga

SEQ ID NO: 1265120 - RNA, 14 nt, Mycobacterium tuberculosis H37Rv
cggcggacgcgggu

SEQ ID NO: 1265121 - RNA, 23 nt, Mycobacterium tuberculosis H37Rv
cggcggacgcgggugccagaucg

SEQ ID NO: 1265122 - RNA, 14 nt, Mycobacterium tuberculosis H37Rv
cggcggacgugacc

SEQ ID NO: 1265123 - RNA, 21 nt, Mycobacterium tuberculosis H37Rv
cggcggcgaacucggcgauga

SEQ ID NO: 1265124 - RNA, 15 nt, Mycobacterium tuberculosis H37Rv
cggcggccugggcca

SEQ ID NO: 1265125 - RNA, 16 nt, Mycobacterium tuberculosis H37Rv
cggcggccugggccag

SEQ ID NO: 1265126 - RNA, 18 nt, Mycobacterium tuberculosis H37Rv
cggcggccugggccagcc

SEQ ID NO: 1265127 - RNA, 20 nt, Mycobacterium tuberculosis H37Rv
cggcggcgacgagcgcagcg

SEQ ID NO: 1265128 - RNA, 15 nt, Mycobacterium tuberculosis H37Rv
cggcggcgacguggc

SEQ ID NO: 1265129 - RNA, 15 nt, Mycobacterium tuberculosis H37Rv
cggcggccucggucu

SEQ ID NO: 1265130 - RNA, 16 nt, Mycobacterium tuberculosis H37Rv
cggcggccucgcugcu

SEQ ID NO: 1265131 - RNA, 23 nt, Mycobacterium tuberculosis H37Rv
cggcggccuccaccacgucggga

SEQ ID NO: 1265132 - RNA, 19 nt, Mycobacterium tuberculosis H37Rv
cggcggccgcuucggcggu

SEQ ID NO: 1265133 - RNA, 14 nt, Mycobacterium tuberculosis H37Rv
cggcggccgcgugc

SEQ ID NO: 1265134 - RNA, 17 nt, Mycobacterium tuberculosis H37Rv
cggcggccgcccagaug

SEQ ID NO: 1265135 - RNA, 16 nt, Mycobacterium tuberculosis H37Rv
cggcggcugucggccg

SEQ ID NO: 1265136 - RNA, 14 nt, Mycobacterium tuberculosis H37Rv
cggcggcugcggcg

SEQ ID NO: 1265137 - RNA, 16 nt, Mycobacterium tuberculosis H37Rv
cggcgggcgcgggugg

SEQ ID NO: 1265138 - RNA, 17 nt, Mycobacterium tuberculosis H37Rv
cggcgggcucggucccg

SEQ ID NO: 1265139 - RNA, 15 nt, Mycobacterium tuberculosis H37Rv
cggcggggaucgcug

SEQ ID NO: 1265140 - RNA, 19 nt, Mycobacterium tuberculosis H37Rv
cggcggggacucugccacc

SEQ ID NO: 1265141 - RNA, 18 nt, Mycobacterium tuberculosis H37Rv
cggcgggcguaccuucga

SEQ ID NO: 1265142 - RNA, 18 nt, Mycobacterium tuberculosis H37Rv
cggcggggaccgcgguca

SEQ ID NO: 1265143 - RNA, 18 nt, Mycobacterium tuberculosis H37Rv
cggcgggggcgucgccgc

SEQ ID NO: 1265144 - RNA, 13 nt, Mycobacterium tuberculosis H37Rv
cggcggcgucuuc

SEQ ID NO: 1265145 - RNA, 16 nt, Mycobacterium tuberculosis H37Rv
cggcggcgcucgucga

SEQ ID NO: 1265146 - RNA, 15 nt, Mycobacterium tuberculosis H37Rv
cggcggcgcucgucg

SEQ ID NO: 1265147 - RNA, 13 nt, Mycobacterium tuberculosis H37Rv
cggcggcccgaua

SEQ ID NO: 1265148 - RNA, 20 nt, Mycobacterium tuberculosis H37Rv
cggcggcccgauagaucgcg

SEQ ID NO: 1265149 - RNA, 17 nt, Mycobacterium tuberculosis H37Rv
cggcggcccgcagcccg

SEQ ID NO: 1265150 - RNA, 13 nt, Mycobacterium tuberculosis H37Rv
cggcggccgccau

SEQ ID NO: 1265151 - RNA, 13 nt, Mycobacterium tuberculosis H37Rv
cggcggccccagg

SEQ ID NO: 1265152 - RNA, 14 nt, Mycobacterium tuberculosis H37Rv
cggcggccagcgca

SEQ ID NO: 1265153 - RNA, 18 nt, Mycobacterium tuberculosis H37Rv
cggcggccagcgcgucgc

SEQ ID NO: 1265154 - RNA, 15 nt, Mycobacterium tuberculosis H37Rv
cggcggcacccgggu

SEQ ID NO: 1265155 - RNA, 20 nt, Mycobacterium tuberculosis H37Rv
cggcggcauguucaucgcag

SEQ ID NO: 1265156 - RNA, 15 nt, Mycobacterium tuberculosis H37Rv
cggcggcaucgaguu

SEQ ID NO: 1265157 - RNA, 16 nt, Mycobacterium tuberculosis H37Rv
cggcggcaugggucgu

SEQ ID NO: 1265158 - RNA, 18 nt, Mycobacterium tuberculosis H37Rv
cggcggccaccugcuggc

SEQ ID NO: 1265159 - RNA, 20 nt, Mycobacterium tuberculosis H37Rv
cggcggcauagugcgacugc

SEQ ID NO: 1265160 - RNA, 15 nt, Mycobacterium tuberculosis H37Rv
cggcggcagcgaucg

SEQ ID NO: 1265161 - RNA, 20 nt, Mycobacterium tuberculosis H37Rv
cggcguccaagaacggaugc

SEQ ID NO: 1265162 - RNA, 15 nt, Mycobacterium tuberculosis H37Rv
cggcguccaccugcu

SEQ ID NO: 1265163 - RNA, 14 nt, Mycobacterium tuberculosis H37Rv
cggcgucauccacc

SEQ ID NO: 1265164 - RNA, 20 nt, Mycobacterium tuberculosis H37Rv
cggcgucaggcacaacgcga

SEQ ID NO: 1265165 - RNA, 20 nt, Mycobacterium tuberculosis H37Rv
cggcgggugccgagcuggcg

SEQ ID NO: 1265166 - RNA, 15 nt, Mycobacterium tuberculosis H37Rv
cggcggguagcucgc

SEQ ID NO: 1265167 - RNA, 18 nt, Mycobacterium tuberculosis H37Rv
cggcggguagaaccagcc

SEQ ID NO: 1265168 - RNA, 15 nt, Mycobacterium tuberculosis H37Rv
cggcguccgaccggu

SEQ ID NO: 1265169 - RNA, 23 nt, Mycobacterium tuberculosis H37Rv
cggcguccccgacaacgaaaccg

SEQ ID NO: 1265170 - RNA, 24 nt, Mycobacterium tuberculosis H37Rv
cggcguccaucgcgcgccgaccga

SEQ ID NO: 1265171 - RNA, 17 nt, Mycobacterium tuberculosis H37Rv
cggcgucccagggcaca

SEQ ID NO: 1265172 - RNA, 13 nt, Mycobacterium tuberculosis H37Rv
cggcguccaucgc

SEQ ID NO: 1265173 - RNA, 15 nt, Mycobacterium tuberculosis H37Rv
cggcguccgcccagc

SEQ ID NO: 1265174 - RNA, 12 nt, Mycobacterium tuberculosis H37Rv
cggcgucggcca

SEQ ID NO: 1265175 - RNA, 15 nt, Mycobacterium tuberculosis H37Rv
cggcgucgccgccau

SEQ ID NO: 1265176 - RNA, 12 nt, Mycobacterium tuberculosis H37Rv
cggcgucgccgc

SEQ ID NO: 1265177 - RNA, 13 nt, Mycobacterium tuberculosis H37Rv
cggcgucggcgcg

SEQ ID NO: 1265178 - RNA, 17 nt, Mycobacterium tuberculosis H37Rv
cggcgucggcgcccagc

SEQ ID NO: 1265179 - RNA, 14 nt, Mycobacterium tuberculosis H37Rv
cggcgucggccacc

SEQ ID NO: 1265180 - RNA, 19 nt, Mycobacterium tuberculosis H37Rv
cggcgucgaguucgguugc

SEQ ID NO: 1265181 - RNA, 16 nt, Mycobacterium tuberculosis H37Rv
cggcgucgaucaacaa

SEQ ID NO: 1265182 - RNA, 23 nt, Mycobacterium tuberculosis H37Rv
cggcgucgaugacgacgccgucg

SEQ ID NO: 1265183 - RNA, 13 nt, Mycobacterium tuberculosis H37Rv
cggcgucgacggc

SEQ ID NO: 1265184 - RNA, 20 nt, Mycobacterium tuberculosis H37Rv
cggcgucgacggcuccuccg

SEQ ID NO: 1265185 - RNA, 12 nt, Mycobacterium tuberculosis H37Rv
cggcgucgacgu

SEQ ID NO: 1265186 - RNA, 18 nt, Mycobacterium tuberculosis H37Rv
cggcgucgacuggccguu

SEQ ID NO: 1265187 - RNA, 13 nt, Mycobacterium tuberculosis H37Rv
cggcgucgagcuc

SEQ ID NO: 1265188 - RNA, 15 nt, Mycobacterium tuberculosis H37Rv
cggcgucgaccucgc

SEQ ID NO: 1265189 - RNA, 18 nt, Mycobacterium tuberculosis H37Rv
cggcgucgaauaggccgc

SEQ ID NO: 1265190 - RNA, 14 nt, Mycobacterium tuberculosis H37Rv
cggcgucgaccucg

SEQ ID NO: 1265191 - RNA, 20 nt, Mycobacterium tuberculosis H37Rv
cggcgucgaacugccggacu

SEQ ID NO: 1265192 - RNA, 14 nt, Mycobacterium tuberculosis H37Rv
cggcgucgacccag

SEQ ID NO: 1265193 - RNA, 20 nt, Mycobacterium tuberculosis H37Rv
cggcgucgacccugcccagc

SEQ ID NO: 1265194 - RNA, 20 nt, Mycobacterium tuberculosis H37Rv
cggcguugauccgcacccca

SEQ ID NO: 1265195 - RNA, 22 nt, Mycobacterium tuberculosis H37Rv
cggcguuaagguacccggucgg

SEQ ID NO: 1265196 - RNA, 16 nt, Mycobacterium tuberculosis H37Rv
cggcgugucgcgucgc

SEQ ID NO: 1265197 - RNA, 14 nt, Mycobacterium tuberculosis H37Rv
cggcgugucgaggg

SEQ ID NO: 1265198 - RNA, 16 nt, Mycobacterium tuberculosis H37Rv
cggcgugucugcccga

SEQ ID NO: 1265199 - RNA, 22 nt, Mycobacterium tuberculosis H37Rv
cggcgugucguugccagggcgg

SEQ ID NO: 1265200 - RNA, 16 nt, Mycobacterium tuberculosis H37Rv
cggcgugagcuccgca

SEQ ID NO: 1265201 - RNA, 23 nt, Mycobacterium tuberculosis H37Rv
cggcgugcagcagcuugacccac

SEQ ID NO: 1265202 - RNA, 20 nt, Mycobacterium tuberculosis H37Rv
cggcgugcagcagcuugacc

SEQ ID NO: 1265203 - RNA, 15 nt, Mycobacterium tuberculosis H37Rv
cggcgugcagaaucc

SEQ ID NO: 1265204 - RNA, 18 nt, Mycobacterium tuberculosis H37Rv
cggcguggucucgauggu

SEQ ID NO: 1265205 - RNA, 21 nt, Mycobacterium tuberculosis H37Rv
cggcgugcaugagccgggugc

SEQ ID NO: 1265206 - RNA, 23 nt, Mycobacterium tuberculosis H37Rv
cggcgugcaugagccgggugcga

SEQ ID NO: 1265207 - RNA, 15 nt, Mycobacterium tuberculosis H37Rv
cggcguguacgucga

SEQ ID NO: 1265208 - RNA, 19 nt, Mycobacterium tuberculosis H37Rv
cggcucaaccucuggcggc

SEQ ID NO: 1265209 - RNA, 18 nt, Mycobacterium tuberculosis H37Rv
cggcucaaccucuggcgg

SEQ ID NO: 1265210 - RNA, 17 nt, Mycobacterium tuberculosis H37Rv
cggcuaucgcuagccgg

SEQ ID NO: 1265211 - RNA, 19 nt, Mycobacterium tuberculosis H37Rv
cggcuaucgcuagccggcu

SEQ ID NO: 1265212 - RNA, 15 nt, Mycobacterium tuberculosis H37Rv
cggcuauuagcggcu

SEQ ID NO: 1265213 - RNA, 18 nt, Mycobacterium tuberculosis H37Rv
cggcuccaacgauggaac

SEQ ID NO: 1265214 - RNA, 14 nt, Mycobacterium tuberculosis H37Rv
cggcuccaacgaug

SEQ ID NO: 1265215 - RNA, 16 nt, Mycobacterium tuberculosis H37Rv
cggcuccaacgaugga

SEQ ID NO: 1265216 - RNA, 14 nt, Mycobacterium tuberculosis H37Rv
cggcuccaccgggc

SEQ ID NO: 1265217 - RNA, 23 nt, Mycobacterium tuberculosis H37Rv
cggcguuuucaauuucacugcga

SEQ ID NO: 1265218 - RNA, 18 nt, Mycobacterium tuberculosis H37Rv
cggcguuuucggugagca

SEQ ID NO: 1265219 - RNA, 19 nt, Mycobacterium tuberculosis H37Rv
cggcuagggcccuggcggc

SEQ ID NO: 1265220 - RNA, 13 nt, Mycobacterium tuberculosis H37Rv
cggcuagcucucg

SEQ ID NO: 1265221 - RNA, 23 nt, Mycobacterium tuberculosis H37Rv
cggcguuuagggcgauuuccauc

SEQ ID NO: 1265222 - RNA, 15 nt, Mycobacterium tuberculosis H37Rv
cggcguuggcgccgu

SEQ ID NO: 1265223 - RNA, 17 nt, Mycobacterium tuberculosis H37Rv
cggcguuguugaccagc

SEQ ID NO: 1265224 - RNA, 21 nt, Mycobacterium tuberculosis H37Rv
cggcguuggugcagucggugc

SEQ ID NO: 1265225 - RNA, 22 nt, Mycobacterium tuberculosis H37Rv
cggcguuguaguugcccacguu

SEQ ID NO: 1265226 - RNA, 18 nt, Mycobacterium tuberculosis H37Rv
cggcugccgcggcugcca

SEQ ID NO: 1265227 - RNA, 12 nt, Mycobacterium tuberculosis H37Rv
cggcugccgcgg

SEQ ID NO: 1265228 - RNA, 19 nt, Mycobacterium tuberculosis H37Rv
cggcugcccguucugccca

SEQ ID NO: 1265229 - RNA, 20 nt, Mycobacterium tuberculosis H37Rv
cggcugcgacaggacgucgg

SEQ ID NO: 1265230 - RNA, 15 nt, Mycobacterium tuberculosis H37Rv
cggcugcgccgggcu

SEQ ID NO: 1265231 - RNA, 21 nt, Mycobacterium tuberculosis H37Rv
cggcugccucccuuccgcgcu

SEQ ID NO: 1265232 - RNA, 19 nt, Mycobacterium tuberculosis H37Rv
cggcugcgaaagccacucg

SEQ ID NO: 1265233 - RNA, 14 nt, Mycobacterium tuberculosis H37Rv
cggcugccgcggug

SEQ ID NO: 1265234 - RNA, 15 nt, Mycobacterium tuberculosis H37Rv
cggcugccgcggugc

SEQ ID NO: 1265235 - RNA, 16 nt, Mycobacterium tuberculosis H37Rv
cggcugcugcgcggug

SEQ ID NO: 1265236 - RNA, 17 nt, Mycobacterium tuberculosis H37Rv
cggcugcugcgcggugc

SEQ ID NO: 1265237 - RNA, 16 nt, Mycobacterium tuberculosis H37Rv
cggcugcguuggcugg

SEQ ID NO: 1265238 - RNA, 17 nt, Mycobacterium tuberculosis H37Rv
cggcugcgucgucugca

SEQ ID NO: 1265239 - RNA, 16 nt, Mycobacterium tuberculosis H37Rv
cggcugcuuggucgcc

SEQ ID NO: 1265240 - RNA, 21 nt, Mycobacterium tuberculosis H37Rv
cggcuggccagguggccgcau

SEQ ID NO: 1265241 - RNA, 20 nt, Mycobacterium tuberculosis H37Rv
cggcucccauggcgcgagca

SEQ ID NO: 1265242 - RNA, 22 nt, Mycobacterium tuberculosis H37Rv
cggcuccagguccacauccagg

SEQ ID NO: 1265243 - RNA, 15 nt, Mycobacterium tuberculosis H37Rv
cggcucgucaaacga

SEQ ID NO: 1265244 - RNA, 20 nt, Mycobacterium tuberculosis H37Rv
cggcucgucgaugucgacgu

SEQ ID NO: 1265245 - RNA, 15 nt, Mycobacterium tuberculosis H37Rv
cggcucgucagguuc

SEQ ID NO: 1265246 - RNA, 21 nt, Mycobacterium tuberculosis H37Rv
cggcucgucgaacauggcacg

SEQ ID NO: 1265247 - RNA, 20 nt, Mycobacterium tuberculosis H37Rv
cggcucuagaucgccgagcg

SEQ ID NO: 1265248 - RNA, 17 nt, Mycobacterium tuberculosis H37Rv
cggcugaauucggcgag

SEQ ID NO: 1265249 - RNA, 16 nt, Mycobacterium tuberculosis H37Rv
cggcugaauucggcga

SEQ ID NO: 1265250 - RNA, 22 nt, Mycobacterium tuberculosis H37Rv
cggcugccagcgccgccgccga

SEQ ID NO: 1265251 - RNA, 21 nt, Mycobacterium tuberculosis H37Rv
cggcugcauccuccucgucga

SEQ ID NO: 1265252 - RNA, 15 nt, Mycobacterium tuberculosis H37Rv
cggcugcagccgacc

SEQ ID NO: 1265253 - RNA, 13 nt, Mycobacterium tuberculosis H37Rv
cggcugcagccga

SEQ ID NO: 1265254 - RNA, 17 nt, Mycobacterium tuberculosis H37Rv
cggcugcagccgaccga

SEQ ID NO: 1265255 - RNA, 15 nt, Mycobacterium tuberculosis H37Rv
cggcugcacgcugcg

SEQ ID NO: 1265256 - RNA, 22 nt, Mycobacterium tuberculosis H37Rv
cggcuggugccaacugcgccgu

SEQ ID NO: 1265257 - RNA, 18 nt, Mycobacterium tuberculosis H37Rv
cggcugguagcugcggua

SEQ ID NO: 1265258 - RNA, 21 nt, Mycobacterium tuberculosis H37Rv
cggcugguugcgccacugcgu

SEQ ID NO: 1265259 - RNA, 22 nt, Mycobacterium tuberculosis H37Rv
cggcugguuacucaccaaccgc

SEQ ID NO: 1265260 - RNA, 20 nt, Mycobacterium tuberculosis H37Rv
cggcuguggucgcugcugcc

SEQ ID NO: 1265261 - RNA, 14 nt, Mycobacterium tuberculosis H37Rv
cggcugugcccgau

SEQ ID NO: 1265262 - RNA, 15 nt, Mycobacterium tuberculosis H37Rv
cggcuggcgucgaug

SEQ ID NO: 1265263 - RNA, 23 nt, Mycobacterium tuberculosis H37Rv
cggcuggcuagcagguacucgcc

SEQ ID NO: 1265264 - RNA, 14 nt, Mycobacterium tuberculosis H37Rv
cggcuggcccgaau

SEQ ID NO: 1265265 - RNA, 14 nt, Mycobacterium tuberculosis H37Rv
cggcuggcccgcau

SEQ ID NO: 1265266 - RNA, 13 nt, Mycobacterium tuberculosis H37Rv
cgggaaacaccgg

SEQ ID NO: 1265267 - RNA, 16 nt, Mycobacterium tuberculosis H37Rv
cgggaaaccgaggaug

SEQ ID NO: 1265268 - RNA, 17 nt, Mycobacterium tuberculosis H37Rv
cggcuuugagccgcucg

SEQ ID NO: 1265269 - RNA, 14 nt, Mycobacterium tuberculosis H37Rv
cggcuuugcuugcc

SEQ ID NO: 1265270 - RNA, 12 nt, Mycobacterium tuberculosis H37Rv
cggcuuuucgac

SEQ ID NO: 1265271 - RNA, 19 nt, Mycobacterium tuberculosis H37Rv
cggcuuuggcccgcgagcg

SEQ ID NO: 1265272 - RNA, 19 nt, Mycobacterium tuberculosis H37Rv
cggcuuggugaaccgcgcg

SEQ ID NO: 1265273 - RNA, 15 nt, Mycobacterium tuberculosis H37Rv
cggcuugucgcggug

SEQ ID NO: 1265274 - RNA, 16 nt, Mycobacterium tuberculosis H37Rv
cggcuugucgcggugc

SEQ ID NO: 1265275 - RNA, 21 nt, Mycobacterium tuberculosis H37Rv
cggcuugggccaggcccagcu

SEQ ID NO: 1265276 - RNA, 16 nt, Mycobacterium tuberculosis H37Rv
cggcuucgccgcgcuu

SEQ ID NO: 1265277 - RNA, 24 nt, Mycobacterium tuberculosis H37Rv
cggccgccucguacggaccgucgc

SEQ ID NO: 1265278 - RNA, 14 nt, Mycobacterium tuberculosis H37Rv
cggccgcgccgucg

SEQ ID NO: 1265279 - RNA, 23 nt, Mycobacterium tuberculosis H37Rv
cggccgccgggaaauaucucggu

SEQ ID NO: 1265280 - RNA, 21 nt, Mycobacterium tuberculosis H37Rv
cggccgccuacccguucuucg

SEQ ID NO: 1265281 - RNA, 19 nt, Mycobacterium tuberculosis H37Rv
cggccgccguccccgccgu

SEQ ID NO: 1265282 - RNA, 19 nt, Mycobacterium tuberculosis H37Rv
cggccgccucguacggacc

SEQ ID NO: 1265283 - RNA, 16 nt, Mycobacterium tuberculosis H37Rv
cggccgccucguacgg

SEQ ID NO: 1265284 - RNA, 15 nt, Mycobacterium tuberculosis H37Rv
cggccgcccgcucga

SEQ ID NO: 1265285 - RNA, 16 nt, Mycobacterium tuberculosis H37Rv
cggccgcccgcucgau

SEQ ID NO: 1265286 - RNA, 20 nt, Mycobacterium tuberculosis H37Rv
cggccgccaguaccacuguu

SEQ ID NO: 1265287 - RNA, 22 nt, Mycobacterium tuberculosis H37Rv
cggccgccaguucggcgucguc

SEQ ID NO: 1265288 - RNA, 15 nt, Mycobacterium tuberculosis H37Rv
cggccgccaucagcc

SEQ ID NO: 1265289 - RNA, 16 nt, Mycobacterium tuberculosis H37Rv
cggccgaucagcagcu

SEQ ID NO: 1265290 - RNA, 14 nt, Mycobacterium tuberculosis H37Rv
cggccgccagcgca

SEQ ID NO: 1265291 - RNA, 16 nt, Mycobacterium tuberculosis H37Rv
cggccgauacgaagcc

SEQ ID NO: 1265292 - RNA, 18 nt, Mycobacterium tuberculosis H37Rv
cggccgauacagaucugg

SEQ ID NO: 1265293 - RNA, 22 nt, Mycobacterium tuberculosis H37Rv
cggccgagucgauugccaccga

SEQ ID NO: 1265294 - RNA, 14 nt, Mycobacterium tuberculosis H37Rv
cggccgagugcacg

SEQ ID NO: 1265295 - RNA, 17 nt, Mycobacterium tuberculosis H37Rv
cggccgagucgauugcc

SEQ ID NO: 1265296 - RNA, 13 nt, Mycobacterium tuberculosis H37Rv
cggccggcaugcu

SEQ ID NO: 1265297 - RNA, 14 nt, Mycobacterium tuberculosis H37Rv
cggccgcuccaccu

SEQ ID NO: 1265298 - RNA, 16 nt, Mycobacterium tuberculosis H37Rv
cggccgcgugcucgcc

SEQ ID NO: 1265299 - RNA, 15 nt, Mycobacterium tuberculosis H37Rv
cggccgcggcgucgu

SEQ ID NO: 1265300 - RNA, 14 nt, Mycobacterium tuberculosis H37Rv
cggccgcggccucc

SEQ ID NO: 1265301 - RNA, 14 nt, Mycobacterium tuberculosis H37Rv
cggccgcggcagcg

SEQ ID NO: 1265302 - RNA, 19 nt, Mycobacterium tuberculosis H37Rv
cggccgaacgccucgccgg

SEQ ID NO: 1265303 - RNA, 14 nt, Mycobacterium tuberculosis H37Rv
cggccgaacucgag

SEQ ID NO: 1265304 - RNA, 16 nt, Mycobacterium tuberculosis H37Rv
cggccgacacgccgau

SEQ ID NO: 1265305 - RNA, 17 nt, Mycobacterium tuberculosis H37Rv
cggccgaaugcgccaau

SEQ ID NO: 1265306 - RNA, 20 nt, Mycobacterium tuberculosis H37Rv
cggccgacaccgccaccacg

SEQ ID NO: 1265307 - RNA, 14 nt, Mycobacterium tuberculosis H37Rv
cggccgacaacccg

SEQ ID NO: 1265308 - RNA, 13 nt, Mycobacterium tuberculosis H37Rv
cggccgacaccgc

SEQ ID NO: 1265309 - RNA, 23 nt, Mycobacterium tuberculosis H37Rv
cggccgagcguggccaauccggc

SEQ ID NO: 1265310 - RNA, 18 nt, Mycobacterium tuberculosis H37Rv
cggccgaggucacccggu

SEQ ID NO: 1265311 - RNA, 17 nt, Mycobacterium tuberculosis H37Rv
cggccgaggucacccgg

SEQ ID NO: 1265312 - RNA, 17 nt, Mycobacterium tuberculosis H37Rv
cggccgagcugguuggc

SEQ ID NO: 1265313 - RNA, 21 nt, Mycobacterium tuberculosis H37Rv
cggccgacuuggugaccccgu

SEQ ID NO: 1265314 - RNA, 20 nt, Mycobacterium tuberculosis H37Rv
cggccgagcgcaccgcugac

SEQ ID NO: 1265315 - RNA, 14 nt, Mycobacterium tuberculosis H37Rv
cggccgagccguug

SEQ ID NO: 1265316 - RNA, 16 nt, Mycobacterium tuberculosis H37Rv
cggccgacuuggugac

SEQ ID NO: 1265317 - RNA, 20 nt, Mycobacterium tuberculosis H37Rv
cggcccugcucgccgucucg

SEQ ID NO: 1265318 - RNA, 22 nt, Mycobacterium tuberculosis H37Rv
cggcccugcucggccaacguag

SEQ ID NO: 1265319 - RNA, 19 nt, Mycobacterium tuberculosis H37Rv
cggcccucgccuucgccgc

SEQ ID NO: 1265320 - RNA, 16 nt, Mycobacterium tuberculosis H37Rv
cggcccuaaacaccgc

SEQ ID NO: 1265321 - RNA, 23 nt, Mycobacterium tuberculosis H37Rv
cggcccuaucuggcggccggacu

SEQ ID NO: 1265322 - RNA, 18 nt, Mycobacterium tuberculosis H37Rv
cggcccuacgcagcgcgg

SEQ ID NO: 1265323 - RNA, 15 nt, Mycobacterium tuberculosis H37Rv
cggcccggucuacgc

SEQ ID NO: 1265324 - RNA, 18 nt, Mycobacterium tuberculosis H37Rv
cggcccguagcugcgcag

SEQ ID NO: 1265325 - RNA, 13 nt, Mycobacterium tuberculosis H37Rv
cggcccggugagc

SEQ ID NO: 1265326 - RNA, 18 nt, Mycobacterium tuberculosis H37Rv
cggcccgucgcgucgacc

SEQ ID NO: 1265327 - RNA, 14 nt, Mycobacterium tuberculosis H37Rv
cggcccgucaccgc

SEQ ID NO: 1265328 - RNA, 18 nt, Mycobacterium tuberculosis H37Rv
cggcccggguuggccgaa

SEQ ID NO: 1265329 - RNA, 18 nt, Mycobacterium tuberculosis H37Rv
cggcccggguaucgccag

SEQ ID NO: 1265330 - RNA, 20 nt, Mycobacterium tuberculosis H37Rv
cggcccggggacgcccucgg

SEQ ID NO: 1265331 - RNA, 13 nt, Mycobacterium tuberculosis H37Rv
cggccccugccac

SEQ ID NO: 1265332 - RNA, 18 nt, Mycobacterium tuberculosis H37Rv
cggcccgaauuugggcga

SEQ ID NO: 1265333 - RNA, 20 nt, Mycobacterium tuberculosis H37Rv
cggcccgagccgcuaggacg

SEQ ID NO: 1265334 - RNA, 19 nt, Mycobacterium tuberculosis H37Rv
cggcccaugaucucggcga

SEQ ID NO: 1265335 - RNA, 18 nt, Mycobacterium tuberculosis H37Rv
cggccccacaagucgcgc

SEQ ID NO: 1265336 - RNA, 16 nt, Mycobacterium tuberculosis H37Rv
cggccccgucgucuag

SEQ ID NO: 1265337 - RNA, 16 nt, Mycobacterium tuberculosis H37Rv
cggcccgcgaucgggc

SEQ ID NO: 1265338 - RNA, 13 nt, Mycobacterium tuberculosis H37Rv
cggcccgccgagu

SEQ ID NO: 1265339 - RNA, 20 nt, Mycobacterium tuberculosis H37Rv
cggcccgcagccaaguccgc

SEQ ID NO: 1265340 - RNA, 16 nt, Mycobacterium tuberculosis H37Rv
cggcccgaucggcaac

SEQ ID NO: 1265341 - RNA, 18 nt, Mycobacterium tuberculosis H37Rv
cggcccgcagcagcaucg

SEQ ID NO: 1265342 - RNA, 19 nt, Mycobacterium tuberculosis H37Rv
cggcccgcaucgucgccga

SEQ ID NO: 1265343 - RNA, 13 nt, Mycobacterium tuberculosis H37Rv
cggcccgaggugc

SEQ ID NO: 1265344 - RNA, 16 nt, Mycobacterium tuberculosis H37Rv
cggcccgcucgaucgg

SEQ ID NO: 1265345 - RNA, 15 nt, Mycobacterium tuberculosis H37Rv
cggcccgcucgaucg

SEQ ID NO: 1265346 - RNA, 14 nt, Mycobacterium tuberculosis H37Rv
cggcccgcucaacg

SEQ ID NO: 1265347 - RNA, 14 nt, Mycobacterium tuberculosis H37Rv
cggcccgcuccacg

SEQ ID NO: 1265348 - RNA, 20 nt, Mycobacterium tuberculosis H37Rv
cggcccggacugaucgucug

SEQ ID NO: 1265349 - RNA, 12 nt, Mycobacterium tuberculosis H37Rv
cggccagugcgc

SEQ ID NO: 1265350 - RNA, 20 nt, Mycobacterium tuberculosis H37Rv
cggccagugucagcacgacg

SEQ ID NO: 1265351 - RNA, 21 nt, Mycobacterium tuberculosis H37Rv
cggccagugucagcacgacga

SEQ ID NO: 1265352 - RNA, 18 nt, Mycobacterium tuberculosis H37Rv
cggccaggugacguucga

SEQ ID NO: 1265353 - RNA, 18 nt, Mycobacterium tuberculosis H37Rv
cggccaggucgacaccgc

SEQ ID NO: 1265354 - RNA, 18 nt, Mycobacterium tuberculosis H37Rv
cggccagguauguccgcc

SEQ ID NO: 1265355 - RNA, 20 nt, Mycobacterium tuberculosis H37Rv
cggccagguauguccgccau

SEQ ID NO: 1265356 - RNA, 22 nt, Mycobacterium tuberculosis H37Rv
cggccaggggaucaccggcugc

SEQ ID NO: 1265357 - RNA, 21 nt, Mycobacterium tuberculosis H37Rv
cggccagggugcccucggccg

SEQ ID NO: 1265358 - RNA, 22 nt, Mycobacterium tuberculosis H37Rv
cggccagguauguccgccauug

SEQ ID NO: 1265359 - RNA, 18 nt, Mycobacterium tuberculosis H37Rv
cggccaucgggauggaca

SEQ ID NO: 1265360 - RNA, 17 nt, Mycobacterium tuberculosis H37Rv
cggccaucugcucgugg

SEQ ID NO: 1265361 - RNA, 23 nt, Mycobacterium tuberculosis H37Rv
cggccaugaaaaucggcaagacg

SEQ ID NO: 1265362 - RNA, 19 nt, Mycobacterium tuberculosis H37Rv
cggccaugacacguugacc

SEQ ID NO: 1265363 - RNA, 16 nt, Mycobacterium tuberculosis H37Rv
cggccaucguccagca

SEQ ID NO: 1265364 - RNA, 14 nt, Mycobacterium tuberculosis H37Rv
cggccaugaucaca

SEQ ID NO: 1265365 - RNA, 17 nt, Mycobacterium tuberculosis H37Rv
cggccauaccgcucgcc

SEQ ID NO: 1265366 - RNA, 18 nt, Mycobacterium tuberculosis H37Rv
cggccauaccgcucgccg

SEQ ID NO: 1265367 - RNA, 21 nt, Mycobacterium tuberculosis H37Rv
cggccaguugguagccgcccu

SEQ ID NO: 1265368 - RNA, 13 nt, Mycobacterium tuberculosis H37Rv
cggccaguucggc

SEQ ID NO: 1265369 - RNA, 17 nt, Mycobacterium tuberculosis H37Rv
cggccaguugcacaucg

SEQ ID NO: 1265370 - RNA, 15 nt, Mycobacterium tuberculosis H37Rv
cggcccaaccggucg

SEQ ID NO: 1265371 - RNA, 19 nt, Mycobacterium tuberculosis H37Rv
cggcccaaggaacggcguc

SEQ ID NO: 1265372 - RNA, 16 nt, Mycobacterium tuberculosis H37Rv
cggccauugcgggcuc

SEQ ID NO: 1265373 - RNA, 15 nt, Mycobacterium tuberculosis H37Rv
cggccaugccuucgg

SEQ ID NO: 1265374 - RNA, 19 nt, Mycobacterium tuberculosis H37Rv
cggccaugaucacaccgcu

SEQ ID NO: 1265375 - RNA, 14 nt, Mycobacterium tuberculosis H37Rv
cggcccaccgccga

SEQ ID NO: 1265376 - RNA, 16 nt, Mycobacterium tuberculosis H37Rv
cggcccaccgccgaua

SEQ ID NO: 1265377 - RNA, 12 nt, Mycobacterium tuberculosis H37Rv
cggcccaccagg

SEQ ID NO: 1265378 - RNA, 23 nt, Mycobacterium tuberculosis H37Rv
cggcccaaguucuaagcguuugg

SEQ ID NO: 1265379 - RNA, 21 nt, Mycobacterium tuberculosis H37Rv
cggcccacacggucgucgcga

SEQ ID NO: 1265380 - RNA, 16 nt, Mycobacterium tuberculosis H37Rv
cggcccacaccagcgc

SEQ ID NO: 1265381 - RNA, 16 nt, Mycobacterium tuberculosis H37Rv
cggccuaggacgccgc

SEQ ID NO: 1265382 - RNA, 18 nt, Mycobacterium tuberculosis H37Rv
cggccguugggccaccgg

SEQ ID NO: 1265383 - RNA, 12 nt, Mycobacterium tuberculosis H37Rv
cggccguugggc

SEQ ID NO: 1265384 - RNA, 14 nt, Mycobacterium tuberculosis H37Rv
cggccgugucgggc

SEQ ID NO: 1265385 - RNA, 16 nt, Mycobacterium tuberculosis H37Rv
cggccguucgugggca

SEQ ID NO: 1265386 - RNA, 15 nt, Mycobacterium tuberculosis H37Rv
cggccgggacggcga

SEQ ID NO: 1265387 - RNA, 13 nt, Mycobacterium tuberculosis H37Rv
cggccgugccgcc

SEQ ID NO: 1265388 - RNA, 15 nt, Mycobacterium tuberculosis H37Rv
cggccgugccgccga

SEQ ID NO: 1265389 - RNA, 22 nt, Mycobacterium tuberculosis H37Rv
cggccguggcauguugcggacc

SEQ ID NO: 1265390 - RNA, 21 nt, Mycobacterium tuberculosis H37Rv
cggccggcggcgcccaucgcg

SEQ ID NO: 1265391 - RNA, 21 nt, Mycobacterium tuberculosis H37Rv
cggccugcgaacacgcgauga

SEQ ID NO: 1265392 - RNA, 17 nt, Mycobacterium tuberculosis H37Rv
cggccugaccggucacc

SEQ ID NO: 1265393 - RNA, 19 nt, Mycobacterium tuberculosis H37Rv
cggccugagcgucgucgcc

SEQ ID NO: 1265394 - RNA, 12 nt, Mycobacterium tuberculosis H37Rv
cggccugaccgg

SEQ ID NO: 1265395 - RNA, 13 nt, Mycobacterium tuberculosis H37Rv
cggccugaccggu

SEQ ID NO: 1265396 - RNA, 20 nt, Mycobacterium tuberculosis H37Rv
cggccucuggaucacgucga

SEQ ID NO: 1265397 - RNA, 17 nt, Mycobacterium tuberculosis H37Rv
cggccucguugaccggg

SEQ ID NO: 1265398 - RNA, 16 nt, Mycobacterium tuberculosis H37Rv
cggccucguugaccgg

SEQ ID NO: 1265399 - RNA, 18 nt, Mycobacterium tuberculosis H37Rv
cggccucuagcuugacaa

SEQ ID NO: 1265400 - RNA, 14 nt, Mycobacterium tuberculosis H37Rv
cggccucgaugucg

SEQ ID NO: 1265401 - RNA, 12 nt, Mycobacterium tuberculosis H37Rv
cggccuccucgu

SEQ ID NO: 1265402 - RNA, 21 nt, Mycobacterium tuberculosis H37Rv
cggcgaacugggugcggucuc

SEQ ID NO: 1265403 - RNA, 20 nt, Mycobacterium tuberculosis H37Rv
cggcgaacucgcgccgagcc

SEQ ID NO: 1265404 - RNA, 14 nt, Mycobacterium tuberculosis H37Rv
cggcgaaucgggca

SEQ ID NO: 1265405 - RNA, 13 nt, Mycobacterium tuberculosis H37Rv
cggcgaagccggg

SEQ ID NO: 1265406 - RNA, 13 nt, Mycobacterium tuberculosis H37Rv
cggcgaacggauu

SEQ ID NO: 1265407 - RNA, 16 nt, Mycobacterium tuberculosis H37Rv
cggcgaacucgggcga

SEQ ID NO: 1265408 - RNA, 21 nt, Mycobacterium tuberculosis H37Rv
cggcgacacgccagccgugcc

SEQ ID NO: 1265409 - RNA, 19 nt, Mycobacterium tuberculosis H37Rv
cggcgacacgccagccgug

SEQ ID NO: 1265410 - RNA, 16 nt, Mycobacterium tuberculosis H37Rv
cggcgacaccgcaccg

SEQ ID NO: 1265411 - RNA, 14 nt, Mycobacterium tuberculosis H37Rv
cggcgacacccugg

SEQ ID NO: 1265412 - RNA, 17 nt, Mycobacterium tuberculosis H37Rv
cggcgacacccugggug

SEQ ID NO: 1265413 - RNA, 18 nt, Mycobacterium tuberculosis H37Rv
cggcgaaugccagugaca

SEQ ID NO: 1265414 - RNA, 23 nt, Mycobacterium tuberculosis H37Rv
cggcgacaagccgagcccgucga

SEQ ID NO: 1265415 - RNA, 22 nt, Mycobacterium tuberculosis H37Rv
cggcgacaagccgagcccgucg

SEQ ID NO: 1265416 - RNA, 20 nt, Mycobacterium tuberculosis H37Rv
cggcgacagcgcggcggucg

SEQ ID NO: 1265417 - RNA, 18 nt, Mycobacterium tuberculosis H37Rv
cggcgacagcuuggccgg

SEQ ID NO: 1265418 - RNA, 14 nt, Mycobacterium tuberculosis H37Rv
cggcgacccgggua

SEQ ID NO: 1265419 - RNA, 15 nt, Mycobacterium tuberculosis H37Rv
cggcgacccgccugu

SEQ ID NO: 1265420 - RNA, 17 nt, Mycobacterium tuberculosis H37Rv
cggcgacccggucgcgg

SEQ ID NO: 1265421 - RNA, 16 nt, Mycobacterium tuberculosis H37Rv
cggcgacccggucacu

SEQ ID NO: 1265422 - RNA, 16 nt, Mycobacterium tuberculosis H37Rv
cggccuuuacccgggc

SEQ ID NO: 1265423 - RNA, 14 nt, Mycobacterium tuberculosis H37Rv
cggccuuugucgcc

SEQ ID NO: 1265424 - RNA, 21 nt, Mycobacterium tuberculosis H37Rv
cggcgaaaacaacaccaccgc

SEQ ID NO: 1265425 - RNA, 16 nt, Mycobacterium tuberculosis H37Rv
cggcgaaccccagcgc

SEQ ID NO: 1265426 - RNA, 18 nt, Mycobacterium tuberculosis H37Rv
cggccuuggcggccgcga

SEQ ID NO: 1265427 - RNA, 17 nt, Mycobacterium tuberculosis H37Rv
cggccuggccaccuggu

SEQ ID NO: 1265428 - RNA, 16 nt, Mycobacterium tuberculosis H37Rv
cggccuggcacccggg

SEQ ID NO: 1265429 - RNA, 14 nt, Mycobacterium tuberculosis H37Rv
cggcgauggucccg

SEQ ID NO: 1265430 - RNA, 18 nt, Mycobacterium tuberculosis H37Rv
cggcgauuaccggcacgc

SEQ ID NO: 1265431 - RNA, 18 nt, Mycobacterium tuberculosis H37Rv
cggcgauuccuccgguug

SEQ ID NO: 1265432 - RNA, 16 nt, Mycobacterium tuberculosis H37Rv
cggcgauuggcuguga

SEQ ID NO: 1265433 - RNA, 16 nt, Mycobacterium tuberculosis H37Rv
cggcgauuggaccgcc

SEQ ID NO: 1265434 - RNA, 23 nt, Mycobacterium tuberculosis H37Rv
cggcgcacgaaaccgcagcgcga

SEQ ID NO: 1265435 - RNA, 20 nt, Mycobacterium tuberculosis H37Rv
cggcgcacgaaaccgcagcg

SEQ ID NO: 1265436 - RNA, 14 nt, Mycobacterium tuberculosis H37Rv
cggcgcaccgucgc

SEQ ID NO: 1265437 - RNA, 13 nt, Mycobacterium tuberculosis H37Rv
cggcgcacgaaac

SEQ ID NO: 1265438 - RNA, 16 nt, Mycobacterium tuberculosis H37Rv
cggcgcagcuaacccg

SEQ ID NO: 1265439 - RNA, 23 nt, Mycobacterium tuberculosis H37Rv
cggcgcagcaacgcaaucgucgc

SEQ ID NO: 1265440 - RNA, 18 nt, Mycobacterium tuberculosis H37Rv
cggcgcagauagcgcucg

SEQ ID NO: 1265441 - RNA, 20 nt, Mycobacterium tuberculosis H37Rv
cggcgcagauagcgcucgaa

SEQ ID NO: 1265442 - RNA, 18 nt, Mycobacterium tuberculosis H37Rv
cggcgauguuggccagcg

SEQ ID NO: 1265443 - RNA, 16 nt, Mycobacterium tuberculosis H37Rv
cggcgcaguagccgac

SEQ ID NO: 1265444 - RNA, 20 nt, Mycobacterium tuberculosis H37Rv
cggcgcaguuggcaccagcc

SEQ ID NO: 1265445 - RNA, 15 nt, Mycobacterium tuberculosis H37Rv
cggcgcagguucucg

SEQ ID NO: 1265446 - RNA, 20 nt, Mycobacterium tuberculosis H37Rv
cggcgcaggucgcgcaguug

SEQ ID NO: 1265447 - RNA, 18 nt, Mycobacterium tuberculosis H37Rv
cggcgaucaacucgggca

SEQ ID NO: 1265448 - RNA, 19 nt, Mycobacterium tuberculosis H37Rv
cggcgaucgggcgggugaa

SEQ ID NO: 1265449 - RNA, 15 nt, Mycobacterium tuberculosis H37Rv
cggcgaucgucucgg

SEQ ID NO: 1265450 - RNA, 17 nt, Mycobacterium tuberculosis H37Rv
cggcgauauaggacgcc

SEQ ID NO: 1265451 - RNA, 18 nt, Mycobacterium tuberculosis H37Rv
cggcgaucaccgagaugg

SEQ ID NO: 1265452 - RNA, 18 nt, Mycobacterium tuberculosis H37Rv
cggcgaugguugaaccag

SEQ ID NO: 1265453 - RNA, 16 nt, Mycobacterium tuberculosis H37Rv
cggcgaugauggcgcg

SEQ ID NO: 1265454 - RNA, 19 nt, Mycobacterium tuberculosis H37Rv
cggcgaugaugacggcggc

SEQ ID NO: 1265455 - RNA, 13 nt, Mycobacterium tuberculosis H37Rv
cggcgaugcagcc

SEQ ID NO: 1265456 - RNA, 19 nt, Mycobacterium tuberculosis H37Rv
cggcgaucguguccaccgg

SEQ ID NO: 1265457 - RNA, 22 nt, Mycobacterium tuberculosis H37Rv
cggcgaucguguccaccggacc

SEQ ID NO: 1265458 - RNA, 16 nt, Mycobacterium tuberculosis H37Rv
cggcgagcccgcaucg

SEQ ID NO: 1265459 - RNA, 19 nt, Mycobacterium tuberculosis H37Rv
cggcgagcgcaucggccaa

SEQ ID NO: 1265460 - RNA, 17 nt, Mycobacterium tuberculosis H37Rv
cggcgagccgcgcccaa

SEQ ID NO: 1265461 - RNA, 15 nt, Mycobacterium tuberculosis H37Rv
cggcgagccgcucgc

SEQ ID NO: 1265462 - RNA, 23 nt, Mycobacterium tuberculosis H37Rv
cggcgagccgcucgcugaaccgg

SEQ ID NO: 1265463 - RNA, 23 nt, Mycobacterium tuberculosis H37Rv
cggcgagccucgcgcgccacggu

SEQ ID NO: 1265464 - RNA, 21 nt, Mycobacterium tuberculosis H37Rv
cggcgagccucuuggucaacg

SEQ ID NO: 1265465 - RNA, 17 nt, Mycobacterium tuberculosis H37Rv
cggcgagcuccgaugcc

SEQ ID NO: 1265466 - RNA, 23 nt, Mycobacterium tuberculosis H37Rv
cggcgagcgcgaugcagugcgac

SEQ ID NO: 1265467 - RNA, 14 nt, Mycobacterium tuberculosis H37Rv
cggcgauaccgguu

SEQ ID NO: 1265468 - RNA, 20 nt, Mycobacterium tuberculosis H37Rv
cggcgauaacuccgcggcga

SEQ ID NO: 1265469 - RNA, 22 nt, Mycobacterium tuberculosis H37Rv
cggcgaggucccggccgagcgu

SEQ ID NO: 1265470 - RNA, 14 nt, Mycobacterium tuberculosis H37Rv
cggcgagggcgguc

SEQ ID NO: 1265471 - RNA, 21 nt, Mycobacterium tuberculosis H37Rv
cggcgaggucccggccgagcg

SEQ ID NO: 1265472 - RNA, 19 nt, Mycobacterium tuberculosis H37Rv
cggcgaggacggcggccag

SEQ ID NO: 1265473 - RNA, 15 nt, Mycobacterium tuberculosis H37Rv
cggcgaggccgaacu

SEQ ID NO: 1265474 - RNA, 23 nt, Mycobacterium tuberculosis H37Rv
cggcgacucgaggaccugcucgg

SEQ ID NO: 1265475 - RNA, 21 nt, Mycobacterium tuberculosis H37Rv
cggcgagcacccgcuggucga

SEQ ID NO: 1265476 - RNA, 17 nt, Mycobacterium tuberculosis H37Rv
cggcgagcacgcgggca

SEQ ID NO: 1265477 - RNA, 18 nt, Mycobacterium tuberculosis H37Rv
cggcgagcacgcgggcac

SEQ ID NO: 1265478 - RNA, 14 nt, Mycobacterium tuberculosis H37Rv
cggcgacgacccgg

SEQ ID NO: 1265479 - RNA, 15 nt, Mycobacterium tuberculosis H37Rv
cggcgacgaaccgcc

SEQ ID NO: 1265480 - RNA, 17 nt, Mycobacterium tuberculosis H37Rv
cggcgacgaaccgccag

SEQ ID NO: 1265481 - RNA, 18 nt, Mycobacterium tuberculosis H37Rv
cggcgacgaaccgccaga

SEQ ID NO: 1265482 - RNA, 14 nt, Mycobacterium tuberculosis H37Rv
cggcgacgaccguc

SEQ ID NO: 1265483 - RNA, 24 nt, Mycobacterium tuberculosis H37Rv
cggcgacuacccagccagccgcga

SEQ ID NO: 1265484 - RNA, 20 nt, Mycobacterium tuberculosis H37Rv
cggcgaccgcgcucaccggg

SEQ ID NO: 1265485 - RNA, 13 nt, Mycobacterium tuberculosis H37Rv
cggcgaccggugc

SEQ ID NO: 1265486 - RNA, 16 nt, Mycobacterium tuberculosis H37Rv
cggcgaccgcgcucac

SEQ ID NO: 1265487 - RNA, 13 nt, Mycobacterium tuberculosis H37Rv
cggcgaccgucga

SEQ ID NO: 1265488 - RNA, 14 nt, Mycobacterium tuberculosis H37Rv
cggcgaccgucgau

SEQ ID NO: 1265489 - RNA, 21 nt, Mycobacterium tuberculosis H37Rv
cggcgaccuccgggaugucga

SEQ ID NO: 1265490 - RNA, 15 nt, Mycobacterium tuberculosis H37Rv
cggcgaccugcucgc

SEQ ID NO: 1265491 - RNA, 21 nt, Mycobacterium tuberculosis H37Rv
cggcgaccugcucgcugguga

SEQ ID NO: 1265492 - RNA, 20 nt, Mycobacterium tuberculosis H37Rv
cggcgaccuggcucaucgau

SEQ ID NO: 1265493 - RNA, 19 nt, Mycobacterium tuberculosis H37Rv
cggcagucccagcgccgca

SEQ ID NO: 1265494 - RNA, 12 nt, Mycobacterium tuberculosis H37Rv
cggcaguacccc

SEQ ID NO: 1265495 - RNA, 20 nt, Mycobacterium tuberculosis H37Rv
cggcagucauuauucgcgca

SEQ ID NO: 1265496 - RNA, 22 nt, Mycobacterium tuberculosis H37Rv
cggcauaacccuggccggugcg

SEQ ID NO: 1265497 - RNA, 19 nt, Mycobacterium tuberculosis H37Rv
cggcauagcggcccaucgg

SEQ ID NO: 1265498 - RNA, 14 nt, Mycobacterium tuberculosis H37Rv
cggcauagcggccc

SEQ ID NO: 1265499 - RNA, 19 nt, Mycobacterium tuberculosis H37Rv
cggcauagcagccagcguc

SEQ ID NO: 1265500 - RNA, 15 nt, Mycobacterium tuberculosis H37Rv
cggcaggugcgguca

SEQ ID NO: 1265501 - RNA, 19 nt, Mycobacterium tuberculosis H37Rv
cggcaggugcggcggcauc

SEQ ID NO: 1265502 - RNA, 22 nt, Mycobacterium tuberculosis H37Rv
cggcaggugcggcggcaucggu

SEQ ID NO: 1265503 - RNA, 18 nt, Mycobacterium tuberculosis H37Rv
cggcaggucuucgcuguc

SEQ ID NO: 1265504 - RNA, 17 nt, Mycobacterium tuberculosis H37Rv
cggcagcuucucgccga

SEQ ID NO: 1265505 - RNA, 19 nt, Mycobacterium tuberculosis H37Rv
cggcagcuucucgccgacg

SEQ ID NO: 1265506 - RNA, 18 nt, Mycobacterium tuberculosis H37Rv
cggcagcuugcagugccg

SEQ ID NO: 1265507 - RNA, 20 nt, Mycobacterium tuberculosis H37Rv
cggcagcucccgccacgucg

SEQ ID NO: 1265508 - RNA, 15 nt, Mycobacterium tuberculosis H37Rv
cggcagcgugggcga

SEQ ID NO: 1265509 - RNA, 21 nt, Mycobacterium tuberculosis H37Rv
cggcagcggaccgcugccugc

SEQ ID NO: 1265510 - RNA, 15 nt, Mycobacterium tuberculosis H37Rv
cggccaccagcgccc

SEQ ID NO: 1265511 - RNA, 15 nt, Mycobacterium tuberculosis H37Rv
cggccaccagcgccu

SEQ ID NO: 1265512 - RNA, 16 nt, Mycobacterium tuberculosis H37Rv
cggccaccucuucucg

SEQ ID NO: 1265513 - RNA, 12 nt, Mycobacterium tuberculosis H37Rv
cggccaccugcu

SEQ ID NO: 1265514 - RNA, 22 nt, Mycobacterium tuberculosis H37Rv
cggccacccggacauagccgcg

SEQ ID NO: 1265515 - RNA, 19 nt, Mycobacterium tuberculosis H37Rv
cggccaccgaggcguucag

SEQ ID NO: 1265516 - RNA, 19 nt, Mycobacterium tuberculosis H37Rv
cggccaccgucagcgcgac

SEQ ID NO: 1265517 - RNA, 23 nt, Mycobacterium tuberculosis H37Rv
cggccaacuucugcacgaacgcc

SEQ ID NO: 1265518 - RNA, 14 nt, Mycobacterium tuberculosis H37Rv
cggccaagccggcg

SEQ ID NO: 1265519 - RNA, 15 nt, Mycobacterium tuberculosis H37Rv
cggccaacggaccgu

SEQ ID NO: 1265520 - RNA, 18 nt, Mycobacterium tuberculosis H37Rv
cggccaacggaccguuac

SEQ ID NO: 1265521 - RNA, 20 nt, Mycobacterium tuberculosis H37Rv
cggccaacgacgacccguug

SEQ ID NO: 1265522 - RNA, 13 nt, Mycobacterium tuberculosis H37Rv
cggccaaccccga

SEQ ID NO: 1265523 - RNA, 21 nt, Mycobacterium tuberculosis H37Rv
cggccaacaccacuagcggcu

SEQ ID NO: 1265524 - RNA, 18 nt, Mycobacterium tuberculosis H37Rv
cggccaaauaacgcggga

SEQ ID NO: 1265525 - RNA, 21 nt, Mycobacterium tuberculosis H37Rv
cggccaaaauggcgcgaacgu

SEQ ID NO: 1265526 - RNA, 22 nt, Mycobacterium tuberculosis H37Rv
cggccaaaugccuuugggcugu

SEQ ID NO: 1265527 - RNA, 20 nt, Mycobacterium tuberculosis H37Rv
cggccaaaacauaucggugc

SEQ ID NO: 1265528 - RNA, 20 nt, Mycobacterium tuberculosis H37Rv
cggccaaagacccggcaccc

SEQ ID NO: 1265529 - RNA, 15 nt, Mycobacterium tuberculosis H37Rv
cggcauuggcggugc

SEQ ID NO: 1265530 - RNA, 23 nt, Mycobacterium tuberculosis H37Rv
cggcauuuucgagguacaacggg

SEQ ID NO: 1265531 - RNA, 16 nt, Mycobacterium tuberculosis H37Rv
cggcaugcucgacaac

SEQ ID NO: 1265532 - RNA, 21 nt, Mycobacterium tuberculosis H37Rv
cggcauccucaacaacgguag

SEQ ID NO: 1265533 - RNA, 21 nt, Mycobacterium tuberculosis H37Rv
cggcaugcccgcggugaccac

SEQ ID NO: 1265534 - RNA, 17 nt, Mycobacterium tuberculosis H37Rv
cggcaugccagccacga

SEQ ID NO: 1265535 - RNA, 22 nt, Mycobacterium tuberculosis H37Rv
cggcaugccagccacgaacuga

SEQ ID NO: 1265536 - RNA, 17 nt, Mycobacterium tuberculosis H37Rv
cggcaugcccgcgguga

SEQ ID NO: 1265537 - RNA, 21 nt, Mycobacterium tuberculosis H37Rv
cggcaugcaaugcuggcggcg

SEQ ID NO: 1265538 - RNA, 17 nt, Mycobacterium tuberculosis H37Rv
cggcaugcaaugcuggc

SEQ ID NO: 1265539 - RNA, 17 nt, Mycobacterium tuberculosis H37Rv
cggcauccugcacgacc

SEQ ID NO: 1265540 - RNA, 17 nt, Mycobacterium tuberculosis H37Rv
cggcaucgacugccagc

SEQ ID NO: 1265541 - RNA, 15 nt, Mycobacterium tuberculosis H37Rv
cggcaucgacugcca

SEQ ID NO: 1265542 - RNA, 20 nt, Mycobacterium tuberculosis H37Rv
cggcaagcgcagacacgacc

SEQ ID NO: 1265543 - RNA, 18 nt, Mycobacterium tuberculosis H37Rv
cggcaagcacaccgccag

SEQ ID NO: 1265544 - RNA, 19 nt, Mycobacterium tuberculosis H37Rv
cggcaagcacaccgccagc

SEQ ID NO: 1265545 - RNA, 17 nt, Mycobacterium tuberculosis H37Rv
cggcaagcacaccgcca

SEQ ID NO: 1265546 - RNA, 22 nt, Mycobacterium tuberculosis H37Rv
cggcaagccacgccggucgcgg

SEQ ID NO: 1265547 - RNA, 18 nt, Mycobacterium tuberculosis H37Rv
cggcaagucgacgccgca

SEQ ID NO: 1265548 - RNA, 15 nt, Mycobacterium tuberculosis H37Rv
cggcaagggcuucgg

SEQ ID NO: 1265549 - RNA, 18 nt, Mycobacterium tuberculosis H37Rv
cggcaaggucgcggccag

SEQ ID NO: 1265550 - RNA, 15 nt, Mycobacterium tuberculosis H37Rv
cggaugcgaugcccg

SEQ ID NO: 1265551 - RNA, 15 nt, Mycobacterium tuberculosis H37Rv
cggaugcgauggccg

SEQ ID NO: 1265552 - RNA, 16 nt, Mycobacterium tuberculosis H37Rv
cggaugcggccgaacu

SEQ ID NO: 1265553 - RNA, 16 nt, Mycobacterium tuberculosis H37Rv
cggaugcggccgguga

SEQ ID NO: 1265554 - RNA, 17 nt, Mycobacterium tuberculosis H37Rv
cggcaagacgcggucga

SEQ ID NO: 1265555 - RNA, 13 nt, Mycobacterium tuberculosis H37Rv
cggcaagaccgaa

SEQ ID NO: 1265556 - RNA, 12 nt, Mycobacterium tuberculosis H37Rv
cggcaccgccgg

SEQ ID NO: 1265557 - RNA, 14 nt, Mycobacterium tuberculosis H37Rv
cggcaccgcccuug

SEQ ID NO: 1265558 - RNA, 17 nt, Mycobacterium tuberculosis H37Rv
cggcaccgcccuugccg

SEQ ID NO: 1265559 - RNA, 23 nt, Mycobacterium tuberculosis H37Rv
cggcaccgcccuugccgccguug

SEQ ID NO: 1265560 - RNA, 16 nt, Mycobacterium tuberculosis H37Rv
cggcacccagucggcg

SEQ ID NO: 1265561 - RNA, 19 nt, Mycobacterium tuberculosis H37Rv
cggcaccgccggcaccgcc

SEQ ID NO: 1265562 - RNA, 23 nt, Mycobacterium tuberculosis H37Rv
cggcaccgcguaauucgacuucg

SEQ ID NO: 1265563 - RNA, 19 nt, Mycobacterium tuberculosis H37Rv
cggcacccacccguucggc

SEQ ID NO: 1265564 - RNA, 18 nt, Mycobacterium tuberculosis H37Rv
cggcacccacccguucgg

SEQ ID NO: 1265565 - RNA, 15 nt, Mycobacterium tuberculosis H37Rv
cggcaccagguugcc

SEQ ID NO: 1265566 - RNA, 19 nt, Mycobacterium tuberculosis H37Rv
cggcaaugcggggcaaucc

SEQ ID NO: 1265567 - RNA, 17 nt, Mycobacterium tuberculosis H37Rv
cggcaccagaucuucga

SEQ ID NO: 1265568 - RNA, 15 nt, Mycobacterium tuberculosis H37Rv
cggcaauggccagca

SEQ ID NO: 1265569 - RNA, 20 nt, Mycobacterium tuberculosis H37Rv
cggcaaugacguacgggguc

SEQ ID NO: 1265570 - RNA, 18 nt, Mycobacterium tuberculosis H37Rv
cggcaaucucgaucuugg

SEQ ID NO: 1265571 - RNA, 13 nt, Mycobacterium tuberculosis H37Rv
cggcaauaccgcc

SEQ ID NO: 1265572 - RNA, 12 nt, Mycobacterium tuberculosis H37Rv
cggcaagucgac

SEQ ID NO: 1265573 - RNA, 17 nt, Mycobacterium tuberculosis H37Rv
cggcagccuugaucucg

SEQ ID NO: 1265574 - RNA, 14 nt, Mycobacterium tuberculosis H37Rv
cggcagccuggccu

SEQ ID NO: 1265575 - RNA, 23 nt, Mycobacterium tuberculosis H37Rv
cggcagccggcuugggcgguagc

SEQ ID NO: 1265576 - RNA, 20 nt, Mycobacterium tuberculosis H37Rv
cggcagccggcuugggcggu

SEQ ID NO: 1265577 - RNA, 20 nt, Mycobacterium tuberculosis H37Rv
cggcacuaacggcgugucgg

SEQ ID NO: 1265578 - RNA, 16 nt, Mycobacterium tuberculosis H37Rv
cggcagcauauccgcc

SEQ ID NO: 1265579 - RNA, 15 nt, Mycobacterium tuberculosis H37Rv
cggcagccgcauagg

SEQ ID NO: 1265580 - RNA, 22 nt, Mycobacterium tuberculosis H37Rv
cggcagccuugaucucguccca

SEQ ID NO: 1265581 - RNA, 13 nt, Mycobacterium tuberculosis H37Rv
cggcagcgagacu

SEQ ID NO: 1265582 - RNA, 15 nt, Mycobacterium tuberculosis H37Rv
cggcagcgagaaccc

SEQ ID NO: 1265583 - RNA, 14 nt, Mycobacterium tuberculosis H37Rv
cggcagcggcgauc

SEQ ID NO: 1265584 - RNA, 14 nt, Mycobacterium tuberculosis H37Rv
cggcacugaccgcg

SEQ ID NO: 1265585 - RNA, 21 nt, Mycobacterium tuberculosis H37Rv
cggcagcaccggugaccucgg

SEQ ID NO: 1265586 - RNA, 19 nt, Mycobacterium tuberculosis H37Rv
cggcagcaggacaccuacc

SEQ ID NO: 1265587 - RNA, 23 nt, Mycobacterium tuberculosis H37Rv
cggcagcagcggugcagcccgcc

SEQ ID NO: 1265588 - RNA, 15 nt, Mycobacterium tuberculosis H37Rv
cggcagcagccggcg

SEQ ID NO: 1265589 - RNA, 15 nt, Mycobacterium tuberculosis H37Rv
cggcagcagaguucc

SEQ ID NO: 1265590 - RNA, 22 nt, Mycobacterium tuberculosis H37Rv
cggcagcagaguucccugaugg

SEQ ID NO: 1265591 - RNA, 14 nt, Mycobacterium tuberculosis H37Rv
cggcagcagcagag

SEQ ID NO: 1265592 - RNA, 18 nt, Mycobacterium tuberculosis H37Rv
cggcacgaaauugggcga

SEQ ID NO: 1265593 - RNA, 20 nt, Mycobacterium tuberculosis H37Rv
cggcaccuuguagcgggcaa

SEQ ID NO: 1265594 - RNA, 15 nt, Mycobacterium tuberculosis H37Rv
cggcaccgcugccgc

SEQ ID NO: 1265595 - RNA, 15 nt, Mycobacterium tuberculosis H37Rv
cggcacgaucgccaa

SEQ ID NO: 1265596 - RNA, 16 nt, Mycobacterium tuberculosis H37Rv
cggcacgacccgggaa

SEQ ID NO: 1265597 - RNA, 20 nt, Mycobacterium tuberculosis H37Rv
cggcacgcccacagcugacg

SEQ ID NO: 1265598 - RNA, 14 nt, Mycobacterium tuberculosis H37Rv
cggcacgcaauguc

SEQ ID NO: 1265599 - RNA, 18 nt, Mycobacterium tuberculosis H37Rv
cggcacgucgucguccca

SEQ ID NO: 1265600 - RNA, 18 nt, Mycobacterium tuberculosis H37Rv
cggcacgucggcgccgac

SEQ ID NO: 1265601 - RNA, 12 nt, Mycobacterium tuberculosis H37Rv
cggcacgguguc

SEQ ID NO: 1265602 - RNA, 20 nt, Mycobacterium tuberculosis H37Rv
cggcacgggaaucgcucgcg

SEQ ID NO: 1265603 - RNA, 19 nt, Mycobacterium tuberculosis H37Rv
cggaccgucguggcggugg

SEQ ID NO: 1265604 - RNA, 16 nt, Mycobacterium tuberculosis H37Rv
cggaccgucgccggug

SEQ ID NO: 1265605 - RNA, 21 nt, Mycobacterium tuberculosis H37Rv
cggaccgcuucgacgucguug

SEQ ID NO: 1265606 - RNA, 13 nt, Mycobacterium tuberculosis H37Rv
cggaccgcggauu

SEQ ID NO: 1265607 - RNA, 15 nt, Mycobacterium tuberculosis H37Rv
cggaccgcggccacc

SEQ ID NO: 1265608 - RNA, 14 nt, Mycobacterium tuberculosis H37Rv
cggacgaacccguu

SEQ ID NO: 1265609 - RNA, 12 nt, Mycobacterium tuberculosis H37Rv
cggaccugggug

SEQ ID NO: 1265610 - RNA, 16 nt, Mycobacterium tuberculosis H37Rv
cggaccugcgccggug

SEQ ID NO: 1265611 - RNA, 17 nt, Mycobacterium tuberculosis H37Rv
cggaccuccucgcccau

SEQ ID NO: 1265612 - RNA, 13 nt, Mycobacterium tuberculosis H37Rv
cggacccgcgcgu

SEQ ID NO: 1265613 - RNA, 13 nt, Mycobacterium tuberculosis H37Rv
cggacccgcccuu

SEQ ID NO: 1265614 - RNA, 17 nt, Mycobacterium tuberculosis H37Rv
cggacccgcccuugccg

SEQ ID NO: 1265615 - RNA, 14 nt, Mycobacterium tuberculosis H37Rv
cggacccgcucgcg

SEQ ID NO: 1265616 - RNA, 13 nt, Mycobacterium tuberculosis H37Rv
cggacccgccgug

SEQ ID NO: 1265617 - RNA, 15 nt, Mycobacterium tuberculosis H37Rv
cggacccgcagcugc

SEQ ID NO: 1265618 - RNA, 17 nt, Mycobacterium tuberculosis H37Rv
cggaccccacgaguagc

SEQ ID NO: 1265619 - RNA, 18 nt, Mycobacterium tuberculosis H37Rv
cggacccggcgcgauggc

SEQ ID NO: 1265620 - RNA, 20 nt, Mycobacterium tuberculosis H37Rv
cggaccgaagaccuccucgg

SEQ ID NO: 1265621 - RNA, 21 nt, Mycobacterium tuberculosis H37Rv
cggacccggugacccgcuggg

SEQ ID NO: 1265622 - RNA, 14 nt, Mycobacterium tuberculosis H37Rv
cggaccgaugacga

SEQ ID NO: 1265623 - RNA, 23 nt, Mycobacterium tuberculosis H37Rv
cggaccgauugucggcaacgacc

SEQ ID NO: 1265624 - RNA, 14 nt, Mycobacterium tuberculosis H37Rv
cggaccgcagcgug

SEQ ID NO: 1265625 - RNA, 16 nt, Mycobacterium tuberculosis H37Rv
cggaccgccaccuugg

SEQ ID NO: 1265626 - RNA, 15 nt, Mycobacterium tuberculosis H37Rv
cggaccgcgacggcg

SEQ ID NO: 1265627 - RNA, 18 nt, Mycobacterium tuberculosis H37Rv
cggacgggaucgcccagg

SEQ ID NO: 1265628 - RNA, 14 nt, Mycobacterium tuberculosis H37Rv
cggacgggaucgcc

SEQ ID NO: 1265629 - RNA, 15 nt, Mycobacterium tuberculosis H37Rv
cggacgcgcggaugg

SEQ ID NO: 1265630 - RNA, 13 nt, Mycobacterium tuberculosis H37Rv
cggacgcugauug

SEQ ID NO: 1265631 - RNA, 23 nt, Mycobacterium tuberculosis H37Rv
cggacggagguccuacgugcugc

SEQ ID NO: 1265632 - RNA, 14 nt, Mycobacterium tuberculosis H37Rv
cggacgaucagggu

SEQ ID NO: 1265633 - RNA, 20 nt, Mycobacterium tuberculosis H37Rv
cggacgauggcgucggccag

SEQ ID NO: 1265634 - RNA, 15 nt, Mycobacterium tuberculosis H37Rv
cggacgacgucgggu

SEQ ID NO: 1265635 - RNA, 22 nt, Mycobacterium tuberculosis H37Rv
cggacgccgacaaccuuggcga

SEQ ID NO: 1265636 - RNA, 17 nt, Mycobacterium tuberculosis H37Rv
cggacgaucaggguguc

SEQ ID NO: 1265637 - RNA, 18 nt, Mycobacterium tuberculosis H37Rv
cggacgcaacucgacgcg

SEQ ID NO: 1265638 - RNA, 18 nt, Mycobacterium tuberculosis H37Rv
cggacagcgccuggccgg

SEQ ID NO: 1265639 - RNA, 15 nt, Mycobacterium tuberculosis H37Rv
cggacagggcggcga

SEQ ID NO: 1265640 - RNA, 18 nt, Mycobacterium tuberculosis H37Rv
cggacauccgaugcguca

SEQ ID NO: 1265641 - RNA, 22 nt, Mycobacterium tuberculosis H37Rv
cggaccaccgggccgacagcac

SEQ ID NO: 1265642 - RNA, 17 nt, Mycobacterium tuberculosis H37Rv
cggaccacaucugguca

SEQ ID NO: 1265643 - RNA, 18 nt, Mycobacterium tuberculosis H37Rv
cggaccaggccgcgcgca

SEQ ID NO: 1265644 - RNA, 22 nt, Mycobacterium tuberculosis H37Rv
cggaccaggccgcgcgcaccgg

SEQ ID NO: 1265645 - RNA, 19 nt, Mycobacterium tuberculosis H37Rv
cggacccacccgcaccgcc

SEQ ID NO: 1265646 - RNA, 13 nt, Mycobacterium tuberculosis H37Rv
cggacccacccgc

SEQ ID NO: 1265647 - RNA, 16 nt, Mycobacterium tuberculosis H37Rv
cggacacggcagccuu

SEQ ID NO: 1265648 - RNA, 22 nt, Mycobacterium tuberculosis H37Rv
cggacaggcuugacugcacacc

SEQ ID NO: 1265649 - RNA, 17 nt, Mycobacterium tuberculosis H37Rv
cggacacacaggcggcg

SEQ ID NO: 1265650 - RNA, 20 nt, Mycobacterium tuberculosis H37Rv
cggacaccgcggcgaucugc

SEQ ID NO: 1265651 - RNA, 13 nt, Mycobacterium tuberculosis H37Rv
cggacacgaucgc

SEQ ID NO: 1265652 - RNA, 18 nt, Mycobacterium tuberculosis H37Rv
cggacacgaucgcgucgg

SEQ ID NO: 1265653 - RNA, 17 nt, Mycobacterium tuberculosis H37Rv
cggaaugaaggcaccga

SEQ ID NO: 1265654 - RNA, 12 nt, Mycobacterium tuberculosis H37Rv
cggaaucgucgc

SEQ ID NO: 1265655 - RNA, 22 nt, Mycobacterium tuberculosis H37Rv
cggaaugggcgccacagccgua

SEQ ID NO: 1265656 - RNA, 15 nt, Mycobacterium tuberculosis H37Rv
cggaauucgguuggc

SEQ ID NO: 1265657 - RNA, 19 nt, Mycobacterium tuberculosis H37Rv
cggacaaagcugcucgucg

SEQ ID NO: 1265658 - RNA, 17 nt, Mycobacterium tuberculosis H37Rv
cggaaugccgucgccgg

SEQ ID NO: 1265659 - RNA, 16 nt, Mycobacterium tuberculosis H37Rv
cgcuggucguggcggu

SEQ ID NO: 1265660 - RNA, 19 nt, Mycobacterium tuberculosis H37Rv
cgcuggugggaucgcagcg

SEQ ID NO: 1265661 - RNA, 22 nt, Mycobacterium tuberculosis H37Rv
cgcuggugcgccacgccaccgc

SEQ ID NO: 1265662 - RNA, 18 nt, Mycobacterium tuberculosis H37Rv
cgcuggugcgccacgcca

SEQ ID NO: 1265663 - RNA, 14 nt, Mycobacterium tuberculosis H37Rv
cgcugguuggcacg

SEQ ID NO: 1265664 - RNA, 17 nt, Mycobacterium tuberculosis H37Rv
cggagccaggacgacgc

SEQ ID NO: 1265665 - RNA, 12 nt, Mycobacterium tuberculosis H37Rv
cggagccgagcc

SEQ ID NO: 1265666 - RNA, 20 nt, Mycobacterium tuberculosis H37Rv
cggagcccugaccgggguga

SEQ ID NO: 1265667 - RNA, 14 nt, Mycobacterium tuberculosis H37Rv
cggagccgacaacg

SEQ ID NO: 1265668 - RNA, 15 nt, Mycobacterium tuberculosis H37Rv
cggagccgacaacga

SEQ ID NO: 1265669 - RNA, 14 nt, Mycobacterium tuberculosis H37Rv
cggagcacccgggg

SEQ ID NO: 1265670 - RNA, 21 nt, Mycobacterium tuberculosis H37Rv
cggagcacuucgucgaaccug

SEQ ID NO: 1265671 - RNA, 18 nt, Mycobacterium tuberculosis H37Rv
cggagauuucgucgcuga

SEQ ID NO: 1265672 - RNA, 18 nt, Mycobacterium tuberculosis H37Rv
cggagaguaggaccucgg

SEQ ID NO: 1265673 - RNA, 20 nt, Mycobacterium tuberculosis H37Rv
cggagaugaacucggcgauc

SEQ ID NO: 1265674 - RNA, 21 nt, Mycobacterium tuberculosis H37Rv
cggagaugccauuucgucguc

SEQ ID NO: 1265675 - RNA, 13 nt, Mycobacterium tuberculosis H37Rv
cggagccggguga

SEQ ID NO: 1265676 - RNA, 16 nt, Mycobacterium tuberculosis H37Rv
cggagccggugccgac

SEQ ID NO: 1265677 - RNA, 20 nt, Mycobacterium tuberculosis H37Rv
cggagccgcccaagccgccg

SEQ ID NO: 1265678 - RNA, 18 nt, Mycobacterium tuberculosis H37Rv
cggagccgccgcuggucu

SEQ ID NO: 1265679 - RNA, 14 nt, Mycobacterium tuberculosis H37Rv
cggagccggccacc

SEQ ID NO: 1265680 - RNA, 14 nt, Mycobacterium tuberculosis H37Rv
cggagccgccgcug

SEQ ID NO: 1265681 - RNA, 23 nt, Mycobacterium tuberculosis H37Rv
cggagccgccaggugcucgucga

SEQ ID NO: 1265682 - RNA, 22 nt, Mycobacterium tuberculosis H37Rv
cggagccgccaggugcucgucg

SEQ ID NO: 1265683 - RNA, 19 nt, Mycobacterium tuberculosis H37Rv
cggagccgaugaucgaaca

SEQ ID NO: 1265684 - RNA, 13 nt, Mycobacterium tuberculosis H37Rv
cggagcgaugcgg

SEQ ID NO: 1265685 - RNA, 14 nt, Mycobacterium tuberculosis H37Rv
cggagcgccgagcu

SEQ ID NO: 1265686 - RNA, 15 nt, Mycobacterium tuberculosis H37Rv
cggagcggugccgac

SEQ ID NO: 1265687 - RNA, 15 nt, Mycobacterium tuberculosis H37Rv
cggacugcagcgcgg

SEQ ID NO: 1265688 - RNA, 22 nt, Mycobacterium tuberculosis H37Rv
cggacucggaauucggcgucgu

SEQ ID NO: 1265689 - RNA, 22 nt, Mycobacterium tuberculosis H37Rv
cggacucguucauguagcagcg

SEQ ID NO: 1265690 - RNA, 19 nt, Mycobacterium tuberculosis H37Rv
cggacugcggaacaccagc

SEQ ID NO: 1265691 - RNA, 18 nt, Mycobacterium tuberculosis H37Rv
cggacucacgaggcacaa

SEQ ID NO: 1265692 - RNA, 23 nt, Mycobacterium tuberculosis H37Rv
cggacgggaucgcccaggcgcga

SEQ ID NO: 1265693 - RNA, 19 nt, Mycobacterium tuberculosis H37Rv
cggacuuggcggucgguuc

SEQ ID NO: 1265694 - RNA, 22 nt, Mycobacterium tuberculosis H37Rv
cggagaaguucgugagcgaacg

SEQ ID NO: 1265695 - RNA, 18 nt, Mycobacterium tuberculosis H37Rv
cggagaacgggucgacgu

SEQ ID NO: 1265696 - RNA, 19 nt, Mycobacterium tuberculosis H37Rv
cggagacuccagcaaggcc

SEQ ID NO: 1265697 - RNA, 16 nt, Mycobacterium tuberculosis H37Rv
cggagacgaucgccag

SEQ ID NO: 1265698 - RNA, 19 nt, Mycobacterium tuberculosis H37Rv
cggagacggcggccauguu

SEQ ID NO: 1265699 - RNA, 19 nt, Mycobacterium tuberculosis H37Rv
cggauaacgucacaccgau

SEQ ID NO: 1265700 - RNA, 18 nt, Mycobacterium tuberculosis H37Rv
cggaucaacaggccggcu

SEQ ID NO: 1265701 - RNA, 20 nt, Mycobacterium tuberculosis H37Rv
cggaggguucggacggcugg

SEQ ID NO: 1265702 - RNA, 21 nt, Mycobacterium tuberculosis H37Rv
cggaggcugggcugagggugg

SEQ ID NO: 1265703 - RNA, 21 nt, Mycobacterium tuberculosis H37Rv
cggaggccuccacauacgcgg

SEQ ID NO: 1265704 - RNA, 12 nt, Mycobacterium tuberculosis H37Rv
cggaggcaagca

SEQ ID NO: 1265705 - RNA, 17 nt, Mycobacterium tuberculosis H37Rv
cggaggcauuagcacgc

SEQ ID NO: 1265706 - RNA, 20 nt, Mycobacterium tuberculosis H37Rv
cggaggcauuagcacgcugu

SEQ ID NO: 1265707 - RNA, 15 nt, Mycobacterium tuberculosis H37Rv
cggaggcaauccgau

SEQ ID NO: 1265708 - RNA, 17 nt, Mycobacterium tuberculosis H37Rv
cggaggcaauccgaucu

SEQ ID NO: 1265709 - RNA, 17 nt, Mycobacterium tuberculosis H37Rv
cggagcuuguugcagcg

SEQ ID NO: 1265710 - RNA, 20 nt, Mycobacterium tuberculosis H37Rv
cggagcgggccagcacccgc

SEQ ID NO: 1265711 - RNA, 20 nt, Mycobacterium tuberculosis H37Rv
cggagcucaaccaccucgcc

SEQ ID NO: 1265712 - RNA, 20 nt, Mycobacterium tuberculosis H37Rv
cggagcgguguggucgcagg

SEQ ID NO: 1265713 - RNA, 20 nt, Mycobacterium tuberculosis H37Rv
cggaucgccgucgcgaccga

SEQ ID NO: 1265714 - RNA, 17 nt, Mycobacterium tuberculosis H37Rv
cggaucgcccugacacc

SEQ ID NO: 1265715 - RNA, 23 nt, Mycobacterium tuberculosis H37Rv
cggaucguacgggucggcgacga

SEQ ID NO: 1265716 - RNA, 18 nt, Mycobacterium tuberculosis H37Rv
cggaucuggccuuggcag

SEQ ID NO: 1265717 - RNA, 23 nt, Mycobacterium tuberculosis H37Rv
cggaucugagcuagccguucggc

SEQ ID NO: 1265718 - RNA, 16 nt, Mycobacterium tuberculosis H37Rv
cggaucgccacggugg

SEQ ID NO: 1265719 - RNA, 14 nt, Mycobacterium tuberculosis H37Rv
ccgugugcacgcga

SEQ ID NO: 1265720 - RNA, 13 nt, Mycobacterium tuberculosis H37Rv
ccgugugggcguu

SEQ ID NO: 1265721 - RNA, 17 nt, Mycobacterium tuberculosis H37Rv
ccguguggugcgcaaac

SEQ ID NO: 1265722 - RNA, 17 nt, Mycobacterium tuberculosis H37Rv
ccgugucgccggcgaag

SEQ ID NO: 1265723 - RNA, 17 nt, Mycobacterium tuberculosis H37Rv
ccgugucgccgccgcga

SEQ ID NO: 1265724 - RNA, 13 nt, Mycobacterium tuberculosis H37Rv
ccguggccucgaa

SEQ ID NO: 1265725 - RNA, 18 nt, Mycobacterium tuberculosis H37Rv
ccguggccggacccauug

SEQ ID NO: 1265726 - RNA, 14 nt, Mycobacterium tuberculosis H37Rv
ccguggcagucgca

SEQ ID NO: 1265727 - RNA, 18 nt, Mycobacterium tuberculosis H37Rv
ccguggccaaacuuucgg

SEQ ID NO: 1265728 - RNA, 19 nt, Mycobacterium tuberculosis H37Rv
ccguguugagggugcccga

SEQ ID NO: 1265729 - RNA, 16 nt, Mycobacterium tuberculosis H37Rv
ccgugugugcgaucca

SEQ ID NO: 1265730 - RNA, 15 nt, Mycobacterium tuberculosis H37Rv
ccguguucgccacac

SEQ ID NO: 1265731 - RNA, 20 nt, Mycobacterium tuberculosis H37Rv
ccgugugcuucgagcaccga

SEQ ID NO: 1265732 - RNA, 21 nt, Mycobacterium tuberculosis H37Rv
ccguuaccgccguuaccgacg

SEQ ID NO: 1265733 - RNA, 20 nt, Mycobacterium tuberculosis H37Rv
ccguuaccgccguugccgau

SEQ ID NO: 1265734 - RNA, 14 nt, Mycobacterium tuberculosis H37Rv
ccguucacgcucgu

SEQ ID NO: 1265735 - RNA, 19 nt, Mycobacterium tuberculosis H37Rv
ccguggaagacgucgaggu

SEQ ID NO: 1265736 - RNA, 22 nt, Mycobacterium tuberculosis H37Rv
ccgugcugggcaucaccgacgc

SEQ ID NO: 1265737 - RNA, 19 nt, Mycobacterium tuberculosis H37Rv
ccgugcugggugacaccgg

SEQ ID NO: 1265738 - RNA, 23 nt, Mycobacterium tuberculosis H37Rv
ccgugcugaacuccgccgcgauc

SEQ ID NO: 1265739 - RNA, 16 nt, Mycobacterium tuberculosis H37Rv
ccgugccgggcgacgg

SEQ ID NO: 1265740 - RNA, 14 nt, Mycobacterium tuberculosis H37Rv
ccgugccagcaggg

SEQ ID NO: 1265741 - RNA, 12 nt, Mycobacterium tuberculosis H37Rv
ccgugccgagcg

SEQ ID NO: 1265742 - RNA, 23 nt, Mycobacterium tuberculosis H37Rv
ccgugacaccggggacgucgacu

SEQ ID NO: 1265743 - RNA, 20 nt, Mycobacterium tuberculosis H37Rv
ccgugacauucugcagcguc

SEQ ID NO: 1265744 - RNA, 20 nt, Mycobacterium tuberculosis H37Rv
ccgucuuugucacgcaccgc

SEQ ID NO: 1265745 - RNA, 21 nt, Mycobacterium tuberculosis H37Rv
ccgucucgguggugaguacca

SEQ ID NO: 1265746 - RNA, 16 nt, Mycobacterium tuberculosis H37Rv
ccgucucgucggcaac

SEQ ID NO: 1265747 - RNA, 21 nt, Mycobacterium tuberculosis H37Rv
ccgucugcggaccggcgcgcu

SEQ ID NO: 1265748 - RNA, 20 nt, Mycobacterium tuberculosis H37Rv
ccgucucggcaugcucgaca

SEQ ID NO: 1265749 - RNA, 21 nt, Mycobacterium tuberculosis H37Rv
ccgucgucgugcacgacgaca

SEQ ID NO: 1265750 - RNA, 13 nt, Mycobacterium tuberculosis H37Rv
ccgucgucgugca

SEQ ID NO: 1265751 - RNA, 15 nt, Mycobacterium tuberculosis H37Rv
ccgucgucgucgaga

SEQ ID NO: 1265752 - RNA, 19 nt, Mycobacterium tuberculosis H37Rv
ccgucugacagcauccuuc

SEQ ID NO: 1265753 - RNA, 15 nt, Mycobacterium tuberculosis H37Rv
ccgucuggccguugc

SEQ ID NO: 1265754 - RNA, 16 nt, Mycobacterium tuberculosis H37Rv
ccgucuuaucggcguc

SEQ ID NO: 1265755 - RNA, 19 nt, Mycobacterium tuberculosis H37Rv
ccgucuuuggugccgagca

SEQ ID NO: 1265756 - RNA, 16 nt, Mycobacterium tuberculosis H37Rv
ccgucggcgaugaagu

SEQ ID NO: 1265757 - RNA, 19 nt, Mycobacterium tuberculosis H37Rv
ccgucggcgccggcaucga

SEQ ID NO: 1265758 - RNA, 20 nt, Mycobacterium tuberculosis H37Rv
ccgucggcgccucggaccag

SEQ ID NO: 1265759 - RNA, 21 nt, Mycobacterium tuberculosis H37Rv
ccgucgucaaauuuucguuga

SEQ ID NO: 1265760 - RNA, 19 nt, Mycobacterium tuberculosis H37Rv
ccgucgucgaccacgacgu

SEQ ID NO: 1265761 - RNA, 22 nt, Mycobacterium tuberculosis H37Rv
ccgucgucgagcaccacccggg

SEQ ID NO: 1265762 - RNA, 13 nt, Mycobacterium tuberculosis H37Rv
ccgucgucgagcc

SEQ ID NO: 1265763 - RNA, 14 nt, Mycobacterium tuberculosis H37Rv
ccgucgucggucuc

SEQ ID NO: 1265764 - RNA, 20 nt, Mycobacterium tuberculosis H37Rv
ccgucgucaccuucaccggg

SEQ ID NO: 1265765 - RNA, 15 nt, Mycobacterium tuberculosis H37Rv
ccgucgucgucggca

SEQ ID NO: 1265766 - RNA, 16 nt, Mycobacterium tuberculosis H37Rv
ccgucgucgucggcag

SEQ ID NO: 1265767 - RNA, 18 nt, Mycobacterium tuberculosis H37Rv
ccgucgucggcguacccg

SEQ ID NO: 1265768 - RNA, 13 nt, Mycobacterium tuberculosis H37Rv
ccgucgucgccgu

SEQ ID NO: 1265769 - RNA, 21 nt, Mycobacterium tuberculosis H37Rv
ccgucgagcaacgugacccgg

SEQ ID NO: 1265770 - RNA, 15 nt, Mycobacterium tuberculosis H37Rv
ccgucgagccgugcc

SEQ ID NO: 1265771 - RNA, 13 nt, Mycobacterium tuberculosis H37Rv
ccgucgaccggcg

SEQ ID NO: 1265772 - RNA, 14 nt, Mycobacterium tuberculosis H37Rv
ccgucgacgcggcc

SEQ ID NO: 1265773 - RNA, 16 nt, Mycobacterium tuberculosis H37Rv
ccgucgacgucgaugg

SEQ ID NO: 1265774 - RNA, 17 nt, Mycobacterium tuberculosis H37Rv
ccgucgacgucgauggu

SEQ ID NO: 1265775 - RNA, 21 nt, Mycobacterium tuberculosis H37Rv
ccguccgcggguagcgguuca

SEQ ID NO: 1265776 - RNA, 14 nt, Mycobacterium tuberculosis H37Rv
ccguccgcaccggc

SEQ ID NO: 1265777 - RNA, 20 nt, Mycobacterium tuberculosis H37Rv
ccguccgccguaugccgcca

SEQ ID NO: 1265778 - RNA, 20 nt, Mycobacterium tuberculosis H37Rv
ccgucccugugucgccgucg

SEQ ID NO: 1265779 - RNA, 17 nt, Mycobacterium tuberculosis H37Rv
ccgucgaaccuaccgug

SEQ ID NO: 1265780 - RNA, 22 nt, Mycobacterium tuberculosis H37Rv
ccgucgaagaugaccugaucga

SEQ ID NO: 1265781 - RNA, 22 nt, Mycobacterium tuberculosis H37Rv
ccgucgaagcgaacacccgguc

SEQ ID NO: 1265782 - RNA, 14 nt, Mycobacterium tuberculosis H37Rv
ccgucgacagcguc

SEQ ID NO: 1265783 - RNA, 16 nt, Mycobacterium tuberculosis H37Rv
ccgguguguccagcgg

SEQ ID NO: 1265784 - RNA, 13 nt, Mycobacterium tuberculosis H37Rv
ccggugugcgcac

SEQ ID NO: 1265785 - RNA, 20 nt, Mycobacterium tuberculosis H37Rv
ccgguucugggccugcggca

SEQ ID NO: 1265786 - RNA, 17 nt, Mycobacterium tuberculosis H37Rv
ccgguugacgggcucgg

SEQ ID NO: 1265787 - RNA, 16 nt, Mycobacterium tuberculosis H37Rv
ccgguugacacccggg

SEQ ID NO: 1265788 - RNA, 14 nt, Mycobacterium tuberculosis H37Rv
ccgguugcggcugc

SEQ ID NO: 1265789 - RNA, 21 nt, Mycobacterium tuberculosis H37Rv
ccgguugccaccugugcgaac

SEQ ID NO: 1265790 - RNA, 12 nt, Mycobacterium tuberculosis H37Rv
ccgguuggcccc

SEQ ID NO: 1265791 - RNA, 23 nt, Mycobacterium tuberculosis H37Rv
ccgguggcagagccgccguugcc

SEQ ID NO: 1265792 - RNA, 12 nt, Mycobacterium tuberculosis H37Rv
ccgguggcagcc

SEQ ID NO: 1265793 - RNA, 19 nt, Mycobacterium tuberculosis H37Rv
ccgguggcagcacagcguc

SEQ ID NO: 1265794 - RNA, 14 nt, Mycobacterium tuberculosis H37Rv
ccgguggccaacac

SEQ ID NO: 1265795 - RNA, 13 nt, Mycobacterium tuberculosis H37Rv
ccgguggccaaca

SEQ ID NO: 1265796 - RNA, 13 nt, Mycobacterium tuberculosis H37Rv
ccgguggcauucg

SEQ ID NO: 1265797 - RNA, 19 nt, Mycobacterium tuberculosis H37Rv
ccgguguaggccucggcag

SEQ ID NO: 1265798 - RNA, 20 nt, Mycobacterium tuberculosis H37Rv
ccgguguaguacagcgcaac

SEQ ID NO: 1265799 - RNA, 20 nt, Mycobacterium tuberculosis H37Rv
ccgguguccagugcauuccc

SEQ ID NO: 1265800 - RNA, 23 nt, Mycobacterium tuberculosis H37Rv
ccggugcaaccccaaguccagca

SEQ ID NO: 1265801 - RNA, 16 nt, Mycobacterium tuberculosis H37Rv
ccggugauggugacca

SEQ ID NO: 1265802 - RNA, 17 nt, Mycobacterium tuberculosis H37Rv
ccggugauggugaccag

SEQ ID NO: 1265803 - RNA, 23 nt, Mycobacterium tuberculosis H37Rv
ccggugauggugaccagcaggcc

SEQ ID NO: 1265804 - RNA, 16 nt, Mycobacterium tuberculosis H37Rv
ccggugagucgcuguc

SEQ ID NO: 1265805 - RNA, 14 nt, Mycobacterium tuberculosis H37Rv
ccggugauccgguc

SEQ ID NO: 1265806 - RNA, 21 nt, Mycobacterium tuberculosis H37Rv
ccggugccaguacucggccag

SEQ ID NO: 1265807 - RNA, 15 nt, Mycobacterium tuberculosis H37Rv
ccgguggcacggccc

SEQ ID NO: 1265808 - RNA, 17 nt, Mycobacterium tuberculosis H37Rv
ccggugccacugccguu

SEQ ID NO: 1265809 - RNA, 20 nt, Mycobacterium tuberculosis H37Rv
ccggugcacgguaucggugc

SEQ ID NO: 1265810 - RNA, 13 nt, Mycobacterium tuberculosis H37Rv
ccggugcaccagg

SEQ ID NO: 1265811 - RNA, 17 nt, Mycobacterium tuberculosis H37Rv
ccgggugaguucggcgu

SEQ ID NO: 1265812 - RNA, 13 nt, Mycobacterium tuberculosis H37Rv
ccgggugcagauc

SEQ ID NO: 1265813 - RNA, 21 nt, Mycobacterium tuberculosis H37Rv
ccgggugcgacgcgaccgcga

SEQ ID NO: 1265814 - RNA, 13 nt, Mycobacterium tuberculosis H37Rv
ccgggugccgcgc

SEQ ID NO: 1265815 - RNA, 14 nt, Mycobacterium tuberculosis H37Rv
ccggugagcaccgg

SEQ ID NO: 1265816 - RNA, 18 nt, Mycobacterium tuberculosis H37Rv
ccggugaggaucagcgug

SEQ ID NO: 1265817 - RNA, 14 nt, Mycobacterium tuberculosis H37Rv
ccguaaaagccgau

SEQ ID NO: 1265818 - RNA, 21 nt, Mycobacterium tuberculosis H37Rv
ccgguuuggagcucaucgacg

SEQ ID NO: 1265819 - RNA, 20 nt, Mycobacterium tuberculosis H37Rv
ccgguuggcugccggcaaca

SEQ ID NO: 1265820 - RNA, 17 nt, Mycobacterium tuberculosis H37Rv
ccgguuucuucggccag

SEQ ID NO: 1265821 - RNA, 13 nt, Mycobacterium tuberculosis H37Rv
ccgguuugacguc

SEQ ID NO: 1265822 - RNA, 22 nt, Mycobacterium tuberculosis H37Rv
ccguauugauacugcccgcguu

SEQ ID NO: 1265823 - RNA, 13 nt, Mycobacterium tuberculosis H37Rv
ccguaccggugau

SEQ ID NO: 1265824 - RNA, 18 nt, Mycobacterium tuberculosis H37Rv
ccguacagcggcggcguc

SEQ ID NO: 1265825 - RNA, 22 nt, Mycobacterium tuberculosis H37Rv
ccguacaucagcgcgaacgccu

SEQ ID NO: 1265826 - RNA, 15 nt, Mycobacterium tuberculosis H37Rv
ccgucaugccgacga

SEQ ID NO: 1265827 - RNA, 22 nt, Mycobacterium tuberculosis H37Rv
ccguccaauuggcgucgucggc

SEQ ID NO: 1265828 - RNA, 15 nt, Mycobacterium tuberculosis H37Rv
ccguccaauuccgca

SEQ ID NO: 1265829 - RNA, 18 nt, Mycobacterium tuberculosis H37Rv
ccguccccgcagcgccua

SEQ ID NO: 1265830 - RNA, 18 nt, Mycobacterium tuberculosis H37Rv
ccgucccagcugaccagc

SEQ ID NO: 1265831 - RNA, 14 nt, Mycobacterium tuberculosis H37Rv
ccgucccgcgagca

SEQ ID NO: 1265832 - RNA, 16 nt, Mycobacterium tuberculosis H37Rv
ccgucauacucgacac

SEQ ID NO: 1265833 - RNA, 20 nt, Mycobacterium tuberculosis H37Rv
ccgucauggcgggugcggcg

SEQ ID NO: 1265834 - RNA, 23 nt, Mycobacterium tuberculosis H37Rv
ccgucaugaagccguugccgcca

SEQ ID NO: 1265835 - RNA, 19 nt, Mycobacterium tuberculosis H37Rv
ccgucagcccgacguugcg

SEQ ID NO: 1265836 - RNA, 17 nt, Mycobacterium tuberculosis H37Rv
ccgucagcggcggccac

SEQ ID NO: 1265837 - RNA, 12 nt, Mycobacterium tuberculosis H37Rv
ccgucaacgaug

SEQ ID NO: 1265838 - RNA, 13 nt, Mycobacterium tuberculosis H37Rv
ccugcaugcccag

SEQ ID NO: 1265839 - RNA, 16 nt, Mycobacterium tuberculosis H37Rv
ccugcagcucgggcag

SEQ ID NO: 1265840 - RNA, 14 nt, Mycobacterium tuberculosis H37Rv
ccugcagcgaugac

SEQ ID NO: 1265841 - RNA, 21 nt, Mycobacterium tuberculosis H37Rv
ccugccaucacgcgcucaccg

SEQ ID NO: 1265842 - RNA, 14 nt, Mycobacterium tuberculosis H37Rv
ccugcccacgcgga

SEQ ID NO: 1265843 - RNA, 15 nt, Mycobacterium tuberculosis H37Rv
ccugauggacccgau

SEQ ID NO: 1265844 - RNA, 16 nt, Mycobacterium tuberculosis H37Rv
ccugacccggagccgc

SEQ ID NO: 1265845 - RNA, 17 nt, Mycobacterium tuberculosis H37Rv
ccucuugcucggcgugc

SEQ ID NO: 1265846 - RNA, 23 nt, Mycobacterium tuberculosis H37Rv
ccucugcugagcugcucgccggc

SEQ ID NO: 1265847 - RNA, 17 nt, Mycobacterium tuberculosis H37Rv
ccucgguguacaccgcg

SEQ ID NO: 1265848 - RNA, 20 nt, Mycobacterium tuberculosis H37Rv
ccucguaggcguacaccagg

SEQ ID NO: 1265849 - RNA, 16 nt, Mycobacterium tuberculosis H37Rv
ccucgcggugcgccac

SEQ ID NO: 1265850 - RNA, 16 nt, Mycobacterium tuberculosis H37Rv
ccucggcgaugucgcg

SEQ ID NO: 1265851 - RNA, 16 nt, Mycobacterium tuberculosis H37Rv
ccucggucaccgaggg

SEQ ID NO: 1265852 - RNA, 15 nt, Mycobacterium tuberculosis H37Rv
ccucggucaccgagg

SEQ ID NO: 1265853 - RNA, 20 nt, Mycobacterium tuberculosis H37Rv
ccucggguguggucaccagg

SEQ ID NO: 1265854 - RNA, 14 nt, Mycobacterium tuberculosis H37Rv
ccucggcgggaucc

SEQ ID NO: 1265855 - RNA, 21 nt, Mycobacterium tuberculosis H37Rv
ccuccuugaaccgggacacca

SEQ ID NO: 1265856 - RNA, 17 nt, Mycobacterium tuberculosis H37Rv
ccucgacguggccgacg

SEQ ID NO: 1265857 - RNA, 14 nt, Mycobacterium tuberculosis H37Rv
ccucgagcaccgcg

SEQ ID NO: 1265858 - RNA, 15 nt, Mycobacterium tuberculosis H37Rv
ccucgagugccgccg

SEQ ID NO: 1265859 - RNA, 14 nt, Mycobacterium tuberculosis H37Rv
ccucgaggcuggua

SEQ ID NO: 1265860 - RNA, 13 nt, Mycobacterium tuberculosis H37Rv
ccuccucggugag

SEQ ID NO: 1265861 - RNA, 18 nt, Mycobacterium tuberculosis H37Rv
ccuccgugggcagcgcgc

SEQ ID NO: 1265862 - RNA, 15 nt, Mycobacterium tuberculosis H37Rv
ccuccucgacgucgg

SEQ ID NO: 1265863 - RNA, 16 nt, Mycobacterium tuberculosis H37Rv
ccuccgcgccgaucag

SEQ ID NO: 1265864 - RNA, 16 nt, Mycobacterium tuberculosis H37Rv
ccucgaguuuggccag

SEQ ID NO: 1265865 - RNA, 17 nt, Mycobacterium tuberculosis H37Rv
ccucgauaucgucggga

SEQ ID NO: 1265866 - RNA, 19 nt, Mycobacterium tuberculosis H37Rv
ccucgaugacaucggucag

SEQ ID NO: 1265867 - RNA, 16 nt, Mycobacterium tuberculosis H37Rv
ccucgcacgacaccuc

SEQ ID NO: 1265868 - RNA, 13 nt, Mycobacterium tuberculosis H37Rv
ccucgaugaugcg

SEQ ID NO: 1265869 - RNA, 20 nt, Mycobacterium tuberculosis H37Rv
ccucgaugacaucggucagc

SEQ ID NO: 1265870 - RNA, 14 nt, Mycobacterium tuberculosis H37Rv
ccucgcccgcacca

SEQ ID NO: 1265871 - RNA, 15 nt, Mycobacterium tuberculosis H37Rv
ccucgcccugcagac

SEQ ID NO: 1265872 - RNA, 19 nt, Mycobacterium tuberculosis H37Rv
ccucgcccugcagacgggu

SEQ ID NO: 1265873 - RNA, 22 nt, Mycobacterium tuberculosis H37Rv
ccucgcagguggugacacgacg

SEQ ID NO: 1265874 - RNA, 14 nt, Mycobacterium tuberculosis H37Rv
ccucgccaucgacc

SEQ ID NO: 1265875 - RNA, 15 nt, Mycobacterium tuberculosis H37Rv
ccucgccggccgcca

SEQ ID NO: 1265876 - RNA, 14 nt, Mycobacterium tuberculosis H37Rv
ccucgccggugacg

SEQ ID NO: 1265877 - RNA, 14 nt, Mycobacterium tuberculosis H37Rv
ccucgccggcggga

SEQ ID NO: 1265878 - RNA, 15 nt, Mycobacterium tuberculosis H37Rv
ccguuccguaucggg

SEQ ID NO: 1265879 - RNA, 20 nt, Mycobacterium tuberculosis H37Rv
ccguucccacccacgccgac

SEQ ID NO: 1265880 - RNA, 16 nt, Mycobacterium tuberculosis H37Rv
ccguuccacgccggca

SEQ ID NO: 1265881 - RNA, 16 nt, Mycobacterium tuberculosis H37Rv
ccguucgcgucgccga

SEQ ID NO: 1265882 - RNA, 17 nt, Mycobacterium tuberculosis H37Rv
ccguucgcccgcccguc

SEQ ID NO: 1265883 - RNA, 18 nt, Mycobacterium tuberculosis H37Rv
ccguucgaggucggcgau

SEQ ID NO: 1265884 - RNA, 17 nt, Mycobacterium tuberculosis H37Rv
ccguucgccgucgguga

SEQ ID NO: 1265885 - RNA, 19 nt, Mycobacterium tuberculosis H37Rv
ccuagccccugaaggccag

SEQ ID NO: 1265886 - RNA, 22 nt, Mycobacterium tuberculosis H37Rv
ccuagcaccgcgccgaacacgc

SEQ ID NO: 1265887 - RNA, 16 nt, Mycobacterium tuberculosis H37Rv
ccuagaccgggcgguu

SEQ ID NO: 1265888 - RNA, 22 nt, Mycobacterium tuberculosis H37Rv
ccuaccggcuacggcgacacgc

SEQ ID NO: 1265889 - RNA, 16 nt, Mycobacterium tuberculosis H37Rv
ccuaccgagaucaccg

SEQ ID NO: 1265890 - RNA, 17 nt, Mycobacterium tuberculosis H37Rv
ccuaccgagaucaccgc

SEQ ID NO: 1265891 - RNA, 23 nt, Mycobacterium tuberculosis H37Rv
ccuagcucgcgguuuuggucgcg

SEQ ID NO: 1265892 - RNA, 20 nt, Mycobacterium tuberculosis H37Rv
ccuagucaccuugaccgggu

SEQ ID NO: 1265893 - RNA, 16 nt, Mycobacterium tuberculosis H37Rv
ccucagccaccgcggu

SEQ ID NO: 1265894 - RNA, 17 nt, Mycobacterium tuberculosis H37Rv
ccuaggucgacgccgac

SEQ ID NO: 1265895 - RNA, 17 nt, Mycobacterium tuberculosis H37Rv
ccucagcgaugcucacu

SEQ ID NO: 1265896 - RNA, 12 nt, Mycobacterium tuberculosis H37Rv
ccucagcggccc

SEQ ID NO: 1265897 - RNA, 19 nt, Mycobacterium tuberculosis H37Rv
ccucaguucacgcucgacg

SEQ ID NO: 1265898 - RNA, 17 nt, Mycobacterium tuberculosis H37Rv
ccuccaccaacucgacg

SEQ ID NO: 1265899 - RNA, 20 nt, Mycobacterium tuberculosis H37Rv
ccuccgccggucaugauccg

SEQ ID NO: 1265900 - RNA, 13 nt, Mycobacterium tuberculosis H37Rv
ccggaaucccgag

SEQ ID NO: 1265901 - RNA, 19 nt, Mycobacterium tuberculosis H37Rv
ccggaauagcaacgcugca

SEQ ID NO: 1265902 - RNA, 19 nt, Mycobacterium tuberculosis H37Rv
ccggaaucggcggcggauu

SEQ ID NO: 1265903 - RNA, 20 nt, Mycobacterium tuberculosis H37Rv
ccggcauacaucgccuugcc

SEQ ID NO: 1265904 - RNA, 15 nt, Mycobacterium tuberculosis H37Rv
ccggcauacaccgug

SEQ ID NO: 1265905 - RNA, 17 nt, Mycobacterium tuberculosis H37Rv
ccggcauaacgaucccg

SEQ ID NO: 1265906 - RNA, 17 nt, Mycobacterium tuberculosis H37Rv
ccggcauagcggcccau

SEQ ID NO: 1265907 - RNA, 15 nt, Mycobacterium tuberculosis H37Rv
ccggcaucgaucaac

SEQ ID NO: 1265908 - RNA, 17 nt, Mycobacterium tuberculosis H37Rv
ccggcauccucaacaac

SEQ ID NO: 1265909 - RNA, 18 nt, Mycobacterium tuberculosis H37Rv
ccggaauacaccagcgac

SEQ ID NO: 1265910 - RNA, 16 nt, Mycobacterium tuberculosis H37Rv
ccggaagcggcguucg

SEQ ID NO: 1265911 - RNA, 12 nt, Mycobacterium tuberculosis H37Rv
ccgcugggccgg

SEQ ID NO: 1265912 - RNA, 19 nt, Mycobacterium tuberculosis H37Rv
ccggccaaaauuuugucgg

SEQ ID NO: 1265913 - RNA, 18 nt, Mycobacterium tuberculosis H37Rv
ccggccaagccggcgagu

SEQ ID NO: 1265914 - RNA, 13 nt, Mycobacterium tuberculosis H37Rv
ccggccaacuggg

SEQ ID NO: 1265915 - RNA, 15 nt, Mycobacterium tuberculosis H37Rv
ccggccaauggccug

SEQ ID NO: 1265916 - RNA, 17 nt, Mycobacterium tuberculosis H37Rv
ccggccaauggccugca

SEQ ID NO: 1265917 - RNA, 13 nt, Mycobacterium tuberculosis H37Rv
ccggccaggccga

SEQ ID NO: 1265918 - RNA, 17 nt, Mycobacterium tuberculosis H37Rv
ccggccagguauguccg

SEQ ID NO: 1265919 - RNA, 13 nt, Mycobacterium tuberculosis H37Rv
ccggccaggccgg

SEQ ID NO: 1265920 - RNA, 18 nt, Mycobacterium tuberculosis H37Rv
ccggcccaccgccgauac

SEQ ID NO: 1265921 - RNA, 16 nt, Mycobacterium tuberculosis H37Rv
ccggccgacacgccga

SEQ ID NO: 1265922 - RNA, 19 nt, Mycobacterium tuberculosis H37Rv
ccggccgaugcgacccgca

SEQ ID NO: 1265923 - RNA, 17 nt, Mycobacterium tuberculosis H37Rv
ccggccgaugcgacccg

SEQ ID NO: 1265924 - RNA, 15 nt, Mycobacterium tuberculosis H37Rv
ccggccgcacccguu

SEQ ID NO: 1265925 - RNA, 23 nt, Mycobacterium tuberculosis H37Rv
ccggccggacaacagagucaccg

SEQ ID NO: 1265926 - RNA, 16 nt, Mycobacterium tuberculosis H37Rv
ccggccgcgacgacac

SEQ ID NO: 1265927 - RNA, 14 nt, Mycobacterium tuberculosis H37Rv
ccggccgccgaaac

SEQ ID NO: 1265928 - RNA, 13 nt, Mycobacterium tuberculosis H37Rv
ccggcccggugau

SEQ ID NO: 1265929 - RNA, 13 nt, Mycobacterium tuberculosis H37Rv
ccggcccgcccgu

SEQ ID NO: 1265930 - RNA, 17 nt, Mycobacterium tuberculosis H37Rv
ccggcccgaucggcaac

SEQ ID NO: 1265931 - RNA, 15 nt, Mycobacterium tuberculosis H37Rv
ccggccccgccguca

SEQ ID NO: 1265932 - RNA, 16 nt, Mycobacterium tuberculosis H37Rv
ccggccccgccgucac

SEQ ID NO: 1265933 - RNA, 18 nt, Mycobacterium tuberculosis H37Rv
ccggcgcaguagccgacc

SEQ ID NO: 1265934 - RNA, 18 nt, Mycobacterium tuberculosis H37Rv
ccggcgcagauagcgcuc

SEQ ID NO: 1265935 - RNA, 22 nt, Mycobacterium tuberculosis H37Rv
ccggcgccaccgugguggacga

SEQ ID NO: 1265936 - RNA, 13 nt, Mycobacterium tuberculosis H37Rv
ccggcgcauuccc

SEQ ID NO: 1265937 - RNA, 16 nt, Mycobacterium tuberculosis H37Rv
ccggcgccaccguugc

SEQ ID NO: 1265938 - RNA, 13 nt, Mycobacterium tuberculosis H37Rv
ccggcgccaccgu

SEQ ID NO: 1265939 - RNA, 20 nt, Mycobacterium tuberculosis H37Rv
ccggcgccaccgccgcugcc

SEQ ID NO: 1265940 - RNA, 14 nt, Mycobacterium tuberculosis H37Rv
ccggcgcaccuggg

SEQ ID NO: 1265941 - RNA, 14 nt, Mycobacterium tuberculosis H37Rv
ccggcgcaagcgcc

SEQ ID NO: 1265942 - RNA, 20 nt, Mycobacterium tuberculosis H37Rv
ccggcgauuaccggcacgcc

SEQ ID NO: 1265943 - RNA, 22 nt, Mycobacterium tuberculosis H37Rv
ccggcgauuccaccuuggccag

SEQ ID NO: 1265944 - RNA, 13 nt, Mycobacterium tuberculosis H37Rv
ccggcgaugagca

SEQ ID NO: 1265945 - RNA, 14 nt, Mycobacterium tuberculosis H37Rv
ccggcgaugcagcc

SEQ ID NO: 1265946 - RNA, 17 nt, Mycobacterium tuberculosis H37Rv
ccggcgaucucgaccgu

SEQ ID NO: 1265947 - RNA, 14 nt, Mycobacterium tuberculosis H37Rv
ccggcgaucguguc

SEQ ID NO: 1265948 - RNA, 16 nt, Mycobacterium tuberculosis H37Rv
ccggcgauccgguagg

SEQ ID NO: 1265949 - RNA, 18 nt, Mycobacterium tuberculosis H37Rv
ccggcgagcagacgcaua

SEQ ID NO: 1265950 - RNA, 16 nt, Mycobacterium tuberculosis H37Rv
ccggcgagcucgacga

SEQ ID NO: 1265951 - RNA, 20 nt, Mycobacterium tuberculosis H37Rv
ccggcgagggcgcggauacg

SEQ ID NO: 1265952 - RNA, 23 nt, Mycobacterium tuberculosis H37Rv
ccggcgagggugagcauggcuag

SEQ ID NO: 1265953 - RNA, 23 nt, Mycobacterium tuberculosis H37Rv
ccggcgaggucggagagcaugcg

SEQ ID NO: 1265954 - RNA, 14 nt, Mycobacterium tuberculosis H37Rv
ccggcgaucaccgu

SEQ ID NO: 1265955 - RNA, 23 nt, Mycobacterium tuberculosis H37Rv
ccggcgacgccggccuuggcgau

SEQ ID NO: 1265956 - RNA, 14 nt, Mycobacterium tuberculosis H37Rv
ccggccuagccgau

SEQ ID NO: 1265957 - RNA, 13 nt, Mycobacterium tuberculosis H37Rv
ccggccucgccga

SEQ ID NO: 1265958 - RNA, 15 nt, Mycobacterium tuberculosis H37Rv
ccggccgucaucugg

SEQ ID NO: 1265959 - RNA, 21 nt, Mycobacterium tuberculosis H37Rv
ccggccgucccgcgagcagcc

SEQ ID NO: 1265960 - RNA, 14 nt, Mycobacterium tuberculosis H37Rv
ccggccgucggccg

SEQ ID NO: 1265961 - RNA, 15 nt, Mycobacterium tuberculosis H37Rv
ccggccgucgcgcga

SEQ ID NO: 1265962 - RNA, 21 nt, Mycobacterium tuberculosis H37Rv
ccggccgugagcccggcgauc

SEQ ID NO: 1265963 - RNA, 22 nt, Mycobacterium tuberculosis H37Rv
ccggccgguggguagccagcgc

SEQ ID NO: 1265964 - RNA, 18 nt, Mycobacterium tuberculosis H37Rv
ccggccgguccgggaagu

SEQ ID NO: 1265965 - RNA, 19 nt, Mycobacterium tuberculosis H37Rv
ccggccuugagcacccgau

SEQ ID NO: 1265966 - RNA, 20 nt, Mycobacterium tuberculosis H37Rv
ccggcgaaccccagcgcauc

SEQ ID NO: 1265967 - RNA, 19 nt, Mycobacterium tuberculosis H37Rv
ccggcgaccaaggccgacc

SEQ ID NO: 1265968 - RNA, 15 nt, Mycobacterium tuberculosis H37Rv
ccggccuggccgcca

SEQ ID NO: 1265969 - RNA, 18 nt, Mycobacterium tuberculosis H37Rv
ccggccugcgcgaccgac

SEQ ID NO: 1265970 - RNA, 17 nt, Mycobacterium tuberculosis H37Rv
ccggccugcgacgagcc

SEQ ID NO: 1265971 - RNA, 16 nt, Mycobacterium tuberculosis H37Rv
ccggccucggcgagca

SEQ ID NO: 1265972 - RNA, 23 nt, Mycobacterium tuberculosis H37Rv
ccggccucuggaucacgucgaug

SEQ ID NO: 1265973 - RNA, 17 nt, Mycobacterium tuberculosis H37Rv
ccggcgguagucggcca

SEQ ID NO: 1265974 - RNA, 18 nt, Mycobacterium tuberculosis H37Rv
ccggcgguagucggccag

SEQ ID NO: 1265975 - RNA, 15 nt, Mycobacterium tuberculosis H37Rv
ccggcgguagucggc

SEQ ID NO: 1265976 - RNA, 17 nt, Mycobacterium tuberculosis H37Rv
ccggcggucagcggcuc

SEQ ID NO: 1265977 - RNA, 17 nt, Mycobacterium tuberculosis H37Rv
ccggcggugccgucagc

SEQ ID NO: 1265978 - RNA, 13 nt, Mycobacterium tuberculosis H37Rv
ccggcggucgcca

SEQ ID NO: 1265979 - RNA, 19 nt, Mycobacterium tuberculosis H37Rv
ccggcggucgccagucgau

SEQ ID NO: 1265980 - RNA, 22 nt, Mycobacterium tuberculosis H37Rv
ccggcguccaguccgaucaccc

SEQ ID NO: 1265981 - RNA, 20 nt, Mycobacterium tuberculosis H37Rv
ccggcgucgacccugcccag

SEQ ID NO: 1265982 - RNA, 14 nt, Mycobacterium tuberculosis H37Rv
ccggcgugcacucc

SEQ ID NO: 1265983 - RNA, 16 nt, Mycobacterium tuberculosis H37Rv
ccggcgugcagaaucc

SEQ ID NO: 1265984 - RNA, 18 nt, Mycobacterium tuberculosis H37Rv
ccggcgucgaugacgacg

SEQ ID NO: 1265985 - RNA, 14 nt, Mycobacterium tuberculosis H37Rv
ccggcgucgacguc

SEQ ID NO: 1265986 - RNA, 16 nt, Mycobacterium tuberculosis H37Rv
ccggcgucgaugacga

SEQ ID NO: 1265987 - RNA, 22 nt, Mycobacterium tuberculosis H37Rv
ccggcguggauccguagaaggc

SEQ ID NO: 1265988 - RNA, 23 nt, Mycobacterium tuberculosis H37Rv
ccggcgugcugugcucacgagca

SEQ ID NO: 1265989 - RNA, 20 nt, Mycobacterium tuberculosis H37Rv
ccggcggcuggucucuggcg

SEQ ID NO: 1265990 - RNA, 14 nt, Mycobacterium tuberculosis H37Rv
ccggcggcggugcg

SEQ ID NO: 1265991 - RNA, 23 nt, Mycobacterium tuberculosis H37Rv
ccggcggcggccgcagcggccag

SEQ ID NO: 1265992 - RNA, 20 nt, Mycobacterium tuberculosis H37Rv
ccggcggccgccaucagccg

SEQ ID NO: 1265993 - RNA, 13 nt, Mycobacterium tuberculosis H37Rv
ccggcggccagcu

SEQ ID NO: 1265994 - RNA, 20 nt, Mycobacterium tuberculosis H37Rv
ccggcggccaucccgcguuc

SEQ ID NO: 1265995 - RNA, 15 nt, Mycobacterium tuberculosis H37Rv
ccggcggccccaggg

SEQ ID NO: 1265996 - RNA, 16 nt, Mycobacterium tuberculosis H37Rv
ccggcgccgccggcac

SEQ ID NO: 1265997 - RNA, 15 nt, Mycobacterium tuberculosis H37Rv
ccggcgccgccggca

SEQ ID NO: 1265998 - RNA, 17 nt, Mycobacterium tuberculosis H37Rv
ccggcgccgcccuugcc

SEQ ID NO: 1265999 - RNA, 17 nt, Mycobacterium tuberculosis H37Rv
ccggcgccgccauugcc

SEQ ID NO: 1266000 - RNA, 13 nt, Mycobacterium tuberculosis H37Rv
ccggcgccgcacc

SEQ ID NO: 1266001 - RNA, 19 nt, Mycobacterium tuberculosis H37Rv
ccggcgccgcaaucagacg

SEQ ID NO: 1266002 - RNA, 19 nt, Mycobacterium tuberculosis H37Rv
ccgggaccauagucgccgu

SEQ ID NO: 1266003 - RNA, 17 nt, Mycobacterium tuberculosis H37Rv
ccgggacgugucgguga

SEQ ID NO: 1266004 - RNA, 19 nt, Mycobacterium tuberculosis H37Rv
ccgggacgugucggugaac

SEQ ID NO: 1266005 - RNA, 15 nt, Mycobacterium tuberculosis H37Rv
ccggcuuggccuuug

SEQ ID NO: 1266006 - RNA, 19 nt, Mycobacterium tuberculosis H37Rv
ccggcuuugcuugccgcau

SEQ ID NO: 1266007 - RNA, 12 nt, Mycobacterium tuberculosis H37Rv
ccggcuucgccg

SEQ ID NO: 1266008 - RNA, 14 nt, Mycobacterium tuberculosis H37Rv
ccggcuucggcaac

SEQ ID NO: 1266009 - RNA, 15 nt, Mycobacterium tuberculosis H37Rv
ccggcuucggcaacc

SEQ ID NO: 1266010 - RNA, 19 nt, Mycobacterium tuberculosis H37Rv
ccggcuucguccaccgcga

SEQ ID NO: 1266011 - RNA, 17 nt, Mycobacterium tuberculosis H37Rv
ccggcuucgucggccag

SEQ ID NO: 1266012 - RNA, 13 nt, Mycobacterium tuberculosis H37Rv
ccggcuucggcga

SEQ ID NO: 1266013 - RNA, 20 nt, Mycobacterium tuberculosis H37Rv
ccggcuucggugagcgggca

SEQ ID NO: 1266014 - RNA, 13 nt, Mycobacterium tuberculosis H37Rv
ccggcuucgccgc

SEQ ID NO: 1266015 - RNA, 19 nt, Mycobacterium tuberculosis H37Rv
ccggcugcgccgggcucgc

SEQ ID NO: 1266016 - RNA, 13 nt, Mycobacterium tuberculosis H37Rv
ccggcugccacac

SEQ ID NO: 1266017 - RNA, 19 nt, Mycobacterium tuberculosis H37Rv
ccggcugauucgagccaca

SEQ ID NO: 1266018 - RNA, 13 nt, Mycobacterium tuberculosis H37Rv
ccggcucggccag

SEQ ID NO: 1266019 - RNA, 23 nt, Mycobacterium tuberculosis H37Rv
ccggcucggccagccagcgggcg

SEQ ID NO: 1266020 - RNA, 19 nt, Mycobacterium tuberculosis H37Rv
ccggcuaggagaucagcac

SEQ ID NO: 1266021 - RNA, 17 nt, Mycobacterium tuberculosis H37Rv
ccggcuccgccguugac

SEQ ID NO: 1266022 - RNA, 19 nt, Mycobacterium tuberculosis H37Rv
ccggcguuguugaccagca

SEQ ID NO: 1266023 - RNA, 20 nt, Mycobacterium tuberculosis H37Rv
ccggcguucccgccauugcc

SEQ ID NO: 1266024 - RNA, 16 nt, Mycobacterium tuberculosis H37Rv
ccggcguugccgaaac

SEQ ID NO: 1266025 - RNA, 18 nt, Mycobacterium tuberculosis H37Rv
ccggggauaucacgacgc

SEQ ID NO: 1266026 - RNA, 13 nt, Mycobacterium tuberculosis H37Rv
ccggggacggguc

SEQ ID NO: 1266027 - RNA, 18 nt, Mycobacterium tuberculosis H37Rv
ccggggacgggucggcag

SEQ ID NO: 1266028 - RNA, 16 nt, Mycobacterium tuberculosis H37Rv
ccggggacgucgacuu

SEQ ID NO: 1266029 - RNA, 17 nt, Mycobacterium tuberculosis H37Rv
ccggggccgccgucgcc

SEQ ID NO: 1266030 - RNA, 19 nt, Mycobacterium tuberculosis H37Rv
ccggggccccaugccgacc

SEQ ID NO: 1266031 - RNA, 23 nt, Mycobacterium tuberculosis H37Rv
ccggggggcugcugcucggccug

SEQ ID NO: 1266032 - RNA, 20 nt, Mycobacterium tuberculosis H37Rv
ccgggggaagcgccaacccg

SEQ ID NO: 1266033 - RNA, 16 nt, Mycobacterium tuberculosis H37Rv
ccggggcggaaccugu

SEQ ID NO: 1266034 - RNA, 14 nt, Mycobacterium tuberculosis H37Rv
ccggguacggcgua

SEQ ID NO: 1266035 - RNA, 14 nt, Mycobacterium tuberculosis H37Rv
ccggguauuaccgc

SEQ ID NO: 1266036 - RNA, 17 nt, Mycobacterium tuberculosis H37Rv
ccgggguugcccgcgac

SEQ ID NO: 1266037 - RNA, 18 nt, Mycobacterium tuberculosis H37Rv
ccggggugccggcgaugu

SEQ ID NO: 1266038 - RNA, 19 nt, Mycobacterium tuberculosis H37Rv
ccggggugcccccggugcc

SEQ ID NO: 1266039 - RNA, 14 nt, Mycobacterium tuberculosis H37Rv
ccggggucggcccg

SEQ ID NO: 1266040 - RNA, 22 nt, Mycobacterium tuberculosis H37Rv
ccgggugacccgccaacgccau

SEQ ID NO: 1266041 - RNA, 19 nt, Mycobacterium tuberculosis H37Rv
ccgggugaggcggugacga

SEQ ID NO: 1266042 - RNA, 19 nt, Mycobacterium tuberculosis H37Rv
ccgggucgccgaugacggu

SEQ ID NO: 1266043 - RNA, 15 nt, Mycobacterium tuberculosis H37Rv
ccgggucgacgcgau

SEQ ID NO: 1266044 - RNA, 15 nt, Mycobacterium tuberculosis H37Rv
ccggguccggcguac

SEQ ID NO: 1266045 - RNA, 17 nt, Mycobacterium tuberculosis H37Rv
ccggguccgccguugcc

SEQ ID NO: 1266046 - RNA, 23 nt, Mycobacterium tuberculosis H37Rv
ccggguccaagaaccacgacguu

SEQ ID NO: 1266047 - RNA, 22 nt, Mycobacterium tuberculosis H37Rv
ccggguccaagaaccacgacgu

SEQ ID NO: 1266048 - RNA, 15 nt, Mycobacterium tuberculosis H37Rv
ccgggcggucgagau

SEQ ID NO: 1266049 - RNA, 21 nt, Mycobacterium tuberculosis H37Rv
ccgggcgggauccacccagug

SEQ ID NO: 1266050 - RNA, 14 nt, Mycobacterium tuberculosis H37Rv
ccgggcggucgaag

SEQ ID NO: 1266051 - RNA, 19 nt, Mycobacterium tuberculosis H37Rv
ccgggcgggagucgucgag

SEQ ID NO: 1266052 - RNA, 21 nt, Mycobacterium tuberculosis H37Rv
ccgggcgggcggccgaucccg

SEQ ID NO: 1266053 - RNA, 15 nt, Mycobacterium tuberculosis H37Rv
ccgggcggcggcgac

SEQ ID NO: 1266054 - RNA, 22 nt, Mycobacterium tuberculosis H37Rv
ccgggccgcacggucagcgcgc

SEQ ID NO: 1266055 - RNA, 22 nt, Mycobacterium tuberculosis H37Rv
ccgggcuguagcgaaugaucuu

SEQ ID NO: 1266056 - RNA, 12 nt, Mycobacterium tuberculosis H37Rv
ccgggcuggcga

SEQ ID NO: 1266057 - RNA, 16 nt, Mycobacterium tuberculosis H37Rv
ccgggcuggcgacgac

SEQ ID NO: 1266058 - RNA, 20 nt, Mycobacterium tuberculosis H37Rv
ccgggcuggccagcgcgcuc

SEQ ID NO: 1266059 - RNA, 16 nt, Mycobacterium tuberculosis H37Rv
ccgggcuggccagcgc

SEQ ID NO: 1266060 - RNA, 21 nt, Mycobacterium tuberculosis H37Rv
ccgggaugcgacagcgcuggg

SEQ ID NO: 1266061 - RNA, 17 nt, Mycobacterium tuberculosis H37Rv
ccgggaugugcggcugc

SEQ ID NO: 1266062 - RNA, 22 nt, Mycobacterium tuberculosis H37Rv
ccgggcaaccagcagcagguug

SEQ ID NO: 1266063 - RNA, 14 nt, Mycobacterium tuberculosis H37Rv
ccgggcaacggcgg

SEQ ID NO: 1266064 - RNA, 22 nt, Mycobacterium tuberculosis H37Rv
ccgggcaacgcgaaccggccau

SEQ ID NO: 1266065 - RNA, 12 nt, Mycobacterium tuberculosis H37Rv
ccgggcgacggu

SEQ ID NO: 1266066 - RNA, 16 nt, Mycobacterium tuberculosis H37Rv
ccgggccgagcgcacc

SEQ ID NO: 1266067 - RNA, 17 nt, Mycobacterium tuberculosis H37Rv
ccgggcccgucggacau

SEQ ID NO: 1266068 - RNA, 22 nt, Mycobacterium tuberculosis H37Rv
ccgccuaggaguuccucgaucg

SEQ ID NO: 1266069 - RNA, 16 nt, Mycobacterium tuberculosis H37Rv
ccgccucaaugaccac

SEQ ID NO: 1266070 - RNA, 21 nt, Mycobacterium tuberculosis H37Rv
ccgccuacccguucuucgcga

SEQ ID NO: 1266071 - RNA, 20 nt, Mycobacterium tuberculosis H37Rv
ccgccguuugcgccguugcc

SEQ ID NO: 1266072 - RNA, 12 nt, Mycobacterium tuberculosis H37Rv
ccgccugaccgc

SEQ ID NO: 1266073 - RNA, 18 nt, Mycobacterium tuberculosis H37Rv
ccgccugaccgccaccgu

SEQ ID NO: 1266074 - RNA, 20 nt, Mycobacterium tuberculosis H37Rv
ccgccucguacggaccgucg

SEQ ID NO: 1266075 - RNA, 20 nt, Mycobacterium tuberculosis H37Rv
ccgccguugccgccguugcc

SEQ ID NO: 1266076 - RNA, 20 nt, Mycobacterium tuberculosis H37Rv
ccgccgucaccgccauugcc

SEQ ID NO: 1266077 - RNA, 19 nt, Mycobacterium tuberculosis H37Rv
ccgccguagaccagccguc

SEQ ID NO: 1266078 - RNA, 22 nt, Mycobacterium tuberculosis H37Rv
ccgccguaccgaagcggaucug

SEQ ID NO: 1266079 - RNA, 22 nt, Mycobacterium tuberculosis H37Rv
ccgccggugccgccggugccgc

SEQ ID NO: 1266080 - RNA, 18 nt, Mycobacterium tuberculosis H37Rv
ccgccggugccgccggug

SEQ ID NO: 1266081 - RNA, 19 nt, Mycobacterium tuberculosis H37Rv
ccgccuuugcccgccgcgu

SEQ ID NO: 1266082 - RNA, 21 nt, Mycobacterium tuberculosis H37Rv
ccgcgaaucaacaggaccggg

SEQ ID NO: 1266083 - RNA, 18 nt, Mycobacterium tuberculosis H37Rv
ccgcgaaucaacaggacc

SEQ ID NO: 1266084 - RNA, 20 nt, Mycobacterium tuberculosis H37Rv
ccgcgaacgauuucggccca

SEQ ID NO: 1266085 - RNA, 19 nt, Mycobacterium tuberculosis H37Rv
ccgcgaagcgcucggcagc

SEQ ID NO: 1266086 - RNA, 18 nt, Mycobacterium tuberculosis H37Rv
ccgccuuugccgccggca

SEQ ID NO: 1266087 - RNA, 15 nt, Mycobacterium tuberculosis H37Rv
ccgccuuugccgccg

SEQ ID NO: 1266088 - RNA, 20 nt, Mycobacterium tuberculosis H37Rv
ccgccuuugcccgccgcguc

SEQ ID NO: 1266089 - RNA, 21 nt, Mycobacterium tuberculosis H37Rv
ccgccuuggcuucgacgcuuc

SEQ ID NO: 1266090 - RNA, 17 nt, Mycobacterium tuberculosis H37Rv
ccgcgaacgauuucggc

SEQ ID NO: 1266091 - RNA, 13 nt, Mycobacterium tuberculosis H37Rv
ccgcgaacauggu

SEQ ID NO: 1266092 - RNA, 16 nt, Mycobacterium tuberculosis H37Rv
ccgccugcgcggcugc

SEQ ID NO: 1266093 - RNA, 22 nt, Mycobacterium tuberculosis H37Rv
ccgccuuggucgcgucggcugc

SEQ ID NO: 1266094 - RNA, 17 nt, Mycobacterium tuberculosis H37Rv
ccgcgagguugaccacc

SEQ ID NO: 1266095 - RNA, 19 nt, Mycobacterium tuberculosis H37Rv
ccgcgaggugaaucgcguc

SEQ ID NO: 1266096 - RNA, 11 nt, Mycobacterium tuberculosis H37Rv
ccgcgaucacc

SEQ ID NO: 1266097 - RNA, 19 nt, Mycobacterium tuberculosis H37Rv
ccgcgaucaccaccggauc

SEQ ID NO: 1266098 - RNA, 15 nt, Mycobacterium tuberculosis H37Rv
ccgcgaucaccgacg

SEQ ID NO: 1266099 - RNA, 18 nt, Mycobacterium tuberculosis H37Rv
ccgcgaccagcgccgcac

SEQ ID NO: 1266100 - RNA, 14 nt, Mycobacterium tuberculosis H37Rv
ccgcgacggaacca

SEQ ID NO: 1266101 - RNA, 16 nt, Mycobacterium tuberculosis H37Rv
ccgcgacggcacgauc

SEQ ID NO: 1266102 - RNA, 20 nt, Mycobacterium tuberculosis H37Rv
ccgcgacgcucgcugcagca

SEQ ID NO: 1266103 - RNA, 21 nt, Mycobacterium tuberculosis H37Rv
ccgcgauuagcaaaccgaccg

SEQ ID NO: 1266104 - RNA, 22 nt, Mycobacterium tuberculosis H37Rv
ccgcgauuagcaaaccgaccgu

SEQ ID NO: 1266105 - RNA, 12 nt, Mycobacterium tuberculosis H37Rv
ccgcgauucgcg

SEQ ID NO: 1266106 - RNA, 14 nt, Mycobacterium tuberculosis H37Rv
ccgcgaugcgcacc

SEQ ID NO: 1266107 - RNA, 16 nt, Mycobacterium tuberculosis H37Rv
ccgcgaugggauaccg

SEQ ID NO: 1266108 - RNA, 14 nt, Mycobacterium tuberculosis H37Rv
ccgcgcagcgucaa

SEQ ID NO: 1266109 - RNA, 16 nt, Mycobacterium tuberculosis H37Rv
ccgcgcaucugucgcg

SEQ ID NO: 1266110 - RNA, 21 nt, Mycobacterium tuberculosis H37Rv
ccgccggguuggcgccggcca

SEQ ID NO: 1266111 - RNA, 19 nt, Mycobacterium tuberculosis H37Rv
ccgccggugccgaucagca

SEQ ID NO: 1266112 - RNA, 16 nt, Mycobacterium tuberculosis H37Rv
ccgccggugccgauca

SEQ ID NO: 1266113 - RNA, 14 nt, Mycobacterium tuberculosis H37Rv
ccgccggugccgau

SEQ ID NO: 1266114 - RNA, 13 nt, Mycobacterium tuberculosis H37Rv
ccgccgggugcgc

SEQ ID NO: 1266115 - RNA, 19 nt, Mycobacterium tuberculosis H37Rv
ccgccgggugucgguggua

SEQ ID NO: 1266116 - RNA, 17 nt, Mycobacterium tuberculosis H37Rv
ccgccgggcucagcugg

SEQ ID NO: 1266117 - RNA, 15 nt, Mycobacterium tuberculosis H37Rv
ccgccggcgccggug

SEQ ID NO: 1266118 - RNA, 19 nt, Mycobacterium tuberculosis H37Rv
ccgccggcgccggugccgc

SEQ ID NO: 1266119 - RNA, 22 nt, Mycobacterium tuberculosis H37Rv
ccgccggcgccgccauugccau

SEQ ID NO: 1266120 - RNA, 22 nt, Mycobacterium tuberculosis H37Rv
ccgccggcgcccaggccgauca

SEQ ID NO: 1266121 - RNA, 12 nt, Mycobacterium tuberculosis H37Rv
ccgccggcccca

SEQ ID NO: 1266122 - RNA, 12 nt, Mycobacterium tuberculosis H37Rv
ccgccggcacca

SEQ ID NO: 1266123 - RNA, 14 nt, Mycobacterium tuberculosis H37Rv
ccgccggcaccggg

SEQ ID NO: 1266124 - RNA, 15 nt, Mycobacterium tuberculosis H37Rv
ccgccggcaccgccg

SEQ ID NO: 1266125 - RNA, 20 nt, Mycobacterium tuberculosis H37Rv
ccgccggcaauaccgccagc

SEQ ID NO: 1266126 - RNA, 12 nt, Mycobacterium tuberculosis H37Rv
ccgccggcaacg

SEQ ID NO: 1266127 - RNA, 17 nt, Mycobacterium tuberculosis H37Rv
ccgccggccagcgucgc

SEQ ID NO: 1266128 - RNA, 16 nt, Mycobacterium tuberculosis H37Rv
ccgccggccaguccgc

SEQ ID NO: 1266129 - RNA, 13 nt, Mycobacterium tuberculosis H37Rv
ccgccggccaggu

SEQ ID NO: 1266130 - RNA, 18 nt, Mycobacterium tuberculosis H37Rv
ccgccggccaggugacgu

SEQ ID NO: 1266131 - RNA, 13 nt, Mycobacterium tuberculosis H37Rv
ccgccggcaccgu

SEQ ID NO: 1266132 - RNA, 15 nt, Mycobacterium tuberculosis H37Rv
ccgccgcuaccgccg

SEQ ID NO: 1266133 - RNA, 15 nt, Mycobacterium tuberculosis H37Rv
ccgccgcgcagccgc

SEQ ID NO: 1266134 - RNA, 13 nt, Mycobacterium tuberculosis H37Rv
ccgccgcgaugac

SEQ ID NO: 1266135 - RNA, 21 nt, Mycobacterium tuberculosis H37Rv
ccgccgcgaacgggucgggac

SEQ ID NO: 1266136 - RNA, 20 nt, Mycobacterium tuberculosis H37Rv
ccgccgccuuuuuucgccgc

SEQ ID NO: 1266137 - RNA, 14 nt, Mycobacterium tuberculosis H37Rv
ccgccgcgagcaga

SEQ ID NO: 1266138 - RNA, 12 nt, Mycobacterium tuberculosis H37Rv
ccgccgagcaga

SEQ ID NO: 1266139 - RNA, 21 nt, Mycobacterium tuberculosis H37Rv
ccgccgaggucgguucggccg

SEQ ID NO: 1266140 - RNA, 22 nt, Mycobacterium tuberculosis H37Rv
ccgccgagcggaccaccgcucg

SEQ ID NO: 1266141 - RNA, 23 nt, Mycobacterium tuberculosis H37Rv
ccgccgagcggaccaccgcucgc

SEQ ID NO: 1266142 - RNA, 19 nt, Mycobacterium tuberculosis H37Rv
ccgccgcaccggaucaccg

SEQ ID NO: 1266143 - RNA, 20 nt, Mycobacterium tuberculosis H37Rv
ccgccgcaccggaucaccgc

SEQ ID NO: 1266144 - RNA, 21 nt, Mycobacterium tuberculosis H37Rv
ccgccgccugcuggagcagcu

SEQ ID NO: 1266145 - RNA, 12 nt, Mycobacterium tuberculosis H37Rv
ccgccgccggca

SEQ ID NO: 1266146 - RNA, 14 nt, Mycobacterium tuberculosis H37Rv
ccgccgccgcguac

SEQ ID NO: 1266147 - RNA, 14 nt, Mycobacterium tuberculosis H37Rv
ccgccgccgacaau

SEQ ID NO: 1266148 - RNA, 16 nt, Mycobacterium tuberculosis H37Rv
ccgccgccgccgcgua

SEQ ID NO: 1266149 - RNA, 21 nt, Mycobacterium tuberculosis H37Rv
ccgccgcaucguuuucgccga

SEQ ID NO: 1266150 - RNA, 13 nt, Mycobacterium tuberculosis H37Rv
ccgccgcagcucc

SEQ ID NO: 1266151 - RNA, 18 nt, Mycobacterium tuberculosis H37Rv
ccgccauccccuggccag

SEQ ID NO: 1266152 - RNA, 13 nt, Mycobacterium tuberculosis H37Rv
ccgcccucaccgc

SEQ ID NO: 1266153 - RNA, 13 nt, Mycobacterium tuberculosis H37Rv
ccgcccgugccgc

SEQ ID NO: 1266154 - RNA, 18 nt, Mycobacterium tuberculosis H37Rv
ccgcccgugaucaccacg

SEQ ID NO: 1266155 - RNA, 19 nt, Mycobacterium tuberculosis H37Rv
ccgcccggugcuaaccgac

SEQ ID NO: 1266156 - RNA, 21 nt, Mycobacterium tuberculosis H37Rv
ccgcccguagacccacagucg

SEQ ID NO: 1266157 - RNA, 23 nt, Mycobacterium tuberculosis H37Rv
ccgccgagauagcaacgaagccg

SEQ ID NO: 1266158 - RNA, 15 nt, Mycobacterium tuberculosis H37Rv
ccgccgagcgcaacu

SEQ ID NO: 1266159 - RNA, 18 nt, Mycobacterium tuberculosis H37Rv
ccgccgacgccgccggca

SEQ ID NO: 1266160 - RNA, 15 nt, Mycobacterium tuberculosis H37Rv
ccgcccucggugaga

SEQ ID NO: 1266161 - RNA, 18 nt, Mycobacterium tuberculosis H37Rv
ccgccgaccggagccgcc

SEQ ID NO: 1266162 - RNA, 18 nt, Mycobacterium tuberculosis H37Rv
ccgcucgaccagacgcug

SEQ ID NO: 1266163 - RNA, 21 nt, Mycobacterium tuberculosis H37Rv
ccgcucgaucggcagccaggg

SEQ ID NO: 1266164 - RNA, 17 nt, Mycobacterium tuberculosis H37Rv
ccgcuccuccggcacca

SEQ ID NO: 1266165 - RNA, 22 nt, Mycobacterium tuberculosis H37Rv
ccgcucgucgccgguggcaccc

SEQ ID NO: 1266166 - RNA, 23 nt, Mycobacterium tuberculosis H37Rv
ccgcucgggguugcucgcgaucg

SEQ ID NO: 1266167 - RNA, 15 nt, Mycobacterium tuberculosis H37Rv
ccgcucgcaggccgg

SEQ ID NO: 1266168 - RNA, 11 nt, Mycobacterium tuberculosis H37Rv
ccgcucgaugu

SEQ ID NO: 1266169 - RNA, 19 nt, Mycobacterium tuberculosis H37Rv
ccgcucgggcgcgaggacg

SEQ ID NO: 1266170 - RNA, 16 nt, Mycobacterium tuberculosis H37Rv
ccgcguuucggucguu

SEQ ID NO: 1266171 - RNA, 15 nt, Mycobacterium tuberculosis H37Rv
ccgcguuucgcgacg

SEQ ID NO: 1266172 - RNA, 13 nt, Mycobacterium tuberculosis H37Rv
ccgcguuggccac

SEQ ID NO: 1266173 - RNA, 13 nt, Mycobacterium tuberculosis H37Rv
ccgcuagcggauu

SEQ ID NO: 1266174 - RNA, 20 nt, Mycobacterium tuberculosis H37Rv
ccgcuacgcgcgcucgcuca

SEQ ID NO: 1266175 - RNA, 22 nt, Mycobacterium tuberculosis H37Rv
ccgcuagaacagacggggucgc

SEQ ID NO: 1266176 - RNA, 21 nt, Mycobacterium tuberculosis H37Rv
ccgcuaccguuguugaggaug

SEQ ID NO: 1266177 - RNA, 13 nt, Mycobacterium tuberculosis H37Rv
ccgcuaacgcacc

SEQ ID NO: 1266178 - RNA, 19 nt, Mycobacterium tuberculosis H37Rv
ccgcuaccgcccgcgccac

SEQ ID NO: 1266179 - RNA, 21 nt, Mycobacterium tuberculosis H37Rv
ccgcugacgaagcacaguucg

SEQ ID NO: 1266180 - RNA, 15 nt, Mycobacterium tuberculosis H37Rv
ccgcugacgguucgg

SEQ ID NO: 1266181 - RNA, 14 nt, Mycobacterium tuberculosis H37Rv
ccgcugcggcaccg

SEQ ID NO: 1266182 - RNA, 13 nt, Mycobacterium tuberculosis H37Rv
ccgcucucggcga

SEQ ID NO: 1266183 - RNA, 21 nt, Mycobacterium tuberculosis H37Rv
ccgcucguuacgccgagcaca

SEQ ID NO: 1266184 - RNA, 14 nt, Mycobacterium tuberculosis H37Rv
ccgcucuagcgucg

SEQ ID NO: 1266185 - RNA, 22 nt, Mycobacterium tuberculosis H37Rv
ccgcucguuacgccgagcacac

SEQ ID NO: 1266186 - RNA, 14 nt, Mycobacterium tuberculosis H37Rv
ccgcucguggucgg

SEQ ID NO: 1266187 - RNA, 18 nt, Mycobacterium tuberculosis H37Rv
ccgcucguggucgguggc

SEQ ID NO: 1266188 - RNA, 15 nt, Mycobacterium tuberculosis H37Rv
ccgcuggagaucacg

SEQ ID NO: 1266189 - RNA, 22 nt, Mycobacterium tuberculosis H37Rv
ccgcuggacaguuacgcuggca

SEQ ID NO: 1266190 - RNA, 21 nt, Mycobacterium tuberculosis H37Rv
ccgcugacuccugcggcaccg

SEQ ID NO: 1266191 - RNA, 12 nt, Mycobacterium tuberculosis H37Rv
ccgcggcugcca

SEQ ID NO: 1266192 - RNA, 21 nt, Mycobacterium tuberculosis H37Rv
ccgcgggaccuucgagccgca

SEQ ID NO: 1266193 - RNA, 19 nt, Mycobacterium tuberculosis H37Rv
ccgcggcugucacgccugc

SEQ ID NO: 1266194 - RNA, 16 nt, Mycobacterium tuberculosis H37Rv
ccgcgggaucgguggc

SEQ ID NO: 1266195 - RNA, 14 nt, Mycobacterium tuberculosis H37Rv
ccgcggugacgcaa

SEQ ID NO: 1266196 - RNA, 16 nt, Mycobacterium tuberculosis H37Rv
ccgcggugacgcaaca

SEQ ID NO: 1266197 - RNA, 16 nt, Mycobacterium tuberculosis H37Rv
ccgcggugacgccagc

SEQ ID NO: 1266198 - RNA, 23 nt, Mycobacterium tuberculosis H37Rv
ccgcggcuaggccagcacggcga

SEQ ID NO: 1266199 - RNA, 13 nt, Mycobacterium tuberculosis H37Rv
ccgcgguggccag

SEQ ID NO: 1266200 - RNA, 17 nt, Mycobacterium tuberculosis H37Rv
ccgcggugacgccagcc

SEQ ID NO: 1266201 - RNA, 20 nt, Mycobacterium tuberculosis H37Rv
ccgcguagaccagugaccgc

SEQ ID NO: 1266202 - RNA, 21 nt, Mycobacterium tuberculosis H37Rv
ccgcgguguauccgacgucgg

SEQ ID NO: 1266203 - RNA, 23 nt, Mycobacterium tuberculosis H37Rv
ccgcgucaucaccgguacugcga

SEQ ID NO: 1266204 - RNA, 18 nt, Mycobacterium tuberculosis H37Rv
ccgcguaugccaggacug

SEQ ID NO: 1266205 - RNA, 13 nt, Mycobacterium tuberculosis H37Rv
ccgcgucacccgu

SEQ ID NO: 1266206 - RNA, 16 nt, Mycobacterium tuberculosis H37Rv
ccgcgucggcggccag

SEQ ID NO: 1266207 - RNA, 13 nt, Mycobacterium tuberculosis H37Rv
ccgcgugaccgac

SEQ ID NO: 1266208 - RNA, 20 nt, Mycobacterium tuberculosis H37Rv
ccgcgucuaccaaccgguac

SEQ ID NO: 1266209 - RNA, 17 nt, Mycobacterium tuberculosis H37Rv
ccgcgugagcagacgca

SEQ ID NO: 1266210 - RNA, 21 nt, Mycobacterium tuberculosis H37Rv
ccgcgugcugcggcugguguc

SEQ ID NO: 1266211 - RNA, 15 nt, Mycobacterium tuberculosis H37Rv
ccgcguggcuggcgg

SEQ ID NO: 1266212 - RNA, 19 nt, Mycobacterium tuberculosis H37Rv
ccgcgugggcaugcggauu

SEQ ID NO: 1266213 - RNA, 19 nt, Mycobacterium tuberculosis H37Rv
ccgcguggucggcgaacgc

SEQ ID NO: 1266214 - RNA, 21 nt, Mycobacterium tuberculosis H37Rv
ccgcguugccaaagcccacac

SEQ ID NO: 1266215 - RNA, 22 nt, Mycobacterium tuberculosis H37Rv
ccgcguugccgggguuggucgu

SEQ ID NO: 1266216 - RNA, 23 nt, Mycobacterium tuberculosis H37Rv
ccgcguucugguuguugccgacg

SEQ ID NO: 1266217 - RNA, 23 nt, Mycobacterium tuberculosis H37Rv
ccgcgugguuccggcgugcagca

SEQ ID NO: 1266218 - RNA, 19 nt, Mycobacterium tuberculosis H37Rv
ccgcguggugcugaccgcg

SEQ ID NO: 1266219 - RNA, 17 nt, Mycobacterium tuberculosis H37Rv
ccgcggcaacaccaccu

SEQ ID NO: 1266220 - RNA, 19 nt, Mycobacterium tuberculosis H37Rv
ccgcggacuuggcggucgg

SEQ ID NO: 1266221 - RNA, 23 nt, Mycobacterium tuberculosis H37Rv
ccgcggagcucaaccaccucgcc

SEQ ID NO: 1266222 - RNA, 21 nt, Mycobacterium tuberculosis H37Rv
ccgcggaucauccuucgccgg

SEQ ID NO: 1266223 - RNA, 20 nt, Mycobacterium tuberculosis H37Rv
ccgcggacuugcgagccgua

SEQ ID NO: 1266224 - RNA, 15 nt, Mycobacterium tuberculosis H37Rv
ccgcgcucgcacccg

SEQ ID NO: 1266225 - RNA, 13 nt, Mycobacterium tuberculosis H37Rv
ccgcggcggccag

SEQ ID NO: 1266226 - RNA, 20 nt, Mycobacterium tuberculosis H37Rv
ccgcggcggccccgcgccac

SEQ ID NO: 1266227 - RNA, 20 nt, Mycobacterium tuberculosis H37Rv
ccgcggcggcagcggcgauc

SEQ ID NO: 1266228 - RNA, 14 nt, Mycobacterium tuberculosis H37Rv
ccgcggccccgacu

SEQ ID NO: 1266229 - RNA, 22 nt, Mycobacterium tuberculosis H37Rv
ccgcggcccgcuccacggucag

SEQ ID NO: 1266230 - RNA, 18 nt, Mycobacterium tuberculosis H37Rv
ccgcggcccggacgucgg

SEQ ID NO: 1266231 - RNA, 17 nt, Mycobacterium tuberculosis H37Rv
ccgcggcccucgccuuc

SEQ ID NO: 1266232 - RNA, 19 nt, Mycobacterium tuberculosis H37Rv
ccgcgcggcgcauuccggc

SEQ ID NO: 1266233 - RNA, 12 nt, Mycobacterium tuberculosis H37Rv
ccgcgcggcacu

SEQ ID NO: 1266234 - RNA, 13 nt, Mycobacterium tuberculosis H37Rv
ccgcgcucgccga

SEQ ID NO: 1266235 - RNA, 18 nt, Mycobacterium tuberculosis H37Rv
ccgcgcggcgagagccuc

SEQ ID NO: 1266236 - RNA, 13 nt, Mycobacterium tuberculosis H37Rv
ccgcgcggcgauc

SEQ ID NO: 1266237 - RNA, 13 nt, Mycobacterium tuberculosis H37Rv
ccgcgcggcgcau

SEQ ID NO: 1266238 - RNA, 19 nt, Mycobacterium tuberculosis H37Rv
ccgcgccggacagcgcauc

SEQ ID NO: 1266239 - RNA, 16 nt, Mycobacterium tuberculosis H37Rv
ccgcgccggcgggcga

SEQ ID NO: 1266240 - RNA, 15 nt, Mycobacterium tuberculosis H37Rv
ccgcgccgucggcga

SEQ ID NO: 1266241 - RNA, 20 nt, Mycobacterium tuberculosis H37Rv
ccgcgccgccggacccaccg

SEQ ID NO: 1266242 - RNA, 15 nt, Mycobacterium tuberculosis H37Rv
ccgcgccgccgccac

SEQ ID NO: 1266243 - RNA, 14 nt, Mycobacterium tuberculosis H37Rv
ccgcgccgagcccg

SEQ ID NO: 1266244 - RNA, 12 nt, Mycobacterium tuberculosis H37Rv
ccgcgccgagcc

SEQ ID NO: 1266245 - RNA, 18 nt, Mycobacterium tuberculosis H37Rv
ccgcgccaccagcaccgc

SEQ ID NO: 1266246 - RNA, 15 nt, Mycobacterium tuberculosis H37Rv
ccgcgcgacaacccg

SEQ ID NO: 1266247 - RNA, 16 nt, Mycobacterium tuberculosis H37Rv
ccgcgcgagauccuuc

SEQ ID NO: 1266248 - RNA, 21 nt, Mycobacterium tuberculosis H37Rv
ccgcgcgaccaugagcuuggu

SEQ ID NO: 1266249 - RNA, 15 nt, Mycobacterium tuberculosis H37Rv
ccgcgccuccguugc

SEQ ID NO: 1266250 - RNA, 20 nt, Mycobacterium tuberculosis H37Rv
ccgcgccugccucaccgccg

SEQ ID NO: 1266251 - RNA, 18 nt, Mycobacterium tuberculosis H37Rv
ccgcgcgcggacagcauc

SEQ ID NO: 1266252 - RNA, 13 nt, Mycobacterium tuberculosis H37Rv
ccgcgcgcaccgg

SEQ ID NO: 1266253 - RNA, 18 nt, Mycobacterium tuberculosis H37Rv
ccgcgcgcaagucgaugu

SEQ ID NO: 1266254 - RNA, 22 nt, Mycobacterium tuberculosis H37Rv
ccgcgcgaugcuggcgaacucg

SEQ ID NO: 1266255 - RNA, 21 nt, Mycobacterium tuberculosis H37Rv
ccgauauccaaugccagaucg

SEQ ID NO: 1266256 - RNA, 16 nt, Mycobacterium tuberculosis H37Rv
ccgauaucgcugcgga

SEQ ID NO: 1266257 - RNA, 14 nt, Mycobacterium tuberculosis H37Rv
ccgauaucggugac

SEQ ID NO: 1266258 - RNA, 22 nt, Mycobacterium tuberculosis H37Rv
ccgauauaccagggcaucagca

SEQ ID NO: 1266259 - RNA, 18 nt, Mycobacterium tuberculosis H37Rv
ccgauaucaauggcagcu

SEQ ID NO: 1266260 - RNA, 14 nt, Mycobacterium tuberculosis H37Rv
ccgauacccgguga

SEQ ID NO: 1266261 - RNA, 17 nt, Mycobacterium tuberculosis H37Rv
ccgauagcgaccgcggc

SEQ ID NO: 1266262 - RNA, 20 nt, Mycobacterium tuberculosis H37Rv
ccgauacuucaucggcacag

SEQ ID NO: 1266263 - RNA, 19 nt, Mycobacterium tuberculosis H37Rv
ccgaucaacaugccgguca

SEQ ID NO: 1266264 - RNA, 19 nt, Mycobacterium tuberculosis H37Rv
ccgaucaccgcaucggugc

SEQ ID NO: 1266265 - RNA, 15 nt, Mycobacterium tuberculosis H37Rv
ccgaucacucggaua

SEQ ID NO: 1266266 - RNA, 14 nt, Mycobacterium tuberculosis H37Rv
ccgaucagcaccga

SEQ ID NO: 1266267 - RNA, 17 nt, Mycobacterium tuberculosis H37Rv
ccgaucagcaccgacgg

SEQ ID NO: 1266268 - RNA, 19 nt, Mycobacterium tuberculosis H37Rv
ccgaucaccuucggccgac

SEQ ID NO: 1266269 - RNA, 16 nt, Mycobacterium tuberculosis H37Rv
ccgaucaugucggccg

SEQ ID NO: 1266270 - RNA, 14 nt, Mycobacterium tuberculosis H37Rv
ccgauccagcaggc

SEQ ID NO: 1266271 - RNA, 16 nt, Mycobacterium tuberculosis H37Rv
ccgaucccggccagcu

SEQ ID NO: 1266272 - RNA, 18 nt, Mycobacterium tuberculosis H37Rv
ccgaucccggcgagcacc

SEQ ID NO: 1266273 - RNA, 21 nt, Mycobacterium tuberculosis H37Rv
ccgaucccggcgagcacccgc

SEQ ID NO: 1266274 - RNA, 14 nt, Mycobacterium tuberculosis H37Rv
ccgaucaucgacga

SEQ ID NO: 1266275 - RNA, 13 nt, Mycobacterium tuberculosis H37Rv
ccgaucaggccga

SEQ ID NO: 1266276 - RNA, 16 nt, Mycobacterium tuberculosis H37Rv
ccgaucaggccgacgu

SEQ ID NO: 1266277 - RNA, 23 nt, Mycobacterium tuberculosis H37Rv
ccgaucgcuccggcccugccgcc

SEQ ID NO: 1266278 - RNA, 19 nt, Mycobacterium tuberculosis H37Rv
ccgaucggcaaaccgucgg

SEQ ID NO: 1266279 - RNA, 12 nt, Mycobacterium tuberculosis H37Rv
ccgaucggccac

SEQ ID NO: 1266280 - RNA, 17 nt, Mycobacterium tuberculosis H37Rv
ccgauccgcucacccgc

SEQ ID NO: 1266281 - RNA, 21 nt, Mycobacterium tuberculosis H37Rv
ccgaucccgauacgcacccgc

SEQ ID NO: 1266282 - RNA, 22 nt, Mycobacterium tuberculosis H37Rv
ccgaucgaucagcaacucggcc

SEQ ID NO: 1266283 - RNA, 22 nt, Mycobacterium tuberculosis H37Rv
ccgaucgacacccgcucggccg

SEQ ID NO: 1266284 - RNA, 20 nt, Mycobacterium tuberculosis H37Rv
ccgaugugucgaugaggauc

SEQ ID NO: 1266285 - RNA, 18 nt, Mycobacterium tuberculosis H37Rv
ccgauguggucggcuguc

SEQ ID NO: 1266286 - RNA, 19 nt, Mycobacterium tuberculosis H37Rv
ccgauguggccggcgaugg

SEQ ID NO: 1266287 - RNA, 16 nt, Mycobacterium tuberculosis H37Rv
ccgaugaugcggcgca

SEQ ID NO: 1266288 - RNA, 18 nt, Mycobacterium tuberculosis H37Rv
ccgaugaggacauccggc

SEQ ID NO: 1266289 - RNA, 19 nt, Mycobacterium tuberculosis H37Rv
ccgaugaggacauccggcg

SEQ ID NO: 1266290 - RNA, 14 nt, Mycobacterium tuberculosis H37Rv
ccgaugaggcgcca

SEQ ID NO: 1266291 - RNA, 13 nt, Mycobacterium tuberculosis H37Rv
ccgaugacgcguu

SEQ ID NO: 1266292 - RNA, 14 nt, Mycobacterium tuberculosis H37Rv
ccgaugaaccaggc

SEQ ID NO: 1266293 - RNA, 14 nt, Mycobacterium tuberculosis H37Rv
ccgaucggccaaca

SEQ ID NO: 1266294 - RNA, 20 nt, Mycobacterium tuberculosis H37Rv
ccgaucguaggacucggcgg

SEQ ID NO: 1266295 - RNA, 22 nt, Mycobacterium tuberculosis H37Rv
ccgaucgucucggccacgaacc

SEQ ID NO: 1266296 - RNA, 20 nt, Mycobacterium tuberculosis H37Rv
ccgaucggucguccggaucg

SEQ ID NO: 1266297 - RNA, 13 nt, Mycobacterium tuberculosis H37Rv
ccgaucggugacg

SEQ ID NO: 1266298 - RNA, 20 nt, Mycobacterium tuberculosis H37Rv
ccgaucggccugcagcgaug

SEQ ID NO: 1266299 - RNA, 17 nt, Mycobacterium tuberculosis H37Rv
ccgcacagcgacgagau

SEQ ID NO: 1266300 - RNA, 19 nt, Mycobacterium tuberculosis H37Rv
ccgcacagaaaacgauggu

SEQ ID NO: 1266301 - RNA, 23 nt, Mycobacterium tuberculosis H37Rv
ccgcaauuggcguagcaacccag

SEQ ID NO: 1266302 - RNA, 20 nt, Mycobacterium tuberculosis H37Rv
ccgcacaacgauaguucggc

SEQ ID NO: 1266303 - RNA, 14 nt, Mycobacterium tuberculosis H37Rv
ccgcaauggaccga

SEQ ID NO: 1266304 - RNA, 15 nt, Mycobacterium tuberculosis H37Rv
ccgcaauggcggccu

SEQ ID NO: 1266305 - RNA, 15 nt, Mycobacterium tuberculosis H37Rv
ccgcacacgcgugca

SEQ ID NO: 1266306 - RNA, 21 nt, Mycobacterium tuberculosis H37Rv
ccgcacaugagcuggaaucga

SEQ ID NO: 1266307 - RNA, 23 nt, Mycobacterium tuberculosis H37Rv
ccgcaccaaggccgccugcaaca

SEQ ID NO: 1266308 - RNA, 13 nt, Mycobacterium tuberculosis H37Rv
ccgauucggcgac

SEQ ID NO: 1266309 - RNA, 12 nt, Mycobacterium tuberculosis H37Rv
ccgcaaccgccg

SEQ ID NO: 1266310 - RNA, 15 nt, Mycobacterium tuberculosis H37Rv
ccgcaaccggcgauc

SEQ ID NO: 1266311 - RNA, 17 nt, Mycobacterium tuberculosis H37Rv
ccgcaaccgguaucgcc

SEQ ID NO: 1266312 - RNA, 19 nt, Mycobacterium tuberculosis H37Rv
ccgcaaccgguaucgccgc

SEQ ID NO: 1266313 - RNA, 14 nt, Mycobacterium tuberculosis H37Rv
ccgcaaugaccgcg

SEQ ID NO: 1266314 - RNA, 13 nt, Mycobacterium tuberculosis H37Rv
ccgcaaucgcgac

SEQ ID NO: 1266315 - RNA, 12 nt, Mycobacterium tuberculosis H37Rv
ccgccaccgcug

SEQ ID NO: 1266316 - RNA, 23 nt, Mycobacterium tuberculosis H37Rv
ccgccaccgcgacgagcggccgu

SEQ ID NO: 1266317 - RNA, 14 nt, Mycobacterium tuberculosis H37Rv
ccgccaccggcuga

SEQ ID NO: 1266318 - RNA, 19 nt, Mycobacterium tuberculosis H37Rv
ccgccaccggcgcgaccgc

SEQ ID NO: 1266319 - RNA, 18 nt, Mycobacterium tuberculosis H37Rv
ccgccagaauugccggcg

SEQ ID NO: 1266320 - RNA, 15 nt, Mycobacterium tuberculosis H37Rv
ccgccagaaucccgc

SEQ ID NO: 1266321 - RNA, 23 nt, Mycobacterium tuberculosis H37Rv
ccgccacuggcgcugaucgccuc

SEQ ID NO: 1266322 - RNA, 18 nt, Mycobacterium tuberculosis H37Rv
ccgcauugcagaaccgcc

SEQ ID NO: 1266323 - RNA, 17 nt, Mycobacterium tuberculosis H37Rv
ccgcauugagcuggcgc

SEQ ID NO: 1266324 - RNA, 16 nt, Mycobacterium tuberculosis H37Rv
ccgcauucgcgacaac

SEQ ID NO: 1266325 - RNA, 12 nt, Mycobacterium tuberculosis H37Rv
ccgcaucgccga

SEQ ID NO: 1266326 - RNA, 21 nt, Mycobacterium tuberculosis H37Rv
ccgcaugugggaacuggacca

SEQ ID NO: 1266327 - RNA, 19 nt, Mycobacterium tuberculosis H37Rv
ccgcauugaacagcggauc

SEQ ID NO: 1266328 - RNA, 14 nt, Mycobacterium tuberculosis H37Rv
ccgccagcggcaau

SEQ ID NO: 1266329 - RNA, 16 nt, Mycobacterium tuberculosis H37Rv
ccgccagcgucgacac

SEQ ID NO: 1266330 - RNA, 18 nt, Mycobacterium tuberculosis H37Rv
ccgccagcugggcagcca

SEQ ID NO: 1266331 - RNA, 22 nt, Mycobacterium tuberculosis H37Rv
ccgccagcugggcagccagauc

SEQ ID NO: 1266332 - RNA, 16 nt, Mycobacterium tuberculosis H37Rv
ccgccaucagcccggc

SEQ ID NO: 1266333 - RNA, 12 nt, Mycobacterium tuberculosis H37Rv
ccgccaucaucg

SEQ ID NO: 1266334 - RNA, 22 nt, Mycobacterium tuberculosis H37Rv
ccgccaucaacaaggggcagca

SEQ ID NO: 1266335 - RNA, 16 nt, Mycobacterium tuberculosis H37Rv
ccgccagcgccgccga

SEQ ID NO: 1266336 - RNA, 13 nt, Mycobacterium tuberculosis H37Rv
ccgccagcgccgc

SEQ ID NO: 1266337 - RNA, 12 nt, Mycobacterium tuberculosis H37Rv
ccgccagcgcac

SEQ ID NO: 1266338 - RNA, 15 nt, Mycobacterium tuberculosis H37Rv
ccgccagcgccgguc

SEQ ID NO: 1266339 - RNA, 21 nt, Mycobacterium tuberculosis H37Rv
ccgccagcccgucaucgcgua

SEQ ID NO: 1266340 - RNA, 20 nt, Mycobacterium tuberculosis H37Rv
ccgccagauugccugacaac

SEQ ID NO: 1266341 - RNA, 15 nt, Mycobacterium tuberculosis H37Rv
ccgcauccccgguac

SEQ ID NO: 1266342 - RNA, 19 nt, Mycobacterium tuberculosis H37Rv
ccgcauauugcggcgccgu

SEQ ID NO: 1266343 - RNA, 14 nt, Mycobacterium tuberculosis H37Rv
ccgcauauugcggc

SEQ ID NO: 1266344 - RNA, 19 nt, Mycobacterium tuberculosis H37Rv
ccgcaucgccucaccacgu

SEQ ID NO: 1266345 - RNA, 19 nt, Mycobacterium tuberculosis H37Rv
ccgcauccggucucggccg

SEQ ID NO: 1266346 - RNA, 22 nt, Mycobacterium tuberculosis H37Rv
ccgcauccggcaagccggggaa

SEQ ID NO: 1266347 - RNA, 19 nt, Mycobacterium tuberculosis H37Rv
ccgcauaccuuccagaucg

SEQ ID NO: 1266348 - RNA, 18 nt, Mycobacterium tuberculosis H37Rv
ccgcauaccaguaccguc

SEQ ID NO: 1266349 - RNA, 14 nt, Mycobacterium tuberculosis H37Rv
ccgcauaacgccag

SEQ ID NO: 1266350 - RNA, 18 nt, Mycobacterium tuberculosis H37Rv
ccgcauaacgcgaacccg

SEQ ID NO: 1266351 - RNA, 20 nt, Mycobacterium tuberculosis H37Rv
ccgcauaaaucgggguuccg

SEQ ID NO: 1266352 - RNA, 22 nt, Mycobacterium tuberculosis H37Rv
ccgcaguggaugcauacacggu

SEQ ID NO: 1266353 - RNA, 22 nt, Mycobacterium tuberculosis H37Rv
ccgcagucgcggcagacgcguu

SEQ ID NO: 1266354 - RNA, 12 nt, Mycobacterium tuberculosis H37Rv
ccgcagucccga

SEQ ID NO: 1266355 - RNA, 14 nt, Mycobacterium tuberculosis H37Rv
ccgcagcugcggau

SEQ ID NO: 1266356 - RNA, 15 nt, Mycobacterium tuberculosis H37Rv
ccgcaggacgcugcc

SEQ ID NO: 1266357 - RNA, 22 nt, Mycobacterium tuberculosis H37Rv
ccgcacguagaaguaggcggcg

SEQ ID NO: 1266358 - RNA, 15 nt, Mycobacterium tuberculosis H37Rv
ccgcagcucgaccag

SEQ ID NO: 1266359 - RNA, 20 nt, Mycobacterium tuberculosis H37Rv
ccgcacccaugaucccgcug

SEQ ID NO: 1266360 - RNA, 14 nt, Mycobacterium tuberculosis H37Rv
ccgcacgccgaccg

SEQ ID NO: 1266361 - RNA, 20 nt, Mycobacterium tuberculosis H37Rv
ccgcaccagcugucgggcag

SEQ ID NO: 1266362 - RNA, 21 nt, Mycobacterium tuberculosis H37Rv
ccgcaccagaaauugacgugc

SEQ ID NO: 1266363 - RNA, 11 nt, Mycobacterium tuberculosis H37Rv
ccgcaccaggu

SEQ ID NO: 1266364 - RNA, 15 nt, Mycobacterium tuberculosis H37Rv
ccgcacgggcgaccu

SEQ ID NO: 1266365 - RNA, 17 nt, Mycobacterium tuberculosis H37Rv
ccgcacggugaccacgc

SEQ ID NO: 1266366 - RNA, 19 nt, Mycobacterium tuberculosis H37Rv
ccgcacgcuggcgggcacu

SEQ ID NO: 1266367 - RNA, 13 nt, Mycobacterium tuberculosis H37Rv
ccgcacgcucggc

SEQ ID NO: 1266368 - RNA, 20 nt, Mycobacterium tuberculosis H37Rv
ccgacggaaugucagccggu

SEQ ID NO: 1266369 - RNA, 18 nt, Mycobacterium tuberculosis H37Rv
ccgacggaaugucagccg

SEQ ID NO: 1266370 - RNA, 14 nt, Mycobacterium tuberculosis H37Rv
ccgacggagaucga

SEQ ID NO: 1266371 - RNA, 22 nt, Mycobacterium tuberculosis H37Rv
ccgacggaucgcccugacaccc

SEQ ID NO: 1266372 - RNA, 17 nt, Mycobacterium tuberculosis H37Rv
ccgacggaugaucagcg

SEQ ID NO: 1266373 - RNA, 15 nt, Mycobacterium tuberculosis H37Rv
ccgacggcccgguga

SEQ ID NO: 1266374 - RNA, 13 nt, Mycobacterium tuberculosis H37Rv
ccgacggcgccca

SEQ ID NO: 1266375 - RNA, 17 nt, Mycobacterium tuberculosis H37Rv
ccgacggccagcaggau

SEQ ID NO: 1266376 - RNA, 16 nt, Mycobacterium tuberculosis H37Rv
ccgacgggccgucgcc

SEQ ID NO: 1266377 - RNA, 17 nt, Mycobacterium tuberculosis H37Rv
ccgacgggauagacgac

SEQ ID NO: 1266378 - RNA, 16 nt, Mycobacterium tuberculosis H37Rv
ccgacgggacaacccg

SEQ ID NO: 1266379 - RNA, 13 nt, Mycobacterium tuberculosis H37Rv
ccgacgucaggca

SEQ ID NO: 1266380 - RNA, 12 nt, Mycobacterium tuberculosis H37Rv
ccgacggugaug

SEQ ID NO: 1266381 - RNA, 19 nt, Mycobacterium tuberculosis H37Rv
ccgacaaugucggcgaugc

SEQ ID NO: 1266382 - RNA, 19 nt, Mycobacterium tuberculosis H37Rv
ccgacgcaccaacgcgauc

SEQ ID NO: 1266383 - RNA, 21 nt, Mycobacterium tuberculosis H37Rv
ccgacgccagaacguggccau

SEQ ID NO: 1266384 - RNA, 18 nt, Mycobacterium tuberculosis H37Rv
ccgacaagcugucggcga

SEQ ID NO: 1266385 - RNA, 15 nt, Mycobacterium tuberculosis H37Rv
ccgacgaugcgcacu

SEQ ID NO: 1266386 - RNA, 16 nt, Mycobacterium tuberculosis H37Rv
ccgacgaugcgggcga

SEQ ID NO: 1266387 - RNA, 14 nt, Mycobacterium tuberculosis H37Rv
ccgaaugucgauga

SEQ ID NO: 1266388 - RNA, 19 nt, Mycobacterium tuberculosis H37Rv
ccgaaugugaaaugcgcga

SEQ ID NO: 1266389 - RNA, 15 nt, Mycobacterium tuberculosis H37Rv
ccgacgcgcggccag

SEQ ID NO: 1266390 - RNA, 14 nt, Mycobacterium tuberculosis H37Rv
ccgacgccguugcc

SEQ ID NO: 1266391 - RNA, 21 nt, Mycobacterium tuberculosis H37Rv
ccgacgccugggcacggccgu

SEQ ID NO: 1266392 - RNA, 14 nt, Mycobacterium tuberculosis H37Rv
ccgacgcgaaccca

SEQ ID NO: 1266393 - RNA, 19 nt, Mycobacterium tuberculosis H37Rv
ccgacgcgaacgcggccac

SEQ ID NO: 1266394 - RNA, 18 nt, Mycobacterium tuberculosis H37Rv
ccgacgcgaucuguccgc

SEQ ID NO: 1266395 - RNA, 21 nt, Mycobacterium tuberculosis H37Rv
ccgacgccgccggcgccaccg

SEQ ID NO: 1266396 - RNA, 19 nt, Mycobacterium tuberculosis H37Rv
ccgacgccgccagguccgc

SEQ ID NO: 1266397 - RNA, 19 nt, Mycobacterium tuberculosis H37Rv
ccgacugcggguucgccga

SEQ ID NO: 1266398 - RNA, 19 nt, Mycobacterium tuberculosis H37Rv
ccgacuuaagcgaacccga

SEQ ID NO: 1266399 - RNA, 13 nt, Mycobacterium tuberculosis H37Rv
ccgacguugccga

SEQ ID NO: 1266400 - RNA, 13 nt, Mycobacterium tuberculosis H37Rv
ccgacucggccgu

SEQ ID NO: 1266401 - RNA, 17 nt, Mycobacterium tuberculosis H37Rv
ccgacugcgggccagcg

SEQ ID NO: 1266402 - RNA, 21 nt, Mycobacterium tuberculosis H37Rv
ccgacugcgggccagcgcauc

SEQ ID NO: 1266403 - RNA, 13 nt, Mycobacterium tuberculosis H37Rv
ccgacugccgcgg

SEQ ID NO: 1266404 - RNA, 13 nt, Mycobacterium tuberculosis H37Rv
ccgacucggccac

SEQ ID NO: 1266405 - RNA, 15 nt, Mycobacterium tuberculosis H37Rv
ccgacucggcaccgc

SEQ ID NO: 1266406 - RNA, 17 nt, Mycobacterium tuberculosis H37Rv
ccgacucaggucggugc

SEQ ID NO: 1266407 - RNA, 22 nt, Mycobacterium tuberculosis H37Rv
ccgacucaggucggugcgguca

SEQ ID NO: 1266408 - RNA, 23 nt, Mycobacterium tuberculosis H37Rv
ccgacucccccucuaccuccgcc

SEQ ID NO: 1266409 - RNA, 21 nt, Mycobacterium tuberculosis H37Rv
ccgacgugagggucaugucga

SEQ ID NO: 1266410 - RNA, 17 nt, Mycobacterium tuberculosis H37Rv
ccgacgucgccaagacc

SEQ ID NO: 1266411 - RNA, 14 nt, Mycobacterium tuberculosis H37Rv
ccgacgucgccaag

SEQ ID NO: 1266412 - RNA, 14 nt, Mycobacterium tuberculosis H37Rv
ccgacgucggugac

SEQ ID NO: 1266413 - RNA, 13 nt, Mycobacterium tuberculosis H37Rv
ccgacgucgacga

SEQ ID NO: 1266414 - RNA, 15 nt, Mycobacterium tuberculosis H37Rv
ccgacgucgacgccg

SEQ ID NO: 1266415 - RNA, 19 nt, Mycobacterium tuberculosis H37Rv
ccgacgucaggcagcuccg

SEQ ID NO: 1266416 - RNA, 21 nt, Mycobacterium tuberculosis H37Rv
ccgacguuccccuucagcacg

SEQ ID NO: 1266417 - RNA, 14 nt, Mycobacterium tuberculosis H37Rv
ccgacuaucggccg

SEQ ID NO: 1266418 - RNA, 15 nt, Mycobacterium tuberculosis H37Rv
ccgagauagcaacga

SEQ ID NO: 1266419 - RNA, 17 nt, Mycobacterium tuberculosis H37Rv
ccgagacggcgucgggc

SEQ ID NO: 1266420 - RNA, 23 nt, Mycobacterium tuberculosis H37Rv
ccgagaccgcgugcucgagcacc

SEQ ID NO: 1266421 - RNA, 18 nt, Mycobacterium tuberculosis H37Rv
ccgagaccaugccgacga

SEQ ID NO: 1266422 - RNA, 17 nt, Mycobacterium tuberculosis H37Rv
ccgagaccaugccgacg

SEQ ID NO: 1266423 - RNA, 16 nt, Mycobacterium tuberculosis H37Rv
ccgagaccaacgcgca

SEQ ID NO: 1266424 - RNA, 12 nt, Mycobacterium tuberculosis H37Rv
ccgagaucgaca

SEQ ID NO: 1266425 - RNA, 17 nt, Mycobacterium tuberculosis H37Rv
ccgagcaaacacgccuc

SEQ ID NO: 1266426 - RNA, 20 nt, Mycobacterium tuberculosis H37Rv
ccgagcaacaccgucggcag

SEQ ID NO: 1266427 - RNA, 22 nt, Mycobacterium tuberculosis H37Rv
ccgagaugcuggucggcgauga

SEQ ID NO: 1266428 - RNA, 20 nt, Mycobacterium tuberculosis H37Rv
ccgagauccacgccagagcg

SEQ ID NO: 1266429 - RNA, 18 nt, Mycobacterium tuberculosis H37Rv
ccgagcacaggaucaccc

SEQ ID NO: 1266430 - RNA, 19 nt, Mycobacterium tuberculosis H37Rv
ccgagcaccugaccguuga

SEQ ID NO: 1266431 - RNA, 20 nt, Mycobacterium tuberculosis H37Rv
ccgagcagggccggcaccgc

SEQ ID NO: 1266432 - RNA, 18 nt, Mycobacterium tuberculosis H37Rv
ccgagcagcccgcggauc

SEQ ID NO: 1266433 - RNA, 16 nt, Mycobacterium tuberculosis H37Rv
ccgagcagggccggca

SEQ ID NO: 1266434 - RNA, 19 nt, Mycobacterium tuberculosis H37Rv
ccgagcagacgcaaaaucg

SEQ ID NO: 1266435 - RNA, 19 nt, Mycobacterium tuberculosis H37Rv
ccgagcagacgcggaaucg

SEQ ID NO: 1266436 - RNA, 16 nt, Mycobacterium tuberculosis H37Rv
ccgagcagcagaaacg

SEQ ID NO: 1266437 - RNA, 17 nt, Mycobacterium tuberculosis H37Rv
ccgagccuugagcgcgg

SEQ ID NO: 1266438 - RNA, 16 nt, Mycobacterium tuberculosis H37Rv
ccgagcccagcgccuc

SEQ ID NO: 1266439 - RNA, 13 nt, Mycobacterium tuberculosis H37Rv
ccgagcccggugc

SEQ ID NO: 1266440 - RNA, 19 nt, Mycobacterium tuberculosis H37Rv
ccgagcccgccagcgccgc

SEQ ID NO: 1266441 - RNA, 13 nt, Mycobacterium tuberculosis H37Rv
ccgagcgcgauga

SEQ ID NO: 1266442 - RNA, 20 nt, Mycobacterium tuberculosis H37Rv
ccgagcgcgaugaugaucgg

SEQ ID NO: 1266443 - RNA, 19 nt, Mycobacterium tuberculosis H37Rv
ccgagcgccaguucgcggc

SEQ ID NO: 1266444 - RNA, 12 nt, Mycobacterium tuberculosis H37Rv
ccgagcgggaac

SEQ ID NO: 1266445 - RNA, 15 nt, Mycobacterium tuberculosis H37Rv
ccgagcggcaucggu

SEQ ID NO: 1266446 - RNA, 21 nt, Mycobacterium tuberculosis H37Rv
ccgagcugagcggccagcauc

SEQ ID NO: 1266447 - RNA, 21 nt, Mycobacterium tuberculosis H37Rv
ccgagcugugcgcagacaucg

SEQ ID NO: 1266448 - RNA, 17 nt, Mycobacterium tuberculosis H37Rv
ccgagcguaaugcugcu

SEQ ID NO: 1266449 - RNA, 15 nt, Mycobacterium tuberculosis H37Rv
ccgagcggcggcacu

SEQ ID NO: 1266450 - RNA, 20 nt, Mycobacterium tuberculosis H37Rv
ccgagcgugaagucacggcg

SEQ ID NO: 1266451 - RNA, 23 nt, Mycobacterium tuberculosis H37Rv
ccgagcuagaucacggagcucuu

SEQ ID NO: 1266452 - RNA, 12 nt, Mycobacterium tuberculosis H37Rv
ccgaggaucgcg

SEQ ID NO: 1266453 - RNA, 18 nt, Mycobacterium tuberculosis H37Rv
ccgaggaccucgucaccg

SEQ ID NO: 1266454 - RNA, 14 nt, Mycobacterium tuberculosis H37Rv
ccgaggaccagagg

SEQ ID NO: 1266455 - RNA, 17 nt, Mycobacterium tuberculosis H37Rv
ccgagcuuccaaacccg

SEQ ID NO: 1266456 - RNA, 20 nt, Mycobacterium tuberculosis H37Rv
ccgagcuguggucacccgug

SEQ ID NO: 1266457 - RNA, 16 nt, Mycobacterium tuberculosis H37Rv
ccgaggccucggccag

SEQ ID NO: 1266458 - RNA, 17 nt, Mycobacterium tuberculosis H37Rv
ccgaggccuaccaggcg

SEQ ID NO: 1266459 - RNA, 19 nt, Mycobacterium tuberculosis H37Rv
ccgaggccgccaucgccgc

SEQ ID NO: 1266460 - RNA, 17 nt, Mycobacterium tuberculosis H37Rv
ccgaggccgccaucgcc

SEQ ID NO: 1266461 - RNA, 14 nt, Mycobacterium tuberculosis H37Rv
ccgaggaugccgaa

SEQ ID NO: 1266462 - RNA, 17 nt, Mycobacterium tuberculosis H37Rv
ccgaggucacccgguag

SEQ ID NO: 1266463 - RNA, 13 nt, Mycobacterium tuberculosis H37Rv
ccgaggcucgggc

SEQ ID NO: 1266464 - RNA, 20 nt, Mycobacterium tuberculosis H37Rv
ccgaggcggguacaccacgg

SEQ ID NO: 1266465 - RNA, 12 nt, Mycobacterium tuberculosis H37Rv
ccgaggcggaug

SEQ ID NO: 1266466 - RNA, 15 nt, Mycobacterium tuberculosis H37Rv
ccgaggcggaugcgg

SEQ ID NO: 1266467 - RNA, 13 nt, Mycobacterium tuberculosis H37Rv
ccgaggucgguuc

SEQ ID NO: 1266468 - RNA, 17 nt, Mycobacterium tuberculosis H37Rv
ccgaggucgguucggcc

SEQ ID NO: 1266469 - RNA, 21 nt, Mycobacterium tuberculosis H37Rv
ccgaggugcuuggggucaccc

SEQ ID NO: 1266470 - RNA, 20 nt, Mycobacterium tuberculosis H37Rv
ccgaguaccgauagccugcg

SEQ ID NO: 1266471 - RNA, 16 nt, Mycobacterium tuberculosis H37Rv
ccgagucgacggccag

SEQ ID NO: 1266472 - RNA, 15 nt, Mycobacterium tuberculosis H37Rv
ccgaguauuggucgg

SEQ ID NO: 1266473 - RNA, 18 nt, Mycobacterium tuberculosis H37Rv
ccgauaaaggucacuccu

SEQ ID NO: 1266474 - RNA, 14 nt, Mycobacterium tuberculosis H37Rv
ccgauaaaugccgc

SEQ ID NO: 1266475 - RNA, 15 nt, Mycobacterium tuberculosis H37Rv
ccgauaaaugccgcg

SEQ ID NO: 1266476 - RNA, 13 nt, Mycobacterium tuberculosis H37Rv
ccgaguuggucgu

SEQ ID NO: 1266477 - RNA, 15 nt, Mycobacterium tuberculosis H37Rv
ccgaguuugcgauac

SEQ ID NO: 1266478 - RNA, 18 nt, Mycobacterium tuberculosis H37Rv
ccgaguuauagaagccga

SEQ ID NO: 1266479 - RNA, 16 nt, Mycobacterium tuberculosis H37Rv
ccgaguuaccggugac

SEQ ID NO: 1266480 - RNA, 19 nt, Mycobacterium tuberculosis H37Rv
ccgagugugaaucgcacga

SEQ ID NO: 1266481 - RNA, 14 nt, Mycobacterium tuberculosis H37Rv
ccgagucggcaaac

SEQ ID NO: 1266482 - RNA, 16 nt, Mycobacterium tuberculosis H37Rv
ccgagucugcgagcag

SEQ ID NO: 1266483 - RNA, 22 nt, Mycobacterium tuberculosis H37Rv
ccgagugcccagcgaugcgcuc

SEQ ID NO: 1266484 - RNA, 17 nt, Mycobacterium tuberculosis H37Rv
cgcacguuggcggccag

SEQ ID NO: 1266485 - RNA, 22 nt, Mycobacterium tuberculosis H37Rv
cgcacguauccacggucgacca

SEQ ID NO: 1266486 - RNA, 13 nt, Mycobacterium tuberculosis H37Rv
cgcacgucgaccu

SEQ ID NO: 1266487 - RNA, 21 nt, Mycobacterium tuberculosis H37Rv
cgcacggugaccacgccgugg

SEQ ID NO: 1266488 - RNA, 22 nt, Mycobacterium tuberculosis H37Rv
cgcacgguucuuggcgucuugg

SEQ ID NO: 1266489 - RNA, 19 nt, Mycobacterium tuberculosis H37Rv
cgcacggugccgccgucga

SEQ ID NO: 1266490 - RNA, 15 nt, Mycobacterium tuberculosis H37Rv
cgcacugccgggugg

SEQ ID NO: 1266491 - RNA, 12 nt, Mycobacterium tuberculosis H37Rv
cgcacugccggg

SEQ ID NO: 1266492 - RNA, 22 nt, Mycobacterium tuberculosis H37Rv
cgcacugguugggcgagaccgc

SEQ ID NO: 1266493 - RNA, 15 nt, Mycobacterium tuberculosis H37Rv
cgcacuccacgaucg

SEQ ID NO: 1266494 - RNA, 20 nt, Mycobacterium tuberculosis H37Rv
cgcacuccacgaucggccca

SEQ ID NO: 1266495 - RNA, 20 nt, Mycobacterium tuberculosis H37Rv
cgcacucgcgucccgaaccg

SEQ ID NO: 1266496 - RNA, 20 nt, Mycobacterium tuberculosis H37Rv
cgcacucguugccgaccaug

SEQ ID NO: 1266497 - RNA, 14 nt, Mycobacterium tuberculosis H37Rv
cgcacgcucggcgu

SEQ ID NO: 1266498 - RNA, 19 nt, Mycobacterium tuberculosis H37Rv
cgcacgcucggcgugucgg

SEQ ID NO: 1266499 - RNA, 15 nt, Mycobacterium tuberculosis H37Rv
cgcacgcuagccgac

SEQ ID NO: 1266500 - RNA, 14 nt, Mycobacterium tuberculosis H37Rv
cgcacggaccaucg

SEQ ID NO: 1266501 - RNA, 19 nt, Mycobacterium tuberculosis H37Rv
cgcacggaggcggaccagg

SEQ ID NO: 1266502 - RNA, 15 nt, Mycobacterium tuberculosis H37Rv
cgcacgcuggcgggc

SEQ ID NO: 1266503 - RNA, 12 nt, Mycobacterium tuberculosis H37Rv
cgcacgggcgac

SEQ ID NO: 1266504 - RNA, 17 nt, Mycobacterium tuberculosis H37Rv
cgcacgggcgaccugcg

SEQ ID NO: 1266505 - RNA, 19 nt, Mycobacterium tuberculosis H37Rv
cgcacggcgucggccaccg

SEQ ID NO: 1266506 - RNA, 14 nt, Mycobacterium tuberculosis H37Rv
cgcacggcgucggc

SEQ ID NO: 1266507 - RNA, 13 nt, Mycobacterium tuberculosis H37Rv
cgcacggcgucgg

SEQ ID NO: 1266508 - RNA, 17 nt, Mycobacterium tuberculosis H37Rv
cgcacggcgccgacccg

SEQ ID NO: 1266509 - RNA, 14 nt, Mycobacterium tuberculosis H37Rv
cgcacggcgccgac

SEQ ID NO: 1266510 - RNA, 20 nt, Mycobacterium tuberculosis H37Rv
cgcacggccaccgcgcaacc

SEQ ID NO: 1266511 - RNA, 17 nt, Mycobacterium tuberculosis H37Rv
cgcacgauggccgucga

SEQ ID NO: 1266512 - RNA, 14 nt, Mycobacterium tuberculosis H37Rv
cgcacgcaguucgg

SEQ ID NO: 1266513 - RNA, 14 nt, Mycobacterium tuberculosis H37Rv
cgcacgccgaccgg

SEQ ID NO: 1266514 - RNA, 13 nt, Mycobacterium tuberculosis H37Rv
cgcacgcccgcac

SEQ ID NO: 1266515 - RNA, 16 nt, Mycobacterium tuberculosis H37Rv
cgcacgcccgcacucg

SEQ ID NO: 1266516 - RNA, 21 nt, Mycobacterium tuberculosis H37Rv
cgcacgcggaaaggcuuccgc

SEQ ID NO: 1266517 - RNA, 16 nt, Mycobacterium tuberculosis H37Rv
cgcacgccggccagcg

SEQ ID NO: 1266518 - RNA, 18 nt, Mycobacterium tuberculosis H37Rv
cgcacgccggcaugccag

SEQ ID NO: 1266519 - RNA, 14 nt, Mycobacterium tuberculosis H37Rv
cgcacgccggccag

SEQ ID NO: 1266520 - RNA, 17 nt, Mycobacterium tuberculosis H37Rv
cgcaacggccagcgcug

SEQ ID NO: 1266521 - RNA, 14 nt, Mycobacterium tuberculosis H37Rv
cgcaaggaugucgg

SEQ ID NO: 1266522 - RNA, 21 nt, Mycobacterium tuberculosis H37Rv
cgcaagcggacccgaccgucg

SEQ ID NO: 1266523 - RNA, 18 nt, Mycobacterium tuberculosis H37Rv
cgcaccgcgguacgccgg

SEQ ID NO: 1266524 - RNA, 19 nt, Mycobacterium tuberculosis H37Rv
cgcaccgcgggaucggugg

SEQ ID NO: 1266525 - RNA, 20 nt, Mycobacterium tuberculosis H37Rv
cgcaccgcgggaucgguggc

SEQ ID NO: 1266526 - RNA, 21 nt, Mycobacterium tuberculosis H37Rv
cgcaccgcggaccggcgucgg

SEQ ID NO: 1266527 - RNA, 14 nt, Mycobacterium tuberculosis H37Rv
cgcaccgcguucug

SEQ ID NO: 1266528 - RNA, 21 nt, Mycobacterium tuberculosis H37Rv
cgcaccgcguugaugaccgcc

SEQ ID NO: 1266529 - RNA, 17 nt, Mycobacterium tuberculosis H37Rv
cgcaccggcgucggcgc

SEQ ID NO: 1266530 - RNA, 15 nt, Mycobacterium tuberculosis H37Rv
cgcaccggcgucggc

SEQ ID NO: 1266531 - RNA, 22 nt, Mycobacterium tuberculosis H37Rv
cgcaccgugugggccccgccga

SEQ ID NO: 1266532 - RNA, 22 nt, Mycobacterium tuberculosis H37Rv
cgcaccuccugcgagugcggca

SEQ ID NO: 1266533 - RNA, 19 nt, Mycobacterium tuberculosis H37Rv
cgcaccguggacaccuggc

SEQ ID NO: 1266534 - RNA, 16 nt, Mycobacterium tuberculosis H37Rv
cgcaccugaucgguca

SEQ ID NO: 1266535 - RNA, 21 nt, Mycobacterium tuberculosis H37Rv
cgcaccucggcgaagucacgc

SEQ ID NO: 1266536 - RNA, 13 nt, Mycobacterium tuberculosis H37Rv
cgcaccuugaccg

SEQ ID NO: 1266537 - RNA, 20 nt, Mycobacterium tuberculosis H37Rv
cgcacgaaaccgcagcgcga

SEQ ID NO: 1266538 - RNA, 15 nt, Mycobacterium tuberculosis H37Rv
cgcacgaaccggucg

SEQ ID NO: 1266539 - RNA, 18 nt, Mycobacterium tuberculosis H37Rv
cgcacgaacgaguccaac

SEQ ID NO: 1266540 - RNA, 17 nt, Mycobacterium tuberculosis H37Rv
cgcacgaaccccacgca

SEQ ID NO: 1266541 - RNA, 17 nt, Mycobacterium tuberculosis H37Rv
cgcacgaucgcccguga

SEQ ID NO: 1266542 - RNA, 19 nt, Mycobacterium tuberculosis H37Rv
cgcacgauagccaccgacg

SEQ ID NO: 1266543 - RNA, 16 nt, Mycobacterium tuberculosis H37Rv
cgcacgaucgcaccga

SEQ ID NO: 1266544 - RNA, 19 nt, Mycobacterium tuberculosis H37Rv
cgcacgacugugcgccgca

SEQ ID NO: 1266545 - RNA, 22 nt, Mycobacterium tuberculosis H37Rv
cgcacgacugugcgccgcagcc

SEQ ID NO: 1266546 - RNA, 19 nt, Mycobacterium tuberculosis H37Rv
cgcacgaagccggcuucgg

SEQ ID NO: 1266547 - RNA, 21 nt, Mycobacterium tuberculosis H37Rv
cgcagcaccucgucgaucgcc

SEQ ID NO: 1266548 - RNA, 16 nt, Mycobacterium tuberculosis H37Rv
cgcagcaccucgucga

SEQ ID NO: 1266549 - RNA, 14 nt, Mycobacterium tuberculosis H37Rv
cgcagcaccgguca

SEQ ID NO: 1266550 - RNA, 13 nt, Mycobacterium tuberculosis H37Rv
cgcagcacugcgg

SEQ ID NO: 1266551 - RNA, 16 nt, Mycobacterium tuberculosis H37Rv
cgcagcacucgcccaa

SEQ ID NO: 1266552 - RNA, 19 nt, Mycobacterium tuberculosis H37Rv
cgcagaacaccaccgccag

SEQ ID NO: 1266553 - RNA, 17 nt, Mycobacterium tuberculosis H37Rv
cgcagaacggaccucgg

SEQ ID NO: 1266554 - RNA, 14 nt, Mycobacterium tuberculosis H37Rv
cgcagaacggcguu

SEQ ID NO: 1266555 - RNA, 19 nt, Mycobacterium tuberculosis H37Rv
cgcagcacauccugcagcu

SEQ ID NO: 1266556 - RNA, 23 nt, Mycobacterium tuberculosis H37Rv
cgcagaaauguauugcggugagu

SEQ ID NO: 1266557 - RNA, 21 nt, Mycobacterium tuberculosis H37Rv
cgcagaaauguauugcgguga

SEQ ID NO: 1266558 - RNA, 22 nt, Mycobacterium tuberculosis H37Rv
cgcacuugaucgacggccaucg

SEQ ID NO: 1266559 - RNA, 22 nt, Mycobacterium tuberculosis H37Rv
cgcagccacguuacgcucgcgg

SEQ ID NO: 1266560 - RNA, 14 nt, Mycobacterium tuberculosis H37Rv
cgcagccagcaagu

SEQ ID NO: 1266561 - RNA, 14 nt, Mycobacterium tuberculosis H37Rv
cgcagccagcggua

SEQ ID NO: 1266562 - RNA, 13 nt, Mycobacterium tuberculosis H37Rv
cgcagccacgcgg

SEQ ID NO: 1266563 - RNA, 17 nt, Mycobacterium tuberculosis H37Rv
cgcagcgauucgccuag

SEQ ID NO: 1266564 - RNA, 13 nt, Mycobacterium tuberculosis H37Rv
cgcagcgacgcgg

SEQ ID NO: 1266565 - RNA, 16 nt, Mycobacterium tuberculosis H37Rv
cgcagcgacgcggugg

SEQ ID NO: 1266566 - RNA, 18 nt, Mycobacterium tuberculosis H37Rv
cgcagccugccgaugacg

SEQ ID NO: 1266567 - RNA, 13 nt, Mycobacterium tuberculosis H37Rv
cgcaggacgcugc

SEQ ID NO: 1266568 - RNA, 18 nt, Mycobacterium tuberculosis H37Rv
cgcaggaucgaguugcgg

SEQ ID NO: 1266569 - RNA, 15 nt, Mycobacterium tuberculosis H37Rv
cgcagcgccacccga

SEQ ID NO: 1266570 - RNA, 22 nt, Mycobacterium tuberculosis H37Rv
cgcagcgccuccucgaucuccg

SEQ ID NO: 1266571 - RNA, 22 nt, Mycobacterium tuberculosis H37Rv
cgcagcgccggcagcagcagag

SEQ ID NO: 1266572 - RNA, 15 nt, Mycobacterium tuberculosis H37Rv
cgcagcgccucggua

SEQ ID NO: 1266573 - RNA, 16 nt, Mycobacterium tuberculosis H37Rv
cgcaggugcugggcga

SEQ ID NO: 1266574 - RNA, 18 nt, Mycobacterium tuberculosis H37Rv
cgcaggugaacgccggug

SEQ ID NO: 1266575 - RNA, 22 nt, Mycobacterium tuberculosis H37Rv
cgcaggccgacacgaacgcugc

SEQ ID NO: 1266576 - RNA, 13 nt, Mycobacterium tuberculosis H37Rv
cgccaccggcaau

SEQ ID NO: 1266577 - RNA, 15 nt, Mycobacterium tuberculosis H37Rv
cgccaccgcgagcag

SEQ ID NO: 1266578 - RNA, 16 nt, Mycobacterium tuberculosis H37Rv
cgccaccgccggcagc

SEQ ID NO: 1266579 - RNA, 21 nt, Mycobacterium tuberculosis H37Rv
cgccaccccgcuuggaccguu

SEQ ID NO: 1266580 - RNA, 16 nt, Mycobacterium tuberculosis H37Rv
cgccaccgaagccgcc

SEQ ID NO: 1266581 - RNA, 22 nt, Mycobacterium tuberculosis H37Rv
cgccacccuuggcccggugcag

SEQ ID NO: 1266582 - RNA, 18 nt, Mycobacterium tuberculosis H37Rv
cgccaccgagaucggaca

SEQ ID NO: 1266583 - RNA, 15 nt, Mycobacterium tuberculosis H37Rv
cgccaccgaggccgc

SEQ ID NO: 1266584 - RNA, 18 nt, Mycobacterium tuberculosis H37Rv
cgccacgcccgacgccag

SEQ ID NO: 1266585 - RNA, 19 nt, Mycobacterium tuberculosis H37Rv
cgccacgccaccgcgguca

SEQ ID NO: 1266586 - RNA, 15 nt, Mycobacterium tuberculosis H37Rv
cgccacgaugaccgg

SEQ ID NO: 1266587 - RNA, 11 nt, Mycobacterium tuberculosis H37Rv
cgccaccggcu

SEQ ID NO: 1266588 - RNA, 16 nt, Mycobacterium tuberculosis H37Rv
cgccaccgucaccgcc

SEQ ID NO: 1266589 - RNA, 22 nt, Mycobacterium tuberculosis H37Rv
cgccaccguacgacagucgcag

SEQ ID NO: 1266590 - RNA, 14 nt, Mycobacterium tuberculosis H37Rv
cgccaccggcaccg

SEQ ID NO: 1266591 - RNA, 13 nt, Mycobacterium tuberculosis H37Rv
cgccaccggcgac

SEQ ID NO: 1266592 - RNA, 20 nt, Mycobacterium tuberculosis H37Rv
cgccagagucggagacccgu

SEQ ID NO: 1266593 - RNA, 16 nt, Mycobacterium tuberculosis H37Rv
cgccacuugaugccgc

SEQ ID NO: 1266594 - RNA, 23 nt, Mycobacterium tuberculosis H37Rv
cgccacuugaugccgcacccgau

SEQ ID NO: 1266595 - RNA, 14 nt, Mycobacterium tuberculosis H37Rv
cgccagaucaccgu

SEQ ID NO: 1266596 - RNA, 21 nt, Mycobacterium tuberculosis H37Rv
cgccacuguugaagaagcccg

SEQ ID NO: 1266597 - RNA, 19 nt, Mycobacterium tuberculosis H37Rv
cgccacuggaagccaagcu

SEQ ID NO: 1266598 - RNA, 22 nt, Mycobacterium tuberculosis H37Rv
cgccacugcguuggaauguccg

SEQ ID NO: 1266599 - RNA, 22 nt, Mycobacterium tuberculosis H37Rv
cgccacuggcgccggugccgcc

SEQ ID NO: 1266600 - RNA, 18 nt, Mycobacterium tuberculosis H37Rv
cgccacuggcgcugaucg

SEQ ID NO: 1266601 - RNA, 12 nt, Mycobacterium tuberculosis H37Rv
cgccacggugua

SEQ ID NO: 1266602 - RNA, 18 nt, Mycobacterium tuberculosis H37Rv
cgccacgggugacucggg

SEQ ID NO: 1266603 - RNA, 13 nt, Mycobacterium tuberculosis H37Rv
cgccagaucucgc

SEQ ID NO: 1266604 - RNA, 17 nt, Mycobacterium tuberculosis H37Rv
cgccagcaacagcgcgg

SEQ ID NO: 1266605 - RNA, 18 nt, Mycobacterium tuberculosis H37Rv
cgccagcagggccagacc

SEQ ID NO: 1266606 - RNA, 19 nt, Mycobacterium tuberculosis H37Rv
cgccagcccagcacgcugg

SEQ ID NO: 1266607 - RNA, 20 nt, Mycobacterium tuberculosis H37Rv
cgccagcccagcacgcuggc

SEQ ID NO: 1266608 - RNA, 14 nt, Mycobacterium tuberculosis H37Rv
cgccagcccgucau

SEQ ID NO: 1266609 - RNA, 17 nt, Mycobacterium tuberculosis H37Rv
cgccagcccggugaugg

SEQ ID NO: 1266610 - RNA, 15 nt, Mycobacterium tuberculosis H37Rv
cgccagcgccaccgu

SEQ ID NO: 1266611 - RNA, 23 nt, Mycobacterium tuberculosis H37Rv
cgccagcgauccaccaagcucgc

SEQ ID NO: 1266612 - RNA, 15 nt, Mycobacterium tuberculosis H37Rv
cgccagcgccacugg

SEQ ID NO: 1266613 - RNA, 18 nt, Mycobacterium tuberculosis H37Rv
cgccagcgccgccggcac

SEQ ID NO: 1266614 - RNA, 19 nt, Mycobacterium tuberculosis H37Rv
cgccagcggccgcuccacc

SEQ ID NO: 1266615 - RNA, 14 nt, Mycobacterium tuberculosis H37Rv
cgccagcggccgcu

SEQ ID NO: 1266616 - RNA, 17 nt, Mycobacterium tuberculosis H37Rv
cgccagcgguggaccac

SEQ ID NO: 1266617 - RNA, 14 nt, Mycobacterium tuberculosis H37Rv
cgccagcgucgaca

SEQ ID NO: 1266618 - RNA, 20 nt, Mycobacterium tuberculosis H37Rv
cgccagcggggcuagucggg

SEQ ID NO: 1266619 - RNA, 21 nt, Mycobacterium tuberculosis H37Rv
cgccagcuugucgggcaccgg

SEQ ID NO: 1266620 - RNA, 16 nt, Mycobacterium tuberculosis H37Rv
cgcagguuggcaagca

SEQ ID NO: 1266621 - RNA, 19 nt, Mycobacterium tuberculosis H37Rv
cgcagguucaacgcgggga

SEQ ID NO: 1266622 - RNA, 14 nt, Mycobacterium tuberculosis H37Rv
cgcagguggucgau

SEQ ID NO: 1266623 - RNA, 16 nt, Mycobacterium tuberculosis H37Rv
cgcaucggcgaacaac

SEQ ID NO: 1266624 - RNA, 16 nt, Mycobacterium tuberculosis H37Rv
cgcaucgccucgaggu

SEQ ID NO: 1266625 - RNA, 17 nt, Mycobacterium tuberculosis H37Rv
cgcaucgccucaccacg

SEQ ID NO: 1266626 - RNA, 11 nt, Mycobacterium tuberculosis H37Rv
cgcaucgccaa

SEQ ID NO: 1266627 - RNA, 19 nt, Mycobacterium tuberculosis H37Rv
cgcaucgcccaagccguag

SEQ ID NO: 1266628 - RNA, 21 nt, Mycobacterium tuberculosis H37Rv
cgcaucgagcccggacgagug

SEQ ID NO: 1266629 - RNA, 15 nt, Mycobacterium tuberculosis H37Rv
cgcaucgacgcucau

SEQ ID NO: 1266630 - RNA, 15 nt, Mycobacterium tuberculosis H37Rv
cgcaucgucagcgac

SEQ ID NO: 1266631 - RNA, 18 nt, Mycobacterium tuberculosis H37Rv
cgcaucguugccgaccgu

SEQ ID NO: 1266632 - RNA, 19 nt, Mycobacterium tuberculosis H37Rv
cgcaucggcgccagaucga

SEQ ID NO: 1266633 - RNA, 14 nt, Mycobacterium tuberculosis H37Rv
cgcaucggcgguga

SEQ ID NO: 1266634 - RNA, 22 nt, Mycobacterium tuberculosis H37Rv
cgcaucugcucggcaucgagca

SEQ ID NO: 1266635 - RNA, 20 nt, Mycobacterium tuberculosis H37Rv
cgcaugggccaggucagccg

SEQ ID NO: 1266636 - RNA, 12 nt, Mycobacterium tuberculosis H37Rv
cgcauggucgac

SEQ ID NO: 1266637 - RNA, 20 nt, Mycobacterium tuberculosis H37Rv
cgcauugcagcguccccaug

SEQ ID NO: 1266638 - RNA, 16 nt, Mycobacterium tuberculosis H37Rv
cgcauugcagaaccgc

SEQ ID NO: 1266639 - RNA, 19 nt, Mycobacterium tuberculosis H37Rv
cgcauugccaacgcccacg

SEQ ID NO: 1266640 - RNA, 14 nt, Mycobacterium tuberculosis H37Rv
cgcauugagcuggc

SEQ ID NO: 1266641 - RNA, 18 nt, Mycobacterium tuberculosis H37Rv
cgccacagccccagggug

SEQ ID NO: 1266642 - RNA, 14 nt, Mycobacterium tuberculosis H37Rv
cgccaccaccaggg

SEQ ID NO: 1266643 - RNA, 19 nt, Mycobacterium tuberculosis H37Rv
cgccaccaccagggcaacg

SEQ ID NO: 1266644 - RNA, 21 nt, Mycobacterium tuberculosis H37Rv
cgccaccaccuccgcgucgga

SEQ ID NO: 1266645 - RNA, 18 nt, Mycobacterium tuberculosis H37Rv
cgccaccagcaccgccgc

SEQ ID NO: 1266646 - RNA, 19 nt, Mycobacterium tuberculosis H37Rv
cgccaccauccccggcaac

SEQ ID NO: 1266647 - RNA, 19 nt, Mycobacterium tuberculosis H37Rv
cgccaagacgucggcgugg

SEQ ID NO: 1266648 - RNA, 22 nt, Mycobacterium tuberculosis H37Rv
cgccaagaucggguggcggguc

SEQ ID NO: 1266649 - RNA, 21 nt, Mycobacterium tuberculosis H37Rv
cgccaagaucggguggcgggu

SEQ ID NO: 1266650 - RNA, 13 nt, Mycobacterium tuberculosis H37Rv
cgccaacugcggc

SEQ ID NO: 1266651 - RNA, 23 nt, Mycobacterium tuberculosis H37Rv
cgcauugaucucgaccggcuugc

SEQ ID NO: 1266652 - RNA, 12 nt, Mycobacterium tuberculosis H37Rv
cgcauuggcggc

SEQ ID NO: 1266653 - RNA, 17 nt, Mycobacterium tuberculosis H37Rv
cgcauuucggaucucga

SEQ ID NO: 1266654 - RNA, 20 nt, Mycobacterium tuberculosis H37Rv
cgccaaugccaccauugccg

SEQ ID NO: 1266655 - RNA, 16 nt, Mycobacterium tuberculosis H37Rv
cgccaaugcccaggug

SEQ ID NO: 1266656 - RNA, 13 nt, Mycobacterium tuberculosis H37Rv
cgccacacccgug

SEQ ID NO: 1266657 - RNA, 20 nt, Mycobacterium tuberculosis H37Rv
cgccacaccaugauugccag

SEQ ID NO: 1266658 - RNA, 14 nt, Mycobacterium tuberculosis H37Rv
cgccacaccaacgu

SEQ ID NO: 1266659 - RNA, 18 nt, Mycobacterium tuberculosis H37Rv
cgccacaccaacgucgau

SEQ ID NO: 1266660 - RNA, 20 nt, Mycobacterium tuberculosis H37Rv
cgaucagauaguccggcuug

SEQ ID NO: 1266661 - RNA, 22 nt, Mycobacterium tuberculosis H37Rv
cgaucacgucgucucggcggug

SEQ ID NO: 1266662 - RNA, 23 nt, Mycobacterium tuberculosis H37Rv
cgaucacgucgucucggcggugg

SEQ ID NO: 1266663 - RNA, 23 nt, Mycobacterium tuberculosis H37Rv
cgaucacuagucguagacggcga

SEQ ID NO: 1266664 - RNA, 19 nt, Mycobacterium tuberculosis H37Rv
cgaucacgucgucagccac

SEQ ID NO: 1266665 - RNA, 15 nt, Mycobacterium tuberculosis H37Rv
cgaucagcgccggau

SEQ ID NO: 1266666 - RNA, 15 nt, Mycobacterium tuberculosis H37Rv
cgaucagcgcgacgg

SEQ ID NO: 1266667 - RNA, 22 nt, Mycobacterium tuberculosis H37Rv
cgaucagcggcagcaccgcacg

SEQ ID NO: 1266668 - RNA, 21 nt, Mycobacterium tuberculosis H37Rv
cgaucaggggcccacccgaau

SEQ ID NO: 1266669 - RNA, 14 nt, Mycobacterium tuberculosis H37Rv
cgauccgagaccgc

SEQ ID NO: 1266670 - RNA, 13 nt, Mycobacterium tuberculosis H37Rv
cgauccgcacagc

SEQ ID NO: 1266671 - RNA, 15 nt, Mycobacterium tuberculosis H37Rv
cgauccccgcgcuga

SEQ ID NO: 1266672 - RNA, 16 nt, Mycobacterium tuberculosis H37Rv
cgauccacuguagggc

SEQ ID NO: 1266673 - RNA, 20 nt, Mycobacterium tuberculosis H37Rv
cgaucccggcgagcacccgc

SEQ ID NO: 1266674 - RNA, 18 nt, Mycobacterium tuberculosis H37Rv
cgaucccguccgcgccca

SEQ ID NO: 1266675 - RNA, 12 nt, Mycobacterium tuberculosis H37Rv
cgauccacaggc

SEQ ID NO: 1266676 - RNA, 14 nt, Mycobacterium tuberculosis H37Rv
cgauccacuccggc

SEQ ID NO: 1266677 - RNA, 19 nt, Mycobacterium tuberculosis H37Rv
cgauccacucggcgaucuc

SEQ ID NO: 1266678 - RNA, 15 nt, Mycobacterium tuberculosis H37Rv
cgauaccggcgugca

SEQ ID NO: 1266679 - RNA, 13 nt, Mycobacterium tuberculosis H37Rv
cgauaccggcgug

SEQ ID NO: 1266680 - RNA, 22 nt, Mycobacterium tuberculosis H37Rv
cgauacgaagccgccgcgacca

SEQ ID NO: 1266681 - RNA, 23 nt, Mycobacterium tuberculosis H37Rv
cgauaccgguugcggucaucggc

SEQ ID NO: 1266682 - RNA, 14 nt, Mycobacterium tuberculosis H37Rv
cgauacccagcggg

SEQ ID NO: 1266683 - RNA, 19 nt, Mycobacterium tuberculosis H37Rv
cgaguuucugcucgaccgu

SEQ ID NO: 1266684 - RNA, 21 nt, Mycobacterium tuberculosis H37Rv
cgaguugcggugcccgcacca

SEQ ID NO: 1266685 - RNA, 16 nt, Mycobacterium tuberculosis H37Rv
cgaguugucucgcauc

SEQ ID NO: 1266686 - RNA, 16 nt, Mycobacterium tuberculosis H37Rv
cgaguuucugcucgac

SEQ ID NO: 1266687 - RNA, 13 nt, Mycobacterium tuberculosis H37Rv
cgaguuucucggc

SEQ ID NO: 1266688 - RNA, 20 nt, Mycobacterium tuberculosis H37Rv
cgaguuucugaagcccgaca

SEQ ID NO: 1266689 - RNA, 17 nt, Mycobacterium tuberculosis H37Rv
cgaguugagaaccggcu

SEQ ID NO: 1266690 - RNA, 14 nt, Mycobacterium tuberculosis H37Rv
cgaguugagaaccg

SEQ ID NO: 1266691 - RNA, 13 nt, Mycobacterium tuberculosis H37Rv
cgaguucggcagc

SEQ ID NO: 1266692 - RNA, 20 nt, Mycobacterium tuberculosis H37Rv
cgauauucggccauguagcc

SEQ ID NO: 1266693 - RNA, 18 nt, Mycobacterium tuberculosis H37Rv
cgauauuggacgcgcaug

SEQ ID NO: 1266694 - RNA, 23 nt, Mycobacterium tuberculosis H37Rv
cgauauuggaugcgcuaggugcg

SEQ ID NO: 1266695 - RNA, 16 nt, Mycobacterium tuberculosis H37Rv
cgauagaacguagcgc

SEQ ID NO: 1266696 - RNA, 16 nt, Mycobacterium tuberculosis H37Rv
cgauacgucgucagcc

SEQ ID NO: 1266697 - RNA, 18 nt, Mycobacterium tuberculosis H37Rv
cgauacggccggccguug

SEQ ID NO: 1266698 - RNA, 18 nt, Mycobacterium tuberculosis H37Rv
cgaucaaccgcugucacc

SEQ ID NO: 1266699 - RNA, 15 nt, Mycobacterium tuberculosis H37Rv
cgaucacccccugga

SEQ ID NO: 1266700 - RNA, 12 nt, Mycobacterium tuberculosis H37Rv
cgaucacggugg

SEQ ID NO: 1266701 - RNA, 16 nt, Mycobacterium tuberculosis H37Rv
cgaucaccgacaccgu

SEQ ID NO: 1266702 - RNA, 23 nt, Mycobacterium tuberculosis H37Rv
cgaucacccgcacuccacgaucg

SEQ ID NO: 1266703 - RNA, 16 nt, Mycobacterium tuberculosis H37Rv
cgagguugaccaccag

SEQ ID NO: 1266704 - RNA, 15 nt, Mycobacterium tuberculosis H37Rv
cgaguaccaggacga

SEQ ID NO: 1266705 - RNA, 15 nt, Mycobacterium tuberculosis H37Rv
cgaggugggcgucau

SEQ ID NO: 1266706 - RNA, 15 nt, Mycobacterium tuberculosis H37Rv
cgagguucugccgcg

SEQ ID NO: 1266707 - RNA, 20 nt, Mycobacterium tuberculosis H37Rv
cgaguagaagauggcaccgc

SEQ ID NO: 1266708 - RNA, 19 nt, Mycobacterium tuberculosis H37Rv
cgaguagauggucgacggg

SEQ ID NO: 1266709 - RNA, 16 nt, Mycobacterium tuberculosis H37Rv
cgaguagauggucgac

SEQ ID NO: 1266710 - RNA, 17 nt, Mycobacterium tuberculosis H37Rv
cgaguaggcggcuccga

SEQ ID NO: 1266711 - RNA, 19 nt, Mycobacterium tuberculosis H37Rv
cgaguauuuuucgaccagc

SEQ ID NO: 1266712 - RNA, 17 nt, Mycobacterium tuberculosis H37Rv
cgaguccaacucggcca

SEQ ID NO: 1266713 - RNA, 17 nt, Mycobacterium tuberculosis H37Rv
cgaguccagcgcaucgu

SEQ ID NO: 1266714 - RNA, 15 nt, Mycobacterium tuberculosis H37Rv
cgaguccaggcagcu

SEQ ID NO: 1266715 - RNA, 15 nt, Mycobacterium tuberculosis H37Rv
cgaguauuuuucgac

SEQ ID NO: 1266716 - RNA, 16 nt, Mycobacterium tuberculosis H37Rv
cgagucccggcgguug

SEQ ID NO: 1266717 - RNA, 19 nt, Mycobacterium tuberculosis H37Rv
cgaguccucgagugccgcc

SEQ ID NO: 1266718 - RNA, 23 nt, Mycobacterium tuberculosis H37Rv
cgaguccucgagugccgccgucg

SEQ ID NO: 1266719 - RNA, 21 nt, Mycobacterium tuberculosis H37Rv
cgagucgaaugucccgguguc

SEQ ID NO: 1266720 - RNA, 18 nt, Mycobacterium tuberculosis H37Rv
cgagucgacaagccgucg

SEQ ID NO: 1266721 - RNA, 21 nt, Mycobacterium tuberculosis H37Rv
cgagucgggggccgcgucucg

SEQ ID NO: 1266722 - RNA, 19 nt, Mycobacterium tuberculosis H37Rv
cgagucgaacccgcgagca

SEQ ID NO: 1266723 - RNA, 15 nt, Mycobacterium tuberculosis H37Rv
cgagucgacggccag

SEQ ID NO: 1266724 - RNA, 18 nt, Mycobacterium tuberculosis H37Rv
cgagucgaugaccccggu

SEQ ID NO: 1266725 - RNA, 13 nt, Mycobacterium tuberculosis H37Rv
cgagucgaugacc

SEQ ID NO: 1266726 - RNA, 19 nt, Mycobacterium tuberculosis H37Rv
cgagugcguugacucugcg

SEQ ID NO: 1266727 - RNA, 21 nt, Mycobacterium tuberculosis H37Rv
cgaguggaucauguucggcca

SEQ ID NO: 1266728 - RNA, 14 nt, Mycobacterium tuberculosis H37Rv
cgaguuaccggugg

SEQ ID NO: 1266729 - RNA, 15 nt, Mycobacterium tuberculosis H37Rv
cgagugcggcgacca

SEQ ID NO: 1266730 - RNA, 21 nt, Mycobacterium tuberculosis H37Rv
cgagugcggcacgaucgccaa

SEQ ID NO: 1266731 - RNA, 18 nt, Mycobacterium tuberculosis H37Rv
cgagugcggcacgaucgc

SEQ ID NO: 1266732 - RNA, 17 nt, Mycobacterium tuberculosis H37Rv
cgaguccgacaguccgc

SEQ ID NO: 1266733 - RNA, 14 nt, Mycobacterium tuberculosis H37Rv
cgagugcccagcga

SEQ ID NO: 1266734 - RNA, 14 nt, Mycobacterium tuberculosis H37Rv
cgagugcacgcuug

SEQ ID NO: 1266735 - RNA, 15 nt, Mycobacterium tuberculosis H37Rv
cgagugcaugaacgc

SEQ ID NO: 1266736 - RNA, 15 nt, Mycobacterium tuberculosis H37Rv
cgagugcgacggcga

SEQ ID NO: 1266737 - RNA, 18 nt, Mycobacterium tuberculosis H37Rv
cgagggugaagacaccgg

SEQ ID NO: 1266738 - RNA, 17 nt, Mycobacterium tuberculosis H37Rv
cgagguaagcgagucga

SEQ ID NO: 1266739 - RNA, 17 nt, Mycobacterium tuberculosis H37Rv
cgaggguuuccauggcg

SEQ ID NO: 1266740 - RNA, 23 nt, Mycobacterium tuberculosis H37Rv
cgaggucccgaaugucgaugacg

SEQ ID NO: 1266741 - RNA, 20 nt, Mycobacterium tuberculosis H37Rv
cgagguccagcaugcucgug

SEQ ID NO: 1266742 - RNA, 14 nt, Mycobacterium tuberculosis H37Rv
cgaggucacccggu

SEQ ID NO: 1266743 - RNA, 15 nt, Mycobacterium tuberculosis H37Rv
cgagguccucgucgg

SEQ ID NO: 1266744 - RNA, 15 nt, Mycobacterium tuberculosis H37Rv
cgagguccucagcga

SEQ ID NO: 1266745 - RNA, 17 nt, Mycobacterium tuberculosis H37Rv
cgagguccucagcgaug

SEQ ID NO: 1266746 - RNA, 22 nt, Mycobacterium tuberculosis H37Rv
cgaggucgcccgugucguacca

SEQ ID NO: 1266747 - RNA, 14 nt, Mycobacterium tuberculosis H37Rv
cgagguggcgcaca

SEQ ID NO: 1266748 - RNA, 23 nt, Mycobacterium tuberculosis H37Rv
cgaggugagguugacccccgggu

SEQ ID NO: 1266749 - RNA, 21 nt, Mycobacterium tuberculosis H37Rv
cgagguccucgucggcgucga

SEQ ID NO: 1266750 - RNA, 17 nt, Mycobacterium tuberculosis H37Rv
cgaggucggcgaucugc

SEQ ID NO: 1266751 - RNA, 22 nt, Mycobacterium tuberculosis H37Rv
cgaggucggugaggucgaugcc

SEQ ID NO: 1266752 - RNA, 17 nt, Mycobacterium tuberculosis H37Rv
cgagcguaacgguaacc

SEQ ID NO: 1266753 - RNA, 14 nt, Mycobacterium tuberculosis H37Rv
cgagcggucgacgu

SEQ ID NO: 1266754 - RNA, 14 nt, Mycobacterium tuberculosis H37Rv
cgagcgguugccau

SEQ ID NO: 1266755 - RNA, 16 nt, Mycobacterium tuberculosis H37Rv
cgagcggucgacgugu

SEQ ID NO: 1266756 - RNA, 16 nt, Mycobacterium tuberculosis H37Rv
cgagcgguugaucgcg

SEQ ID NO: 1266757 - RNA, 14 nt, Mycobacterium tuberculosis H37Rv
cgagcgguacgccc

SEQ ID NO: 1266758 - RNA, 15 nt, Mycobacterium tuberculosis H37Rv
cgagcgguacgcccg

SEQ ID NO: 1266759 - RNA, 18 nt, Mycobacterium tuberculosis H37Rv
cgagcgguacgcccgaau

SEQ ID NO: 1266760 - RNA, 20 nt, Mycobacterium tuberculosis H37Rv
cgagcgguacgcccgaaucg

SEQ ID NO: 1266761 - RNA, 21 nt, Mycobacterium tuberculosis H37Rv
cgagcgguacgcccgaaucgc

SEQ ID NO: 1266762 - RNA, 13 nt, Mycobacterium tuberculosis H37Rv
cgagggcugcgug

SEQ ID NO: 1266763 - RNA, 20 nt, Mycobacterium tuberculosis H37Rv
cgagggcgucgccgccguug

SEQ ID NO: 1266764 - RNA, 18 nt, Mycobacterium tuberculosis H37Rv
cgagggccacggcugcgg

SEQ ID NO: 1266765 - RNA, 21 nt, Mycobacterium tuberculosis H37Rv
cgagggcaaggacaagccgcu

SEQ ID NO: 1266766 - RNA, 20 nt, Mycobacterium tuberculosis H37Rv
cgaucuccucuugcaccagg

SEQ ID NO: 1266767 - RNA, 14 nt, Mycobacterium tuberculosis H37Rv
cgaucucgaccagc

SEQ ID NO: 1266768 - RNA, 21 nt, Mycobacterium tuberculosis H37Rv
cgaucuccaggcccggcggug

SEQ ID NO: 1266769 - RNA, 22 nt, Mycobacterium tuberculosis H37Rv
cgaucucccagugagcaugcga

SEQ ID NO: 1266770 - RNA, 14 nt, Mycobacterium tuberculosis H37Rv
cgaucgugccggga

SEQ ID NO: 1266771 - RNA, 18 nt, Mycobacterium tuberculosis H37Rv
cgaucguugccgcugaau

SEQ ID NO: 1266772 - RNA, 22 nt, Mycobacterium tuberculosis H37Rv
cgaucgugagacgccgucgacg

SEQ ID NO: 1266773 - RNA, 22 nt, Mycobacterium tuberculosis H37Rv
cgaucgucgagccgaucgcccg

SEQ ID NO: 1266774 - RNA, 23 nt, Mycobacterium tuberculosis H37Rv
cgaucgucacgggguccgaugcg

SEQ ID NO: 1266775 - RNA, 21 nt, Mycobacterium tuberculosis H37Rv
cgaucgucgcggccaaggcga

SEQ ID NO: 1266776 - RNA, 21 nt, Mycobacterium tuberculosis H37Rv
cgaucgcauccgcgguuggca

SEQ ID NO: 1266777 - RNA, 19 nt, Mycobacterium tuberculosis H37Rv
cgaucgucagccagcguug

SEQ ID NO: 1266778 - RNA, 15 nt, Mycobacterium tuberculosis H37Rv
cgaucgucgacgcgu

SEQ ID NO: 1266779 - RNA, 23 nt, Mycobacterium tuberculosis H37Rv
cgaucgacggugucaugaacgac

SEQ ID NO: 1266780 - RNA, 20 nt, Mycobacterium tuberculosis H37Rv
cgaucgagacuucuucgacg

SEQ ID NO: 1266781 - RNA, 15 nt, Mycobacterium tuberculosis H37Rv
cgauccggcgcacga

SEQ ID NO: 1266782 - RNA, 15 nt, Mycobacterium tuberculosis H37Rv
cgauccgcggcguuc

SEQ ID NO: 1266783 - RNA, 21 nt, Mycobacterium tuberculosis H37Rv
cgaucuggcguagugcucgcc

SEQ ID NO: 1266784 - RNA, 13 nt, Mycobacterium tuberculosis H37Rv
cgaucuggucgcc

SEQ ID NO: 1266785 - RNA, 20 nt, Mycobacterium tuberculosis H37Rv
cgaucugugguugcagcaca

SEQ ID NO: 1266786 - RNA, 15 nt, Mycobacterium tuberculosis H37Rv
cgaugaccgccugcu

SEQ ID NO: 1266787 - RNA, 15 nt, Mycobacterium tuberculosis H37Rv
cgaugaccgcaccga

SEQ ID NO: 1266788 - RNA, 20 nt, Mycobacterium tuberculosis H37Rv
cgaugaccgcaccgaccuga

SEQ ID NO: 1266789 - RNA, 23 nt, Mycobacterium tuberculosis H37Rv
cgaugaccgcaccgaccugaguc

SEQ ID NO: 1266790 - RNA, 18 nt, Mycobacterium tuberculosis H37Rv
cgaucuucuccucgucgg

SEQ ID NO: 1266791 - RNA, 21 nt, Mycobacterium tuberculosis H37Rv
cgaucugucgcgccggugguc

SEQ ID NO: 1266792 - RNA, 19 nt, Mycobacterium tuberculosis H37Rv
cgaugaccagggucugcuc

SEQ ID NO: 1266793 - RNA, 21 nt, Mycobacterium tuberculosis H37Rv
cgaucugcagcacucgguguc

SEQ ID NO: 1266794 - RNA, 23 nt, Mycobacterium tuberculosis H37Rv
cgaucucgccggcgaagaccgcc

SEQ ID NO: 1266795 - RNA, 20 nt, Mycobacterium tuberculosis H37Rv
cgaucugcuggccgaaccgg

SEQ ID NO: 1266796 - RNA, 12 nt, Mycobacterium tuberculosis H37Rv
cgaucugcgcca

SEQ ID NO: 1266797 - RNA, 17 nt, Mycobacterium tuberculosis H37Rv
cgaugaccucggcgaug

SEQ ID NO: 1266798 - RNA, 21 nt, Mycobacterium tuberculosis H37Rv
cgaugcauggcuugcucugcg

SEQ ID NO: 1266799 - RNA, 13 nt, Mycobacterium tuberculosis H37Rv
cgaugcaucggug

SEQ ID NO: 1266800 - RNA, 15 nt, Mycobacterium tuberculosis H37Rv
cgaugcagccgggaa

SEQ ID NO: 1266801 - RNA, 20 nt, Mycobacterium tuberculosis H37Rv
cgaugcccaagcccucgacg

SEQ ID NO: 1266802 - RNA, 23 nt, Mycobacterium tuberculosis H37Rv
cgaugccgaagcccccgacguug

SEQ ID NO: 1266803 - RNA, 22 nt, Mycobacterium tuberculosis H37Rv
cgaugccgaggaucgcgccuau

SEQ ID NO: 1266804 - RNA, 17 nt, Mycobacterium tuberculosis H37Rv
cgaugccgccggcaccg

SEQ ID NO: 1266805 - RNA, 18 nt, Mycobacterium tuberculosis H37Rv
cgaugccgccggcaccgc

SEQ ID NO: 1266806 - RNA, 19 nt, Mycobacterium tuberculosis H37Rv
cgaugcgcucacugcagcg

SEQ ID NO: 1266807 - RNA, 16 nt, Mycobacterium tuberculosis H37Rv
cgaugcgcugcucacg

SEQ ID NO: 1266808 - RNA, 18 nt, Mycobacterium tuberculosis H37Rv
cgaugcgcagugcaccgc

SEQ ID NO: 1266809 - RNA, 20 nt, Mycobacterium tuberculosis H37Rv
cgaugccggcuggcggcgug

SEQ ID NO: 1266810 - RNA, 16 nt, Mycobacterium tuberculosis H37Rv
cgaugccgugcugggc

SEQ ID NO: 1266811 - RNA, 15 nt, Mycobacterium tuberculosis H37Rv
cgaugcgcacaccga

SEQ ID NO: 1266812 - RNA, 21 nt, Mycobacterium tuberculosis H37Rv
cgaugcgauucugcgucugcu

SEQ ID NO: 1266813 - RNA, 21 nt, Mycobacterium tuberculosis H37Rv
cgaugcgauuccgcgucugcu

SEQ ID NO: 1266814 - RNA, 22 nt, Mycobacterium tuberculosis H37Rv
cgaugcgcaccagcaccugcac

SEQ ID NO: 1266815 - RNA, 13 nt, Mycobacterium tuberculosis H37Rv
cgaugcgcaccag

SEQ ID NO: 1266816 - RNA, 13 nt, Mycobacterium tuberculosis H37Rv
cgaugcgacgaac

SEQ ID NO: 1266817 - RNA, 13 nt, Mycobacterium tuberculosis H37Rv
cgaugcgacgcag

SEQ ID NO: 1266818 - RNA, 15 nt, Mycobacterium tuberculosis H37Rv
cgaugcgacgcagac

SEQ ID NO: 1266819 - RNA, 13 nt, Mycobacterium tuberculosis H37Rv
cgaugugcacggu

SEQ ID NO: 1266820 - RNA, 22 nt, Mycobacterium tuberculosis H37Rv
cgaugugcccaugaugcucgau

SEQ ID NO: 1266821 - RNA, 22 nt, Mycobacterium tuberculosis H37Rv
cgaugugcccggcucucagcga

SEQ ID NO: 1266822 - RNA, 17 nt, Mycobacterium tuberculosis H37Rv
cgauguggccggcgaug

SEQ ID NO: 1266823 - RNA, 14 nt, Mycobacterium tuberculosis H37Rv
cgaugugguccauc

SEQ ID NO: 1266824 - RNA, 23 nt, Mycobacterium tuberculosis H37Rv
cgaugguugccuuguucgcccac

SEQ ID NO: 1266825 - RNA, 20 nt, Mycobacterium tuberculosis H37Rv
cgaugguggugccgaccugu

SEQ ID NO: 1266826 - RNA, 22 nt, Mycobacterium tuberculosis H37Rv
cgaugguuauccccuggccaac

SEQ ID NO: 1266827 - RNA, 20 nt, Mycobacterium tuberculosis H37Rv
cgaugucagccaccaucugg

SEQ ID NO: 1266828 - RNA, 17 nt, Mycobacterium tuberculosis H37Rv
cgauguauccgaugcga

SEQ ID NO: 1266829 - RNA, 23 nt, Mycobacterium tuberculosis H37Rv
cgaugucagcggccgcgacguug

SEQ ID NO: 1266830 - RNA, 20 nt, Mycobacterium tuberculosis H37Rv
cgaugugaaccgggcaccac

SEQ ID NO: 1266831 - RNA, 17 nt, Mycobacterium tuberculosis H37Rv
cgauggcggccaccagc

SEQ ID NO: 1266832 - RNA, 13 nt, Mycobacterium tuberculosis H37Rv
cgauggcggccac

SEQ ID NO: 1266833 - RNA, 18 nt, Mycobacterium tuberculosis H37Rv
cgauggcggccaccagcg

SEQ ID NO: 1266834 - RNA, 17 nt, Mycobacterium tuberculosis H37Rv
cgauggcugcgccgaac

SEQ ID NO: 1266835 - RNA, 15 nt, Mycobacterium tuberculosis H37Rv
cgaugggugcaccga

SEQ ID NO: 1266836 - RNA, 21 nt, Mycobacterium tuberculosis H37Rv
cgaugggugacgguggccggc

SEQ ID NO: 1266837 - RNA, 21 nt, Mycobacterium tuberculosis H37Rv
cgauggguguugcuggccgcg

SEQ ID NO: 1266838 - RNA, 22 nt, Mycobacterium tuberculosis H37Rv
cgaugcuuucguauucggccgc

SEQ ID NO: 1266839 - RNA, 20 nt, Mycobacterium tuberculosis H37Rv
cgaugcgucacaccacgacg

SEQ ID NO: 1266840 - RNA, 14 nt, Mycobacterium tuberculosis H37Rv
cgaugcgguucucg

SEQ ID NO: 1266841 - RNA, 23 nt, Mycobacterium tuberculosis H37Rv
cgaugcgguucucgagcucggcg

SEQ ID NO: 1266842 - RNA, 23 nt, Mycobacterium tuberculosis H37Rv
cgaugcuucccggaugccgaccu

SEQ ID NO: 1266843 - RNA, 16 nt, Mycobacterium tuberculosis H37Rv
cgaugcggucgacggg

SEQ ID NO: 1266844 - RNA, 14 nt, Mycobacterium tuberculosis H37Rv
cgaugcgguaucgg

SEQ ID NO: 1266845 - RNA, 22 nt, Mycobacterium tuberculosis H37Rv
cgaugcgguaucggucgacugg

SEQ ID NO: 1266846 - RNA, 14 nt, Mycobacterium tuberculosis H37Rv
cgaugcgggcgacg

SEQ ID NO: 1266847 - RNA, 15 nt, Mycobacterium tuberculosis H37Rv
cgaugcgggcgacga

SEQ ID NO: 1266848 - RNA, 13 nt, Mycobacterium tuberculosis H37Rv
cgaugcggcguug

SEQ ID NO: 1266849 - RNA, 18 nt, Mycobacterium tuberculosis H37Rv
cgauggcaagggccgacg

SEQ ID NO: 1266850 - RNA, 16 nt, Mycobacterium tuberculosis H37Rv
cgauggcgauacgcgc

SEQ ID NO: 1266851 - RNA, 13 nt, Mycobacterium tuberculosis H37Rv
cgauggcgcaccg

SEQ ID NO: 1266852 - RNA, 15 nt, Mycobacterium tuberculosis H37Rv
cgauggcgcaccggc

SEQ ID NO: 1266853 - RNA, 15 nt, Mycobacterium tuberculosis H37Rv
cgauggcaucucgau

SEQ ID NO: 1266854 - RNA, 16 nt, Mycobacterium tuberculosis H37Rv
cgauggcaucggccau

SEQ ID NO: 1266855 - RNA, 22 nt, Mycobacterium tuberculosis H37Rv
cgauggaugggcugcgcgucga

SEQ ID NO: 1266856 - RNA, 21 nt, Mycobacterium tuberculosis H37Rv
cgauggaguucucaucgccaa

SEQ ID NO: 1266857 - RNA, 19 nt, Mycobacterium tuberculosis H37Rv
cgauggaguucucaucgcc

SEQ ID NO: 1266858 - RNA, 17 nt, Mycobacterium tuberculosis H37Rv
cgcaaaggccccgguga

SEQ ID NO: 1266859 - RNA, 20 nt, Mycobacterium tuberculosis H37Rv
cgauuuugugucugcucgcc

SEQ ID NO: 1266860 - RNA, 22 nt, Mycobacterium tuberculosis H37Rv
cgauuuugcgucugcucggcgc

SEQ ID NO: 1266861 - RNA, 20 nt, Mycobacterium tuberculosis H37Rv
cgauuuugcgucugcucggc

SEQ ID NO: 1266862 - RNA, 19 nt, Mycobacterium tuberculosis H37Rv
cgauuuugcgucugcucgg

SEQ ID NO: 1266863 - RNA, 20 nt, Mycobacterium tuberculosis H37Rv
cgauuuugcgucugcucgcg

SEQ ID NO: 1266864 - RNA, 15 nt, Mycobacterium tuberculosis H37Rv
cgauuucggcgcgug

SEQ ID NO: 1266865 - RNA, 19 nt, Mycobacterium tuberculosis H37Rv
cgauuucgccugcggccca

SEQ ID NO: 1266866 - RNA, 18 nt, Mycobacterium tuberculosis H37Rv
cgauuuccucugggcugu

SEQ ID NO: 1266867 - RNA, 13 nt, Mycobacterium tuberculosis H37Rv
cgcaacgcgucgg

SEQ ID NO: 1266868 - RNA, 13 nt, Mycobacterium tuberculosis H37Rv
cgcaacgcuucgg

SEQ ID NO: 1266869 - RNA, 15 nt, Mycobacterium tuberculosis H37Rv
cgcaacgcaucgaug

SEQ ID NO: 1266870 - RNA, 16 nt, Mycobacterium tuberculosis H37Rv
cgcaacaaccgguugg

SEQ ID NO: 1266871 - RNA, 17 nt, Mycobacterium tuberculosis H37Rv
cgcaacacugaguucgg

SEQ ID NO: 1266872 - RNA, 19 nt, Mycobacterium tuberculosis H37Rv
cgauuagcaaaccgaccgu

SEQ ID NO: 1266873 - RNA, 20 nt, Mycobacterium tuberculosis H37Rv
cgauucagcgccccaugcaa

SEQ ID NO: 1266874 - RNA, 17 nt, Mycobacterium tuberculosis H37Rv
cgaugucaacgcccagc

SEQ ID NO: 1266875 - RNA, 17 nt, Mycobacterium tuberculosis H37Rv
cgauucgugucggugcg

SEQ ID NO: 1266876 - RNA, 18 nt, Mycobacterium tuberculosis H37Rv
cgauucgucgcggaucag

SEQ ID NO: 1266877 - RNA, 20 nt, Mycobacterium tuberculosis H37Rv
cgauucugcgucugcucggc

SEQ ID NO: 1266878 - RNA, 20 nt, Mycobacterium tuberculosis H37Rv
cgauucugcgucugcucgcg

SEQ ID NO: 1266879 - RNA, 19 nt, Mycobacterium tuberculosis H37Rv
cgauucugcgucugcucgc

SEQ ID NO: 1266880 - RNA, 16 nt, Mycobacterium tuberculosis H37Rv
cgauucugcgucugcu

SEQ ID NO: 1266881 - RNA, 20 nt, Mycobacterium tuberculosis H37Rv
cgauucugugucugcucgcg

SEQ ID NO: 1266882 - RNA, 17 nt, Mycobacterium tuberculosis H37Rv
cgauugaacucugguga

SEQ ID NO: 1266883 - RNA, 14 nt, Mycobacterium tuberculosis H37Rv
cgauuucgaucaca

SEQ ID NO: 1266884 - RNA, 12 nt, Mycobacterium tuberculosis H37Rv
cgauuucgccgg

SEQ ID NO: 1266885 - RNA, 14 nt, Mycobacterium tuberculosis H37Rv
cgauuuccaugcug

SEQ ID NO: 1266886 - RNA, 20 nt, Mycobacterium tuberculosis H37Rv
cgauucugugucugcucggc

SEQ ID NO: 1266887 - RNA, 19 nt, Mycobacterium tuberculosis H37Rv
cgauugcagcuucggccag

SEQ ID NO: 1266888 - RNA, 23 nt, Mycobacterium tuberculosis H37Rv
ccuggcggaacagcuucgcgcag

SEQ ID NO: 1266889 - RNA, 21 nt, Mycobacterium tuberculosis H37Rv
ccuggcgugucgccgccacca

SEQ ID NO: 1266890 - RNA, 18 nt, Mycobacterium tuberculosis H37Rv
ccugccgaugacgauggc

SEQ ID NO: 1266891 - RNA, 13 nt, Mycobacterium tuberculosis H37Rv
ccugccgaucggg

SEQ ID NO: 1266892 - RNA, 14 nt, Mycobacterium tuberculosis H37Rv
ccugccggaccacc

SEQ ID NO: 1266893 - RNA, 15 nt, Mycobacterium tuberculosis H37Rv
ccugccggaccaccg

SEQ ID NO: 1266894 - RNA, 14 nt, Mycobacterium tuberculosis H37Rv
ccuggucaaccgcg

SEQ ID NO: 1266895 - RNA, 20 nt, Mycobacterium tuberculosis H37Rv
ccugguaaggccggccggug

SEQ ID NO: 1266896 - RNA, 16 nt, Mycobacterium tuberculosis H37Rv
ccuggggccguccggc

SEQ ID NO: 1266897 - RNA, 13 nt, Mycobacterium tuberculosis H37Rv
ccuggggccacca

SEQ ID NO: 1266898 - RNA, 19 nt, Mycobacterium tuberculosis H37Rv
ccugggguagccaucggcu

SEQ ID NO: 1266899 - RNA, 18 nt, Mycobacterium tuberculosis H37Rv
ccuggguauccaccgcga

SEQ ID NO: 1266900 - RNA, 20 nt, Mycobacterium tuberculosis H37Rv
ccugguuguccguaucgggc

SEQ ID NO: 1266901 - RNA, 19 nt, Mycobacterium tuberculosis H37Rv
ccuguacgagcagaucgcg

SEQ ID NO: 1266902 - RNA, 17 nt, Mycobacterium tuberculosis H37Rv
ccugguguagccgagca

SEQ ID NO: 1266903 - RNA, 19 nt, Mycobacterium tuberculosis H37Rv
ccugguucgacucaugccg

SEQ ID NO: 1266904 - RNA, 20 nt, Mycobacterium tuberculosis H37Rv
ccuggucuuguugcgcagcg

SEQ ID NO: 1266905 - RNA, 15 nt, Mycobacterium tuberculosis H37Rv
ccugguugcugacga

SEQ ID NO: 1266906 - RNA, 13 nt, Mycobacterium tuberculosis H37Rv
ccuggucggccag

SEQ ID NO: 1266907 - RNA, 20 nt, Mycobacterium tuberculosis H37Rv
ccuggugagauugguggccc

SEQ ID NO: 1266908 - RNA, 18 nt, Mycobacterium tuberculosis H37Rv
ccugguccaaucgcgaca

SEQ ID NO: 1266909 - RNA, 20 nt, Mycobacterium tuberculosis H37Rv
ccuggucaagucccucggcg

SEQ ID NO: 1266910 - RNA, 19 nt, Mycobacterium tuberculosis H37Rv
ccuggucaccagccaccgc

SEQ ID NO: 1266911 - RNA, 21 nt, Mycobacterium tuberculosis H37Rv
ccuggucacgccggcggaauc

SEQ ID NO: 1266912 - RNA, 16 nt, Mycobacterium tuberculosis H37Rv
cgaaaucgcacagcgc

SEQ ID NO: 1266913 - RNA, 22 nt, Mycobacterium tuberculosis H37Rv
cgaaauccccugcgcugcagcu

SEQ ID NO: 1266914 - RNA, 18 nt, Mycobacterium tuberculosis H37Rv
cgaaacaucucggcgcag

SEQ ID NO: 1266915 - RNA, 14 nt, Mycobacterium tuberculosis H37Rv
cgaaaagccuugac

SEQ ID NO: 1266916 - RNA, 19 nt, Mycobacterium tuberculosis H37Rv
cgaaaagccuugacccaug

SEQ ID NO: 1266917 - RNA, 11 nt, Mycobacterium tuberculosis H37Rv
ccuuggcagcc

SEQ ID NO: 1266918 - RNA, 20 nt, Mycobacterium tuberculosis H37Rv
ccuuguuguccuucagccag

SEQ ID NO: 1266919 - RNA, 21 nt, Mycobacterium tuberculosis H37Rv
ccuuguugugguggagcggcg

SEQ ID NO: 1266920 - RNA, 15 nt, Mycobacterium tuberculosis H37Rv
ccuugcgggccuggu

SEQ ID NO: 1266921 - RNA, 21 nt, Mycobacterium tuberculosis H37Rv
cgaaaacgacaucaccaccgc

SEQ ID NO: 1266922 - RNA, 18 nt, Mycobacterium tuberculosis H37Rv
cgaaaagccguucgcguc

SEQ ID NO: 1266923 - RNA, 15 nt, Mycobacterium tuberculosis H37Rv
ccuucguagaaggac

SEQ ID NO: 1266924 - RNA, 16 nt, Mycobacterium tuberculosis H37Rv
ccuucgccggcgccag

SEQ ID NO: 1266925 - RNA, 17 nt, Mycobacterium tuberculosis H37Rv
ccuucgggugugacgcg

SEQ ID NO: 1266926 - RNA, 19 nt, Mycobacterium tuberculosis H37Rv
ccuugacggugagaucggg

SEQ ID NO: 1266927 - RNA, 16 nt, Mycobacterium tuberculosis H37Rv
ccuugacgcggccaca

SEQ ID NO: 1266928 - RNA, 13 nt, Mycobacterium tuberculosis H37Rv
ccuugaccgcggu

SEQ ID NO: 1266929 - RNA, 19 nt, Mycobacterium tuberculosis H37Rv
ccuugaggucaucgggcag

SEQ ID NO: 1266930 - RNA, 21 nt, Mycobacterium tuberculosis H37Rv
ccuugaggauccgcaccacgc

SEQ ID NO: 1266931 - RNA, 15 nt, Mycobacterium tuberculosis H37Rv
ccuugauguccgcga

SEQ ID NO: 1266932 - RNA, 14 nt, Mycobacterium tuberculosis H37Rv
ccuugaucggcgag

SEQ ID NO: 1266933 - RNA, 18 nt, Mycobacterium tuberculosis H37Rv
ccuugcccacggcgacca

SEQ ID NO: 1266934 - RNA, 13 nt, Mycobacterium tuberculosis H37Rv
cgaacucaccgcc

SEQ ID NO: 1266935 - RNA, 18 nt, Mycobacterium tuberculosis H37Rv
cgaacucaugcccgacga

SEQ ID NO: 1266936 - RNA, 15 nt, Mycobacterium tuberculosis H37Rv
cgaacgucucggcca

SEQ ID NO: 1266937 - RNA, 16 nt, Mycobacterium tuberculosis H37Rv
cgaacgugcgguggcu

SEQ ID NO: 1266938 - RNA, 17 nt, Mycobacterium tuberculosis H37Rv
cgaacucgcgccgagcc

SEQ ID NO: 1266939 - RNA, 23 nt, Mycobacterium tuberculosis H37Rv
cgaacucgcgccgagccagcacc

SEQ ID NO: 1266940 - RNA, 21 nt, Mycobacterium tuberculosis H37Rv
cgaacuccuuaucgucgacgc

SEQ ID NO: 1266941 - RNA, 21 nt, Mycobacterium tuberculosis H37Rv
cgaacucaucuuugacaccgg

SEQ ID NO: 1266942 - RNA, 14 nt, Mycobacterium tuberculosis H37Rv
cgaacgucaaccgg

SEQ ID NO: 1266943 - RNA, 15 nt, Mycobacterium tuberculosis H37Rv
cgaacgucaccaucg

SEQ ID NO: 1266944 - RNA, 19 nt, Mycobacterium tuberculosis H37Rv
cgaacgguagcacggucug

SEQ ID NO: 1266945 - RNA, 20 nt, Mycobacterium tuberculosis H37Rv
cgaacggcaccagaucuucg

SEQ ID NO: 1266946 - RNA, 17 nt, Mycobacterium tuberculosis H37Rv
cgaacgcuuccagcgug

SEQ ID NO: 1266947 - RNA, 16 nt, Mycobacterium tuberculosis H37Rv
cgaacggaucucggug

SEQ ID NO: 1266948 - RNA, 15 nt, Mycobacterium tuberculosis H37Rv
cgaacggauucccgc

SEQ ID NO: 1266949 - RNA, 18 nt, Mycobacterium tuberculosis H37Rv
cgaacggacccggcgcga

SEQ ID NO: 1266950 - RNA, 18 nt, Mycobacterium tuberculosis H37Rv
cgaaccuugguugccaac

SEQ ID NO: 1266951 - RNA, 16 nt, Mycobacterium tuberculosis H37Rv
cgaacgaagucgacga

SEQ ID NO: 1266952 - RNA, 14 nt, Mycobacterium tuberculosis H37Rv
cgaacgcuccaggc

SEQ ID NO: 1266953 - RNA, 23 nt, Mycobacterium tuberculosis H37Rv
cgaacgcguccagcgcggccuug

SEQ ID NO: 1266954 - RNA, 13 nt, Mycobacterium tuberculosis H37Rv
cgaaccucggcgg

SEQ ID NO: 1266955 - RNA, 17 nt, Mycobacterium tuberculosis H37Rv
cgaaccgucucggcgac

SEQ ID NO: 1266956 - RNA, 20 nt, Mycobacterium tuberculosis H37Rv
cgaaccguucgcucagggug

SEQ ID NO: 1266957 - RNA, 16 nt, Mycobacterium tuberculosis H37Rv
cgaaccguucggcgac

SEQ ID NO: 1266958 - RNA, 17 nt, Mycobacterium tuberculosis H37Rv
cgaaccgguugccguug

SEQ ID NO: 1266959 - RNA, 18 nt, Mycobacterium tuberculosis H37Rv
cgaaccggccgucgacgc

SEQ ID NO: 1266960 - RNA, 16 nt, Mycobacterium tuberculosis H37Rv
cgaaccggaucaucgc

SEQ ID NO: 1266961 - RNA, 15 nt, Mycobacterium tuberculosis H37Rv
cgaaccggcaccagc

SEQ ID NO: 1266962 - RNA, 13 nt, Mycobacterium tuberculosis H37Rv
cgaacaccagcgc

SEQ ID NO: 1266963 - RNA, 16 nt, Mycobacterium tuberculosis H37Rv
cgaacaccacaccgag

SEQ ID NO: 1266964 - RNA, 22 nt, Mycobacterium tuberculosis H37Rv
cgaaauguuggccguaccggug

SEQ ID NO: 1266965 - RNA, 24 nt, Mycobacterium tuberculosis H37Rv
cgaaaucggcggcguccagcagcg

SEQ ID NO: 1266966 - RNA, 15 nt, Mycobacterium tuberculosis H37Rv
cgaacaaccgguccu

SEQ ID NO: 1266967 - RNA, 24 nt, Mycobacterium tuberculosis H37Rv
cgaacaauaaggccgcacgggcga

SEQ ID NO: 1266968 - RNA, 19 nt, Mycobacterium tuberculosis H37Rv
cgaagaacgacgccaccgc

SEQ ID NO: 1266969 - RNA, 16 nt, Mycobacterium tuberculosis H37Rv
cgaagaauaugccgau

SEQ ID NO: 1266970 - RNA, 15 nt, Mycobacterium tuberculosis H37Rv
cgaagaaccggucgc

SEQ ID NO: 1266971 - RNA, 18 nt, Mycobacterium tuberculosis H37Rv
cgaagaaccggucgcagu

SEQ ID NO: 1266972 - RNA, 16 nt, Mycobacterium tuberculosis H37Rv
cgaacucggcgaugaa

SEQ ID NO: 1266973 - RNA, 18 nt, Mycobacterium tuberculosis H37Rv
cgaacucgcgggcgacca

SEQ ID NO: 1266974 - RNA, 23 nt, Mycobacterium tuberculosis H37Rv
cgaagccccucaccucggcuuug

SEQ ID NO: 1266975 - RNA, 17 nt, Mycobacterium tuberculosis H37Rv
cgaagcccccgacguug

SEQ ID NO: 1266976 - RNA, 15 nt, Mycobacterium tuberculosis H37Rv
cgaacucgaggucaa

SEQ ID NO: 1266977 - RNA, 22 nt, Mycobacterium tuberculosis H37Rv
cgaagccucggcaugcagcccc

SEQ ID NO: 1266978 - RNA, 14 nt, Mycobacterium tuberculosis H37Rv
cgaagcuugacguu

SEQ ID NO: 1266979 - RNA, 19 nt, Mycobacterium tuberculosis H37Rv
cgaagcucaucgccgcuac

SEQ ID NO: 1266980 - RNA, 21 nt, Mycobacterium tuberculosis H37Rv
cgaagcuacgucggcucgucg

SEQ ID NO: 1266981 - RNA, 18 nt, Mycobacterium tuberculosis H37Rv
cgaagcucaucgccgcua

SEQ ID NO: 1266982 - RNA, 19 nt, Mycobacterium tuberculosis H37Rv
cgaagcugcccaaccgguc

SEQ ID NO: 1266983 - RNA, 20 nt, Mycobacterium tuberculosis H37Rv
cgaagcugcgggucagcgcc

SEQ ID NO: 1266984 - RNA, 15 nt, Mycobacterium tuberculosis H37Rv
cgaagcggccaccgc

SEQ ID NO: 1266985 - RNA, 15 nt, Mycobacterium tuberculosis H37Rv
cgaagcgggcccgca

SEQ ID NO: 1266986 - RNA, 23 nt, Mycobacterium tuberculosis H37Rv
cgaagcgggcuugagcgccgaug

SEQ ID NO: 1266987 - RNA, 16 nt, Mycobacterium tuberculosis H37Rv
cgaagcggcugcugcg

SEQ ID NO: 1266988 - RNA, 15 nt, Mycobacterium tuberculosis H37Rv
cgacaucauggugaa

SEQ ID NO: 1266989 - RNA, 14 nt, Mycobacterium tuberculosis H37Rv
cgacaucgcugcga

SEQ ID NO: 1266990 - RNA, 18 nt, Mycobacterium tuberculosis H37Rv
cgacaucaccaccgcacg

SEQ ID NO: 1266991 - RNA, 15 nt, Mycobacterium tuberculosis H37Rv
cgacaucaccaccga

SEQ ID NO: 1266992 - RNA, 13 nt, Mycobacterium tuberculosis H37Rv
cgacaggucgccc

SEQ ID NO: 1266993 - RNA, 13 nt, Mycobacterium tuberculosis H37Rv
cgacagccaccgc

SEQ ID NO: 1266994 - RNA, 23 nt, Mycobacterium tuberculosis H37Rv
cgacagggaauucccaugcugcg

SEQ ID NO: 1266995 - RNA, 20 nt, Mycobacterium tuberculosis H37Rv
cgacagcacccggccaccgg

SEQ ID NO: 1266996 - RNA, 21 nt, Mycobacterium tuberculosis H37Rv
cgacagauggucacccacguu

SEQ ID NO: 1266997 - RNA, 19 nt, Mycobacterium tuberculosis H37Rv
cgacagauggucggucgcu

SEQ ID NO: 1266998 - RNA, 20 nt, Mycobacterium tuberculosis H37Rv
cgacacguuucacguggucg

SEQ ID NO: 1266999 - RNA, 19 nt, Mycobacterium tuberculosis H37Rv
cgacacggugcugccguug

SEQ ID NO: 1267000 - RNA, 18 nt, Mycobacterium tuberculosis H37Rv
cgacacggugcugccguu

SEQ ID NO: 1267001 - RNA, 12 nt, Mycobacterium tuberculosis H37Rv
cgacacggugcu

SEQ ID NO: 1267002 - RNA, 20 nt, Mycobacterium tuberculosis H37Rv
cgacaccaccagguccaccc

SEQ ID NO: 1267003 - RNA, 21 nt, Mycobacterium tuberculosis H37Rv
cgacacauagugcggcaccgc

SEQ ID NO: 1267004 - RNA, 13 nt, Mycobacterium tuberculosis H37Rv
cgacacacgccgc

SEQ ID NO: 1267005 - RNA, 21 nt, Mycobacterium tuberculosis H37Rv
cgacaagcugucggcgaccga

SEQ ID NO: 1267006 - RNA, 14 nt, Mycobacterium tuberculosis H37Rv
cgacaagaccggcg

SEQ ID NO: 1267007 - RNA, 20 nt, Mycobacterium tuberculosis H37Rv
cgacaacuucgccggacccc

SEQ ID NO: 1267008 - RNA, 14 nt, Mycobacterium tuberculosis H37Rv
cgaauugcguucgc

SEQ ID NO: 1267009 - RNA, 21 nt, Mycobacterium tuberculosis H37Rv
cgaauguugcgaucugcggcg

SEQ ID NO: 1267010 - RNA, 17 nt, Mycobacterium tuberculosis H37Rv
cgaauguugcgaucugc

SEQ ID NO: 1267011 - RNA, 16 nt, Mycobacterium tuberculosis H37Rv
cgaauguuucggcgau

SEQ ID NO: 1267012 - RNA, 15 nt, Mycobacterium tuberculosis H37Rv
cgaaugucugcgcag

SEQ ID NO: 1267013 - RNA, 18 nt, Mycobacterium tuberculosis H37Rv
cgaauccgacgucgacga

SEQ ID NO: 1267014 - RNA, 20 nt, Mycobacterium tuberculosis H37Rv
cgaaucccgcgaugcgcacc

SEQ ID NO: 1267015 - RNA, 17 nt, Mycobacterium tuberculosis H37Rv
cgaaucccacagcagga

SEQ ID NO: 1267016 - RNA, 14 nt, Mycobacterium tuberculosis H37Rv
cgaaucccaucggg

SEQ ID NO: 1267017 - RNA, 17 nt, Mycobacterium tuberculosis H37Rv
cgacaacugcccgauga

SEQ ID NO: 1267018 - RNA, 14 nt, Mycobacterium tuberculosis H37Rv
cgacaacagcacgu

SEQ ID NO: 1267019 - RNA, 22 nt, Mycobacterium tuberculosis H37Rv
cgacaaccgcccgccaggccgu

SEQ ID NO: 1267020 - RNA, 19 nt, Mycobacterium tuberculosis H37Rv
cgacaacgacgucgccgac

SEQ ID NO: 1267021 - RNA, 21 nt, Mycobacterium tuberculosis H37Rv
cgacaaacguguugaccgggu

SEQ ID NO: 1267022 - RNA, 17 nt, Mycobacterium tuberculosis H37Rv
cgacaaacguguugacc

SEQ ID NO: 1267023 - RNA, 12 nt, Mycobacterium tuberculosis H37Rv
cgaauuugucgg

SEQ ID NO: 1267024 - RNA, 15 nt, Mycobacterium tuberculosis H37Rv
cgacaacacgccguc

SEQ ID NO: 1267025 - RNA, 18 nt, Mycobacterium tuberculosis H37Rv
cgacaacaaacccggccu

SEQ ID NO: 1267026 - RNA, 19 nt, Mycobacterium tuberculosis H37Rv
cgaauaccacaccgugacc

SEQ ID NO: 1267027 - RNA, 18 nt, Mycobacterium tuberculosis H37Rv
cgaaggcgggggagccca

SEQ ID NO: 1267028 - RNA, 19 nt, Mycobacterium tuberculosis H37Rv
cgacgacacgccugggcga

SEQ ID NO: 1267029 - RNA, 14 nt, Mycobacterium tuberculosis H37Rv
cgacgacaccgcgc

SEQ ID NO: 1267030 - RNA, 18 nt, Mycobacterium tuberculosis H37Rv
cgacgacaacagccagcu

SEQ ID NO: 1267031 - RNA, 16 nt, Mycobacterium tuberculosis H37Rv
cgacgacaacagccag

SEQ ID NO: 1267032 - RNA, 17 nt, Mycobacterium tuberculosis H37Rv
cgacgacaaccggccag

SEQ ID NO: 1267033 - RNA, 13 nt, Mycobacterium tuberculosis H37Rv
cgacgacaaccgg

SEQ ID NO: 1267034 - RNA, 14 nt, Mycobacterium tuberculosis H37Rv
cgacgaauguccgc

SEQ ID NO: 1267035 - RNA, 16 nt, Mycobacterium tuberculosis H37Rv
cgacgaauccccgaca

SEQ ID NO: 1267036 - RNA, 16 nt, Mycobacterium tuberculosis H37Rv
cgacgaacaccagcgc

SEQ ID NO: 1267037 - RNA, 16 nt, Mycobacterium tuberculosis H37Rv
cgacgauccacggcga

SEQ ID NO: 1267038 - RNA, 20 nt, Mycobacterium tuberculosis H37Rv
cgacgagcaacgccacccga

SEQ ID NO: 1267039 - RNA, 22 nt, Mycobacterium tuberculosis H37Rv
cgacgacuggacaggucgccca

SEQ ID NO: 1267040 - RNA, 18 nt, Mycobacterium tuberculosis H37Rv
cgacgagauacggccacc

SEQ ID NO: 1267041 - RNA, 14 nt, Mycobacterium tuberculosis H37Rv
cgacgagacggcag

SEQ ID NO: 1267042 - RNA, 18 nt, Mycobacterium tuberculosis H37Rv
cgaccguccgggucacca

SEQ ID NO: 1267043 - RNA, 17 nt, Mycobacterium tuberculosis H37Rv
cgaccguccgggucacc

SEQ ID NO: 1267044 - RNA, 15 nt, Mycobacterium tuberculosis H37Rv
cgaccgucgcgcugc

SEQ ID NO: 1267045 - RNA, 12 nt, Mycobacterium tuberculosis H37Rv
cgaccgucgcgc

SEQ ID NO: 1267046 - RNA, 15 nt, Mycobacterium tuberculosis H37Rv
cgaccgucacugaug

SEQ ID NO: 1267047 - RNA, 16 nt, Mycobacterium tuberculosis H37Rv
cgaccgucacugaugg

SEQ ID NO: 1267048 - RNA, 21 nt, Mycobacterium tuberculosis H37Rv
cgaccgucacugaugggccgg

SEQ ID NO: 1267049 - RNA, 21 nt, Mycobacterium tuberculosis H37Rv
cgaccgucacaagucgacacg

SEQ ID NO: 1267050 - RNA, 13 nt, Mycobacterium tuberculosis H37Rv
cgaccgucaccgg

SEQ ID NO: 1267051 - RNA, 19 nt, Mycobacterium tuberculosis H37Rv
cgaccgguucggcguacaa

SEQ ID NO: 1267052 - RNA, 17 nt, Mycobacterium tuberculosis H37Rv
cgaccguauugaccagc

SEQ ID NO: 1267053 - RNA, 19 nt, Mycobacterium tuberculosis H37Rv
cgaccgucggcuccagguc

SEQ ID NO: 1267054 - RNA, 18 nt, Mycobacterium tuberculosis H37Rv
cgaccuggauugccacca

SEQ ID NO: 1267055 - RNA, 14 nt, Mycobacterium tuberculosis H37Rv
cgaccgugaucagc

SEQ ID NO: 1267056 - RNA, 12 nt, Mycobacterium tuberculosis H37Rv
cgaccuguccac

SEQ ID NO: 1267057 - RNA, 19 nt, Mycobacterium tuberculosis H37Rv
cgaccuguaugccgcggug

SEQ ID NO: 1267058 - RNA, 16 nt, Mycobacterium tuberculosis H37Rv
cgaccugguaugccgc

SEQ ID NO: 1267059 - RNA, 17 nt, Mycobacterium tuberculosis H37Rv
cgaccugguaugccgcc

SEQ ID NO: 1267060 - RNA, 17 nt, Mycobacterium tuberculosis H37Rv
cgacgaaaggcgcguug

SEQ ID NO: 1267061 - RNA, 13 nt, Mycobacterium tuberculosis H37Rv
cgacgccaguguu

SEQ ID NO: 1267062 - RNA, 23 nt, Mycobacterium tuberculosis H37Rv
cgacgccgacgaugacgcgcgaa

SEQ ID NO: 1267063 - RNA, 14 nt, Mycobacterium tuberculosis H37Rv
cgacgccgaucgcg

SEQ ID NO: 1267064 - RNA, 22 nt, Mycobacterium tuberculosis H37Rv
cgacgccagcugcccgacguug

SEQ ID NO: 1267065 - RNA, 23 nt, Mycobacterium tuberculosis H37Rv
cgacgccaucugcuggcugggaa

SEQ ID NO: 1267066 - RNA, 23 nt, Mycobacterium tuberculosis H37Rv
cgacgccaugucgauguccacgc

SEQ ID NO: 1267067 - RNA, 15 nt, Mycobacterium tuberculosis H37Rv
cgacgaugcgcacuc

SEQ ID NO: 1267068 - RNA, 19 nt, Mycobacterium tuberculosis H37Rv
cgacgauccacggcgaugc

SEQ ID NO: 1267069 - RNA, 17 nt, Mycobacterium tuberculosis H37Rv
cgacgaugacgcgcgaa

SEQ ID NO: 1267070 - RNA, 14 nt, Mycobacterium tuberculosis H37Rv
cgacgcgggcguug

SEQ ID NO: 1267071 - RNA, 23 nt, Mycobacterium tuberculosis H37Rv
cgacgcgggcguugacgaacacc

SEQ ID NO: 1267072 - RNA, 19 nt, Mycobacterium tuberculosis H37Rv
cgacgcguccggugcacca

SEQ ID NO: 1267073 - RNA, 14 nt, Mycobacterium tuberculosis H37Rv
cgacgcgucggcga

SEQ ID NO: 1267074 - RNA, 14 nt, Mycobacterium tuberculosis H37Rv
cgacgcucaucucg

SEQ ID NO: 1267075 - RNA, 21 nt, Mycobacterium tuberculosis H37Rv
cgacgcucgccgagcagacac

SEQ ID NO: 1267076 - RNA, 17 nt, Mycobacterium tuberculosis H37Rv
cgacgcuaccgccggag

SEQ ID NO: 1267077 - RNA, 17 nt, Mycobacterium tuberculosis H37Rv
cgacgcuaaguccccgc

SEQ ID NO: 1267078 - RNA, 17 nt, Mycobacterium tuberculosis H37Rv
cgacgcguugcucgaaa

SEQ ID NO: 1267079 - RNA, 17 nt, Mycobacterium tuberculosis H37Rv
cgacgcgucggcgacgc

SEQ ID NO: 1267080 - RNA, 16 nt, Mycobacterium tuberculosis H37Rv
cgacgcguuccucgac

SEQ ID NO: 1267081 - RNA, 18 nt, Mycobacterium tuberculosis H37Rv
cgacgcguuccucgacgu

SEQ ID NO: 1267082 - RNA, 22 nt, Mycobacterium tuberculosis H37Rv
cgacgcuaaauuuugcgccgac

SEQ ID NO: 1267083 - RNA, 13 nt, Mycobacterium tuberculosis H37Rv
cgacgcgaucugu

SEQ ID NO: 1267084 - RNA, 18 nt, Mycobacterium tuberculosis H37Rv
cgacgcgauggccgccag

SEQ ID NO: 1267085 - RNA, 19 nt, Mycobacterium tuberculosis H37Rv
cgacgcgauggccgccagu

SEQ ID NO: 1267086 - RNA, 18 nt, Mycobacterium tuberculosis H37Rv
cgacgccuugucggcgug

SEQ ID NO: 1267087 - RNA, 17 nt, Mycobacterium tuberculosis H37Rv
cgacgcgacacgccgau

SEQ ID NO: 1267088 - RNA, 18 nt, Mycobacterium tuberculosis H37Rv
cgacgcgacacacgccgc

SEQ ID NO: 1267089 - RNA, 13 nt, Mycobacterium tuberculosis H37Rv
cgacgcgacacgc

SEQ ID NO: 1267090 - RNA, 14 nt, Mycobacterium tuberculosis H37Rv
cgacgccugcggcg

SEQ ID NO: 1267091 - RNA, 20 nt, Mycobacterium tuberculosis H37Rv
cgacccuucgggcuggucgg

SEQ ID NO: 1267092 - RNA, 17 nt, Mycobacterium tuberculosis H37Rv
cgaccgaaccgucagcg

SEQ ID NO: 1267093 - RNA, 16 nt, Mycobacterium tuberculosis H37Rv
cgaccgaccuggucgg

SEQ ID NO: 1267094 - RNA, 21 nt, Mycobacterium tuberculosis H37Rv
cgacccgggucggcacgaccc

SEQ ID NO: 1267095 - RNA, 20 nt, Mycobacterium tuberculosis H37Rv
cgaccgaugaucucacccag

SEQ ID NO: 1267096 - RNA, 14 nt, Mycobacterium tuberculosis H37Rv
cgaccgcacgaucg

SEQ ID NO: 1267097 - RNA, 12 nt, Mycobacterium tuberculosis H37Rv
cgaccgacggac

SEQ ID NO: 1267098 - RNA, 18 nt, Mycobacterium tuberculosis H37Rv
cgacccuaguucagcgcc

SEQ ID NO: 1267099 - RNA, 22 nt, Mycobacterium tuberculosis H37Rv
cgacccguugaacucgaagacc

SEQ ID NO: 1267100 - RNA, 14 nt, Mycobacterium tuberculosis H37Rv
cgacccguaccagc

SEQ ID NO: 1267101 - RNA, 14 nt, Mycobacterium tuberculosis H37Rv
cgacccgggcgucc

SEQ ID NO: 1267102 - RNA, 16 nt, Mycobacterium tuberculosis H37Rv
cgacccggucgcggaa

SEQ ID NO: 1267103 - RNA, 19 nt, Mycobacterium tuberculosis H37Rv
cgacccgggaaggaaccgg

SEQ ID NO: 1267104 - RNA, 16 nt, Mycobacterium tuberculosis H37Rv
cgacccgggaaggaac

SEQ ID NO: 1267105 - RNA, 13 nt, Mycobacterium tuberculosis H37Rv
cgacccggcgcag

SEQ ID NO: 1267106 - RNA, 19 nt, Mycobacterium tuberculosis H37Rv
cgacccggcgcagcaacgc

SEQ ID NO: 1267107 - RNA, 20 nt, Mycobacterium tuberculosis H37Rv
cgacaucucggucagaugcg

SEQ ID NO: 1267108 - RNA, 12 nt, Mycobacterium tuberculosis H37Rv
cgacaucgccau

SEQ ID NO: 1267109 - RNA, 17 nt, Mycobacterium tuberculosis H37Rv
cgacccgaacugggcga

SEQ ID NO: 1267110 - RNA, 12 nt, Mycobacterium tuberculosis H37Rv
cgacaugagcgc

SEQ ID NO: 1267111 - RNA, 14 nt, Mycobacterium tuberculosis H37Rv
cgacaugaccgaca

SEQ ID NO: 1267112 - RNA, 20 nt, Mycobacterium tuberculosis H37Rv
cgacaugagcgccacgccga

SEQ ID NO: 1267113 - RNA, 15 nt, Mycobacterium tuberculosis H37Rv
cgaccccggcugcgc

SEQ ID NO: 1267114 - RNA, 22 nt, Mycobacterium tuberculosis H37Rv
cgacccgccgcgcccggcgcaa

SEQ ID NO: 1267115 - RNA, 21 nt, Mycobacterium tuberculosis H37Rv
cgacccgccgcgcccggcgcu

SEQ ID NO: 1267116 - RNA, 20 nt, Mycobacterium tuberculosis H37Rv
cgacccgcagaccgccaccg

SEQ ID NO: 1267117 - RNA, 21 nt, Mycobacterium tuberculosis H37Rv
cgacccgcuucgcccggcugc

SEQ ID NO: 1267118 - RNA, 14 nt, Mycobacterium tuberculosis H37Rv
cgacccggcccagc

SEQ ID NO: 1267119 - RNA, 21 nt, Mycobacterium tuberculosis H37Rv
cgaccggacacuccugcacac

SEQ ID NO: 1267120 - RNA, 19 nt, Mycobacterium tuberculosis H37Rv
cgaccggacacuccugcac

SEQ ID NO: 1267121 - RNA, 22 nt, Mycobacterium tuberculosis H37Rv
cgaccgcuaugaugccgccggu

SEQ ID NO: 1267122 - RNA, 15 nt, Mycobacterium tuberculosis H37Rv
cgaccgcgugcaccg

SEQ ID NO: 1267123 - RNA, 17 nt, Mycobacterium tuberculosis H37Rv
cgaccgcgugcaccgag

SEQ ID NO: 1267124 - RNA, 14 nt, Mycobacterium tuberculosis H37Rv
cgaccgcggucgcc

SEQ ID NO: 1267125 - RNA, 16 nt, Mycobacterium tuberculosis H37Rv
cgaccgcggucgcugc

SEQ ID NO: 1267126 - RNA, 14 nt, Mycobacterium tuberculosis H37Rv
cgaccggcagcgau

SEQ ID NO: 1267127 - RNA, 14 nt, Mycobacterium tuberculosis H37Rv
cgaccggcacggug

SEQ ID NO: 1267128 - RNA, 15 nt, Mycobacterium tuberculosis H37Rv
cgaccggcacggugg

SEQ ID NO: 1267129 - RNA, 19 nt, Mycobacterium tuberculosis H37Rv
cgaccggacgaucagggug

SEQ ID NO: 1267130 - RNA, 14 nt, Mycobacterium tuberculosis H37Rv
cgaccggagccgcc

SEQ ID NO: 1267131 - RNA, 19 nt, Mycobacterium tuberculosis H37Rv
cgaccggacgagcgucaga

SEQ ID NO: 1267132 - RNA, 18 nt, Mycobacterium tuberculosis H37Rv
cgaccggacgagcgucag

SEQ ID NO: 1267133 - RNA, 15 nt, Mycobacterium tuberculosis H37Rv
cgaccggacgagcgu

SEQ ID NO: 1267134 - RNA, 20 nt, Mycobacterium tuberculosis H37Rv
cgaccggcaacgcggccuug

SEQ ID NO: 1267135 - RNA, 12 nt, Mycobacterium tuberculosis H37Rv
cgaccggcaccc

SEQ ID NO: 1267136 - RNA, 19 nt, Mycobacterium tuberculosis H37Rv
cgaccgguggcgucaugcc

SEQ ID NO: 1267137 - RNA, 15 nt, Mycobacterium tuberculosis H37Rv
cgaccgguccagcca

SEQ ID NO: 1267138 - RNA, 16 nt, Mycobacterium tuberculosis H37Rv
cgaccggucagcgcgc

SEQ ID NO: 1267139 - RNA, 22 nt, Mycobacterium tuberculosis H37Rv
cgaccgguaauccguugccguu

SEQ ID NO: 1267140 - RNA, 12 nt, Mycobacterium tuberculosis H37Rv
cgaccggucagc

SEQ ID NO: 1267141 - RNA, 22 nt, Mycobacterium tuberculosis H37Rv
cgaccgguacccguagcaccac

SEQ ID NO: 1267142 - RNA, 12 nt, Mycobacterium tuberculosis H37Rv
cgaccggcggga

SEQ ID NO: 1267143 - RNA, 19 nt, Mycobacterium tuberculosis H37Rv
cgaccgggcucuggccagu

SEQ ID NO: 1267144 - RNA, 20 nt, Mycobacterium tuberculosis H37Rv
cgaccgccuccucgauagcg

SEQ ID NO: 1267145 - RNA, 16 nt, Mycobacterium tuberculosis H37Rv
cgaccgccgcgagcag

SEQ ID NO: 1267146 - RNA, 14 nt, Mycobacterium tuberculosis H37Rv
cgaccgccaccgcc

SEQ ID NO: 1267147 - RNA, 16 nt, Mycobacterium tuberculosis H37Rv
cgaccgcccgccagcg

SEQ ID NO: 1267148 - RNA, 16 nt, Mycobacterium tuberculosis H37Rv
cgaccgcccgccaacu

SEQ ID NO: 1267149 - RNA, 15 nt, Mycobacterium tuberculosis H37Rv
cgaccgcccgccagc

SEQ ID NO: 1267150 - RNA, 21 nt, Mycobacterium tuberculosis H37Rv
cgaccgcgagggccagcaagu

SEQ ID NO: 1267151 - RNA, 19 nt, Mycobacterium tuberculosis H37Rv
cgaccgcgaguaaucgacc

SEQ ID NO: 1267152 - RNA, 12 nt, Mycobacterium tuberculosis H37Rv
cgaccgccugca

SEQ ID NO: 1267153 - RNA, 20 nt, Mycobacterium tuberculosis H37Rv
cgaccgccugcaacacgcga

SEQ ID NO: 1267154 - RNA, 16 nt, Mycobacterium tuberculosis H37Rv
cgaccgcgggccgacg

SEQ ID NO: 1267155 - RNA, 14 nt, Mycobacterium tuberculosis H37Rv
cgaccgcggccuug

SEQ ID NO: 1267156 - RNA, 14 nt, Mycobacterium tuberculosis H37Rv
cgaccgcgccgcau

SEQ ID NO: 1267157 - RNA, 13 nt, Mycobacterium tuberculosis H37Rv
cgaccgcgccgca

SEQ ID NO: 1267158 - RNA, 15 nt, Mycobacterium tuberculosis H37Rv
cgagaaucacgguca

SEQ ID NO: 1267159 - RNA, 14 nt, Mycobacterium tuberculosis H37Rv
cgagaccgccgcug

SEQ ID NO: 1267160 - RNA, 19 nt, Mycobacterium tuberculosis H37Rv
cgagaccgccgcugccgcc

SEQ ID NO: 1267161 - RNA, 23 nt, Mycobacterium tuberculosis H37Rv
cgagacgcacggccaccgcgcaa

SEQ ID NO: 1267162 - RNA, 16 nt, Mycobacterium tuberculosis H37Rv
cgagacgcacggccac

SEQ ID NO: 1267163 - RNA, 14 nt, Mycobacterium tuberculosis H37Rv
cgagacggcgucgg

SEQ ID NO: 1267164 - RNA, 22 nt, Mycobacterium tuberculosis H37Rv
cgagaucaccgccaccaccagg

SEQ ID NO: 1267165 - RNA, 17 nt, Mycobacterium tuberculosis H37Rv
cgagaucaccgccacca

SEQ ID NO: 1267166 - RNA, 13 nt, Mycobacterium tuberculosis H37Rv
cgagaucaccggu

SEQ ID NO: 1267167 - RNA, 18 nt, Mycobacterium tuberculosis H37Rv
cgagauacggccaccagg

SEQ ID NO: 1267168 - RNA, 16 nt, Mycobacterium tuberculosis H37Rv
cgagcacaagauccgc

SEQ ID NO: 1267169 - RNA, 18 nt, Mycobacterium tuberculosis H37Rv
cgagaucagucugggcga

SEQ ID NO: 1267170 - RNA, 17 nt, Mycobacterium tuberculosis H37Rv
cgagcacaugcucgacg

SEQ ID NO: 1267171 - RNA, 15 nt, Mycobacterium tuberculosis H37Rv
cgagcacaugcugcc

SEQ ID NO: 1267172 - RNA, 18 nt, Mycobacterium tuberculosis H37Rv
cgagcacaugcugccgcu

SEQ ID NO: 1267173 - RNA, 17 nt, Mycobacterium tuberculosis H37Rv
cgagcagcccggcgaau

SEQ ID NO: 1267174 - RNA, 17 nt, Mycobacterium tuberculosis H37Rv
cgagcagccgaugcugc

SEQ ID NO: 1267175 - RNA, 15 nt, Mycobacterium tuberculosis H37Rv
cgagcagauggugaa

SEQ ID NO: 1267176 - RNA, 22 nt, Mycobacterium tuberculosis H37Rv
cgagcagaucgcgggcgcguug

SEQ ID NO: 1267177 - RNA, 12 nt, Mycobacterium tuberculosis H37Rv
cgagcagcaggu

SEQ ID NO: 1267178 - RNA, 19 nt, Mycobacterium tuberculosis H37Rv
cgagcagggccggcaccgc

SEQ ID NO: 1267179 - RNA, 14 nt, Mycobacterium tuberculosis H37Rv
cgagcagggugacc

SEQ ID NO: 1267180 - RNA, 15 nt, Mycobacterium tuberculosis H37Rv
cgagcaggucggcaa

SEQ ID NO: 1267181 - RNA, 15 nt, Mycobacterium tuberculosis H37Rv
cgagcagggcgucga

SEQ ID NO: 1267182 - RNA, 22 nt, Mycobacterium tuberculosis H37Rv
cgagcagagaacuccgccacca

SEQ ID NO: 1267183 - RNA, 16 nt, Mycobacterium tuberculosis H37Rv
cgagcaccggcugcgg

SEQ ID NO: 1267184 - RNA, 16 nt, Mycobacterium tuberculosis H37Rv
cgagcaccgcgguagc

SEQ ID NO: 1267185 - RNA, 18 nt, Mycobacterium tuberculosis H37Rv
cgagcaccgcaaccacgc

SEQ ID NO: 1267186 - RNA, 15 nt, Mycobacterium tuberculosis H37Rv
cgagcacccgcucca

SEQ ID NO: 1267187 - RNA, 22 nt, Mycobacterium tuberculosis H37Rv
cgagcaccgacaccggccgcga

SEQ ID NO: 1267188 - RNA, 18 nt, Mycobacterium tuberculosis H37Rv
cgagcaccgacaccggcc

SEQ ID NO: 1267189 - RNA, 15 nt, Mycobacterium tuberculosis H37Rv
cgagcaccgacaccg

SEQ ID NO: 1267190 - RNA, 15 nt, Mycobacterium tuberculosis H37Rv
cgagcaccccgacgu

SEQ ID NO: 1267191 - RNA, 19 nt, Mycobacterium tuberculosis H37Rv
cgagcggcaucggucaccg

SEQ ID NO: 1267192 - RNA, 20 nt, Mycobacterium tuberculosis H37Rv
cgagcgcgccaaucgcccag

SEQ ID NO: 1267193 - RNA, 17 nt, Mycobacterium tuberculosis H37Rv
cgagcggcaucggucac

SEQ ID NO: 1267194 - RNA, 13 nt, Mycobacterium tuberculosis H37Rv
cgagcgcuucguc

SEQ ID NO: 1267195 - RNA, 23 nt, Mycobacterium tuberculosis H37Rv
cgagcgccucaagcucgccggau

SEQ ID NO: 1267196 - RNA, 15 nt, Mycobacterium tuberculosis H37Rv
cgagcgcccgcagcg

SEQ ID NO: 1267197 - RNA, 19 nt, Mycobacterium tuberculosis H37Rv
cgagccgggguuaggcgca

SEQ ID NO: 1267198 - RNA, 14 nt, Mycobacterium tuberculosis H37Rv
cgagccgccgugga

SEQ ID NO: 1267199 - RNA, 12 nt, Mycobacterium tuberculosis H37Rv
cgagccgcucca

SEQ ID NO: 1267200 - RNA, 21 nt, Mycobacterium tuberculosis H37Rv
cgagccgcgugggccgcugca

SEQ ID NO: 1267201 - RNA, 20 nt, Mycobacterium tuberculosis H37Rv
cgagccggauucggcugcca

SEQ ID NO: 1267202 - RNA, 21 nt, Mycobacterium tuberculosis H37Rv
cgagccggaacagugccaccu

SEQ ID NO: 1267203 - RNA, 13 nt, Mycobacterium tuberculosis H37Rv
cgagccgcucgcu

SEQ ID NO: 1267204 - RNA, 21 nt, Mycobacterium tuberculosis H37Rv
cgagccacgccagcgucgacc

SEQ ID NO: 1267205 - RNA, 20 nt, Mycobacterium tuberculosis H37Rv
cgagcagugccucggcgaug

SEQ ID NO: 1267206 - RNA, 21 nt, Mycobacterium tuberculosis H37Rv
cgagcaguggaguauccggca

SEQ ID NO: 1267207 - RNA, 20 nt, Mycobacterium tuberculosis H37Rv
cgagcaguuccagcucgcgg

SEQ ID NO: 1267208 - RNA, 19 nt, Mycobacterium tuberculosis H37Rv
cgagcagguuccgcacgau

SEQ ID NO: 1267209 - RNA, 23 nt, Mycobacterium tuberculosis H37Rv
cgagcagucgcuaaagcccccga

SEQ ID NO: 1267210 - RNA, 22 nt, Mycobacterium tuberculosis H37Rv
cgagccacaugaccugauccgg

SEQ ID NO: 1267211 - RNA, 17 nt, Mycobacterium tuberculosis H37Rv
cgagccaacaagucgau

SEQ ID NO: 1267212 - RNA, 16 nt, Mycobacterium tuberculosis H37Rv
cgagccaucgucgagc

SEQ ID NO: 1267213 - RNA, 18 nt, Mycobacterium tuberculosis H37Rv
cgacguagacgacgucgg

SEQ ID NO: 1267214 - RNA, 21 nt, Mycobacterium tuberculosis H37Rv
cgacguacgaguagugcggug

SEQ ID NO: 1267215 - RNA, 16 nt, Mycobacterium tuberculosis H37Rv
cgacgucgaccacugc

SEQ ID NO: 1267216 - RNA, 13 nt, Mycobacterium tuberculosis H37Rv
cgacgucgcccau

SEQ ID NO: 1267217 - RNA, 12 nt, Mycobacterium tuberculosis H37Rv
cgacgucgccaa

SEQ ID NO: 1267218 - RNA, 19 nt, Mycobacterium tuberculosis H37Rv
cgacgucgauuucggcgac

SEQ ID NO: 1267219 - RNA, 14 nt, Mycobacterium tuberculosis H37Rv
cgacgucgauuucg

SEQ ID NO: 1267220 - RNA, 23 nt, Mycobacterium tuberculosis H37Rv
cgacgucgagcgccuugucgauc

SEQ ID NO: 1267221 - RNA, 14 nt, Mycobacterium tuberculosis H37Rv
cgacguugaucgcc

SEQ ID NO: 1267222 - RNA, 15 nt, Mycobacterium tuberculosis H37Rv
cgacguugaucgcca

SEQ ID NO: 1267223 - RNA, 13 nt, Mycobacterium tuberculosis H37Rv
cgacguucggugg

SEQ ID NO: 1267224 - RNA, 22 nt, Mycobacterium tuberculosis H37Rv
cgacguugaucgccaugguguc

SEQ ID NO: 1267225 - RNA, 17 nt, Mycobacterium tuberculosis H37Rv
cgacguugaugaccugu

SEQ ID NO: 1267226 - RNA, 15 nt, Mycobacterium tuberculosis H37Rv
cgacgugauggugac

SEQ ID NO: 1267227 - RNA, 23 nt, Mycobacterium tuberculosis H37Rv
cgacgugauggugacuucggugg

SEQ ID NO: 1267228 - RNA, 20 nt, Mycobacterium tuberculosis H37Rv
cgacgucucgcaugcucacg

SEQ ID NO: 1267229 - RNA, 21 nt, Mycobacterium tuberculosis H37Rv
cgacgucugcccaguguccgg

SEQ ID NO: 1267230 - RNA, 17 nt, Mycobacterium tuberculosis H37Rv
cgacgcucgcugcagca

SEQ ID NO: 1267231 - RNA, 17 nt, Mycobacterium tuberculosis H37Rv
cgacggcucuaccgguc

SEQ ID NO: 1267232 - RNA, 16 nt, Mycobacterium tuberculosis H37Rv
cgacgggaaccucgac

SEQ ID NO: 1267233 - RNA, 14 nt, Mycobacterium tuberculosis H37Rv
cgacgggaaccagc

SEQ ID NO: 1267234 - RNA, 20 nt, Mycobacterium tuberculosis H37Rv
cgacgggaaccagcggucgg

SEQ ID NO: 1267235 - RNA, 15 nt, Mycobacterium tuberculosis H37Rv
cgacggggcggucgg

SEQ ID NO: 1267236 - RNA, 17 nt, Mycobacterium tuberculosis H37Rv
cgacgggucggcgccga

SEQ ID NO: 1267237 - RNA, 17 nt, Mycobacterium tuberculosis H37Rv
cgacgggucguucuccg

SEQ ID NO: 1267238 - RNA, 20 nt, Mycobacterium tuberculosis H37Rv
cgacggucaccggcgcaccg

SEQ ID NO: 1267239 - RNA, 19 nt, Mycobacterium tuberculosis H37Rv
cgacggucagauggccacc

SEQ ID NO: 1267240 - RNA, 16 nt, Mycobacterium tuberculosis H37Rv
cgacgguuugcaccgc

SEQ ID NO: 1267241 - RNA, 17 nt, Mycobacterium tuberculosis H37Rv
cgacguaccaggguguc

SEQ ID NO: 1267242 - RNA, 16 nt, Mycobacterium tuberculosis H37Rv
cgagaagacaccgcgc

SEQ ID NO: 1267243 - RNA, 13 nt, Mycobacterium tuberculosis H37Rv
cgagaagaucucg

SEQ ID NO: 1267244 - RNA, 17 nt, Mycobacterium tuberculosis H37Rv
cgacuuguugggcgcga

SEQ ID NO: 1267245 - RNA, 17 nt, Mycobacterium tuberculosis H37Rv
cgacuugugacggucgu

SEQ ID NO: 1267246 - RNA, 14 nt, Mycobacterium tuberculosis H37Rv
cgagaacgcccgag

SEQ ID NO: 1267247 - RNA, 19 nt, Mycobacterium tuberculosis H37Rv
cgacuugcggugcucacca

SEQ ID NO: 1267248 - RNA, 13 nt, Mycobacterium tuberculosis H37Rv
cgacuugcuggcg

SEQ ID NO: 1267249 - RNA, 14 nt, Mycobacterium tuberculosis H37Rv
cgacuuggcaucgc

SEQ ID NO: 1267250 - RNA, 15 nt, Mycobacterium tuberculosis H37Rv
cgacuuggcaucgcg

SEQ ID NO: 1267251 - RNA, 18 nt, Mycobacterium tuberculosis H37Rv
cgacuuggugacaccgag

SEQ ID NO: 1267252 - RNA, 17 nt, Mycobacterium tuberculosis H37Rv
cgacuuggugacaccga

SEQ ID NO: 1267253 - RNA, 17 nt, Mycobacterium tuberculosis H37Rv
cgacuuguacgcaucgc

SEQ ID NO: 1267254 - RNA, 12 nt, Mycobacterium tuberculosis H37Rv
cgacuucgaugg

SEQ ID NO: 1267255 - RNA, 13 nt, Mycobacterium tuberculosis H37Rv
cgacuucggcguc

SEQ ID NO: 1267256 - RNA, 23 nt, Mycobacterium tuberculosis H37Rv
cgacuguacaccgacacgccguu

SEQ ID NO: 1267257 - RNA, 20 nt, Mycobacterium tuberculosis H37Rv
cgacuggccguuucggcgcc

SEQ ID NO: 1267258 - RNA, 15 nt, Mycobacterium tuberculosis H37Rv
cgacuggcgcccagc

SEQ ID NO: 1267259 - RNA, 14 nt, Mycobacterium tuberculosis H37Rv
cgacugugcgccgc

SEQ ID NO: 1267260 - RNA, 20 nt, Mycobacterium tuberculosis H37Rv
cgacugcguuccgaucggca

SEQ ID NO: 1267261 - RNA, 21 nt, Mycobacterium tuberculosis H37Rv
cgacuggccccgccagcggca

SEQ ID NO: 1267262 - RNA, 21 nt, Mycobacterium tuberculosis H37Rv
cgacucacccacccgcaccgc

SEQ ID NO: 1267263 - RNA, 14 nt, Mycobacterium tuberculosis H37Rv
cgacuagacgccgc

SEQ ID NO: 1267264 - RNA, 12 nt, Mycobacterium tuberculosis H37Rv
cgacuacggccu

SEQ ID NO: 1267265 - RNA, 16 nt, Mycobacterium tuberculosis H37Rv
cgacuccagcaccagc

SEQ ID NO: 1267266 - RNA, 17 nt, Mycobacterium tuberculosis H37Rv
cgacucagcccggcacu

SEQ ID NO: 1267267 - RNA, 18 nt, Mycobacterium tuberculosis H37Rv
cgacuccaccccacccag

SEQ ID NO: 1267268 - RNA, 19 nt, Mycobacterium tuberculosis H37Rv
cgacuaacggugcgguugc

SEQ ID NO: 1267269 - RNA, 22 nt, Mycobacterium tuberculosis H37Rv
cgacuaucggccgccggaucag

SEQ ID NO: 1267270 - RNA, 15 nt, Mycobacterium tuberculosis H37Rv
cacgcgcaacucgcc

SEQ ID NO: 1267271 - RNA, 16 nt, Mycobacterium tuberculosis H37Rv
cacgcgaccaccgccg

SEQ ID NO: 1267272 - RNA, 16 nt, Mycobacterium tuberculosis H37Rv
cacgcgaggcgaagcg

SEQ ID NO: 1267273 - RNA, 15 nt, Mycobacterium tuberculosis H37Rv
cacgcgcggcgucgu

SEQ ID NO: 1267274 - RNA, 18 nt, Mycobacterium tuberculosis H37Rv
cacggcaccaccaagcuc

SEQ ID NO: 1267275 - RNA, 12 nt, Mycobacterium tuberculosis H37Rv
cacggcaccacc

SEQ ID NO: 1267276 - RNA, 23 nt, Mycobacterium tuberculosis H37Rv
cacgcgcgcgaccucgcuggccg

SEQ ID NO: 1267277 - RNA, 21 nt, Mycobacterium tuberculosis H37Rv
cacggagaccggccgggugaa

SEQ ID NO: 1267278 - RNA, 22 nt, Mycobacterium tuberculosis H37Rv
cacggagcccgacucuccggca

SEQ ID NO: 1267279 - RNA, 16 nt, Mycobacterium tuberculosis H37Rv
cacggauucgggcgaa

SEQ ID NO: 1267280 - RNA, 14 nt, Mycobacterium tuberculosis H37Rv
cacggaugcgaugg

SEQ ID NO: 1267281 - RNA, 14 nt, Mycobacterium tuberculosis H37Rv
cacggcggcggcgu

SEQ ID NO: 1267282 - RNA, 20 nt, Mycobacterium tuberculosis H37Rv
cacggcgguugccccgaccg

SEQ ID NO: 1267283 - RNA, 12 nt, Mycobacterium tuberculosis H37Rv
cacggcggcgaa

SEQ ID NO: 1267284 - RNA, 23 nt, Mycobacterium tuberculosis H37Rv
cacggcgccgccacggaucgcgg

SEQ ID NO: 1267285 - RNA, 14 nt, Mycobacterium tuberculosis H37Rv
cacggcgccgccac

SEQ ID NO: 1267286 - RNA, 15 nt, Mycobacterium tuberculosis H37Rv
cacggcgaucgguga

SEQ ID NO: 1267287 - RNA, 17 nt, Mycobacterium tuberculosis H37Rv
cacggccuccggaccga

SEQ ID NO: 1267288 - RNA, 19 nt, Mycobacterium tuberculosis H37Rv
cacggcuucgccgcgggac

SEQ ID NO: 1267289 - RNA, 15 nt, Mycobacterium tuberculosis H37Rv
cacgggcuaccggca

SEQ ID NO: 1267290 - RNA, 15 nt, Mycobacterium tuberculosis H37Rv
cacggguagcgucca

SEQ ID NO: 1267291 - RNA, 21 nt, Mycobacterium tuberculosis H37Rv
cacggggcuuggcgacgucgc

SEQ ID NO: 1267292 - RNA, 15 nt, Mycobacterium tuberculosis H37Rv
cacgggcucgcugca

SEQ ID NO: 1267293 - RNA, 17 nt, Mycobacterium tuberculosis H37Rv
cacggcgucggccaccg

SEQ ID NO: 1267294 - RNA, 11 nt, Mycobacterium tuberculosis H37Rv
cacggcgucgg

SEQ ID NO: 1267295 - RNA, 15 nt, Mycobacterium tuberculosis H37Rv
cacggcgucggccac

SEQ ID NO: 1267296 - RNA, 17 nt, Mycobacterium tuberculosis H37Rv
cacggcguggcgccgga

SEQ ID NO: 1267297 - RNA, 14 nt, Mycobacterium tuberculosis H37Rv
cacggcugaccggg

SEQ ID NO: 1267298 - RNA, 19 nt, Mycobacterium tuberculosis H37Rv
cacggugaucuucuucagg

SEQ ID NO: 1267299 - RNA, 15 nt, Mycobacterium tuberculosis H37Rv
cacggugaucagcag

SEQ ID NO: 1267300 - RNA, 13 nt, Mycobacterium tuberculosis H37Rv
cacgguggccgca

SEQ ID NO: 1267301 - RNA, 19 nt, Mycobacterium tuberculosis H37Rv
cacgguacauccagagaca

SEQ ID NO: 1267302 - RNA, 22 nt, Mycobacterium tuberculosis H37Rv
cacggguguucucgcgcgucgc

SEQ ID NO: 1267303 - RNA, 17 nt, Mycobacterium tuberculosis H37Rv
cacgggucgucaugcca

SEQ ID NO: 1267304 - RNA, 12 nt, Mycobacterium tuberculosis H37Rv
cacgucccagag

SEQ ID NO: 1267305 - RNA, 23 nt, Mycobacterium tuberculosis H37Rv
cacgucggcccauaacagcuggc

SEQ ID NO: 1267306 - RNA, 23 nt, Mycobacterium tuberculosis H37Rv
cacgucggguugcacggcgauug

SEQ ID NO: 1267307 - RNA, 15 nt, Mycobacterium tuberculosis H37Rv
cacgguguugcgcac

SEQ ID NO: 1267308 - RNA, 19 nt, Mycobacterium tuberculosis H37Rv
cacgguguugcgcacccgc

SEQ ID NO: 1267309 - RNA, 19 nt, Mycobacterium tuberculosis H37Rv
cacggugugcacggcgaau

SEQ ID NO: 1267310 - RNA, 16 nt, Mycobacterium tuberculosis H37Rv
cacgguuagacgucgu

SEQ ID NO: 1267311 - RNA, 22 nt, Mycobacterium tuberculosis H37Rv
cacguccaguggcagccagcgg

SEQ ID NO: 1267312 - RNA, 21 nt, Mycobacterium tuberculosis H37Rv
cacggugggcgccgacaccgg

SEQ ID NO: 1267313 - RNA, 22 nt, Mycobacterium tuberculosis H37Rv
cacggugguggugggaguucgc

SEQ ID NO: 1267314 - RNA, 15 nt, Mycobacterium tuberculosis H37Rv
cacggugggcgcugg

SEQ ID NO: 1267315 - RNA, 23 nt, Mycobacterium tuberculosis H37Rv
cacgguguaccagguggaccggc

SEQ ID NO: 1267316 - RNA, 17 nt, Mycobacterium tuberculosis H37Rv
cacgguggugucagcca

SEQ ID NO: 1267317 - RNA, 17 nt, Mycobacterium tuberculosis H37Rv
cacgguggccgcaucga

SEQ ID NO: 1267318 - RNA, 14 nt, Mycobacterium tuberculosis H37Rv
cacgguggccgcac

SEQ ID NO: 1267319 - RNA, 17 nt, Mycobacterium tuberculosis H37Rv
cacgguggcucuguagc

SEQ ID NO: 1267320 - RNA, 17 nt, Mycobacterium tuberculosis H37Rv
cacgugaucgacgaccg

SEQ ID NO: 1267321 - RNA, 17 nt, Mycobacterium tuberculosis H37Rv
cacuccgggcucggcgu

SEQ ID NO: 1267322 - RNA, 16 nt, Mycobacterium tuberculosis H37Rv
cacgugaucgacgacc

SEQ ID NO: 1267323 - RNA, 16 nt, Mycobacterium tuberculosis H37Rv
cacgugagugccggcg

SEQ ID NO: 1267324 - RNA, 16 nt, Mycobacterium tuberculosis H37Rv
cacgugaaggcgaugg

SEQ ID NO: 1267325 - RNA, 23 nt, Mycobacterium tuberculosis H37Rv
cacgucguugggcaugucgccga

SEQ ID NO: 1267326 - RNA, 23 nt, Mycobacterium tuberculosis H37Rv
cacgucgucgggguuguccucgg

SEQ ID NO: 1267327 - RNA, 23 nt, Mycobacterium tuberculosis H37Rv
cacgucuccuucggcgacugcgc

SEQ ID NO: 1267328 - RNA, 22 nt, Mycobacterium tuberculosis H37Rv
cacgucuccuucggcgacugcg

SEQ ID NO: 1267329 - RNA, 19 nt, Mycobacterium tuberculosis H37Rv
cacgucgucucggcggugg

SEQ ID NO: 1267330 - RNA, 21 nt, Mycobacterium tuberculosis H37Rv
cacuccugcaccaucgguauc

SEQ ID NO: 1267331 - RNA, 20 nt, Mycobacterium tuberculosis H37Rv
cacucgaugcggugcggcac

SEQ ID NO: 1267332 - RNA, 16 nt, Mycobacterium tuberculosis H37Rv
cacugaagaucgcgcc

SEQ ID NO: 1267333 - RNA, 19 nt, Mycobacterium tuberculosis H37Rv
cacugaaccgguugacacc

SEQ ID NO: 1267334 - RNA, 20 nt, Mycobacterium tuberculosis H37Rv
cacugaaucguuggcgaucg

SEQ ID NO: 1267335 - RNA, 21 nt, Mycobacterium tuberculosis H37Rv
cacugaaucguuggcgaucgc

SEQ ID NO: 1267336 - RNA, 14 nt, Mycobacterium tuberculosis H37Rv
cacugccggcagcg

SEQ ID NO: 1267337 - RNA, 23 nt, Mycobacterium tuberculosis H37Rv
cacugcccucaacgaucgcgccg

SEQ ID NO: 1267338 - RNA, 23 nt, Mycobacterium tuberculosis H37Rv
cacuggacccgcccaggcgucca

SEQ ID NO: 1267339 - RNA, 18 nt, Mycobacterium tuberculosis H37Rv
cacuggacgcuccgggaa

SEQ ID NO: 1267340 - RNA, 16 nt, Mycobacterium tuberculosis H37Rv
cacugcgccgugaccc

SEQ ID NO: 1267341 - RNA, 15 nt, Mycobacterium tuberculosis H37Rv
cacugaucaggccga

SEQ ID NO: 1267342 - RNA, 11 nt, Mycobacterium tuberculosis H37Rv
cacugagaucc

SEQ ID NO: 1267343 - RNA, 21 nt, Mycobacterium tuberculosis H37Rv
cacugaccaggucugcggugc

SEQ ID NO: 1267344 - RNA, 15 nt, Mycobacterium tuberculosis H37Rv
cacugcaucacgccg

SEQ ID NO: 1267345 - RNA, 22 nt, Mycobacterium tuberculosis H37Rv
cacugcccucaacgaucgcgcc

SEQ ID NO: 1267346 - RNA, 16 nt, Mycobacterium tuberculosis H37Rv
cagaaccuggagccgu

SEQ ID NO: 1267347 - RNA, 19 nt, Mycobacterium tuberculosis H37Rv
cagaaccggugcgguuuca

SEQ ID NO: 1267348 - RNA, 16 nt, Mycobacterium tuberculosis H37Rv
cagaaggccgcaccgc

SEQ ID NO: 1267349 - RNA, 14 nt, Mycobacterium tuberculosis H37Rv
cacuuccaagccga

SEQ ID NO: 1267350 - RNA, 20 nt, Mycobacterium tuberculosis H37Rv
cacuggauggcucgccgaaa

SEQ ID NO: 1267351 - RNA, 19 nt, Mycobacterium tuberculosis H37Rv
cacuggaagccaagcuaac

SEQ ID NO: 1267352 - RNA, 22 nt, Mycobacterium tuberculosis H37Rv
cacuggcgaaccagaguucggc

SEQ ID NO: 1267353 - RNA, 16 nt, Mycobacterium tuberculosis H37Rv
cacuggggugcugcgc

SEQ ID NO: 1267354 - RNA, 19 nt, Mycobacterium tuberculosis H37Rv
cacuggggugcugcgcgcg

SEQ ID NO: 1267355 - RNA, 23 nt, Mycobacterium tuberculosis H37Rv
cacuggucaacgggaugccggcg

SEQ ID NO: 1267356 - RNA, 16 nt, Mycobacterium tuberculosis H37Rv
cacugugcgagcugcg

SEQ ID NO: 1267357 - RNA, 20 nt, Mycobacterium tuberculosis H37Rv
cacuguuacuccgacggccc

SEQ ID NO: 1267358 - RNA, 20 nt, Mycobacterium tuberculosis H37Rv
cacugucagcgauccucgcc

SEQ ID NO: 1267359 - RNA, 21 nt, Mycobacterium tuberculosis H37Rv
cacugguugggcgagaccgcg

SEQ ID NO: 1267360 - RNA, 17 nt, Mycobacterium tuberculosis H37Rv
cacuguuggugccgcca

SEQ ID NO: 1267361 - RNA, 16 nt, Mycobacterium tuberculosis H37Rv
cacgcacagcccgaug

SEQ ID NO: 1267362 - RNA, 18 nt, Mycobacterium tuberculosis H37Rv
cacgcacaaguucuucga

SEQ ID NO: 1267363 - RNA, 23 nt, Mycobacterium tuberculosis H37Rv
cacgcacaaguucuucgacagcg

SEQ ID NO: 1267364 - RNA, 22 nt, Mycobacterium tuberculosis H37Rv
cacgaucggcugguuacucacc

SEQ ID NO: 1267365 - RNA, 16 nt, Mycobacterium tuberculosis H37Rv
cacgaucgugccggga

SEQ ID NO: 1267366 - RNA, 15 nt, Mycobacterium tuberculosis H37Rv
cacgaucgcccguga

SEQ ID NO: 1267367 - RNA, 21 nt, Mycobacterium tuberculosis H37Rv
cacgaucgccaacgacucacc

SEQ ID NO: 1267368 - RNA, 17 nt, Mycobacterium tuberculosis H37Rv
cacgagcgcauguugca

SEQ ID NO: 1267369 - RNA, 13 nt, Mycobacterium tuberculosis H37Rv
cacgagcgguacg

SEQ ID NO: 1267370 - RNA, 13 nt, Mycobacterium tuberculosis H37Rv
cacgagcguagcg

SEQ ID NO: 1267371 - RNA, 21 nt, Mycobacterium tuberculosis H37Rv
cacgaggcacaaucaccgccg

SEQ ID NO: 1267372 - RNA, 19 nt, Mycobacterium tuberculosis H37Rv
cacgaguccgcggaucacc

SEQ ID NO: 1267373 - RNA, 17 nt, Mycobacterium tuberculosis H37Rv
cacgagguugggccggu

SEQ ID NO: 1267374 - RNA, 23 nt, Mycobacterium tuberculosis H37Rv
cacgauaucgggcucagcggcga

SEQ ID NO: 1267375 - RNA, 21 nt, Mycobacterium tuberculosis H37Rv
cacgaucaacucgugcgggca

SEQ ID NO: 1267376 - RNA, 17 nt, Mycobacterium tuberculosis H37Rv
cacgaucacccgcacgu

SEQ ID NO: 1267377 - RNA, 16 nt, Mycobacterium tuberculosis H37Rv
cacgauaucgaugcgg

SEQ ID NO: 1267378 - RNA, 14 nt, Mycobacterium tuberculosis H37Rv
cacgacgccgagca

SEQ ID NO: 1267379 - RNA, 16 nt, Mycobacterium tuberculosis H37Rv
cacgacgucggugaac

SEQ ID NO: 1267380 - RNA, 21 nt, Mycobacterium tuberculosis H37Rv
cacgacuggcgcccagccgga

SEQ ID NO: 1267381 - RNA, 17 nt, Mycobacterium tuberculosis H37Rv
cacgagcaacgggcgaa

SEQ ID NO: 1267382 - RNA, 22 nt, Mycobacterium tuberculosis H37Rv
cacgcagcacccugcgggccga

SEQ ID NO: 1267383 - RNA, 12 nt, Mycobacterium tuberculosis H37Rv
cacgcacccggc

SEQ ID NO: 1267384 - RNA, 19 nt, Mycobacterium tuberculosis H37Rv
cacgcacucgucgggguug

SEQ ID NO: 1267385 - RNA, 20 nt, Mycobacterium tuberculosis H37Rv
cacgcacguagacgguguca

SEQ ID NO: 1267386 - RNA, 14 nt, Mycobacterium tuberculosis H37Rv
cacgccaaguccgc

SEQ ID NO: 1267387 - RNA, 18 nt, Mycobacterium tuberculosis H37Rv
cacgcaguucggucagcg

SEQ ID NO: 1267388 - RNA, 19 nt, Mycobacterium tuberculosis H37Rv
cacgccaccgcaacucgcc

SEQ ID NO: 1267389 - RNA, 17 nt, Mycobacterium tuberculosis H37Rv
cacgccacuucuucggg

SEQ ID NO: 1267390 - RNA, 16 nt, Mycobacterium tuberculosis H37Rv
cacgccagcgcgacca

SEQ ID NO: 1267391 - RNA, 15 nt, Mycobacterium tuberculosis H37Rv
cacgccagcucgccg

SEQ ID NO: 1267392 - RNA, 21 nt, Mycobacterium tuberculosis H37Rv
cacgcccgaagaaugggaugg

SEQ ID NO: 1267393 - RNA, 18 nt, Mycobacterium tuberculosis H37Rv
cacgccaggugaugccgc

SEQ ID NO: 1267394 - RNA, 19 nt, Mycobacterium tuberculosis H37Rv
cacgccauccacgacaucg

SEQ ID NO: 1267395 - RNA, 17 nt, Mycobacterium tuberculosis H37Rv
cacgccaucgagcagca

SEQ ID NO: 1267396 - RNA, 13 nt, Mycobacterium tuberculosis H37Rv
cacgcccgcacuc

SEQ ID NO: 1267397 - RNA, 15 nt, Mycobacterium tuberculosis H37Rv
cacgcccucgacgcg

SEQ ID NO: 1267398 - RNA, 18 nt, Mycobacterium tuberculosis H37Rv
cacgcccugaagggccgc

SEQ ID NO: 1267399 - RNA, 16 nt, Mycobacterium tuberculosis H37Rv
cacgcgaaaugccugc

SEQ ID NO: 1267400 - RNA, 12 nt, Mycobacterium tuberculosis H37Rv
cacgcgaccacc

SEQ ID NO: 1267401 - RNA, 13 nt, Mycobacterium tuberculosis H37Rv
cacgccgccggug

SEQ ID NO: 1267402 - RNA, 20 nt, Mycobacterium tuberculosis H37Rv
caccucggugaccaggccgg

SEQ ID NO: 1267403 - RNA, 13 nt, Mycobacterium tuberculosis H37Rv
caccucgucgaca

SEQ ID NO: 1267404 - RNA, 24 nt, Mycobacterium tuberculosis H37Rv
caccucgucgacaaaccacagacu

SEQ ID NO: 1267405 - RNA, 13 nt, Mycobacterium tuberculosis H37Rv
caccucgaugccg

SEQ ID NO: 1267406 - RNA, 23 nt, Mycobacterium tuberculosis H37Rv
caccucgaugccgccccgcagcu

SEQ ID NO: 1267407 - RNA, 20 nt, Mycobacterium tuberculosis H37Rv
caccucgaugcggguggcgc

SEQ ID NO: 1267408 - RNA, 21 nt, Mycobacterium tuberculosis H37Rv
caccucgauggcguccaucuc

SEQ ID NO: 1267409 - RNA, 20 nt, Mycobacterium tuberculosis H37Rv
caccucgccaacaucccaac

SEQ ID NO: 1267410 - RNA, 13 nt, Mycobacterium tuberculosis H37Rv
caccgcggcaaga

SEQ ID NO: 1267411 - RNA, 13 nt, Mycobacterium tuberculosis H37Rv
caccgcggcaugu

SEQ ID NO: 1267412 - RNA, 21 nt, Mycobacterium tuberculosis H37Rv
caccgcggccagcaccagcuc

SEQ ID NO: 1267413 - RNA, 14 nt, Mycobacterium tuberculosis H37Rv
caccucccgcagcc

SEQ ID NO: 1267414 - RNA, 15 nt, Mycobacterium tuberculosis H37Rv
caccucccgcggcac

SEQ ID NO: 1267415 - RNA, 14 nt, Mycobacterium tuberculosis H37Rv
caccuccgcgucgg

SEQ ID NO: 1267416 - RNA, 15 nt, Mycobacterium tuberculosis H37Rv
caccuccggcaccgc

SEQ ID NO: 1267417 - RNA, 22 nt, Mycobacterium tuberculosis H37Rv
caccuccgaggccgccaucgcc

SEQ ID NO: 1267418 - RNA, 18 nt, Mycobacterium tuberculosis H37Rv
caccucgaaugcauccgc

SEQ ID NO: 1267419 - RNA, 21 nt, Mycobacterium tuberculosis H37Rv
caccucgagcccgcguucagg

SEQ ID NO: 1267420 - RNA, 12 nt, Mycobacterium tuberculosis H37Rv
caccucgaugcc

SEQ ID NO: 1267421 - RNA, 20 nt, Mycobacterium tuberculosis H37Rv
caccugcagcacgacgugcg

SEQ ID NO: 1267422 - RNA, 19 nt, Mycobacterium tuberculosis H37Rv
caccugcacgugacccugg

SEQ ID NO: 1267423 - RNA, 19 nt, Mycobacterium tuberculosis H37Rv
caccugccgacucaucggc

SEQ ID NO: 1267424 - RNA, 20 nt, Mycobacterium tuberculosis H37Rv
caccugacuaccgucaucga

SEQ ID NO: 1267425 - RNA, 22 nt, Mycobacterium tuberculosis H37Rv
caccuggcuggucaggaucgca

SEQ ID NO: 1267426 - RNA, 20 nt, Mycobacterium tuberculosis H37Rv
caccuggcgcagcaacucga

SEQ ID NO: 1267427 - RNA, 19 nt, Mycobacterium tuberculosis H37Rv
caccuguuggcaugccgcc

SEQ ID NO: 1267428 - RNA, 22 nt, Mycobacterium tuberculosis H37Rv
caccuucgacguugcggacggc

SEQ ID NO: 1267429 - RNA, 19 nt, Mycobacterium tuberculosis H37Rv
caccuucgacguugcggac

SEQ ID NO: 1267430 - RNA, 16 nt, Mycobacterium tuberculosis H37Rv
caccugguccaaucgc

SEQ ID NO: 1267431 - RNA, 16 nt, Mycobacterium tuberculosis H37Rv
caccugguuuacccgc

SEQ ID NO: 1267432 - RNA, 23 nt, Mycobacterium tuberculosis H37Rv
caccuugaccgggucgaugacgc

SEQ ID NO: 1267433 - RNA, 13 nt, Mycobacterium tuberculosis H37Rv
caccuugcguccg

SEQ ID NO: 1267434 - RNA, 21 nt, Mycobacterium tuberculosis H37Rv
caccuugcccaagaucucgcg

SEQ ID NO: 1267435 - RNA, 14 nt, Mycobacterium tuberculosis H37Rv
cacgaaacccaguc

SEQ ID NO: 1267436 - RNA, 23 nt, Mycobacterium tuberculosis H37Rv
caccuuggcggucggcagaccga

SEQ ID NO: 1267437 - RNA, 15 nt, Mycobacterium tuberculosis H37Rv
cacgaccgccgauac

SEQ ID NO: 1267438 - RNA, 22 nt, Mycobacterium tuberculosis H37Rv
cacgaccccggcgguaccgccg

SEQ ID NO: 1267439 - RNA, 14 nt, Mycobacterium tuberculosis H37Rv
cacgaccgccgaua

SEQ ID NO: 1267440 - RNA, 20 nt, Mycobacterium tuberculosis H37Rv
cacgacaucguaggccggca

SEQ ID NO: 1267441 - RNA, 14 nt, Mycobacterium tuberculosis H37Rv
cacgacaacuucgc

SEQ ID NO: 1267442 - RNA, 21 nt, Mycobacterium tuberculosis H37Rv
cacgaaauugggcgauucugc

SEQ ID NO: 1267443 - RNA, 17 nt, Mycobacterium tuberculosis H37Rv
cacgaagaccgcgucgg

SEQ ID NO: 1267444 - RNA, 22 nt, Mycobacterium tuberculosis H37Rv
cacgaagcuggcgugcagcagg

SEQ ID NO: 1267445 - RNA, 14 nt, Mycobacterium tuberculosis H37Rv
cacgaagcuggcgu

SEQ ID NO: 1267446 - RNA, 12 nt, Mycobacterium tuberculosis H37Rv
cagcgacgucgc

SEQ ID NO: 1267447 - RNA, 18 nt, Mycobacterium tuberculosis H37Rv
cagcgacuccguaccggg

SEQ ID NO: 1267448 - RNA, 15 nt, Mycobacterium tuberculosis H37Rv
cagcgacgaagucgc

SEQ ID NO: 1267449 - RNA, 15 nt, Mycobacterium tuberculosis H37Rv
cagcgacgccauguc

SEQ ID NO: 1267450 - RNA, 21 nt, Mycobacterium tuberculosis H37Rv
cagcgacgcggccagcggcaa

SEQ ID NO: 1267451 - RNA, 13 nt, Mycobacterium tuberculosis H37Rv
cagcgacgcacgc

SEQ ID NO: 1267452 - RNA, 16 nt, Mycobacterium tuberculosis H37Rv
cagcgacgccaugguc

SEQ ID NO: 1267453 - RNA, 14 nt, Mycobacterium tuberculosis H37Rv
cagcgacgccaugg

SEQ ID NO: 1267454 - RNA, 10 nt, Mycobacterium tuberculosis H37Rv
cagcgaacgg

SEQ ID NO: 1267455 - RNA, 16 nt, Mycobacterium tuberculosis H37Rv
cagcgaaccgccggca

SEQ ID NO: 1267456 - RNA, 16 nt, Mycobacterium tuberculosis H37Rv
cagccuggcaaccacg

SEQ ID NO: 1267457 - RNA, 19 nt, Mycobacterium tuberculosis H37Rv
cagccuggccucgccauug

SEQ ID NO: 1267458 - RNA, 15 nt, Mycobacterium tuberculosis H37Rv
cagccugccagguac

SEQ ID NO: 1267459 - RNA, 17 nt, Mycobacterium tuberculosis H37Rv
cagccgugcccaggcca

SEQ ID NO: 1267460 - RNA, 22 nt, Mycobacterium tuberculosis H37Rv
cagccgugcggcggcugccggu

SEQ ID NO: 1267461 - RNA, 22 nt, Mycobacterium tuberculosis H37Rv
cagccgucggcgcugcgcgcga

SEQ ID NO: 1267462 - RNA, 16 nt, Mycobacterium tuberculosis H37Rv
cagccggaccguguac

SEQ ID NO: 1267463 - RNA, 15 nt, Mycobacterium tuberculosis H37Rv
cagccggcagcagcg

SEQ ID NO: 1267464 - RNA, 13 nt, Mycobacterium tuberculosis H37Rv
cagccggagucac

SEQ ID NO: 1267465 - RNA, 16 nt, Mycobacterium tuberculosis H37Rv
cagccggagucaccga

SEQ ID NO: 1267466 - RNA, 17 nt, Mycobacterium tuberculosis H37Rv
cagccggcccugcggcc

SEQ ID NO: 1267467 - RNA, 20 nt, Mycobacterium tuberculosis H37Rv
cagccggaccgcgacggcgc

SEQ ID NO: 1267468 - RNA, 14 nt, Mycobacterium tuberculosis H37Rv
cagccggaccacca

SEQ ID NO: 1267469 - RNA, 17 nt, Mycobacterium tuberculosis H37Rv
cagccggaccaccaggu

SEQ ID NO: 1267470 - RNA, 15 nt, Mycobacterium tuberculosis H37Rv
cagccgcucacccgg

SEQ ID NO: 1267471 - RNA, 17 nt, Mycobacterium tuberculosis H37Rv
cagccgcgcguccgggc

SEQ ID NO: 1267472 - RNA, 14 nt, Mycobacterium tuberculosis H37Rv
cagccgcggaucau

SEQ ID NO: 1267473 - RNA, 18 nt, Mycobacterium tuberculosis H37Rv
cagccgcgcgggucacga

SEQ ID NO: 1267474 - RNA, 20 nt, Mycobacterium tuberculosis H37Rv
cagccgcgcgguacugcgca

SEQ ID NO: 1267475 - RNA, 14 nt, Mycobacterium tuberculosis H37Rv
cagccgcgccgggu

SEQ ID NO: 1267476 - RNA, 21 nt, Mycobacterium tuberculosis H37Rv
cagccgcgccgaccucaucgg

SEQ ID NO: 1267477 - RNA, 22 nt, Mycobacterium tuberculosis H37Rv
cagccgcauaggccccgccagc

SEQ ID NO: 1267478 - RNA, 13 nt, Mycobacterium tuberculosis H37Rv
cagccgcccucgg

SEQ ID NO: 1267479 - RNA, 22 nt, Mycobacterium tuberculosis H37Rv
cagccgccgacuuccgcgucgc

SEQ ID NO: 1267480 - RNA, 14 nt, Mycobacterium tuberculosis H37Rv
cagccgccgaugau

SEQ ID NO: 1267481 - RNA, 23 nt, Mycobacterium tuberculosis H37Rv
cagccgcagccaggucuccuugg

SEQ ID NO: 1267482 - RNA, 14 nt, Mycobacterium tuberculosis H37Rv
cagccgcacgguuc

SEQ ID NO: 1267483 - RNA, 17 nt, Mycobacterium tuberculosis H37Rv
cagcccgucgggcaguu

SEQ ID NO: 1267484 - RNA, 14 nt, Mycobacterium tuberculosis H37Rv
cagcccuaucagcc

SEQ ID NO: 1267485 - RNA, 21 nt, Mycobacterium tuberculosis H37Rv
cagcccuaucagccgagacac

SEQ ID NO: 1267486 - RNA, 17 nt, Mycobacterium tuberculosis H37Rv
cagcccggcgacgaccc

SEQ ID NO: 1267487 - RNA, 21 nt, Mycobacterium tuberculosis H37Rv
cagcccggcgacgacccgggu

SEQ ID NO: 1267488 - RNA, 21 nt, Mycobacterium tuberculosis H37Rv
cagcccggcgcgccgaguugc

SEQ ID NO: 1267489 - RNA, 13 nt, Mycobacterium tuberculosis H37Rv
cagcccgucagcc

SEQ ID NO: 1267490 - RNA, 18 nt, Mycobacterium tuberculosis H37Rv
cagcccggugugcugcac

SEQ ID NO: 1267491 - RNA, 18 nt, Mycobacterium tuberculosis H37Rv
cagcccgccggauccgcc

SEQ ID NO: 1267492 - RNA, 12 nt, Mycobacterium tuberculosis H37Rv
cagcccgcccaa

SEQ ID NO: 1267493 - RNA, 13 nt, Mycobacterium tuberculosis H37Rv
cagcccgcccaau

SEQ ID NO: 1267494 - RNA, 20 nt, Mycobacterium tuberculosis H37Rv
cagcccgcccugaccgcccg

SEQ ID NO: 1267495 - RNA, 23 nt, Mycobacterium tuberculosis H37Rv
cagcccgccgggcuccacgucau

SEQ ID NO: 1267496 - RNA, 13 nt, Mycobacterium tuberculosis H37Rv
cagcccgccgucg

SEQ ID NO: 1267497 - RNA, 15 nt, Mycobacterium tuberculosis H37Rv
cagcccaugucgagc

SEQ ID NO: 1267498 - RNA, 14 nt, Mycobacterium tuberculosis H37Rv
cagcccacucgucg

SEQ ID NO: 1267499 - RNA, 13 nt, Mycobacterium tuberculosis H37Rv
cagcccagcaggu

SEQ ID NO: 1267500 - RNA, 15 nt, Mycobacterium tuberculosis H37Rv
cagcccagauccagc

SEQ ID NO: 1267501 - RNA, 16 nt, Mycobacterium tuberculosis H37Rv
cagcccaaagcgccag

SEQ ID NO: 1267502 - RNA, 16 nt, Mycobacterium tuberculosis H37Rv
cagcccacaggcggcg

SEQ ID NO: 1267503 - RNA, 12 nt, Mycobacterium tuberculosis H37Rv
cagcccaccggu

SEQ ID NO: 1267504 - RNA, 17 nt, Mycobacterium tuberculosis H37Rv
cagcccaccggugccgc

SEQ ID NO: 1267505 - RNA, 22 nt, Mycobacterium tuberculosis H37Rv
cagccauguccgcaguucgguc

SEQ ID NO: 1267506 - RNA, 17 nt, Mycobacterium tuberculosis H37Rv
cagccaugcucgucuug

SEQ ID NO: 1267507 - RNA, 17 nt, Mycobacterium tuberculosis H37Rv
cagccaggcacguccga

SEQ ID NO: 1267508 - RNA, 14 nt, Mycobacterium tuberculosis H37Rv
cagccaggagccga

SEQ ID NO: 1267509 - RNA, 15 nt, Mycobacterium tuberculosis H37Rv
cagccaggaagcggu

SEQ ID NO: 1267510 - RNA, 20 nt, Mycobacterium tuberculosis H37Rv
cagcaucagcgccagcgagc

SEQ ID NO: 1267511 - RNA, 16 nt, Mycobacterium tuberculosis H37Rv
cagcaucacgcccacg

SEQ ID NO: 1267512 - RNA, 20 nt, Mycobacterium tuberculosis H37Rv
cagcaugacaccggccacca

SEQ ID NO: 1267513 - RNA, 16 nt, Mycobacterium tuberculosis H37Rv
cagcaggcccagcgga

SEQ ID NO: 1267514 - RNA, 19 nt, Mycobacterium tuberculosis H37Rv
cagcaggaucggcagcaga

SEQ ID NO: 1267515 - RNA, 19 nt, Mycobacterium tuberculosis H37Rv
cagcaggaugaugaccgcc

SEQ ID NO: 1267516 - RNA, 19 nt, Mycobacterium tuberculosis H37Rv
cagcaugcccgccauccga

SEQ ID NO: 1267517 - RNA, 17 nt, Mycobacterium tuberculosis H37Rv
cagcauugacccgacga

SEQ ID NO: 1267518 - RNA, 18 nt, Mycobacterium tuberculosis H37Rv
cagccaacucaggccggu

SEQ ID NO: 1267519 - RNA, 20 nt, Mycobacterium tuberculosis H37Rv
cagccagaucuccccgaccg

SEQ ID NO: 1267520 - RNA, 19 nt, Mycobacterium tuberculosis H37Rv
cagccagaucuccagguuc

SEQ ID NO: 1267521 - RNA, 15 nt, Mycobacterium tuberculosis H37Rv
cagccagaucuccag

SEQ ID NO: 1267522 - RNA, 21 nt, Mycobacterium tuberculosis H37Rv
cagccagaugccgguaacgaa

SEQ ID NO: 1267523 - RNA, 23 nt, Mycobacterium tuberculosis H37Rv
cagcagaccaaguccggucgcgg

SEQ ID NO: 1267524 - RNA, 19 nt, Mycobacterium tuberculosis H37Rv
cagcagagcggcacgcacg

SEQ ID NO: 1267525 - RNA, 20 nt, Mycobacterium tuberculosis H37Rv
cagcagaguggugaucuugg

SEQ ID NO: 1267526 - RNA, 12 nt, Mycobacterium tuberculosis H37Rv
cagcacgccggg

SEQ ID NO: 1267527 - RNA, 17 nt, Mycobacterium tuberculosis H37Rv
cagcacggcaaccagcg

SEQ ID NO: 1267528 - RNA, 16 nt, Mycobacterium tuberculosis H37Rv
cagcacuuggccagcu

SEQ ID NO: 1267529 - RNA, 16 nt, Mycobacterium tuberculosis H37Rv
cagcagcgugaccacc

SEQ ID NO: 1267530 - RNA, 22 nt, Mycobacterium tuberculosis H37Rv
cagcagcgucggugccaccacg

SEQ ID NO: 1267531 - RNA, 14 nt, Mycobacterium tuberculosis H37Rv
cagcagcgugacca

SEQ ID NO: 1267532 - RNA, 19 nt, Mycobacterium tuberculosis H37Rv
cagcagcucggggcgauga

SEQ ID NO: 1267533 - RNA, 14 nt, Mycobacterium tuberculosis H37Rv
cagcaccucgucga

SEQ ID NO: 1267534 - RNA, 14 nt, Mycobacterium tuberculosis H37Rv
cagcacgaccuggu

SEQ ID NO: 1267535 - RNA, 15 nt, Mycobacterium tuberculosis H37Rv
cagcacgaccugguu

SEQ ID NO: 1267536 - RNA, 16 nt, Mycobacterium tuberculosis H37Rv
cagcacgaccugguua

SEQ ID NO: 1267537 - RNA, 12 nt, Mycobacterium tuberculosis H37Rv
cagcacgacggc

SEQ ID NO: 1267538 - RNA, 13 nt, Mycobacterium tuberculosis H37Rv
cagcacgacgugc

SEQ ID NO: 1267539 - RNA, 20 nt, Mycobacterium tuberculosis H37Rv
cagcacgauccagcuguaca

SEQ ID NO: 1267540 - RNA, 14 nt, Mycobacterium tuberculosis H37Rv
cagcacgauccagc

SEQ ID NO: 1267541 - RNA, 22 nt, Mycobacterium tuberculosis H37Rv
cagcaccucggucccguugccg

SEQ ID NO: 1267542 - RNA, 16 nt, Mycobacterium tuberculosis H37Rv
cagcaccuagucgcgg

SEQ ID NO: 1267543 - RNA, 13 nt, Mycobacterium tuberculosis H37Rv
cagcaccgucggg

SEQ ID NO: 1267544 - RNA, 20 nt, Mycobacterium tuberculosis H37Rv
cagcaccgugacccugaugg

SEQ ID NO: 1267545 - RNA, 18 nt, Mycobacterium tuberculosis H37Rv
cagcaccgucggcaccag

SEQ ID NO: 1267546 - RNA, 23 nt, Mycobacterium tuberculosis H37Rv
cagcaccguccucggucacgauc

SEQ ID NO: 1267547 - RNA, 13 nt, Mycobacterium tuberculosis H37Rv
cagcaccggugac

SEQ ID NO: 1267548 - RNA, 16 nt, Mycobacterium tuberculosis H37Rv
cagcaccguaguccac

SEQ ID NO: 1267549 - RNA, 21 nt, Mycobacterium tuberculosis H37Rv
cagcaccguaguccacauggu

SEQ ID NO: 1267550 - RNA, 21 nt, Mycobacterium tuberculosis H37Rv
cagcacccugaugugagucca

SEQ ID NO: 1267551 - RNA, 20 nt, Mycobacterium tuberculosis H37Rv
cagcacccucaggcaaucgc

SEQ ID NO: 1267552 - RNA, 20 nt, Mycobacterium tuberculosis H37Rv
cagcacccgcacgguguauc

SEQ ID NO: 1267553 - RNA, 11 nt, Mycobacterium tuberculosis H37Rv
cagcacccggc

SEQ ID NO: 1267554 - RNA, 20 nt, Mycobacterium tuberculosis H37Rv
cagcaccgaacccgccaccg

SEQ ID NO: 1267555 - RNA, 14 nt, Mycobacterium tuberculosis H37Rv
cagcaccgccgcug

SEQ ID NO: 1267556 - RNA, 17 nt, Mycobacterium tuberculosis H37Rv
cagcacccacgccggug

SEQ ID NO: 1267557 - RNA, 22 nt, Mycobacterium tuberculosis H37Rv
cagcacccacaucagccgcacc

SEQ ID NO: 1267558 - RNA, 23 nt, Mycobacterium tuberculosis H37Rv
cagcacccaccgaagcgaacggc

SEQ ID NO: 1267559 - RNA, 14 nt, Mycobacterium tuberculosis H37Rv
cagcaccccgaucu

SEQ ID NO: 1267560 - RNA, 22 nt, Mycobacterium tuberculosis H37Rv
cagcaccaguguggcgaugacc

SEQ ID NO: 1267561 - RNA, 15 nt, Mycobacterium tuberculosis H37Rv
cagcaccagcucacg

SEQ ID NO: 1267562 - RNA, 18 nt, Mycobacterium tuberculosis H37Rv
cagcaccaacugaauggc

SEQ ID NO: 1267563 - RNA, 13 nt, Mycobacterium tuberculosis H37Rv
cagcaccacaucg

SEQ ID NO: 1267564 - RNA, 17 nt, Mycobacterium tuberculosis H37Rv
cagcaccaccgcggugu

SEQ ID NO: 1267565 - RNA, 14 nt, Mycobacterium tuberculosis H37Rv
cagcaccaccggcu

SEQ ID NO: 1267566 - RNA, 12 nt, Mycobacterium tuberculosis H37Rv
cagcaccaccgg

SEQ ID NO: 1267567 - RNA, 17 nt, Mycobacterium tuberculosis H37Rv
cagcaccagcacggcaa

SEQ ID NO: 1267568 - RNA, 17 nt, Mycobacterium tuberculosis H37Rv
cagcacaccgucgacga

SEQ ID NO: 1267569 - RNA, 14 nt, Mycobacterium tuberculosis H37Rv
cagcacagcgcagc

SEQ ID NO: 1267570 - RNA, 16 nt, Mycobacterium tuberculosis H37Rv
cagcacauccugcagc

SEQ ID NO: 1267571 - RNA, 14 nt, Mycobacterium tuberculosis H37Rv
cagcaacugccgca

SEQ ID NO: 1267572 - RNA, 14 nt, Mycobacterium tuberculosis H37Rv
cagcaacucggcca

SEQ ID NO: 1267573 - RNA, 15 nt, Mycobacterium tuberculosis H37Rv
cagcaacucggccac

SEQ ID NO: 1267574 - RNA, 18 nt, Mycobacterium tuberculosis H37Rv
cagcaacgcggugccggg

SEQ ID NO: 1267575 - RNA, 14 nt, Mycobacterium tuberculosis H37Rv
cagcaacgcggugc

SEQ ID NO: 1267576 - RNA, 20 nt, Mycobacterium tuberculosis H37Rv
cagauucggugccagcaggc

SEQ ID NO: 1267577 - RNA, 12 nt, Mycobacterium tuberculosis H37Rv
cagauucgccgc

SEQ ID NO: 1267578 - RNA, 23 nt, Mycobacterium tuberculosis H37Rv
cagauugaggcuggucugcaggc

SEQ ID NO: 1267579 - RNA, 21 nt, Mycobacterium tuberculosis H37Rv
cagaugguuggaucgccaccg

SEQ ID NO: 1267580 - RNA, 20 nt, Mycobacterium tuberculosis H37Rv
cagauguaccucaucgcaga

SEQ ID NO: 1267581 - RNA, 19 nt, Mycobacterium tuberculosis H37Rv
cagaugguuggaucgccac

SEQ ID NO: 1267582 - RNA, 15 nt, Mycobacterium tuberculosis H37Rv
cagaugguggcaugc

SEQ ID NO: 1267583 - RNA, 18 nt, Mycobacterium tuberculosis H37Rv
cagaugguuggaucgcca

SEQ ID NO: 1267584 - RNA, 21 nt, Mycobacterium tuberculosis H37Rv
cagauggugaaguugccgguc

SEQ ID NO: 1267585 - RNA, 20 nt, Mycobacterium tuberculosis H37Rv
cagaugggccuccaccgcgu

SEQ ID NO: 1267586 - RNA, 20 nt, Mycobacterium tuberculosis H37Rv
cagauggguacccgaucacu

SEQ ID NO: 1267587 - RNA, 22 nt, Mycobacterium tuberculosis H37Rv
cagauggucucgaacuccaugc

SEQ ID NO: 1267588 - RNA, 19 nt, Mycobacterium tuberculosis H37Rv
cagauggcauugcgcccac

SEQ ID NO: 1267589 - RNA, 14 nt, Mycobacterium tuberculosis H37Rv
cagauggccacgga

SEQ ID NO: 1267590 - RNA, 16 nt, Mycobacterium tuberculosis H37Rv
cagauagugcuccacg

SEQ ID NO: 1267591 - RNA, 16 nt, Mycobacterium tuberculosis H37Rv
cagaucaacgcgucgc

SEQ ID NO: 1267592 - RNA, 14 nt, Mycobacterium tuberculosis H37Rv
cagaucaacgcguc

SEQ ID NO: 1267593 - RNA, 20 nt, Mycobacterium tuberculosis H37Rv
cagaucaacaucaucacugu

SEQ ID NO: 1267594 - RNA, 17 nt, Mycobacterium tuberculosis H37Rv
cagaucaggacgcgauc

SEQ ID NO: 1267595 - RNA, 22 nt, Mycobacterium tuberculosis H37Rv
cagaugccgguaacgaacagcg

SEQ ID NO: 1267596 - RNA, 13 nt, Mycobacterium tuberculosis H37Rv
cagaaucgcacgc

SEQ ID NO: 1267597 - RNA, 20 nt, Mycobacterium tuberculosis H37Rv
cagaaucgcccauuucggca

SEQ ID NO: 1267598 - RNA, 16 nt, Mycobacterium tuberculosis H37Rv
cagaaucaggcucgcc

SEQ ID NO: 1267599 - RNA, 17 nt, Mycobacterium tuberculosis H37Rv
cagaauucggcgcgaca

SEQ ID NO: 1267600 - RNA, 23 nt, Mycobacterium tuberculosis H37Rv
cagauagcgcucgaacucggcgg

SEQ ID NO: 1267601 - RNA, 15 nt, Mycobacterium tuberculosis H37Rv
cagcgacuugcggug

SEQ ID NO: 1267602 - RNA, 19 nt, Mycobacterium tuberculosis H37Rv
cagcgacuuggcaucgcga

SEQ ID NO: 1267603 - RNA, 20 nt, Mycobacterium tuberculosis H37Rv
cagcgacuuggcaucgcgag

SEQ ID NO: 1267604 - RNA, 14 nt, Mycobacterium tuberculosis H37Rv
cagcgacuuggcau

SEQ ID NO: 1267605 - RNA, 12 nt, Mycobacterium tuberculosis H37Rv
cagcgcgccgua

SEQ ID NO: 1267606 - RNA, 17 nt, Mycobacterium tuberculosis H37Rv
cagcgcgccggcgucgg

SEQ ID NO: 1267607 - RNA, 14 nt, Mycobacterium tuberculosis H37Rv
cagcgcgccgcguu

SEQ ID NO: 1267608 - RNA, 12 nt, Mycobacterium tuberculosis H37Rv
cagcgcggcacg

SEQ ID NO: 1267609 - RNA, 14 nt, Mycobacterium tuberculosis H37Rv
cagcgcggcaccca

SEQ ID NO: 1267610 - RNA, 13 nt, Mycobacterium tuberculosis H37Rv
cagcgcggcaagc

SEQ ID NO: 1267611 - RNA, 14 nt, Mycobacterium tuberculosis H37Rv
cagcgcgcgcgggu

SEQ ID NO: 1267612 - RNA, 23 nt, Mycobacterium tuberculosis H37Rv
cagcgcggcguguacgucgauca

SEQ ID NO: 1267613 - RNA, 18 nt, Mycobacterium tuberculosis H37Rv
cagcgcgggacacgucgc

SEQ ID NO: 1267614 - RNA, 15 nt, Mycobacterium tuberculosis H37Rv
cagcgcgucgccgaa

SEQ ID NO: 1267615 - RNA, 13 nt, Mycobacterium tuberculosis H37Rv
cagcgcggcgcga

SEQ ID NO: 1267616 - RNA, 15 nt, Mycobacterium tuberculosis H37Rv
cagcgcggcgcacaa

SEQ ID NO: 1267617 - RNA, 22 nt, Mycobacterium tuberculosis H37Rv
cagcgcggcgagggcggucagc

SEQ ID NO: 1267618 - RNA, 14 nt, Mycobacterium tuberculosis H37Rv
cagcgcggccaccc

SEQ ID NO: 1267619 - RNA, 17 nt, Mycobacterium tuberculosis H37Rv
cagcgcggccacccgcg

SEQ ID NO: 1267620 - RNA, 18 nt, Mycobacterium tuberculosis H37Rv
cagcgcggccacccgcga

SEQ ID NO: 1267621 - RNA, 20 nt, Mycobacterium tuberculosis H37Rv
cagcgcguucggcaccuggu

SEQ ID NO: 1267622 - RNA, 22 nt, Mycobacterium tuberculosis H37Rv
cagcgcuccagcacccgcgcga

SEQ ID NO: 1267623 - RNA, 13 nt, Mycobacterium tuberculosis H37Rv
cagcgcuccagcc

SEQ ID NO: 1267624 - RNA, 13 nt, Mycobacterium tuberculosis H37Rv
cagcgcucaccgg

SEQ ID NO: 1267625 - RNA, 20 nt, Mycobacterium tuberculosis H37Rv
cagcgcgucguccagggcga

SEQ ID NO: 1267626 - RNA, 13 nt, Mycobacterium tuberculosis H37Rv
cagcgcgucggga

SEQ ID NO: 1267627 - RNA, 14 nt, Mycobacterium tuberculosis H37Rv
cagcgcgucgucca

SEQ ID NO: 1267628 - RNA, 14 nt, Mycobacterium tuberculosis H37Rv
cagcgcgucgccgu

SEQ ID NO: 1267629 - RNA, 21 nt, Mycobacterium tuberculosis H37Rv
cagcgcuucgucggccggcac

SEQ ID NO: 1267630 - RNA, 15 nt, Mycobacterium tuberculosis H37Rv
cagcgcuucgucggc

SEQ ID NO: 1267631 - RNA, 20 nt, Mycobacterium tuberculosis H37Rv
cagcgcuggcuacgccuccu

SEQ ID NO: 1267632 - RNA, 17 nt, Mycobacterium tuberculosis H37Rv
cagcgcugucguaccgc

SEQ ID NO: 1267633 - RNA, 22 nt, Mycobacterium tuberculosis H37Rv
cagcgcucucauagcgacggcg

SEQ ID NO: 1267634 - RNA, 18 nt, Mycobacterium tuberculosis H37Rv
cagcgcugagccgcucau

SEQ ID NO: 1267635 - RNA, 20 nt, Mycobacterium tuberculosis H37Rv
cagcggaccccacgaguagc

SEQ ID NO: 1267636 - RNA, 13 nt, Mycobacterium tuberculosis H37Rv
cagcggaccgcug

SEQ ID NO: 1267637 - RNA, 14 nt, Mycobacterium tuberculosis H37Rv
cagcggaccgcugc

SEQ ID NO: 1267638 - RNA, 19 nt, Mycobacterium tuberculosis H37Rv
cagcggaauuagucgccgc

SEQ ID NO: 1267639 - RNA, 16 nt, Mycobacterium tuberculosis H37Rv
cagcggagacgaucgc

SEQ ID NO: 1267640 - RNA, 18 nt, Mycobacterium tuberculosis H37Rv
cagcggcaauggccagca

SEQ ID NO: 1267641 - RNA, 23 nt, Mycobacterium tuberculosis H37Rv
cagcggaucgucguugucagcga

SEQ ID NO: 1267642 - RNA, 18 nt, Mycobacterium tuberculosis H37Rv
cagcggcagcaccgcacg

SEQ ID NO: 1267643 - RNA, 18 nt, Mycobacterium tuberculosis H37Rv
cagcggcacugaucugcg

SEQ ID NO: 1267644 - RNA, 16 nt, Mycobacterium tuberculosis H37Rv
cagcggcgggcgauga

SEQ ID NO: 1267645 - RNA, 17 nt, Mycobacterium tuberculosis H37Rv
cagcggcgggcgaugac

SEQ ID NO: 1267646 - RNA, 19 nt, Mycobacterium tuberculosis H37Rv
cagcggcggcgucgacggc

SEQ ID NO: 1267647 - RNA, 20 nt, Mycobacterium tuberculosis H37Rv
cagcggcggguagauccgcc

SEQ ID NO: 1267648 - RNA, 20 nt, Mycobacterium tuberculosis H37Rv
cagcggcggcgacgagcgca

SEQ ID NO: 1267649 - RNA, 20 nt, Mycobacterium tuberculosis H37Rv
cagcggcgcucggcgccacg

SEQ ID NO: 1267650 - RNA, 19 nt, Mycobacterium tuberculosis H37Rv
cagcggcgcucggcgccac

SEQ ID NO: 1267651 - RNA, 18 nt, Mycobacterium tuberculosis H37Rv
cagcggcgggccguacac

SEQ ID NO: 1267652 - RNA, 13 nt, Mycobacterium tuberculosis H37Rv
cagcggcugccca

SEQ ID NO: 1267653 - RNA, 16 nt, Mycobacterium tuberculosis H37Rv
cagcggcugaccgggc

SEQ ID NO: 1267654 - RNA, 19 nt, Mycobacterium tuberculosis H37Rv
cagcggcucuauccggcgc

SEQ ID NO: 1267655 - RNA, 12 nt, Mycobacterium tuberculosis H37Rv
cagcggcgucgu

SEQ ID NO: 1267656 - RNA, 16 nt, Mycobacterium tuberculosis H37Rv
cagcggcaucggccag

SEQ ID NO: 1267657 - RNA, 17 nt, Mycobacterium tuberculosis H37Rv
cagcggcauccagcuuc

SEQ ID NO: 1267658 - RNA, 14 nt, Mycobacterium tuberculosis H37Rv
cagcggcaucgcgg

SEQ ID NO: 1267659 - RNA, 18 nt, Mycobacterium tuberculosis H37Rv
cagcggccagggcaccca

SEQ ID NO: 1267660 - RNA, 19 nt, Mycobacterium tuberculosis H37Rv
cagcggccaccgaggcguu

SEQ ID NO: 1267661 - RNA, 16 nt, Mycobacterium tuberculosis H37Rv
cagcggccgaccgcga

SEQ ID NO: 1267662 - RNA, 17 nt, Mycobacterium tuberculosis H37Rv
cagcggcccgucaccgc

SEQ ID NO: 1267663 - RNA, 17 nt, Mycobacterium tuberculosis H37Rv
cagcggcccgcugcgcg

SEQ ID NO: 1267664 - RNA, 16 nt, Mycobacterium tuberculosis H37Rv
cagcggccugaccggc

SEQ ID NO: 1267665 - RNA, 17 nt, Mycobacterium tuberculosis H37Rv
cagcggccugaccggcu

SEQ ID NO: 1267666 - RNA, 13 nt, Mycobacterium tuberculosis H37Rv
cagcggccgguac

SEQ ID NO: 1267667 - RNA, 16 nt, Mycobacterium tuberculosis H37Rv
cagcggcgaucaggcg

SEQ ID NO: 1267668 - RNA, 22 nt, Mycobacterium tuberculosis H37Rv
cagcggcgcgaggaacgccggg

SEQ ID NO: 1267669 - RNA, 22 nt, Mycobacterium tuberculosis H37Rv
cagcgucucggaggcgaccacg

SEQ ID NO: 1267670 - RNA, 19 nt, Mycobacterium tuberculosis H37Rv
cagcgucugagcgccggca

SEQ ID NO: 1267671 - RNA, 21 nt, Mycobacterium tuberculosis H37Rv
cagcgucucgugaacaacucc

SEQ ID NO: 1267672 - RNA, 23 nt, Mycobacterium tuberculosis H37Rv
cagcguggacguacugucgucgc

SEQ ID NO: 1267673 - RNA, 21 nt, Mycobacterium tuberculosis H37Rv
cagcggguugcggucaccgga

SEQ ID NO: 1267674 - RNA, 23 nt, Mycobacterium tuberculosis H37Rv
cagcggguggccaucaccgcgcu

SEQ ID NO: 1267675 - RNA, 13 nt, Mycobacterium tuberculosis H37Rv
cagcgggucgcgg

SEQ ID NO: 1267676 - RNA, 20 nt, Mycobacterium tuberculosis H37Rv
cagcggguccuucugccggg

SEQ ID NO: 1267677 - RNA, 22 nt, Mycobacterium tuberculosis H37Rv
cagcgucagcuguuugccggcu

SEQ ID NO: 1267678 - RNA, 20 nt, Mycobacterium tuberculosis H37Rv
cagcgucaggugcgcgacca

SEQ ID NO: 1267679 - RNA, 17 nt, Mycobacterium tuberculosis H37Rv
cagcgucaccucaccga

SEQ ID NO: 1267680 - RNA, 17 nt, Mycobacterium tuberculosis H37Rv
cagcucaucgcgcacgc

SEQ ID NO: 1267681 - RNA, 17 nt, Mycobacterium tuberculosis H37Rv
cagcguucccgccggcu

SEQ ID NO: 1267682 - RNA, 24 nt, Mycobacterium tuberculosis H37Rv
cagcuaucccaggggcaccgagcu

SEQ ID NO: 1267683 - RNA, 18 nt, Mycobacterium tuberculosis H37Rv
cagcguguugagggcugu

SEQ ID NO: 1267684 - RNA, 14 nt, Mycobacterium tuberculosis H37Rv
cagcgugucgccga

SEQ ID NO: 1267685 - RNA, 13 nt, Mycobacterium tuberculosis H37Rv
cagcguggcuggc

SEQ ID NO: 1267686 - RNA, 22 nt, Mycobacterium tuberculosis H37Rv
cagcguggcuggcaccucccgg

SEQ ID NO: 1267687 - RNA, 17 nt, Mycobacterium tuberculosis H37Rv
cagcguggggccgccac

SEQ ID NO: 1267688 - RNA, 15 nt, Mycobacterium tuberculosis H37Rv
cagcgucgucgacga

SEQ ID NO: 1267689 - RNA, 20 nt, Mycobacterium tuberculosis H37Rv
cagcguggugaagucggugc

SEQ ID NO: 1267690 - RNA, 16 nt, Mycobacterium tuberculosis H37Rv
caggcccugccgacgc

SEQ ID NO: 1267691 - RNA, 14 nt, Mycobacterium tuberculosis H37Rv
caggcccacccggg

SEQ ID NO: 1267692 - RNA, 22 nt, Mycobacterium tuberculosis H37Rv
caggccagugccaccugggcgg

SEQ ID NO: 1267693 - RNA, 17 nt, Mycobacterium tuberculosis H37Rv
caggccagugccaccug

SEQ ID NO: 1267694 - RNA, 19 nt, Mycobacterium tuberculosis H37Rv
caggccgaugacgaugccg

SEQ ID NO: 1267695 - RNA, 16 nt, Mycobacterium tuberculosis H37Rv
caggccgaugccgacc

SEQ ID NO: 1267696 - RNA, 23 nt, Mycobacterium tuberculosis H37Rv
caggcccugguagugaacggauc

SEQ ID NO: 1267697 - RNA, 16 nt, Mycobacterium tuberculosis H37Rv
caggcccuggccaccc

SEQ ID NO: 1267698 - RNA, 17 nt, Mycobacterium tuberculosis H37Rv
caggcaguccaccgcgc

SEQ ID NO: 1267699 - RNA, 13 nt, Mycobacterium tuberculosis H37Rv
caggcaucaccgg

SEQ ID NO: 1267700 - RNA, 14 nt, Mycobacterium tuberculosis H37Rv
caggccagagucgc

SEQ ID NO: 1267701 - RNA, 23 nt, Mycobacterium tuberculosis H37Rv
caggccaccgcagacgccgucug

SEQ ID NO: 1267702 - RNA, 17 nt, Mycobacterium tuberculosis H37Rv
caggccaacggcgcugc

SEQ ID NO: 1267703 - RNA, 20 nt, Mycobacterium tuberculosis H37Rv
caggccaacuuggcggccag

SEQ ID NO: 1267704 - RNA, 18 nt, Mycobacterium tuberculosis H37Rv
caggcgaagucgacucgc

SEQ ID NO: 1267705 - RNA, 23 nt, Mycobacterium tuberculosis H37Rv
caggcgaagucgacucgccacau

SEQ ID NO: 1267706 - RNA, 22 nt, Mycobacterium tuberculosis H37Rv
caggcgcauagggccaccgccg

SEQ ID NO: 1267707 - RNA, 14 nt, Mycobacterium tuberculosis H37Rv
caggcgcgccgcac

SEQ ID NO: 1267708 - RNA, 20 nt, Mycobacterium tuberculosis H37Rv
caggccuaguccggcacugc

SEQ ID NO: 1267709 - RNA, 16 nt, Mycobacterium tuberculosis H37Rv
caggccgcgcucgucg

SEQ ID NO: 1267710 - RNA, 17 nt, Mycobacterium tuberculosis H37Rv
caggccgcggagaaggc

SEQ ID NO: 1267711 - RNA, 14 nt, Mycobacterium tuberculosis H37Rv
caggccgcgcggac

SEQ ID NO: 1267712 - RNA, 15 nt, Mycobacterium tuberculosis H37Rv
caggccgcgcgacaa

SEQ ID NO: 1267713 - RNA, 17 nt, Mycobacterium tuberculosis H37Rv
caggcccuuuucccugc

SEQ ID NO: 1267714 - RNA, 13 nt, Mycobacterium tuberculosis H37Rv
cagcugucgggca

SEQ ID NO: 1267715 - RNA, 16 nt, Mycobacterium tuberculosis H37Rv
cagcugugcgacccgc

SEQ ID NO: 1267716 - RNA, 13 nt, Mycobacterium tuberculosis H37Rv
cagcuguugcggg

SEQ ID NO: 1267717 - RNA, 16 nt, Mycobacterium tuberculosis H37Rv
cagcugguuugcggug

SEQ ID NO: 1267718 - RNA, 14 nt, Mycobacterium tuberculosis H37Rv
cagcuuggcgucga

SEQ ID NO: 1267719 - RNA, 21 nt, Mycobacterium tuberculosis H37Rv
cagcuuccgcugaacaccgug

SEQ ID NO: 1267720 - RNA, 16 nt, Mycobacterium tuberculosis H37Rv
caggaacaaugagauc

SEQ ID NO: 1267721 - RNA, 20 nt, Mycobacterium tuberculosis H37Rv
caggaaccaguccucgacgu

SEQ ID NO: 1267722 - RNA, 21 nt, Mycobacterium tuberculosis H37Rv
cagcuuguuuuccaccagcga

SEQ ID NO: 1267723 - RNA, 20 nt, Mycobacterium tuberculosis H37Rv
cagcuugugggcgacggcga

SEQ ID NO: 1267724 - RNA, 19 nt, Mycobacterium tuberculosis H37Rv
cagcuugucgggcaccggu

SEQ ID NO: 1267725 - RNA, 14 nt, Mycobacterium tuberculosis H37Rv
caggaaaccggcgc

SEQ ID NO: 1267726 - RNA, 20 nt, Mycobacterium tuberculosis H37Rv
cagcuuugguaccgagcaca

SEQ ID NO: 1267727 - RNA, 23 nt, Mycobacterium tuberculosis H37Rv
cagcuccgggucgacgacgucgc

SEQ ID NO: 1267728 - RNA, 17 nt, Mycobacterium tuberculosis H37Rv
cagcuccgggucgacga

SEQ ID NO: 1267729 - RNA, 18 nt, Mycobacterium tuberculosis H37Rv
cagcuccgugacaccggg

SEQ ID NO: 1267730 - RNA, 19 nt, Mycobacterium tuberculosis H37Rv
cagcuccgugacaccgggg

SEQ ID NO: 1267731 - RNA, 21 nt, Mycobacterium tuberculosis H37Rv
cagcuccucagccaccgcggu

SEQ ID NO: 1267732 - RNA, 20 nt, Mycobacterium tuberculosis H37Rv
cagcuccgggugcagaucgc

SEQ ID NO: 1267733 - RNA, 15 nt, Mycobacterium tuberculosis H37Rv
cagcugcgcgggcga

SEQ ID NO: 1267734 - RNA, 15 nt, Mycobacterium tuberculosis H37Rv
cagcuccuugagguc

SEQ ID NO: 1267735 - RNA, 17 nt, Mycobacterium tuberculosis H37Rv
cagcugccugaccggcg

SEQ ID NO: 1267736 - RNA, 21 nt, Mycobacterium tuberculosis H37Rv
cagcugcguggcgaaccaggg

SEQ ID NO: 1267737 - RNA, 15 nt, Mycobacterium tuberculosis H37Rv
cagcuggcucaccga

SEQ ID NO: 1267738 - RNA, 23 nt, Mycobacterium tuberculosis H37Rv
cagcuggucgugggccaccaccu

SEQ ID NO: 1267739 - RNA, 23 nt, Mycobacterium tuberculosis H37Rv
caggauggacucgacaauucgca

SEQ ID NO: 1267740 - RNA, 15 nt, Mycobacterium tuberculosis H37Rv
caggaucggcggaua

SEQ ID NO: 1267741 - RNA, 20 nt, Mycobacterium tuberculosis H37Rv
caggaugccugccacccguu

SEQ ID NO: 1267742 - RNA, 18 nt, Mycobacterium tuberculosis H37Rv
caggcagcucggcaacgu

SEQ ID NO: 1267743 - RNA, 16 nt, Mycobacterium tuberculosis H37Rv
caggcagcggcgacac

SEQ ID NO: 1267744 - RNA, 22 nt, Mycobacterium tuberculosis H37Rv
caggagaucaacauccugggca

SEQ ID NO: 1267745 - RNA, 19 nt, Mycobacterium tuberculosis H37Rv
caggacuccggccgcacgc

SEQ ID NO: 1267746 - RNA, 19 nt, Mycobacterium tuberculosis H37Rv
caggagaacacauccgcuu

SEQ ID NO: 1267747 - RNA, 18 nt, Mycobacterium tuberculosis H37Rv
caggacuggcaccgccag

SEQ ID NO: 1267748 - RNA, 22 nt, Mycobacterium tuberculosis H37Rv
caggacgcgggcuaucgguuca

SEQ ID NO: 1267749 - RNA, 19 nt, Mycobacterium tuberculosis H37Rv
caggaucacacuggccugc

SEQ ID NO: 1267750 - RNA, 23 nt, Mycobacterium tuberculosis H37Rv
caggaucacacuggccugcucaa

SEQ ID NO: 1267751 - RNA, 23 nt, Mycobacterium tuberculosis H37Rv
caggaucacccacucgacgucgu

SEQ ID NO: 1267752 - RNA, 22 nt, Mycobacterium tuberculosis H37Rv
caggaucagcccggacguaggc

SEQ ID NO: 1267753 - RNA, 13 nt, Mycobacterium tuberculosis H37Rv
caggaucagcgac

SEQ ID NO: 1267754 - RNA, 23 nt, Mycobacterium tuberculosis H37Rv
caggaacaaguagccgucgucgu

SEQ ID NO: 1267755 - RNA, 22 nt, Mycobacterium tuberculosis H37Rv
caggacgcgaucggcgucacga

SEQ ID NO: 1267756 - RNA, 13 nt, Mycobacterium tuberculosis H37Rv
caggacggcaccc

SEQ ID NO: 1267757 - RNA, 16 nt, Mycobacterium tuberculosis H37Rv
caggacgucggcgaau

SEQ ID NO: 1267758 - RNA, 17 nt, Mycobacterium tuberculosis H37Rv
cagggugcccucggccg

SEQ ID NO: 1267759 - RNA, 14 nt, Mycobacterium tuberculosis H37Rv
cagggugacuucgc

SEQ ID NO: 1267760 - RNA, 20 nt, Mycobacterium tuberculosis H37Rv
cagggugcgccgcagcaggu

SEQ ID NO: 1267761 - RNA, 16 nt, Mycobacterium tuberculosis H37Rv
cagggugcgcuggccg

SEQ ID NO: 1267762 - RNA, 14 nt, Mycobacterium tuberculosis H37Rv
caggguggcgacgu

SEQ ID NO: 1267763 - RNA, 15 nt, Mycobacterium tuberculosis H37Rv
caggguguccgucga

SEQ ID NO: 1267764 - RNA, 20 nt, Mycobacterium tuberculosis H37Rv
caggguguauggccaccacg

SEQ ID NO: 1267765 - RNA, 20 nt, Mycobacterium tuberculosis H37Rv
cagggucagcugggacccga

SEQ ID NO: 1267766 - RNA, 23 nt, Mycobacterium tuberculosis H37Rv
cagguagaacuccucgcugucga

SEQ ID NO: 1267767 - RNA, 14 nt, Mycobacterium tuberculosis H37Rv
cagguagcgcucga

SEQ ID NO: 1267768 - RNA, 19 nt, Mycobacterium tuberculosis H37Rv
cagguagucgacgacgugg

SEQ ID NO: 1267769 - RNA, 17 nt, Mycobacterium tuberculosis H37Rv
cagguaccaccgcggug

SEQ ID NO: 1267770 - RNA, 18 nt, Mycobacterium tuberculosis H37Rv
cagguacgcgaucagcgc

SEQ ID NO: 1267771 - RNA, 17 nt, Mycobacterium tuberculosis H37Rv
cagggugucgaagagca

SEQ ID NO: 1267772 - RNA, 16 nt, Mycobacterium tuberculosis H37Rv
cagggcgaucugcgcg

SEQ ID NO: 1267773 - RNA, 19 nt, Mycobacterium tuberculosis H37Rv
cagggccggcaccgcagcg

SEQ ID NO: 1267774 - RNA, 17 nt, Mycobacterium tuberculosis H37Rv
cagggccggcaccgcag

SEQ ID NO: 1267775 - RNA, 14 nt, Mycobacterium tuberculosis H37Rv
cagggccggcaccg

SEQ ID NO: 1267776 - RNA, 14 nt, Mycobacterium tuberculosis H37Rv
cagggccgcucgcc

SEQ ID NO: 1267777 - RNA, 21 nt, Mycobacterium tuberculosis H37Rv
cagggccaccaccacggccag

SEQ ID NO: 1267778 - RNA, 20 nt, Mycobacterium tuberculosis H37Rv
cagggggacccggaccuucg

SEQ ID NO: 1267779 - RNA, 18 nt, Mycobacterium tuberculosis H37Rv
cagggggcgagagcgcgg

SEQ ID NO: 1267780 - RNA, 21 nt, Mycobacterium tuberculosis H37Rv
cagggcuucgugcaccacauu

SEQ ID NO: 1267781 - RNA, 19 nt, Mycobacterium tuberculosis H37Rv
caggggaucccccgcgcga

SEQ ID NO: 1267782 - RNA, 19 nt, Mycobacterium tuberculosis H37Rv
cagggcuuguacgaacugc

SEQ ID NO: 1267783 - RNA, 16 nt, Mycobacterium tuberculosis H37Rv
caggggcgcagcgcgg

SEQ ID NO: 1267784 - RNA, 20 nt, Mycobacterium tuberculosis H37Rv
cagggcgcgcaucugcucgg

SEQ ID NO: 1267785 - RNA, 15 nt, Mycobacterium tuberculosis H37Rv
cagggcgccgacgac

SEQ ID NO: 1267786 - RNA, 16 nt, Mycobacterium tuberculosis H37Rv
cagggcugcgaugcgg

SEQ ID NO: 1267787 - RNA, 20 nt, Mycobacterium tuberculosis H37Rv
cagguccgccaacggcaccu

SEQ ID NO: 1267788 - RNA, 14 nt, Mycobacterium tuberculosis H37Rv
cagguccgccggug

SEQ ID NO: 1267789 - RNA, 16 nt, Mycobacterium tuberculosis H37Rv
caggucauugccggcg

SEQ ID NO: 1267790 - RNA, 17 nt, Mycobacterium tuberculosis H37Rv
cagguccgccggugccg

SEQ ID NO: 1267791 - RNA, 22 nt, Mycobacterium tuberculosis H37Rv
cagguccugcgccgcacgccga

SEQ ID NO: 1267792 - RNA, 17 nt, Mycobacterium tuberculosis H37Rv
caggucgacaccgcggu

SEQ ID NO: 1267793 - RNA, 23 nt, Mycobacterium tuberculosis H37Rv
caggucgacaccgcggugccccg

SEQ ID NO: 1267794 - RNA, 17 nt, Mycobacterium tuberculosis H37Rv
caggucgagcaccggcu

SEQ ID NO: 1267795 - RNA, 23 nt, Mycobacterium tuberculosis H37Rv
cagguaucggggggucuugccga

SEQ ID NO: 1267796 - RNA, 16 nt, Mycobacterium tuberculosis H37Rv
cagguagucgccgguc

SEQ ID NO: 1267797 - RNA, 21 nt, Mycobacterium tuberculosis H37Rv
cagguagucgucgacuugcag

SEQ ID NO: 1267798 - RNA, 14 nt, Mycobacterium tuberculosis H37Rv
cagguccaccgcug

SEQ ID NO: 1267799 - RNA, 18 nt, Mycobacterium tuberculosis H37Rv
caggucaucggcuaucgc

SEQ ID NO: 1267800 - RNA, 13 nt, Mycobacterium tuberculosis H37Rv
caggucagccgcg

SEQ ID NO: 1267801 - RNA, 18 nt, Mycobacterium tuberculosis H37Rv
caggucacuggguugcga

SEQ ID NO: 1267802 - RNA, 20 nt, Mycobacterium tuberculosis H37Rv
caggucagaaaaucgguugu

SEQ ID NO: 1267803 - RNA, 17 nt, Mycobacterium tuberculosis H37Rv
caggucgagguccucgg

SEQ ID NO: 1267804 - RNA, 23 nt, Mycobacterium tuberculosis H37Rv
caggucgaggcaggccucggcgc

SEQ ID NO: 1267805 - RNA, 19 nt, Mycobacterium tuberculosis H37Rv
caggucguuuacggcaagu

SEQ ID NO: 1267806 - RNA, 20 nt, Mycobacterium tuberculosis H37Rv
caggucguuuacggcaaguu

SEQ ID NO: 1267807 - RNA, 17 nt, Mycobacterium tuberculosis H37Rv
caggucgucguaccggc

SEQ ID NO: 1267808 - RNA, 17 nt, Mycobacterium tuberculosis H37Rv
caggucgucggcgucgc

SEQ ID NO: 1267809 - RNA, 20 nt, Mycobacterium tuberculosis H37Rv
caggucguccaucgcgucgu

SEQ ID NO: 1267810 - RNA, 21 nt, Mycobacterium tuberculosis H37Rv
caggucgguggucucgacggc

SEQ ID NO: 1267811 - RNA, 13 nt, Mycobacterium tuberculosis H37Rv
caggucggugacg

SEQ ID NO: 1267812 - RNA, 23 nt, Mycobacterium tuberculosis H37Rv
caggucggugacgaagagcaccg

SEQ ID NO: 1267813 - RNA, 15 nt, Mycobacterium tuberculosis H37Rv
caggugcagcaccag

SEQ ID NO: 1267814 - RNA, 17 nt, Mycobacterium tuberculosis H37Rv
caggugccagaccaggg

SEQ ID NO: 1267815 - RNA, 18 nt, Mycobacterium tuberculosis H37Rv
caggugccuuucggcaga

SEQ ID NO: 1267816 - RNA, 16 nt, Mycobacterium tuberculosis H37Rv
cagguggccgcaucgc

SEQ ID NO: 1267817 - RNA, 14 nt, Mycobacterium tuberculosis H37Rv
cagguuuucgaucu

SEQ ID NO: 1267818 - RNA, 21 nt, Mycobacterium tuberculosis H37Rv
caguacgcgcugagcgacugc

SEQ ID NO: 1267819 - RNA, 18 nt, Mycobacterium tuberculosis H37Rv
cagguugucggcgaucaa

SEQ ID NO: 1267820 - RNA, 19 nt, Mycobacterium tuberculosis H37Rv
cagguugucggcgaucaac

SEQ ID NO: 1267821 - RNA, 18 nt, Mycobacterium tuberculosis H37Rv
cagguggugacacgacgu

SEQ ID NO: 1267822 - RNA, 17 nt, Mycobacterium tuberculosis H37Rv
cagguuguagacggcac

SEQ ID NO: 1267823 - RNA, 20 nt, Mycobacterium tuberculosis H37Rv
caggugggcguuggcgacga

SEQ ID NO: 1267824 - RNA, 17 nt, Mycobacterium tuberculosis H37Rv
caggugggccgagagca

SEQ ID NO: 1267825 - RNA, 20 nt, Mycobacterium tuberculosis H37Rv
cagguggugacacgacgugc

SEQ ID NO: 1267826 - RNA, 19 nt, Mycobacterium tuberculosis H37Rv
cagguuggauacggugcga

SEQ ID NO: 1267827 - RNA, 21 nt, Mycobacterium tuberculosis H37Rv
caguccagccgggugccggca

SEQ ID NO: 1267828 - RNA, 23 nt, Mycobacterium tuberculosis H37Rv
cagucaggccuagcgcggcgacg

SEQ ID NO: 1267829 - RNA, 18 nt, Mycobacterium tuberculosis H37Rv
cagucauuauucgcgcaa

SEQ ID NO: 1267830 - RNA, 21 nt, Mycobacterium tuberculosis H37Rv
cagucccagcacacccccguc

SEQ ID NO: 1267831 - RNA, 15 nt, Mycobacterium tuberculosis H37Rv
caguccgacaccggc

SEQ ID NO: 1267832 - RNA, 14 nt, Mycobacterium tuberculosis H37Rv
caguccgaucgccg

SEQ ID NO: 1267833 - RNA, 15 nt, Mycobacterium tuberculosis H37Rv
caguccgaucgccga

SEQ ID NO: 1267834 - RNA, 15 nt, Mycobacterium tuberculosis H37Rv
caguccgaugccgga

SEQ ID NO: 1267835 - RNA, 19 nt, Mycobacterium tuberculosis H37Rv
caucaacgccggcgacggc

SEQ ID NO: 1267836 - RNA, 22 nt, Mycobacterium tuberculosis H37Rv
caucaacgacaccagaucguuc

SEQ ID NO: 1267837 - RNA, 21 nt, Mycobacterium tuberculosis H37Rv
caucaccaccgaccuggacgc

SEQ ID NO: 1267838 - RNA, 15 nt, Mycobacterium tuberculosis H37Rv
caucaccacuggacc

SEQ ID NO: 1267839 - RNA, 18 nt, Mycobacterium tuberculosis H37Rv
caucaccgacgcgucggc

SEQ ID NO: 1267840 - RNA, 12 nt, Mycobacterium tuberculosis H37Rv
caucaccgacgc

SEQ ID NO: 1267841 - RNA, 16 nt, Mycobacterium tuberculosis H37Rv
caucaccccggccuug

SEQ ID NO: 1267842 - RNA, 15 nt, Mycobacterium tuberculosis H37Rv
caucacccagcgccg

SEQ ID NO: 1267843 - RNA, 21 nt, Mycobacterium tuberculosis H37Rv
caucaccggcaugcgugccgg

SEQ ID NO: 1267844 - RNA, 12 nt, Mycobacterium tuberculosis H37Rv
cauaucggugcc

SEQ ID NO: 1267845 - RNA, 18 nt, Mycobacterium tuberculosis H37Rv
cauauccgccccagcugc

SEQ ID NO: 1267846 - RNA, 21 nt, Mycobacterium tuberculosis H37Rv
cauauagaucacugcucgucg

SEQ ID NO: 1267847 - RNA, 18 nt, Mycobacterium tuberculosis H37Rv
caucaggucgucguccug

SEQ ID NO: 1267848 - RNA, 18 nt, Mycobacterium tuberculosis H37Rv
caucagggccuuggcggg

SEQ ID NO: 1267849 - RNA, 23 nt, Mycobacterium tuberculosis H37Rv
caucagaccaaugaccgccagca

SEQ ID NO: 1267850 - RNA, 12 nt, Mycobacterium tuberculosis H37Rv
caucacucgcgc

SEQ ID NO: 1267851 - RNA, 22 nt, Mycobacterium tuberculosis H37Rv
caucaguugcacaccgaucggc

SEQ ID NO: 1267852 - RNA, 22 nt, Mycobacterium tuberculosis H37Rv
caucccgaucccggccagcucc

SEQ ID NO: 1267853 - RNA, 15 nt, Mycobacterium tuberculosis H37Rv
caucccggagccgcu

SEQ ID NO: 1267854 - RNA, 13 nt, Mycobacterium tuberculosis H37Rv
caucccggccgcu

SEQ ID NO: 1267855 - RNA, 22 nt, Mycobacterium tuberculosis H37Rv
caucccggcgcguuggguugaa

SEQ ID NO: 1267856 - RNA, 17 nt, Mycobacterium tuberculosis H37Rv
cauccgaucgccgcgaa

SEQ ID NO: 1267857 - RNA, 19 nt, Mycobacterium tuberculosis H37Rv
cauccgagcgggaacgagc

SEQ ID NO: 1267858 - RNA, 16 nt, Mycobacterium tuberculosis H37Rv
cauccgacgggauaga

SEQ ID NO: 1267859 - RNA, 16 nt, Mycobacterium tuberculosis H37Rv
cauccccuggccagca

SEQ ID NO: 1267860 - RNA, 14 nt, Mycobacterium tuberculosis H37Rv
cauccacaaucaca

SEQ ID NO: 1267861 - RNA, 13 nt, Mycobacterium tuberculosis H37Rv
cauccacaccgac

SEQ ID NO: 1267862 - RNA, 15 nt, Mycobacterium tuberculosis H37Rv
cauccacaccgaccg

SEQ ID NO: 1267863 - RNA, 20 nt, Mycobacterium tuberculosis H37Rv
cauagugaggccgaccagca

SEQ ID NO: 1267864 - RNA, 16 nt, Mycobacterium tuberculosis H37Rv
cauaguuggcgcccga

SEQ ID NO: 1267865 - RNA, 20 nt, Mycobacterium tuberculosis H37Rv
cauagggccaccgccgccug

SEQ ID NO: 1267866 - RNA, 17 nt, Mycobacterium tuberculosis H37Rv
cauaggccugcagccga

SEQ ID NO: 1267867 - RNA, 15 nt, Mycobacterium tuberculosis H37Rv
cauacgucgccucga

SEQ ID NO: 1267868 - RNA, 19 nt, Mycobacterium tuberculosis H37Rv
cauaccgaugguggugcca

SEQ ID NO: 1267869 - RNA, 17 nt, Mycobacterium tuberculosis H37Rv
cauaccgcaauggcggc

SEQ ID NO: 1267870 - RNA, 17 nt, Mycobacterium tuberculosis H37Rv
cauacccagcucgucgc

SEQ ID NO: 1267871 - RNA, 17 nt, Mycobacterium tuberculosis H37Rv
cauaaaugcgcguucga

SEQ ID NO: 1267872 - RNA, 15 nt, Mycobacterium tuberculosis H37Rv
caguugugcggccag

SEQ ID NO: 1267873 - RNA, 21 nt, Mycobacterium tuberculosis H37Rv
caguccggcguucccgccauu

SEQ ID NO: 1267874 - RNA, 19 nt, Mycobacterium tuberculosis H37Rv
cagucgcuaaagcccccga

SEQ ID NO: 1267875 - RNA, 17 nt, Mycobacterium tuberculosis H37Rv
cagucgcggcguucggc

SEQ ID NO: 1267876 - RNA, 19 nt, Mycobacterium tuberculosis H37Rv
caguggcgcccauggccac

SEQ ID NO: 1267877 - RNA, 17 nt, Mycobacterium tuberculosis H37Rv
caguggcguuacgcucg

SEQ ID NO: 1267878 - RNA, 20 nt, Mycobacterium tuberculosis H37Rv
caguggcguuacgcucggcg

SEQ ID NO: 1267879 - RNA, 21 nt, Mycobacterium tuberculosis H37Rv
cagugcgacucugcgucugcu

SEQ ID NO: 1267880 - RNA, 14 nt, Mycobacterium tuberculosis H37Rv
cagugccucggcga

SEQ ID NO: 1267881 - RNA, 20 nt, Mycobacterium tuberculosis H37Rv
caguuggcaccagccgguga

SEQ ID NO: 1267882 - RNA, 17 nt, Mycobacterium tuberculosis H37Rv
caguuccggugacggca

SEQ ID NO: 1267883 - RNA, 16 nt, Mycobacterium tuberculosis H37Rv
caguugcacaccggca

SEQ ID NO: 1267884 - RNA, 21 nt, Mycobacterium tuberculosis H37Rv
caguggucccggugaugaccg

SEQ ID NO: 1267885 - RNA, 17 nt, Mycobacterium tuberculosis H37Rv
caguuauccgguguccu

SEQ ID NO: 1267886 - RNA, 15 nt, Mycobacterium tuberculosis H37Rv
caguuccaccgcgca

SEQ ID NO: 1267887 - RNA, 14 nt, Mycobacterium tuberculosis H37Rv
caguucaccgcgcu

SEQ ID NO: 1267888 - RNA, 16 nt, Mycobacterium tuberculosis H37Rv
ccagcgcaucggccag

SEQ ID NO: 1267889 - RNA, 15 nt, Mycobacterium tuberculosis H37Rv
ccagcgcacggacca

SEQ ID NO: 1267890 - RNA, 18 nt, Mycobacterium tuberculosis H37Rv
ccagcgcacgcucggcac

SEQ ID NO: 1267891 - RNA, 15 nt, Mycobacterium tuberculosis H37Rv
ccagcgcagcagcgg

SEQ ID NO: 1267892 - RNA, 19 nt, Mycobacterium tuberculosis H37Rv
ccagcgcccgcgcggccac

SEQ ID NO: 1267893 - RNA, 20 nt, Mycobacterium tuberculosis H37Rv
ccagcgcauggacgaacgcg

SEQ ID NO: 1267894 - RNA, 19 nt, Mycobacterium tuberculosis H37Rv
ccagcgcccgucgcuggga

SEQ ID NO: 1267895 - RNA, 15 nt, Mycobacterium tuberculosis H37Rv
ccagcgcacgcucgg

SEQ ID NO: 1267896 - RNA, 15 nt, Mycobacterium tuberculosis H37Rv
ccagcgccgccggca

SEQ ID NO: 1267897 - RNA, 18 nt, Mycobacterium tuberculosis H37Rv
ccagcgccgccggcaccu

SEQ ID NO: 1267898 - RNA, 22 nt, Mycobacterium tuberculosis H37Rv
ccagcgagcccagcugcgccga

SEQ ID NO: 1267899 - RNA, 15 nt, Mycobacterium tuberculosis H37Rv
ccagcgacgcggcca

SEQ ID NO: 1267900 - RNA, 15 nt, Mycobacterium tuberculosis H37Rv
ccagcgacucggcca

SEQ ID NO: 1267901 - RNA, 16 nt, Mycobacterium tuberculosis H37Rv
ccagcgagaucagcau

SEQ ID NO: 1267902 - RNA, 16 nt, Mycobacterium tuberculosis H37Rv
ccagcgacucggccag

SEQ ID NO: 1267903 - RNA, 15 nt, Mycobacterium tuberculosis H37Rv
ccagcgacgcgguca

SEQ ID NO: 1267904 - RNA, 13 nt, Mycobacterium tuberculosis H37Rv
ccagccgaucacg

SEQ ID NO: 1267905 - RNA, 16 nt, Mycobacterium tuberculosis H37Rv
ccagccgcgagccggu

SEQ ID NO: 1267906 - RNA, 21 nt, Mycobacterium tuberculosis H37Rv
ccagcgggugaaucgacaccg

SEQ ID NO: 1267907 - RNA, 22 nt, Mycobacterium tuberculosis H37Rv
ccagcgggugaaucgacaccgc

SEQ ID NO: 1267908 - RNA, 19 nt, Mycobacterium tuberculosis H37Rv
ccagcggucagccggccau

SEQ ID NO: 1267909 - RNA, 17 nt, Mycobacterium tuberculosis H37Rv
ccagcggucggcgacca

SEQ ID NO: 1267910 - RNA, 23 nt, Mycobacterium tuberculosis H37Rv
ccagcgggcauaacccgcaccgg

SEQ ID NO: 1267911 - RNA, 17 nt, Mycobacterium tuberculosis H37Rv
ccagcgucucgaucacc

SEQ ID NO: 1267912 - RNA, 16 nt, Mycobacterium tuberculosis H37Rv
ccagcgucgcggccac

SEQ ID NO: 1267913 - RNA, 22 nt, Mycobacterium tuberculosis H37Rv
ccagcguccauggucgcgccac

SEQ ID NO: 1267914 - RNA, 16 nt, Mycobacterium tuberculosis H37Rv
ccagcgucaccucacc

SEQ ID NO: 1267915 - RNA, 15 nt, Mycobacterium tuberculosis H37Rv
ccagcgucgcaaggc

SEQ ID NO: 1267916 - RNA, 13 nt, Mycobacterium tuberculosis H37Rv
ccagcgucgccgc

SEQ ID NO: 1267917 - RNA, 15 nt, Mycobacterium tuberculosis H37Rv
ccagcgcgcgccgca

SEQ ID NO: 1267918 - RNA, 19 nt, Mycobacterium tuberculosis H37Rv
ccagcgcgcgcugagccgu

SEQ ID NO: 1267919 - RNA, 16 nt, Mycobacterium tuberculosis H37Rv
ccagcgccucggcauc

SEQ ID NO: 1267920 - RNA, 21 nt, Mycobacterium tuberculosis H37Rv
ccagcgccucggcaucgccgc

SEQ ID NO: 1267921 - RNA, 16 nt, Mycobacterium tuberculosis H37Rv
ccagcggcgugacguc

SEQ ID NO: 1267922 - RNA, 18 nt, Mycobacterium tuberculosis H37Rv
ccagcgggaugagcucgu

SEQ ID NO: 1267923 - RNA, 21 nt, Mycobacterium tuberculosis H37Rv
ccagcggcugcccaucgguga

SEQ ID NO: 1267924 - RNA, 17 nt, Mycobacterium tuberculosis H37Rv
ccagcggccaccgaggc

SEQ ID NO: 1267925 - RNA, 21 nt, Mycobacterium tuberculosis H37Rv
ccagauguaccucaucgcaga

SEQ ID NO: 1267926 - RNA, 17 nt, Mycobacterium tuberculosis H37Rv
ccagcaccucgaccgcc

SEQ ID NO: 1267927 - RNA, 18 nt, Mycobacterium tuberculosis H37Rv
ccagcacugccaucgcgg

SEQ ID NO: 1267928 - RNA, 14 nt, Mycobacterium tuberculosis H37Rv
ccagcagaccaagc

SEQ ID NO: 1267929 - RNA, 22 nt, Mycobacterium tuberculosis H37Rv
ccagcagauucucccuugccga

SEQ ID NO: 1267930 - RNA, 14 nt, Mycobacterium tuberculosis H37Rv
ccagcagagcggca

SEQ ID NO: 1267931 - RNA, 19 nt, Mycobacterium tuberculosis H37Rv
ccagcagcaccugcaccgc

SEQ ID NO: 1267932 - RNA, 10 nt, Mycobacterium tuberculosis H37Rv
ccagcagcgc

SEQ ID NO: 1267933 - RNA, 16 nt, Mycobacterium tuberculosis H37Rv
ccagcagugcgaugaa

SEQ ID NO: 1267934 - RNA, 15 nt, Mycobacterium tuberculosis H37Rv
ccagcaggcggcuga

SEQ ID NO: 1267935 - RNA, 13 nt, Mycobacterium tuberculosis H37Rv
ccagcaggccgaa

SEQ ID NO: 1267936 - RNA, 19 nt, Mycobacterium tuberculosis H37Rv
ccagcaggcccuuggcgau

SEQ ID NO: 1267937 - RNA, 18 nt, Mycobacterium tuberculosis H37Rv
ccagcagcgcgggaucug

SEQ ID NO: 1267938 - RNA, 18 nt, Mycobacterium tuberculosis H37Rv
ccagccaaaacgagcaga

SEQ ID NO: 1267939 - RNA, 17 nt, Mycobacterium tuberculosis H37Rv
ccagccaaaucagccag

SEQ ID NO: 1267940 - RNA, 15 nt, Mycobacterium tuberculosis H37Rv
ccagccagcgggcga

SEQ ID NO: 1267941 - RNA, 18 nt, Mycobacterium tuberculosis H37Rv
ccagccagcgggcgauga

SEQ ID NO: 1267942 - RNA, 15 nt, Mycobacterium tuberculosis H37Rv
ccagccauggcagcg

SEQ ID NO: 1267943 - RNA, 15 nt, Mycobacterium tuberculosis H37Rv
ccagcccggcgugca

SEQ ID NO: 1267944 - RNA, 23 nt, Mycobacterium tuberculosis H37Rv
ccagcccggucauggucagcaga

SEQ ID NO: 1267945 - RNA, 16 nt, Mycobacterium tuberculosis H37Rv
ccagcccgucaucgcg

SEQ ID NO: 1267946 - RNA, 23 nt, Mycobacterium tuberculosis H37Rv
ccagcccggccggucgagacgcu

SEQ ID NO: 1267947 - RNA, 21 nt, Mycobacterium tuberculosis H37Rv
ccagcccggcggcggucacca

SEQ ID NO: 1267948 - RNA, 17 nt, Mycobacterium tuberculosis H37Rv
ccagccccccggcgacg

SEQ ID NO: 1267949 - RNA, 16 nt, Mycobacterium tuberculosis H37Rv
ccagccccgcgcccac

SEQ ID NO: 1267950 - RNA, 19 nt, Mycobacterium tuberculosis H37Rv
ccagccccgcuggucgacc

SEQ ID NO: 1267951 - RNA, 13 nt, Mycobacterium tuberculosis H37Rv
ccagcccgcccag

SEQ ID NO: 1267952 - RNA, 17 nt, Mycobacterium tuberculosis H37Rv
ccagcccgaugaucccg

SEQ ID NO: 1267953 - RNA, 21 nt, Mycobacterium tuberculosis H37Rv
ccaccuuggcguugaccagca

SEQ ID NO: 1267954 - RNA, 22 nt, Mycobacterium tuberculosis H37Rv
ccaccuucugguccagcaccgg

SEQ ID NO: 1267955 - RNA, 23 nt, Mycobacterium tuberculosis H37Rv
ccaccuuagcgcuugccgcugag

SEQ ID NO: 1267956 - RNA, 14 nt, Mycobacterium tuberculosis H37Rv
ccaccuggaucagc

SEQ ID NO: 1267957 - RNA, 22 nt, Mycobacterium tuberculosis H37Rv
ccaccgugcgguauuugaacgc

SEQ ID NO: 1267958 - RNA, 18 nt, Mycobacterium tuberculosis H37Rv
ccaccgugccgggcgacg

SEQ ID NO: 1267959 - RNA, 15 nt, Mycobacterium tuberculosis H37Rv
ccaccguuaccgccg

SEQ ID NO: 1267960 - RNA, 20 nt, Mycobacterium tuberculosis H37Rv
ccaccguuugcgcaccgguc

SEQ ID NO: 1267961 - RNA, 13 nt, Mycobacterium tuberculosis H37Rv
ccaccucagcugc

SEQ ID NO: 1267962 - RNA, 14 nt, Mycobacterium tuberculosis H37Rv
ccaccaugaucaca

SEQ ID NO: 1267963 - RNA, 15 nt, Mycobacterium tuberculosis H37Rv
ccaccagugcaucga

SEQ ID NO: 1267964 - RNA, 23 nt, Mycobacterium tuberculosis H37Rv
ccaccaucgccucggcgcugcgc

SEQ ID NO: 1267965 - RNA, 15 nt, Mycobacterium tuberculosis H37Rv
ccaccaucaccucgc

SEQ ID NO: 1267966 - RNA, 14 nt, Mycobacterium tuberculosis H37Rv
ccaccaucacggug

SEQ ID NO: 1267967 - RNA, 19 nt, Mycobacterium tuberculosis H37Rv
ccaccgucuccggcgccac

SEQ ID NO: 1267968 - RNA, 15 nt, Mycobacterium tuberculosis H37Rv
ccaccgucugcuggc

SEQ ID NO: 1267969 - RNA, 18 nt, Mycobacterium tuberculosis H37Rv
ccaccgucucgccgcgca

SEQ ID NO: 1267970 - RNA, 14 nt, Mycobacterium tuberculosis H37Rv
ccaccgugaccgag

SEQ ID NO: 1267971 - RNA, 15 nt, Mycobacterium tuberculosis H37Rv
ccaccgugacggcca

SEQ ID NO: 1267972 - RNA, 17 nt, Mycobacterium tuberculosis H37Rv
ccacgcauaucgcuuga

SEQ ID NO: 1267973 - RNA, 17 nt, Mycobacterium tuberculosis H37Rv
ccacgcccaauguccag

SEQ ID NO: 1267974 - RNA, 18 nt, Mycobacterium tuberculosis H37Rv
ccacgccaucgagcagca

SEQ ID NO: 1267975 - RNA, 13 nt, Mycobacterium tuberculosis H37Rv
ccacgcccgacga

SEQ ID NO: 1267976 - RNA, 12 nt, Mycobacterium tuberculosis H37Rv
ccacgccgugcu

SEQ ID NO: 1267977 - RNA, 16 nt, Mycobacterium tuberculosis H37Rv
ccacgccgucgacaac

SEQ ID NO: 1267978 - RNA, 15 nt, Mycobacterium tuberculosis H37Rv
ccacgccgaccaucu

SEQ ID NO: 1267979 - RNA, 15 nt, Mycobacterium tuberculosis H37Rv
ccacgaucggcucac

SEQ ID NO: 1267980 - RNA, 13 nt, Mycobacterium tuberculosis H37Rv
ccacgaucagcag

SEQ ID NO: 1267981 - RNA, 13 nt, Mycobacterium tuberculosis H37Rv
ccacgaucggccc

SEQ ID NO: 1267982 - RNA, 15 nt, Mycobacterium tuberculosis H37Rv
ccacgaucggcccag

SEQ ID NO: 1267983 - RNA, 19 nt, Mycobacterium tuberculosis H37Rv
ccacgaugaucuugccgcg

SEQ ID NO: 1267984 - RNA, 19 nt, Mycobacterium tuberculosis H37Rv
ccacgcacaauacggucag

SEQ ID NO: 1267985 - RNA, 23 nt, Mycobacterium tuberculosis H37Rv
ccacgcaagggaauccgaacucg

SEQ ID NO: 1267986 - RNA, 13 nt, Mycobacterium tuberculosis H37Rv
ccacgcacggugg

SEQ ID NO: 1267987 - RNA, 15 nt, Mycobacterium tuberculosis H37Rv
ccacgcacucacuac

SEQ ID NO: 1267988 - RNA, 16 nt, Mycobacterium tuberculosis H37Rv
ccacgauaaggucaca

SEQ ID NO: 1267989 - RNA, 15 nt, Mycobacterium tuberculosis H37Rv
ccacgaguuggccaa

SEQ ID NO: 1267990 - RNA, 18 nt, Mycobacterium tuberculosis H37Rv
ccacgaguuggccaagca

SEQ ID NO: 1267991 - RNA, 17 nt, Mycobacterium tuberculosis H37Rv
ccacgaggcuugcggca

SEQ ID NO: 1267992 - RNA, 15 nt, Mycobacterium tuberculosis H37Rv
ccacgagucgcacgu

SEQ ID NO: 1267993 - RNA, 16 nt, Mycobacterium tuberculosis H37Rv
ccacgaucacccggau

SEQ ID NO: 1267994 - RNA, 20 nt, Mycobacterium tuberculosis H37Rv
ccacgacgucggugaacgcg

SEQ ID NO: 1267995 - RNA, 14 nt, Mycobacterium tuberculosis H37Rv
ccacgacgcgaugg

SEQ ID NO: 1267996 - RNA, 16 nt, Mycobacterium tuberculosis H37Rv
ccagacgccacugcca

SEQ ID NO: 1267997 - RNA, 19 nt, Mycobacterium tuberculosis H37Rv
ccagacgaacgaccaggcg

SEQ ID NO: 1267998 - RNA, 17 nt, Mycobacterium tuberculosis H37Rv
ccagaccgcgcgcauac

SEQ ID NO: 1267999 - RNA, 19 nt, Mycobacterium tuberculosis H37Rv
ccagacaucagugcgccgg

SEQ ID NO: 1268000 - RNA, 19 nt, Mycobacterium tuberculosis H37Rv
ccacuggauggcucgccga

SEQ ID NO: 1268001 - RNA, 24 nt, Mycobacterium tuberculosis H37Rv
ccacuggucaacgggaugccggcg

SEQ ID NO: 1268002 - RNA, 12 nt, Mycobacterium tuberculosis H37Rv
ccacuggccggu

SEQ ID NO: 1268003 - RNA, 18 nt, Mycobacterium tuberculosis H37Rv
ccagauaugcaggacucg

SEQ ID NO: 1268004 - RNA, 22 nt, Mycobacterium tuberculosis H37Rv
ccagaucgaagcgcagcaccuc

SEQ ID NO: 1268005 - RNA, 13 nt, Mycobacterium tuberculosis H37Rv
ccagaucggccaa

SEQ ID NO: 1268006 - RNA, 17 nt, Mycobacterium tuberculosis H37Rv
ccagaucggucggccaa

SEQ ID NO: 1268007 - RNA, 13 nt, Mycobacterium tuberculosis H37Rv
ccagaucggcgac

SEQ ID NO: 1268008 - RNA, 18 nt, Mycobacterium tuberculosis H37Rv
ccagaucggcgacgccgu

SEQ ID NO: 1268009 - RNA, 16 nt, Mycobacterium tuberculosis H37Rv
ccagaucgucgggcac

SEQ ID NO: 1268010 - RNA, 18 nt, Mycobacterium tuberculosis H37Rv
ccagagucgcccgcacac

SEQ ID NO: 1268011 - RNA, 17 nt, Mycobacterium tuberculosis H37Rv
ccagagucgcccgcaca

SEQ ID NO: 1268012 - RNA, 22 nt, Mycobacterium tuberculosis H37Rv
ccagaguucggccagcgugucg

SEQ ID NO: 1268013 - RNA, 16 nt, Mycobacterium tuberculosis H37Rv
ccacgucgucgcccag

SEQ ID NO: 1268014 - RNA, 15 nt, Mycobacterium tuberculosis H37Rv
ccacgucgucgccca

SEQ ID NO: 1268015 - RNA, 14 nt, Mycobacterium tuberculosis H37Rv
ccacgucgucgggg

SEQ ID NO: 1268016 - RNA, 13 nt, Mycobacterium tuberculosis H37Rv
ccacggugucgcg

SEQ ID NO: 1268017 - RNA, 17 nt, Mycobacterium tuberculosis H37Rv
ccacggugucgcgaugc

SEQ ID NO: 1268018 - RNA, 14 nt, Mycobacterium tuberculosis H37Rv
ccacggugucgucg

SEQ ID NO: 1268019 - RNA, 13 nt, Mycobacterium tuberculosis H37Rv
ccacgucgcccag

SEQ ID NO: 1268020 - RNA, 23 nt, Mycobacterium tuberculosis H37Rv
ccacgguggcgcaagugauuucg

SEQ ID NO: 1268021 - RNA, 14 nt, Mycobacterium tuberculosis H37Rv
ccacggugucccgc

SEQ ID NO: 1268022 - RNA, 21 nt, Mycobacterium tuberculosis H37Rv
ccacggucgggaccggcuugc

SEQ ID NO: 1268023 - RNA, 20 nt, Mycobacterium tuberculosis H37Rv
ccacggugcggugauauccg

SEQ ID NO: 1268024 - RNA, 14 nt, Mycobacterium tuberculosis H37Rv
ccacguugcugaug

SEQ ID NO: 1268025 - RNA, 16 nt, Mycobacterium tuberculosis H37Rv
ccacugccguugccgc

SEQ ID NO: 1268026 - RNA, 17 nt, Mycobacterium tuberculosis H37Rv
ccacggcgggcgacccg

SEQ ID NO: 1268027 - RNA, 19 nt, Mycobacterium tuberculosis H37Rv
ccacggcgggcgacccguu

SEQ ID NO: 1268028 - RNA, 13 nt, Mycobacterium tuberculosis H37Rv
ccacggcgggcga

SEQ ID NO: 1268029 - RNA, 15 nt, Mycobacterium tuberculosis H37Rv
ccacggcgucggcca

SEQ ID NO: 1268030 - RNA, 18 nt, Mycobacterium tuberculosis H37Rv
ccacggcgucggccaccc

SEQ ID NO: 1268031 - RNA, 13 nt, Mycobacterium tuberculosis H37Rv
ccacggucagcca

SEQ ID NO: 1268032 - RNA, 14 nt, Mycobacterium tuberculosis H37Rv
ccacggucgaccag

SEQ ID NO: 1268033 - RNA, 18 nt, Mycobacterium tuberculosis H37Rv
ccacgcguuucgaaccgc

SEQ ID NO: 1268034 - RNA, 15 nt, Mycobacterium tuberculosis H37Rv
ccacgcgucgguuga

SEQ ID NO: 1268035 - RNA, 17 nt, Mycobacterium tuberculosis H37Rv
ccacggcgauuccuccg

SEQ ID NO: 1268036 - RNA, 22 nt, Mycobacterium tuberculosis H37Rv
ccacgcgccgcacauugguguc

SEQ ID NO: 1268037 - RNA, 14 nt, Mycobacterium tuberculosis H37Rv
caucgggcggcacc

SEQ ID NO: 1268038 - RNA, 17 nt, Mycobacterium tuberculosis H37Rv
caucgggaccggggacg

SEQ ID NO: 1268039 - RNA, 21 nt, Mycobacterium tuberculosis H37Rv
caucggcuggccgcgccucgg

SEQ ID NO: 1268040 - RNA, 15 nt, Mycobacterium tuberculosis H37Rv
caucgggaccgggga

SEQ ID NO: 1268041 - RNA, 15 nt, Mycobacterium tuberculosis H37Rv
caucggucaaugcca

SEQ ID NO: 1268042 - RNA, 15 nt, Mycobacterium tuberculosis H37Rv
caucggugaugaguc

SEQ ID NO: 1268043 - RNA, 19 nt, Mycobacterium tuberculosis H37Rv
cauccggcggcggccagga

SEQ ID NO: 1268044 - RNA, 15 nt, Mycobacterium tuberculosis H37Rv
cauccgcgacggcgc

SEQ ID NO: 1268045 - RNA, 17 nt, Mycobacterium tuberculosis H37Rv
cauccggucucggccga

SEQ ID NO: 1268046 - RNA, 19 nt, Mycobacterium tuberculosis H37Rv
cauccgggccgcggccaca

SEQ ID NO: 1268047 - RNA, 21 nt, Mycobacterium tuberculosis H37Rv
cauccgggcaaccgaugacgc

SEQ ID NO: 1268048 - RNA, 16 nt, Mycobacterium tuberculosis H37Rv
cauccgggcgaccacc

SEQ ID NO: 1268049 - RNA, 20 nt, Mycobacterium tuberculosis H37Rv
cauccggucggucucggcga

SEQ ID NO: 1268050 - RNA, 16 nt, Mycobacterium tuberculosis H37Rv
caucgucgccgaccgu

SEQ ID NO: 1268051 - RNA, 19 nt, Mycobacterium tuberculosis H37Rv
caucgucgggucaaugcug

SEQ ID NO: 1268052 - RNA, 23 nt, Mycobacterium tuberculosis H37Rv
caucgucugguggcagcgcaccc

SEQ ID NO: 1268053 - RNA, 17 nt, Mycobacterium tuberculosis H37Rv
caucgugcccgcgucua

SEQ ID NO: 1268054 - RNA, 19 nt, Mycobacterium tuberculosis H37Rv
caucguugccgaccgucac

SEQ ID NO: 1268055 - RNA, 18 nt, Mycobacterium tuberculosis H37Rv
caucguuggccgggcacg

SEQ ID NO: 1268056 - RNA, 14 nt, Mycobacterium tuberculosis H37Rv
caucguggcgucgu

SEQ ID NO: 1268057 - RNA, 12 nt, Mycobacterium tuberculosis H37Rv
caucgugguaac

SEQ ID NO: 1268058 - RNA, 23 nt, Mycobacterium tuberculosis H37Rv
caucguggggaucgaccaugguc

SEQ ID NO: 1268059 - RNA, 17 nt, Mycobacterium tuberculosis H37Rv
caucguggggaucgacc

SEQ ID NO: 1268060 - RNA, 21 nt, Mycobacterium tuberculosis H37Rv
caucguggggaucgaccaugg

SEQ ID NO: 1268061 - RNA, 14 nt, Mycobacterium tuberculosis H37Rv
caucgguguggccc

SEQ ID NO: 1268062 - RNA, 17 nt, Mycobacterium tuberculosis H37Rv
caucgguggcgccgaac

SEQ ID NO: 1268063 - RNA, 16 nt, Mycobacterium tuberculosis H37Rv
caucgguggcccggug

SEQ ID NO: 1268064 - RNA, 20 nt, Mycobacterium tuberculosis H37Rv
caucggugccacguucgcgg

SEQ ID NO: 1268065 - RNA, 16 nt, Mycobacterium tuberculosis H37Rv
caucggucagcgccga

SEQ ID NO: 1268066 - RNA, 18 nt, Mycobacterium tuberculosis H37Rv
caucgguugaccggucga

SEQ ID NO: 1268067 - RNA, 21 nt, Mycobacterium tuberculosis H37Rv
caucgguugaccggucgacca

SEQ ID NO: 1268068 - RNA, 15 nt, Mycobacterium tuberculosis H37Rv
caucguaggccggca

SEQ ID NO: 1268069 - RNA, 17 nt, Mycobacterium tuberculosis H37Rv
caucgucaggaaccacc

SEQ ID NO: 1268070 - RNA, 14 nt, Mycobacterium tuberculosis H37Rv
caucgucgcgacga

SEQ ID NO: 1268071 - RNA, 22 nt, Mycobacterium tuberculosis H37Rv
caucgucgccaagcccaggcga

SEQ ID NO: 1268072 - RNA, 14 nt, Mycobacterium tuberculosis H37Rv
caugaaaucgauga

SEQ ID NO: 1268073 - RNA, 15 nt, Mycobacterium tuberculosis H37Rv
caugaauuuccccgg

SEQ ID NO: 1268074 - RNA, 13 nt, Mycobacterium tuberculosis H37Rv
caucuugccaccg

SEQ ID NO: 1268075 - RNA, 12 nt, Mycobacterium tuberculosis H37Rv
caucuugccacc

SEQ ID NO: 1268076 - RNA, 17 nt, Mycobacterium tuberculosis H37Rv
caucuuuggcggccgca

SEQ ID NO: 1268077 - RNA, 22 nt, Mycobacterium tuberculosis H37Rv
caucugguauggguccucgagc

SEQ ID NO: 1268078 - RNA, 14 nt, Mycobacterium tuberculosis H37Rv
caucuggucgacca

SEQ ID NO: 1268079 - RNA, 19 nt, Mycobacterium tuberculosis H37Rv
caucuggucgaccaucggu

SEQ ID NO: 1268080 - RNA, 20 nt, Mycobacterium tuberculosis H37Rv
caucugggguccggugacga

SEQ ID NO: 1268081 - RNA, 16 nt, Mycobacterium tuberculosis H37Rv
caucugauccgguguc

SEQ ID NO: 1268082 - RNA, 23 nt, Mycobacterium tuberculosis H37Rv
caucugaucgggcccguccugcg

SEQ ID NO: 1268083 - RNA, 19 nt, Mycobacterium tuberculosis H37Rv
caucucuugcaaccuggac

SEQ ID NO: 1268084 - RNA, 13 nt, Mycobacterium tuberculosis H37Rv
caucugcgggacg

SEQ ID NO: 1268085 - RNA, 21 nt, Mycobacterium tuberculosis H37Rv
caucuaccagcucacccugcu

SEQ ID NO: 1268086 - RNA, 23 nt, Mycobacterium tuberculosis H37Rv
caucuaggccucagaaccggguc

SEQ ID NO: 1268087 - RNA, 14 nt, Mycobacterium tuberculosis H37Rv
caucuccaccgucg

SEQ ID NO: 1268088 - RNA, 16 nt, Mycobacterium tuberculosis H37Rv
caucucccgaccgccg

SEQ ID NO: 1268089 - RNA, 15 nt, Mycobacterium tuberculosis H37Rv
caucucgacggugac

SEQ ID NO: 1268090 - RNA, 17 nt, Mycobacterium tuberculosis H37Rv
caucucgacgucgguga

SEQ ID NO: 1268091 - RNA, 14 nt, Mycobacterium tuberculosis H37Rv
caucucggaccaca

SEQ ID NO: 1268092 - RNA, 21 nt, Mycobacterium tuberculosis H37Rv
caugauccccguugacccaga

SEQ ID NO: 1268093 - RNA, 22 nt, Mycobacterium tuberculosis H37Rv
caugcacguugccgaacgucgc

SEQ ID NO: 1268094 - RNA, 19 nt, Mycobacterium tuberculosis H37Rv
caugaguggcaaucccgcc

SEQ ID NO: 1268095 - RNA, 17 nt, Mycobacterium tuberculosis H37Rv
caugaccgggcuggcca

SEQ ID NO: 1268096 - RNA, 20 nt, Mycobacterium tuberculosis H37Rv
caugcccucgcuguuggccg

SEQ ID NO: 1268097 - RNA, 22 nt, Mycobacterium tuberculosis H37Rv
caugcccucgcuguuggccggu

SEQ ID NO: 1268098 - RNA, 21 nt, Mycobacterium tuberculosis H37Rv
caugcaucugaucaggccaca

SEQ ID NO: 1268099 - RNA, 14 nt, Mycobacterium tuberculosis H37Rv
caugccgagcgacc

SEQ ID NO: 1268100 - RNA, 23 nt, Mycobacterium tuberculosis H37Rv
caugccggucauccgggcgacca

SEQ ID NO: 1268101 - RNA, 14 nt, Mycobacterium tuberculosis H37Rv
caugccggucaucc

SEQ ID NO: 1268102 - RNA, 18 nt, Mycobacterium tuberculosis H37Rv
caugccgucgucggcgua

SEQ ID NO: 1268103 - RNA, 22 nt, Mycobacterium tuberculosis H37Rv
cauggcguucugcgcccguccg

SEQ ID NO: 1268104 - RNA, 14 nt, Mycobacterium tuberculosis H37Rv
cauggcccuggcga

SEQ ID NO: 1268105 - RNA, 20 nt, Mycobacterium tuberculosis H37Rv
cauggcccguuggcagcaca

SEQ ID NO: 1268106 - RNA, 20 nt, Mycobacterium tuberculosis H37Rv
cauggcccgaucgaccgcug

SEQ ID NO: 1268107 - RNA, 23 nt, Mycobacterium tuberculosis H37Rv
cauggcggcagcaacgacgucgu

SEQ ID NO: 1268108 - RNA, 23 nt, Mycobacterium tuberculosis H37Rv
cauggccgccguuggcaccgggu

SEQ ID NO: 1268109 - RNA, 22 nt, Mycobacterium tuberculosis H37Rv
caugcuggggagggccgucuug

SEQ ID NO: 1268110 - RNA, 16 nt, Mycobacterium tuberculosis H37Rv
caugcgacagaugccg

SEQ ID NO: 1268111 - RNA, 20 nt, Mycobacterium tuberculosis H37Rv
cauggacgccauggugaacg

SEQ ID NO: 1268112 - RNA, 12 nt, Mycobacterium tuberculosis H37Rv
cauggcauuccg

SEQ ID NO: 1268113 - RNA, 20 nt, Mycobacterium tuberculosis H37Rv
cauggauguaggcuucgccg

SEQ ID NO: 1268114 - RNA, 21 nt, Mycobacterium tuberculosis H37Rv
ccaccagugccccgccgagcg

SEQ ID NO: 1268115 - RNA, 21 nt, Mycobacterium tuberculosis H37Rv
ccaccaguuccgggguggacg

SEQ ID NO: 1268116 - RNA, 19 nt, Mycobacterium tuberculosis H37Rv
ccaccaagguguggccuug

SEQ ID NO: 1268117 - RNA, 17 nt, Mycobacterium tuberculosis H37Rv
ccaccagaaacaccgac

SEQ ID NO: 1268118 - RNA, 21 nt, Mycobacterium tuberculosis H37Rv
ccaccacuaggucgccggcca

SEQ ID NO: 1268119 - RNA, 12 nt, Mycobacterium tuberculosis H37Rv
ccaccagaaucc

SEQ ID NO: 1268120 - RNA, 21 nt, Mycobacterium tuberculosis H37Rv
ccaccagacaacgccgucgau

SEQ ID NO: 1268121 - RNA, 16 nt, Mycobacterium tuberculosis H37Rv
ccacaucccacggugg

SEQ ID NO: 1268122 - RNA, 17 nt, Mycobacterium tuberculosis H37Rv
ccacaucaaaacggcgg

SEQ ID NO: 1268123 - RNA, 18 nt, Mycobacterium tuberculosis H37Rv
ccacaucaggucggcgaa

SEQ ID NO: 1268124 - RNA, 12 nt, Mycobacterium tuberculosis H37Rv
ccacaucggugu

SEQ ID NO: 1268125 - RNA, 18 nt, Mycobacterium tuberculosis H37Rv
ccacaccuuggcggucgg

SEQ ID NO: 1268126 - RNA, 22 nt, Mycobacterium tuberculosis H37Rv
ccacacgaagugggucaagauc

SEQ ID NO: 1268127 - RNA, 21 nt, Mycobacterium tuberculosis H37Rv
ccacaccgugggcgacggcgg

SEQ ID NO: 1268128 - RNA, 14 nt, Mycobacterium tuberculosis H37Rv
ccacaccgugacca

SEQ ID NO: 1268129 - RNA, 20 nt, Mycobacterium tuberculosis H37Rv
ccaacgcgcaggccgacacg

SEQ ID NO: 1268130 - RNA, 16 nt, Mycobacterium tuberculosis H37Rv
ccaacgcgcgaccgcg

SEQ ID NO: 1268131 - RNA, 19 nt, Mycobacterium tuberculosis H37Rv
ccaacgcgggugccgggca

SEQ ID NO: 1268132 - RNA, 15 nt, Mycobacterium tuberculosis H37Rv
ccaacgcggugacga

SEQ ID NO: 1268133 - RNA, 16 nt, Mycobacterium tuberculosis H37Rv
ccaacgcggugacgau

SEQ ID NO: 1268134 - RNA, 21 nt, Mycobacterium tuberculosis H37Rv
ccaacgcgucccgccgcaccg

SEQ ID NO: 1268135 - RNA, 22 nt, Mycobacterium tuberculosis H37Rv
ccaacgcgucccgccgcaccgc

SEQ ID NO: 1268136 - RNA, 23 nt, Mycobacterium tuberculosis H37Rv
ccaacgcuucugccugcgcacga

SEQ ID NO: 1268137 - RNA, 18 nt, Mycobacterium tuberculosis H37Rv
ccaacgcagaucagggug

SEQ ID NO: 1268138 - RNA, 19 nt, Mycobacterium tuberculosis H37Rv
ccaacgagaugugagcaca

SEQ ID NO: 1268139 - RNA, 13 nt, Mycobacterium tuberculosis H37Rv
ccaacgccaccgu

SEQ ID NO: 1268140 - RNA, 13 nt, Mycobacterium tuberculosis H37Rv
ccaacgcgaccgc

SEQ ID NO: 1268141 - RNA, 22 nt, Mycobacterium tuberculosis H37Rv
ccaacgccuugacugaacucaa

SEQ ID NO: 1268142 - RNA, 12 nt, Mycobacterium tuberculosis H37Rv
ccaacucggccc

SEQ ID NO: 1268143 - RNA, 13 nt, Mycobacterium tuberculosis H37Rv
ccaacucggcgac

SEQ ID NO: 1268144 - RNA, 14 nt, Mycobacterium tuberculosis H37Rv
ccaacugaucccgu

SEQ ID NO: 1268145 - RNA, 23 nt, Mycobacterium tuberculosis H37Rv
ccaacgucgccaggucaucggug

SEQ ID NO: 1268146 - RNA, 20 nt, Mycobacterium tuberculosis H37Rv
ccaacgucgacuucagcggc

SEQ ID NO: 1268147 - RNA, 19 nt, Mycobacterium tuberculosis H37Rv
ccaagugagcgaucgggug

SEQ ID NO: 1268148 - RNA, 19 nt, Mycobacterium tuberculosis H37Rv
ccaagcgagcggucgacgu

SEQ ID NO: 1268149 - RNA, 19 nt, Mycobacterium tuberculosis H37Rv
ccaagcgacucgccggcga

SEQ ID NO: 1268150 - RNA, 22 nt, Mycobacterium tuberculosis H37Rv
ccaagccgcggcuaggccagca

SEQ ID NO: 1268151 - RNA, 16 nt, Mycobacterium tuberculosis H37Rv
ccaagccggccacgca

SEQ ID NO: 1268152 - RNA, 13 nt, Mycobacterium tuberculosis H37Rv
ccaagcgcggugg

SEQ ID NO: 1268153 - RNA, 18 nt, Mycobacterium tuberculosis H37Rv
ccaagcgcgguggucgcg

SEQ ID NO: 1268154 - RNA, 14 nt, Mycobacterium tuberculosis H37Rv
ccaagguguccagc

SEQ ID NO: 1268155 - RNA, 17 nt, Mycobacterium tuberculosis H37Rv
ccaagguuggucggugc

SEQ ID NO: 1268156 - RNA, 15 nt, Mycobacterium tuberculosis H37Rv
ccaagcgugccugca

SEQ ID NO: 1268157 - RNA, 23 nt, Mycobacterium tuberculosis H37Rv
ccaacuucugcacgaacgccugc

SEQ ID NO: 1268158 - RNA, 14 nt, Mycobacterium tuberculosis H37Rv
ccaacuggucgcca

SEQ ID NO: 1268159 - RNA, 19 nt, Mycobacterium tuberculosis H37Rv
ccaacugcgccguucgcuc

SEQ ID NO: 1268160 - RNA, 18 nt, Mycobacterium tuberculosis H37Rv
ccaagccauguggcgucg

SEQ ID NO: 1268161 - RNA, 19 nt, Mycobacterium tuberculosis H37Rv
ccaagcccgccggacccgc

SEQ ID NO: 1268162 - RNA, 23 nt, Mycobacterium tuberculosis H37Rv
ccaagccguaguaguggccgcca

SEQ ID NO: 1268163 - RNA, 21 nt, Mycobacterium tuberculosis H37Rv
ccaagccgugccgcacagcgg

SEQ ID NO: 1268164 - RNA, 12 nt, Mycobacterium tuberculosis H37Rv
ccaagacaccgg

SEQ ID NO: 1268165 - RNA, 16 nt, Mycobacterium tuberculosis H37Rv
cauguccguccgcgac

SEQ ID NO: 1268166 - RNA, 20 nt, Mycobacterium tuberculosis H37Rv
caugucgccgaacgccacca

SEQ ID NO: 1268167 - RNA, 15 nt, Mycobacterium tuberculosis H37Rv
cauucaucuugcggc

SEQ ID NO: 1268168 - RNA, 20 nt, Mycobacterium tuberculosis H37Rv
cauucguugaugaugcccaa

SEQ ID NO: 1268169 - RNA, 13 nt, Mycobacterium tuberculosis H37Rv
cauucccagaggc

SEQ ID NO: 1268170 - RNA, 13 nt, Mycobacterium tuberculosis H37Rv
cauuccagcaggc

SEQ ID NO: 1268171 - RNA, 22 nt, Mycobacterium tuberculosis H37Rv
cauugccugggcgaccggcucg

SEQ ID NO: 1268172 - RNA, 20 nt, Mycobacterium tuberculosis H37Rv
cauugccgacgcgcggccag

SEQ ID NO: 1268173 - RNA, 21 nt, Mycobacterium tuberculosis H37Rv
cauugccguucucgucgagga

SEQ ID NO: 1268174 - RNA, 18 nt, Mycobacterium tuberculosis H37Rv
cauugccguucucgucga

SEQ ID NO: 1268175 - RNA, 15 nt, Mycobacterium tuberculosis H37Rv
cauugccgaugguca

SEQ ID NO: 1268176 - RNA, 11 nt, Mycobacterium tuberculosis H37Rv
cauugcccuug

SEQ ID NO: 1268177 - RNA, 12 nt, Mycobacterium tuberculosis H37Rv
cauucugcugcc

SEQ ID NO: 1268178 - RNA, 13 nt, Mycobacterium tuberculosis H37Rv
cauugugcucgcc

SEQ ID NO: 1268179 - RNA, 22 nt, Mycobacterium tuberculosis H37Rv
ccaaaccggagucgucggcaac

SEQ ID NO: 1268180 - RNA, 16 nt, Mycobacterium tuberculosis H37Rv
ccaacccgggccgcca

SEQ ID NO: 1268181 - RNA, 21 nt, Mycobacterium tuberculosis H37Rv
ccaacccuaaaccagccacca

SEQ ID NO: 1268182 - RNA, 22 nt, Mycobacterium tuberculosis H37Rv
ccaacccucgccggucagcgug

SEQ ID NO: 1268183 - RNA, 12 nt, Mycobacterium tuberculosis H37Rv
ccaacccucgcc

SEQ ID NO: 1268184 - RNA, 17 nt, Mycobacterium tuberculosis H37Rv
ccaaccgguucgucgaa

SEQ ID NO: 1268185 - RNA, 15 nt, Mycobacterium tuberculosis H37Rv
ccaaaucccagagca

SEQ ID NO: 1268186 - RNA, 21 nt, Mycobacterium tuberculosis H37Rv
ccaaaggacgacaccgcgaau

SEQ ID NO: 1268187 - RNA, 19 nt, Mycobacterium tuberculosis H37Rv
ccaaagccgggauugccgc

SEQ ID NO: 1268188 - RNA, 15 nt, Mycobacterium tuberculosis H37Rv
ccaaagcgacgagca

SEQ ID NO: 1268189 - RNA, 20 nt, Mycobacterium tuberculosis H37Rv
cccguagaacaguucgacau

SEQ ID NO: 1268190 - RNA, 14 nt, Mycobacterium tuberculosis H37Rv
cccguagccgugcc

SEQ ID NO: 1268191 - RNA, 21 nt, Mycobacterium tuberculosis H37Rv
cccguagcaccacaucggugc

SEQ ID NO: 1268192 - RNA, 18 nt, Mycobacterium tuberculosis H37Rv
cccguagcgucgaucacg

SEQ ID NO: 1268193 - RNA, 18 nt, Mycobacterium tuberculosis H37Rv
cccgguuggaccacguga

SEQ ID NO: 1268194 - RNA, 21 nt, Mycobacterium tuberculosis H37Rv
cccgguugacgccgguccccg

SEQ ID NO: 1268195 - RNA, 20 nt, Mycobacterium tuberculosis H37Rv
cccggugcccgcggugacga

SEQ ID NO: 1268196 - RNA, 18 nt, Mycobacterium tuberculosis H37Rv
cccgguugacgccggucc

SEQ ID NO: 1268197 - RNA, 15 nt, Mycobacterium tuberculosis H37Rv
cccggucgauucggc

SEQ ID NO: 1268198 - RNA, 16 nt, Mycobacterium tuberculosis H37Rv
cccggugaccagcaac

SEQ ID NO: 1268199 - RNA, 19 nt, Mycobacterium tuberculosis H37Rv
cccggugaguccggagacu

SEQ ID NO: 1268200 - RNA, 22 nt, Mycobacterium tuberculosis H37Rv
cccggucggagcggugccgacg

SEQ ID NO: 1268201 - RNA, 18 nt, Mycobacterium tuberculosis H37Rv
cccggucuacgacgucgc

SEQ ID NO: 1268202 - RNA, 17 nt, Mycobacterium tuberculosis H37Rv
cccggucuacgccaccg

SEQ ID NO: 1268203 - RNA, 12 nt, Mycobacterium tuberculosis H37Rv
cccgggucccau

SEQ ID NO: 1268204 - RNA, 15 nt, Mycobacterium tuberculosis H37Rv
cccggguaucgccag

SEQ ID NO: 1268205 - RNA, 19 nt, Mycobacterium tuberculosis H37Rv
cccggggcgcucgcgcgcu

SEQ ID NO: 1268206 - RNA, 16 nt, Mycobacterium tuberculosis H37Rv
cccggggcgcucgcgc

SEQ ID NO: 1268207 - RNA, 15 nt, Mycobacterium tuberculosis H37Rv
cccguauggcggcuc

SEQ ID NO: 1268208 - RNA, 16 nt, Mycobacterium tuberculosis H37Rv
cccguauuucaccgaa

SEQ ID NO: 1268209 - RNA, 22 nt, Mycobacterium tuberculosis H37Rv
cccgucacgcccgcgaaccgcg

SEQ ID NO: 1268210 - RNA, 16 nt, Mycobacterium tuberculosis H37Rv
cccgucgaacgcgcgc

SEQ ID NO: 1268211 - RNA, 23 nt, Mycobacterium tuberculosis H37Rv
cccguccugcggguaggugacga

SEQ ID NO: 1268212 - RNA, 22 nt, Mycobacterium tuberculosis H37Rv
cccgucccagcugaccagcguc

SEQ ID NO: 1268213 - RNA, 19 nt, Mycobacterium tuberculosis H37Rv
cccgucauacucgacaccg

SEQ ID NO: 1268214 - RNA, 12 nt, Mycobacterium tuberculosis H37Rv
cccgucggcgcc

SEQ ID NO: 1268215 - RNA, 13 nt, Mycobacterium tuberculosis H37Rv
cccgucgugaccg

SEQ ID NO: 1268216 - RNA, 12 nt, Mycobacterium tuberculosis H37Rv
cccgucgagccg

SEQ ID NO: 1268217 - RNA, 15 nt, Mycobacterium tuberculosis H37Rv
cccggcugccagcgc

SEQ ID NO: 1268218 - RNA, 22 nt, Mycobacterium tuberculosis H37Rv
cccggcgcuagcgccgcgcuug

SEQ ID NO: 1268219 - RNA, 22 nt, Mycobacterium tuberculosis H37Rv
cccggcugcgcuucgaccgagu

SEQ ID NO: 1268220 - RNA, 14 nt, Mycobacterium tuberculosis H37Rv
cccggggcgcucgc

SEQ ID NO: 1268221 - RNA, 13 nt, Mycobacterium tuberculosis H37Rv
cccggggagacga

SEQ ID NO: 1268222 - RNA, 13 nt, Mycobacterium tuberculosis H37Rv
cccggggacgggu

SEQ ID NO: 1268223 - RNA, 17 nt, Mycobacterium tuberculosis H37Rv
cccgggcccgcgggauc

SEQ ID NO: 1268224 - RNA, 13 nt, Mycobacterium tuberculosis H37Rv
cccgggaugcucc

SEQ ID NO: 1268225 - RNA, 18 nt, Mycobacterium tuberculosis H37Rv
cccgggaucuagaugcgg

SEQ ID NO: 1268226 - RNA, 14 nt, Mycobacterium tuberculosis H37Rv
cccgggcagccgca

SEQ ID NO: 1268227 - RNA, 15 nt, Mycobacterium tuberculosis H37Rv
cccggaggcaauccg

SEQ ID NO: 1268228 - RNA, 16 nt, Mycobacterium tuberculosis H37Rv
cccggagcggucagcg

SEQ ID NO: 1268229 - RNA, 12 nt, Mycobacterium tuberculosis H37Rv
cccggagccaga

SEQ ID NO: 1268230 - RNA, 18 nt, Mycobacterium tuberculosis H37Rv
cccggauaucgaccaccg

SEQ ID NO: 1268231 - RNA, 15 nt, Mycobacterium tuberculosis H37Rv
cccggauagacggcg

SEQ ID NO: 1268232 - RNA, 22 nt, Mycobacterium tuberculosis H37Rv
cccggcgcaagcgccgcgcuug

SEQ ID NO: 1268233 - RNA, 12 nt, Mycobacterium tuberculosis H37Rv
cccggacgucgg

SEQ ID NO: 1268234 - RNA, 17 nt, Mycobacterium tuberculosis H37Rv
cccgcuuggcgugaccu

SEQ ID NO: 1268235 - RNA, 20 nt, Mycobacterium tuberculosis H37Rv
cccgcuucgcccggcugcgc

SEQ ID NO: 1268236 - RNA, 12 nt, Mycobacterium tuberculosis H37Rv
cccgcuucgccc

SEQ ID NO: 1268237 - RNA, 20 nt, Mycobacterium tuberculosis H37Rv
cccggaaagaucucggucac

SEQ ID NO: 1268238 - RNA, 23 nt, Mycobacterium tuberculosis H37Rv
cccggcgccgcgggugcggcaug

SEQ ID NO: 1268239 - RNA, 16 nt, Mycobacterium tuberculosis H37Rv
cccggcgcggccagcu

SEQ ID NO: 1268240 - RNA, 16 nt, Mycobacterium tuberculosis H37Rv
cccucguccugcgaga

SEQ ID NO: 1268241 - RNA, 19 nt, Mycobacterium tuberculosis H37Rv
cccucguuaucgaccgccg

SEQ ID NO: 1268242 - RNA, 22 nt, Mycobacterium tuberculosis H37Rv
cccucggugagaaucgacuccg

SEQ ID NO: 1268243 - RNA, 22 nt, Mycobacterium tuberculosis H37Rv
cccucugguggcgcugaagccg

SEQ ID NO: 1268244 - RNA, 20 nt, Mycobacterium tuberculosis H37Rv
cccucuugucuagcggucgc

SEQ ID NO: 1268245 - RNA, 22 nt, Mycobacterium tuberculosis H37Rv
cccugcccgaaggugggauuga

SEQ ID NO: 1268246 - RNA, 21 nt, Mycobacterium tuberculosis H37Rv
cccugcggccacgguggcgca

SEQ ID NO: 1268247 - RNA, 17 nt, Mycobacterium tuberculosis H37Rv
cccuggacuucgggggc

SEQ ID NO: 1268248 - RNA, 13 nt, Mycobacterium tuberculosis H37Rv
cccugcggaucgg

SEQ ID NO: 1268249 - RNA, 16 nt, Mycobacterium tuberculosis H37Rv
cccgucucguugacca

SEQ ID NO: 1268250 - RNA, 15 nt, Mycobacterium tuberculosis H37Rv
cccgugcacgaucgc

SEQ ID NO: 1268251 - RNA, 17 nt, Mycobacterium tuberculosis H37Rv
cccgugcacgaucgcgg

SEQ ID NO: 1268252 - RNA, 13 nt, Mycobacterium tuberculosis H37Rv
cccgugcaggauc

SEQ ID NO: 1268253 - RNA, 14 nt, Mycobacterium tuberculosis H37Rv
cccgugcacgaucg

SEQ ID NO: 1268254 - RNA, 12 nt, Mycobacterium tuberculosis H37Rv
cccgugccgucg

SEQ ID NO: 1268255 - RNA, 21 nt, Mycobacterium tuberculosis H37Rv
cccgugccuggccggugcgca

SEQ ID NO: 1268256 - RNA, 20 nt, Mycobacterium tuberculosis H37Rv
cccgugggccucgaucagcg

SEQ ID NO: 1268257 - RNA, 14 nt, Mycobacterium tuberculosis H37Rv
cccgugcgcgcgca

SEQ ID NO: 1268258 - RNA, 12 nt, Mycobacterium tuberculosis H37Rv
cccuccucgaug

SEQ ID NO: 1268259 - RNA, 19 nt, Mycobacterium tuberculosis H37Rv
cccuccgcgccgaucagcg

SEQ ID NO: 1268260 - RNA, 16 nt, Mycobacterium tuberculosis H37Rv
cccuccgcgccgauca

SEQ ID NO: 1268261 - RNA, 16 nt, Mycobacterium tuberculosis H37Rv
cccguuccacgccggc

SEQ ID NO: 1268262 - RNA, 18 nt, Mycobacterium tuberculosis H37Rv
cccguguuaaagaagccu

SEQ ID NO: 1268263 - RNA, 18 nt, Mycobacterium tuberculosis H37Rv
cccguguugaagaagccc

SEQ ID NO: 1268264 - RNA, 14 nt, Mycobacterium tuberculosis H37Rv
ccgaaaaucgcagc

SEQ ID NO: 1268265 - RNA, 14 nt, Mycobacterium tuberculosis H37Rv
ccgaaaaugccgcc

SEQ ID NO: 1268266 - RNA, 14 nt, Mycobacterium tuberculosis H37Rv
cccugucgcgcacc

SEQ ID NO: 1268267 - RNA, 21 nt, Mycobacterium tuberculosis H37Rv
ccgaaaugccgggcccgacgu

SEQ ID NO: 1268268 - RNA, 23 nt, Mycobacterium tuberculosis H37Rv
ccgaaaccaugccgccgaagccg

SEQ ID NO: 1268269 - RNA, 21 nt, Mycobacterium tuberculosis H37Rv
ccgaaacgcgcggaucgucga

SEQ ID NO: 1268270 - RNA, 13 nt, Mycobacterium tuberculosis H37Rv
ccgaaacgccgac

SEQ ID NO: 1268271 - RNA, 17 nt, Mycobacterium tuberculosis H37Rv
cccuggcgaccagccga

SEQ ID NO: 1268272 - RNA, 16 nt, Mycobacterium tuberculosis H37Rv
cccuggcgaccagccg

SEQ ID NO: 1268273 - RNA, 21 nt, Mycobacterium tuberculosis H37Rv
cccugggguugcaucaugccg

SEQ ID NO: 1268274 - RNA, 15 nt, Mycobacterium tuberculosis H37Rv
ccgaacccggcggac

SEQ ID NO: 1268275 - RNA, 18 nt, Mycobacterium tuberculosis H37Rv
ccgaacccgccaccgcga

SEQ ID NO: 1268276 - RNA, 15 nt, Mycobacterium tuberculosis H37Rv
ccgaaccccgaccgc

SEQ ID NO: 1268277 - RNA, 15 nt, Mycobacterium tuberculosis H37Rv
ccgaaccaccgcguu

SEQ ID NO: 1268278 - RNA, 16 nt, Mycobacterium tuberculosis H37Rv
ccgaagccccgauuga

SEQ ID NO: 1268279 - RNA, 17 nt, Mycobacterium tuberculosis H37Rv
ccgaacgcaacgccgau

SEQ ID NO: 1268280 - RNA, 16 nt, Mycobacterium tuberculosis H37Rv
ccgaaccgucagcggc

SEQ ID NO: 1268281 - RNA, 17 nt, Mycobacterium tuberculosis H37Rv
ccgaauccaucgagacc

SEQ ID NO: 1268282 - RNA, 16 nt, Mycobacterium tuberculosis H37Rv
ccgaaucgcgggcuga

SEQ ID NO: 1268283 - RNA, 21 nt, Mycobacterium tuberculosis H37Rv
ccgaagcagaacaguaucgcc

SEQ ID NO: 1268284 - RNA, 14 nt, Mycobacterium tuberculosis H37Rv
ccgaagcgaugccg

SEQ ID NO: 1268285 - RNA, 21 nt, Mycobacterium tuberculosis H37Rv
ccgaaguugcgucgacgcguu

SEQ ID NO: 1268286 - RNA, 18 nt, Mycobacterium tuberculosis H37Rv
ccgaaguuuuggaagccc

SEQ ID NO: 1268287 - RNA, 15 nt, Mycobacterium tuberculosis H37Rv
cccgccggcagugag

SEQ ID NO: 1268288 - RNA, 15 nt, Mycobacterium tuberculosis H37Rv
cccgcgacaucggga

SEQ ID NO: 1268289 - RNA, 17 nt, Mycobacterium tuberculosis H37Rv
cccgccgggcuccacgu

SEQ ID NO: 1268290 - RNA, 13 nt, Mycobacterium tuberculosis H37Rv
cccgccggcgggu

SEQ ID NO: 1268291 - RNA, 13 nt, Mycobacterium tuberculosis H37Rv
cccgccgucaccg

SEQ ID NO: 1268292 - RNA, 22 nt, Mycobacterium tuberculosis H37Rv
cccgccggcacauugaucgacg

SEQ ID NO: 1268293 - RNA, 21 nt, Mycobacterium tuberculosis H37Rv
cccgccggccucuggaucacg

SEQ ID NO: 1268294 - RNA, 19 nt, Mycobacterium tuberculosis H37Rv
cccgcccgagccgcugcga

SEQ ID NO: 1268295 - RNA, 14 nt, Mycobacterium tuberculosis H37Rv
cccgcugggucgac

SEQ ID NO: 1268296 - RNA, 15 nt, Mycobacterium tuberculosis H37Rv
cccgcuggcgguaag

SEQ ID NO: 1268297 - RNA, 14 nt, Mycobacterium tuberculosis H37Rv
cccgcucgaugucg

SEQ ID NO: 1268298 - RNA, 21 nt, Mycobacterium tuberculosis H37Rv
cccgcgcguacccgaucagcg

SEQ ID NO: 1268299 - RNA, 20 nt, Mycobacterium tuberculosis H37Rv
cccgcgcgggcggaucgccg

SEQ ID NO: 1268300 - RNA, 13 nt, Mycobacterium tuberculosis H37Rv
cccgcgcgucgcc

SEQ ID NO: 1268301 - RNA, 16 nt, Mycobacterium tuberculosis H37Rv
cccgcgcgucgcccag

SEQ ID NO: 1268302 - RNA, 13 nt, Mycobacterium tuberculosis H37Rv
cccgcggugacga

SEQ ID NO: 1268303 - RNA, 24 nt, Mycobacterium tuberculosis H37Rv
cccgcggugugcacgucacgcgga

SEQ ID NO: 1268304 - RNA, 22 nt, Mycobacterium tuberculosis H37Rv
cccgagugaccaggguggcauc

SEQ ID NO: 1268305 - RNA, 20 nt, Mycobacterium tuberculosis H37Rv
cccgaugaucccgccaccga

SEQ ID NO: 1268306 - RNA, 14 nt, Mycobacterium tuberculosis H37Rv
cccgaugaccgccu

SEQ ID NO: 1268307 - RNA, 22 nt, Mycobacterium tuberculosis H37Rv
cccgaugccgugcccggugcgg

SEQ ID NO: 1268308 - RNA, 17 nt, Mycobacterium tuberculosis H37Rv
cccgaucugcuccucgg

SEQ ID NO: 1268309 - RNA, 14 nt, Mycobacterium tuberculosis H37Rv
cccgauagcgaccg

SEQ ID NO: 1268310 - RNA, 17 nt, Mycobacterium tuberculosis H37Rv
cccgaugguggugccga

SEQ ID NO: 1268311 - RNA, 16 nt, Mycobacterium tuberculosis H37Rv
cccgauggugccgacc

SEQ ID NO: 1268312 - RNA, 14 nt, Mycobacterium tuberculosis H37Rv
cccgauggugccga

SEQ ID NO: 1268313 - RNA, 20 nt, Mycobacterium tuberculosis H37Rv
cccgaugguggugccgaccu

SEQ ID NO: 1268314 - RNA, 18 nt, Mycobacterium tuberculosis H37Rv
cccgcaaaaucgucagcg

SEQ ID NO: 1268315 - RNA, 20 nt, Mycobacterium tuberculosis H37Rv
cccgcaacgccaacacgcgu

SEQ ID NO: 1268316 - RNA, 22 nt, Mycobacterium tuberculosis H37Rv
cccgcauaccguucacccagcg

SEQ ID NO: 1268317 - RNA, 15 nt, Mycobacterium tuberculosis H37Rv
cccgcaaugcgagcg

SEQ ID NO: 1268318 - RNA, 14 nt, Mycobacterium tuberculosis H37Rv
cccgcaagcggaug

SEQ ID NO: 1268319 - RNA, 15 nt, Mycobacterium tuberculosis H37Rv
cccgcaaugaccgcg

SEQ ID NO: 1268320 - RNA, 14 nt, Mycobacterium tuberculosis H37Rv
cccgcaagucgaga

SEQ ID NO: 1268321 - RNA, 19 nt, Mycobacterium tuberculosis H37Rv
cccgcagguagucgucgac

SEQ ID NO: 1268322 - RNA, 20 nt, Mycobacterium tuberculosis H37Rv
cccgcaauggggcgcaaugg

SEQ ID NO: 1268323 - RNA, 12 nt, Mycobacterium tuberculosis H37Rv
cccgcauugcca

SEQ ID NO: 1268324 - RNA, 18 nt, Mycobacterium tuberculosis H37Rv
cccgcauugccgucgggg

SEQ ID NO: 1268325 - RNA, 18 nt, Mycobacterium tuberculosis H37Rv
cccgcauugaucucgacc

SEQ ID NO: 1268326 - RNA, 17 nt, Mycobacterium tuberculosis H37Rv
cccgcauugacgaaacc

SEQ ID NO: 1268327 - RNA, 22 nt, Mycobacterium tuberculosis H37Rv
cccgcaucguugccgaccguca

SEQ ID NO: 1268328 - RNA, 14 nt, Mycobacterium tuberculosis H37Rv
cccgcaucgcccaa

SEQ ID NO: 1268329 - RNA, 15 nt, Mycobacterium tuberculosis H37Rv
cccgcaucgcaccag

SEQ ID NO: 1268330 - RNA, 19 nt, Mycobacterium tuberculosis H37Rv
cccgccaccggguucaccg

SEQ ID NO: 1268331 - RNA, 19 nt, Mycobacterium tuberculosis H37Rv
cccgccacgaugucgucga

SEQ ID NO: 1268332 - RNA, 22 nt, Mycobacterium tuberculosis H37Rv
cccgccacaaccaccggaucgg

SEQ ID NO: 1268333 - RNA, 16 nt, Mycobacterium tuberculosis H37Rv
cccgccaucugccugc

SEQ ID NO: 1268334 - RNA, 14 nt, Mycobacterium tuberculosis H37Rv
cccgccauugccgc

SEQ ID NO: 1268335 - RNA, 22 nt, Mycobacterium tuberculosis H37Rv
cccgccaggccgcgcgacaacc

SEQ ID NO: 1268336 - RNA, 21 nt, Mycobacterium tuberculosis H37Rv
cccgaaaacccaacacccaga

SEQ ID NO: 1268337 - RNA, 23 nt, Mycobacterium tuberculosis H37Rv
ccccuucaaagcggccucgaccu

SEQ ID NO: 1268338 - RNA, 14 nt, Mycobacterium tuberculosis H37Rv
ccccuucaaagcgg

SEQ ID NO: 1268339 - RNA, 22 nt, Mycobacterium tuberculosis H37Rv
ccccugucauguccugggccgc

SEQ ID NO: 1268340 - RNA, 11 nt, Mycobacterium tuberculosis H37Rv
ccccuggcgau

SEQ ID NO: 1268341 - RNA, 15 nt, Mycobacterium tuberculosis H37Rv
ccccuggcgauuucg

SEQ ID NO: 1268342 - RNA, 14 nt, Mycobacterium tuberculosis H37Rv
ccccuggcaccucg

SEQ ID NO: 1268343 - RNA, 20 nt, Mycobacterium tuberculosis H37Rv
ccccguuucggucgacaacg

SEQ ID NO: 1268344 - RNA, 15 nt, Mycobacterium tuberculosis H37Rv
ccccucuagcgccuc

SEQ ID NO: 1268345 - RNA, 16 nt, Mycobacterium tuberculosis H37Rv
ccccguuccacgauca

SEQ ID NO: 1268346 - RNA, 15 nt, Mycobacterium tuberculosis H37Rv
ccccguucuggaacc

SEQ ID NO: 1268347 - RNA, 16 nt, Mycobacterium tuberculosis H37Rv
ccccguucuggaaccc

SEQ ID NO: 1268348 - RNA, 12 nt, Mycobacterium tuberculosis H37Rv
ccccguugccgc

SEQ ID NO: 1268349 - RNA, 21 nt, Mycobacterium tuberculosis H37Rv
ccccguuaccgccgucgccga

SEQ ID NO: 1268350 - RNA, 15 nt, Mycobacterium tuberculosis H37Rv
ccccgucgccaccga

SEQ ID NO: 1268351 - RNA, 14 nt, Mycobacterium tuberculosis H37Rv
cccauggccaccga

SEQ ID NO: 1268352 - RNA, 18 nt, Mycobacterium tuberculosis H37Rv
cccaugcgccagcgagcg

SEQ ID NO: 1268353 - RNA, 15 nt, Mycobacterium tuberculosis H37Rv
cccaugcgccagcga

SEQ ID NO: 1268354 - RNA, 13 nt, Mycobacterium tuberculosis H37Rv
cccaugccgaccg

SEQ ID NO: 1268355 - RNA, 18 nt, Mycobacterium tuberculosis H37Rv
cccaugccgaccggcacc

SEQ ID NO: 1268356 - RNA, 13 nt, Mycobacterium tuberculosis H37Rv
cccauucucggcc

SEQ ID NO: 1268357 - RNA, 12 nt, Mycobacterium tuberculosis H37Rv
cccauucggcgg

SEQ ID NO: 1268358 - RNA, 13 nt, Mycobacterium tuberculosis H37Rv
ccccggucgccgc

SEQ ID NO: 1268359 - RNA, 12 nt, Mycobacterium tuberculosis H37Rv
ccccggugacgc

SEQ ID NO: 1268360 - RNA, 13 nt, Mycobacterium tuberculosis H37Rv
ccccgggcgguga

SEQ ID NO: 1268361 - RNA, 16 nt, Mycobacterium tuberculosis H37Rv
ccccgggcggugaggc

SEQ ID NO: 1268362 - RNA, 15 nt, Mycobacterium tuberculosis H37Rv
ccccggggcgcucgc

SEQ ID NO: 1268363 - RNA, 17 nt, Mycobacterium tuberculosis H37Rv
ccccggucaggacggca

SEQ ID NO: 1268364 - RNA, 11 nt, Mycobacterium tuberculosis H37Rv
cccgaccgccg

SEQ ID NO: 1268365 - RNA, 14 nt, Mycobacterium tuberculosis H37Rv
cccgaccgccaccg

SEQ ID NO: 1268366 - RNA, 15 nt, Mycobacterium tuberculosis H37Rv
cccgaccgggaacca

SEQ ID NO: 1268367 - RNA, 16 nt, Mycobacterium tuberculosis H37Rv
cccgacgaggaugucg

SEQ ID NO: 1268368 - RNA, 22 nt, Mycobacterium tuberculosis H37Rv
cccgacgaugcgggcgaucucg

SEQ ID NO: 1268369 - RNA, 12 nt, Mycobacterium tuberculosis H37Rv
cccgacgcagcu

SEQ ID NO: 1268370 - RNA, 12 nt, Mycobacterium tuberculosis H37Rv
cccgacguucgu

SEQ ID NO: 1268371 - RNA, 24 nt, Mycobacterium tuberculosis H37Rv
cccgacucggccgugaccgagccg

SEQ ID NO: 1268372 - RNA, 13 nt, Mycobacterium tuberculosis H37Rv
cccgacucggccg

SEQ ID NO: 1268373 - RNA, 15 nt, Mycobacterium tuberculosis H37Rv
cccgaggcuggcauc

SEQ ID NO: 1268374 - RNA, 13 nt, Mycobacterium tuberculosis H37Rv
cccgagcgaugcg

SEQ ID NO: 1268375 - RNA, 16 nt, Mycobacterium tuberculosis H37Rv
cccgagcggagccgcc

SEQ ID NO: 1268376 - RNA, 12 nt, Mycobacterium tuberculosis H37Rv
cccgagccugga

SEQ ID NO: 1268377 - RNA, 14 nt, Mycobacterium tuberculosis H37Rv
cccgaaggcggcuc

SEQ ID NO: 1268378 - RNA, 17 nt, Mycobacterium tuberculosis H37Rv
cccgaaguggugaccga

SEQ ID NO: 1268379 - RNA, 16 nt, Mycobacterium tuberculosis H37Rv
cccgaaguagaagccc

SEQ ID NO: 1268380 - RNA, 13 nt, Mycobacterium tuberculosis H37Rv
cccgaagucucgg

SEQ ID NO: 1268381 - RNA, 19 nt, Mycobacterium tuberculosis H37Rv
cccgaauuccuacgccgcc

SEQ ID NO: 1268382 - RNA, 17 nt, Mycobacterium tuberculosis H37Rv
cccgaaacccgaugugg

SEQ ID NO: 1268383 - RNA, 13 nt, Mycobacterium tuberculosis H37Rv
cccgaaccgagcg

SEQ ID NO: 1268384 - RNA, 14 nt, Mycobacterium tuberculosis H37Rv
cccgaagccgaccg

SEQ ID NO: 1268385 - RNA, 19 nt, Mycobacterium tuberculosis H37Rv
cccgacacccguaagcgga

SEQ ID NO: 1268386 - RNA, 17 nt, Mycobacterium tuberculosis H37Rv
cccgacacccguaagcg

SEQ ID NO: 1268387 - RNA, 23 nt, Mycobacterium tuberculosis H37Rv
cccgacacucgauccggauucag

SEQ ID NO: 1268388 - RNA, 18 nt, Mycobacterium tuberculosis H37Rv
cccgacaucggccagcgc

SEQ ID NO: 1268389 - RNA, 22 nt, Mycobacterium tuberculosis H37Rv
cccacuugauuuggggcagucc

SEQ ID NO: 1268390 - RNA, 13 nt, Mycobacterium tuberculosis H37Rv
cccacucggaccc

SEQ ID NO: 1268391 - RNA, 17 nt, Mycobacterium tuberculosis H37Rv
cccacucggggacggcg

SEQ ID NO: 1268392 - RNA, 17 nt, Mycobacterium tuberculosis H37Rv
cccacucgucgaacacc

SEQ ID NO: 1268393 - RNA, 14 nt, Mycobacterium tuberculosis H37Rv
cccacugccacucc

SEQ ID NO: 1268394 - RNA, 16 nt, Mycobacterium tuberculosis H37Rv
cccacucggacccgca

SEQ ID NO: 1268395 - RNA, 15 nt, Mycobacterium tuberculosis H37Rv
cccacuggaccaccg

SEQ ID NO: 1268396 - RNA, 13 nt, Mycobacterium tuberculosis H37Rv
cccacugggccgg

SEQ ID NO: 1268397 - RNA, 22 nt, Mycobacterium tuberculosis H37Rv
cccacaggggcagcgcggccac

SEQ ID NO: 1268398 - RNA, 17 nt, Mycobacterium tuberculosis H37Rv
cccacaguuaucagccg

SEQ ID NO: 1268399 - RNA, 19 nt, Mycobacterium tuberculosis H37Rv
cccacaugaacgaccaccg

SEQ ID NO: 1268400 - RNA, 18 nt, Mycobacterium tuberculosis H37Rv
cccacaugcgcucgcgga

SEQ ID NO: 1268401 - RNA, 22 nt, Mycobacterium tuberculosis H37Rv
cccaccacaccaaggccgagcg

SEQ ID NO: 1268402 - RNA, 13 nt, Mycobacterium tuberculosis H37Rv
cccacgucgagca

SEQ ID NO: 1268403 - RNA, 14 nt, Mycobacterium tuberculosis H37Rv
cccacguugacggc

SEQ ID NO: 1268404 - RNA, 18 nt, Mycobacterium tuberculosis H37Rv
cccagcaugaagucccgg

SEQ ID NO: 1268405 - RNA, 16 nt, Mycobacterium tuberculosis H37Rv
cccagccaacucaggc

SEQ ID NO: 1268406 - RNA, 16 nt, Mycobacterium tuberculosis H37Rv
cccagccguucgucgc

SEQ ID NO: 1268407 - RNA, 17 nt, Mycobacterium tuberculosis H37Rv
cccagccggcagcagcg

SEQ ID NO: 1268408 - RNA, 20 nt, Mycobacterium tuberculosis H37Rv
cccagcgaccgcugcagauu

SEQ ID NO: 1268409 - RNA, 16 nt, Mycobacterium tuberculosis H37Rv
cccagcgaccgcugca

SEQ ID NO: 1268410 - RNA, 22 nt, Mycobacterium tuberculosis H37Rv
cccagcgaaucacccgcgagau

SEQ ID NO: 1268411 - RNA, 13 nt, Mycobacterium tuberculosis H37Rv
cccagcgaccgcu

SEQ ID NO: 1268412 - RNA, 20 nt, Mycobacterium tuberculosis H37Rv
cccagcgacgcggccagcgg

SEQ ID NO: 1268413 - RNA, 21 nt, Mycobacterium tuberculosis H37Rv
cccagccggaaccggacagcg

SEQ ID NO: 1268414 - RNA, 15 nt, Mycobacterium tuberculosis H37Rv
cccagcccuuggcgc

SEQ ID NO: 1268415 - RNA, 23 nt, Mycobacterium tuberculosis H37Rv
cccaucggggcuacaacugccga

SEQ ID NO: 1268416 - RNA, 18 nt, Mycobacterium tuberculosis H37Rv
cccauaccuucggcgauc

SEQ ID NO: 1268417 - RNA, 22 nt, Mycobacterium tuberculosis H37Rv
cccauacgugccgccgaugucg

SEQ ID NO: 1268418 - RNA, 17 nt, Mycobacterium tuberculosis H37Rv
cccagguuccgcugucg

SEQ ID NO: 1268419 - RNA, 14 nt, Mycobacterium tuberculosis H37Rv
cccaggguggcgac

SEQ ID NO: 1268420 - RNA, 13 nt, Mycobacterium tuberculosis H37Rv
cccaggucaacga

SEQ ID NO: 1268421 - RNA, 15 nt, Mycobacterium tuberculosis H37Rv
cccagguccgcgugc

SEQ ID NO: 1268422 - RNA, 15 nt, Mycobacterium tuberculosis H37Rv
cccaggugcaagcgg

SEQ ID NO: 1268423 - RNA, 12 nt, Mycobacterium tuberculosis H37Rv
cccaggaucgga

SEQ ID NO: 1268424 - RNA, 18 nt, Mycobacterium tuberculosis H37Rv
cccaggaaggcgacgccg

SEQ ID NO: 1268425 - RNA, 13 nt, Mycobacterium tuberculosis H37Rv
cccaggcucgcac

SEQ ID NO: 1268426 - RNA, 23 nt, Mycobacterium tuberculosis H37Rv
cccaggcguuuggcgugccgucg

SEQ ID NO: 1268427 - RNA, 18 nt, Mycobacterium tuberculosis H37Rv
cccaggcgcucagcgcgg

SEQ ID NO: 1268428 - RNA, 15 nt, Mycobacterium tuberculosis H37Rv
cccagcuuggcgucg

SEQ ID NO: 1268429 - RNA, 21 nt, Mycobacterium tuberculosis H37Rv
cccagcuuggcgucgaugcgg

SEQ ID NO: 1268430 - RNA, 15 nt, Mycobacterium tuberculosis H37Rv
cccaggaacgggacg

SEQ ID NO: 1268431 - RNA, 18 nt, Mycobacterium tuberculosis H37Rv
cccagcgccuccagcacc

SEQ ID NO: 1268432 - RNA, 13 nt, Mycobacterium tuberculosis H37Rv
cccagcgccgaau

SEQ ID NO: 1268433 - RNA, 15 nt, Mycobacterium tuberculosis H37Rv
cccagcgcagcagcg

SEQ ID NO: 1268434 - RNA, 17 nt, Mycobacterium tuberculosis H37Rv
cccagcgcacggaccau

SEQ ID NO: 1268435 - RNA, 16 nt, Mycobacterium tuberculosis H37Rv
cccagcgcagcggacg

SEQ ID NO: 1268436 - RNA, 23 nt, Mycobacterium tuberculosis H37Rv
cccagcgaggugggcgucaucga

SEQ ID NO: 1268437 - RNA, 22 nt, Mycobacterium tuberculosis H37Rv
ccaucuccggugugaucggcgg

SEQ ID NO: 1268438 - RNA, 14 nt, Mycobacterium tuberculosis H37Rv
ccaucgucgagcgc

SEQ ID NO: 1268439 - RNA, 15 nt, Mycobacterium tuberculosis H37Rv
ccaugcgcaccaguc

SEQ ID NO: 1268440 - RNA, 16 nt, Mycobacterium tuberculosis H37Rv
ccaugggauucggcca

SEQ ID NO: 1268441 - RNA, 21 nt, Mycobacterium tuberculosis H37Rv
ccaugggaguucaucgcacga

SEQ ID NO: 1268442 - RNA, 20 nt, Mycobacterium tuberculosis H37Rv
ccauggcgcgaccuccgcga

SEQ ID NO: 1268443 - RNA, 16 nt, Mycobacterium tuberculosis H37Rv
ccauggcgcgagcaga

SEQ ID NO: 1268444 - RNA, 12 nt, Mycobacterium tuberculosis H37Rv
ccaucacggugg

SEQ ID NO: 1268445 - RNA, 13 nt, Mycobacterium tuberculosis H37Rv
ccaucgguugacc

SEQ ID NO: 1268446 - RNA, 16 nt, Mycobacterium tuberculosis H37Rv
ccaucgucgagccgcc

SEQ ID NO: 1268447 - RNA, 21 nt, Mycobacterium tuberculosis H37Rv
ccaucggggaaggggcucagc

SEQ ID NO: 1268448 - RNA, 18 nt, Mycobacterium tuberculosis H37Rv
ccaucgggauggacacca

SEQ ID NO: 1268449 - RNA, 11 nt, Mycobacterium tuberculosis H37Rv
ccaucgguuga

SEQ ID NO: 1268450 - RNA, 17 nt, Mycobacterium tuberculosis H37Rv
cccacacacccgacacg

SEQ ID NO: 1268451 - RNA, 21 nt, Mycobacterium tuberculosis H37Rv
cccaauucagauagucgccgc

SEQ ID NO: 1268452 - RNA, 22 nt, Mycobacterium tuberculosis H37Rv
cccaaucgaccgcccgccaacu

SEQ ID NO: 1268453 - RNA, 21 nt, Mycobacterium tuberculosis H37Rv
cccacagcgugcgggucuuug

SEQ ID NO: 1268454 - RNA, 12 nt, Mycobacterium tuberculosis H37Rv
cccacagcagga

SEQ ID NO: 1268455 - RNA, 21 nt, Mycobacterium tuberculosis H37Rv
cccacacggucgucgcgagcg

SEQ ID NO: 1268456 - RNA, 22 nt, Mycobacterium tuberculosis H37Rv
cccacacggucgucgcgagcgg

SEQ ID NO: 1268457 - RNA, 21 nt, Mycobacterium tuberculosis H37Rv
cccacaccgucuuacucguca

SEQ ID NO: 1268458 - RNA, 21 nt, Mycobacterium tuberculosis H37Rv
cccaagaccaagugucgccgc

SEQ ID NO: 1268459 - RNA, 19 nt, Mycobacterium tuberculosis H37Rv
cccaacuccaucagcgcga

SEQ ID NO: 1268460 - RNA, 15 nt, Mycobacterium tuberculosis H37Rv
cccaaggccaggauc

SEQ ID NO: 1268461 - RNA, 23 nt, Mycobacterium tuberculosis H37Rv
cccaacagcccaccggugccgcc

SEQ ID NO: 1268462 - RNA, 15 nt, Mycobacterium tuberculosis H37Rv
cccaaaaagaccgcc

SEQ ID NO: 1268463 - RNA, 13 nt, Mycobacterium tuberculosis H37Rv
ccauuucggcccg

SEQ ID NO: 1268464 - RNA, 19 nt, Mycobacterium tuberculosis H37Rv
ccauuggccaagucagccc

SEQ ID NO: 1268465 - RNA, 19 nt, Mycobacterium tuberculosis H37Rv
ccauguuggggaugccgga

SEQ ID NO: 1268466 - RNA, 21 nt, Mycobacterium tuberculosis H37Rv
ccauguagccguugccgccga

SEQ ID NO: 1268467 - RNA, 22 nt, Mycobacterium tuberculosis H37Rv
ccaugguggcgccgacguacag

SEQ ID NO: 1268468 - RNA, 16 nt, Mycobacterium tuberculosis H37Rv
ccauguacaggcccca

SEQ ID NO: 1268469 - RNA, 14 nt, Mycobacterium tuberculosis H37Rv
ccaugucuccgaca

SEQ ID NO: 1268470 - RNA, 22 nt, Mycobacterium tuberculosis H37Rv
ccaugucggcgcgccgcacacg

SEQ ID NO: 1268471 - RNA, 13 nt, Mycobacterium tuberculosis H37Rv
ccaugucggccag

SEQ ID NO: 1268472 - RNA, 23 nt, Mycobacterium tuberculosis H37Rv
ccaugucggugaggaagcggccg

SEQ ID NO: 1268473 - RNA, 21 nt, Mycobacterium tuberculosis H37Rv
ccaugucggugaccguucggc

SEQ ID NO: 1268474 - RNA, 20 nt, Mycobacterium tuberculosis H37Rv
ccaugucggugaccguucgg

SEQ ID NO: 1268475 - RNA, 14 nt, Mycobacterium tuberculosis H37Rv
ccaugucggugacc

SEQ ID NO: 1268476 - RNA, 12 nt, Mycobacterium tuberculosis H37Rv
ccaggcaccacg

SEQ ID NO: 1268477 - RNA, 22 nt, Mycobacterium tuberculosis H37Rv
ccaggcaccacgaccgacaccc

SEQ ID NO: 1268478 - RNA, 20 nt, Mycobacterium tuberculosis H37Rv
ccaggcacaacaucgccgca

SEQ ID NO: 1268479 - RNA, 18 nt, Mycobacterium tuberculosis H37Rv
ccaggcacguccgaucgg

SEQ ID NO: 1268480 - RNA, 13 nt, Mycobacterium tuberculosis H37Rv
ccaggcagcuugc

SEQ ID NO: 1268481 - RNA, 20 nt, Mycobacterium tuberculosis H37Rv
ccaggccaagguggccacca

SEQ ID NO: 1268482 - RNA, 23 nt, Mycobacterium tuberculosis H37Rv
ccaggccaacggcgcugccggga

SEQ ID NO: 1268483 - RNA, 16 nt, Mycobacterium tuberculosis H37Rv
ccagcgugcugccgga

SEQ ID NO: 1268484 - RNA, 17 nt, Mycobacterium tuberculosis H37Rv
ccaggcaaaccgaucaa

SEQ ID NO: 1268485 - RNA, 16 nt, Mycobacterium tuberculosis H37Rv
ccaggccgcgcgcacc

SEQ ID NO: 1268486 - RNA, 19 nt, Mycobacterium tuberculosis H37Rv
ccaggccgcacagcaccac

SEQ ID NO: 1268487 - RNA, 14 nt, Mycobacterium tuberculosis H37Rv
ccaggccgagcccg

SEQ ID NO: 1268488 - RNA, 16 nt, Mycobacterium tuberculosis H37Rv
ccaggccgaccgcgca

SEQ ID NO: 1268489 - RNA, 15 nt, Mycobacterium tuberculosis H37Rv
ccaggcgggcggcac

SEQ ID NO: 1268490 - RNA, 22 nt, Mycobacterium tuberculosis H37Rv
ccaggcucgagguguagcccuc

SEQ ID NO: 1268491 - RNA, 20 nt, Mycobacterium tuberculosis H37Rv
ccaggcugaucccgaugcug

SEQ ID NO: 1268492 - RNA, 18 nt, Mycobacterium tuberculosis H37Rv
ccaggcgcgcaccaccgc

SEQ ID NO: 1268493 - RNA, 17 nt, Mycobacterium tuberculosis H37Rv
ccaggcgcccagcaccc

SEQ ID NO: 1268494 - RNA, 22 nt, Mycobacterium tuberculosis H37Rv
ccaggcgaagucgacucgccac

SEQ ID NO: 1268495 - RNA, 23 nt, Mycobacterium tuberculosis H37Rv
ccaggccuaguccggcacugcgg

SEQ ID NO: 1268496 - RNA, 15 nt, Mycobacterium tuberculosis H37Rv
ccaggccuaguccgg

SEQ ID NO: 1268497 - RNA, 22 nt, Mycobacterium tuberculosis H37Rv
ccaggccguugcuauucgccag

SEQ ID NO: 1268498 - RNA, 23 nt, Mycobacterium tuberculosis H37Rv
ccaggccguugcuauucgccagc

SEQ ID NO: 1268499 - RNA, 14 nt, Mycobacterium tuberculosis H37Rv
ccaggccggugacg

SEQ ID NO: 1268500 - RNA, 19 nt, Mycobacterium tuberculosis H37Rv
ccagugcggccaccuccaa

SEQ ID NO: 1268501 - RNA, 19 nt, Mycobacterium tuberculosis H37Rv
ccaguggauuggcgaugac

SEQ ID NO: 1268502 - RNA, 19 nt, Mycobacterium tuberculosis H37Rv
ccaguucaccgcgcugaac

SEQ ID NO: 1268503 - RNA, 13 nt, Mycobacterium tuberculosis H37Rv
ccaguucggcguc

SEQ ID NO: 1268504 - RNA, 22 nt, Mycobacterium tuberculosis H37Rv
ccaguucggauccggacggugu

SEQ ID NO: 1268505 - RNA, 16 nt, Mycobacterium tuberculosis H37Rv
ccagugccagcguccg

SEQ ID NO: 1268506 - RNA, 20 nt, Mycobacterium tuberculosis H37Rv
ccagugcccgcacugccgcc

SEQ ID NO: 1268507 - RNA, 20 nt, Mycobacterium tuberculosis H37Rv
ccauaucgaucggaucggca

SEQ ID NO: 1268508 - RNA, 13 nt, Mycobacterium tuberculosis H37Rv
ccauaucgcccac

SEQ ID NO: 1268509 - RNA, 15 nt, Mycobacterium tuberculosis H37Rv
ccauaucgcccacca

SEQ ID NO: 1268510 - RNA, 21 nt, Mycobacterium tuberculosis H37Rv
ccauaucgaucggaucggcac

SEQ ID NO: 1268511 - RNA, 15 nt, Mycobacterium tuberculosis H37Rv
ccaucaaggccaccu

SEQ ID NO: 1268512 - RNA, 17 nt, Mycobacterium tuberculosis H37Rv
ccauagccgcgacccgc

SEQ ID NO: 1268513 - RNA, 17 nt, Mycobacterium tuberculosis H37Rv
ccauagcgccgcgccca

SEQ ID NO: 1268514 - RNA, 22 nt, Mycobacterium tuberculosis H37Rv
ccauaaucacaucgcccggaac

SEQ ID NO: 1268515 - RNA, 12 nt, Mycobacterium tuberculosis H37Rv
ccaguuucggcg

SEQ ID NO: 1268516 - RNA, 16 nt, Mycobacterium tuberculosis H37Rv
ccaguaccaccggcac

SEQ ID NO: 1268517 - RNA, 13 nt, Mycobacterium tuberculosis H37Rv
ccaguaagccgcg

SEQ ID NO: 1268518 - RNA, 14 nt, Mycobacterium tuberculosis H37Rv
ccaguaagccgcgg

SEQ ID NO: 1268519 - RNA, 14 nt, Mycobacterium tuberculosis H37Rv
ccaguaauuccgau

SEQ ID NO: 1268520 - RNA, 12 nt, Mycobacterium tuberculosis H37Rv
ccaguagccggu

SEQ ID NO: 1268521 - RNA, 13 nt, Mycobacterium tuberculosis H37Rv
ccaguacucggcc

SEQ ID NO: 1268522 - RNA, 16 nt, Mycobacterium tuberculosis H37Rv
ccaggugcccaagcag

SEQ ID NO: 1268523 - RNA, 12 nt, Mycobacterium tuberculosis H37Rv
ccaggucggcca

SEQ ID NO: 1268524 - RNA, 15 nt, Mycobacterium tuberculosis H37Rv
ccaggucggccaccg

SEQ ID NO: 1268525 - RNA, 22 nt, Mycobacterium tuberculosis H37Rv
ccagguguucgccggagacccg

SEQ ID NO: 1268526 - RNA, 14 nt, Mycobacterium tuberculosis H37Rv
ccaggugggcagca

SEQ ID NO: 1268527 - RNA, 14 nt, Mycobacterium tuberculosis H37Rv
ccagguacucagug

SEQ ID NO: 1268528 - RNA, 22 nt, Mycobacterium tuberculosis H37Rv
ccagguagaacuccucgcuguc

SEQ ID NO: 1268529 - RNA, 15 nt, Mycobacterium tuberculosis H37Rv
ccaggucgacaccgc

SEQ ID NO: 1268530 - RNA, 15 nt, Mycobacterium tuberculosis H37Rv
ccaggcuguggccag

SEQ ID NO: 1268531 - RNA, 22 nt, Mycobacterium tuberculosis H37Rv
ccaggcugcgcagugacgccuc

SEQ ID NO: 1268532 - RNA, 17 nt, Mycobacterium tuberculosis H37Rv
ccaggguguauggccac

SEQ ID NO: 1268533 - RNA, 23 nt, Mycobacterium tuberculosis H37Rv
ccaggguguccauguucuccggc

SEQ ID NO: 1268534 - RNA, 22 nt, Mycobacterium tuberculosis H37Rv
ccaggguggucaguccgucggc

SEQ ID NO: 1268535 - RNA, 20 nt, Mycobacterium tuberculosis H37Rv
ccagggcacguggcgguaca

SEQ ID NO: 1268536 - RNA, 19 nt, Mycobacterium tuberculosis H37Rv
aucccccggcuggucaccc

SEQ ID NO: 1268537 - RNA, 11 nt, Mycobacterium tuberculosis H37Rv
aucccaucggg

SEQ ID NO: 1268538 - RNA, 20 nt, Mycobacterium tuberculosis H37Rv
auccauccgggccgcggcca

SEQ ID NO: 1268539 - RNA, 19 nt, Mycobacterium tuberculosis H37Rv
auccagugcgguggccagu

SEQ ID NO: 1268540 - RNA, 23 nt, Mycobacterium tuberculosis H37Rv
auccacgguugccggcggcgacg

SEQ ID NO: 1268541 - RNA, 17 nt, Mycobacterium tuberculosis H37Rv
auccacggcgaugcagc

SEQ ID NO: 1268542 - RNA, 15 nt, Mycobacterium tuberculosis H37Rv
auccagagacauguc

SEQ ID NO: 1268543 - RNA, 20 nt, Mycobacterium tuberculosis H37Rv
auccagcagccaggagccga

SEQ ID NO: 1268544 - RNA, 22 nt, Mycobacterium tuberculosis H37Rv
auccagcagccaggagccgauc

SEQ ID NO: 1268545 - RNA, 16 nt, Mycobacterium tuberculosis H37Rv
auccagcccgacgccc

SEQ ID NO: 1268546 - RNA, 15 nt, Mycobacterium tuberculosis H37Rv
auccagccaugcggu

SEQ ID NO: 1268547 - RNA, 19 nt, Mycobacterium tuberculosis H37Rv
auccagggugccggucacg

SEQ ID NO: 1268548 - RNA, 21 nt, Mycobacterium tuberculosis H37Rv
auccaggccucgcaccggauc

SEQ ID NO: 1268549 - RNA, 16 nt, Mycobacterium tuberculosis H37Rv
auccagguagaccgga

SEQ ID NO: 1268550 - RNA, 20 nt, Mycobacterium tuberculosis H37Rv
auccaggcgugcaucgcgau

SEQ ID NO: 1268551 - RNA, 20 nt, Mycobacterium tuberculosis H37Rv
auccgccgggcgccgugccc

SEQ ID NO: 1268552 - RNA, 13 nt, Mycobacterium tuberculosis H37Rv
auccgcgaucggc

SEQ ID NO: 1268553 - RNA, 18 nt, Mycobacterium tuberculosis H37Rv
auccggcccaccggucgc

SEQ ID NO: 1268554 - RNA, 17 nt, Mycobacterium tuberculosis H37Rv
auccggcauacaucgcc

SEQ ID NO: 1268555 - RNA, 15 nt, Mycobacterium tuberculosis H37Rv
auccggucgaugacc

SEQ ID NO: 1268556 - RNA, 21 nt, Mycobacterium tuberculosis H37Rv
auccggucgaugaccucguca

SEQ ID NO: 1268557 - RNA, 23 nt, Mycobacterium tuberculosis H37Rv
auccgguuaugcgguacccgaug

SEQ ID NO: 1268558 - RNA, 17 nt, Mycobacterium tuberculosis H37Rv
auccgguuauggcaagc

SEQ ID NO: 1268559 - RNA, 16 nt, Mycobacterium tuberculosis H37Rv
auccggugcccgcacc

SEQ ID NO: 1268560 - RNA, 16 nt, Mycobacterium tuberculosis H37Rv
auccggucucggccga

SEQ ID NO: 1268561 - RNA, 22 nt, Mycobacterium tuberculosis H37Rv
auccgucaaguggcaaccgcac

SEQ ID NO: 1268562 - RNA, 19 nt, Mycobacterium tuberculosis H37Rv
aucccgcucccaugaucgc

SEQ ID NO: 1268563 - RNA, 13 nt, Mycobacterium tuberculosis H37Rv
aucccggaccgau

SEQ ID NO: 1268564 - RNA, 18 nt, Mycobacterium tuberculosis H37Rv
aucccgggcaguccaggc

SEQ ID NO: 1268565 - RNA, 20 nt, Mycobacterium tuberculosis H37Rv
aucccggccuccauaucgca

SEQ ID NO: 1268566 - RNA, 20 nt, Mycobacterium tuberculosis H37Rv
aucccgccacaccaacgucg

SEQ ID NO: 1268567 - RNA, 18 nt, Mycobacterium tuberculosis H37Rv
auccccuggccaaccggg

SEQ ID NO: 1268568 - RNA, 17 nt, Mycobacterium tuberculosis H37Rv
aucccgaaccguucgcu

SEQ ID NO: 1268569 - RNA, 22 nt, Mycobacterium tuberculosis H37Rv
aucaucucgguggacggcaggc

SEQ ID NO: 1268570 - RNA, 19 nt, Mycobacterium tuberculosis H37Rv
aucaucucccgaccgccga

SEQ ID NO: 1268571 - RNA, 14 nt, Mycobacterium tuberculosis H37Rv
aucaugaccaccga

SEQ ID NO: 1268572 - RNA, 20 nt, Mycobacterium tuberculosis H37Rv
aucaugcgauucugcgucug

SEQ ID NO: 1268573 - RNA, 18 nt, Mycobacterium tuberculosis H37Rv
auccaccucgauggcguc

SEQ ID NO: 1268574 - RNA, 19 nt, Mycobacterium tuberculosis H37Rv
auccaaugccagaucggcc

SEQ ID NO: 1268575 - RNA, 18 nt, Mycobacterium tuberculosis H37Rv
auccacacacagccggug

SEQ ID NO: 1268576 - RNA, 23 nt, Mycobacterium tuberculosis H37Rv
aucauguucuuuugcgucugcug

SEQ ID NO: 1268577 - RNA, 20 nt, Mycobacterium tuberculosis H37Rv
aucauguucuuuugcgucug

SEQ ID NO: 1268578 - RNA, 18 nt, Mycobacterium tuberculosis H37Rv
aucaguugcacaccgauc

SEQ ID NO: 1268579 - RNA, 21 nt, Mycobacterium tuberculosis H37Rv
aucagucugggcgaucgcuuc

SEQ ID NO: 1268580 - RNA, 22 nt, Mycobacterium tuberculosis H37Rv
aucagugcgugauggcggcgca

SEQ ID NO: 1268581 - RNA, 21 nt, Mycobacterium tuberculosis H37Rv
aucaggucgccgagaccggcc

SEQ ID NO: 1268582 - RNA, 17 nt, Mycobacterium tuberculosis H37Rv
aucaggucgccgagacc

SEQ ID NO: 1268583 - RNA, 23 nt, Mycobacterium tuberculosis H37Rv
aucagguccuaggugugcgacga

SEQ ID NO: 1268584 - RNA, 16 nt, Mycobacterium tuberculosis H37Rv
aucagggugucgaaga

SEQ ID NO: 1268585 - RNA, 13 nt, Mycobacterium tuberculosis H37Rv
aucaggucggcga

SEQ ID NO: 1268586 - RNA, 15 nt, Mycobacterium tuberculosis H37Rv
aucaggucgucgucc

SEQ ID NO: 1268587 - RNA, 15 nt, Mycobacterium tuberculosis H37Rv
aucagcucgaugccg

SEQ ID NO: 1268588 - RNA, 18 nt, Mycobacterium tuberculosis H37Rv
aucagcuugugggcgacg

SEQ ID NO: 1268589 - RNA, 18 nt, Mycobacterium tuberculosis H37Rv
aucaggaaccgcucguca

SEQ ID NO: 1268590 - RNA, 18 nt, Mycobacterium tuberculosis H37Rv
aucagcucgaugccgugu

SEQ ID NO: 1268591 - RNA, 21 nt, Mycobacterium tuberculosis H37Rv
aucaggacgcgaucggcguca

SEQ ID NO: 1268592 - RNA, 19 nt, Mycobacterium tuberculosis H37Rv
aucaggccgacgucgacca

SEQ ID NO: 1268593 - RNA, 17 nt, Mycobacterium tuberculosis H37Rv
aucgucaacgacgacga

SEQ ID NO: 1268594 - RNA, 17 nt, Mycobacterium tuberculosis H37Rv
aucgucacgggguccga

SEQ ID NO: 1268595 - RNA, 15 nt, Mycobacterium tuberculosis H37Rv
aucgucgagcgcggu

SEQ ID NO: 1268596 - RNA, 19 nt, Mycobacterium tuberculosis H37Rv
aucgucgagccgaucgccc

SEQ ID NO: 1268597 - RNA, 16 nt, Mycobacterium tuberculosis H37Rv
aucgucgacgcgucgu

SEQ ID NO: 1268598 - RNA, 20 nt, Mycobacterium tuberculosis H37Rv
aucgucgaaccggaugcggu

SEQ ID NO: 1268599 - RNA, 18 nt, Mycobacterium tuberculosis H37Rv
aucgucgacgccgaucgc

SEQ ID NO: 1268600 - RNA, 23 nt, Mycobacterium tuberculosis H37Rv
aucgugcuggugguaucggcgug

SEQ ID NO: 1268601 - RNA, 16 nt, Mycobacterium tuberculosis H37Rv
aucgugguucggcguc

SEQ ID NO: 1268602 - RNA, 18 nt, Mycobacterium tuberculosis H37Rv
aucguggcggcgucgaca

SEQ ID NO: 1268603 - RNA, 13 nt, Mycobacterium tuberculosis H37Rv
aucgugcuggcga

SEQ ID NO: 1268604 - RNA, 15 nt, Mycobacterium tuberculosis H37Rv
aucguggcgcccguc

SEQ ID NO: 1268605 - RNA, 14 nt, Mycobacterium tuberculosis H37Rv
aucguggcggcguc

SEQ ID NO: 1268606 - RNA, 12 nt, Mycobacterium tuberculosis H37Rv
aucgucggguca

SEQ ID NO: 1268607 - RNA, 15 nt, Mycobacterium tuberculosis H37Rv
aucgucgggucaccc

SEQ ID NO: 1268608 - RNA, 12 nt, Mycobacterium tuberculosis H37Rv
aucgucgccaug

SEQ ID NO: 1268609 - RNA, 16 nt, Mycobacterium tuberculosis H37Rv
aucgucgccaagccca

SEQ ID NO: 1268610 - RNA, 16 nt, Mycobacterium tuberculosis H37Rv
aucguugccgaccguc

SEQ ID NO: 1268611 - RNA, 17 nt, Mycobacterium tuberculosis H37Rv
aucguugccgaccguca

SEQ ID NO: 1268612 - RNA, 16 nt, Mycobacterium tuberculosis H37Rv
aucguuccaggccgcg

SEQ ID NO: 1268613 - RNA, 21 nt, Mycobacterium tuberculosis H37Rv
aucguuccacgagucgucguc

SEQ ID NO: 1268614 - RNA, 23 nt, Mycobacterium tuberculosis H37Rv
aucuccaaguagcacuucagcuu

SEQ ID NO: 1268615 - RNA, 18 nt, Mycobacterium tuberculosis H37Rv
aucuccaccgucgccgcc

SEQ ID NO: 1268616 - RNA, 23 nt, Mycobacterium tuberculosis H37Rv
aucggcagucccagcgccgcaca

SEQ ID NO: 1268617 - RNA, 22 nt, Mycobacterium tuberculosis H37Rv
aucggcagucccagcgccgcac

SEQ ID NO: 1268618 - RNA, 19 nt, Mycobacterium tuberculosis H37Rv
aucggcaggguggccagca

SEQ ID NO: 1268619 - RNA, 19 nt, Mycobacterium tuberculosis H37Rv
aucggacagguaacgcggu

SEQ ID NO: 1268620 - RNA, 20 nt, Mycobacterium tuberculosis H37Rv
aucggcagccagggcgccga

SEQ ID NO: 1268621 - RNA, 22 nt, Mycobacterium tuberculosis H37Rv
aucggacucggaauucggcguc

SEQ ID NO: 1268622 - RNA, 14 nt, Mycobacterium tuberculosis H37Rv
aucgggaucgacgu

SEQ ID NO: 1268623 - RNA, 15 nt, Mycobacterium tuberculosis H37Rv
aucgggaucgacguc

SEQ ID NO: 1268624 - RNA, 17 nt, Mycobacterium tuberculosis H37Rv
aucgggaucgcugccag

SEQ ID NO: 1268625 - RNA, 14 nt, Mycobacterium tuberculosis H37Rv
aucgggaucgcugc

SEQ ID NO: 1268626 - RNA, 18 nt, Mycobacterium tuberculosis H37Rv
aucgggccacagcaacgu

SEQ ID NO: 1268627 - RNA, 16 nt, Mycobacterium tuberculosis H37Rv
aucgggcggcaccgcu

SEQ ID NO: 1268628 - RNA, 21 nt, Mycobacterium tuberculosis H37Rv
aucggcuuggcugugauguug

SEQ ID NO: 1268629 - RNA, 19 nt, Mycobacterium tuberculosis H37Rv
aucggcuugccugcgccga

SEQ ID NO: 1268630 - RNA, 13 nt, Mycobacterium tuberculosis H37Rv
aucgggaaugacc

SEQ ID NO: 1268631 - RNA, 13 nt, Mycobacterium tuberculosis H37Rv
aucggucaugucc

SEQ ID NO: 1268632 - RNA, 16 nt, Mycobacterium tuberculosis H37Rv
aucggucagcgggcac

SEQ ID NO: 1268633 - RNA, 15 nt, Mycobacterium tuberculosis H37Rv
aucggucagcgccga

SEQ ID NO: 1268634 - RNA, 20 nt, Mycobacterium tuberculosis H37Rv
aucggguuuccuugggcguc

SEQ ID NO: 1268635 - RNA, 16 nt, Mycobacterium tuberculosis H37Rv
aucgggcucacucgcc

SEQ ID NO: 1268636 - RNA, 22 nt, Mycobacterium tuberculosis H37Rv
aucgggcgcgguaaccacgcgg

SEQ ID NO: 1268637 - RNA, 17 nt, Mycobacterium tuberculosis H37Rv
aucgggcuucggccaga

SEQ ID NO: 1268638 - RNA, 20 nt, Mycobacterium tuberculosis H37Rv
aucggggcgacgauccgcac

SEQ ID NO: 1268639 - RNA, 22 nt, Mycobacterium tuberculosis H37Rv
aucgggguuggugaacgagaug

SEQ ID NO: 1268640 - RNA, 16 nt, Mycobacterium tuberculosis H37Rv
aucggggcgcugcagc

SEQ ID NO: 1268641 - RNA, 19 nt, Mycobacterium tuberculosis H37Rv
aucggggcggugacuccgc

SEQ ID NO: 1268642 - RNA, 17 nt, Mycobacterium tuberculosis H37Rv
aucggguccacgucucc

SEQ ID NO: 1268643 - RNA, 17 nt, Mycobacterium tuberculosis H37Rv
aucgggucgucggcguc

SEQ ID NO: 1268644 - RNA, 21 nt, Mycobacterium tuberculosis H37Rv
aucggugguuagguggcuggc

SEQ ID NO: 1268645 - RNA, 13 nt, Mycobacterium tuberculosis H37Rv
aucggugguaaca

SEQ ID NO: 1268646 - RNA, 20 nt, Mycobacterium tuberculosis H37Rv
aucggugguaacaccggcga

SEQ ID NO: 1268647 - RNA, 20 nt, Mycobacterium tuberculosis H37Rv
aucgguugaccggucgacca

SEQ ID NO: 1268648 - RNA, 15 nt, Mycobacterium tuberculosis H37Rv
aucggugaucgaggu

SEQ ID NO: 1268649 - RNA, 20 nt, Mycobacterium tuberculosis H37Rv
aucggugccgaagcugccca

SEQ ID NO: 1268650 - RNA, 18 nt, Mycobacterium tuberculosis H37Rv
aucgccacaacgcgcggu

SEQ ID NO: 1268651 - RNA, 14 nt, Mycobacterium tuberculosis H37Rv
aucgcauccgcggu

SEQ ID NO: 1268652 - RNA, 19 nt, Mycobacterium tuberculosis H37Rv
aucgcagacggcugccacg

SEQ ID NO: 1268653 - RNA, 19 nt, Mycobacterium tuberculosis H37Rv
aucgcacggaugaugccgg

SEQ ID NO: 1268654 - RNA, 15 nt, Mycobacterium tuberculosis H37Rv
aucgcagaacggacc

SEQ ID NO: 1268655 - RNA, 17 nt, Mycobacterium tuberculosis H37Rv
aucgccaucgguugacc

SEQ ID NO: 1268656 - RNA, 13 nt, Mycobacterium tuberculosis H37Rv
aucgccaggccga

SEQ ID NO: 1268657 - RNA, 17 nt, Mycobacterium tuberculosis H37Rv
aucgccagcgccggcca

SEQ ID NO: 1268658 - RNA, 14 nt, Mycobacterium tuberculosis H37Rv
aucgccagcggcaa

SEQ ID NO: 1268659 - RNA, 15 nt, Mycobacterium tuberculosis H37Rv
aucgccaccgcguca

SEQ ID NO: 1268660 - RNA, 22 nt, Mycobacterium tuberculosis H37Rv
aucgaucaacaccaaucggguc

SEQ ID NO: 1268661 - RNA, 11 nt, Mycobacterium tuberculosis H37Rv
aucgauuugga

SEQ ID NO: 1268662 - RNA, 19 nt, Mycobacterium tuberculosis H37Rv
aucgaugcggugaauccgu

SEQ ID NO: 1268663 - RNA, 14 nt, Mycobacterium tuberculosis H37Rv
aucgaguucggccc

SEQ ID NO: 1268664 - RNA, 12 nt, Mycobacterium tuberculosis H37Rv
aucgaguucggc

SEQ ID NO: 1268665 - RNA, 19 nt, Mycobacterium tuberculosis H37Rv
aucgaguuccgcaucggcc

SEQ ID NO: 1268666 - RNA, 20 nt, Mycobacterium tuberculosis H37Rv
auccgugaaucgagcaccgc

SEQ ID NO: 1268667 - RNA, 17 nt, Mycobacterium tuberculosis H37Rv
aucgaggcgaucaccgc

SEQ ID NO: 1268668 - RNA, 14 nt, Mycobacterium tuberculosis H37Rv
aucgcgucggcgau

SEQ ID NO: 1268669 - RNA, 18 nt, Mycobacterium tuberculosis H37Rv
aucgcgucgagagaacgu

SEQ ID NO: 1268670 - RNA, 17 nt, Mycobacterium tuberculosis H37Rv
aucgcguggaucgcgcu

SEQ ID NO: 1268671 - RNA, 14 nt, Mycobacterium tuberculosis H37Rv
aucgcguggaucgc

SEQ ID NO: 1268672 - RNA, 19 nt, Mycobacterium tuberculosis H37Rv
aucgcggucagcgggucga

SEQ ID NO: 1268673 - RNA, 19 nt, Mycobacterium tuberculosis H37Rv
aucgcggucuugacaccgc

SEQ ID NO: 1268674 - RNA, 21 nt, Mycobacterium tuberculosis H37Rv
aucgcgggcggcgcuggcguc

SEQ ID NO: 1268675 - RNA, 22 nt, Mycobacterium tuberculosis H37Rv
aucgcgacgaugccccgguuga

SEQ ID NO: 1268676 - RNA, 15 nt, Mycobacterium tuberculosis H37Rv
aucgcgacgaugccc

SEQ ID NO: 1268677 - RNA, 15 nt, Mycobacterium tuberculosis H37Rv
aucgcgagccagcug

SEQ ID NO: 1268678 - RNA, 20 nt, Mycobacterium tuberculosis H37Rv
aucgcgagaaggugcugcgc

SEQ ID NO: 1268679 - RNA, 20 nt, Mycobacterium tuberculosis H37Rv
aucgcgaacgaagucgacga

SEQ ID NO: 1268680 - RNA, 18 nt, Mycobacterium tuberculosis H37Rv
aucgcgaauauagcggcg

SEQ ID NO: 1268681 - RNA, 16 nt, Mycobacterium tuberculosis H37Rv
aucgccuggaugccga

SEQ ID NO: 1268682 - RNA, 18 nt, Mycobacterium tuberculosis H37Rv
aucgccuugcccagcgac

SEQ ID NO: 1268683 - RNA, 20 nt, Mycobacterium tuberculosis H37Rv
aucgccugcgccuuggucgc

SEQ ID NO: 1268684 - RNA, 21 nt, Mycobacterium tuberculosis H37Rv
aucgcccugggcgccggcguc

SEQ ID NO: 1268685 - RNA, 14 nt, Mycobacterium tuberculosis H37Rv
aucgccgaaucggc

SEQ ID NO: 1268686 - RNA, 16 nt, Mycobacterium tuberculosis H37Rv
aucgccgacacccucg

SEQ ID NO: 1268687 - RNA, 20 nt, Mycobacterium tuberculosis H37Rv
aucgccgacgccagaacgug

SEQ ID NO: 1268688 - RNA, 22 nt, Mycobacterium tuberculosis H37Rv
aucgccgacgccagaacguggc

SEQ ID NO: 1268689 - RNA, 16 nt, Mycobacterium tuberculosis H37Rv
aucgccgagaccgcgu

SEQ ID NO: 1268690 - RNA, 13 nt, Mycobacterium tuberculosis H37Rv
aucgccgacgccc

SEQ ID NO: 1268691 - RNA, 21 nt, Mycobacterium tuberculosis H37Rv
aucgccgaccucgaacggggu

SEQ ID NO: 1268692 - RNA, 22 nt, Mycobacterium tuberculosis H37Rv
aucgccgaggccucggccagcg

SEQ ID NO: 1268693 - RNA, 22 nt, Mycobacterium tuberculosis H37Rv
aucgccgaggcagcgucgucga

SEQ ID NO: 1268694 - RNA, 15 nt, Mycobacterium tuberculosis H37Rv
aucgccgaguccggc

SEQ ID NO: 1268695 - RNA, 15 nt, Mycobacterium tuberculosis H37Rv
aucgccuccucgacg

SEQ ID NO: 1268696 - RNA, 20 nt, Mycobacterium tuberculosis H37Rv
aucgccucggcguaggcgau

SEQ ID NO: 1268697 - RNA, 19 nt, Mycobacterium tuberculosis H37Rv
augcccuguucgauaagca

SEQ ID NO: 1268698 - RNA, 13 nt, Mycobacterium tuberculosis H37Rv
augcccucggcgc

SEQ ID NO: 1268699 - RNA, 19 nt, Mycobacterium tuberculosis H37Rv
augcccuccucgaccgcgg

SEQ ID NO: 1268700 - RNA, 20 nt, Mycobacterium tuberculosis H37Rv
augcccggcggguagcucgc

SEQ ID NO: 1268701 - RNA, 19 nt, Mycobacterium tuberculosis H37Rv
augcccggacgauggcguc

SEQ ID NO: 1268702 - RNA, 19 nt, Mycobacterium tuberculosis H37Rv
augccaggacuggcaccgc

SEQ ID NO: 1268703 - RNA, 19 nt, Mycobacterium tuberculosis H37Rv
augccauuucgucgucgcu

SEQ ID NO: 1268704 - RNA, 20 nt, Mycobacterium tuberculosis H37Rv
augcccaagcccucgacguc

SEQ ID NO: 1268705 - RNA, 14 nt, Mycobacterium tuberculosis H37Rv
augccagucgccga

SEQ ID NO: 1268706 - RNA, 15 nt, Mycobacterium tuberculosis H37Rv
augccacagaccgaa

SEQ ID NO: 1268707 - RNA, 18 nt, Mycobacterium tuberculosis H37Rv
augccagaucggccaacu

SEQ ID NO: 1268708 - RNA, 14 nt, Mycobacterium tuberculosis H37Rv
augcaacaccgcac

SEQ ID NO: 1268709 - RNA, 23 nt, Mycobacterium tuberculosis H37Rv
augacgguguacucgaagcgggc

SEQ ID NO: 1268710 - RNA, 16 nt, Mycobacterium tuberculosis H37Rv
augacguuuggauggc

SEQ ID NO: 1268711 - RNA, 16 nt, Mycobacterium tuberculosis H37Rv
augacgguuugcagcg

SEQ ID NO: 1268712 - RNA, 23 nt, Mycobacterium tuberculosis H37Rv
augacgguggggucgccgucgaa

SEQ ID NO: 1268713 - RNA, 20 nt, Mycobacterium tuberculosis H37Rv
augacggcuccgaugcaucg

SEQ ID NO: 1268714 - RNA, 18 nt, Mycobacterium tuberculosis H37Rv
aucugccgguaccggcga

SEQ ID NO: 1268715 - RNA, 14 nt, Mycobacterium tuberculosis H37Rv
augacggccugcac

SEQ ID NO: 1268716 - RNA, 23 nt, Mycobacterium tuberculosis H37Rv
aucugcgccaucacaucggccuc

SEQ ID NO: 1268717 - RNA, 19 nt, Mycobacterium tuberculosis H37Rv
aucugacgacgcgacacgc

SEQ ID NO: 1268718 - RNA, 14 nt, Mycobacterium tuberculosis H37Rv
aucugaucggcgcg

SEQ ID NO: 1268719 - RNA, 14 nt, Mycobacterium tuberculosis H37Rv
augagccaacccga

SEQ ID NO: 1268720 - RNA, 16 nt, Mycobacterium tuberculosis H37Rv
augagcggucagcguc

SEQ ID NO: 1268721 - RNA, 13 nt, Mycobacterium tuberculosis H37Rv
augaggucaacgc

SEQ ID NO: 1268722 - RNA, 20 nt, Mycobacterium tuberculosis H37Rv
augaucuugccgcggcgcaa

SEQ ID NO: 1268723 - RNA, 19 nt, Mycobacterium tuberculosis H37Rv
augccggacgccaugcccg

SEQ ID NO: 1268724 - RNA, 17 nt, Mycobacterium tuberculosis H37Rv
augccgggcccgacguu

SEQ ID NO: 1268725 - RNA, 21 nt, Mycobacterium tuberculosis H37Rv
augccgguguugccgaagccc

SEQ ID NO: 1268726 - RNA, 16 nt, Mycobacterium tuberculosis H37Rv
augccggugccgggca

SEQ ID NO: 1268727 - RNA, 15 nt, Mycobacterium tuberculosis H37Rv
augccguauagcgca

SEQ ID NO: 1268728 - RNA, 17 nt, Mycobacterium tuberculosis H37Rv
augccguggccgccaug

SEQ ID NO: 1268729 - RNA, 17 nt, Mycobacterium tuberculosis H37Rv
augccgugcugggccga

SEQ ID NO: 1268730 - RNA, 12 nt, Mycobacterium tuberculosis H37Rv
augccguucgga

SEQ ID NO: 1268731 - RNA, 18 nt, Mycobacterium tuberculosis H37Rv
augccgucgccggucagg

SEQ ID NO: 1268732 - RNA, 23 nt, Mycobacterium tuberculosis H37Rv
augccgccaugcgcaccagucca

SEQ ID NO: 1268733 - RNA, 14 nt, Mycobacterium tuberculosis H37Rv
augccgccggcagc

SEQ ID NO: 1268734 - RNA, 20 nt, Mycobacterium tuberculosis H37Rv
augccgcgggacaucaccgc

SEQ ID NO: 1268735 - RNA, 16 nt, Mycobacterium tuberculosis H37Rv
augccgccaaccgcgu

SEQ ID NO: 1268736 - RNA, 23 nt, Mycobacterium tuberculosis H37Rv
augccgaucggccugcagcgaug

SEQ ID NO: 1268737 - RNA, 17 nt, Mycobacterium tuberculosis H37Rv
augccgaggaucgcgcc

SEQ ID NO: 1268738 - RNA, 22 nt, Mycobacterium tuberculosis H37Rv
augccgacgacggguuggcguc

SEQ ID NO: 1268739 - RNA, 18 nt, Mycobacterium tuberculosis H37Rv
augcgcucacugcagcgc

SEQ ID NO: 1268740 - RNA, 17 nt, Mycobacterium tuberculosis H37Rv
augcgcggugaccgggu

SEQ ID NO: 1268741 - RNA, 22 nt, Mycobacterium tuberculosis H37Rv
augcgcugucgcccucgaucgc

SEQ ID NO: 1268742 - RNA, 20 nt, Mycobacterium tuberculosis H37Rv
augcgugaccagucgcggcg

SEQ ID NO: 1268743 - RNA, 12 nt, Mycobacterium tuberculosis H37Rv
augcggaacgcc

SEQ ID NO: 1268744 - RNA, 19 nt, Mycobacterium tuberculosis H37Rv
augcggaugucgucgacca

SEQ ID NO: 1268745 - RNA, 20 nt, Mycobacterium tuberculosis H37Rv
augccucggcggccucgcug

SEQ ID NO: 1268746 - RNA, 20 nt, Mycobacterium tuberculosis H37Rv
augccuagguagucggccuc

SEQ ID NO: 1268747 - RNA, 17 nt, Mycobacterium tuberculosis H37Rv
augccuggaaucgcgga

SEQ ID NO: 1268748 - RNA, 16 nt, Mycobacterium tuberculosis H37Rv
augccugccucggcga

SEQ ID NO: 1268749 - RNA, 18 nt, Mycobacterium tuberculosis H37Rv
augccuugaccgcggucu

SEQ ID NO: 1268750 - RNA, 15 nt, Mycobacterium tuberculosis H37Rv
augccuugaccgcgg

SEQ ID NO: 1268751 - RNA, 16 nt, Mycobacterium tuberculosis H37Rv
augccuuggcagccca

SEQ ID NO: 1268752 - RNA, 23 nt, Mycobacterium tuberculosis H37Rv
augccuuugggcuguggccgcgu

SEQ ID NO: 1268753 - RNA, 14 nt, Mycobacterium tuberculosis H37Rv
augcgagaacgucg

SEQ ID NO: 1268754 - RNA, 19 nt, Mycobacterium tuberculosis H37Rv
augcgacgcagaccgucca

SEQ ID NO: 1268755 - RNA, 20 nt, Mycobacterium tuberculosis H37Rv
augcgacgcagaccguccag

SEQ ID NO: 1268756 - RNA, 18 nt, Mycobacterium tuberculosis H37Rv
augucgagcacaccgucg

SEQ ID NO: 1268757 - RNA, 18 nt, Mycobacterium tuberculosis H37Rv
augucgaucagcgcgacg

SEQ ID NO: 1268758 - RNA, 15 nt, Mycobacterium tuberculosis H37Rv
augucgacggucaga

SEQ ID NO: 1268759 - RNA, 15 nt, Mycobacterium tuberculosis H37Rv
augucgaugccgugu

SEQ ID NO: 1268760 - RNA, 17 nt, Mycobacterium tuberculosis H37Rv
augucgacgagcaccgc

SEQ ID NO: 1268761 - RNA, 13 nt, Mycobacterium tuberculosis H37Rv
augucgaccgcga

SEQ ID NO: 1268762 - RNA, 21 nt, Mycobacterium tuberculosis H37Rv
auguccauguuuugcugcaug

SEQ ID NO: 1268763 - RNA, 18 nt, Mycobacterium tuberculosis H37Rv
auguagugcugcucgaca

SEQ ID NO: 1268764 - RNA, 18 nt, Mycobacterium tuberculosis H37Rv
auggucauccagccagca

SEQ ID NO: 1268765 - RNA, 22 nt, Mycobacterium tuberculosis H37Rv
augguccggccgcggaccgcga

SEQ ID NO: 1268766 - RNA, 14 nt, Mycobacterium tuberculosis H37Rv
auggucgacggguu

SEQ ID NO: 1268767 - RNA, 16 nt, Mycobacterium tuberculosis H37Rv
auggucagcuggccgc

SEQ ID NO: 1268768 - RNA, 18 nt, Mycobacterium tuberculosis H37Rv
auggucaccagcuggaac

SEQ ID NO: 1268769 - RNA, 16 nt, Mycobacterium tuberculosis H37Rv
auggugaaguugccgg

SEQ ID NO: 1268770 - RNA, 21 nt, Mycobacterium tuberculosis H37Rv
auggucgucauccuggucacc

SEQ ID NO: 1268771 - RNA, 20 nt, Mycobacterium tuberculosis H37Rv
auggugcaggacgaacgcgu

SEQ ID NO: 1268772 - RNA, 23 nt, Mycobacterium tuberculosis H37Rv
auggugcucaaggcuucggcggc

SEQ ID NO: 1268773 - RNA, 16 nt, Mycobacterium tuberculosis H37Rv
auggugcugcggcguc

SEQ ID NO: 1268774 - RNA, 21 nt, Mycobacterium tuberculosis H37Rv
auggugccggugauggccgac

SEQ ID NO: 1268775 - RNA, 23 nt, Mycobacterium tuberculosis H37Rv
auggcgcggucgcugaugagcuc

SEQ ID NO: 1268776 - RNA, 22 nt, Mycobacterium tuberculosis H37Rv
auggcggcuucgacgucggcga

SEQ ID NO: 1268777 - RNA, 18 nt, Mycobacterium tuberculosis H37Rv
auggcgucaugaacgauc

SEQ ID NO: 1268778 - RNA, 17 nt, Mycobacterium tuberculosis H37Rv
auggcggccaccgucag

SEQ ID NO: 1268779 - RNA, 14 nt, Mycobacterium tuberculosis H37Rv
auggcguucugcgc

SEQ ID NO: 1268780 - RNA, 16 nt, Mycobacterium tuberculosis H37Rv
auggcgcaccggcguc

SEQ ID NO: 1268781 - RNA, 21 nt, Mycobacterium tuberculosis H37Rv
auggccgcauuggcgaccgcu

SEQ ID NO: 1268782 - RNA, 20 nt, Mycobacterium tuberculosis H37Rv
auggcccuuccggccgacac

SEQ ID NO: 1268783 - RNA, 15 nt, Mycobacterium tuberculosis H37Rv
auggcccuggcgacc

SEQ ID NO: 1268784 - RNA, 17 nt, Mycobacterium tuberculosis H37Rv
auggccgaccagccgau

SEQ ID NO: 1268785 - RNA, 21 nt, Mycobacterium tuberculosis H37Rv
augcucgauccacugccgcgc

SEQ ID NO: 1268786 - RNA, 14 nt, Mycobacterium tuberculosis H37Rv
augcucgucccaga

SEQ ID NO: 1268787 - RNA, 13 nt, Mycobacterium tuberculosis H37Rv
augcucaccggga

SEQ ID NO: 1268788 - RNA, 23 nt, Mycobacterium tuberculosis H37Rv
augcucaccgaaacgaugcggcc

SEQ ID NO: 1268789 - RNA, 20 nt, Mycobacterium tuberculosis H37Rv
augcucagcuggucggcuuc

SEQ ID NO: 1268790 - RNA, 19 nt, Mycobacterium tuberculosis H37Rv
auguugugccgaucggcca

SEQ ID NO: 1268791 - RNA, 19 nt, Mycobacterium tuberculosis H37Rv
augucgcugggugcgcgaa

SEQ ID NO: 1268792 - RNA, 20 nt, Mycobacterium tuberculosis H37Rv
auuaggggcuuuugcgucug

SEQ ID NO: 1268793 - RNA, 14 nt, Mycobacterium tuberculosis H37Rv
auuacuucggccac

SEQ ID NO: 1268794 - RNA, 13 nt, Mycobacterium tuberculosis H37Rv
auuccaccgccga

SEQ ID NO: 1268795 - RNA, 17 nt, Mycobacterium tuberculosis H37Rv
auuccagaucaacgcgu

SEQ ID NO: 1268796 - RNA, 17 nt, Mycobacterium tuberculosis H37Rv
auuccaccuuggccaga

SEQ ID NO: 1268797 - RNA, 17 nt, Mycobacterium tuberculosis H37Rv
auuccacggcagcaccg

SEQ ID NO: 1268798 - RNA, 13 nt, Mycobacterium tuberculosis H37Rv
auuccagccggug

SEQ ID NO: 1268799 - RNA, 16 nt, Mycobacterium tuberculosis H37Rv
auuccagccagccgcc

SEQ ID NO: 1268800 - RNA, 15 nt, Mycobacterium tuberculosis H37Rv
auuucgucgucgcag

SEQ ID NO: 1268801 - RNA, 20 nt, Mycobacterium tuberculosis H37Rv
auuucuagguggacgugcag

SEQ ID NO: 1268802 - RNA, 21 nt, Mycobacterium tuberculosis H37Rv
auucccgcggcaacgcggucu

SEQ ID NO: 1268803 - RNA, 14 nt, Mycobacterium tuberculosis H37Rv
auucccaggaacgg

SEQ ID NO: 1268804 - RNA, 22 nt, Mycobacterium tuberculosis H37Rv
auucccaauucagauagucgcc

SEQ ID NO: 1268805 - RNA, 18 nt, Mycobacterium tuberculosis H37Rv
caaagcccuccucgauga

SEQ ID NO: 1268806 - RNA, 15 nt, Mycobacterium tuberculosis H37Rv
caaagccgucgacgc

SEQ ID NO: 1268807 - RNA, 14 nt, Mycobacterium tuberculosis H37Rv
caaagccgucagcu

SEQ ID NO: 1268808 - RNA, 22 nt, Mycobacterium tuberculosis H37Rv
caaagcacuucacgaguagcgg

SEQ ID NO: 1268809 - RNA, 17 nt, Mycobacterium tuberculosis H37Rv
caaagacccggcaccca

SEQ ID NO: 1268810 - RNA, 17 nt, Mycobacterium tuberculosis H37Rv
caaacgcgcgcgccauu

SEQ ID NO: 1268811 - RNA, 20 nt, Mycobacterium tuberculosis H37Rv
caaacaucuugucgaucugc

SEQ ID NO: 1268812 - RNA, 15 nt, Mycobacterium tuberculosis H37Rv
caaaauacuccgcga

SEQ ID NO: 1268813 - RNA, 20 nt, Mycobacterium tuberculosis H37Rv
auuuugcgucugcucggcgc

SEQ ID NO: 1268814 - RNA, 15 nt, Mycobacterium tuberculosis H37Rv
auuuucggcacggau

SEQ ID NO: 1268815 - RNA, 17 nt, Mycobacterium tuberculosis H37Rv
caaaaacccggugacca

SEQ ID NO: 1268816 - RNA, 17 nt, Mycobacterium tuberculosis H37Rv
caacgcgcauucgggau

SEQ ID NO: 1268817 - RNA, 16 nt, Mycobacterium tuberculosis H37Rv
caacgcgcacgcgugc

SEQ ID NO: 1268818 - RNA, 18 nt, Mycobacterium tuberculosis H37Rv
caacgcgcaaccagccuu

SEQ ID NO: 1268819 - RNA, 22 nt, Mycobacterium tuberculosis H37Rv
caacgcgggaacgaugccgccg

SEQ ID NO: 1268820 - RNA, 20 nt, Mycobacterium tuberculosis H37Rv
caacggaaucucuucggcgg

SEQ ID NO: 1268821 - RNA, 11 nt, Mycobacterium tuberculosis H37Rv
caacggaaucu

SEQ ID NO: 1268822 - RNA, 16 nt, Mycobacterium tuberculosis H37Rv
caacggaagaccgcgg

SEQ ID NO: 1268823 - RNA, 23 nt, Mycobacterium tuberculosis H37Rv
caacggaaucgguuucgaccugc

SEQ ID NO: 1268824 - RNA, 15 nt, Mycobacterium tuberculosis H37Rv
caacggcacccugcg

SEQ ID NO: 1268825 - RNA, 17 nt, Mycobacterium tuberculosis H37Rv
caacggcaccucgacgu

SEQ ID NO: 1268826 - RNA, 20 nt, Mycobacterium tuberculosis H37Rv
caacggcaccucgacgucga

SEQ ID NO: 1268827 - RNA, 17 nt, Mycobacterium tuberculosis H37Rv
caacgcgaaccgucucg

SEQ ID NO: 1268828 - RNA, 14 nt, Mycobacterium tuberculosis H37Rv
caacgcgaguccgc

SEQ ID NO: 1268829 - RNA, 18 nt, Mycobacterium tuberculosis H37Rv
caacgcgauaguugccga

SEQ ID NO: 1268830 - RNA, 23 nt, Mycobacterium tuberculosis H37Rv
caacgcgaucaccucgccacacu

SEQ ID NO: 1268831 - RNA, 23 nt, Mycobacterium tuberculosis H37Rv
caacgccucgauggcgguggcga

SEQ ID NO: 1268832 - RNA, 20 nt, Mycobacterium tuberculosis H37Rv
caacgccucgccauccauga

SEQ ID NO: 1268833 - RNA, 13 nt, Mycobacterium tuberculosis H37Rv
caacgccgauggc

SEQ ID NO: 1268834 - RNA, 23 nt, Mycobacterium tuberculosis H37Rv
caacgacauccagaugcccagca

SEQ ID NO: 1268835 - RNA, 21 nt, Mycobacterium tuberculosis H37Rv
caacgccagcaccagcgucgc

SEQ ID NO: 1268836 - RNA, 16 nt, Mycobacterium tuberculosis H37Rv
caacgccagcaccagc

SEQ ID NO: 1268837 - RNA, 14 nt, Mycobacterium tuberculosis H37Rv
caacgccacgccga

SEQ ID NO: 1268838 - RNA, 15 nt, Mycobacterium tuberculosis H37Rv
caacgcaucgguggc

SEQ ID NO: 1268839 - RNA, 20 nt, Mycobacterium tuberculosis H37Rv
caacgccauuuccuggcgca

SEQ ID NO: 1268840 - RNA, 18 nt, Mycobacterium tuberculosis H37Rv
caacgcccaacgucgcca

SEQ ID NO: 1268841 - RNA, 21 nt, Mycobacterium tuberculosis H37Rv
caacgaaugguaucgaguggc

SEQ ID NO: 1268842 - RNA, 23 nt, Mycobacterium tuberculosis H37Rv
caacgaagagggcgccgcgcgca

SEQ ID NO: 1268843 - RNA, 19 nt, Mycobacterium tuberculosis H37Rv
caacgaaccgcucagcgca

SEQ ID NO: 1268844 - RNA, 14 nt, Mycobacterium tuberculosis H37Rv
caacgaaccgcuca

SEQ ID NO: 1268845 - RNA, 16 nt, Mycobacterium tuberculosis H37Rv
caacgaaccagcuugc

SEQ ID NO: 1268846 - RNA, 15 nt, Mycobacterium tuberculosis H37Rv
caacgaaaccgaccu

SEQ ID NO: 1268847 - RNA, 21 nt, Mycobacterium tuberculosis H37Rv
caaccuuugcguugcugagca

SEQ ID NO: 1268848 - RNA, 17 nt, Mycobacterium tuberculosis H37Rv
caaccgaccgggccgca

SEQ ID NO: 1268849 - RNA, 14 nt, Mycobacterium tuberculosis H37Rv
caaccgaaccgcgu

SEQ ID NO: 1268850 - RNA, 15 nt, Mycobacterium tuberculosis H37Rv
caacccugcggugca

SEQ ID NO: 1268851 - RNA, 17 nt, Mycobacterium tuberculosis H37Rv
caacccugcggcgucgu

SEQ ID NO: 1268852 - RNA, 23 nt, Mycobacterium tuberculosis H37Rv
caacccggugauggugugcagca

SEQ ID NO: 1268853 - RNA, 13 nt, Mycobacterium tuberculosis H37Rv
caacccggugaug

SEQ ID NO: 1268854 - RNA, 19 nt, Mycobacterium tuberculosis H37Rv
caacccgucgagccgugcc

SEQ ID NO: 1268855 - RNA, 23 nt, Mycobacterium tuberculosis H37Rv
caacccgugcgacuucgagauug

SEQ ID NO: 1268856 - RNA, 20 nt, Mycobacterium tuberculosis H37Rv
caacccuagggcggugccgc

SEQ ID NO: 1268857 - RNA, 17 nt, Mycobacterium tuberculosis H37Rv
caaccagugcagcucga

SEQ ID NO: 1268858 - RNA, 17 nt, Mycobacterium tuberculosis H37Rv
caacccggucggcagcu

SEQ ID NO: 1268859 - RNA, 17 nt, Mycobacterium tuberculosis H37Rv
caacaucgagcgccagc

SEQ ID NO: 1268860 - RNA, 20 nt, Mycobacterium tuberculosis H37Rv
caacagggugacuucgcugc

SEQ ID NO: 1268861 - RNA, 16 nt, Mycobacterium tuberculosis H37Rv
caacagguccaccggc

SEQ ID NO: 1268862 - RNA, 22 nt, Mycobacterium tuberculosis H37Rv
caacagggcgccgacgacuccg

SEQ ID NO: 1268863 - RNA, 17 nt, Mycobacterium tuberculosis H37Rv
caacaggccggcucgcu

SEQ ID NO: 1268864 - RNA, 22 nt, Mycobacterium tuberculosis H37Rv
caaaguucggugauuucggcgu

SEQ ID NO: 1268865 - RNA, 15 nt, Mycobacterium tuberculosis H37Rv
caaaguaucgcagca

SEQ ID NO: 1268866 - RNA, 12 nt, Mycobacterium tuberculosis H37Rv
caacagcggcaa

SEQ ID NO: 1268867 - RNA, 20 nt, Mycobacterium tuberculosis H37Rv
caagaaugccgccgacggga

SEQ ID NO: 1268868 - RNA, 21 nt, Mycobacterium tuberculosis H37Rv
caagaccaagugucgccgcuc

SEQ ID NO: 1268869 - RNA, 17 nt, Mycobacterium tuberculosis H37Rv
caagaaacagguaagca

SEQ ID NO: 1268870 - RNA, 23 nt, Mycobacterium tuberculosis H37Rv
caacugggcggccuggucggcca

SEQ ID NO: 1268871 - RNA, 20 nt, Mycobacterium tuberculosis H37Rv
caacuucuuuagcguguggc

SEQ ID NO: 1268872 - RNA, 15 nt, Mycobacterium tuberculosis H37Rv
caacggucucaacgc

SEQ ID NO: 1268873 - RNA, 19 nt, Mycobacterium tuberculosis H37Rv
caacggggcagucaacucc

SEQ ID NO: 1268874 - RNA, 22 nt, Mycobacterium tuberculosis H37Rv
caacgggccuucagcucaccac

SEQ ID NO: 1268875 - RNA, 18 nt, Mycobacterium tuberculosis H37Rv
caacgggccuucgccacu

SEQ ID NO: 1268876 - RNA, 15 nt, Mycobacterium tuberculosis H37Rv
caacgggcgaacuug

SEQ ID NO: 1268877 - RNA, 23 nt, Mycobacterium tuberculosis H37Rv
caacggcagaucccacgccagga

SEQ ID NO: 1268878 - RNA, 16 nt, Mycobacterium tuberculosis H37Rv
caacucuucagcaagc

SEQ ID NO: 1268879 - RNA, 18 nt, Mycobacterium tuberculosis H37Rv
caacugauggcgcgcaac

SEQ ID NO: 1268880 - RNA, 19 nt, Mycobacterium tuberculosis H37Rv
caacugcgaaacgccaccg

SEQ ID NO: 1268881 - RNA, 14 nt, Mycobacterium tuberculosis H37Rv
caacugcucgacga

SEQ ID NO: 1268882 - RNA, 20 nt, Mycobacterium tuberculosis H37Rv
caacucuucccauuucggca

SEQ ID NO: 1268883 - RNA, 17 nt, Mycobacterium tuberculosis H37Rv
caacucgguucgccccu

SEQ ID NO: 1268884 - RNA, 19 nt, Mycobacterium tuberculosis H37Rv
caagcggacccgaccgucg

SEQ ID NO: 1268885 - RNA, 13 nt, Mycobacterium tuberculosis H37Rv
caagccgaccugc

SEQ ID NO: 1268886 - RNA, 20 nt, Mycobacterium tuberculosis H37Rv
caagccgagcccgucgauca

SEQ ID NO: 1268887 - RNA, 17 nt, Mycobacterium tuberculosis H37Rv
caagcuaagcgccugau

SEQ ID NO: 1268888 - RNA, 14 nt, Mycobacterium tuberculosis H37Rv
caagcuaacucgac

SEQ ID NO: 1268889 - RNA, 16 nt, Mycobacterium tuberculosis H37Rv
caagcauuggcgucga

SEQ ID NO: 1268890 - RNA, 16 nt, Mycobacterium tuberculosis H37Rv
caagcagcgaccagca

SEQ ID NO: 1268891 - RNA, 19 nt, Mycobacterium tuberculosis H37Rv
caagcaguccacgagcacg

SEQ ID NO: 1268892 - RNA, 14 nt, Mycobacterium tuberculosis H37Rv
caagccagcacugc

SEQ ID NO: 1268893 - RNA, 15 nt, Mycobacterium tuberculosis H37Rv
caagccacgccgguc

SEQ ID NO: 1268894 - RNA, 18 nt, Mycobacterium tuberculosis H37Rv
caagccauguggcgucgc

SEQ ID NO: 1268895 - RNA, 18 nt, Mycobacterium tuberculosis H37Rv
caagauuaccgaagcccg

SEQ ID NO: 1268896 - RNA, 20 nt, Mycobacterium tuberculosis H37Rv
caagaguugccggaucgacg

SEQ ID NO: 1268897 - RNA, 21 nt, Mycobacterium tuberculosis H37Rv
caagcacagcccggcgacgac

SEQ ID NO: 1268898 - RNA, 22 nt, Mycobacterium tuberculosis H37Rv
caagcacagcccggcgacgacc

SEQ ID NO: 1268899 - RNA, 14 nt, Mycobacterium tuberculosis H37Rv
caagcacgcgacgg

SEQ ID NO: 1268900 - RNA, 19 nt, Mycobacterium tuberculosis H37Rv
caagcagacgcagaaucgc

SEQ ID NO: 1268901 - RNA, 22 nt, Mycobacterium tuberculosis H37Rv
caagcacauuauucuucgcggc

SEQ ID NO: 1268902 - RNA, 16 nt, Mycobacterium tuberculosis H37Rv
caccgccgacgcccga

SEQ ID NO: 1268903 - RNA, 17 nt, Mycobacterium tuberculosis H37Rv
caccgcccuugccgccg

SEQ ID NO: 1268904 - RNA, 16 nt, Mycobacterium tuberculosis H37Rv
caccgccgaacagugu

SEQ ID NO: 1268905 - RNA, 22 nt, Mycobacterium tuberculosis H37Rv
caccgccgcccaaaacgucacc

SEQ ID NO: 1268906 - RNA, 13 nt, Mycobacterium tuberculosis H37Rv
caccgccgcacgc

SEQ ID NO: 1268907 - RNA, 19 nt, Mycobacterium tuberculosis H37Rv
caccgccgccgccaccggc

SEQ ID NO: 1268908 - RNA, 14 nt, Mycobacterium tuberculosis H37Rv
caccgccgccggag

SEQ ID NO: 1268909 - RNA, 14 nt, Mycobacterium tuberculosis H37Rv
caccgccgccggca

SEQ ID NO: 1268910 - RNA, 15 nt, Mycobacterium tuberculosis H37Rv
caccgccgccgccac

SEQ ID NO: 1268911 - RNA, 13 nt, Mycobacterium tuberculosis H37Rv
caccgccgccgaa

SEQ ID NO: 1268912 - RNA, 21 nt, Mycobacterium tuberculosis H37Rv
caccgccaguuccggugacgg

SEQ ID NO: 1268913 - RNA, 13 nt, Mycobacterium tuberculosis H37Rv
caccgccagcggc

SEQ ID NO: 1268914 - RNA, 15 nt, Mycobacterium tuberculosis H37Rv
caccgcccuugccgc

SEQ ID NO: 1268915 - RNA, 20 nt, Mycobacterium tuberculosis H37Rv
caccgcccccgucggccuug

SEQ ID NO: 1268916 - RNA, 18 nt, Mycobacterium tuberculosis H37Rv
caccgccccgcgcccaac

SEQ ID NO: 1268917 - RNA, 17 nt, Mycobacterium tuberculosis H37Rv
caccgcccgcaagucgg

SEQ ID NO: 1268918 - RNA, 23 nt, Mycobacterium tuberculosis H37Rv
caccgcccgcaagucggacgggu

SEQ ID NO: 1268919 - RNA, 23 nt, Mycobacterium tuberculosis H37Rv
caccgccuguacgagcagaucgc

SEQ ID NO: 1268920 - RNA, 17 nt, Mycobacterium tuberculosis H37Rv
caccgcgaaagcaccga

SEQ ID NO: 1268921 - RNA, 20 nt, Mycobacterium tuberculosis H37Rv
caccgccuuugccgccggca

SEQ ID NO: 1268922 - RNA, 14 nt, Mycobacterium tuberculosis H37Rv
caccgcgaccucgc

SEQ ID NO: 1268923 - RNA, 13 nt, Mycobacterium tuberculosis H37Rv
caccgcgacaccc

SEQ ID NO: 1268924 - RNA, 17 nt, Mycobacterium tuberculosis H37Rv
caccgcgacaccccgga

SEQ ID NO: 1268925 - RNA, 17 nt, Mycobacterium tuberculosis H37Rv
caccgccggcaccgccg

SEQ ID NO: 1268926 - RNA, 14 nt, Mycobacterium tuberculosis H37Rv
caccgcgcucucgg

SEQ ID NO: 1268927 - RNA, 17 nt, Mycobacterium tuberculosis H37Rv
caccgcgcucucgguca

SEQ ID NO: 1268928 - RNA, 15 nt, Mycobacterium tuberculosis H37Rv
caccgcggacccgca

SEQ ID NO: 1268929 - RNA, 14 nt, Mycobacterium tuberculosis H37Rv
caccgcgcagcgaa

SEQ ID NO: 1268930 - RNA, 14 nt, Mycobacterium tuberculosis H37Rv
caccgcgacgacga

SEQ ID NO: 1268931 - RNA, 15 nt, Mycobacterium tuberculosis H37Rv
caccgcgaucaccac

SEQ ID NO: 1268932 - RNA, 13 nt, Mycobacterium tuberculosis H37Rv
caccgcgaucacc

SEQ ID NO: 1268933 - RNA, 22 nt, Mycobacterium tuberculosis H37Rv
caccgauggcgguggugccgcg

SEQ ID NO: 1268934 - RNA, 17 nt, Mycobacterium tuberculosis H37Rv
caccgaugugaccgaac

SEQ ID NO: 1268935 - RNA, 15 nt, Mycobacterium tuberculosis H37Rv
caccgauucggcgac

SEQ ID NO: 1268936 - RNA, 18 nt, Mycobacterium tuberculosis H37Rv
caccgauucggcgacgaa

SEQ ID NO: 1268937 - RNA, 15 nt, Mycobacterium tuberculosis H37Rv
caccgcaacgcgugc

SEQ ID NO: 1268938 - RNA, 19 nt, Mycobacterium tuberculosis H37Rv
caccgcaaaguagacgugc

SEQ ID NO: 1268939 - RNA, 21 nt, Mycobacterium tuberculosis H37Rv
caccgcagauccccgccaccg

SEQ ID NO: 1268940 - RNA, 22 nt, Mycobacterium tuberculosis H37Rv
caccgcacggaugucgcccaac

SEQ ID NO: 1268941 - RNA, 17 nt, Mycobacterium tuberculosis H37Rv
caccgcacguucggcgu

SEQ ID NO: 1268942 - RNA, 15 nt, Mycobacterium tuberculosis H37Rv
caccgcacaccugcg

SEQ ID NO: 1268943 - RNA, 22 nt, Mycobacterium tuberculosis H37Rv
caccgcauaacgcgaacccgcg

SEQ ID NO: 1268944 - RNA, 23 nt, Mycobacterium tuberculosis H37Rv
caccgcaucgggcuugcgcagca

SEQ ID NO: 1268945 - RNA, 18 nt, Mycobacterium tuberculosis H37Rv
caccgccagauaggcacc

SEQ ID NO: 1268946 - RNA, 19 nt, Mycobacterium tuberculosis H37Rv
caccgaggaccucgucacc

SEQ ID NO: 1268947 - RNA, 12 nt, Mycobacterium tuberculosis H37Rv
caccgagccgau

SEQ ID NO: 1268948 - RNA, 20 nt, Mycobacterium tuberculosis H37Rv
caccgagccacgacccagca

SEQ ID NO: 1268949 - RNA, 16 nt, Mycobacterium tuberculosis H37Rv
caccgagcgcaaucga

SEQ ID NO: 1268950 - RNA, 21 nt, Mycobacterium tuberculosis H37Rv
caccgagcugagcggccagca

SEQ ID NO: 1268951 - RNA, 13 nt, Mycobacterium tuberculosis H37Rv
caccgaugcguuc

SEQ ID NO: 1268952 - RNA, 18 nt, Mycobacterium tuberculosis H37Rv
caccgaggucgagcgacc

SEQ ID NO: 1268953 - RNA, 15 nt, Mycobacterium tuberculosis H37Rv
caccgagccacgacc

SEQ ID NO: 1268954 - RNA, 17 nt, Mycobacterium tuberculosis H37Rv
cacccuugccgccggug

SEQ ID NO: 1268955 - RNA, 17 nt, Mycobacterium tuberculosis H37Rv
caccgagccgucgucga

SEQ ID NO: 1268956 - RNA, 13 nt, Mycobacterium tuberculosis H37Rv
cacccuugccgcc

SEQ ID NO: 1268957 - RNA, 13 nt, Mycobacterium tuberculosis H37Rv
cacccuggucgaa

SEQ ID NO: 1268958 - RNA, 13 nt, Mycobacterium tuberculosis H37Rv
cacccuugcccac

SEQ ID NO: 1268959 - RNA, 21 nt, Mycobacterium tuberculosis H37Rv
cacccugcggcaccucauugc

SEQ ID NO: 1268960 - RNA, 18 nt, Mycobacterium tuberculosis H37Rv
cacccugaugugagucca

SEQ ID NO: 1268961 - RNA, 16 nt, Mycobacterium tuberculosis H37Rv
cacccuaaucguuccg

SEQ ID NO: 1268962 - RNA, 22 nt, Mycobacterium tuberculosis H37Rv
cacccgggccucggcgccgucg

SEQ ID NO: 1268963 - RNA, 17 nt, Mycobacterium tuberculosis H37Rv
cacccgguagacgucgu

SEQ ID NO: 1268964 - RNA, 23 nt, Mycobacterium tuberculosis H37Rv
cacccgguagacgucguagacac

SEQ ID NO: 1268965 - RNA, 19 nt, Mycobacterium tuberculosis H37Rv
caccccggucccgccgacc

SEQ ID NO: 1268966 - RNA, 16 nt, Mycobacterium tuberculosis H37Rv
caccccggucggagcg

SEQ ID NO: 1268967 - RNA, 17 nt, Mycobacterium tuberculosis H37Rv
caccccguagcggucuc

SEQ ID NO: 1268968 - RNA, 20 nt, Mycobacterium tuberculosis H37Rv
caccccgguucgacgucugc

SEQ ID NO: 1268969 - RNA, 22 nt, Mycobacterium tuberculosis H37Rv
caccccguucgaggucggcgau

SEQ ID NO: 1268970 - RNA, 21 nt, Mycobacterium tuberculosis H37Rv
caccccgcgaaccucacagcu

SEQ ID NO: 1268971 - RNA, 18 nt, Mycobacterium tuberculosis H37Rv
cacccaucaccgccagcc

SEQ ID NO: 1268972 - RNA, 18 nt, Mycobacterium tuberculosis H37Rv
cacccaucgcacggauga

SEQ ID NO: 1268973 - RNA, 15 nt, Mycobacterium tuberculosis H37Rv
cacccaucgaccgcc

SEQ ID NO: 1268974 - RNA, 23 nt, Mycobacterium tuberculosis H37Rv
cacccaaaccggcccgcagcagc

SEQ ID NO: 1268975 - RNA, 18 nt, Mycobacterium tuberculosis H37Rv
cacccaucgugcugaagc

SEQ ID NO: 1268976 - RNA, 15 nt, Mycobacterium tuberculosis H37Rv
caccccagcggccac

SEQ ID NO: 1268977 - RNA, 19 nt, Mycobacterium tuberculosis H37Rv
caccccacagucgugagcc

SEQ ID NO: 1268978 - RNA, 23 nt, Mycobacterium tuberculosis H37Rv
cacccggccguugggccaccggc

SEQ ID NO: 1268979 - RNA, 16 nt, Mycobacterium tuberculosis H37Rv
cacccgggaugaccac

SEQ ID NO: 1268980 - RNA, 22 nt, Mycobacterium tuberculosis H37Rv
cacccggaaagaucucggucac

SEQ ID NO: 1268981 - RNA, 14 nt, Mycobacterium tuberculosis H37Rv
cacccgcaccaccg

SEQ ID NO: 1268982 - RNA, 22 nt, Mycobacterium tuberculosis H37Rv
cacccgcaaugcgcgcgauggc

SEQ ID NO: 1268983 - RNA, 12 nt, Mycobacterium tuberculosis H37Rv
cacccgauuggc

SEQ ID NO: 1268984 - RNA, 18 nt, Mycobacterium tuberculosis H37Rv
cacccgaucgacgacuug

SEQ ID NO: 1268985 - RNA, 18 nt, Mycobacterium tuberculosis H37Rv
cacccgaucgacggucgu

SEQ ID NO: 1268986 - RNA, 14 nt, Mycobacterium tuberculosis H37Rv
cacccgagccgcac

SEQ ID NO: 1268987 - RNA, 17 nt, Mycobacterium tuberculosis H37Rv
cacccgcaccgccggca

SEQ ID NO: 1268988 - RNA, 14 nt, Mycobacterium tuberculosis H37Rv
cacccgcaccggau

SEQ ID NO: 1268989 - RNA, 15 nt, Mycobacterium tuberculosis H37Rv
cacccgcaccgcggu

SEQ ID NO: 1268990 - RNA, 20 nt, Mycobacterium tuberculosis H37Rv
cacccgcaccucaccggguu

SEQ ID NO: 1268991 - RNA, 21 nt, Mycobacterium tuberculosis H37Rv
caccaugggucuggcaggcca

SEQ ID NO: 1268992 - RNA, 23 nt, Mycobacterium tuberculosis H37Rv
caccaucgccgccguugccgccg

SEQ ID NO: 1268993 - RNA, 17 nt, Mycobacterium tuberculosis H37Rv
caccaucagcgacaagu

SEQ ID NO: 1268994 - RNA, 19 nt, Mycobacterium tuberculosis H37Rv
caccaucgccgccgcgcgu

SEQ ID NO: 1268995 - RNA, 17 nt, Mycobacterium tuberculosis H37Rv
caccaucuccgccgucg

SEQ ID NO: 1268996 - RNA, 21 nt, Mycobacterium tuberculosis H37Rv
caccaucuccgccgucgccac

SEQ ID NO: 1268997 - RNA, 16 nt, Mycobacterium tuberculosis H37Rv
caccaucguugccggu

SEQ ID NO: 1268998 - RNA, 21 nt, Mycobacterium tuberculosis H37Rv
caccaucguugccggugccgc

SEQ ID NO: 1268999 - RNA, 16 nt, Mycobacterium tuberculosis H37Rv
caccauaauggucguc

SEQ ID NO: 1269000 - RNA, 19 nt, Mycobacterium tuberculosis H37Rv
caccaguggcgcgugcagc

SEQ ID NO: 1269001 - RNA, 23 nt, Mycobacterium tuberculosis H37Rv
caccagguugcaaccuugggcgc

SEQ ID NO: 1269002 - RNA, 17 nt, Mycobacterium tuberculosis H37Rv
caccaguccagcgggca

SEQ ID NO: 1269003 - RNA, 23 nt, Mycobacterium tuberculosis H37Rv
caccaggcggccguaacggcgaa

SEQ ID NO: 1269004 - RNA, 14 nt, Mycobacterium tuberculosis H37Rv
caccacucggucgu

SEQ ID NO: 1269005 - RNA, 14 nt, Mycobacterium tuberculosis H37Rv
caccacgucccgga

SEQ ID NO: 1269006 - RNA, 14 nt, Mycobacterium tuberculosis H37Rv
caccacgucgaccg

SEQ ID NO: 1269007 - RNA, 16 nt, Mycobacterium tuberculosis H37Rv
cacaggccgacgaugu

SEQ ID NO: 1269008 - RNA, 18 nt, Mycobacterium tuberculosis H37Rv
cacagcuugcccgagccc

SEQ ID NO: 1269009 - RNA, 16 nt, Mycobacterium tuberculosis H37Rv
cacaggcgcgaucgcu

SEQ ID NO: 1269010 - RNA, 14 nt, Mycobacterium tuberculosis H37Rv
cacagucgcucgcu

SEQ ID NO: 1269011 - RNA, 18 nt, Mycobacterium tuberculosis H37Rv
cacagucacggaccgcuu

SEQ ID NO: 1269012 - RNA, 16 nt, Mycobacterium tuberculosis H37Rv
cacagugcggccccga

SEQ ID NO: 1269013 - RNA, 17 nt, Mycobacterium tuberculosis H37Rv
cacagugccaauuccag

SEQ ID NO: 1269014 - RNA, 23 nt, Mycobacterium tuberculosis H37Rv
cacaguggcucgcggaugcucgu

SEQ ID NO: 1269015 - RNA, 18 nt, Mycobacterium tuberculosis H37Rv
cacauccuggcggcugca

SEQ ID NO: 1269016 - RNA, 23 nt, Mycobacterium tuberculosis H37Rv
cacauccaguaaccguccgcgga

SEQ ID NO: 1269017 - RNA, 19 nt, Mycobacterium tuberculosis H37Rv
cacaucggcucugauggug

SEQ ID NO: 1269018 - RNA, 19 nt, Mycobacterium tuberculosis H37Rv
cacaucaugccagccguca

SEQ ID NO: 1269019 - RNA, 18 nt, Mycobacterium tuberculosis H37Rv
cacaucagccgcaccagu

SEQ ID NO: 1269020 - RNA, 20 nt, Mycobacterium tuberculosis H37Rv
caccaagguuggucggugcu

SEQ ID NO: 1269021 - RNA, 18 nt, Mycobacterium tuberculosis H37Rv
caccaagcucggccagca

SEQ ID NO: 1269022 - RNA, 15 nt, Mycobacterium tuberculosis H37Rv
caccaaggucggcga

SEQ ID NO: 1269023 - RNA, 16 nt, Mycobacterium tuberculosis H37Rv
caccaagcagcgacca

SEQ ID NO: 1269024 - RNA, 13 nt, Mycobacterium tuberculosis H37Rv
caccaacucgacg

SEQ ID NO: 1269025 - RNA, 13 nt, Mycobacterium tuberculosis H37Rv
caccaacgcggga

SEQ ID NO: 1269026 - RNA, 15 nt, Mycobacterium tuberculosis H37Rv
caccaacgagucagu

SEQ ID NO: 1269027 - RNA, 15 nt, Mycobacterium tuberculosis H37Rv
caccaacgacagcga

SEQ ID NO: 1269028 - RNA, 15 nt, Mycobacterium tuberculosis H37Rv
caccaacaccagcgc

SEQ ID NO: 1269029 - RNA, 16 nt, Mycobacterium tuberculosis H37Rv
caccaaaucgaugucc

SEQ ID NO: 1269030 - RNA, 19 nt, Mycobacterium tuberculosis H37Rv
cacauugaucgacggccag

SEQ ID NO: 1269031 - RNA, 19 nt, Mycobacterium tuberculosis H37Rv
cacauuggcgaucagcagc

SEQ ID NO: 1269032 - RNA, 22 nt, Mycobacterium tuberculosis H37Rv
cacauuggcgaucagcagccgc

SEQ ID NO: 1269033 - RNA, 15 nt, Mycobacterium tuberculosis H37Rv
cacaugcucagucgc

SEQ ID NO: 1269034 - RNA, 16 nt, Mycobacterium tuberculosis H37Rv
cacaugccacagcggc

SEQ ID NO: 1269035 - RNA, 20 nt, Mycobacterium tuberculosis H37Rv
cacaugcccggacgauggcg

SEQ ID NO: 1269036 - RNA, 14 nt, Mycobacterium tuberculosis H37Rv
caccacacagccgc

SEQ ID NO: 1269037 - RNA, 21 nt, Mycobacterium tuberculosis H37Rv
caccacaccacgguggccgcu

SEQ ID NO: 1269038 - RNA, 18 nt, Mycobacterium tuberculosis H37Rv
caccaccgcccgcacguu

SEQ ID NO: 1269039 - RNA, 18 nt, Mycobacterium tuberculosis H37Rv
caccaccgccggugccgc

SEQ ID NO: 1269040 - RNA, 20 nt, Mycobacterium tuberculosis H37Rv
caccacgcuggccucgucgc

SEQ ID NO: 1269041 - RNA, 20 nt, Mycobacterium tuberculosis H37Rv
caccaccgcggcggcggcca

SEQ ID NO: 1269042 - RNA, 14 nt, Mycobacterium tuberculosis H37Rv
caccaccgcucguc

SEQ ID NO: 1269043 - RNA, 15 nt, Mycobacterium tuberculosis H37Rv
caccacgagcagccg

SEQ ID NO: 1269044 - RNA, 16 nt, Mycobacterium tuberculosis H37Rv
caccacgagcagccga

SEQ ID NO: 1269045 - RNA, 22 nt, Mycobacterium tuberculosis H37Rv
caccacgagggccacguagcag

SEQ ID NO: 1269046 - RNA, 17 nt, Mycobacterium tuberculosis H37Rv
cacagaacucaccgacg

SEQ ID NO: 1269047 - RNA, 17 nt, Mycobacterium tuberculosis H37Rv
cacagacugcgcggcac

SEQ ID NO: 1269048 - RNA, 20 nt, Mycobacterium tuberculosis H37Rv
cacagaccgaacagcaccga

SEQ ID NO: 1269049 - RNA, 12 nt, Mycobacterium tuberculosis H37Rv
cacagacgacgu

SEQ ID NO: 1269050 - RNA, 18 nt, Mycobacterium tuberculosis H37Rv
cacacgcccucgacgccg

SEQ ID NO: 1269051 - RNA, 22 nt, Mycobacterium tuberculosis H37Rv
cacacgaugacguugacgucgg

SEQ ID NO: 1269052 - RNA, 18 nt, Mycobacterium tuberculosis H37Rv
cacacgaucgcggugaug

SEQ ID NO: 1269053 - RNA, 16 nt, Mycobacterium tuberculosis H37Rv
cacacgaucgcgguga

SEQ ID NO: 1269054 - RNA, 12 nt, Mycobacterium tuberculosis H37Rv
cacacgaugacg

SEQ ID NO: 1269055 - RNA, 12 nt, Mycobacterium tuberculosis H37Rv
cacagcggccau

SEQ ID NO: 1269056 - RNA, 17 nt, Mycobacterium tuberculosis H37Rv
cacagcggagacgaucg

SEQ ID NO: 1269057 - RNA, 13 nt, Mycobacterium tuberculosis H37Rv
cacagcggagacg

SEQ ID NO: 1269058 - RNA, 14 nt, Mycobacterium tuberculosis H37Rv
cacagcgccgcguu

SEQ ID NO: 1269059 - RNA, 15 nt, Mycobacterium tuberculosis H37Rv
cacagcccgaugccg

SEQ ID NO: 1269060 - RNA, 15 nt, Mycobacterium tuberculosis H37Rv
cacagcccggcgacg

SEQ ID NO: 1269061 - RNA, 13 nt, Mycobacterium tuberculosis H37Rv
cacaccuccucga

SEQ ID NO: 1269062 - RNA, 13 nt, Mycobacterium tuberculosis H37Rv
cacaccguaccga

SEQ ID NO: 1269063 - RNA, 12 nt, Mycobacterium tuberculosis H37Rv
cacaccgucgca

SEQ ID NO: 1269064 - RNA, 17 nt, Mycobacterium tuberculosis H37Rv
cacaccgucgcgcucgc

SEQ ID NO: 1269065 - RNA, 16 nt, Mycobacterium tuberculosis H37Rv
cacaccuaccguacgc

SEQ ID NO: 1269066 - RNA, 13 nt, Mycobacterium tuberculosis H37Rv
cacaccaccgccg

SEQ ID NO: 1269067 - RNA, 23 nt, Mycobacterium tuberculosis H37Rv
cacaccgguggacccggcggugc

SEQ ID NO: 1269068 - RNA, 13 nt, Mycobacterium tuberculosis H37Rv
cacaccagcgguc

SEQ ID NO: 1269069 - RNA, 17 nt, Mycobacterium tuberculosis H37Rv
cacacaggcggcgaacu

SEQ ID NO: 1269070 - RNA, 17 nt, Mycobacterium tuberculosis H37Rv
cacacauagcgauucgc

SEQ ID NO: 1269071 - RNA, 14 nt, Mycobacterium tuberculosis H37Rv
cacacagucacgga

SEQ ID NO: 1269072 - RNA, 13 nt, Mycobacterium tuberculosis H37Rv
caagguggccacc

SEQ ID NO: 1269073 - RNA, 23 nt, Mycobacterium tuberculosis H37Rv
caagguggcggccaguucggcgg

SEQ ID NO: 1269074 - RNA, 15 nt, Mycobacterium tuberculosis H37Rv
caagguggcggccag

SEQ ID NO: 1269075 - RNA, 14 nt, Mycobacterium tuberculosis H37Rv
caagguguccagca

SEQ ID NO: 1269076 - RNA, 23 nt, Mycobacterium tuberculosis H37Rv
caagguacuugcgcaaccggugg

SEQ ID NO: 1269077 - RNA, 13 nt, Mycobacterium tuberculosis H37Rv
caaggggcgucgc

SEQ ID NO: 1269078 - RNA, 21 nt, Mycobacterium tuberculosis H37Rv
caagggcugugucugacgcua

SEQ ID NO: 1269079 - RNA, 14 nt, Mycobacterium tuberculosis H37Rv
caaggccgaccugu

SEQ ID NO: 1269080 - RNA, 22 nt, Mycobacterium tuberculosis H37Rv
caaugacuggaccgcggugacc

SEQ ID NO: 1269081 - RNA, 19 nt, Mycobacterium tuberculosis H37Rv
caaugacgucgucggccaa

SEQ ID NO: 1269082 - RNA, 16 nt, Mycobacterium tuberculosis H37Rv
caaugacucggccgca

SEQ ID NO: 1269083 - RNA, 21 nt, Mycobacterium tuberculosis H37Rv
caaugaucaucccggcgcguu

SEQ ID NO: 1269084 - RNA, 21 nt, Mycobacterium tuberculosis H37Rv
caauucgggauaggacaccgu

SEQ ID NO: 1269085 - RNA, 18 nt, Mycobacterium tuberculosis H37Rv
caauuccgcuugcucucg

SEQ ID NO: 1269086 - RNA, 19 nt, Mycobacterium tuberculosis H37Rv
caauucgcaaucggcguua

SEQ ID NO: 1269087 - RNA, 17 nt, Mycobacterium tuberculosis H37Rv
caauuccggugaucgcg

SEQ ID NO: 1269088 - RNA, 19 nt, Mycobacterium tuberculosis H37Rv
caauucgggcauggucgcc

SEQ ID NO: 1269089 - RNA, 12 nt, Mycobacterium tuberculosis H37Rv
caauucagcggc

SEQ ID NO: 1269090 - RNA, 22 nt, Mycobacterium tuberculosis H37Rv
caauuccacgaucggcucacga

SEQ ID NO: 1269091 - RNA, 20 nt, Mycobacterium tuberculosis H37Rv
caaugcuggcagcggccucc

SEQ ID NO: 1269092 - RNA, 16 nt, Mycobacterium tuberculosis H37Rv
caaugcuggcagcggc

SEQ ID NO: 1269093 - RNA, 17 nt, Mycobacterium tuberculosis H37Rv
caaugcguugacgucga

SEQ ID NO: 1269094 - RNA, 20 nt, Mycobacterium tuberculosis H37Rv
caauggccagcaccacggcc

SEQ ID NO: 1269095 - RNA, 20 nt, Mycobacterium tuberculosis H37Rv
agcugucgcaacgcaucgau

SEQ ID NO: 1269096 - RNA, 14 nt, Mycobacterium tuberculosis H37Rv
agcugucgaccgcg

SEQ ID NO: 1269097 - RNA, 18 nt, Mycobacterium tuberculosis H37Rv
agcuggggaacagcagcg

SEQ ID NO: 1269098 - RNA, 22 nt, Mycobacterium tuberculosis H37Rv
agcuggccacuuucagaucgau

SEQ ID NO: 1269099 - RNA, 16 nt, Mycobacterium tuberculosis H37Rv
agcuggacuccgguca

SEQ ID NO: 1269100 - RNA, 13 nt, Mycobacterium tuberculosis H37Rv
agcuggaccuccg

SEQ ID NO: 1269101 - RNA, 17 nt, Mycobacterium tuberculosis H37Rv
agcugcucgucggcgcc

SEQ ID NO: 1269102 - RNA, 22 nt, Mycobacterium tuberculosis H37Rv
agcugcugccgauacagcacau

SEQ ID NO: 1269103 - RNA, 15 nt, Mycobacterium tuberculosis H37Rv
agcgucgggcacauc

SEQ ID NO: 1269104 - RNA, 15 nt, Mycobacterium tuberculosis H37Rv
agcgucgguggcagc

SEQ ID NO: 1269105 - RNA, 13 nt, Mycobacterium tuberculosis H37Rv
agcgucguugcuc

SEQ ID NO: 1269106 - RNA, 21 nt, Mycobacterium tuberculosis H37Rv
agcgucuggcgacaucucggu

SEQ ID NO: 1269107 - RNA, 21 nt, Mycobacterium tuberculosis H37Rv
agcugcggucgaacaucaucg

SEQ ID NO: 1269108 - RNA, 20 nt, Mycobacterium tuberculosis H37Rv
agcugcgguaagaaucgaag

SEQ ID NO: 1269109 - RNA, 15 nt, Mycobacterium tuberculosis H37Rv
aggaaccacccaccg

SEQ ID NO: 1269110 - RNA, 12 nt, Mycobacterium tuberculosis H37Rv
aggacaccaccg

SEQ ID NO: 1269111 - RNA, 14 nt, Mycobacterium tuberculosis H37Rv
aggacaccggcacc

SEQ ID NO: 1269112 - RNA, 21 nt, Mycobacterium tuberculosis H37Rv
agcuucaucccggagccgcua

SEQ ID NO: 1269113 - RNA, 17 nt, Mycobacterium tuberculosis H37Rv
agcuugcccgacggcgu

SEQ ID NO: 1269114 - RNA, 13 nt, Mycobacterium tuberculosis H37Rv
agcuuguugcagc

SEQ ID NO: 1269115 - RNA, 21 nt, Mycobacterium tuberculosis H37Rv
agcuugggccggugcagcacg

SEQ ID NO: 1269116 - RNA, 15 nt, Mycobacterium tuberculosis H37Rv
agcuuggcgucgaug

SEQ ID NO: 1269117 - RNA, 13 nt, Mycobacterium tuberculosis H37Rv
aggcaucaccgga

SEQ ID NO: 1269118 - RNA, 21 nt, Mycobacterium tuberculosis H37Rv
aggcagguuggccaccgccca

SEQ ID NO: 1269119 - RNA, 16 nt, Mycobacterium tuberculosis H37Rv
aggcaggccucggcgc

SEQ ID NO: 1269120 - RNA, 18 nt, Mycobacterium tuberculosis H37Rv
aggccagagucgcccgca

SEQ ID NO: 1269121 - RNA, 21 nt, Mycobacterium tuberculosis H37Rv
aggccacggggcuuggcgacg

SEQ ID NO: 1269122 - RNA, 12 nt, Mycobacterium tuberculosis H37Rv
aggccaccgucg

SEQ ID NO: 1269123 - RNA, 21 nt, Mycobacterium tuberculosis H37Rv
aggccacccgcgaagccgcca

SEQ ID NO: 1269124 - RNA, 23 nt, Mycobacterium tuberculosis H37Rv
aggcccgcgguggaccgggcaag

SEQ ID NO: 1269125 - RNA, 19 nt, Mycobacterium tuberculosis H37Rv
aggcccgggcggaugcugu

SEQ ID NO: 1269126 - RNA, 23 nt, Mycobacterium tuberculosis H37Rv
aggcccgcacguuggcggccagc

SEQ ID NO: 1269127 - RNA, 16 nt, Mycobacterium tuberculosis H37Rv
aggcccgaguuaccgg

SEQ ID NO: 1269128 - RNA, 19 nt, Mycobacterium tuberculosis H37Rv
aggcagcgugggacgcagu

SEQ ID NO: 1269129 - RNA, 22 nt, Mycobacterium tuberculosis H37Rv
aggcagcuugccaaucaccgua

SEQ ID NO: 1269130 - RNA, 19 nt, Mycobacterium tuberculosis H37Rv
aggcagcgucgucgacgac

SEQ ID NO: 1269131 - RNA, 15 nt, Mycobacterium tuberculosis H37Rv
aggcagcgaccgucg

SEQ ID NO: 1269132 - RNA, 15 nt, Mycobacterium tuberculosis H37Rv
aggcagcacccgcac

SEQ ID NO: 1269133 - RNA, 18 nt, Mycobacterium tuberculosis H37Rv
aggcagcacccgcacggu

SEQ ID NO: 1269134 - RNA, 16 nt, Mycobacterium tuberculosis H37Rv
aggcaccccgaucacc

SEQ ID NO: 1269135 - RNA, 20 nt, Mycobacterium tuberculosis H37Rv
aggcacguucagccaggcgu

SEQ ID NO: 1269136 - RNA, 16 nt, Mycobacterium tuberculosis H37Rv
aggaugcaucgcaacg

SEQ ID NO: 1269137 - RNA, 18 nt, Mycobacterium tuberculosis H37Rv
aggagauccuuaucgcuc

SEQ ID NO: 1269138 - RNA, 23 nt, Mycobacterium tuberculosis H37Rv
aggacuggcaccgccagccacca

SEQ ID NO: 1269139 - RNA, 19 nt, Mycobacterium tuberculosis H37Rv
aggacuuguccaucacauc

SEQ ID NO: 1269140 - RNA, 17 nt, Mycobacterium tuberculosis H37Rv
aggacucuucggucagg

SEQ ID NO: 1269141 - RNA, 22 nt, Mycobacterium tuberculosis H37Rv
aggacugaacaguugcacaccg

SEQ ID NO: 1269142 - RNA, 15 nt, Mycobacterium tuberculosis H37Rv
aggacucacgcagcg

SEQ ID NO: 1269143 - RNA, 18 nt, Mycobacterium tuberculosis H37Rv
aggacggcugccgucagc

SEQ ID NO: 1269144 - RNA, 16 nt, Mycobacterium tuberculosis H37Rv
aggacggcagccacca

SEQ ID NO: 1269145 - RNA, 16 nt, Mycobacterium tuberculosis H37Rv
aggacggcugccguca

SEQ ID NO: 1269146 - RNA, 15 nt, Mycobacterium tuberculosis H37Rv
aggacauucccgagu

SEQ ID NO: 1269147 - RNA, 15 nt, Mycobacterium tuberculosis H37Rv
aggaccagagcucga

SEQ ID NO: 1269148 - RNA, 16 nt, Mycobacterium tuberculosis H37Rv
aggaccgcgccgauca

SEQ ID NO: 1269149 - RNA, 13 nt, Mycobacterium tuberculosis H37Rv
aggaccagcaccg

SEQ ID NO: 1269150 - RNA, 22 nt, Mycobacterium tuberculosis H37Rv
aggacggagcccaaaaccgcga

SEQ ID NO: 1269151 - RNA, 13 nt, Mycobacterium tuberculosis H37Rv
aggacgccagcaa

SEQ ID NO: 1269152 - RNA, 21 nt, Mycobacterium tuberculosis H37Rv
aggacgacuggaaggcgggca

SEQ ID NO: 1269153 - RNA, 18 nt, Mycobacterium tuberculosis H37Rv
aggagugguugcccgcac

SEQ ID NO: 1269154 - RNA, 22 nt, Mycobacterium tuberculosis H37Rv
aggagugguacggcucggcgcu

SEQ ID NO: 1269155 - RNA, 13 nt, Mycobacterium tuberculosis H37Rv
aggaguggccggg

SEQ ID NO: 1269156 - RNA, 17 nt, Mycobacterium tuberculosis H37Rv
aggagugcgggcaugcc

SEQ ID NO: 1269157 - RNA, 16 nt, Mycobacterium tuberculosis H37Rv
aggaggcggucgauca

SEQ ID NO: 1269158 - RNA, 18 nt, Mycobacterium tuberculosis H37Rv
aggaggcuuacaugcccu

SEQ ID NO: 1269159 - RNA, 17 nt, Mycobacterium tuberculosis H37Rv
aggagcggauagcggca

SEQ ID NO: 1269160 - RNA, 22 nt, Mycobacterium tuberculosis H37Rv
aggaucccgcugcacgacaucg

SEQ ID NO: 1269161 - RNA, 14 nt, Mycobacterium tuberculosis H37Rv
aggaucugguugaa

SEQ ID NO: 1269162 - RNA, 20 nt, Mycobacterium tuberculosis H37Rv
agggcuguugacgccacgac

SEQ ID NO: 1269163 - RNA, 14 nt, Mycobacterium tuberculosis H37Rv
agggcuuccagggc

SEQ ID NO: 1269164 - RNA, 15 nt, Mycobacterium tuberculosis H37Rv
agggcuugucgccgg

SEQ ID NO: 1269165 - RNA, 19 nt, Mycobacterium tuberculosis H37Rv
agggcuuguggugagcgga

SEQ ID NO: 1269166 - RNA, 22 nt, Mycobacterium tuberculosis H37Rv
aggggaguugcgacgauacacg

SEQ ID NO: 1269167 - RNA, 18 nt, Mycobacterium tuberculosis H37Rv
aggggaucaccggcugcu

SEQ ID NO: 1269168 - RNA, 16 nt, Mycobacterium tuberculosis H37Rv
agggucaucgccagcg

SEQ ID NO: 1269169 - RNA, 15 nt, Mycobacterium tuberculosis H37Rv
agggucaucgccagc

SEQ ID NO: 1269170 - RNA, 18 nt, Mycobacterium tuberculosis H37Rv
agggucgggguccgcggc

SEQ ID NO: 1269171 - RNA, 17 nt, Mycobacterium tuberculosis H37Rv
agguaagcagccagcaa

SEQ ID NO: 1269172 - RNA, 23 nt, Mycobacterium tuberculosis H37Rv
agguaggucugggcaagaccgcg

SEQ ID NO: 1269173 - RNA, 16 nt, Mycobacterium tuberculosis H37Rv
aggguuuccaagucgg

SEQ ID NO: 1269174 - RNA, 13 nt, Mycobacterium tuberculosis H37Rv
agguaugcgguug

SEQ ID NO: 1269175 - RNA, 16 nt, Mycobacterium tuberculosis H37Rv
agguccgccaccgcga

SEQ ID NO: 1269176 - RNA, 21 nt, Mycobacterium tuberculosis H37Rv
agguccgugccgaugccggcg

SEQ ID NO: 1269177 - RNA, 23 nt, Mycobacterium tuberculosis H37Rv
aggucccgugcgcgcgcagcuga

SEQ ID NO: 1269178 - RNA, 22 nt, Mycobacterium tuberculosis H37Rv
agguccgcacgaucugcaggcc

SEQ ID NO: 1269179 - RNA, 15 nt, Mycobacterium tuberculosis H37Rv
aggucccggcuggga

SEQ ID NO: 1269180 - RNA, 21 nt, Mycobacterium tuberculosis H37Rv
agggcgacgagaucugcgaug

SEQ ID NO: 1269181 - RNA, 15 nt, Mycobacterium tuberculosis H37Rv
agggcgacgagaucu

SEQ ID NO: 1269182 - RNA, 14 nt, Mycobacterium tuberculosis H37Rv
agggccucgaccgc

SEQ ID NO: 1269183 - RNA, 18 nt, Mycobacterium tuberculosis H37Rv
agggccuguucgagaucg

SEQ ID NO: 1269184 - RNA, 21 nt, Mycobacterium tuberculosis H37Rv
agggccgcucgccucgauggc

SEQ ID NO: 1269185 - RNA, 19 nt, Mycobacterium tuberculosis H37Rv
agggccgucuugccggcca

SEQ ID NO: 1269186 - RNA, 14 nt, Mycobacterium tuberculosis H37Rv
agggccgacgucgu

SEQ ID NO: 1269187 - RNA, 15 nt, Mycobacterium tuberculosis H37Rv
aggcuugcaaggucg

SEQ ID NO: 1269188 - RNA, 12 nt, Mycobacterium tuberculosis H37Rv
agggcuccucgu

SEQ ID NO: 1269189 - RNA, 18 nt, Mycobacterium tuberculosis H37Rv
agggcggggcagaagucg

SEQ ID NO: 1269190 - RNA, 20 nt, Mycobacterium tuberculosis H37Rv
agggcggcgucgauggccac

SEQ ID NO: 1269191 - RNA, 14 nt, Mycobacterium tuberculosis H37Rv
agggcgguggccac

SEQ ID NO: 1269192 - RNA, 13 nt, Mycobacterium tuberculosis H37Rv
agggcgucgccgc

SEQ ID NO: 1269193 - RNA, 21 nt, Mycobacterium tuberculosis H37Rv
agggcgccacugaccgcgauc

SEQ ID NO: 1269194 - RNA, 19 nt, Mycobacterium tuberculosis H37Rv
agggcgccacugaccgcga

SEQ ID NO: 1269195 - RNA, 19 nt, Mycobacterium tuberculosis H37Rv
agggcggccauccggucgc

SEQ ID NO: 1269196 - RNA, 15 nt, Mycobacterium tuberculosis H37Rv
agggcggccgcggug

SEQ ID NO: 1269197 - RNA, 21 nt, Mycobacterium tuberculosis H37Rv
aggccuuuuggcgaaccgcag

SEQ ID NO: 1269198 - RNA, 14 nt, Mycobacterium tuberculosis H37Rv
aggccgagcccggu

SEQ ID NO: 1269199 - RNA, 14 nt, Mycobacterium tuberculosis H37Rv
aggccgagcgcgau

SEQ ID NO: 1269200 - RNA, 13 nt, Mycobacterium tuberculosis H37Rv
aggccucggcagc

SEQ ID NO: 1269201 - RNA, 22 nt, Mycobacterium tuberculosis H37Rv
aggcgcagcugguuugcggugc

SEQ ID NO: 1269202 - RNA, 23 nt, Mycobacterium tuberculosis H37Rv
aggcgcagauuccucuucaggcc

SEQ ID NO: 1269203 - RNA, 21 nt, Mycobacterium tuberculosis H37Rv
aggcgaagcgggacugcagcg

SEQ ID NO: 1269204 - RNA, 17 nt, Mycobacterium tuberculosis H37Rv
aggcgaccggacgagcg

SEQ ID NO: 1269205 - RNA, 21 nt, Mycobacterium tuberculosis H37Rv
aggcgaccggacgagcgucag

SEQ ID NO: 1269206 - RNA, 14 nt, Mycobacterium tuberculosis H37Rv
aggcgaccggacga

SEQ ID NO: 1269207 - RNA, 20 nt, Mycobacterium tuberculosis H37Rv
aggcuccagcgcgcgccgca

SEQ ID NO: 1269208 - RNA, 23 nt, Mycobacterium tuberculosis H37Rv
aggcuccagcgcgcgccgcagcg

SEQ ID NO: 1269209 - RNA, 21 nt, Mycobacterium tuberculosis H37Rv
aggcucccccaccagggacga

SEQ ID NO: 1269210 - RNA, 22 nt, Mycobacterium tuberculosis H37Rv
aggcugugccccagggcagugc

SEQ ID NO: 1269211 - RNA, 22 nt, Mycobacterium tuberculosis H37Rv
aggcugggcagaccgaucggca

SEQ ID NO: 1269212 - RNA, 17 nt, Mycobacterium tuberculosis H37Rv
aggcuguaacacccggc

SEQ ID NO: 1269213 - RNA, 18 nt, Mycobacterium tuberculosis H37Rv
aggcggcggucgagcucg

SEQ ID NO: 1269214 - RNA, 17 nt, Mycobacterium tuberculosis H37Rv
aggcggcgacgaccguc

SEQ ID NO: 1269215 - RNA, 12 nt, Mycobacterium tuberculosis H37Rv
aggcggcagguu

SEQ ID NO: 1269216 - RNA, 18 nt, Mycobacterium tuberculosis H37Rv
aggcggccacaaacccga

SEQ ID NO: 1269217 - RNA, 20 nt, Mycobacterium tuberculosis H37Rv
aggcggccaucgacgacacg

SEQ ID NO: 1269218 - RNA, 17 nt, Mycobacterium tuberculosis H37Rv
aggcggcccccggcagc

SEQ ID NO: 1269219 - RNA, 14 nt, Mycobacterium tuberculosis H37Rv
aggucgcgcaguug

SEQ ID NO: 1269220 - RNA, 21 nt, Mycobacterium tuberculosis H37Rv
aggucggcgaacaaccgccgc

SEQ ID NO: 1269221 - RNA, 15 nt, Mycobacterium tuberculosis H37Rv
aggucggccaccgug

SEQ ID NO: 1269222 - RNA, 13 nt, Mycobacterium tuberculosis H37Rv
aguagccggucgg

SEQ ID NO: 1269223 - RNA, 16 nt, Mycobacterium tuberculosis H37Rv
aguaggcggcuccgau

SEQ ID NO: 1269224 - RNA, 21 nt, Mycobacterium tuberculosis H37Rv
agucacggaugcggccgguga

SEQ ID NO: 1269225 - RNA, 13 nt, Mycobacterium tuberculosis H37Rv
agucaagcagcag

SEQ ID NO: 1269226 - RNA, 14 nt, Mycobacterium tuberculosis H37Rv
aguccaggcagcuu

SEQ ID NO: 1269227 - RNA, 23 nt, Mycobacterium tuberculosis H37Rv
agucgcgaacucaugcccgacga

SEQ ID NO: 1269228 - RNA, 17 nt, Mycobacterium tuberculosis H37Rv
aguccucgagugccgcc

SEQ ID NO: 1269229 - RNA, 15 nt, Mycobacterium tuberculosis H37Rv
agucgccagaccgca

SEQ ID NO: 1269230 - RNA, 17 nt, Mycobacterium tuberculosis H37Rv
aguccguacuugccacc

SEQ ID NO: 1269231 - RNA, 14 nt, Mycobacterium tuberculosis H37Rv
aguccgguagcagc

SEQ ID NO: 1269232 - RNA, 21 nt, Mycobacterium tuberculosis H37Rv
aguccgggccccuucgcagca

SEQ ID NO: 1269233 - RNA, 21 nt, Mycobacterium tuberculosis H37Rv
aguccggccccccgacuccgg

SEQ ID NO: 1269234 - RNA, 22 nt, Mycobacterium tuberculosis H37Rv
aguccggcacugcggccaguca

SEQ ID NO: 1269235 - RNA, 14 nt, Mycobacterium tuberculosis H37Rv
aguccggccgaccc

SEQ ID NO: 1269236 - RNA, 19 nt, Mycobacterium tuberculosis H37Rv
agucggccuccucgucgcu

SEQ ID NO: 1269237 - RNA, 22 nt, Mycobacterium tuberculosis H37Rv
agucgcuaaagcccccgacacg

SEQ ID NO: 1269238 - RNA, 20 nt, Mycobacterium tuberculosis H37Rv
agucgcgguaccaucaccgc

SEQ ID NO: 1269239 - RNA, 17 nt, Mycobacterium tuberculosis H37Rv
agucgcgcgccaagacg

SEQ ID NO: 1269240 - RNA, 18 nt, Mycobacterium tuberculosis H37Rv
agucgguaucggcagaug

SEQ ID NO: 1269241 - RNA, 19 nt, Mycobacterium tuberculosis H37Rv
agucgguggucucggcauc

SEQ ID NO: 1269242 - RNA, 14 nt, Mycobacterium tuberculosis H37Rv
agucuucggcgaca

SEQ ID NO: 1269243 - RNA, 19 nt, Mycobacterium tuberculosis H37Rv
agucuggcgguaucgaaag

SEQ ID NO: 1269244 - RNA, 20 nt, Mycobacterium tuberculosis H37Rv
agugccgcacgauggccguc

SEQ ID NO: 1269245 - RNA, 22 nt, Mycobacterium tuberculosis H37Rv
agugcccacaaccgcaccaggu

SEQ ID NO: 1269246 - RNA, 22 nt, Mycobacterium tuberculosis H37Rv
agugcaggugcccggccaaaau

SEQ ID NO: 1269247 - RNA, 15 nt, Mycobacterium tuberculosis H37Rv
agugcagcgaucccg

SEQ ID NO: 1269248 - RNA, 15 nt, Mycobacterium tuberculosis H37Rv
agugacucgaucacc

SEQ ID NO: 1269249 - RNA, 15 nt, Mycobacterium tuberculosis H37Rv
agugacgccacgacc

SEQ ID NO: 1269250 - RNA, 22 nt, Mycobacterium tuberculosis H37Rv
agugcgucucgguggcugcgcc

SEQ ID NO: 1269251 - RNA, 21 nt, Mycobacterium tuberculosis H37Rv
aguggccucguccagcucggu

SEQ ID NO: 1269252 - RNA, 17 nt, Mycobacterium tuberculosis H37Rv
aguggcccgcgggcaag

SEQ ID NO: 1269253 - RNA, 14 nt, Mycobacterium tuberculosis H37Rv
aguggcaaucccgc

SEQ ID NO: 1269254 - RNA, 17 nt, Mycobacterium tuberculosis H37Rv
agugcggccuuggcgac

SEQ ID NO: 1269255 - RNA, 17 nt, Mycobacterium tuberculosis H37Rv
agugcggcugcaacgau

SEQ ID NO: 1269256 - RNA, 18 nt, Mycobacterium tuberculosis H37Rv
agugccgugucgaguggc

SEQ ID NO: 1269257 - RNA, 22 nt, Mycobacterium tuberculosis H37Rv
agugcgacguaaagggcgucgu

SEQ ID NO: 1269258 - RNA, 21 nt, Mycobacterium tuberculosis H37Rv
agugcgaaauugcuuggccgc

SEQ ID NO: 1269259 - RNA, 19 nt, Mycobacterium tuberculosis H37Rv
agugggcaauccggucagc

SEQ ID NO: 1269260 - RNA, 16 nt, Mycobacterium tuberculosis H37Rv
aguggcgacgagcaac

SEQ ID NO: 1269261 - RNA, 19 nt, Mycobacterium tuberculosis H37Rv
aguguguuugaguugcccg

SEQ ID NO: 1269262 - RNA, 18 nt, Mycobacterium tuberculosis H37Rv
agugggcuuuugcgucug

SEQ ID NO: 1269263 - RNA, 17 nt, Mycobacterium tuberculosis H37Rv
agugggucaagaucggu

SEQ ID NO: 1269264 - RNA, 15 nt, Mycobacterium tuberculosis H37Rv
aguuauagaagccga

SEQ ID NO: 1269265 - RNA, 15 nt, Mycobacterium tuberculosis H37Rv
aguuaggccgccagc

SEQ ID NO: 1269266 - RNA, 21 nt, Mycobacterium tuberculosis H37Rv
aguugguccaggugaccgaga

SEQ ID NO: 1269267 - RNA, 17 nt, Mycobacterium tuberculosis H37Rv
aguuggaacugcccgau

SEQ ID NO: 1269268 - RNA, 18 nt, Mycobacterium tuberculosis H37Rv
aguuggccaugcaccgau

SEQ ID NO: 1269269 - RNA, 16 nt, Mycobacterium tuberculosis H37Rv
aguuggcaccagccgg

SEQ ID NO: 1269270 - RNA, 15 nt, Mycobacterium tuberculosis H37Rv
aguuggcgaccugcg

SEQ ID NO: 1269271 - RNA, 20 nt, Mycobacterium tuberculosis H37Rv
aguucgcacccguucgugag

SEQ ID NO: 1269272 - RNA, 13 nt, Mycobacterium tuberculosis H37Rv
aguucgaccggcg

SEQ ID NO: 1269273 - RNA, 19 nt, Mycobacterium tuberculosis H37Rv
aguucaccaacgcgggaac

SEQ ID NO: 1269274 - RNA, 16 nt, Mycobacterium tuberculosis H37Rv
aguucaccaacgcggg

SEQ ID NO: 1269275 - RNA, 15 nt, Mycobacterium tuberculosis H37Rv
aguucggcagcgggc

SEQ ID NO: 1269276 - RNA, 14 nt, Mycobacterium tuberculosis H37Rv
aguucgcgcuggca

SEQ ID NO: 1269277 - RNA, 15 nt, Mycobacterium tuberculosis H37Rv
auaccgguggcagcc

SEQ ID NO: 1269278 - RNA, 20 nt, Mycobacterium tuberculosis H37Rv
auaccugggacaggacgacu

SEQ ID NO: 1269279 - RNA, 23 nt, Mycobacterium tuberculosis H37Rv
auacacugaaucguuggcgaucg

SEQ ID NO: 1269280 - RNA, 16 nt, Mycobacterium tuberculosis H37Rv
auaccaagcgcggugg

SEQ ID NO: 1269281 - RNA, 23 nt, Mycobacterium tuberculosis H37Rv
auaacgcuucaugaacagccggu

SEQ ID NO: 1269282 - RNA, 14 nt, Mycobacterium tuberculosis H37Rv
auagaacucgccgc

SEQ ID NO: 1269283 - RNA, 21 nt, Mycobacterium tuberculosis H37Rv
auagcgcggcaccagcaccgu

SEQ ID NO: 1269284 - RNA, 14 nt, Mycobacterium tuberculosis H37Rv
auagcggcccgauc

SEQ ID NO: 1269285 - RNA, 16 nt, Mycobacterium tuberculosis H37Rv
auagcggcccgaucac

SEQ ID NO: 1269286 - RNA, 22 nt, Mycobacterium tuberculosis H37Rv
auaggucagaauugugugcagc

SEQ ID NO: 1269287 - RNA, 15 nt, Mycobacterium tuberculosis H37Rv
auaggcaccaaggua

SEQ ID NO: 1269288 - RNA, 17 nt, Mycobacterium tuberculosis H37Rv
auagucgccgucgcccc

SEQ ID NO: 1269289 - RNA, 22 nt, Mycobacterium tuberculosis H37Rv
auauccgugaauggcagcacga

SEQ ID NO: 1269290 - RNA, 19 nt, Mycobacterium tuberculosis H37Rv
auaucggugaccguggcgg

SEQ ID NO: 1269291 - RNA, 17 nt, Mycobacterium tuberculosis H37Rv
auaucgucgggagagug

SEQ ID NO: 1269292 - RNA, 16 nt, Mycobacterium tuberculosis H37Rv
agcaccacaacgucgg

SEQ ID NO: 1269293 - RNA, 14 nt, Mycobacterium tuberculosis H37Rv
agcaccaccacccg

SEQ ID NO: 1269294 - RNA, 17 nt, Mycobacterium tuberculosis H37Rv
agcaccacaacgucggc

SEQ ID NO: 1269295 - RNA, 14 nt, Mycobacterium tuberculosis H37Rv
agcaccacccgcac

SEQ ID NO: 1269296 - RNA, 20 nt, Mycobacterium tuberculosis H37Rv
agcaccaccggaaccaccag

SEQ ID NO: 1269297 - RNA, 13 nt, Mycobacterium tuberculosis H37Rv
agcaccugcaccg

SEQ ID NO: 1269298 - RNA, 16 nt, Mycobacterium tuberculosis H37Rv
agcaccggucccugcg

SEQ ID NO: 1269299 - RNA, 17 nt, Mycobacterium tuberculosis H37Rv
agcaccggcucgacugc

SEQ ID NO: 1269300 - RNA, 16 nt, Mycobacterium tuberculosis H37Rv
agcacgcccucgacgc

SEQ ID NO: 1269301 - RNA, 15 nt, Mycobacterium tuberculosis H37Rv
agcacgaagcuggcg

SEQ ID NO: 1269302 - RNA, 23 nt, Mycobacterium tuberculosis H37Rv
agcacgaaagucaaucgcgucau

SEQ ID NO: 1269303 - RNA, 12 nt, Mycobacterium tuberculosis H37Rv
agcacugacggg

SEQ ID NO: 1269304 - RNA, 20 nt, Mycobacterium tuberculosis H37Rv
agcacuuccaagccgaccug

SEQ ID NO: 1269305 - RNA, 16 nt, Mycobacterium tuberculosis H37Rv
agcacuuggacccggc

SEQ ID NO: 1269306 - RNA, 15 nt, Mycobacterium tuberculosis H37Rv
agcacaccgccagcg

SEQ ID NO: 1269307 - RNA, 20 nt, Mycobacterium tuberculosis H37Rv
agcacaccgguggacccggc

SEQ ID NO: 1269308 - RNA, 21 nt, Mycobacterium tuberculosis H37Rv
agcacagcagcaacgcggugc

SEQ ID NO: 1269309 - RNA, 20 nt, Mycobacterium tuberculosis H37Rv
agcacaugcucggccugcuu

SEQ ID NO: 1269310 - RNA, 16 nt, Mycobacterium tuberculosis H37Rv
agcacauucugcagcg

SEQ ID NO: 1269311 - RNA, 22 nt, Mycobacterium tuberculosis H37Rv
agcacauuauucuucgcggcga

SEQ ID NO: 1269312 - RNA, 23 nt, Mycobacterium tuberculosis H37Rv
agcaagccagcaucggcagcagc

SEQ ID NO: 1269313 - RNA, 14 nt, Mycobacterium tuberculosis H37Rv
agcaaggcccgaaa

SEQ ID NO: 1269314 - RNA, 14 nt, Mycobacterium tuberculosis H37Rv
agcaaguccaccgg

SEQ ID NO: 1269315 - RNA, 17 nt, Mycobacterium tuberculosis H37Rv
agcaaggccagcacggc

SEQ ID NO: 1269316 - RNA, 18 nt, Mycobacterium tuberculosis H37Rv
agauccauuggaugccau

SEQ ID NO: 1269317 - RNA, 19 nt, Mycobacterium tuberculosis H37Rv
agaucccaccaccggugaa

SEQ ID NO: 1269318 - RNA, 21 nt, Mycobacterium tuberculosis H37Rv
agaucaugccggcgaacucgc

SEQ ID NO: 1269319 - RNA, 14 nt, Mycobacterium tuberculosis H37Rv
agaucaugccggcg

SEQ ID NO: 1269320 - RNA, 17 nt, Mycobacterium tuberculosis H37Rv
agauccagggagcggcu

SEQ ID NO: 1269321 - RNA, 18 nt, Mycobacterium tuberculosis H37Rv
agauccagggagcggcug

SEQ ID NO: 1269322 - RNA, 16 nt, Mycobacterium tuberculosis H37Rv
agcaaaauggccaccg

SEQ ID NO: 1269323 - RNA, 13 nt, Mycobacterium tuberculosis H37Rv
agauugccgagcc

SEQ ID NO: 1269324 - RNA, 12 nt, Mycobacterium tuberculosis H37Rv
agauugcugacg

SEQ ID NO: 1269325 - RNA, 20 nt, Mycobacterium tuberculosis H37Rv
agcagcucggggcgaugagc

SEQ ID NO: 1269326 - RNA, 12 nt, Mycobacterium tuberculosis H37Rv
agcagcucggcc

SEQ ID NO: 1269327 - RNA, 23 nt, Mycobacterium tuberculosis H37Rv
agcagcucggccgaggcggucuu

SEQ ID NO: 1269328 - RNA, 23 nt, Mycobacterium tuberculosis H37Rv
agcagcugaaaauaggccgggca

SEQ ID NO: 1269329 - RNA, 21 nt, Mycobacterium tuberculosis H37Rv
agcagcugggcaucaccgccg

SEQ ID NO: 1269330 - RNA, 20 nt, Mycobacterium tuberculosis H37Rv
agcaggaugaugaccgccau

SEQ ID NO: 1269331 - RNA, 23 nt, Mycobacterium tuberculosis H37Rv
agcaggccacugcguuccaucgc

SEQ ID NO: 1269332 - RNA, 17 nt, Mycobacterium tuberculosis H37Rv
agcagcgucaucagguc

SEQ ID NO: 1269333 - RNA, 13 nt, Mycobacterium tuberculosis H37Rv
agcagcguggcga

SEQ ID NO: 1269334 - RNA, 15 nt, Mycobacterium tuberculosis H37Rv
agcagcggcacgucg

SEQ ID NO: 1269335 - RNA, 22 nt, Mycobacterium tuberculosis H37Rv
agcagcggcucuauccggcgca

SEQ ID NO: 1269336 - RNA, 18 nt, Mycobacterium tuberculosis H37Rv
agcagcgccggcaccgac

SEQ ID NO: 1269337 - RNA, 12 nt, Mycobacterium tuberculosis H37Rv
agcagcaccacc

SEQ ID NO: 1269338 - RNA, 14 nt, Mycobacterium tuberculosis H37Rv
agcagauuaccgag

SEQ ID NO: 1269339 - RNA, 18 nt, Mycobacterium tuberculosis H37Rv
agcagaucgcgggcgcgu

SEQ ID NO: 1269340 - RNA, 19 nt, Mycobacterium tuberculosis H37Rv
agcagaggaucaucgacgc

SEQ ID NO: 1269341 - RNA, 20 nt, Mycobacterium tuberculosis H37Rv
agcagacacagaaucgccca

SEQ ID NO: 1269342 - RNA, 21 nt, Mycobacterium tuberculosis H37Rv
agcagacacagaaucgcccau

SEQ ID NO: 1269343 - RNA, 17 nt, Mycobacterium tuberculosis H37Rv
agcagaccaaguccggu

SEQ ID NO: 1269344 - RNA, 18 nt, Mycobacterium tuberculosis H37Rv
agcagacacagaaucgca

SEQ ID NO: 1269345 - RNA, 17 nt, Mycobacterium tuberculosis H37Rv
agcagcgccacccgguc

SEQ ID NO: 1269346 - RNA, 14 nt, Mycobacterium tuberculosis H37Rv
agcagcgccagcag

SEQ ID NO: 1269347 - RNA, 13 nt, Mycobacterium tuberculosis H37Rv
agcagcgccgcgu

SEQ ID NO: 1269348 - RNA, 20 nt, Mycobacterium tuberculosis H37Rv
agcagcgacgcugccgccag

SEQ ID NO: 1269349 - RNA, 14 nt, Mycobacterium tuberculosis H37Rv
agcagccgcgacau

SEQ ID NO: 1269350 - RNA, 19 nt, Mycobacterium tuberculosis H37Rv
agcagccggugccggucga

SEQ ID NO: 1269351 - RNA, 15 nt, Mycobacterium tuberculosis H37Rv
agcaggguuccccau

SEQ ID NO: 1269352 - RNA, 23 nt, Mycobacterium tuberculosis H37Rv
agcagugcgguaaagaucuuguc

SEQ ID NO: 1269353 - RNA, 21 nt, Mycobacterium tuberculosis H37Rv
agcagugccucggcgaugggc

SEQ ID NO: 1269354 - RNA, 13 nt, Mycobacterium tuberculosis H37Rv
agcauaccgccgc

SEQ ID NO: 1269355 - RNA, 17 nt, Mycobacterium tuberculosis H37Rv
agcauauccgccggcga

SEQ ID NO: 1269356 - RNA, 16 nt, Mycobacterium tuberculosis H37Rv
agcaguuggccgagcg

SEQ ID NO: 1269357 - RNA, 21 nt, Mycobacterium tuberculosis H37Rv
agcaggggacgaccaugccga

SEQ ID NO: 1269358 - RNA, 16 nt, Mycobacterium tuberculosis H37Rv
agcaggccgggacagc

SEQ ID NO: 1269359 - RNA, 16 nt, Mycobacterium tuberculosis H37Rv
agcauugaccaaucca

SEQ ID NO: 1269360 - RNA, 20 nt, Mycobacterium tuberculosis H37Rv
agccacauacaggcccgcca

SEQ ID NO: 1269361 - RNA, 17 nt, Mycobacterium tuberculosis H37Rv
agcaucuccgucggcca

SEQ ID NO: 1269362 - RNA, 16 nt, Mycobacterium tuberculosis H37Rv
agcaucggcagcagcg

SEQ ID NO: 1269363 - RNA, 22 nt, Mycobacterium tuberculosis H37Rv
agcaucguggccgcaccuccgc

SEQ ID NO: 1269364 - RNA, 13 nt, Mycobacterium tuberculosis H37Rv
agcaucucggcgg

SEQ ID NO: 1269365 - RNA, 12 nt, Mycobacterium tuberculosis H37Rv
agacgccggcga

SEQ ID NO: 1269366 - RNA, 18 nt, Mycobacterium tuberculosis H37Rv
agacgcggaaucgcaccg

SEQ ID NO: 1269367 - RNA, 19 nt, Mycobacterium tuberculosis H37Rv
agacgcagaaucgcccaau

SEQ ID NO: 1269368 - RNA, 20 nt, Mycobacterium tuberculosis H37Rv
agacgcagaaucgcacgcga

SEQ ID NO: 1269369 - RNA, 18 nt, Mycobacterium tuberculosis H37Rv
agacgcagaaucgcacgc

SEQ ID NO: 1269370 - RNA, 22 nt, Mycobacterium tuberculosis H37Rv
agacgcacggccaccgcgcaac

SEQ ID NO: 1269371 - RNA, 20 nt, Mycobacterium tuberculosis H37Rv
agacgcagaaucgcccaauu

SEQ ID NO: 1269372 - RNA, 22 nt, Mycobacterium tuberculosis H37Rv
agacgcgaaaucccccgacacg

SEQ ID NO: 1269373 - RNA, 19 nt, Mycobacterium tuberculosis H37Rv
agacgcaaaaucgcccgaa

SEQ ID NO: 1269374 - RNA, 19 nt, Mycobacterium tuberculosis H37Rv
agacgcaaaaucgcccauu

SEQ ID NO: 1269375 - RNA, 20 nt, Mycobacterium tuberculosis H37Rv
agacgcaaaaagcuccaaau

SEQ ID NO: 1269376 - RNA, 20 nt, Mycobacterium tuberculosis H37Rv
agacgcaaaaucgcccaauu

SEQ ID NO: 1269377 - RNA, 12 nt, Mycobacterium tuberculosis H37Rv
agacgaugccgu

SEQ ID NO: 1269378 - RNA, 16 nt, Mycobacterium tuberculosis H37Rv
agacgaauaacgccgc

SEQ ID NO: 1269379 - RNA, 16 nt, Mycobacterium tuberculosis H37Rv
agacgacaucgucauc

SEQ ID NO: 1269380 - RNA, 16 nt, Mycobacterium tuberculosis H37Rv
agaccuucucgccgcc

SEQ ID NO: 1269381 - RNA, 16 nt, Mycobacterium tuberculosis H37Rv
agaccuguccggcaua

SEQ ID NO: 1269382 - RNA, 17 nt, Mycobacterium tuberculosis H37Rv
agaccuagcaccgcgcc

SEQ ID NO: 1269383 - RNA, 16 nt, Mycobacterium tuberculosis H37Rv
agaccgccgacgccgu

SEQ ID NO: 1269384 - RNA, 20 nt, Mycobacterium tuberculosis H37Rv
agaccgcgucggcggccagu

SEQ ID NO: 1269385 - RNA, 21 nt, Mycobacterium tuberculosis H37Rv
agaccgggugggucguucacc

SEQ ID NO: 1269386 - RNA, 21 nt, Mycobacterium tuberculosis H37Rv
agaccgguuucuucggccagc

SEQ ID NO: 1269387 - RNA, 18 nt, Mycobacterium tuberculosis H37Rv
agaccagggcagcggcca

SEQ ID NO: 1269388 - RNA, 13 nt, Mycobacterium tuberculosis H37Rv
agaccgcagucgc

SEQ ID NO: 1269389 - RNA, 14 nt, Mycobacterium tuberculosis H37Rv
agaccgaucggcag

SEQ ID NO: 1269390 - RNA, 14 nt, Mycobacterium tuberculosis H37Rv
agaccgagcccgau

SEQ ID NO: 1269391 - RNA, 17 nt, Mycobacterium tuberculosis H37Rv
agaccgacagcggcacc

SEQ ID NO: 1269392 - RNA, 12 nt, Mycobacterium tuberculosis H37Rv
agacccacgaug

SEQ ID NO: 1269393 - RNA, 19 nt, Mycobacterium tuberculosis H37Rv
agacccgugagcggagcaa

SEQ ID NO: 1269394 - RNA, 15 nt, Mycobacterium tuberculosis H37Rv
agauaccaccgccgc

SEQ ID NO: 1269395 - RNA, 21 nt, Mycobacterium tuberculosis H37Rv
agauacgcguguggcagaugu

SEQ ID NO: 1269396 - RNA, 13 nt, Mycobacterium tuberculosis H37Rv
agauacgagcugu

SEQ ID NO: 1269397 - RNA, 23 nt, Mycobacterium tuberculosis H37Rv
agagugcucagcgcgcgccgcug

SEQ ID NO: 1269398 - RNA, 16 nt, Mycobacterium tuberculosis H37Rv
agacuucuucgacgcg

SEQ ID NO: 1269399 - RNA, 14 nt, Mycobacterium tuberculosis H37Rv
agacuucuucgacg

SEQ ID NO: 1269400 - RNA, 16 nt, Mycobacterium tuberculosis H37Rv
agagccaacgcgcgac

SEQ ID NO: 1269401 - RNA, 17 nt, Mycobacterium tuberculosis H37Rv
agagccaacgcgcgacc

SEQ ID NO: 1269402 - RNA, 20 nt, Mycobacterium tuberculosis H37Rv
agacguauaucgguugcugc

SEQ ID NO: 1269403 - RNA, 20 nt, Mycobacterium tuberculosis H37Rv
agacguccgcggucgcagca

SEQ ID NO: 1269404 - RNA, 12 nt, Mycobacterium tuberculosis H37Rv
agaagcccgaag

SEQ ID NO: 1269405 - RNA, 19 nt, Mycobacterium tuberculosis H37Rv
agaagcccgacuggucacu

SEQ ID NO: 1269406 - RNA, 15 nt, Mycobacterium tuberculosis H37Rv
agaacuucgccagcg

SEQ ID NO: 1269407 - RNA, 23 nt, Mycobacterium tuberculosis H37Rv
agaaccggguaaugcgacgccgg

SEQ ID NO: 1269408 - RNA, 15 nt, Mycobacterium tuberculosis H37Rv
agaaccuggagccgu

SEQ ID NO: 1269409 - RNA, 16 nt, Mycobacterium tuberculosis H37Rv
agaacgcgucgcgcgc

SEQ ID NO: 1269410 - RNA, 19 nt, Mycobacterium tuberculosis H37Rv
agaacguaggguggccggu

SEQ ID NO: 1269411 - RNA, 13 nt, Mycobacterium tuberculosis H37Rv
agaacucggcguc

SEQ ID NO: 1269412 - RNA, 11 nt, Mycobacterium tuberculosis H37Rv
acugcugggcu

SEQ ID NO: 1269413 - RNA, 15 nt, Mycobacterium tuberculosis H37Rv
acuggaauggcucac

SEQ ID NO: 1269414 - RNA, 13 nt, Mycobacterium tuberculosis H37Rv
acuggaccaccgc

SEQ ID NO: 1269415 - RNA, 17 nt, Mycobacterium tuberculosis H37Rv
acuggaccgcggugacc

SEQ ID NO: 1269416 - RNA, 22 nt, Mycobacterium tuberculosis H37Rv
agaacacguuauucaugcccau

SEQ ID NO: 1269417 - RNA, 13 nt, Mycobacterium tuberculosis H37Rv
agaacaccaccgc

SEQ ID NO: 1269418 - RNA, 18 nt, Mycobacterium tuberculosis H37Rv
agaauuccccagccgcau

SEQ ID NO: 1269419 - RNA, 21 nt, Mycobacterium tuberculosis H37Rv
agacaccgcgaucaccaccgg

SEQ ID NO: 1269420 - RNA, 20 nt, Mycobacterium tuberculosis H37Rv
agacacagaaucgcccauuu

SEQ ID NO: 1269421 - RNA, 15 nt, Mycobacterium tuberculosis H37Rv
agacaacaacacggg

SEQ ID NO: 1269422 - RNA, 19 nt, Mycobacterium tuberculosis H37Rv
agacagcgccaugcccucg

SEQ ID NO: 1269423 - RNA, 12 nt, Mycobacterium tuberculosis H37Rv
agacagcgcggg

SEQ ID NO: 1269424 - RNA, 14 nt, Mycobacterium tuberculosis H37Rv
agacaucgcgacga

SEQ ID NO: 1269425 - RNA, 17 nt, Mycobacterium tuberculosis H37Rv
agaaguaggcggcgacg

SEQ ID NO: 1269426 - RNA, 15 nt, Mycobacterium tuberculosis H37Rv
agaaggcgcgggcga

SEQ ID NO: 1269427 - RNA, 16 nt, Mycobacterium tuberculosis H37Rv
agaaucggcucagcaa

SEQ ID NO: 1269428 - RNA, 16 nt, Mycobacterium tuberculosis H37Rv
agaaucgaagcggcug

SEQ ID NO: 1269429 - RNA, 19 nt, Mycobacterium tuberculosis H37Rv
agaaugggauggcaccacc

SEQ ID NO: 1269430 - RNA, 23 nt, Mycobacterium tuberculosis H37Rv
agaaucgcccaauuucgugccga

SEQ ID NO: 1269431 - RNA, 15 nt, Mycobacterium tuberculosis H37Rv
agccugccgaugacg

SEQ ID NO: 1269432 - RNA, 16 nt, Mycobacterium tuberculosis H37Rv
agccugcgggccggca

SEQ ID NO: 1269433 - RNA, 19 nt, Mycobacterium tuberculosis H37Rv
agccugcucgcagcgggcg

SEQ ID NO: 1269434 - RNA, 22 nt, Mycobacterium tuberculosis H37Rv
agcgaaaacccggucggcgaaa

SEQ ID NO: 1269435 - RNA, 22 nt, Mycobacterium tuberculosis H37Rv
agccugcuucugggcuuucugc

SEQ ID NO: 1269436 - RNA, 22 nt, Mycobacterium tuberculosis H37Rv
agccuaguacgccgagcagacg

SEQ ID NO: 1269437 - RNA, 17 nt, Mycobacterium tuberculosis H37Rv
agccgguugucgcagcg

SEQ ID NO: 1269438 - RNA, 21 nt, Mycobacterium tuberculosis H37Rv
agccguagaccaggcccaggu

SEQ ID NO: 1269439 - RNA, 17 nt, Mycobacterium tuberculosis H37Rv
agccucggcaugcagcc

SEQ ID NO: 1269440 - RNA, 22 nt, Mycobacterium tuberculosis H37Rv
agccucguagaacgcuagcgcc

SEQ ID NO: 1269441 - RNA, 21 nt, Mycobacterium tuberculosis H37Rv
agccucguucauguccaccgc

SEQ ID NO: 1269442 - RNA, 17 nt, Mycobacterium tuberculosis H37Rv
agcgacuccagcgcccg

SEQ ID NO: 1269443 - RNA, 17 nt, Mycobacterium tuberculosis H37Rv
agcgacucgccggcgaa

SEQ ID NO: 1269444 - RNA, 16 nt, Mycobacterium tuberculosis H37Rv
agcgacucgccggcga

SEQ ID NO: 1269445 - RNA, 23 nt, Mycobacterium tuberculosis H37Rv
agcgacggucccggcacgucgac

SEQ ID NO: 1269446 - RNA, 16 nt, Mycobacterium tuberculosis H37Rv
agcgacgcugccgcca

SEQ ID NO: 1269447 - RNA, 14 nt, Mycobacterium tuberculosis H37Rv
agcgacgagcagca

SEQ ID NO: 1269448 - RNA, 13 nt, Mycobacterium tuberculosis H37Rv
agcgacgcacgca

SEQ ID NO: 1269449 - RNA, 14 nt, Mycobacterium tuberculosis H37Rv
agcgaccgacgcca

SEQ ID NO: 1269450 - RNA, 16 nt, Mycobacterium tuberculosis H37Rv
agcgaccgcugcagau

SEQ ID NO: 1269451 - RNA, 22 nt, Mycobacterium tuberculosis H37Rv
agcgaccucacugcggcgccau

SEQ ID NO: 1269452 - RNA, 16 nt, Mycobacterium tuberculosis H37Rv
agccgguagccgggca

SEQ ID NO: 1269453 - RNA, 21 nt, Mycobacterium tuberculosis H37Rv
agccggucauagucgaauggc

SEQ ID NO: 1269454 - RNA, 19 nt, Mycobacterium tuberculosis H37Rv
agccgggugggagcagccg

SEQ ID NO: 1269455 - RNA, 18 nt, Mycobacterium tuberculosis H37Rv
agccggguaucuuggcga

SEQ ID NO: 1269456 - RNA, 18 nt, Mycobacterium tuberculosis H37Rv
agccgggcggccucguug

SEQ ID NO: 1269457 - RNA, 14 nt, Mycobacterium tuberculosis H37Rv
agccggggaacgug

SEQ ID NO: 1269458 - RNA, 21 nt, Mycobacterium tuberculosis H37Rv
agccggugccggcguugccgc

SEQ ID NO: 1269459 - RNA, 15 nt, Mycobacterium tuberculosis H37Rv
agccggugaccgcga

SEQ ID NO: 1269460 - RNA, 12 nt, Mycobacterium tuberculosis H37Rv
agccggugacgg

SEQ ID NO: 1269461 - RNA, 16 nt, Mycobacterium tuberculosis H37Rv
agccggugacgguguu

SEQ ID NO: 1269462 - RNA, 19 nt, Mycobacterium tuberculosis H37Rv
agccgguggcccgccggca

SEQ ID NO: 1269463 - RNA, 16 nt, Mycobacterium tuberculosis H37Rv
agccggugggugacgu

SEQ ID NO: 1269464 - RNA, 21 nt, Mycobacterium tuberculosis H37Rv
agccgguguugauguugccgg

SEQ ID NO: 1269465 - RNA, 18 nt, Mycobacterium tuberculosis H37Rv
agccggucuugcaucgcc

SEQ ID NO: 1269466 - RNA, 20 nt, Mycobacterium tuberculosis H37Rv
agccggucuugcaucgccga

SEQ ID NO: 1269467 - RNA, 19 nt, Mycobacterium tuberculosis H37Rv
agccgggccccacaucgcc

SEQ ID NO: 1269468 - RNA, 18 nt, Mycobacterium tuberculosis H37Rv
agccggcuguuaggcgau

SEQ ID NO: 1269469 - RNA, 17 nt, Mycobacterium tuberculosis H37Rv
agccggcgccgggucga

SEQ ID NO: 1269470 - RNA, 15 nt, Mycobacterium tuberculosis H37Rv
agccggcgacaccgc

SEQ ID NO: 1269471 - RNA, 22 nt, Mycobacterium tuberculosis H37Rv
agccggcgagaaacacgacagc

SEQ ID NO: 1269472 - RNA, 17 nt, Mycobacterium tuberculosis H37Rv
agccggcgacaccgcag

SEQ ID NO: 1269473 - RNA, 18 nt, Mycobacterium tuberculosis H37Rv
agccggccgcgaccgcga

SEQ ID NO: 1269474 - RNA, 14 nt, Mycobacterium tuberculosis H37Rv
agccggccgugaug

SEQ ID NO: 1269475 - RNA, 14 nt, Mycobacterium tuberculosis H37Rv
agccggccacuacg

SEQ ID NO: 1269476 - RNA, 12 nt, Mycobacterium tuberculosis H37Rv
agccggccaccu

SEQ ID NO: 1269477 - RNA, 17 nt, Mycobacterium tuberculosis H37Rv
agccgaaggggaacgcg

SEQ ID NO: 1269478 - RNA, 16 nt, Mycobacterium tuberculosis H37Rv
agccgacuaucggccg

SEQ ID NO: 1269479 - RNA, 19 nt, Mycobacterium tuberculosis H37Rv
agccgacgucgccggacga

SEQ ID NO: 1269480 - RNA, 12 nt, Mycobacterium tuberculosis H37Rv
agccgacgucgc

SEQ ID NO: 1269481 - RNA, 21 nt, Mycobacterium tuberculosis H37Rv
agccgaagaaccggucgcagu

SEQ ID NO: 1269482 - RNA, 18 nt, Mycobacterium tuberculosis H37Rv
agccgaagaaccggucgc

SEQ ID NO: 1269483 - RNA, 21 nt, Mycobacterium tuberculosis H37Rv
agcccgucgaguagguaacgc

SEQ ID NO: 1269484 - RNA, 13 nt, Mycobacterium tuberculosis H37Rv
agccgaacaccgu

SEQ ID NO: 1269485 - RNA, 21 nt, Mycobacterium tuberculosis H37Rv
agccgcaccaguggcgcccau

SEQ ID NO: 1269486 - RNA, 19 nt, Mycobacterium tuberculosis H37Rv
agccgcaccccgcccgacg

SEQ ID NO: 1269487 - RNA, 14 nt, Mycobacterium tuberculosis H37Rv
agccgcacgaugcc

SEQ ID NO: 1269488 - RNA, 21 nt, Mycobacterium tuberculosis H37Rv
agccgauguccgacgccaccg

SEQ ID NO: 1269489 - RNA, 18 nt, Mycobacterium tuberculosis H37Rv
agccgauguccgacgcca

SEQ ID NO: 1269490 - RNA, 18 nt, Mycobacterium tuberculosis H37Rv
agccgaugaucgaacacg

SEQ ID NO: 1269491 - RNA, 21 nt, Mycobacterium tuberculosis H37Rv
agccgauuuuuccacaccagc

SEQ ID NO: 1269492 - RNA, 17 nt, Mycobacterium tuberculosis H37Rv
agccgacuucgucaacc

SEQ ID NO: 1269493 - RNA, 19 nt, Mycobacterium tuberculosis H37Rv
agccgagcccgucgaucag

SEQ ID NO: 1269494 - RNA, 12 nt, Mycobacterium tuberculosis H37Rv
agccgagcggcg

SEQ ID NO: 1269495 - RNA, 18 nt, Mycobacterium tuberculosis H37Rv
agccgagccagcuccggc

SEQ ID NO: 1269496 - RNA, 13 nt, Mycobacterium tuberculosis H37Rv
agccgagccucgc

SEQ ID NO: 1269497 - RNA, 16 nt, Mycobacterium tuberculosis H37Rv
agccgaugaucgaaca

SEQ ID NO: 1269498 - RNA, 20 nt, Mycobacterium tuberculosis H37Rv
agccgaucgucucggccacg

SEQ ID NO: 1269499 - RNA, 18 nt, Mycobacterium tuberculosis H37Rv
agcccgggauaccgcuca

SEQ ID NO: 1269500 - RNA, 17 nt, Mycobacterium tuberculosis H37Rv
agcccggcggcggucac

SEQ ID NO: 1269501 - RNA, 23 nt, Mycobacterium tuberculosis H37Rv
agcccggcguuguugaccagcac

SEQ ID NO: 1269502 - RNA, 14 nt, Mycobacterium tuberculosis H37Rv
agcccggcgaucag

SEQ ID NO: 1269503 - RNA, 17 nt, Mycobacterium tuberculosis H37Rv
agcccggcgaucagcag

SEQ ID NO: 1269504 - RNA, 21 nt, Mycobacterium tuberculosis H37Rv
agccaccgucaugccgacgac

SEQ ID NO: 1269505 - RNA, 15 nt, Mycobacterium tuberculosis H37Rv
agccaccgucaugcc

SEQ ID NO: 1269506 - RNA, 21 nt, Mycobacterium tuberculosis H37Rv
agcccggccucggcgagcacg

SEQ ID NO: 1269507 - RNA, 19 nt, Mycobacterium tuberculosis H37Rv
agccaccgcgaaaauucgu

SEQ ID NO: 1269508 - RNA, 16 nt, Mycobacterium tuberculosis H37Rv
agcccguucgaaguuc

SEQ ID NO: 1269509 - RNA, 18 nt, Mycobacterium tuberculosis H37Rv
agcccguugguagccggu

SEQ ID NO: 1269510 - RNA, 18 nt, Mycobacterium tuberculosis H37Rv
agcccggucauggucagc

SEQ ID NO: 1269511 - RNA, 16 nt, Mycobacterium tuberculosis H37Rv
agcccguagccgauca

SEQ ID NO: 1269512 - RNA, 12 nt, Mycobacterium tuberculosis H37Rv
agcccgucagcc

SEQ ID NO: 1269513 - RNA, 15 nt, Mycobacterium tuberculosis H37Rv
agcccggggaugccu

SEQ ID NO: 1269514 - RNA, 22 nt, Mycobacterium tuberculosis H37Rv
agcccgggugaaacgauggcga

SEQ ID NO: 1269515 - RNA, 21 nt, Mycobacterium tuberculosis H37Rv
agcccgggccugaaccacgcg

SEQ ID NO: 1269516 - RNA, 15 nt, Mycobacterium tuberculosis H37Rv
agcccgguacgccgc

SEQ ID NO: 1269517 - RNA, 21 nt, Mycobacterium tuberculosis H37Rv
agccgcauaggccccgccagc

SEQ ID NO: 1269518 - RNA, 19 nt, Mycobacterium tuberculosis H37Rv
agccgcagcaccucgucga

SEQ ID NO: 1269519 - RNA, 22 nt, Mycobacterium tuberculosis H37Rv
agccgcagcggccugaccggcu

SEQ ID NO: 1269520 - RNA, 22 nt, Mycobacterium tuberculosis H37Rv
agccgccgcgaccaaaccgcug

SEQ ID NO: 1269521 - RNA, 13 nt, Mycobacterium tuberculosis H37Rv
agccgccgcgacg

SEQ ID NO: 1269522 - RNA, 20 nt, Mycobacterium tuberculosis H37Rv
agccgcggcggcagcaccca

SEQ ID NO: 1269523 - RNA, 13 nt, Mycobacterium tuberculosis H37Rv
agccgccggacga

SEQ ID NO: 1269524 - RNA, 17 nt, Mycobacterium tuberculosis H37Rv
agccgcggcccucgaug

SEQ ID NO: 1269525 - RNA, 19 nt, Mycobacterium tuberculosis H37Rv
agccgcgcgccaucgccuc

SEQ ID NO: 1269526 - RNA, 14 nt, Mycobacterium tuberculosis H37Rv
agccgcgcggguca

SEQ ID NO: 1269527 - RNA, 22 nt, Mycobacterium tuberculosis H37Rv
agccggaugcgcuuccaucgcc

SEQ ID NO: 1269528 - RNA, 21 nt, Mycobacterium tuberculosis H37Rv
agccggaugcggccgaacucg

SEQ ID NO: 1269529 - RNA, 14 nt, Mycobacterium tuberculosis H37Rv
agccggcagcagcg

SEQ ID NO: 1269530 - RNA, 21 nt, Mycobacterium tuberculosis H37Rv
agccggauucggcugccaccg

SEQ ID NO: 1269531 - RNA, 13 nt, Mycobacterium tuberculosis H37Rv
agccggauucggc

SEQ ID NO: 1269532 - RNA, 21 nt, Mycobacterium tuberculosis H37Rv
agccgcggcgccauagccgcg

SEQ ID NO: 1269533 - RNA, 18 nt, Mycobacterium tuberculosis H37Rv
agccgcguucgcgcaaau

SEQ ID NO: 1269534 - RNA, 18 nt, Mycobacterium tuberculosis H37Rv
agccgcucaucgaucccg

SEQ ID NO: 1269535 - RNA, 18 nt, Mycobacterium tuberculosis H37Rv
agccgcucacccggucgc

SEQ ID NO: 1269536 - RNA, 15 nt, Mycobacterium tuberculosis H37Rv
agccgcuccgcccau

SEQ ID NO: 1269537 - RNA, 21 nt, Mycobacterium tuberculosis H37Rv
agccgcuccacguacgcggcu

SEQ ID NO: 1269538 - RNA, 15 nt, Mycobacterium tuberculosis H37Rv
agccgcuggaagucg

SEQ ID NO: 1269539 - RNA, 14 nt, Mycobacterium tuberculosis H37Rv
agccgcugcggcac

SEQ ID NO: 1269540 - RNA, 16 nt, Mycobacterium tuberculosis H37Rv
agccgcugaucgccga

SEQ ID NO: 1269541 - RNA, 18 nt, Mycobacterium tuberculosis H37Rv
agccgcucggcguagcga

SEQ ID NO: 1269542 - RNA, 23 nt, Mycobacterium tuberculosis H37Rv
agccgcucgcugaaccggaucga

SEQ ID NO: 1269543 - RNA, 16 nt, Mycobacterium tuberculosis H37Rv
agcgcugagccgcuca

SEQ ID NO: 1269544 - RNA, 15 nt, Mycobacterium tuberculosis H37Rv
agcgcugagccgcuc

SEQ ID NO: 1269545 - RNA, 16 nt, Mycobacterium tuberculosis H37Rv
agcgcgugugcgucgc

SEQ ID NO: 1269546 - RNA, 21 nt, Mycobacterium tuberculosis H37Rv
agcgcuggcaggccgggcacc

SEQ ID NO: 1269547 - RNA, 17 nt, Mycobacterium tuberculosis H37Rv
agcgcugccaccgcggu

SEQ ID NO: 1269548 - RNA, 13 nt, Mycobacterium tuberculosis H37Rv
agcgcugccaccg

SEQ ID NO: 1269549 - RNA, 14 nt, Mycobacterium tuberculosis H37Rv
agcgcgggcucaca

SEQ ID NO: 1269550 - RNA, 19 nt, Mycobacterium tuberculosis H37Rv
agcgcggcguguacgucga

SEQ ID NO: 1269551 - RNA, 18 nt, Mycobacterium tuberculosis H37Rv
agcgcggcguguacgucg

SEQ ID NO: 1269552 - RNA, 17 nt, Mycobacterium tuberculosis H37Rv
agcgcggcuacggucgc

SEQ ID NO: 1269553 - RNA, 21 nt, Mycobacterium tuberculosis H37Rv
agcgcgucgggaugcgcguua

SEQ ID NO: 1269554 - RNA, 15 nt, Mycobacterium tuberculosis H37Rv
agcgcgucggucacc

SEQ ID NO: 1269555 - RNA, 23 nt, Mycobacterium tuberculosis H37Rv
agcgcggugccgccaccggcguc

SEQ ID NO: 1269556 - RNA, 14 nt, Mycobacterium tuberculosis H37Rv
agcgcggccagcag

SEQ ID NO: 1269557 - RNA, 21 nt, Mycobacterium tuberculosis H37Rv
agcgcggcgucuagcccgcca

SEQ ID NO: 1269558 - RNA, 22 nt, Mycobacterium tuberculosis H37Rv
agcgcggccauuagcagcaccc

SEQ ID NO: 1269559 - RNA, 12 nt, Mycobacterium tuberculosis H37Rv
agcgcggagacg

SEQ ID NO: 1269560 - RNA, 19 nt, Mycobacterium tuberculosis H37Rv
agcgcgcugcggaucgugg

SEQ ID NO: 1269561 - RNA, 22 nt, Mycobacterium tuberculosis H37Rv
agcgcgcuacagcaucaaccgu

SEQ ID NO: 1269562 - RNA, 18 nt, Mycobacterium tuberculosis H37Rv
agcgcgcccgacacccgu

SEQ ID NO: 1269563 - RNA, 24 nt, Mycobacterium tuberculosis H37Rv
agcgaugucccaucgcgucggcga

SEQ ID NO: 1269564 - RNA, 21 nt, Mycobacterium tuberculosis H37Rv
agcgauuccacggcagcaccg

SEQ ID NO: 1269565 - RNA, 22 nt, Mycobacterium tuberculosis H37Rv
agcgauuccacggcagcaccgg

SEQ ID NO: 1269566 - RNA, 17 nt, Mycobacterium tuberculosis H37Rv
agcgcaaccuccgcgag

SEQ ID NO: 1269567 - RNA, 20 nt, Mycobacterium tuberculosis H37Rv
agcgcaaccuccgcgagcag

SEQ ID NO: 1269568 - RNA, 15 nt, Mycobacterium tuberculosis H37Rv
agcgcaaaugcgggc

SEQ ID NO: 1269569 - RNA, 22 nt, Mycobacterium tuberculosis H37Rv
agcgccaugcccucggcgccga

SEQ ID NO: 1269570 - RNA, 16 nt, Mycobacterium tuberculosis H37Rv
agcgccaggccgcaca

SEQ ID NO: 1269571 - RNA, 13 nt, Mycobacterium tuberculosis H37Rv
agcgcccuccucg

SEQ ID NO: 1269572 - RNA, 15 nt, Mycobacterium tuberculosis H37Rv
agcgcccuccucgau

SEQ ID NO: 1269573 - RNA, 17 nt, Mycobacterium tuberculosis H37Rv
agcgccgaauucauccg

SEQ ID NO: 1269574 - RNA, 19 nt, Mycobacterium tuberculosis H37Rv
agcgcccuuggacgcgaug

SEQ ID NO: 1269575 - RNA, 22 nt, Mycobacterium tuberculosis H37Rv
agcgccgauguggccggcgaug

SEQ ID NO: 1269576 - RNA, 17 nt, Mycobacterium tuberculosis H37Rv
agcgccuugaccagcag

SEQ ID NO: 1269577 - RNA, 16 nt, Mycobacterium tuberculosis H37Rv
agcgccuccagcacca

SEQ ID NO: 1269578 - RNA, 14 nt, Mycobacterium tuberculosis H37Rv
agcgccucgaccug

SEQ ID NO: 1269579 - RNA, 19 nt, Mycobacterium tuberculosis H37Rv
agcgccuccagcaccacgg

SEQ ID NO: 1269580 - RNA, 21 nt, Mycobacterium tuberculosis H37Rv
agcgccuccagcaccacggcg

SEQ ID NO: 1269581 - RNA, 13 nt, Mycobacterium tuberculosis H37Rv
agcgccgcgccca

SEQ ID NO: 1269582 - RNA, 22 nt, Mycobacterium tuberculosis H37Rv
agcgccguacagcggcggcguc

SEQ ID NO: 1269583 - RNA, 21 nt, Mycobacterium tuberculosis H37Rv
agcgccgccagguguucgccg

SEQ ID NO: 1269584 - RNA, 20 nt, Mycobacterium tuberculosis H37Rv
agcgccgccgcgagcgccgg

SEQ ID NO: 1269585 - RNA, 13 nt, Mycobacterium tuberculosis H37Rv
agcgccgccggca

SEQ ID NO: 1269586 - RNA, 12 nt, Mycobacterium tuberculosis H37Rv
agcggacccgac

SEQ ID NO: 1269587 - RNA, 16 nt, Mycobacterium tuberculosis H37Rv
agcggacagcucgcgg

SEQ ID NO: 1269588 - RNA, 23 nt, Mycobacterium tuberculosis H37Rv
agcggaccgaugacgaucggcgg

SEQ ID NO: 1269589 - RNA, 20 nt, Mycobacterium tuberculosis H37Rv
agcggaauggaggccgccga

SEQ ID NO: 1269590 - RNA, 19 nt, Mycobacterium tuberculosis H37Rv
agcggcaccgcggccagcg

SEQ ID NO: 1269591 - RNA, 13 nt, Mycobacterium tuberculosis H37Rv
agcggagccggcg

SEQ ID NO: 1269592 - RNA, 19 nt, Mycobacterium tuberculosis H37Rv
agcggagcaauuccacgau

SEQ ID NO: 1269593 - RNA, 21 nt, Mycobacterium tuberculosis H37Rv
agcggccaccguagccagcag

SEQ ID NO: 1269594 - RNA, 21 nt, Mycobacterium tuberculosis H37Rv
agcggccaccgccgccgccac

SEQ ID NO: 1269595 - RNA, 12 nt, Mycobacterium tuberculosis H37Rv
agcggcaucggc

SEQ ID NO: 1269596 - RNA, 15 nt, Mycobacterium tuberculosis H37Rv
agcggcaucggccag

SEQ ID NO: 1269597 - RNA, 21 nt, Mycobacterium tuberculosis H37Rv
agcggcagaugaauugccggg

SEQ ID NO: 1269598 - RNA, 23 nt, Mycobacterium tuberculosis H37Rv
agcggcagccuggccucgccauu

SEQ ID NO: 1269599 - RNA, 19 nt, Mycobacterium tuberculosis H37Rv
agcggcagcgaguggccga

SEQ ID NO: 1269600 - RNA, 16 nt, Mycobacterium tuberculosis H37Rv
agcggcacgucggcgc

SEQ ID NO: 1269601 - RNA, 19 nt, Mycobacterium tuberculosis H37Rv
agcggcacgucggcgccga

SEQ ID NO: 1269602 - RNA, 13 nt, Mycobacterium tuberculosis H37Rv
agcggccgcgaug

SEQ ID NO: 1269603 - RNA, 23 nt, Mycobacterium tuberculosis H37Rv
agcggccgcuccaccucggcguu

SEQ ID NO: 1269604 - RNA, 13 nt, Mycobacterium tuberculosis H37Rv
agcggccucgacc

SEQ ID NO: 1269605 - RNA, 20 nt, Mycobacterium tuberculosis H37Rv
agcggccucgaccucuucgg

SEQ ID NO: 1269606 - RNA, 17 nt, Mycobacterium tuberculosis H37Rv
agcggccuccagcaccc

SEQ ID NO: 1269607 - RNA, 13 nt, Mycobacterium tuberculosis H37Rv
agcggcgaacucg

SEQ ID NO: 1269608 - RNA, 20 nt, Mycobacterium tuberculosis H37Rv
agcggcgaaggucuggccug

SEQ ID NO: 1269609 - RNA, 18 nt, Mycobacterium tuberculosis H37Rv
agcggcgacacaucgccc

SEQ ID NO: 1269610 - RNA, 15 nt, Mycobacterium tuberculosis H37Rv
agcggcgcucggcgc

SEQ ID NO: 1269611 - RNA, 12 nt, Mycobacterium tuberculosis H37Rv
agcggccagcau

SEQ ID NO: 1269612 - RNA, 18 nt, Mycobacterium tuberculosis H37Rv
agcggccagcagugcggu

SEQ ID NO: 1269613 - RNA, 16 nt, Mycobacterium tuberculosis H37Rv
agcggcccgcugcgcg

SEQ ID NO: 1269614 - RNA, 14 nt, Mycobacterium tuberculosis H37Rv
agcggccgcaggcg

SEQ ID NO: 1269615 - RNA, 20 nt, Mycobacterium tuberculosis H37Rv
agcgggcuguaggcgaucac

SEQ ID NO: 1269616 - RNA, 12 nt, Mycobacterium tuberculosis H37Rv
agcgguagccga

SEQ ID NO: 1269617 - RNA, 18 nt, Mycobacterium tuberculosis H37Rv
agcgguagcucauugccg

SEQ ID NO: 1269618 - RNA, 19 nt, Mycobacterium tuberculosis H37Rv
agcgguacguaaucgagcg

SEQ ID NO: 1269619 - RNA, 18 nt, Mycobacterium tuberculosis H37Rv
agcgggggcagcgcgaac

SEQ ID NO: 1269620 - RNA, 21 nt, Mycobacterium tuberculosis H37Rv
agcgguaggcguugaucgccg

SEQ ID NO: 1269621 - RNA, 17 nt, Mycobacterium tuberculosis H37Rv
agcgguauuugaugagc

SEQ ID NO: 1269622 - RNA, 20 nt, Mycobacterium tuberculosis H37Rv
agcgguccggauugaagucg

SEQ ID NO: 1269623 - RNA, 18 nt, Mycobacterium tuberculosis H37Rv
agcgguccggauugaagu

SEQ ID NO: 1269624 - RNA, 16 nt, Mycobacterium tuberculosis H37Rv
agcggcgggccguaca

SEQ ID NO: 1269625 - RNA, 19 nt, Mycobacterium tuberculosis H37Rv
agcgggcgaugagcgcgau

SEQ ID NO: 1269626 - RNA, 19 nt, Mycobacterium tuberculosis H37Rv
agcguaaugcugcugcagc

SEQ ID NO: 1269627 - RNA, 23 nt, Mycobacterium tuberculosis H37Rv
agcgguuucgaauguuucggcga

SEQ ID NO: 1269628 - RNA, 18 nt, Mycobacterium tuberculosis H37Rv
agcgguuugccagugaug

SEQ ID NO: 1269629 - RNA, 16 nt, Mycobacterium tuberculosis H37Rv
agcguagcccgaguug

SEQ ID NO: 1269630 - RNA, 12 nt, Mycobacterium tuberculosis H37Rv
agcgucacccug

SEQ ID NO: 1269631 - RNA, 20 nt, Mycobacterium tuberculosis H37Rv
guugaaggugccggcguuag

SEQ ID NO: 1269632 - RNA, 20 nt, Mycobacterium tuberculosis H37Rv
guugagaacaacgcgucgau

SEQ ID NO: 1269633 - RNA, 19 nt, Mycobacterium tuberculosis H37Rv
guugacucugcguccacca

SEQ ID NO: 1269634 - RNA, 18 nt, Mycobacterium tuberculosis H37Rv
guucugccuuaccaaccg

SEQ ID NO: 1269635 - RNA, 23 nt, Mycobacterium tuberculosis H37Rv
guucugggaccgauaaguucggc

SEQ ID NO: 1269636 - RNA, 15 nt, Mycobacterium tuberculosis H37Rv
guucucgguccacgg

SEQ ID NO: 1269637 - RNA, 21 nt, Mycobacterium tuberculosis H37Rv
guucucgcgcaggucgccuuc

SEQ ID NO: 1269638 - RNA, 17 nt, Mycobacterium tuberculosis H37Rv
guucucgagcucggcga

SEQ ID NO: 1269639 - RNA, 15 nt, Mycobacterium tuberculosis H37Rv
guucuccucgugcag

SEQ ID NO: 1269640 - RNA, 14 nt, Mycobacterium tuberculosis H37Rv
guucggucagcgcc

SEQ ID NO: 1269641 - RNA, 22 nt, Mycobacterium tuberculosis H37Rv
guucgggcugccaggagcacgg

SEQ ID NO: 1269642 - RNA, 19 nt, Mycobacterium tuberculosis H37Rv
guucggugguccuggcgaa

SEQ ID NO: 1269643 - RNA, 14 nt, Mycobacterium tuberculosis H37Rv
guucgggacgcgag

SEQ ID NO: 1269644 - RNA, 16 nt, Mycobacterium tuberculosis H37Rv
guucgugagcggccag

SEQ ID NO: 1269645 - RNA, 15 nt, Mycobacterium tuberculosis H37Rv
guucgugcacggcga

SEQ ID NO: 1269646 - RNA, 22 nt, Mycobacterium tuberculosis H37Rv
guucgucgaacggaucucggug

SEQ ID NO: 1269647 - RNA, 15 nt, Mycobacterium tuberculosis H37Rv
guucgucgucgcuga

SEQ ID NO: 1269648 - RNA, 19 nt, Mycobacterium tuberculosis H37Rv
guucgucggcugcggcguc

SEQ ID NO: 1269649 - RNA, 15 nt, Mycobacterium tuberculosis H37Rv
guucgcgcacgucgg

SEQ ID NO: 1269650 - RNA, 15 nt, Mycobacterium tuberculosis H37Rv
guucgcgucgccgau

SEQ ID NO: 1269651 - RNA, 19 nt, Mycobacterium tuberculosis H37Rv
guucgcgggcgucccgcau

SEQ ID NO: 1269652 - RNA, 16 nt, Mycobacterium tuberculosis H37Rv
guucgcgucgccgaug

SEQ ID NO: 1269653 - RNA, 17 nt, Mycobacterium tuberculosis H37Rv
guucgcgucgccgauga

SEQ ID NO: 1269654 - RNA, 15 nt, Mycobacterium tuberculosis H37Rv
guucgcugacggcca

SEQ ID NO: 1269655 - RNA, 15 nt, Mycobacterium tuberculosis H37Rv
guucggacgagguca

SEQ ID NO: 1269656 - RNA, 21 nt, Mycobacterium tuberculosis H37Rv
guucgauagcggcggcggcac

SEQ ID NO: 1269657 - RNA, 16 nt, Mycobacterium tuberculosis H37Rv
guucgaucccguccgc

SEQ ID NO: 1269658 - RNA, 15 nt, Mycobacterium tuberculosis H37Rv
guucgacggcgucaa

SEQ ID NO: 1269659 - RNA, 18 nt, Mycobacterium tuberculosis H37Rv
guucgcccacaugccggu

SEQ ID NO: 1269660 - RNA, 19 nt, Mycobacterium tuberculosis H37Rv
guucgaugggugcaccgaa

SEQ ID NO: 1269661 - RNA, 21 nt, Mycobacterium tuberculosis H37Rv
guugagaaccggcucaccacg

SEQ ID NO: 1269662 - RNA, 14 nt, Mycobacterium tuberculosis H37Rv
guugagaucgcccg

SEQ ID NO: 1269663 - RNA, 21 nt, Mycobacterium tuberculosis H37Rv
guugagcaagugggugccggc

SEQ ID NO: 1269664 - RNA, 21 nt, Mycobacterium tuberculosis H37Rv
guugagcggcagccaagcgag

SEQ ID NO: 1269665 - RNA, 14 nt, Mycobacterium tuberculosis H37Rv
guugagcuggaccu

SEQ ID NO: 1269666 - RNA, 20 nt, Mycobacterium tuberculosis H37Rv
guugccgccgaagccgacga

SEQ ID NO: 1269667 - RNA, 14 nt, Mycobacterium tuberculosis H37Rv
guugccgccagcgc

SEQ ID NO: 1269668 - RNA, 20 nt, Mycobacterium tuberculosis H37Rv
guugccgccguuaccgccgu

SEQ ID NO: 1269669 - RNA, 20 nt, Mycobacterium tuberculosis H37Rv
guugccgccgucaccgccga

SEQ ID NO: 1269670 - RNA, 20 nt, Mycobacterium tuberculosis H37Rv
guugccgccgucaccgccgu

SEQ ID NO: 1269671 - RNA, 23 nt, Mycobacterium tuberculosis H37Rv
guugccgccguccccaccgacgc

SEQ ID NO: 1269672 - RNA, 16 nt, Mycobacterium tuberculosis H37Rv
guugccggcggcgacg

SEQ ID NO: 1269673 - RNA, 18 nt, Mycobacterium tuberculosis H37Rv
guugccggaucgacguuc

SEQ ID NO: 1269674 - RNA, 17 nt, Mycobacterium tuberculosis H37Rv
guugccggagacgucgc

SEQ ID NO: 1269675 - RNA, 16 nt, Mycobacterium tuberculosis H37Rv
guugccguuggugccg

SEQ ID NO: 1269676 - RNA, 13 nt, Mycobacterium tuberculosis H37Rv
guugccucgucgc

SEQ ID NO: 1269677 - RNA, 21 nt, Mycobacterium tuberculosis H37Rv
guugccgugacgauucgagca

SEQ ID NO: 1269678 - RNA, 16 nt, Mycobacterium tuberculosis H37Rv
guugcgagccggcgaa

SEQ ID NO: 1269679 - RNA, 12 nt, Mycobacterium tuberculosis H37Rv
guugccuuggcg

SEQ ID NO: 1269680 - RNA, 19 nt, Mycobacterium tuberculosis H37Rv
guuggaagucccgccguug

SEQ ID NO: 1269681 - RNA, 19 nt, Mycobacterium tuberculosis H37Rv
guugcgcggcuugggcaga

SEQ ID NO: 1269682 - RNA, 16 nt, Mycobacterium tuberculosis H37Rv
guugcuggcggccagc

SEQ ID NO: 1269683 - RNA, 13 nt, Mycobacterium tuberculosis H37Rv
guuggcccgacgc

SEQ ID NO: 1269684 - RNA, 19 nt, Mycobacterium tuberculosis H37Rv
guuggccagccacagccga

SEQ ID NO: 1269685 - RNA, 20 nt, Mycobacterium tuberculosis H37Rv
guuggccacacagucacgga

SEQ ID NO: 1269686 - RNA, 15 nt, Mycobacterium tuberculosis H37Rv
guuggauacggugcg

SEQ ID NO: 1269687 - RNA, 14 nt, Mycobacterium tuberculosis H37Rv
guuggccagaccgc

SEQ ID NO: 1269688 - RNA, 13 nt, Mycobacterium tuberculosis H37Rv
guuggcaguggcg

SEQ ID NO: 1269689 - RNA, 18 nt, Mycobacterium tuberculosis H37Rv
guuggcagggccagcggc

SEQ ID NO: 1269690 - RNA, 12 nt, Mycobacterium tuberculosis H37Rv
guuggcaguggc

SEQ ID NO: 1269691 - RNA, 20 nt, Mycobacterium tuberculosis H37Rv
guuggcacgcaacaccgcca

SEQ ID NO: 1269692 - RNA, 16 nt, Mycobacterium tuberculosis H37Rv
guugucguugcuggug

SEQ ID NO: 1269693 - RNA, 18 nt, Mycobacterium tuberculosis H37Rv
guugucuuucacaugcgc

SEQ ID NO: 1269694 - RNA, 18 nt, Mycobacterium tuberculosis H37Rv
guuguggaaccacggcgc

SEQ ID NO: 1269695 - RNA, 15 nt, Mycobacterium tuberculosis H37Rv
guugugcuguggucg

SEQ ID NO: 1269696 - RNA, 22 nt, Mycobacterium tuberculosis H37Rv
guuggccgcccgaaugcgguga

SEQ ID NO: 1269697 - RNA, 17 nt, Mycobacterium tuberculosis H37Rv
guuggcgggagcaccga

SEQ ID NO: 1269698 - RNA, 18 nt, Mycobacterium tuberculosis H37Rv
guuggcgggagcaccgac

SEQ ID NO: 1269699 - RNA, 22 nt, Mycobacterium tuberculosis H37Rv
guuggcggugaacaccgccagc

SEQ ID NO: 1269700 - RNA, 18 nt, Mycobacterium tuberculosis H37Rv
guuggcggcugcacgcug

SEQ ID NO: 1269701 - RNA, 12 nt, Mycobacterium tuberculosis H37Rv
guuguccaccgc

SEQ ID NO: 1269702 - RNA, 22 nt, Mycobacterium tuberculosis H37Rv
guuggcugagcagcgcggccag

SEQ ID NO: 1269703 - RNA, 20 nt, Mycobacterium tuberculosis H37Rv
guuggcgucgcuacgcaacg

SEQ ID NO: 1269704 - RNA, 16 nt, Mycobacterium tuberculosis H37Rv
guuguuggugccagcc

SEQ ID NO: 1269705 - RNA, 13 nt, Mycobacterium tuberculosis H37Rv
guuguugucggug

SEQ ID NO: 1269706 - RNA, 16 nt, Mycobacterium tuberculosis H37Rv
guugugugcucgucgc

SEQ ID NO: 1269707 - RNA, 14 nt, Mycobacterium tuberculosis H37Rv
guuguggguggucc

SEQ ID NO: 1269708 - RNA, 15 nt, Mycobacterium tuberculosis H37Rv
uaauccccgacaucg

SEQ ID NO: 1269709 - RNA, 17 nt, Mycobacterium tuberculosis H37Rv
uaauccagcgccgaccu

SEQ ID NO: 1269710 - RNA, 16 nt, Mycobacterium tuberculosis H37Rv
uaaugccagcggcaca

SEQ ID NO: 1269711 - RNA, 18 nt, Mycobacterium tuberculosis H37Rv
uaauucaacagcaccgcg

SEQ ID NO: 1269712 - RNA, 21 nt, Mycobacterium tuberculosis H37Rv
uaacgacugacaacggccaca

SEQ ID NO: 1269713 - RNA, 22 nt, Mycobacterium tuberculosis H37Rv
uaaccguugaccucuucgggca

SEQ ID NO: 1269714 - RNA, 20 nt, Mycobacterium tuberculosis H37Rv
uaaacugccgcggcaccgcc

SEQ ID NO: 1269715 - RNA, 16 nt, Mycobacterium tuberculosis H37Rv
gucggcguggucgcgc

SEQ ID NO: 1269716 - RNA, 18 nt, Mycobacterium tuberculosis H37Rv
gucggcgugucgcgucgc

SEQ ID NO: 1269717 - RNA, 19 nt, Mycobacterium tuberculosis H37Rv
gucggcgugucgcgucgca

SEQ ID NO: 1269718 - RNA, 16 nt, Mycobacterium tuberculosis H37Rv
gugaucacccgcaucg

SEQ ID NO: 1269719 - RNA, 18 nt, Mycobacterium tuberculosis H37Rv
gugaucaaaccggccuua

SEQ ID NO: 1269720 - RNA, 17 nt, Mycobacterium tuberculosis H37Rv
gucggcggauucacgca

SEQ ID NO: 1269721 - RNA, 24 nt, Mycobacterium tuberculosis H37Rv
gucggcgucgaagugggugaaccg

SEQ ID NO: 1269722 - RNA, 13 nt, Mycobacterium tuberculosis H37Rv
gucggcgucgagc

SEQ ID NO: 1269723 - RNA, 20 nt, Mycobacterium tuberculosis H37Rv
gucggcgucgaaguggguga

SEQ ID NO: 1269724 - RNA, 14 nt, Mycobacterium tuberculosis H37Rv
gugaucgcggucga

SEQ ID NO: 1269725 - RNA, 12 nt, Mycobacterium tuberculosis H37Rv
gugaucagcgca

SEQ ID NO: 1269726 - RNA, 13 nt, Mycobacterium tuberculosis H37Rv
gugaucagcagga

SEQ ID NO: 1269727 - RNA, 22 nt, Mycobacterium tuberculosis H37Rv
gugauugacggugcgauaccga

SEQ ID NO: 1269728 - RNA, 13 nt, Mycobacterium tuberculosis H37Rv
gugauugucggcg

SEQ ID NO: 1269729 - RNA, 13 nt, Mycobacterium tuberculosis H37Rv
gugauucggcgac

SEQ ID NO: 1269730 - RNA, 16 nt, Mycobacterium tuberculosis H37Rv
gugauggucaccgucu

SEQ ID NO: 1269731 - RNA, 22 nt, Mycobacterium tuberculosis H37Rv
gugauguucagcgccacgucca

SEQ ID NO: 1269732 - RNA, 20 nt, Mycobacterium tuberculosis H37Rv
gugaugaauucgcuugcagc

SEQ ID NO: 1269733 - RNA, 13 nt, Mycobacterium tuberculosis H37Rv
gugaugccgccgu

SEQ ID NO: 1269734 - RNA, 17 nt, Mycobacterium tuberculosis H37Rv
gugaucgugaccggcaa

SEQ ID NO: 1269735 - RNA, 14 nt, Mycobacterium tuberculosis H37Rv
gugaugaacaccgg

SEQ ID NO: 1269736 - RNA, 14 nt, Mycobacterium tuberculosis H37Rv
gugaucuuguccgg

SEQ ID NO: 1269737 - RNA, 15 nt, Mycobacterium tuberculosis H37Rv
gugaucuucggcgau

SEQ ID NO: 1269738 - RNA, 21 nt, Mycobacterium tuberculosis H37Rv
gugcauagcaauccgcacagc

SEQ ID NO: 1269739 - RNA, 15 nt, Mycobacterium tuberculosis H37Rv
gugccacgaggaccc

SEQ ID NO: 1269740 - RNA, 20 nt, Mycobacterium tuberculosis H37Rv
gugccaccugacuaccguca

SEQ ID NO: 1269741 - RNA, 13 nt, Mycobacterium tuberculosis H37Rv
gugccaccgacgc

SEQ ID NO: 1269742 - RNA, 13 nt, Mycobacterium tuberculosis H37Rv
gugccaccacgcu

SEQ ID NO: 1269743 - RNA, 20 nt, Mycobacterium tuberculosis H37Rv
gugcaggucguccaucgcgu

SEQ ID NO: 1269744 - RNA, 16 nt, Mycobacterium tuberculosis H37Rv
gugcccaugaugguca

SEQ ID NO: 1269745 - RNA, 11 nt, Mycobacterium tuberculosis H37Rv
gugccagcagg

SEQ ID NO: 1269746 - RNA, 23 nt, Mycobacterium tuberculosis H37Rv
gugccagaccagggcagcggcca

SEQ ID NO: 1269747 - RNA, 19 nt, Mycobacterium tuberculosis H37Rv
gugccagcccguugcagga

SEQ ID NO: 1269748 - RNA, 13 nt, Mycobacterium tuberculosis H37Rv
gugccagccggau

SEQ ID NO: 1269749 - RNA, 13 nt, Mycobacterium tuberculosis H37Rv
gugccacguucgc

SEQ ID NO: 1269750 - RNA, 18 nt, Mycobacterium tuberculosis H37Rv
gugccacuuccacggcgu

SEQ ID NO: 1269751 - RNA, 19 nt, Mycobacterium tuberculosis H37Rv
gugcagaucggcucaccga

SEQ ID NO: 1269752 - RNA, 22 nt, Mycobacterium tuberculosis H37Rv
gugcaagaccguuacaccauca

SEQ ID NO: 1269753 - RNA, 13 nt, Mycobacterium tuberculosis H37Rv
gugcagcaccagc

SEQ ID NO: 1269754 - RNA, 16 nt, Mycobacterium tuberculosis H37Rv
gugcagcaccagccac

SEQ ID NO: 1269755 - RNA, 21 nt, Mycobacterium tuberculosis H37Rv
gugcacgacgacaucgagcca

SEQ ID NO: 1269756 - RNA, 14 nt, Mycobacterium tuberculosis H37Rv
gugcaacggcguug

SEQ ID NO: 1269757 - RNA, 16 nt, Mycobacterium tuberculosis H37Rv
gugcacgaucgcggug

SEQ ID NO: 1269758 - RNA, 14 nt, Mycobacterium tuberculosis H37Rv
gugcacgagcggac

SEQ ID NO: 1269759 - RNA, 20 nt, Mycobacterium tuberculosis H37Rv
gugcacggcuuuucgacgcu

SEQ ID NO: 1269760 - RNA, 14 nt, Mycobacterium tuberculosis H37Rv
gugcggucaaagga

SEQ ID NO: 1269761 - RNA, 15 nt, Mycobacterium tuberculosis H37Rv
gugcggucgucaccg

SEQ ID NO: 1269762 - RNA, 16 nt, Mycobacterium tuberculosis H37Rv
gugcgguacaucgacc

SEQ ID NO: 1269763 - RNA, 17 nt, Mycobacterium tuberculosis H37Rv
gugcgguacaucgacca

SEQ ID NO: 1269764 - RNA, 14 nt, Mycobacterium tuberculosis H37Rv
gugcguuggaugaa

SEQ ID NO: 1269765 - RNA, 18 nt, Mycobacterium tuberculosis H37Rv
gugcggugccguggugga

SEQ ID NO: 1269766 - RNA, 17 nt, Mycobacterium tuberculosis H37Rv
gugcucaaggcuucggc

SEQ ID NO: 1269767 - RNA, 19 nt, Mycobacterium tuberculosis H37Rv
gugcugaacuccgccgcga

SEQ ID NO: 1269768 - RNA, 17 nt, Mycobacterium tuberculosis H37Rv
gugcugccauugccgca

SEQ ID NO: 1269769 - RNA, 17 nt, Mycobacterium tuberculosis H37Rv
gugcugcagaucggccg

SEQ ID NO: 1269770 - RNA, 20 nt, Mycobacterium tuberculosis H37Rv
gugcugagucgguucagcca

SEQ ID NO: 1269771 - RNA, 17 nt, Mycobacterium tuberculosis H37Rv
gugcgccaccucgacgc

SEQ ID NO: 1269772 - RNA, 23 nt, Mycobacterium tuberculosis H37Rv
gugcgccacgaccgcggcggcau

SEQ ID NO: 1269773 - RNA, 16 nt, Mycobacterium tuberculosis H37Rv
gugcgccaccucgacg

SEQ ID NO: 1269774 - RNA, 21 nt, Mycobacterium tuberculosis H37Rv
gugcgcagaacaccaccgcca

SEQ ID NO: 1269775 - RNA, 20 nt, Mycobacterium tuberculosis H37Rv
gugcgccuugaccacagcgg

SEQ ID NO: 1269776 - RNA, 19 nt, Mycobacterium tuberculosis H37Rv
gugcgcuggcugacaccga

SEQ ID NO: 1269777 - RNA, 18 nt, Mycobacterium tuberculosis H37Rv
gugcgcgugacgaccagc

SEQ ID NO: 1269778 - RNA, 19 nt, Mycobacterium tuberculosis H37Rv
gugcgcggcauucucgagc

SEQ ID NO: 1269779 - RNA, 16 nt, Mycobacterium tuberculosis H37Rv
gugcgcggccgcccgu

SEQ ID NO: 1269780 - RNA, 14 nt, Mycobacterium tuberculosis H37Rv
gugcgcgcggucga

SEQ ID NO: 1269781 - RNA, 13 nt, Mycobacterium tuberculosis H37Rv
gugcgcguccaga

SEQ ID NO: 1269782 - RNA, 20 nt, Mycobacterium tuberculosis H37Rv
gugccggcccugcucggcca

SEQ ID NO: 1269783 - RNA, 15 nt, Mycobacterium tuberculosis H37Rv
gugccggcgccgcca

SEQ ID NO: 1269784 - RNA, 17 nt, Mycobacterium tuberculosis H37Rv
gugccggcgccgcccuu

SEQ ID NO: 1269785 - RNA, 19 nt, Mycobacterium tuberculosis H37Rv
gugccggcgaaccccagcg

SEQ ID NO: 1269786 - RNA, 14 nt, Mycobacterium tuberculosis H37Rv
gugccggcgugcgc

SEQ ID NO: 1269787 - RNA, 14 nt, Mycobacterium tuberculosis H37Rv
gugccggaaacgcc

SEQ ID NO: 1269788 - RNA, 17 nt, Mycobacterium tuberculosis H37Rv
gugccggccaucgcccg

SEQ ID NO: 1269789 - RNA, 18 nt, Mycobacterium tuberculosis H37Rv
gugccggcauagaucggg

SEQ ID NO: 1269790 - RNA, 12 nt, Mycobacterium tuberculosis H37Rv
gugccggcagcg

SEQ ID NO: 1269791 - RNA, 19 nt, Mycobacterium tuberculosis H37Rv
gugccgcgguaggugcaug

SEQ ID NO: 1269792 - RNA, 13 nt, Mycobacterium tuberculosis H37Rv
gugccgacggcgc

SEQ ID NO: 1269793 - RNA, 21 nt, Mycobacterium tuberculosis H37Rv
gugccgacgccccgaucggcc

SEQ ID NO: 1269794 - RNA, 18 nt, Mycobacterium tuberculosis H37Rv
gugccgcggcuaggccaa

SEQ ID NO: 1269795 - RNA, 17 nt, Mycobacterium tuberculosis H37Rv
gugccgaacagcggguu

SEQ ID NO: 1269796 - RNA, 12 nt, Mycobacterium tuberculosis H37Rv
gugcccgcacca

SEQ ID NO: 1269797 - RNA, 23 nt, Mycobacterium tuberculosis H37Rv
gugcccgaccacaagcagugugg

SEQ ID NO: 1269798 - RNA, 13 nt, Mycobacterium tuberculosis H37Rv
gugcccgaucagc

SEQ ID NO: 1269799 - RNA, 15 nt, Mycobacterium tuberculosis H37Rv
gugccgaaaugggcg

SEQ ID NO: 1269800 - RNA, 20 nt, Mycobacterium tuberculosis H37Rv
gugccgaagaugaccgcucg

SEQ ID NO: 1269801 - RNA, 17 nt, Mycobacterium tuberculosis H37Rv
gugccugcuuggccacu

SEQ ID NO: 1269802 - RNA, 22 nt, Mycobacterium tuberculosis H37Rv
gugccguugcgucugcucggcg

SEQ ID NO: 1269803 - RNA, 14 nt, Mycobacterium tuberculosis H37Rv
gugccguguccagc

SEQ ID NO: 1269804 - RNA, 23 nt, Mycobacterium tuberculosis H37Rv
gugccgugugcuucgagcaccga

SEQ ID NO: 1269805 - RNA, 22 nt, Mycobacterium tuberculosis H37Rv
gugccggcggaucugaucggcg

SEQ ID NO: 1269806 - RNA, 21 nt, Mycobacterium tuberculosis H37Rv
gugccgggaucgccguccagc

SEQ ID NO: 1269807 - RNA, 20 nt, Mycobacterium tuberculosis H37Rv
gugccggcguugccgccguu

SEQ ID NO: 1269808 - RNA, 16 nt, Mycobacterium tuberculosis H37Rv
aagugggugccggcac

SEQ ID NO: 1269809 - RNA, 14 nt, Mycobacterium tuberculosis H37Rv
gugcgcaccaccga

SEQ ID NO: 1269810 - RNA, 13 nt, Mycobacterium tuberculosis H37Rv
gugcugcucgaca

SEQ ID NO: 1269811 - RNA, 21 nt, Mycobacterium tuberculosis H37Rv
gugcuggccuuguuguccuuc

SEQ ID NO: 1269812 - RNA, 21 nt, Mycobacterium tuberculosis H37Rv
gugcugcgcaauagcgacagc

SEQ ID NO: 1269813 - RNA, 16 nt, Mycobacterium tuberculosis H37Rv
gugcuggucaacagcg

SEQ ID NO: 1269814 - RNA, 22 nt, Mycobacterium tuberculosis H37Rv
gugcuggggaugcgauggcccg

SEQ ID NO: 1269815 - RNA, 20 nt, Mycobacterium tuberculosis H37Rv
gugcugggcaucaccgacgc

SEQ ID NO: 1269816 - RNA, 22 nt, Mycobacterium tuberculosis H37Rv
guggcccacauguccagcgucc

SEQ ID NO: 1269817 - RNA, 17 nt, Mycobacterium tuberculosis H37Rv
guggcccaacaccgcca

SEQ ID NO: 1269818 - RNA, 17 nt, Mycobacterium tuberculosis H37Rv
guggcccguagcgucga

SEQ ID NO: 1269819 - RNA, 14 nt, Mycobacterium tuberculosis H37Rv
guggccagcgcuug

SEQ ID NO: 1269820 - RNA, 17 nt, Mycobacterium tuberculosis H37Rv
guggccagcgucgcgau

SEQ ID NO: 1269821 - RNA, 19 nt, Mycobacterium tuberculosis H37Rv
guggccgacaagucaagau

SEQ ID NO: 1269822 - RNA, 15 nt, Mycobacterium tuberculosis H37Rv
guggccgcaucgacg

SEQ ID NO: 1269823 - RNA, 14 nt, Mycobacterium tuberculosis H37Rv
guggccggacccau

SEQ ID NO: 1269824 - RNA, 16 nt, Mycobacterium tuberculosis H37Rv
guggccgcgcugguca

SEQ ID NO: 1269825 - RNA, 17 nt, Mycobacterium tuberculosis H37Rv
guggccucgucccggac

SEQ ID NO: 1269826 - RNA, 16 nt, Mycobacterium tuberculosis H37Rv
guggccgucgccgaag

SEQ ID NO: 1269827 - RNA, 15 nt, Mycobacterium tuberculosis H37Rv
guggcgaaaucgucg

SEQ ID NO: 1269828 - RNA, 20 nt, Mycobacterium tuberculosis H37Rv
guggcgcgccgcaucggcga

SEQ ID NO: 1269829 - RNA, 20 nt, Mycobacterium tuberculosis H37Rv
guggcgccggggccgccgau

SEQ ID NO: 1269830 - RNA, 20 nt, Mycobacterium tuberculosis H37Rv
guggcgcugaagccgacgau

SEQ ID NO: 1269831 - RNA, 14 nt, Mycobacterium tuberculosis H37Rv
guggcggaucgcga

SEQ ID NO: 1269832 - RNA, 19 nt, Mycobacterium tuberculosis H37Rv
guggcggcggugccacgau

SEQ ID NO: 1269833 - RNA, 13 nt, Mycobacterium tuberculosis H37Rv
guggcgaucaucg

SEQ ID NO: 1269834 - RNA, 18 nt, Mycobacterium tuberculosis H37Rv
guggcgcacaucgcgaaa

SEQ ID NO: 1269835 - RNA, 21 nt, Mycobacterium tuberculosis H37Rv
guggcgcccgcguucagggca

SEQ ID NO: 1269836 - RNA, 18 nt, Mycobacterium tuberculosis H37Rv
guggcgcccauggccacc

SEQ ID NO: 1269837 - RNA, 13 nt, Mycobacterium tuberculosis H37Rv
guggcgccaugaa

SEQ ID NO: 1269838 - RNA, 20 nt, Mycobacterium tuberculosis H37Rv
guggcgccacggcagcgccc

SEQ ID NO: 1269839 - RNA, 12 nt, Mycobacterium tuberculosis H37Rv
guggcucgacga

SEQ ID NO: 1269840 - RNA, 14 nt, Mycobacterium tuberculosis H37Rv
guggcucgacgaug

SEQ ID NO: 1269841 - RNA, 18 nt, Mycobacterium tuberculosis H37Rv
gugggauucugacgaccg

SEQ ID NO: 1269842 - RNA, 18 nt, Mycobacterium tuberculosis H37Rv
gugggcagcagcuggucg

SEQ ID NO: 1269843 - RNA, 21 nt, Mycobacterium tuberculosis H37Rv
gugggcaauccggucagcgcg

SEQ ID NO: 1269844 - RNA, 19 nt, Mycobacterium tuberculosis H37Rv
gugggcaagcugaccgcca

SEQ ID NO: 1269845 - RNA, 13 nt, Mycobacterium tuberculosis H37Rv
gugggcacagcga

SEQ ID NO: 1269846 - RNA, 15 nt, Mycobacterium tuberculosis H37Rv
gugggcacagcgacc

SEQ ID NO: 1269847 - RNA, 21 nt, Mycobacterium tuberculosis H37Rv
guggcgguaccuagccgcaga

SEQ ID NO: 1269848 - RNA, 15 nt, Mycobacterium tuberculosis H37Rv
guggcgguacaccga

SEQ ID NO: 1269849 - RNA, 21 nt, Mycobacterium tuberculosis H37Rv
guggcgggcugcagccgacag

SEQ ID NO: 1269850 - RNA, 19 nt, Mycobacterium tuberculosis H37Rv
guggcgggccggaugacgc

SEQ ID NO: 1269851 - RNA, 16 nt, Mycobacterium tuberculosis H37Rv
guggcgggaucaccau

SEQ ID NO: 1269852 - RNA, 14 nt, Mycobacterium tuberculosis H37Rv
guggcgggccggau

SEQ ID NO: 1269853 - RNA, 14 nt, Mycobacterium tuberculosis H37Rv
guggcguggucucg

SEQ ID NO: 1269854 - RNA, 21 nt, Mycobacterium tuberculosis H37Rv
guggcguuacgcucggcgaac

SEQ ID NO: 1269855 - RNA, 18 nt, Mycobacterium tuberculosis H37Rv
guggcguuacgcucggcg

SEQ ID NO: 1269856 - RNA, 16 nt, Mycobacterium tuberculosis H37Rv
guggcgucgcucgucg

SEQ ID NO: 1269857 - RNA, 17 nt, Mycobacterium tuberculosis H37Rv
gugucaaugacaccggg

SEQ ID NO: 1269858 - RNA, 16 nt, Mycobacterium tuberculosis H37Rv
gugucaaugacaccgg

SEQ ID NO: 1269859 - RNA, 22 nt, Mycobacterium tuberculosis H37Rv
gugucaaaaccguugucgucca

SEQ ID NO: 1269860 - RNA, 15 nt, Mycobacterium tuberculosis H37Rv
gugucacgcgaccac

SEQ ID NO: 1269861 - RNA, 18 nt, Mycobacterium tuberculosis H37Rv
gugucagcaagaucggca

SEQ ID NO: 1269862 - RNA, 22 nt, Mycobacterium tuberculosis H37Rv
gugucagcaagaucggcagcgu

SEQ ID NO: 1269863 - RNA, 21 nt, Mycobacterium tuberculosis H37Rv
gugucugggaccccgcugcga

SEQ ID NO: 1269864 - RNA, 19 nt, Mycobacterium tuberculosis H37Rv
guguaguggcccgcgggca

SEQ ID NO: 1269865 - RNA, 19 nt, Mycobacterium tuberculosis H37Rv
guguagaagcgggcgucgc

SEQ ID NO: 1269866 - RNA, 19 nt, Mycobacterium tuberculosis H37Rv
guguagagcgcaccgcgaa

SEQ ID NO: 1269867 - RNA, 18 nt, Mycobacterium tuberculosis H37Rv
guguagcccuccgagcac

SEQ ID NO: 1269868 - RNA, 17 nt, Mycobacterium tuberculosis H37Rv
guguagcaagucgccga

SEQ ID NO: 1269869 - RNA, 14 nt, Mycobacterium tuberculosis H37Rv
gugugauacagcgc

SEQ ID NO: 1269870 - RNA, 21 nt, Mycobacterium tuberculosis H37Rv
gugugaacuggucgacgucgg

SEQ ID NO: 1269871 - RNA, 18 nt, Mycobacterium tuberculosis H37Rv
gugugccugcgucucgau

SEQ ID NO: 1269872 - RNA, 13 nt, Mycobacterium tuberculosis H37Rv
guggggaucacga

SEQ ID NO: 1269873 - RNA, 19 nt, Mycobacterium tuberculosis H37Rv
guggggauagccgcgucgc

SEQ ID NO: 1269874 - RNA, 12 nt, Mycobacterium tuberculosis H37Rv
gugggcuuggug

SEQ ID NO: 1269875 - RNA, 20 nt, Mycobacterium tuberculosis H37Rv
gugggcuuugccgucgagca

SEQ ID NO: 1269876 - RNA, 15 nt, Mycobacterium tuberculosis H37Rv
gugggcggcucgucg

SEQ ID NO: 1269877 - RNA, 19 nt, Mycobacterium tuberculosis H37Rv
gugggcguggcuggucaug

SEQ ID NO: 1269878 - RNA, 21 nt, Mycobacterium tuberculosis H37Rv
gugggcguugucuagcuggug

SEQ ID NO: 1269879 - RNA, 20 nt, Mycobacterium tuberculosis H37Rv
guggugaccgacgcggacag

SEQ ID NO: 1269880 - RNA, 21 nt, Mycobacterium tuberculosis H37Rv
guggggcguuagggccgccau

SEQ ID NO: 1269881 - RNA, 14 nt, Mycobacterium tuberculosis H37Rv
guggugcgcaaucg

SEQ ID NO: 1269882 - RNA, 14 nt, Mycobacterium tuberculosis H37Rv
guggugauugcgga

SEQ ID NO: 1269883 - RNA, 17 nt, Mycobacterium tuberculosis H37Rv
guggugccgcggccacc

SEQ ID NO: 1269884 - RNA, 21 nt, Mycobacterium tuberculosis H37Rv
gugguuguccacggcguuacg

SEQ ID NO: 1269885 - RNA, 19 nt, Mycobacterium tuberculosis H37Rv
gugguuuucccgucgccgc

SEQ ID NO: 1269886 - RNA, 16 nt, Mycobacterium tuberculosis H37Rv
guguacgcccgcucgg

SEQ ID NO: 1269887 - RNA, 22 nt, Mycobacterium tuberculosis H37Rv
guguacaccgcgcccgccgauc

SEQ ID NO: 1269888 - RNA, 18 nt, Mycobacterium tuberculosis H37Rv
guuaccgccgucgccgaa

SEQ ID NO: 1269889 - RNA, 21 nt, Mycobacterium tuberculosis H37Rv
guuaccgaccgcgugcaccga

SEQ ID NO: 1269890 - RNA, 13 nt, Mycobacterium tuberculosis H37Rv
aaguucgucacca

SEQ ID NO: 1269891 - RNA, 17 nt, Mycobacterium tuberculosis H37Rv
guguucgacacccucgg

SEQ ID NO: 1269892 - RNA, 15 nt, Mycobacterium tuberculosis H37Rv
guguucgcggcaucg

SEQ ID NO: 1269893 - RNA, 16 nt, Mycobacterium tuberculosis H37Rv
guguugagaucgcccg

SEQ ID NO: 1269894 - RNA, 16 nt, Mycobacterium tuberculosis H37Rv
guguugagcggcagcc

SEQ ID NO: 1269895 - RNA, 22 nt, Mycobacterium tuberculosis H37Rv
uaugcgggacugacccugaucg

SEQ ID NO: 1269896 - RNA, 13 nt, Mycobacterium tuberculosis H37Rv
uauggaccgccgc

SEQ ID NO: 1269897 - RNA, 13 nt, Mycobacterium tuberculosis H37Rv
uaugccgcccgca

SEQ ID NO: 1269898 - RNA, 14 nt, Mycobacterium tuberculosis H37Rv
uaucgaaggcgaca

SEQ ID NO: 1269899 - RNA, 19 nt, Mycobacterium tuberculosis H37Rv
uaucgccaguggugcaccg

SEQ ID NO: 1269900 - RNA, 22 nt, Mycobacterium tuberculosis H37Rv
uaucgaucggaucggcacccca

SEQ ID NO: 1269901 - RNA, 14 nt, Mycobacterium tuberculosis H37Rv
uauggguccucgag

SEQ ID NO: 1269902 - RNA, 14 nt, Mycobacterium tuberculosis H37Rv
uauucggcaucgcc

SEQ ID NO: 1269903 - RNA, 22 nt, Mycobacterium tuberculosis H37Rv
ucaacaugaguggcaaucccgc

SEQ ID NO: 1269904 - RNA, 16 nt, Mycobacterium tuberculosis H37Rv
ucaacaaucggugguc

SEQ ID NO: 1269905 - RNA, 15 nt, Mycobacterium tuberculosis H37Rv
uagucgcgaccgcgg

SEQ ID NO: 1269906 - RNA, 23 nt, Mycobacterium tuberculosis H37Rv
uagucgacgucgauuucggcgac

SEQ ID NO: 1269907 - RNA, 23 nt, Mycobacterium tuberculosis H37Rv
uagucagaugguuggaucgccac

SEQ ID NO: 1269908 - RNA, 21 nt, Mycobacterium tuberculosis H37Rv
uaguccagcucgcugcgcgcc

SEQ ID NO: 1269909 - RNA, 15 nt, Mycobacterium tuberculosis H37Rv
uagucgcgguaggcg

SEQ ID NO: 1269910 - RNA, 19 nt, Mycobacterium tuberculosis H37Rv
uaguugguccaggugaccg

SEQ ID NO: 1269911 - RNA, 12 nt, Mycobacterium tuberculosis H37Rv
uaguugcgcggc

SEQ ID NO: 1269912 - RNA, 16 nt, Mycobacterium tuberculosis H37Rv
uaguggaagccgacca

SEQ ID NO: 1269913 - RNA, 18 nt, Mycobacterium tuberculosis H37Rv
uagugcucgccggcaccg

SEQ ID NO: 1269914 - RNA, 22 nt, Mycobacterium tuberculosis H37Rv
uaguggcgaucugcugcucgau

SEQ ID NO: 1269915 - RNA, 17 nt, Mycobacterium tuberculosis H37Rv
uagucagaaccgacggc

SEQ ID NO: 1269916 - RNA, 18 nt, Mycobacterium tuberculosis H37Rv
uagguucaguuccaccgc

SEQ ID NO: 1269917 - RNA, 15 nt, Mycobacterium tuberculosis H37Rv
uagcgucuggcgaca

SEQ ID NO: 1269918 - RNA, 17 nt, Mycobacterium tuberculosis H37Rv
uagcgucugcuggaucg

SEQ ID NO: 1269919 - RNA, 12 nt, Mycobacterium tuberculosis H37Rv
uagcugcugaug

SEQ ID NO: 1269920 - RNA, 19 nt, Mycobacterium tuberculosis H37Rv
uaucgaaaaguagaccgag

SEQ ID NO: 1269921 - RNA, 19 nt, Mycobacterium tuberculosis H37Rv
uaucgaaagccaacucgac

SEQ ID NO: 1269922 - RNA, 14 nt, Mycobacterium tuberculosis H37Rv
uagcaggucgacgg

SEQ ID NO: 1269923 - RNA, 14 nt, Mycobacterium tuberculosis H37Rv
uagcaucgggcgag

SEQ ID NO: 1269924 - RNA, 22 nt, Mycobacterium tuberculosis H37Rv
uagccaagcgagcggucgacgu

SEQ ID NO: 1269925 - RNA, 20 nt, Mycobacterium tuberculosis H37Rv
uagcccgauggugccgaccc

SEQ ID NO: 1269926 - RNA, 21 nt, Mycobacterium tuberculosis H37Rv
uagcccgcgaucucggagcgc

SEQ ID NO: 1269927 - RNA, 13 nt, Mycobacterium tuberculosis H37Rv
uagccccgucgac

SEQ ID NO: 1269928 - RNA, 17 nt, Mycobacterium tuberculosis H37Rv
uagccaggcaaccgguc

SEQ ID NO: 1269929 - RNA, 19 nt, Mycobacterium tuberculosis H37Rv
uagcgccgcgcccaccaug

SEQ ID NO: 1269930 - RNA, 20 nt, Mycobacterium tuberculosis H37Rv
uagcgggcaagaugaucgcg

SEQ ID NO: 1269931 - RNA, 20 nt, Mycobacterium tuberculosis H37Rv
uagcgguucaucaccgucag

SEQ ID NO: 1269932 - RNA, 15 nt, Mycobacterium tuberculosis H37Rv
uagcguagcccgagu

SEQ ID NO: 1269933 - RNA, 18 nt, Mycobacterium tuberculosis H37Rv
uagcgguccagcgucgcc

SEQ ID NO: 1269934 - RNA, 22 nt, Mycobacterium tuberculosis H37Rv
uagccggucaguauggcgacga

SEQ ID NO: 1269935 - RNA, 15 nt, Mycobacterium tuberculosis H37Rv
uagccggugaccgcg

SEQ ID NO: 1269936 - RNA, 17 nt, Mycobacterium tuberculosis H37Rv
uagccggcucaucgcag

SEQ ID NO: 1269937 - RNA, 19 nt, Mycobacterium tuberculosis H37Rv
uagccggcucaucgcagcc

SEQ ID NO: 1269938 - RNA, 18 nt, Mycobacterium tuberculosis H37Rv
uagccggcgacaccgcag

SEQ ID NO: 1269939 - RNA, 16 nt, Mycobacterium tuberculosis H37Rv
uagaggauaucgccga

SEQ ID NO: 1269940 - RNA, 13 nt, Mycobacterium tuberculosis H37Rv
uagagcgcaccgc

SEQ ID NO: 1269941 - RNA, 19 nt, Mycobacterium tuberculosis H37Rv
uagaucgcguggaucgcgc

SEQ ID NO: 1269942 - RNA, 20 nt, Mycobacterium tuberculosis H37Rv
uagaacugcaucauggccgu

SEQ ID NO: 1269943 - RNA, 19 nt, Mycobacterium tuberculosis H37Rv
uagacguagaaugcgccgu

SEQ ID NO: 1269944 - RNA, 12 nt, Mycobacterium tuberculosis H37Rv
uagacggcgacg

SEQ ID NO: 1269945 - RNA, 21 nt, Mycobacterium tuberculosis H37Rv
uacuggcgucgaugucgccgc

SEQ ID NO: 1269946 - RNA, 23 nt, Mycobacterium tuberculosis H37Rv
uacucggcauccaggcugucgcg

SEQ ID NO: 1269947 - RNA, 18 nt, Mycobacterium tuberculosis H37Rv
uacucggccagcucguga

SEQ ID NO: 1269948 - RNA, 19 nt, Mycobacterium tuberculosis H37Rv
uacucggcgacugcgucgg

SEQ ID NO: 1269949 - RNA, 18 nt, Mycobacterium tuberculosis H37Rv
uacucaguguuccgccac

SEQ ID NO: 1269950 - RNA, 15 nt, Mycobacterium tuberculosis H37Rv
uaccugccggaccac

SEQ ID NO: 1269951 - RNA, 15 nt, Mycobacterium tuberculosis H37Rv
uaccugguucgacuc

SEQ ID NO: 1269952 - RNA, 19 nt, Mycobacterium tuberculosis H37Rv
uaccuuggcgucgacaccc

SEQ ID NO: 1269953 - RNA, 20 nt, Mycobacterium tuberculosis H37Rv
uaccggucagcaccuccacc

SEQ ID NO: 1269954 - RNA, 20 nt, Mycobacterium tuberculosis H37Rv
uaccggccuuuccagcaccc

SEQ ID NO: 1269955 - RNA, 14 nt, Mycobacterium tuberculosis H37Rv
uaccgucagcgccg

SEQ ID NO: 1269956 - RNA, 22 nt, Mycobacterium tuberculosis H37Rv
uaccgucgaccacuagcccagu

SEQ ID NO: 1269957 - RNA, 21 nt, Mycobacterium tuberculosis H37Rv
uaccgucgugcgugcggcgaa

SEQ ID NO: 1269958 - RNA, 15 nt, Mycobacterium tuberculosis H37Rv
uaccgcgcucccggc

SEQ ID NO: 1269959 - RNA, 17 nt, Mycobacterium tuberculosis H37Rv
uaccgcgaagcugcggg

SEQ ID NO: 1269960 - RNA, 20 nt, Mycobacterium tuberculosis H37Rv
uaccgcgcguuguggcgaug

SEQ ID NO: 1269961 - RNA, 20 nt, Mycobacterium tuberculosis H37Rv
uaccgccgucgccgaacagc

SEQ ID NO: 1269962 - RNA, 16 nt, Mycobacterium tuberculosis H37Rv
uaccgccguugccgau

SEQ ID NO: 1269963 - RNA, 20 nt, Mycobacterium tuberculosis H37Rv
uaccgcgugcgccggggaca

SEQ ID NO: 1269964 - RNA, 18 nt, Mycobacterium tuberculosis H37Rv
uaccccgcagcucaccuc

SEQ ID NO: 1269965 - RNA, 15 nt, Mycobacterium tuberculosis H37Rv
uacccccgauggcgu

SEQ ID NO: 1269966 - RNA, 23 nt, Mycobacterium tuberculosis H37Rv
uacccgcccacggcaccaccaag

SEQ ID NO: 1269967 - RNA, 12 nt, Mycobacterium tuberculosis H37Rv
uacccggcgacg

SEQ ID NO: 1269968 - RNA, 15 nt, Mycobacterium tuberculosis H37Rv
uaccgaacagcaccu

SEQ ID NO: 1269969 - RNA, 14 nt, Mycobacterium tuberculosis H37Rv
uaccgaagcggauc

SEQ ID NO: 1269970 - RNA, 23 nt, Mycobacterium tuberculosis H37Rv
uaccgacaccgugucgccggcga

SEQ ID NO: 1269971 - RNA, 16 nt, Mycobacterium tuberculosis H37Rv
uaccgaccaucgggac

SEQ ID NO: 1269972 - RNA, 19 nt, Mycobacterium tuberculosis H37Rv
uaccgaugguggugccaac

SEQ ID NO: 1269973 - RNA, 14 nt, Mycobacterium tuberculosis H37Rv
ucagguccaccgcu

SEQ ID NO: 1269974 - RNA, 19 nt, Mycobacterium tuberculosis H37Rv
ucaggucugacagaccggg

SEQ ID NO: 1269975 - RNA, 20 nt, Mycobacterium tuberculosis H37Rv
ucaggucgguggucucgacg

SEQ ID NO: 1269976 - RNA, 16 nt, Mycobacterium tuberculosis H37Rv
ucaggucgguggucuc

SEQ ID NO: 1269977 - RNA, 15 nt, Mycobacterium tuberculosis H37Rv
ucagguucgcaccgg

SEQ ID NO: 1269978 - RNA, 17 nt, Mycobacterium tuberculosis H37Rv
ucaggugagaccagguu

SEQ ID NO: 1269979 - RNA, 16 nt, Mycobacterium tuberculosis H37Rv
ucagggcucgcucgcc

SEQ ID NO: 1269980 - RNA, 13 nt, Mycobacterium tuberculosis H37Rv
ucagggugucgaa

SEQ ID NO: 1269981 - RNA, 23 nt, Mycobacterium tuberculosis H37Rv
ucagggcacgcuggaacuuggcg

SEQ ID NO: 1269982 - RNA, 16 nt, Mycobacterium tuberculosis H37Rv
ucagggccccaccgag

SEQ ID NO: 1269983 - RNA, 14 nt, Mycobacterium tuberculosis H37Rv
ucaggcgccgcuau

SEQ ID NO: 1269984 - RNA, 22 nt, Mycobacterium tuberculosis H37Rv
ucaggcggacgggacgcaugcg

SEQ ID NO: 1269985 - RNA, 16 nt, Mycobacterium tuberculosis H37Rv
ucaggcucauccgccg

SEQ ID NO: 1269986 - RNA, 15 nt, Mycobacterium tuberculosis H37Rv
ucaggcucgccgaug

SEQ ID NO: 1269987 - RNA, 19 nt, Mycobacterium tuberculosis H37Rv
ucaggcgggcaacgcagca

SEQ ID NO: 1269988 - RNA, 19 nt, Mycobacterium tuberculosis H37Rv
ucaggccgaugcgggucuc

SEQ ID NO: 1269989 - RNA, 23 nt, Mycobacterium tuberculosis H37Rv
ucagcgggcagcaggcgaugcgc

SEQ ID NO: 1269990 - RNA, 18 nt, Mycobacterium tuberculosis H37Rv
ucaucgcccaccgcaacg

SEQ ID NO: 1269991 - RNA, 21 nt, Mycobacterium tuberculosis H37Rv
ucaucgggguggccaccagcg

SEQ ID NO: 1269992 - RNA, 20 nt, Mycobacterium tuberculosis H37Rv
ucaucggcaucgacugccag

SEQ ID NO: 1269993 - RNA, 20 nt, Mycobacterium tuberculosis H37Rv
ucaucaccggcgcaccgucg

SEQ ID NO: 1269994 - RNA, 13 nt, Mycobacterium tuberculosis H37Rv
ucaucaccggcau

SEQ ID NO: 1269995 - RNA, 12 nt, Mycobacterium tuberculosis H37Rv
ucaucaccggca

SEQ ID NO: 1269996 - RNA, 13 nt, Mycobacterium tuberculosis H37Rv
ucauccaccgaug

SEQ ID NO: 1269997 - RNA, 13 nt, Mycobacterium tuberculosis H37Rv
ucauccccgacug

SEQ ID NO: 1269998 - RNA, 16 nt, Mycobacterium tuberculosis H37Rv
ucagucaacucaccgu

SEQ ID NO: 1269999 - RNA, 16 nt, Mycobacterium tuberculosis H37Rv
ucagugccccgcagca

SEQ ID NO: 1270000 - RNA, 13 nt, Mycobacterium tuberculosis H37Rv
ucagugccaggug

SEQ ID NO: 1270001 - RNA, 23 nt, Mycobacterium tuberculosis H37Rv
ucagugaccuguugaacggccgc

SEQ ID NO: 1270002 - RNA, 20 nt, Mycobacterium tuberculosis H37Rv
ucagugggcgguugaucgcc

SEQ ID NO: 1270003 - RNA, 15 nt, Mycobacterium tuberculosis H37Rv
ucaucaagguguugc

SEQ ID NO: 1270004 - RNA, 17 nt, Mycobacterium tuberculosis H37Rv
uccacggagucaacuuc

SEQ ID NO: 1270005 - RNA, 23 nt, Mycobacterium tuberculosis H37Rv
uccacggcgggaacggugccgau

SEQ ID NO: 1270006 - RNA, 17 nt, Mycobacterium tuberculosis H37Rv
uccacggcagcaccggu

SEQ ID NO: 1270007 - RNA, 18 nt, Mycobacterium tuberculosis H37Rv
uccacggccaggucgacg

SEQ ID NO: 1270008 - RNA, 17 nt, Mycobacterium tuberculosis H37Rv
uccacgggccgggcggu

SEQ ID NO: 1270009 - RNA, 18 nt, Mycobacterium tuberculosis H37Rv
uccacgucaucuggcgcu

SEQ ID NO: 1270010 - RNA, 20 nt, Mycobacterium tuberculosis H37Rv
uccacggguggugccagguc

SEQ ID NO: 1270011 - RNA, 13 nt, Mycobacterium tuberculosis H37Rv
uccagccaacggg

SEQ ID NO: 1270012 - RNA, 17 nt, Mycobacterium tuberculosis H37Rv
uccagcgcccggucacg

SEQ ID NO: 1270013 - RNA, 18 nt, Mycobacterium tuberculosis H37Rv
uccagcgcccggucacgc

SEQ ID NO: 1270014 - RNA, 18 nt, Mycobacterium tuberculosis H37Rv
uccaggcugaucccgaug

SEQ ID NO: 1270015 - RNA, 13 nt, Mycobacterium tuberculosis H37Rv
uccaggcgccacc

SEQ ID NO: 1270016 - RNA, 15 nt, Mycobacterium tuberculosis H37Rv
uccaggagccgagga

SEQ ID NO: 1270017 - RNA, 14 nt, Mycobacterium tuberculosis H37Rv
uccagcggcaccgc

SEQ ID NO: 1270018 - RNA, 20 nt, Mycobacterium tuberculosis H37Rv
uccagcuguacaacgccguc

SEQ ID NO: 1270019 - RNA, 15 nt, Mycobacterium tuberculosis H37Rv
uccagcugcugccga

SEQ ID NO: 1270020 - RNA, 14 nt, Mycobacterium tuberculosis H37Rv
uccagcugcgcggg

SEQ ID NO: 1270021 - RNA, 23 nt, Mycobacterium tuberculosis H37Rv
uccacccaggccgaugugucgau

SEQ ID NO: 1270022 - RNA, 16 nt, Mycobacterium tuberculosis H37Rv
uccacccccacgcugc

SEQ ID NO: 1270023 - RNA, 17 nt, Mycobacterium tuberculosis H37Rv
uccaccaggucgugccc

SEQ ID NO: 1270024 - RNA, 13 nt, Mycobacterium tuberculosis H37Rv
uccaccacgucgg

SEQ ID NO: 1270025 - RNA, 21 nt, Mycobacterium tuberculosis H37Rv
uccaacucggcccgggugacg

SEQ ID NO: 1270026 - RNA, 22 nt, Mycobacterium tuberculosis H37Rv
uccaccugcuccgcugucaccc

SEQ ID NO: 1270027 - RNA, 14 nt, Mycobacterium tuberculosis H37Rv
uccaccgucgccgc

SEQ ID NO: 1270028 - RNA, 13 nt, Mycobacterium tuberculosis H37Rv
uccacgacgucga

SEQ ID NO: 1270029 - RNA, 23 nt, Mycobacterium tuberculosis H37Rv
uccaccgcagauccccgccaccg

SEQ ID NO: 1270030 - RNA, 12 nt, Mycobacterium tuberculosis H37Rv
uccaccgcaucg

SEQ ID NO: 1270031 - RNA, 18 nt, Mycobacterium tuberculosis H37Rv
uccaccgccgacgcccga

SEQ ID NO: 1270032 - RNA, 19 nt, Mycobacterium tuberculosis H37Rv
uccaccggaccgaccaccg

SEQ ID NO: 1270033 - RNA, 13 nt, Mycobacterium tuberculosis H37Rv
uccaccggaccga

SEQ ID NO: 1270034 - RNA, 17 nt, Mycobacterium tuberculosis H37Rv
ucauggcgaaccgucag

SEQ ID NO: 1270035 - RNA, 18 nt, Mycobacterium tuberculosis H37Rv
ucauggcgaguacggccu

SEQ ID NO: 1270036 - RNA, 14 nt, Mycobacterium tuberculosis H37Rv
uccaaaaucgcggc

SEQ ID NO: 1270037 - RNA, 22 nt, Mycobacterium tuberculosis H37Rv
uccaaaacacucggaaucggcg

SEQ ID NO: 1270038 - RNA, 12 nt, Mycobacterium tuberculosis H37Rv
uccaaaccggag

SEQ ID NO: 1270039 - RNA, 19 nt, Mycobacterium tuberculosis H37Rv
uccaacaggaacaggcaaa

SEQ ID NO: 1270040 - RNA, 18 nt, Mycobacterium tuberculosis H37Rv
uccaacaacuccagcagg

SEQ ID NO: 1270041 - RNA, 18 nt, Mycobacterium tuberculosis H37Rv
uccaacccaggguggcga

SEQ ID NO: 1270042 - RNA, 19 nt, Mycobacterium tuberculosis H37Rv
ucaugcuaggccaccggcg

SEQ ID NO: 1270043 - RNA, 22 nt, Mycobacterium tuberculosis H37Rv
ucacauuggccaggucggccac

SEQ ID NO: 1270044 - RNA, 14 nt, Mycobacterium tuberculosis H37Rv
ucaccacaccggca

SEQ ID NO: 1270045 - RNA, 14 nt, Mycobacterium tuberculosis H37Rv
ucaccaccgcaccg

SEQ ID NO: 1270046 - RNA, 17 nt, Mycobacterium tuberculosis H37Rv
ucaccaccgcaccggaa

SEQ ID NO: 1270047 - RNA, 17 nt, Mycobacterium tuberculosis H37Rv
ucaccacgccggucgag

SEQ ID NO: 1270048 - RNA, 13 nt, Mycobacterium tuberculosis H37Rv
ucaccaccggcag

SEQ ID NO: 1270049 - RNA, 13 nt, Mycobacterium tuberculosis H37Rv
ucaccagcgguca

SEQ ID NO: 1270050 - RNA, 21 nt, Mycobacterium tuberculosis H37Rv
ucaacggucucaacgcaucgg

SEQ ID NO: 1270051 - RNA, 15 nt, Mycobacterium tuberculosis H37Rv
ucaacgggaccgauc

SEQ ID NO: 1270052 - RNA, 21 nt, Mycobacterium tuberculosis H37Rv
ucaacggaaugaaggcaccga

SEQ ID NO: 1270053 - RNA, 21 nt, Mycobacterium tuberculosis H37Rv
ucaacgccucugcucagccgu

SEQ ID NO: 1270054 - RNA, 21 nt, Mycobacterium tuberculosis H37Rv
ucaacgcacggcagacacgcu

SEQ ID NO: 1270055 - RNA, 17 nt, Mycobacterium tuberculosis H37Rv
ucaacgaugguggcgau

SEQ ID NO: 1270056 - RNA, 23 nt, Mycobacterium tuberculosis H37Rv
ucaccaaaaacccggugaccagc

SEQ ID NO: 1270057 - RNA, 21 nt, Mycobacterium tuberculosis H37Rv
ucaccaaaaacccggugacca

SEQ ID NO: 1270058 - RNA, 15 nt, Mycobacterium tuberculosis H37Rv
ucacauucaacagau

SEQ ID NO: 1270059 - RNA, 16 nt, Mycobacterium tuberculosis H37Rv
ucacaugcccgcaccg

SEQ ID NO: 1270060 - RNA, 17 nt, Mycobacterium tuberculosis H37Rv
ucacaugcccgcaccgu

SEQ ID NO: 1270061 - RNA, 14 nt, Mycobacterium tuberculosis H37Rv
ucacccggucaacg

SEQ ID NO: 1270062 - RNA, 14 nt, Mycobacterium tuberculosis H37Rv
ucaccgccgcgacc

SEQ ID NO: 1270063 - RNA, 15 nt, Mycobacterium tuberculosis H37Rv
ucaccgccgucaccg

SEQ ID NO: 1270064 - RNA, 17 nt, Mycobacterium tuberculosis H37Rv
ucaccgccggcaccgcc

SEQ ID NO: 1270065 - RNA, 18 nt, Mycobacterium tuberculosis H37Rv
ucaccgcgauuagcaaac

SEQ ID NO: 1270066 - RNA, 14 nt, Mycobacterium tuberculosis H37Rv
ucaccgcgcagcga

SEQ ID NO: 1270067 - RNA, 16 nt, Mycobacterium tuberculosis H37Rv
ucaccgcgcggcucac

SEQ ID NO: 1270068 - RNA, 16 nt, Mycobacterium tuberculosis H37Rv
ucacccagcgccgacc

SEQ ID NO: 1270069 - RNA, 17 nt, Mycobacterium tuberculosis H37Rv
ucacccacccgcaccgc

SEQ ID NO: 1270070 - RNA, 18 nt, Mycobacterium tuberculosis H37Rv
ucacccacccgcaccgcg

SEQ ID NO: 1270071 - RNA, 17 nt, Mycobacterium tuberculosis H37Rv
ucacccacauggugauc

SEQ ID NO: 1270072 - RNA, 20 nt, Mycobacterium tuberculosis H37Rv
ucacccagcucgcgcaccca

SEQ ID NO: 1270073 - RNA, 19 nt, Mycobacterium tuberculosis H37Rv
ucacccacucgacgucguc

SEQ ID NO: 1270074 - RNA, 14 nt, Mycobacterium tuberculosis H37Rv
ucacccagccggaa

SEQ ID NO: 1270075 - RNA, 19 nt, Mycobacterium tuberculosis H37Rv
ucacccgcaacgacugauc

SEQ ID NO: 1270076 - RNA, 22 nt, Mycobacterium tuberculosis H37Rv
ucacccgccgcgguuaucgccg

SEQ ID NO: 1270077 - RNA, 13 nt, Mycobacterium tuberculosis H37Rv
ucacccgcgagau

SEQ ID NO: 1270078 - RNA, 22 nt, Mycobacterium tuberculosis H37Rv
ucaccccggucccgccgaccga

SEQ ID NO: 1270079 - RNA, 20 nt, Mycobacterium tuberculosis H37Rv
ucaccccggcggccaucccg

SEQ ID NO: 1270080 - RNA, 18 nt, Mycobacterium tuberculosis H37Rv
ucaccggcuggugccaac

SEQ ID NO: 1270081 - RNA, 17 nt, Mycobacterium tuberculosis H37Rv
ucaccgucgagucgacg

SEQ ID NO: 1270082 - RNA, 21 nt, Mycobacterium tuberculosis H37Rv
ucaccgucgagucgacggcau

SEQ ID NO: 1270083 - RNA, 19 nt, Mycobacterium tuberculosis H37Rv
ucaccgucugcaccggcag

SEQ ID NO: 1270084 - RNA, 16 nt, Mycobacterium tuberculosis H37Rv
ucaccgugcggaucgc

SEQ ID NO: 1270085 - RNA, 24 nt, Mycobacterium tuberculosis H37Rv
ucaccguaauuucuucacggucga

SEQ ID NO: 1270086 - RNA, 17 nt, Mycobacterium tuberculosis H37Rv
ucaccggucagcgacgc

SEQ ID NO: 1270087 - RNA, 16 nt, Mycobacterium tuberculosis H37Rv
ucaccgguacgcaacc

SEQ ID NO: 1270088 - RNA, 22 nt, Mycobacterium tuberculosis H37Rv
ucaccguugcguuggcgccacc

SEQ ID NO: 1270089 - RNA, 13 nt, Mycobacterium tuberculosis H37Rv
ucaccucgcacga

SEQ ID NO: 1270090 - RNA, 14 nt, Mycobacterium tuberculosis H37Rv
ucaccucggcgacg

SEQ ID NO: 1270091 - RNA, 22 nt, Mycobacterium tuberculosis H37Rv
ucacgaagaccaggccggugac

SEQ ID NO: 1270092 - RNA, 21 nt, Mycobacterium tuberculosis H37Rv
ucacgacguccgaucgguguc

SEQ ID NO: 1270093 - RNA, 21 nt, Mycobacterium tuberculosis H37Rv
ucagcacggugaucagcagca

SEQ ID NO: 1270094 - RNA, 17 nt, Mycobacterium tuberculosis H37Rv
ucagcacggugaucagc

SEQ ID NO: 1270095 - RNA, 16 nt, Mycobacterium tuberculosis H37Rv
ucagcagccgccgaug

SEQ ID NO: 1270096 - RNA, 12 nt, Mycobacterium tuberculosis H37Rv
ucagcagcagcg

SEQ ID NO: 1270097 - RNA, 13 nt, Mycobacterium tuberculosis H37Rv
ucagcagcgucgg

SEQ ID NO: 1270098 - RNA, 23 nt, Mycobacterium tuberculosis H37Rv
ucagcccggccuugccgccggcu

SEQ ID NO: 1270099 - RNA, 18 nt, Mycobacterium tuberculosis H37Rv
ucagcccgucagccgaug

SEQ ID NO: 1270100 - RNA, 16 nt, Mycobacterium tuberculosis H37Rv
ucagcggcgaccgcau

SEQ ID NO: 1270101 - RNA, 20 nt, Mycobacterium tuberculosis H37Rv
ucagcggcccgcugcgcggc

SEQ ID NO: 1270102 - RNA, 16 nt, Mycobacterium tuberculosis H37Rv
ucagccggaccaccag

SEQ ID NO: 1270103 - RNA, 16 nt, Mycobacterium tuberculosis H37Rv
ucagcgauuccacggc

SEQ ID NO: 1270104 - RNA, 14 nt, Mycobacterium tuberculosis H37Rv
ucagcgaguggucc

SEQ ID NO: 1270105 - RNA, 16 nt, Mycobacterium tuberculosis H37Rv
ucagcgauccucgccg

SEQ ID NO: 1270106 - RNA, 21 nt, Mycobacterium tuberculosis H37Rv
ucagcgcaucgccgcuggcca

SEQ ID NO: 1270107 - RNA, 18 nt, Mycobacterium tuberculosis H37Rv
ucacgccugccaccggcg

SEQ ID NO: 1270108 - RNA, 15 nt, Mycobacterium tuberculosis H37Rv
ucacgcgaccaccgc

SEQ ID NO: 1270109 - RNA, 17 nt, Mycobacterium tuberculosis H37Rv
ucacgcgaaugacgauc

SEQ ID NO: 1270110 - RNA, 14 nt, Mycobacterium tuberculosis H37Rv
ucacgccgucaccg

SEQ ID NO: 1270111 - RNA, 15 nt, Mycobacterium tuberculosis H37Rv
ucacgccgucaccgc

SEQ ID NO: 1270112 - RNA, 16 nt, Mycobacterium tuberculosis H37Rv
ucacgccgucaccgcu

SEQ ID NO: 1270113 - RNA, 15 nt, Mycobacterium tuberculosis H37Rv
ucacgccccucacgu

SEQ ID NO: 1270114 - RNA, 14 nt, Mycobacterium tuberculosis H37Rv
ucacgaucacgaug

SEQ ID NO: 1270115 - RNA, 16 nt, Mycobacterium tuberculosis H37Rv
ucacgaucacgauguc

SEQ ID NO: 1270116 - RNA, 23 nt, Mycobacterium tuberculosis H37Rv
ucacgacuggcgcccagccggaa

SEQ ID NO: 1270117 - RNA, 22 nt, Mycobacterium tuberculosis H37Rv
ucacgaggcguucaccacgauc

SEQ ID NO: 1270118 - RNA, 15 nt, Mycobacterium tuberculosis H37Rv
ucacucgccgaaucg

SEQ ID NO: 1270119 - RNA, 17 nt, Mycobacterium tuberculosis H37Rv
ucacgguggccgcaucg

SEQ ID NO: 1270120 - RNA, 23 nt, Mycobacterium tuberculosis H37Rv
ucacggugaucguuccguugugc

SEQ ID NO: 1270121 - RNA, 21 nt, Mycobacterium tuberculosis H37Rv
ucacguagcgagcccacgugg

SEQ ID NO: 1270122 - RNA, 21 nt, Mycobacterium tuberculosis H37Rv
ucacguagcgaccgcggucgc

SEQ ID NO: 1270123 - RNA, 21 nt, Mycobacterium tuberculosis H37Rv
ucagcaagaucggcagcgugg

SEQ ID NO: 1270124 - RNA, 15 nt, Mycobacterium tuberculosis H37Rv
ucagacggcgucugc

SEQ ID NO: 1270125 - RNA, 18 nt, Mycobacterium tuberculosis H37Rv
ucgcgaaauagcugcgga

SEQ ID NO: 1270126 - RNA, 22 nt, Mycobacterium tuberculosis H37Rv
ucgcgaagaacgacgccaccgc

SEQ ID NO: 1270127 - RNA, 18 nt, Mycobacterium tuberculosis H37Rv
ucgcgaagucguccagaa

SEQ ID NO: 1270128 - RNA, 15 nt, Mycobacterium tuberculosis H37Rv
ucgcgacacggccau

SEQ ID NO: 1270129 - RNA, 15 nt, Mycobacterium tuberculosis H37Rv
ucgccuggaugccga

SEQ ID NO: 1270130 - RNA, 16 nt, Mycobacterium tuberculosis H37Rv
ucgccugggcuuggcg

SEQ ID NO: 1270131 - RNA, 21 nt, Mycobacterium tuberculosis H37Rv
ucgcgaucagaaacuccggac

SEQ ID NO: 1270132 - RNA, 13 nt, Mycobacterium tuberculosis H37Rv
ucgcgcacgucgg

SEQ ID NO: 1270133 - RNA, 16 nt, Mycobacterium tuberculosis H37Rv
ucgcgaugacgauguc

SEQ ID NO: 1270134 - RNA, 18 nt, Mycobacterium tuberculosis H37Rv
ucgcgaugcucaaugugc

SEQ ID NO: 1270135 - RNA, 21 nt, Mycobacterium tuberculosis H37Rv
ucgcgccaggcuugcggcacc

SEQ ID NO: 1270136 - RNA, 22 nt, Mycobacterium tuberculosis H37Rv
ucgcgccaggcgcgaucgcgcc

SEQ ID NO: 1270137 - RNA, 19 nt, Mycobacterium tuberculosis H37Rv
ucgcgcccgcugagccagc

SEQ ID NO: 1270138 - RNA, 15 nt, Mycobacterium tuberculosis H37Rv
ucgcgccaucgucgc

SEQ ID NO: 1270139 - RNA, 18 nt, Mycobacterium tuberculosis H37Rv
ucgccgugaugcuggucg

SEQ ID NO: 1270140 - RNA, 14 nt, Mycobacterium tuberculosis H37Rv
ucgccucaccggcg

SEQ ID NO: 1270141 - RNA, 20 nt, Mycobacterium tuberculosis H37Rv
ucgccuaaacccgugcgggu

SEQ ID NO: 1270142 - RNA, 17 nt, Mycobacterium tuberculosis H37Rv
ucgccguuauccgacga

SEQ ID NO: 1270143 - RNA, 17 nt, Mycobacterium tuberculosis H37Rv
ucgccucgaggaccacc

SEQ ID NO: 1270144 - RNA, 18 nt, Mycobacterium tuberculosis H37Rv
ucgccuccagccggcgaa

SEQ ID NO: 1270145 - RNA, 17 nt, Mycobacterium tuberculosis H37Rv
ucgccgucgucgaucga

SEQ ID NO: 1270146 - RNA, 15 nt, Mycobacterium tuberculosis H37Rv
ucgccguccagcaau

SEQ ID NO: 1270147 - RNA, 17 nt, Mycobacterium tuberculosis H37Rv
ucgccggcgcucaucgc

SEQ ID NO: 1270148 - RNA, 16 nt, Mycobacterium tuberculosis H37Rv
ucgccggaaagcccgu

SEQ ID NO: 1270149 - RNA, 20 nt, Mycobacterium tuberculosis H37Rv
ucgccgcuggccagcacacc

SEQ ID NO: 1270150 - RNA, 17 nt, Mycobacterium tuberculosis H37Rv
ucgccggcgaacugauc

SEQ ID NO: 1270151 - RNA, 14 nt, Mycobacterium tuberculosis H37Rv
ucgccggcgccagc

SEQ ID NO: 1270152 - RNA, 13 nt, Mycobacterium tuberculosis H37Rv
ucgccgccgcuac

SEQ ID NO: 1270153 - RNA, 21 nt, Mycobacterium tuberculosis H37Rv
ucgccgcggcggcagcggcga

SEQ ID NO: 1270154 - RNA, 18 nt, Mycobacterium tuberculosis H37Rv
ucgccgccgcuaccgccg

SEQ ID NO: 1270155 - RNA, 13 nt, Mycobacterium tuberculosis H37Rv
ucgccgacgccgg

SEQ ID NO: 1270156 - RNA, 21 nt, Mycobacterium tuberculosis H37Rv
ucgccgagauagggccgcguc

SEQ ID NO: 1270157 - RNA, 22 nt, Mycobacterium tuberculosis H37Rv
ucgcccaccacgaacacguucg

SEQ ID NO: 1270158 - RNA, 23 nt, Mycobacterium tuberculosis H37Rv
ucgcccagagccgcugcggcacc

SEQ ID NO: 1270159 - RNA, 19 nt, Mycobacterium tuberculosis H37Rv
ucgccagcggcgcgaccgu

SEQ ID NO: 1270160 - RNA, 13 nt, Mycobacterium tuberculosis H37Rv
ucgccagagucgg

SEQ ID NO: 1270161 - RNA, 13 nt, Mycobacterium tuberculosis H37Rv
ucgccacggucgc

SEQ ID NO: 1270162 - RNA, 17 nt, Mycobacterium tuberculosis H37Rv
ucgccagcgccggccag

SEQ ID NO: 1270163 - RNA, 17 nt, Mycobacterium tuberculosis H37Rv
ucgccagccugugcugc

SEQ ID NO: 1270164 - RNA, 12 nt, Mycobacterium tuberculosis H37Rv
ucgccagcagca

SEQ ID NO: 1270165 - RNA, 19 nt, Mycobacterium tuberculosis H37Rv
ucgccagccggccgcgacc

SEQ ID NO: 1270166 - RNA, 17 nt, Mycobacterium tuberculosis H37Rv
ucgccccguucacgcuc

SEQ ID NO: 1270167 - RNA, 20 nt, Mycobacterium tuberculosis H37Rv
ucgcccccagugcacgcucg

SEQ ID NO: 1270168 - RNA, 18 nt, Mycobacterium tuberculosis H37Rv
ucgcccgugagcagcggg

SEQ ID NO: 1270169 - RNA, 14 nt, Mycobacterium tuberculosis H37Rv
ucgcccguggcggu

SEQ ID NO: 1270170 - RNA, 18 nt, Mycobacterium tuberculosis H37Rv
ucgcccgagucgaaaccg

SEQ ID NO: 1270171 - RNA, 17 nt, Mycobacterium tuberculosis H37Rv
ucgcccgauccggaucc

SEQ ID NO: 1270172 - RNA, 17 nt, Mycobacterium tuberculosis H37Rv
ucgcccgcacacagacc

SEQ ID NO: 1270173 - RNA, 13 nt, Mycobacterium tuberculosis H37Rv
ucgcccugacacc

SEQ ID NO: 1270174 - RNA, 20 nt, Mycobacterium tuberculosis H37Rv
ucgcccugagaacacguucg

SEQ ID NO: 1270175 - RNA, 15 nt, Mycobacterium tuberculosis H37Rv
ucgccgacgguuacc

SEQ ID NO: 1270176 - RNA, 22 nt, Mycobacterium tuberculosis H37Rv
ucgcaguauucacagucgcucg

SEQ ID NO: 1270177 - RNA, 14 nt, Mycobacterium tuberculosis H37Rv
ucgcagugagcagc

SEQ ID NO: 1270178 - RNA, 20 nt, Mycobacterium tuberculosis H37Rv
ucgcagugacguuccgcucg

SEQ ID NO: 1270179 - RNA, 22 nt, Mycobacterium tuberculosis H37Rv
ucgcagugagcagccggaccgu

SEQ ID NO: 1270180 - RNA, 20 nt, Mycobacterium tuberculosis H37Rv
ucgcagccacguuacgcucg

SEQ ID NO: 1270181 - RNA, 18 nt, Mycobacterium tuberculosis H37Rv
ucgcagccgguccagcgc

SEQ ID NO: 1270182 - RNA, 20 nt, Mycobacterium tuberculosis H37Rv
ucgcagccgguccagcgccg

SEQ ID NO: 1270183 - RNA, 20 nt, Mycobacterium tuberculosis H37Rv
ucgcaggcaccccgaucacc

SEQ ID NO: 1270184 - RNA, 21 nt, Mycobacterium tuberculosis H37Rv
ucgcagcucgucgugagucac

SEQ ID NO: 1270185 - RNA, 14 nt, Mycobacterium tuberculosis H37Rv
ucgaucucgaucga

SEQ ID NO: 1270186 - RNA, 16 nt, Mycobacterium tuberculosis H37Rv
ucgaucguuccgcugg

SEQ ID NO: 1270187 - RNA, 23 nt, Mycobacterium tuberculosis H37Rv
ucgaucugcccccgccggccguc

SEQ ID NO: 1270188 - RNA, 14 nt, Mycobacterium tuberculosis H37Rv
ucgaucugcccggu

SEQ ID NO: 1270189 - RNA, 21 nt, Mycobacterium tuberculosis H37Rv
ucgaugaagcgucguugcucg

SEQ ID NO: 1270190 - RNA, 14 nt, Mycobacterium tuberculosis H37Rv
ucgcagccacgcgg

SEQ ID NO: 1270191 - RNA, 21 nt, Mycobacterium tuberculosis H37Rv
ucgcagccacgcgggcgcggu

SEQ ID NO: 1270192 - RNA, 15 nt, Mycobacterium tuberculosis H37Rv
ucgcagauugugagc

SEQ ID NO: 1270193 - RNA, 15 nt, Mycobacterium tuberculosis H37Rv
ucgccaaauccggug

SEQ ID NO: 1270194 - RNA, 19 nt, Mycobacterium tuberculosis H37Rv
ucgcaucgacgugcgcggc

SEQ ID NO: 1270195 - RNA, 22 nt, Mycobacterium tuberculosis H37Rv
ucgcauguucuccacgccgauc

SEQ ID NO: 1270196 - RNA, 22 nt, Mycobacterium tuberculosis H37Rv
ucgcaugauuugagcucaaauc

SEQ ID NO: 1270197 - RNA, 17 nt, Mycobacterium tuberculosis H37Rv
ucgcaguuggcggugaa

SEQ ID NO: 1270198 - RNA, 15 nt, Mycobacterium tuberculosis H37Rv
ucgccaccaucaccg

SEQ ID NO: 1270199 - RNA, 13 nt, Mycobacterium tuberculosis H37Rv
ucgccacaccaug

SEQ ID NO: 1270200 - RNA, 20 nt, Mycobacterium tuberculosis H37Rv
ucgccaccagagucaacauc

SEQ ID NO: 1270201 - RNA, 21 nt, Mycobacterium tuberculosis H37Rv
ucgccaagugcagggcugcua

SEQ ID NO: 1270202 - RNA, 17 nt, Mycobacterium tuberculosis H37Rv
ucgccaaggccgucgac

SEQ ID NO: 1270203 - RNA, 19 nt, Mycobacterium tuberculosis H37Rv
ucgccaaucgaguagcuga

SEQ ID NO: 1270204 - RNA, 17 nt, Mycobacterium tuberculosis H37Rv
ucgccaccaucaccgcc

SEQ ID NO: 1270205 - RNA, 16 nt, Mycobacterium tuberculosis H37Rv
ucgccaccaucaccgc

SEQ ID NO: 1270206 - RNA, 18 nt, Mycobacterium tuberculosis H37Rv
ucgccaccgccggcagca

SEQ ID NO: 1270207 - RNA, 18 nt, Mycobacterium tuberculosis H37Rv
ucgccaccgguaccggcg

SEQ ID NO: 1270208 - RNA, 21 nt, Mycobacterium tuberculosis H37Rv
ucgccacccgacaugcgccga

SEQ ID NO: 1270209 - RNA, 17 nt, Mycobacterium tuberculosis H37Rv
ucgccacgacaggucgc

SEQ ID NO: 1270210 - RNA, 15 nt, Mycobacterium tuberculosis H37Rv
ucgccacgcucggcg

SEQ ID NO: 1270211 - RNA, 15 nt, Mycobacterium tuberculosis H37Rv
ucggcccuccaccgg

SEQ ID NO: 1270212 - RNA, 15 nt, Mycobacterium tuberculosis H37Rv
ucggccagcacgccg

SEQ ID NO: 1270213 - RNA, 13 nt, Mycobacterium tuberculosis H37Rv
ucggccagcagca

SEQ ID NO: 1270214 - RNA, 15 nt, Mycobacterium tuberculosis H37Rv
ucggccagcgucagc

SEQ ID NO: 1270215 - RNA, 18 nt, Mycobacterium tuberculosis H37Rv
ucggccagcguguccgcc

SEQ ID NO: 1270216 - RNA, 13 nt, Mycobacterium tuberculosis H37Rv
ucggccagcagcg

SEQ ID NO: 1270217 - RNA, 17 nt, Mycobacterium tuberculosis H37Rv
ucggccaggaucaaccg

SEQ ID NO: 1270218 - RNA, 15 nt, Mycobacterium tuberculosis H37Rv
ucggccaccggcguc

SEQ ID NO: 1270219 - RNA, 12 nt, Mycobacterium tuberculosis H37Rv
ucggccaccgug

SEQ ID NO: 1270220 - RNA, 14 nt, Mycobacterium tuberculosis H37Rv
ucggccaccgugga

SEQ ID NO: 1270221 - RNA, 14 nt, Mycobacterium tuberculosis H37Rv
ucggccacggcguc

SEQ ID NO: 1270222 - RNA, 22 nt, Mycobacterium tuberculosis H37Rv
ucggccaccagaaccagcgacc

SEQ ID NO: 1270223 - RNA, 20 nt, Mycobacterium tuberculosis H37Rv
ucggccaacagguccaccgg

SEQ ID NO: 1270224 - RNA, 19 nt, Mycobacterium tuberculosis H37Rv
ucggccaacagguccaccg

SEQ ID NO: 1270225 - RNA, 19 nt, Mycobacterium tuberculosis H37Rv
ucggcauggauacgcagca

SEQ ID NO: 1270226 - RNA, 20 nt, Mycobacterium tuberculosis H37Rv
ucggccaccaaccucaucgc

SEQ ID NO: 1270227 - RNA, 20 nt, Mycobacterium tuberculosis H37Rv
ucggacuggggcacgccaug

SEQ ID NO: 1270228 - RNA, 17 nt, Mycobacterium tuberculosis H37Rv
ucggagacgucuucggg

SEQ ID NO: 1270229 - RNA, 16 nt, Mycobacterium tuberculosis H37Rv
ucggcaacccgcacca

SEQ ID NO: 1270230 - RNA, 13 nt, Mycobacterium tuberculosis H37Rv
ucggcaacgcugg

SEQ ID NO: 1270231 - RNA, 15 nt, Mycobacterium tuberculosis H37Rv
ucggcaacgcuggca

SEQ ID NO: 1270232 - RNA, 17 nt, Mycobacterium tuberculosis H37Rv
ucggcaaggacguggcg

SEQ ID NO: 1270233 - RNA, 18 nt, Mycobacterium tuberculosis H37Rv
ucggcaaugucuucgaua

SEQ ID NO: 1270234 - RNA, 15 nt, Mycobacterium tuberculosis H37Rv
ucggcaccaccgcga

SEQ ID NO: 1270235 - RNA, 23 nt, Mycobacterium tuberculosis H37Rv
ucggcacaggcggccagcaucgc

SEQ ID NO: 1270236 - RNA, 20 nt, Mycobacterium tuberculosis H37Rv
ucggcagaccgaccucggcg

SEQ ID NO: 1270237 - RNA, 18 nt, Mycobacterium tuberculosis H37Rv
ucggcacccggcagagca

SEQ ID NO: 1270238 - RNA, 22 nt, Mycobacterium tuberculosis H37Rv
ucggcacccggcagagcacgcg

SEQ ID NO: 1270239 - RNA, 18 nt, Mycobacterium tuberculosis H37Rv
ucggcaccagguugccga

SEQ ID NO: 1270240 - RNA, 16 nt, Mycobacterium tuberculosis H37Rv
ucggcacgacccggga

SEQ ID NO: 1270241 - RNA, 23 nt, Mycobacterium tuberculosis H37Rv
ucggcaccggugcccaccaccga

SEQ ID NO: 1270242 - RNA, 22 nt, Mycobacterium tuberculosis H37Rv
ucggcaccgugcggggggcagc

SEQ ID NO: 1270243 - RNA, 15 nt, Mycobacterium tuberculosis H37Rv
ucggcgaagcacacc

SEQ ID NO: 1270244 - RNA, 21 nt, Mycobacterium tuberculosis H37Rv
ucggcgaccagaaucucgccg

SEQ ID NO: 1270245 - RNA, 15 nt, Mycobacterium tuberculosis H37Rv
ucggcgaccgagacg

SEQ ID NO: 1270246 - RNA, 15 nt, Mycobacterium tuberculosis H37Rv
ucggcgaacgcggcg

SEQ ID NO: 1270247 - RNA, 15 nt, Mycobacterium tuberculosis H37Rv
ucggcgaacgccgug

SEQ ID NO: 1270248 - RNA, 17 nt, Mycobacterium tuberculosis H37Rv
ucggcgaacaaccgccg

SEQ ID NO: 1270249 - RNA, 22 nt, Mycobacterium tuberculosis H37Rv
ucggccuugaucgugcuggcga

SEQ ID NO: 1270250 - RNA, 24 nt, Mycobacterium tuberculosis H37Rv
ucggccugguacucccgcgaucgc

SEQ ID NO: 1270251 - RNA, 16 nt, Mycobacterium tuberculosis H37Rv
ucggccuguccaccga

SEQ ID NO: 1270252 - RNA, 18 nt, Mycobacterium tuberculosis H37Rv
ucggccuguccaccgaug

SEQ ID NO: 1270253 - RNA, 15 nt, Mycobacterium tuberculosis H37Rv
ucggccuguucgccg

SEQ ID NO: 1270254 - RNA, 23 nt, Mycobacterium tuberculosis H37Rv
ucggccuucuugagguagcugcg

SEQ ID NO: 1270255 - RNA, 15 nt, Mycobacterium tuberculosis H37Rv
ucggccuucagcguc

SEQ ID NO: 1270256 - RNA, 12 nt, Mycobacterium tuberculosis H37Rv
ucggccgagucg

SEQ ID NO: 1270257 - RNA, 15 nt, Mycobacterium tuberculosis H37Rv
ucggccgaugcgcag

SEQ ID NO: 1270258 - RNA, 20 nt, Mycobacterium tuberculosis H37Rv
ucggccgccagccccacccg

SEQ ID NO: 1270259 - RNA, 19 nt, Mycobacterium tuberculosis H37Rv
ucggccgccaucgcccgau

SEQ ID NO: 1270260 - RNA, 19 nt, Mycobacterium tuberculosis H37Rv
ucggccgccuucuccggcg

SEQ ID NO: 1270261 - RNA, 14 nt, Mycobacterium tuberculosis H37Rv
ucggcgcacagcga

SEQ ID NO: 1270262 - RNA, 23 nt, Mycobacterium tuberculosis H37Rv
ucggcgccgccguccagcgccgc

SEQ ID NO: 1270263 - RNA, 12 nt, Mycobacterium tuberculosis H37Rv
ucggcgcaggcg

SEQ ID NO: 1270264 - RNA, 18 nt, Mycobacterium tuberculosis H37Rv
ucggcgacgcggaguccg

SEQ ID NO: 1270265 - RNA, 20 nt, Mycobacterium tuberculosis H37Rv
ucggcgaucgucaagccggg

SEQ ID NO: 1270266 - RNA, 16 nt, Mycobacterium tuberculosis H37Rv
ucggcgaucuccggcg

SEQ ID NO: 1270267 - RNA, 19 nt, Mycobacterium tuberculosis H37Rv
ucggcgaccuggcucaucg

SEQ ID NO: 1270268 - RNA, 20 nt, Mycobacterium tuberculosis H37Rv
ucggcgacgaugucgagcgc

SEQ ID NO: 1270269 - RNA, 13 nt, Mycobacterium tuberculosis H37Rv
ucggcgacgcgga

SEQ ID NO: 1270270 - RNA, 18 nt, Mycobacterium tuberculosis H37Rv
ucgcugcugccgcaccgg

SEQ ID NO: 1270271 - RNA, 20 nt, Mycobacterium tuberculosis H37Rv
ucgcugcugccgcaccggug

SEQ ID NO: 1270272 - RNA, 18 nt, Mycobacterium tuberculosis H37Rv
ucgcugcucagcaacggc

SEQ ID NO: 1270273 - RNA, 16 nt, Mycobacterium tuberculosis H37Rv
ucggaccuuccgggug

SEQ ID NO: 1270274 - RNA, 20 nt, Mycobacterium tuberculosis H37Rv
ucggacccgcaauuccggug

SEQ ID NO: 1270275 - RNA, 21 nt, Mycobacterium tuberculosis H37Rv
ucggacgggaugcuuggucuc

SEQ ID NO: 1270276 - RNA, 22 nt, Mycobacterium tuberculosis H37Rv
ucgcuucagcgccaaugucagc

SEQ ID NO: 1270277 - RNA, 14 nt, Mycobacterium tuberculosis H37Rv
ucgcgugcaucgcc

SEQ ID NO: 1270278 - RNA, 19 nt, Mycobacterium tuberculosis H37Rv
ucgcgucugacaucgucga

SEQ ID NO: 1270279 - RNA, 13 nt, Mycobacterium tuberculosis H37Rv
ucgcgugcggcug

SEQ ID NO: 1270280 - RNA, 14 nt, Mycobacterium tuberculosis H37Rv
ucgcgugcggcugc

SEQ ID NO: 1270281 - RNA, 15 nt, Mycobacterium tuberculosis H37Rv
ucgcuacgcaacggg

SEQ ID NO: 1270282 - RNA, 16 nt, Mycobacterium tuberculosis H37Rv
ucgcucgcgccagguc

SEQ ID NO: 1270283 - RNA, 20 nt, Mycobacterium tuberculosis H37Rv
ucgcuccgaccgguggcguc

SEQ ID NO: 1270284 - RNA, 17 nt, Mycobacterium tuberculosis H37Rv
ucgcucgugcacgcuga

SEQ ID NO: 1270285 - RNA, 16 nt, Mycobacterium tuberculosis H37Rv
ucgcucguugcguugc

SEQ ID NO: 1270286 - RNA, 13 nt, Mycobacterium tuberculosis H37Rv
ucgcuauccggcg

SEQ ID NO: 1270287 - RNA, 14 nt, Mycobacterium tuberculosis H37Rv
ucgcucaccggcug

SEQ ID NO: 1270288 - RNA, 18 nt, Mycobacterium tuberculosis H37Rv
ucgcucccccgcuacgcg

SEQ ID NO: 1270289 - RNA, 12 nt, Mycobacterium tuberculosis H37Rv
ucgcguccaccc

SEQ ID NO: 1270290 - RNA, 17 nt, Mycobacterium tuberculosis H37Rv
ucgcguaucccgugugc

SEQ ID NO: 1270291 - RNA, 18 nt, Mycobacterium tuberculosis H37Rv
ucgcgucgacccgaacug

SEQ ID NO: 1270292 - RNA, 16 nt, Mycobacterium tuberculosis H37Rv
ucgcguccuccucggu

SEQ ID NO: 1270293 - RNA, 21 nt, Mycobacterium tuberculosis H37Rv
ucgcgguuuuggucgcgauga

SEQ ID NO: 1270294 - RNA, 18 nt, Mycobacterium tuberculosis H37Rv
ucgcgguaccaucaccgc

SEQ ID NO: 1270295 - RNA, 22 nt, Mycobacterium tuberculosis H37Rv
ucgcggguguuccacaccaggc

SEQ ID NO: 1270296 - RNA, 15 nt, Mycobacterium tuberculosis H37Rv
ucgcggguucggcug

SEQ ID NO: 1270297 - RNA, 17 nt, Mycobacterium tuberculosis H37Rv
ucgcgguccaacagcgc

SEQ ID NO: 1270298 - RNA, 20 nt, Mycobacterium tuberculosis H37Rv
ucgcggucuugacaccgccg

SEQ ID NO: 1270299 - RNA, 12 nt, Mycobacterium tuberculosis H37Rv
ucgcggugaccu

SEQ ID NO: 1270300 - RNA, 22 nt, Mycobacterium tuberculosis H37Rv
ucgcggugugcggcagcccgcu

SEQ ID NO: 1270301 - RNA, 22 nt, Mycobacterium tuberculosis H37Rv
ucgcgcgccacggugucgucga

SEQ ID NO: 1270302 - RNA, 12 nt, Mycobacterium tuberculosis H37Rv
ucgcgcgcucgc

SEQ ID NO: 1270303 - RNA, 14 nt, Mycobacterium tuberculosis H37Rv
ucgcgcgcugggcg

SEQ ID NO: 1270304 - RNA, 16 nt, Mycobacterium tuberculosis H37Rv
ucgcgcggcaccgaug

SEQ ID NO: 1270305 - RNA, 16 nt, Mycobacterium tuberculosis H37Rv
ucgcggguaaccggcu

SEQ ID NO: 1270306 - RNA, 14 nt, Mycobacterium tuberculosis H37Rv
ucgagaucucacgu

SEQ ID NO: 1270307 - RNA, 22 nt, Mycobacterium tuberculosis H37Rv
ucgagcccucguuaucgaccgc

SEQ ID NO: 1270308 - RNA, 20 nt, Mycobacterium tuberculosis H37Rv
ucgagcaucucgucggugaa

SEQ ID NO: 1270309 - RNA, 17 nt, Mycobacterium tuberculosis H37Rv
ucgaggaacacgaugcc

SEQ ID NO: 1270310 - RNA, 18 nt, Mycobacterium tuberculosis H37Rv
ucgaggaacacgaugccc

SEQ ID NO: 1270311 - RNA, 20 nt, Mycobacterium tuberculosis H37Rv
ucgaggaccaccacuagguc

SEQ ID NO: 1270312 - RNA, 16 nt, Mycobacterium tuberculosis H37Rv
ucgaggaaggugugcg

SEQ ID NO: 1270313 - RNA, 14 nt, Mycobacterium tuberculosis H37Rv
ucgagcaccacccg

SEQ ID NO: 1270314 - RNA, 13 nt, Mycobacterium tuberculosis H37Rv
ucgagcucggcga

SEQ ID NO: 1270315 - RNA, 22 nt, Mycobacterium tuberculosis H37Rv
ucgagcucccacaggaccgaug

SEQ ID NO: 1270316 - RNA, 16 nt, Mycobacterium tuberculosis H37Rv
ucgagcugacgauggc

SEQ ID NO: 1270317 - RNA, 13 nt, Mycobacterium tuberculosis H37Rv
ucgagccgaucgc

SEQ ID NO: 1270318 - RNA, 23 nt, Mycobacterium tuberculosis H37Rv
ucgaucgacccggucgacggguc

SEQ ID NO: 1270319 - RNA, 19 nt, Mycobacterium tuberculosis H37Rv
ucgauaaccucagcgcggu

SEQ ID NO: 1270320 - RNA, 23 nt, Mycobacterium tuberculosis H37Rv
ucgagguacaacgggcacgcuau

SEQ ID NO: 1270321 - RNA, 21 nt, Mycobacterium tuberculosis H37Rv
ucgaguguggcgacgcacucg

SEQ ID NO: 1270322 - RNA, 21 nt, Mycobacterium tuberculosis H37Rv
ucgaguauugcaggaaaucgu

SEQ ID NO: 1270323 - RNA, 17 nt, Mycobacterium tuberculosis H37Rv
ucgaguccaccaccugg

SEQ ID NO: 1270324 - RNA, 12 nt, Mycobacterium tuberculosis H37Rv
ucgagucgcagc

SEQ ID NO: 1270325 - RNA, 21 nt, Mycobacterium tuberculosis H37Rv
ucgaggugacuugcacgcugu

SEQ ID NO: 1270326 - RNA, 15 nt, Mycobacterium tuberculosis H37Rv
ucgagguucccgcau

SEQ ID NO: 1270327 - RNA, 16 nt, Mycobacterium tuberculosis H37Rv
ucgagguccucagcga

SEQ ID NO: 1270328 - RNA, 18 nt, Mycobacterium tuberculosis H37Rv
ucgagguccucagcgaug

SEQ ID NO: 1270329 - RNA, 14 nt, Mycobacterium tuberculosis H37Rv
ucgagguccucggu

SEQ ID NO: 1270330 - RNA, 13 nt, Mycobacterium tuberculosis H37Rv
ucgagguccucgu

SEQ ID NO: 1270331 - RNA, 15 nt, Mycobacterium tuberculosis H37Rv
ucgaggucgagcgcc

SEQ ID NO: 1270332 - RNA, 14 nt, Mycobacterium tuberculosis H37Rv
ucgaccacgacgug

SEQ ID NO: 1270333 - RNA, 16 nt, Mycobacterium tuberculosis H37Rv
ucgaccagaaucgggu

SEQ ID NO: 1270334 - RNA, 22 nt, Mycobacterium tuberculosis H37Rv
ucgaccaggccacugccgacca

SEQ ID NO: 1270335 - RNA, 14 nt, Mycobacterium tuberculosis H37Rv
ucgaccaugcgacc

SEQ ID NO: 1270336 - RNA, 17 nt, Mycobacterium tuberculosis H37Rv
ucgacccaacgcagauc

SEQ ID NO: 1270337 - RNA, 22 nt, Mycobacterium tuberculosis H37Rv
ucgacccccugccacagcgaca

SEQ ID NO: 1270338 - RNA, 20 nt, Mycobacterium tuberculosis H37Rv
ucgacccccugccacagcga

SEQ ID NO: 1270339 - RNA, 17 nt, Mycobacterium tuberculosis H37Rv
ucgaccaugccgucguc

SEQ ID NO: 1270340 - RNA, 12 nt, Mycobacterium tuberculosis H37Rv
ucgacgaucagc

SEQ ID NO: 1270341 - RNA, 20 nt, Mycobacterium tuberculosis H37Rv
ucgacgagaagacaccgcgc

SEQ ID NO: 1270342 - RNA, 13 nt, Mycobacterium tuberculosis H37Rv
ucgacgagcgaua

SEQ ID NO: 1270343 - RNA, 23 nt, Mycobacterium tuberculosis H37Rv
ucgacgaggccacggggcuuggc

SEQ ID NO: 1270344 - RNA, 16 nt, Mycobacterium tuberculosis H37Rv
ucgacgcacacccggu

SEQ ID NO: 1270345 - RNA, 23 nt, Mycobacterium tuberculosis H37Rv
ucgacgcaccuauggucaaccgc

SEQ ID NO: 1270346 - RNA, 17 nt, Mycobacterium tuberculosis H37Rv
ucgacgcgcauucgccg

SEQ ID NO: 1270347 - RNA, 22 nt, Mycobacterium tuberculosis H37Rv
ucgacgcgucucuggcucaccu

SEQ ID NO: 1270348 - RNA, 16 nt, Mycobacterium tuberculosis H37Rv
ucgacgcggcgaccgu

SEQ ID NO: 1270349 - RNA, 15 nt, Mycobacterium tuberculosis H37Rv
ucgacuccggaugga

SEQ ID NO: 1270350 - RNA, 17 nt, Mycobacterium tuberculosis H37Rv
ucgacucgaccgcgacg

SEQ ID NO: 1270351 - RNA, 15 nt, Mycobacterium tuberculosis H37Rv
ucgacucagcccggc

SEQ ID NO: 1270352 - RNA, 17 nt, Mycobacterium tuberculosis H37Rv
ucgacguugcggacggc

SEQ ID NO: 1270353 - RNA, 20 nt, Mycobacterium tuberculosis H37Rv
ucgacguuggcgugcaccgc

SEQ ID NO: 1270354 - RNA, 11 nt, Mycobacterium tuberculosis H37Rv
ucgacguucgg

SEQ ID NO: 1270355 - RNA, 14 nt, Mycobacterium tuberculosis H37Rv
ucgacguugcggac

SEQ ID NO: 1270356 - RNA, 20 nt, Mycobacterium tuberculosis H37Rv
ucgacgucguagaccuccag

SEQ ID NO: 1270357 - RNA, 16 nt, Mycobacterium tuberculosis H37Rv
ucgacguggccgacgu

SEQ ID NO: 1270358 - RNA, 16 nt, Mycobacterium tuberculosis H37Rv
ucgacugaaucaugga

SEQ ID NO: 1270359 - RNA, 20 nt, Mycobacterium tuberculosis H37Rv
ucgacuugccgaccccggaa

SEQ ID NO: 1270360 - RNA, 21 nt, Mycobacterium tuberculosis H37Rv
ucgacguaaugcgcugccgcc

SEQ ID NO: 1270361 - RNA, 17 nt, Mycobacterium tuberculosis H37Rv
ucgacguaaugcgcugc

SEQ ID NO: 1270362 - RNA, 13 nt, Mycobacterium tuberculosis H37Rv
ucgacggugucau

SEQ ID NO: 1270363 - RNA, 18 nt, Mycobacterium tuberculosis H37Rv
ucgacggccagugcgcag

SEQ ID NO: 1270364 - RNA, 15 nt, Mycobacterium tuberculosis H37Rv
ucgacguccaucccg

SEQ ID NO: 1270365 - RNA, 18 nt, Mycobacterium tuberculosis H37Rv
ucgacgucgauuucggcg

SEQ ID NO: 1270366 - RNA, 15 nt, Mycobacterium tuberculosis H37Rv
ucgacgucggcgacc

SEQ ID NO: 1270367 - RNA, 15 nt, Mycobacterium tuberculosis H37Rv
ucgacgucguagacc

SEQ ID NO: 1270368 - RNA, 18 nt, Mycobacterium tuberculosis H37Rv
uccugguguucgggcagc

SEQ ID NO: 1270369 - RNA, 14 nt, Mycobacterium tuberculosis H37Rv
uccuggaucgcggu

SEQ ID NO: 1270370 - RNA, 18 nt, Mycobacterium tuberculosis H37Rv
uccuggcggcugcagccg

SEQ ID NO: 1270371 - RNA, 16 nt, Mycobacterium tuberculosis H37Rv
uccuggcggguggcga

SEQ ID NO: 1270372 - RNA, 17 nt, Mycobacterium tuberculosis H37Rv
uccuggguuggcaucca

SEQ ID NO: 1270373 - RNA, 15 nt, Mycobacterium tuberculosis H37Rv
uccuggucaaccgcg

SEQ ID NO: 1270374 - RNA, 18 nt, Mycobacterium tuberculosis H37Rv
uccugguaggugucgugg

SEQ ID NO: 1270375 - RNA, 15 nt, Mycobacterium tuberculosis H37Rv
uccuggucgacgcgu

SEQ ID NO: 1270376 - RNA, 19 nt, Mycobacterium tuberculosis H37Rv
ucgaaggcacugcgaucgc

SEQ ID NO: 1270377 - RNA, 13 nt, Mycobacterium tuberculosis H37Rv
ucgacaucgacaa

SEQ ID NO: 1270378 - RNA, 13 nt, Mycobacterium tuberculosis H37Rv
ucgacaucggcga

SEQ ID NO: 1270379 - RNA, 19 nt, Mycobacterium tuberculosis H37Rv
ucgaccaagguguccagca

SEQ ID NO: 1270380 - RNA, 15 nt, Mycobacterium tuberculosis H37Rv
ucgaccacgaccguc

SEQ ID NO: 1270381 - RNA, 21 nt, Mycobacterium tuberculosis H37Rv
ucgacaucugagcccggucgc

SEQ ID NO: 1270382 - RNA, 18 nt, Mycobacterium tuberculosis H37Rv
ucgaaccagaggucacgc

SEQ ID NO: 1270383 - RNA, 15 nt, Mycobacterium tuberculosis H37Rv
ucgaaccgacgcguc

SEQ ID NO: 1270384 - RNA, 19 nt, Mycobacterium tuberculosis H37Rv
ucgaaggaccggcaccugg

SEQ ID NO: 1270385 - RNA, 21 nt, Mycobacterium tuberculosis H37Rv
ucgaagcggcugcugcgcggu

SEQ ID NO: 1270386 - RNA, 19 nt, Mycobacterium tuberculosis H37Rv
uccugaccagccaggugau

SEQ ID NO: 1270387 - RNA, 14 nt, Mycobacterium tuberculosis H37Rv
uccugcagcccggg

SEQ ID NO: 1270388 - RNA, 15 nt, Mycobacterium tuberculosis H37Rv
uccugcggcaccgcu

SEQ ID NO: 1270389 - RNA, 14 nt, Mycobacterium tuberculosis H37Rv
uccucgucggcgaa

SEQ ID NO: 1270390 - RNA, 14 nt, Mycobacterium tuberculosis H37Rv
uccucgucggcguc

SEQ ID NO: 1270391 - RNA, 16 nt, Mycobacterium tuberculosis H37Rv
uccucgguguccucga

SEQ ID NO: 1270392 - RNA, 12 nt, Mycobacterium tuberculosis H37Rv
uccguaggccac

SEQ ID NO: 1270393 - RNA, 13 nt, Mycobacterium tuberculosis H37Rv
uccucggugucau

SEQ ID NO: 1270394 - RNA, 22 nt, Mycobacterium tuberculosis H37Rv
uccgguguggcgcugaucggca

SEQ ID NO: 1270395 - RNA, 17 nt, Mycobacterium tuberculosis H37Rv
uccggugucgcgaucgc

SEQ ID NO: 1270396 - RNA, 18 nt, Mycobacterium tuberculosis H37Rv
uccggugucgcgaucgcg

SEQ ID NO: 1270397 - RNA, 13 nt, Mycobacterium tuberculosis H37Rv
uccguaucacggu

SEQ ID NO: 1270398 - RNA, 16 nt, Mycobacterium tuberculosis H37Rv
uccgguaucggcgacc

SEQ ID NO: 1270399 - RNA, 14 nt, Mycobacterium tuberculosis H37Rv
uccggucgcucgau

SEQ ID NO: 1270400 - RNA, 22 nt, Mycobacterium tuberculosis H37Rv
uccggucgcuguccacugccac

SEQ ID NO: 1270401 - RNA, 14 nt, Mycobacterium tuberculosis H37Rv
uccgggugccggug

SEQ ID NO: 1270402 - RNA, 16 nt, Mycobacterium tuberculosis H37Rv
uccggugaacccgauu

SEQ ID NO: 1270403 - RNA, 15 nt, Mycobacterium tuberculosis H37Rv
uccgguggaccgccg

SEQ ID NO: 1270404 - RNA, 21 nt, Mycobacterium tuberculosis H37Rv
uccgguggaccgccgaucggc

SEQ ID NO: 1270405 - RNA, 21 nt, Mycobacterium tuberculosis H37Rv
uccgguggccaacaccgccag

SEQ ID NO: 1270406 - RNA, 12 nt, Mycobacterium tuberculosis H37Rv
ucccucgaucac

SEQ ID NO: 1270407 - RNA, 22 nt, Mycobacterium tuberculosis H37Rv
ucccgugacgaacuucgaugcc

SEQ ID NO: 1270408 - RNA, 17 nt, Mycobacterium tuberculosis H37Rv
ucccgucgaugugcggu

SEQ ID NO: 1270409 - RNA, 23 nt, Mycobacterium tuberculosis H37Rv
ucccgcuugaucugggcugcggc

SEQ ID NO: 1270410 - RNA, 15 nt, Mycobacterium tuberculosis H37Rv
ucccggaccaucgcc

SEQ ID NO: 1270411 - RNA, 13 nt, Mycobacterium tuberculosis H37Rv
ucccggaugccga

SEQ ID NO: 1270412 - RNA, 20 nt, Mycobacterium tuberculosis H37Rv
ucccggauauugccaucccu

SEQ ID NO: 1270413 - RNA, 19 nt, Mycobacterium tuberculosis H37Rv
ucccgccgugcugcggcga

SEQ ID NO: 1270414 - RNA, 21 nt, Mycobacterium tuberculosis H37Rv
ucccgccgugcugcggcgacg

SEQ ID NO: 1270415 - RNA, 19 nt, Mycobacterium tuberculosis H37Rv
ucccgcgcgggcggaucgc

SEQ ID NO: 1270416 - RNA, 17 nt, Mycobacterium tuberculosis H37Rv
ucccgcgccggcguugc

SEQ ID NO: 1270417 - RNA, 15 nt, Mycobacterium tuberculosis H37Rv
uccccgguagccccg

SEQ ID NO: 1270418 - RNA, 13 nt, Mycobacterium tuberculosis H37Rv
uccccgucgggac

SEQ ID NO: 1270419 - RNA, 14 nt, Mycobacterium tuberculosis H37Rv
uccccgggcucggu

SEQ ID NO: 1270420 - RNA, 18 nt, Mycobacterium tuberculosis H37Rv
ucccgccgaccgacacca

SEQ ID NO: 1270421 - RNA, 21 nt, Mycobacterium tuberculosis H37Rv
uccccgccggaacugcgcaac

SEQ ID NO: 1270422 - RNA, 12 nt, Mycobacterium tuberculosis H37Rv
uccccgccggaa

SEQ ID NO: 1270423 - RNA, 20 nt, Mycobacterium tuberculosis H37Rv
uccccgacggacuccggccg

SEQ ID NO: 1270424 - RNA, 15 nt, Mycobacterium tuberculosis H37Rv
uccccgaccgaaccg

SEQ ID NO: 1270425 - RNA, 16 nt, Mycobacterium tuberculosis H37Rv
uccccgccgucgccac

SEQ ID NO: 1270426 - RNA, 17 nt, Mycobacterium tuberculosis H37Rv
uccagggccgacgcgaa

SEQ ID NO: 1270427 - RNA, 16 nt, Mycobacterium tuberculosis H37Rv
uccagggccgacgcga

SEQ ID NO: 1270428 - RNA, 21 nt, Mycobacterium tuberculosis H37Rv
uccaggguccggacgaaaucg

SEQ ID NO: 1270429 - RNA, 12 nt, Mycobacterium tuberculosis H37Rv
ucccacucccgc

SEQ ID NO: 1270430 - RNA, 14 nt, Mycobacterium tuberculosis H37Rv
ucccacucgucguc

SEQ ID NO: 1270431 - RNA, 18 nt, Mycobacterium tuberculosis H37Rv
ucccacugcaucacgccg

SEQ ID NO: 1270432 - RNA, 16 nt, Mycobacterium tuberculosis H37Rv
uccagguagucgcggu

SEQ ID NO: 1270433 - RNA, 22 nt, Mycobacterium tuberculosis H37Rv
uccaggguggucgucgucucga

SEQ ID NO: 1270434 - RNA, 19 nt, Mycobacterium tuberculosis H37Rv
ucccagagaaucagcgugg

SEQ ID NO: 1270435 - RNA, 21 nt, Mycobacterium tuberculosis H37Rv
ucccagccuggcaaccacguc

SEQ ID NO: 1270436 - RNA, 18 nt, Mycobacterium tuberculosis H37Rv
ucccagcugaccagcguc

SEQ ID NO: 1270437 - RNA, 16 nt, Mycobacterium tuberculosis H37Rv
ucccagggcugccggu

SEQ ID NO: 1270438 - RNA, 14 nt, Mycobacterium tuberculosis H37Rv
uccccaccgucguc

SEQ ID NO: 1270439 - RNA, 19 nt, Mycobacterium tuberculosis H37Rv
uccccaagucgacgguggc

SEQ ID NO: 1270440 - RNA, 13 nt, Mycobacterium tuberculosis H37Rv
ucccauacgccgg

SEQ ID NO: 1270441 - RNA, 22 nt, Mycobacterium tuberculosis H37Rv
ucccccagaugcugguguugau

SEQ ID NO: 1270442 - RNA, 21 nt, Mycobacterium tuberculosis H37Rv
ucccccaaaucaacagggugg

SEQ ID NO: 1270443 - RNA, 14 nt, Mycobacterium tuberculosis H37Rv
uccccagcgccacc

SEQ ID NO: 1270444 - RNA, 18 nt, Mycobacterium tuberculosis H37Rv
uccccgacaucgcugcga

SEQ ID NO: 1270445 - RNA, 21 nt, Mycobacterium tuberculosis H37Rv
uccccgacaucgcugcgacug

SEQ ID NO: 1270446 - RNA, 16 nt, Mycobacterium tuberculosis H37Rv
ucccccgcgcgaaccg

SEQ ID NO: 1270447 - RNA, 21 nt, Mycobacterium tuberculosis H37Rv
uccggcguacucggugaucgc

SEQ ID NO: 1270448 - RNA, 13 nt, Mycobacterium tuberculosis H37Rv
uccggggcuggcu

SEQ ID NO: 1270449 - RNA, 17 nt, Mycobacterium tuberculosis H37Rv
uccggggggauccagca

SEQ ID NO: 1270450 - RNA, 19 nt, Mycobacterium tuberculosis H37Rv
uccgggucaccagcgcauc

SEQ ID NO: 1270451 - RNA, 13 nt, Mycobacterium tuberculosis H37Rv
uccgggucgacga

SEQ ID NO: 1270452 - RNA, 17 nt, Mycobacterium tuberculosis H37Rv
uccgggugcagaucgcc

SEQ ID NO: 1270453 - RNA, 17 nt, Mycobacterium tuberculosis H37Rv
uccgggucgacgacguc

SEQ ID NO: 1270454 - RNA, 17 nt, Mycobacterium tuberculosis H37Rv
uccggguuuugcgcggc

SEQ ID NO: 1270455 - RNA, 23 nt, Mycobacterium tuberculosis H37Rv
uccggcgcuaugaagucgaucuc

SEQ ID NO: 1270456 - RNA, 18 nt, Mycobacterium tuberculosis H37Rv
uccggccgucaucuggaa

SEQ ID NO: 1270457 - RNA, 22 nt, Mycobacterium tuberculosis H37Rv
uccggccgaugcgacccgcaga

SEQ ID NO: 1270458 - RNA, 19 nt, Mycobacterium tuberculosis H37Rv
uccggccaggggaucaccg

SEQ ID NO: 1270459 - RNA, 11 nt, Mycobacterium tuberculosis H37Rv
uccggcagacc

SEQ ID NO: 1270460 - RNA, 15 nt, Mycobacterium tuberculosis H37Rv
uccggcccugccgcc

SEQ ID NO: 1270461 - RNA, 17 nt, Mycobacterium tuberculosis H37Rv
uccggcccguagcugcg

SEQ ID NO: 1270462 - RNA, 18 nt, Mycobacterium tuberculosis H37Rv
uccggcaccaacgccacc

SEQ ID NO: 1270463 - RNA, 20 nt, Mycobacterium tuberculosis H37Rv
uccggcaagcacaccgccag

SEQ ID NO: 1270464 - RNA, 19 nt, Mycobacterium tuberculosis H37Rv
uccggauugaagucgucgg

SEQ ID NO: 1270465 - RNA, 17 nt, Mycobacterium tuberculosis H37Rv
uccggcaaccaccggcc

SEQ ID NO: 1270466 - RNA, 20 nt, Mycobacterium tuberculosis H37Rv
uccgcucgaaucgucacgga

SEQ ID NO: 1270467 - RNA, 22 nt, Mycobacterium tuberculosis H37Rv
uccgcgucggucagcugugcga

SEQ ID NO: 1270468 - RNA, 13 nt, Mycobacterium tuberculosis H37Rv
uccgcgucgucga

SEQ ID NO: 1270469 - RNA, 22 nt, Mycobacterium tuberculosis H37Rv
uccgcugguggaguucgcgcug

SEQ ID NO: 1270470 - RNA, 15 nt, Mycobacterium tuberculosis H37Rv
uccgcugaacaccgu

SEQ ID NO: 1270471 - RNA, 16 nt, Mycobacterium tuberculosis H37Rv
uccgcugaacaccgug

SEQ ID NO: 1270472 - RNA, 21 nt, Mycobacterium tuberculosis H37Rv
uccgcgcgcaagucgauguac

SEQ ID NO: 1270473 - RNA, 15 nt, Mycobacterium tuberculosis H37Rv
uccgccguucucgcg

SEQ ID NO: 1270474 - RNA, 18 nt, Mycobacterium tuberculosis H37Rv
uccgccguugccgauccc

SEQ ID NO: 1270475 - RNA, 17 nt, Mycobacterium tuberculosis H37Rv
uccgccguugacgccgu

SEQ ID NO: 1270476 - RNA, 19 nt, Mycobacterium tuberculosis H37Rv
uccgcggucgcagcagacc

SEQ ID NO: 1270477 - RNA, 14 nt, Mycobacterium tuberculosis H37Rv
uccgcggccgcggu

SEQ ID NO: 1270478 - RNA, 22 nt, Mycobacterium tuberculosis H37Rv
uccgcgcucaaccgcaaucgga

SEQ ID NO: 1270479 - RNA, 12 nt, Mycobacterium tuberculosis H37Rv
uccgcgcgguuu

SEQ ID NO: 1270480 - RNA, 17 nt, Mycobacterium tuberculosis H37Rv
uccgcggaucaccaucg

SEQ ID NO: 1270481 - RNA, 23 nt, Mycobacterium tuberculosis H37Rv
uccgcggagaacaucccccggcu

SEQ ID NO: 1270482 - RNA, 20 nt, Mycobacterium tuberculosis H37Rv
uccgaaccaccuguccggug

SEQ ID NO: 1270483 - RNA, 15 nt, Mycobacterium tuberculosis H37Rv
uccgaacacggugaa

SEQ ID NO: 1270484 - RNA, 17 nt, Mycobacterium tuberculosis H37Rv
uccgaagagccagcaac

SEQ ID NO: 1270485 - RNA, 20 nt, Mycobacterium tuberculosis H37Rv
ucccuggcggggaucagcga

SEQ ID NO: 1270486 - RNA, 19 nt, Mycobacterium tuberculosis H37Rv
ucccugcaguccacugauc

SEQ ID NO: 1270487 - RNA, 13 nt, Mycobacterium tuberculosis H37Rv
uccgccgagcaga

SEQ ID NO: 1270488 - RNA, 19 nt, Mycobacterium tuberculosis H37Rv
uccgccgagcagacgcaga

SEQ ID NO: 1270489 - RNA, 20 nt, Mycobacterium tuberculosis H37Rv
uccgcccucaguucacgcuc

SEQ ID NO: 1270490 - RNA, 19 nt, Mycobacterium tuberculosis H37Rv
uccgccgauagcaccggaa

SEQ ID NO: 1270491 - RNA, 22 nt, Mycobacterium tuberculosis H37Rv
uccgccgcagaccugcaucaca

SEQ ID NO: 1270492 - RNA, 14 nt, Mycobacterium tuberculosis H37Rv
uccgccgccgacgg

SEQ ID NO: 1270493 - RNA, 12 nt, Mycobacterium tuberculosis H37Rv
uccgcccggugc

SEQ ID NO: 1270494 - RNA, 15 nt, Mycobacterium tuberculosis H37Rv
uccgccccagcugcg

SEQ ID NO: 1270495 - RNA, 18 nt, Mycobacterium tuberculosis H37Rv
uccgcccucaguucacgc

SEQ ID NO: 1270496 - RNA, 14 nt, Mycobacterium tuberculosis H37Rv
ucggcgcgcgacga

SEQ ID NO: 1270497 - RNA, 19 nt, Mycobacterium tuberculosis H37Rv
ucgggaacgcucgucgaca

SEQ ID NO: 1270498 - RNA, 12 nt, Mycobacterium tuberculosis H37Rv
ucgggaccggga

SEQ ID NO: 1270499 - RNA, 19 nt, Mycobacterium tuberculosis H37Rv
ucgggaccgggaacccgag

SEQ ID NO: 1270500 - RNA, 22 nt, Mycobacterium tuberculosis H37Rv
ucgggacaaucguccacccgag

SEQ ID NO: 1270501 - RNA, 13 nt, Mycobacterium tuberculosis H37Rv
ucgggacggccaa

SEQ ID NO: 1270502 - RNA, 23 nt, Mycobacterium tuberculosis H37Rv
ucggcgcgcggguugucggcgac

SEQ ID NO: 1270503 - RNA, 17 nt, Mycobacterium tuberculosis H37Rv
ucggcgauugcaccaug

SEQ ID NO: 1270504 - RNA, 16 nt, Mycobacterium tuberculosis H37Rv
ucgggcagggaccgca

SEQ ID NO: 1270505 - RNA, 17 nt, Mycobacterium tuberculosis H37Rv
ucgggcacgggugacga

SEQ ID NO: 1270506 - RNA, 21 nt, Mycobacterium tuberculosis H37Rv
ucgggcacgggugacgauguc

SEQ ID NO: 1270507 - RNA, 13 nt, Mycobacterium tuberculosis H37Rv
ucgggcccaccgc

SEQ ID NO: 1270508 - RNA, 15 nt, Mycobacterium tuberculosis H37Rv
ucgggcccagcgcgc

SEQ ID NO: 1270509 - RNA, 15 nt, Mycobacterium tuberculosis H37Rv
ucgggcccuccggcg

SEQ ID NO: 1270510 - RNA, 22 nt, Mycobacterium tuberculosis H37Rv
ucgggccgaauaccacaccgug

SEQ ID NO: 1270511 - RNA, 21 nt, Mycobacterium tuberculosis H37Rv
ucgggccacagcaacgugugc

SEQ ID NO: 1270512 - RNA, 12 nt, Mycobacterium tuberculosis H37Rv
ucgggaugcgcg

SEQ ID NO: 1270513 - RNA, 17 nt, Mycobacterium tuberculosis H37Rv
ucgggaucgcugccagc

SEQ ID NO: 1270514 - RNA, 19 nt, Mycobacterium tuberculosis H37Rv
ucgggaugcccgcugauca

SEQ ID NO: 1270515 - RNA, 19 nt, Mycobacterium tuberculosis H37Rv
ucgggauaagccugggaaa

SEQ ID NO: 1270516 - RNA, 15 nt, Mycobacterium tuberculosis H37Rv
ucgggacugcgcggc

SEQ ID NO: 1270517 - RNA, 22 nt, Mycobacterium tuberculosis H37Rv
ucgggauggacggcagccagcc

SEQ ID NO: 1270518 - RNA, 14 nt, Mycobacterium tuberculosis H37Rv
ucgggaugcucgau

SEQ ID NO: 1270519 - RNA, 22 nt, Mycobacterium tuberculosis H37Rv
ucgggcaaccggagaucccggu

SEQ ID NO: 1270520 - RNA, 19 nt, Mycobacterium tuberculosis H37Rv
ucgggcaacgccucgagca

SEQ ID NO: 1270521 - RNA, 17 nt, Mycobacterium tuberculosis H37Rv
ucgggcacaccgacgcc

SEQ ID NO: 1270522 - RNA, 22 nt, Mycobacterium tuberculosis H37Rv
ucgggcaccuccaauugcgaac

SEQ ID NO: 1270523 - RNA, 19 nt, Mycobacterium tuberculosis H37Rv
ucgggccgucgggugugcg

SEQ ID NO: 1270524 - RNA, 13 nt, Mycobacterium tuberculosis H37Rv
ucgggcgagaucu

SEQ ID NO: 1270525 - RNA, 19 nt, Mycobacterium tuberculosis H37Rv
ucgggcgugcucgccgggu

SEQ ID NO: 1270526 - RNA, 17 nt, Mycobacterium tuberculosis H37Rv
ucgggcgggucggcggc

SEQ ID NO: 1270527 - RNA, 16 nt, Mycobacterium tuberculosis H37Rv
ucgggcucguccagca

SEQ ID NO: 1270528 - RNA, 21 nt, Mycobacterium tuberculosis H37Rv
ucgggcgucaugaugucgaca

SEQ ID NO: 1270529 - RNA, 17 nt, Mycobacterium tuberculosis H37Rv
ucggggacggcgaaucg

SEQ ID NO: 1270530 - RNA, 14 nt, Mycobacterium tuberculosis H37Rv
ucggggccacugag

SEQ ID NO: 1270531 - RNA, 22 nt, Mycobacterium tuberculosis H37Rv
ucgggcuugcgcagcagcgugc

SEQ ID NO: 1270532 - RNA, 18 nt, Mycobacterium tuberculosis H37Rv
ucggggcgcaccacgaug

SEQ ID NO: 1270533 - RNA, 23 nt, Mycobacterium tuberculosis H37Rv
ucggggcgcgguaccggugucag

SEQ ID NO: 1270534 - RNA, 20 nt, Mycobacterium tuberculosis H37Rv
ucggggggcaggucgagcgc

SEQ ID NO: 1270535 - RNA, 20 nt, Mycobacterium tuberculosis H37Rv
ucgggggcuuuugcgucugc

SEQ ID NO: 1270536 - RNA, 19 nt, Mycobacterium tuberculosis H37Rv
ucgggggcuuuugcgucug

SEQ ID NO: 1270537 - RNA, 20 nt, Mycobacterium tuberculosis H37Rv
ucgggggcuuuuacgucugc

SEQ ID NO: 1270538 - RNA, 18 nt, Mycobacterium tuberculosis H37Rv
ucgggggcugcacgcucg

SEQ ID NO: 1270539 - RNA, 18 nt, Mycobacterium tuberculosis H37Rv
ucggucagagccgucgaa

SEQ ID NO: 1270540 - RNA, 24 nt, Mycobacterium tuberculosis H37Rv
ucggucagcgucaggugcgcgacc

SEQ ID NO: 1270541 - RNA, 22 nt, Mycobacterium tuberculosis H37Rv
ucggucagcgucaggugcgcga

SEQ ID NO: 1270542 - RNA, 23 nt, Mycobacterium tuberculosis H37Rv
ucggucagcgucaggugcgcgac

SEQ ID NO: 1270543 - RNA, 13 nt, Mycobacterium tuberculosis H37Rv
ucgggugcugaug

SEQ ID NO: 1270544 - RNA, 17 nt, Mycobacterium tuberculosis H37Rv
ucgggucgaucaccgac

SEQ ID NO: 1270545 - RNA, 20 nt, Mycobacterium tuberculosis H37Rv
ucgggucccagccuggcaac

SEQ ID NO: 1270546 - RNA, 22 nt, Mycobacterium tuberculosis H37Rv
ucggguagggcaucgucgccga

SEQ ID NO: 1270547 - RNA, 13 nt, Mycobacterium tuberculosis H37Rv
ucggguagaucgc

SEQ ID NO: 1270548 - RNA, 15 nt, Mycobacterium tuberculosis H37Rv
ucggguagccgggaa

SEQ ID NO: 1270549 - RNA, 20 nt, Mycobacterium tuberculosis H37Rv
ucgggucaccgugcggaucg

SEQ ID NO: 1270550 - RNA, 20 nt, Mycobacterium tuberculosis H37Rv
ucgggguggucgcaccgccg

SEQ ID NO: 1270551 - RNA, 14 nt, Mycobacterium tuberculosis H37Rv
ucgggguuacguug

SEQ ID NO: 1270552 - RNA, 15 nt, Mycobacterium tuberculosis H37Rv
ucggggucaccggcu

SEQ ID NO: 1270553 - RNA, 11 nt, Mycobacterium tuberculosis H37Rv
ucgucggcguc

SEQ ID NO: 1270554 - RNA, 15 nt, Mycobacterium tuberculosis H37Rv
ucgucggcggugcgc

SEQ ID NO: 1270555 - RNA, 11 nt, Mycobacterium tuberculosis H37Rv
ucgucgggagc

SEQ ID NO: 1270556 - RNA, 15 nt, Mycobacterium tuberculosis H37Rv
ucgucggcggcgacg

SEQ ID NO: 1270557 - RNA, 15 nt, Mycobacterium tuberculosis H37Rv
ucgucggcgggcugc

SEQ ID NO: 1270558 - RNA, 14 nt, Mycobacterium tuberculosis H37Rv
ucgucgccacgaug

SEQ ID NO: 1270559 - RNA, 14 nt, Mycobacterium tuberculosis H37Rv
ucgucgaucgccgc

SEQ ID NO: 1270560 - RNA, 16 nt, Mycobacterium tuberculosis H37Rv
ucgucgaaguagccga

SEQ ID NO: 1270561 - RNA, 17 nt, Mycobacterium tuberculosis H37Rv
ucgucgaaguuggcgaa

SEQ ID NO: 1270562 - RNA, 19 nt, Mycobacterium tuberculosis H37Rv
ucgucgaccaccugagccg

SEQ ID NO: 1270563 - RNA, 22 nt, Mycobacterium tuberculosis H37Rv
ucgucgcaaacuucgcgcacgc

SEQ ID NO: 1270564 - RNA, 20 nt, Mycobacterium tuberculosis H37Rv
ucgucgauggucuccggacg

SEQ ID NO: 1270565 - RNA, 21 nt, Mycobacterium tuberculosis H37Rv
ucgucgauuagcccacccaug

SEQ ID NO: 1270566 - RNA, 19 nt, Mycobacterium tuberculosis H37Rv
ucgucgucaucgagcggga

SEQ ID NO: 1270567 - RNA, 13 nt, Mycobacterium tuberculosis H37Rv
ucgucgucgguca

SEQ ID NO: 1270568 - RNA, 15 nt, Mycobacterium tuberculosis H37Rv
ucgucgugucgccgc

SEQ ID NO: 1270569 - RNA, 21 nt, Mycobacterium tuberculosis H37Rv
ucgucgucggcaggcagcucg

SEQ ID NO: 1270570 - RNA, 17 nt, Mycobacterium tuberculosis H37Rv
ucgucguacaugggcag

SEQ ID NO: 1270571 - RNA, 17 nt, Mycobacterium tuberculosis H37Rv
ucgucgguguccucggu

SEQ ID NO: 1270572 - RNA, 12 nt, Mycobacterium tuberculosis H37Rv
ucgucggucuca

SEQ ID NO: 1270573 - RNA, 22 nt, Mycobacterium tuberculosis H37Rv
ucgucggucucaugcacccggu

SEQ ID NO: 1270574 - RNA, 13 nt, Mycobacterium tuberculosis H37Rv
ucgucggugauca

SEQ ID NO: 1270575 - RNA, 17 nt, Mycobacterium tuberculosis H37Rv
ucgucggucaccgaaug

SEQ ID NO: 1270576 - RNA, 14 nt, Mycobacterium tuberculosis H37Rv
ucgugagcggccag

SEQ ID NO: 1270577 - RNA, 18 nt, Mycobacterium tuberculosis H37Rv
ucgugaacacgucgcggu

SEQ ID NO: 1270578 - RNA, 14 nt, Mycobacterium tuberculosis H37Rv
ucgugagacgccgu

SEQ ID NO: 1270579 - RNA, 20 nt, Mycobacterium tuberculosis H37Rv
ucgucguugagcaucaccgu

SEQ ID NO: 1270580 - RNA, 16 nt, Mycobacterium tuberculosis H37Rv
ucgucugaaucgucgc

SEQ ID NO: 1270581 - RNA, 22 nt, Mycobacterium tuberculosis H37Rv
ucggucgccaccgccggcagca

SEQ ID NO: 1270582 - RNA, 19 nt, Mycobacterium tuberculosis H37Rv
ucggucccgccggucacga

SEQ ID NO: 1270583 - RNA, 17 nt, Mycobacterium tuberculosis H37Rv
ucgguguucgguggucc

SEQ ID NO: 1270584 - RNA, 17 nt, Mycobacterium tuberculosis H37Rv
ucggucggcaccagguu

SEQ ID NO: 1270585 - RNA, 19 nt, Mycobacterium tuberculosis H37Rv
ucggugguggguugaucgc

SEQ ID NO: 1270586 - RNA, 21 nt, Mycobacterium tuberculosis H37Rv
ucggucgcgcgacggccggga

SEQ ID NO: 1270587 - RNA, 19 nt, Mycobacterium tuberculosis H37Rv
ucgguuucgaccugcggga

SEQ ID NO: 1270588 - RNA, 19 nt, Mycobacterium tuberculosis H37Rv
ucgguuggcucgggccaga

SEQ ID NO: 1270589 - RNA, 14 nt, Mycobacterium tuberculosis H37Rv
ucguaggugggcuc

SEQ ID NO: 1270590 - RNA, 12 nt, Mycobacterium tuberculosis H37Rv
ucguaggcgaug

SEQ ID NO: 1270591 - RNA, 15 nt, Mycobacterium tuberculosis H37Rv
ucguaggcgaugagc

SEQ ID NO: 1270592 - RNA, 16 nt, Mycobacterium tuberculosis H37Rv
ucgucaaaucuggcug

SEQ ID NO: 1270593 - RNA, 18 nt, Mycobacterium tuberculosis H37Rv
ucgucccagaagucguca

SEQ ID NO: 1270594 - RNA, 14 nt, Mycobacterium tuberculosis H37Rv
ucgucccacugcgc

SEQ ID NO: 1270595 - RNA, 21 nt, Mycobacterium tuberculosis H37Rv
ucguccuguccgggcugcaug

SEQ ID NO: 1270596 - RNA, 18 nt, Mycobacterium tuberculosis H37Rv
ucguccuguccgggcugc

SEQ ID NO: 1270597 - RNA, 18 nt, Mycobacterium tuberculosis H37Rv
ucguccagcgaucccggu

SEQ ID NO: 1270598 - RNA, 19 nt, Mycobacterium tuberculosis H37Rv
ucguccagcucggugcugu

SEQ ID NO: 1270599 - RNA, 12 nt, Mycobacterium tuberculosis H37Rv
ucugcgacacca

SEQ ID NO: 1270600 - RNA, 22 nt, Mycobacterium tuberculosis H37Rv
ucugccgguaccggcgaucugc

SEQ ID NO: 1270601 - RNA, 16 nt, Mycobacterium tuberculosis H37Rv
ucugccggucgauguc

SEQ ID NO: 1270602 - RNA, 20 nt, Mycobacterium tuberculosis H37Rv
ucugccggucgaugucggcg

SEQ ID NO: 1270603 - RNA, 16 nt, Mycobacterium tuberculosis H37Rv
ucugcaccggcaggcg

SEQ ID NO: 1270604 - RNA, 15 nt, Mycobacterium tuberculosis H37Rv
ucugcagcgucgucu

SEQ ID NO: 1270605 - RNA, 22 nt, Mycobacterium tuberculosis H37Rv
ucugaucuguguuugcggcuuc

SEQ ID NO: 1270606 - RNA, 12 nt, Mycobacterium tuberculosis H37Rv
ucucgucgucgg

SEQ ID NO: 1270607 - RNA, 12 nt, Mycobacterium tuberculosis H37Rv
ucucggugcugg

SEQ ID NO: 1270608 - RNA, 17 nt, Mycobacterium tuberculosis H37Rv
ucucgguggugcgcucg

SEQ ID NO: 1270609 - RNA, 17 nt, Mycobacterium tuberculosis H37Rv
ucucguugauacggcau

SEQ ID NO: 1270610 - RNA, 19 nt, Mycobacterium tuberculosis H37Rv
ucugagacugccgccgcuu

SEQ ID NO: 1270611 - RNA, 17 nt, Mycobacterium tuberculosis H37Rv
ucucgcucgugcacgcu

SEQ ID NO: 1270612 - RNA, 19 nt, Mycobacterium tuberculosis H37Rv
ucucgcucgugcacgcuga

SEQ ID NO: 1270613 - RNA, 20 nt, Mycobacterium tuberculosis H37Rv
ucucgcccccagugcacgcu

SEQ ID NO: 1270614 - RNA, 21 nt, Mycobacterium tuberculosis H37Rv
ucucggccgcucguuacgccg

SEQ ID NO: 1270615 - RNA, 16 nt, Mycobacterium tuberculosis H37Rv
ucucgagcucggcgaa

SEQ ID NO: 1270616 - RNA, 18 nt, Mycobacterium tuberculosis H37Rv
ucucgacggccucgucga

SEQ ID NO: 1270617 - RNA, 23 nt, Mycobacterium tuberculosis H37Rv
ucucgaccguugcauacagcgga

SEQ ID NO: 1270618 - RNA, 14 nt, Mycobacterium tuberculosis H37Rv
ucuccggcgccacc

SEQ ID NO: 1270619 - RNA, 21 nt, Mycobacterium tuberculosis H37Rv
ucuccgggucgaugucggggc

SEQ ID NO: 1270620 - RNA, 15 nt, Mycobacterium tuberculosis H37Rv
ucucgcaucggccuc

SEQ ID NO: 1270621 - RNA, 23 nt, Mycobacterium tuberculosis H37Rv
ucucgauggucauccagccagca

SEQ ID NO: 1270622 - RNA, 15 nt, Mycobacterium tuberculosis H37Rv
ucucccgcacggccg

SEQ ID NO: 1270623 - RNA, 18 nt, Mycobacterium tuberculosis H37Rv
ucucccgguauucccgcu

SEQ ID NO: 1270624 - RNA, 13 nt, Mycobacterium tuberculosis H37Rv
ucucccuugccga

SEQ ID NO: 1270625 - RNA, 20 nt, Mycobacterium tuberculosis H37Rv
ucguggagcucacgugcugc

SEQ ID NO: 1270626 - RNA, 20 nt, Mycobacterium tuberculosis H37Rv
ucguggcuuccggugguguc

SEQ ID NO: 1270627 - RNA, 23 nt, Mycobacterium tuberculosis H37Rv
ucgugggccacuugaugcucgau

SEQ ID NO: 1270628 - RNA, 21 nt, Mycobacterium tuberculosis H37Rv
ucguggggaucgaccaugguc

SEQ ID NO: 1270629 - RNA, 13 nt, Mycobacterium tuberculosis H37Rv
ucguggucgacgu

SEQ ID NO: 1270630 - RNA, 16 nt, Mycobacterium tuberculosis H37Rv
ucgugucaugcucacc

SEQ ID NO: 1270631 - RNA, 22 nt, Mycobacterium tuberculosis H37Rv
ucguguccggggaccucggcga

SEQ ID NO: 1270632 - RNA, 13 nt, Mycobacterium tuberculosis H37Rv
ucguggucgaucc

SEQ ID NO: 1270633 - RNA, 17 nt, Mycobacterium tuberculosis H37Rv
ucugcgccacagcagcg

SEQ ID NO: 1270634 - RNA, 15 nt, Mycobacterium tuberculosis H37Rv
ucuuagccagcagca

SEQ ID NO: 1270635 - RNA, 21 nt, Mycobacterium tuberculosis H37Rv
ucuugcggggucgguagcugg

SEQ ID NO: 1270636 - RNA, 21 nt, Mycobacterium tuberculosis H37Rv
ucuugcgacgcccgccuucga

SEQ ID NO: 1270637 - RNA, 17 nt, Mycobacterium tuberculosis H37Rv
ucuugcgaugugcauuc

SEQ ID NO: 1270638 - RNA, 22 nt, Mycobacterium tuberculosis H37Rv
ucuucagcugcggauacagccg

SEQ ID NO: 1270639 - RNA, 19 nt, Mycobacterium tuberculosis H37Rv
ugaacacgaauccggccac

SEQ ID NO: 1270640 - RNA, 13 nt, Mycobacterium tuberculosis H37Rv
ugaacaacagcgc

SEQ ID NO: 1270641 - RNA, 15 nt, Mycobacterium tuberculosis H37Rv
ugaacgacauccggc

SEQ ID NO: 1270642 - RNA, 17 nt, Mycobacterium tuberculosis H37Rv
ugaacgaccaccgcuga

SEQ ID NO: 1270643 - RNA, 14 nt, Mycobacterium tuberculosis H37Rv
ugaaccuggcgacg

SEQ ID NO: 1270644 - RNA, 22 nt, Mycobacterium tuberculosis H37Rv
ugaacgcaugcgagaacgucga

SEQ ID NO: 1270645 - RNA, 15 nt, Mycobacterium tuberculosis H37Rv
ugaacgccagcagcg

SEQ ID NO: 1270646 - RNA, 18 nt, Mycobacterium tuberculosis H37Rv
ugaacgccagcagcgcga

SEQ ID NO: 1270647 - RNA, 13 nt, Mycobacterium tuberculosis H37Rv
ucuuggucaccgg

SEQ ID NO: 1270648 - RNA, 18 nt, Mycobacterium tuberculosis H37Rv
ucuuggcgcgguccucca

SEQ ID NO: 1270649 - RNA, 16 nt, Mycobacterium tuberculosis H37Rv
ugcccgcacugccgcc

SEQ ID NO: 1270650 - RNA, 20 nt, Mycobacterium tuberculosis H37Rv
ugcccgccaccggcgcgacc

SEQ ID NO: 1270651 - RNA, 21 nt, Mycobacterium tuberculosis H37Rv
ugcccgccagcgccgccgcga

SEQ ID NO: 1270652 - RNA, 14 nt, Mycobacterium tuberculosis H37Rv
ugcccgcauugcca

SEQ ID NO: 1270653 - RNA, 15 nt, Mycobacterium tuberculosis H37Rv
ugcccgccguagacc

SEQ ID NO: 1270654 - RNA, 13 nt, Mycobacterium tuberculosis H37Rv
ugcccgccgacgc

SEQ ID NO: 1270655 - RNA, 17 nt, Mycobacterium tuberculosis H37Rv
ugcccaugauggucacg

SEQ ID NO: 1270656 - RNA, 16 nt, Mycobacterium tuberculosis H37Rv
ugcccaguguccggcg

SEQ ID NO: 1270657 - RNA, 19 nt, Mycobacterium tuberculosis H37Rv
ugcccaguguccggcgacg

SEQ ID NO: 1270658 - RNA, 18 nt, Mycobacterium tuberculosis H37Rv
ugcccaggccaccggcug

SEQ ID NO: 1270659 - RNA, 16 nt, Mycobacterium tuberculosis H37Rv
ugcccgggugacccgu

SEQ ID NO: 1270660 - RNA, 20 nt, Mycobacterium tuberculosis H37Rv
ugcccgggcgugguaucgcc

SEQ ID NO: 1270661 - RNA, 20 nt, Mycobacterium tuberculosis H37Rv
ugcccgggguccaucggggc

SEQ ID NO: 1270662 - RNA, 20 nt, Mycobacterium tuberculosis H37Rv
ugcccgcguuugcgaagccc

SEQ ID NO: 1270663 - RNA, 22 nt, Mycobacterium tuberculosis H37Rv
ugcccgcugaucagauccucga

SEQ ID NO: 1270664 - RNA, 14 nt, Mycobacterium tuberculosis H37Rv
ugcccgcggugacg

SEQ ID NO: 1270665 - RNA, 19 nt, Mycobacterium tuberculosis H37Rv
ugcccgcgucuacgucguc

SEQ ID NO: 1270666 - RNA, 19 nt, Mycobacterium tuberculosis H37Rv
ugccauccuuaugcgcggu

SEQ ID NO: 1270667 - RNA, 13 nt, Mycobacterium tuberculosis H37Rv
ugccaucuacauc

SEQ ID NO: 1270668 - RNA, 22 nt, Mycobacterium tuberculosis H37Rv
ugccagcagcagcgccgcgugg

SEQ ID NO: 1270669 - RNA, 19 nt, Mycobacterium tuberculosis H37Rv
ugccagccgucaccgcgac

SEQ ID NO: 1270670 - RNA, 20 nt, Mycobacterium tuberculosis H37Rv
ugccagccgucaccgcgacc

SEQ ID NO: 1270671 - RNA, 15 nt, Mycobacterium tuberculosis H37Rv
ugccagccggucgau

SEQ ID NO: 1270672 - RNA, 23 nt, Mycobacterium tuberculosis H37Rv
ugccagccuuggacgugcgcgcc

SEQ ID NO: 1270673 - RNA, 24 nt, Mycobacterium tuberculosis H37Rv
ugccauuccagaucaacgcgucgc

SEQ ID NO: 1270674 - RNA, 20 nt, Mycobacterium tuberculosis H37Rv
ugcccagcaccaccgcggug

SEQ ID NO: 1270675 - RNA, 19 nt, Mycobacterium tuberculosis H37Rv
ugcccagcacccccugcac

SEQ ID NO: 1270676 - RNA, 21 nt, Mycobacterium tuberculosis H37Rv
ugccacggucauuggguguca

SEQ ID NO: 1270677 - RNA, 15 nt, Mycobacterium tuberculosis H37Rv
ugccagcaccacguc

SEQ ID NO: 1270678 - RNA, 20 nt, Mycobacterium tuberculosis H37Rv
ugccaccugacuaccgucau

SEQ ID NO: 1270679 - RNA, 21 nt, Mycobacterium tuberculosis H37Rv
ugcaguuccuugagacgccgg

SEQ ID NO: 1270680 - RNA, 22 nt, Mycobacterium tuberculosis H37Rv
ugcaguguuuuugcagacucgg

SEQ ID NO: 1270681 - RNA, 16 nt, Mycobacterium tuberculosis H37Rv
ugcaggaccagcaccg

SEQ ID NO: 1270682 - RNA, 16 nt, Mycobacterium tuberculosis H37Rv
ugcaggauucggcggu

SEQ ID NO: 1270683 - RNA, 20 nt, Mycobacterium tuberculosis H37Rv
ugcagcgucaagggcugggu

SEQ ID NO: 1270684 - RNA, 16 nt, Mycobacterium tuberculosis H37Rv
ugcagcggguugcggu

SEQ ID NO: 1270685 - RNA, 19 nt, Mycobacterium tuberculosis H37Rv
ugcagcgccucgaccugac

SEQ ID NO: 1270686 - RNA, 19 nt, Mycobacterium tuberculosis H37Rv
ugcagccgggaaaucucgg

SEQ ID NO: 1270687 - RNA, 13 nt, Mycobacterium tuberculosis H37Rv
ugcagccgaccga

SEQ ID NO: 1270688 - RNA, 10 nt, Mycobacterium tuberculosis H37Rv
ugcagcgacg

SEQ ID NO: 1270689 - RNA, 17 nt, Mycobacterium tuberculosis H37Rv
ugcagcccgggcagcac

SEQ ID NO: 1270690 - RNA, 19 nt, Mycobacterium tuberculosis H37Rv
ugcagcccgggcagcacca

SEQ ID NO: 1270691 - RNA, 17 nt, Mycobacterium tuberculosis H37Rv
ugcagcccaaggcgacg

SEQ ID NO: 1270692 - RNA, 17 nt, Mycobacterium tuberculosis H37Rv
ugcagcacguccgcgga

SEQ ID NO: 1270693 - RNA, 22 nt, Mycobacterium tuberculosis H37Rv
ugcagaucggccggauacgggc

SEQ ID NO: 1270694 - RNA, 21 nt, Mycobacterium tuberculosis H37Rv
ugcagauggaaccucggcggu

SEQ ID NO: 1270695 - RNA, 18 nt, Mycobacterium tuberculosis H37Rv
ugcagcacccccucggcu

SEQ ID NO: 1270696 - RNA, 15 nt, Mycobacterium tuberculosis H37Rv
ugcacauucagcgcc

SEQ ID NO: 1270697 - RNA, 18 nt, Mycobacterium tuberculosis H37Rv
ugauguacccggcgacgu

SEQ ID NO: 1270698 - RNA, 18 nt, Mycobacterium tuberculosis H37Rv
ugaugguguacacgucgc

SEQ ID NO: 1270699 - RNA, 21 nt, Mycobacterium tuberculosis H37Rv
ugcaccacauuggcgaucagc

SEQ ID NO: 1270700 - RNA, 22 nt, Mycobacterium tuberculosis H37Rv
ugauggccucgcgaauccuggc

SEQ ID NO: 1270701 - RNA, 17 nt, Mycobacterium tuberculosis H37Rv
ugauggacaccagccag

SEQ ID NO: 1270702 - RNA, 14 nt, Mycobacterium tuberculosis H37Rv
ugcacgcugcgggu

SEQ ID NO: 1270703 - RNA, 15 nt, Mycobacterium tuberculosis H37Rv
ugcacgccgauaccg

SEQ ID NO: 1270704 - RNA, 20 nt, Mycobacterium tuberculosis H37Rv
ugcacgcugagccggucgcg

SEQ ID NO: 1270705 - RNA, 18 nt, Mycobacterium tuberculosis H37Rv
ugcacgcccagcgucugu

SEQ ID NO: 1270706 - RNA, 17 nt, Mycobacterium tuberculosis H37Rv
ugcacgccgguggucac

SEQ ID NO: 1270707 - RNA, 21 nt, Mycobacterium tuberculosis H37Rv
ugcacgacaucgucgcgacga

SEQ ID NO: 1270708 - RNA, 14 nt, Mycobacterium tuberculosis H37Rv
ugcacgaacgccug

SEQ ID NO: 1270709 - RNA, 16 nt, Mycobacterium tuberculosis H37Rv
ugcacgacgguguccg

SEQ ID NO: 1270710 - RNA, 22 nt, Mycobacterium tuberculosis H37Rv
ugcacggucaugccgccgccga

SEQ ID NO: 1270711 - RNA, 14 nt, Mycobacterium tuberculosis H37Rv
ugcacggccgucau

SEQ ID NO: 1270712 - RNA, 16 nt, Mycobacterium tuberculosis H37Rv
ugcacggcgcuaccag

SEQ ID NO: 1270713 - RNA, 14 nt, Mycobacterium tuberculosis H37Rv
ugcacggcgauugc

SEQ ID NO: 1270714 - RNA, 16 nt, Mycobacterium tuberculosis H37Rv
ugcacguacucggcca

SEQ ID NO: 1270715 - RNA, 17 nt, Mycobacterium tuberculosis H37Rv
ugaccgccgcgccggca

SEQ ID NO: 1270716 - RNA, 15 nt, Mycobacterium tuberculosis H37Rv
ugaccgccgacacca

SEQ ID NO: 1270717 - RNA, 21 nt, Mycobacterium tuberculosis H37Rv
ugaccgcgaugaucgcaucga

SEQ ID NO: 1270718 - RNA, 20 nt, Mycobacterium tuberculosis H37Rv
ugaccgcgaugucacggaug

SEQ ID NO: 1270719 - RNA, 14 nt, Mycobacterium tuberculosis H37Rv
ugaccgcgaucgcc

SEQ ID NO: 1270720 - RNA, 19 nt, Mycobacterium tuberculosis H37Rv
ugaccgcgaucgccgacgc

SEQ ID NO: 1270721 - RNA, 17 nt, Mycobacterium tuberculosis H37Rv
ugacccggcagcccggc

SEQ ID NO: 1270722 - RNA, 18 nt, Mycobacterium tuberculosis H37Rv
ugacccucagcaccgcug

SEQ ID NO: 1270723 - RNA, 16 nt, Mycobacterium tuberculosis H37Rv
ugacccuccgcaucgc

SEQ ID NO: 1270724 - RNA, 16 nt, Mycobacterium tuberculosis H37Rv
ugacccgggcggcguu

SEQ ID NO: 1270725 - RNA, 15 nt, Mycobacterium tuberculosis H37Rv
ugaccgaauggccgc

SEQ ID NO: 1270726 - RNA, 14 nt, Mycobacterium tuberculosis H37Rv
ugaccgaccgccau

SEQ ID NO: 1270727 - RNA, 23 nt, Mycobacterium tuberculosis H37Rv
ugaccgaagaagcccgacugguc

SEQ ID NO: 1270728 - RNA, 13 nt, Mycobacterium tuberculosis H37Rv
ugaccggcucgcc

SEQ ID NO: 1270729 - RNA, 14 nt, Mycobacterium tuberculosis H37Rv
ugaccgggucgccg

SEQ ID NO: 1270730 - RNA, 14 nt, Mycobacterium tuberculosis H37Rv
ugaccguccaccga

SEQ ID NO: 1270731 - RNA, 18 nt, Mycobacterium tuberculosis H37Rv
ugaccgguauuaccgccg

SEQ ID NO: 1270732 - RNA, 18 nt, Mycobacterium tuberculosis H37Rv
ugaccgguguuccgccca

SEQ ID NO: 1270733 - RNA, 12 nt, Mycobacterium tuberculosis H37Rv
ugaccgugccgu

SEQ ID NO: 1270734 - RNA, 17 nt, Mycobacterium tuberculosis H37Rv
ugacgaacuucgaugcc

SEQ ID NO: 1270735 - RNA, 20 nt, Mycobacterium tuberculosis H37Rv
ugacgaaggguauccgugug

SEQ ID NO: 1270736 - RNA, 17 nt, Mycobacterium tuberculosis H37Rv
ugacgaaguccaccacg

SEQ ID NO: 1270737 - RNA, 23 nt, Mycobacterium tuberculosis H37Rv
ugacgaauccacuggucaacggg

SEQ ID NO: 1270738 - RNA, 20 nt, Mycobacterium tuberculosis H37Rv
ugacgaauugguugcccuug

SEQ ID NO: 1270739 - RNA, 15 nt, Mycobacterium tuberculosis H37Rv
ugacgaacccaccgu

SEQ ID NO: 1270740 - RNA, 16 nt, Mycobacterium tuberculosis H37Rv
ugacgaacccaccgug

SEQ ID NO: 1270741 - RNA, 23 nt, Mycobacterium tuberculosis H37Rv
ugaccuucaggcccugccgacgc

SEQ ID NO: 1270742 - RNA, 16 nt, Mycobacterium tuberculosis H37Rv
ugaccuucccgucgac

SEQ ID NO: 1270743 - RNA, 15 nt, Mycobacterium tuberculosis H37Rv
ugaccuugcccacca

SEQ ID NO: 1270744 - RNA, 14 nt, Mycobacterium tuberculosis H37Rv
ugaccucggcgacg

SEQ ID NO: 1270745 - RNA, 13 nt, Mycobacterium tuberculosis H37Rv
ugaccucggcgac

SEQ ID NO: 1270746 - RNA, 15 nt, Mycobacterium tuberculosis H37Rv
ugaccucggcgacga

SEQ ID NO: 1270747 - RNA, 14 nt, Mycobacterium tuberculosis H37Rv
ugaccugcagaaac

SEQ ID NO: 1270748 - RNA, 14 nt, Mycobacterium tuberculosis H37Rv
ugacgccgucagcg

SEQ ID NO: 1270749 - RNA, 14 nt, Mycobacterium tuberculosis H37Rv
ugacgcaacaucgg

SEQ ID NO: 1270750 - RNA, 14 nt, Mycobacterium tuberculosis H37Rv
ugacgauugccacc

SEQ ID NO: 1270751 - RNA, 13 nt, Mycobacterium tuberculosis H37Rv
ugacgccaacgug

SEQ ID NO: 1270752 - RNA, 16 nt, Mycobacterium tuberculosis H37Rv
ugacgcacgacugugc

SEQ ID NO: 1270753 - RNA, 19 nt, Mycobacterium tuberculosis H37Rv
ugacgaccggcuaccggcg

SEQ ID NO: 1270754 - RNA, 17 nt, Mycobacterium tuberculosis H37Rv
ugacgacgagggccagc

SEQ ID NO: 1270755 - RNA, 23 nt, Mycobacterium tuberculosis H37Rv
ugacgagccgguggcgugggcac

SEQ ID NO: 1270756 - RNA, 14 nt, Mycobacterium tuberculosis H37Rv
ugacgagccgacca

SEQ ID NO: 1270757 - RNA, 18 nt, Mycobacterium tuberculosis H37Rv
ugacgaucgagcugacga

SEQ ID NO: 1270758 - RNA, 15 nt, Mycobacterium tuberculosis H37Rv
ugacgcuaacgucga

SEQ ID NO: 1270759 - RNA, 22 nt, Mycobacterium tuberculosis H37Rv
ugacgcguucaacaccgccgac

SEQ ID NO: 1270760 - RNA, 20 nt, Mycobacterium tuberculosis H37Rv
ugacgcgucagcggcgagca

SEQ ID NO: 1270761 - RNA, 21 nt, Mycobacterium tuberculosis H37Rv
ugacgcgcgccggauacaccg

SEQ ID NO: 1270762 - RNA, 17 nt, Mycobacterium tuberculosis H37Rv
ugacgcucggucgccac

SEQ ID NO: 1270763 - RNA, 17 nt, Mycobacterium tuberculosis H37Rv
ugacggcgucgaccucg

SEQ ID NO: 1270764 - RNA, 18 nt, Mycobacterium tuberculosis H37Rv
ugacggcgcaacaccucg

SEQ ID NO: 1270765 - RNA, 20 nt, Mycobacterium tuberculosis H37Rv
ugacggcgaacccgccgaug

SEQ ID NO: 1270766 - RNA, 20 nt, Mycobacterium tuberculosis H37Rv
ugacggggcugaccgccacc

SEQ ID NO: 1270767 - RNA, 19 nt, Mycobacterium tuberculosis H37Rv
ugacggggcugaccgccac

SEQ ID NO: 1270768 - RNA, 17 nt, Mycobacterium tuberculosis H37Rv
ugacggggcugaccgcc

SEQ ID NO: 1270769 - RNA, 21 nt, Mycobacterium tuberculosis H37Rv
ugacgguccguucgaugccag

SEQ ID NO: 1270770 - RNA, 19 nt, Mycobacterium tuberculosis H37Rv
ugacggugaauucacgaug

SEQ ID NO: 1270771 - RNA, 19 nt, Mycobacterium tuberculosis H37Rv
ugacgguccacgacgucga

SEQ ID NO: 1270772 - RNA, 16 nt, Mycobacterium tuberculosis H37Rv
ugaucaccgacaccgu

SEQ ID NO: 1270773 - RNA, 16 nt, Mycobacterium tuberculosis H37Rv
ugaucgaauacaccug

SEQ ID NO: 1270774 - RNA, 18 nt, Mycobacterium tuberculosis H37Rv
ugaucgacaccgagccac

SEQ ID NO: 1270775 - RNA, 20 nt, Mycobacterium tuberculosis H37Rv
ugaucgacaccgagccacga

SEQ ID NO: 1270776 - RNA, 13 nt, Mycobacterium tuberculosis H37Rv
ugaucacaccgag

SEQ ID NO: 1270777 - RNA, 14 nt, Mycobacterium tuberculosis H37Rv
ugaucaaccggaca

SEQ ID NO: 1270778 - RNA, 20 nt, Mycobacterium tuberculosis H37Rv
ugaucaacuuccgcagcgcc

SEQ ID NO: 1270779 - RNA, 15 nt, Mycobacterium tuberculosis H37Rv
ugaucgcuggcgacc

SEQ ID NO: 1270780 - RNA, 11 nt, Mycobacterium tuberculosis H37Rv
ugaucggcaac

SEQ ID NO: 1270781 - RNA, 16 nt, Mycobacterium tuberculosis H37Rv
ugaucgcgguccaaca

SEQ ID NO: 1270782 - RNA, 19 nt, Mycobacterium tuberculosis H37Rv
ugaucgcgguccaacagcg

SEQ ID NO: 1270783 - RNA, 18 nt, Mycobacterium tuberculosis H37Rv
ugaucgccaccgguaccg

SEQ ID NO: 1270784 - RNA, 21 nt, Mycobacterium tuberculosis H37Rv
ugaucgagcagggugaccagg

SEQ ID NO: 1270785 - RNA, 21 nt, Mycobacterium tuberculosis H37Rv
ugaucggcgaacccaccgcau

SEQ ID NO: 1270786 - RNA, 18 nt, Mycobacterium tuberculosis H37Rv
ugaucgugaacacgucgc

SEQ ID NO: 1270787 - RNA, 17 nt, Mycobacterium tuberculosis H37Rv
ugaucugagcgcgggug

SEQ ID NO: 1270788 - RNA, 20 nt, Mycobacterium tuberculosis H37Rv
ugaucugccgccgcggccac

SEQ ID NO: 1270789 - RNA, 13 nt, Mycobacterium tuberculosis H37Rv
ugaucuugacggu

SEQ ID NO: 1270790 - RNA, 22 nt, Mycobacterium tuberculosis H37Rv
ugaugagggacgaacacgucua

SEQ ID NO: 1270791 - RNA, 21 nt, Mycobacterium tuberculosis H37Rv
ugaugccuuccgacgaccagg

SEQ ID NO: 1270792 - RNA, 22 nt, Mycobacterium tuberculosis H37Rv
ugagcgaacgccagugaacgcg

SEQ ID NO: 1270793 - RNA, 15 nt, Mycobacterium tuberculosis H37Rv
ugagcgccacgccga

SEQ ID NO: 1270794 - RNA, 21 nt, Mycobacterium tuberculosis H37Rv
ugagcgccaggccgcacagca

SEQ ID NO: 1270795 - RNA, 20 nt, Mycobacterium tuberculosis H37Rv
ugaggacuugcacgucggcu

SEQ ID NO: 1270796 - RNA, 20 nt, Mycobacterium tuberculosis H37Rv
ugagcgcggcgacaaucgag

SEQ ID NO: 1270797 - RNA, 20 nt, Mycobacterium tuberculosis H37Rv
ugagcgcggcuacggucgca

SEQ ID NO: 1270798 - RNA, 20 nt, Mycobacterium tuberculosis H37Rv
ugacuccugcggcaccgcug

SEQ ID NO: 1270799 - RNA, 16 nt, Mycobacterium tuberculosis H37Rv
ugacucgaucaccaug

SEQ ID NO: 1270800 - RNA, 15 nt, Mycobacterium tuberculosis H37Rv
ugacguugucgccaa

SEQ ID NO: 1270801 - RNA, 18 nt, Mycobacterium tuberculosis H37Rv
ugacguugcagccggcau

SEQ ID NO: 1270802 - RNA, 19 nt, Mycobacterium tuberculosis H37Rv
ugaguugcccguucaugcg

SEQ ID NO: 1270803 - RNA, 21 nt, Mycobacterium tuberculosis H37Rv
ugaggccgucgaacgguagca

SEQ ID NO: 1270804 - RNA, 18 nt, Mycobacterium tuberculosis H37Rv
ugaggcgcagcgccagcg

SEQ ID NO: 1270805 - RNA, 17 nt, Mycobacterium tuberculosis H37Rv
accgccuugucggcgau

SEQ ID NO: 1270806 - RNA, 13 nt, Mycobacterium tuberculosis H37Rv
accgccuugguca

SEQ ID NO: 1270807 - RNA, 21 nt, Mycobacterium tuberculosis H37Rv
accgcgaaaauucgucgcguc

SEQ ID NO: 1270808 - RNA, 20 nt, Mycobacterium tuberculosis H37Rv
accgccuuugcccgccgcgu

SEQ ID NO: 1270809 - RNA, 22 nt, Mycobacterium tuberculosis H37Rv
accgccuuugcccgccgcguca

SEQ ID NO: 1270810 - RNA, 15 nt, Mycobacterium tuberculosis H37Rv
accgccuuugcccgc

SEQ ID NO: 1270811 - RNA, 16 nt, Mycobacterium tuberculosis H37Rv
accgcgaacagcgggg

SEQ ID NO: 1270812 - RNA, 22 nt, Mycobacterium tuberculosis H37Rv
accgcgaccccugguagcaccc

SEQ ID NO: 1270813 - RNA, 17 nt, Mycobacterium tuberculosis H37Rv
accgccguugccgccuu

SEQ ID NO: 1270814 - RNA, 14 nt, Mycobacterium tuberculosis H37Rv
accgccguugccga

SEQ ID NO: 1270815 - RNA, 21 nt, Mycobacterium tuberculosis H37Rv
accgccguuaccgacgccggu

SEQ ID NO: 1270816 - RNA, 17 nt, Mycobacterium tuberculosis H37Rv
accgccgcugccgccga

SEQ ID NO: 1270817 - RNA, 20 nt, Mycobacterium tuberculosis H37Rv
accgccgcugccgccgagcu

SEQ ID NO: 1270818 - RNA, 14 nt, Mycobacterium tuberculosis H37Rv
accgccgucgccga

SEQ ID NO: 1270819 - RNA, 23 nt, Mycobacterium tuberculosis H37Rv
accgccugcaacacgcgaugcac

SEQ ID NO: 1270820 - RNA, 21 nt, Mycobacterium tuberculosis H37Rv
accgccuccucgauagcggcg

SEQ ID NO: 1270821 - RNA, 16 nt, Mycobacterium tuberculosis H37Rv
accgccucacuggacc

SEQ ID NO: 1270822 - RNA, 14 nt, Mycobacterium tuberculosis H37Rv
accgcgacggcgcc

SEQ ID NO: 1270823 - RNA, 14 nt, Mycobacterium tuberculosis H37Rv
accgcgagcagcac

SEQ ID NO: 1270824 - RNA, 14 nt, Mycobacterium tuberculosis H37Rv
accgcgaccgcgca

SEQ ID NO: 1270825 - RNA, 13 nt, Mycobacterium tuberculosis H37Rv
accgcgaccgcgc

SEQ ID NO: 1270826 - RNA, 16 nt, Mycobacterium tuberculosis H37Rv
accgcgacgagcggcc

SEQ ID NO: 1270827 - RNA, 17 nt, Mycobacterium tuberculosis H37Rv
accgcgcagaacgaucg

SEQ ID NO: 1270828 - RNA, 18 nt, Mycobacterium tuberculosis H37Rv
accgcgcaacccggacga

SEQ ID NO: 1270829 - RNA, 17 nt, Mycobacterium tuberculosis H37Rv
accgcgagggccagcaa

SEQ ID NO: 1270830 - RNA, 15 nt, Mycobacterium tuberculosis H37Rv
accgcgcaucaucgc

SEQ ID NO: 1270831 - RNA, 18 nt, Mycobacterium tuberculosis H37Rv
accgcgcaucaucgccca

SEQ ID NO: 1270832 - RNA, 16 nt, Mycobacterium tuberculosis H37Rv
accgcgcccgcgggca

SEQ ID NO: 1270833 - RNA, 19 nt, Mycobacterium tuberculosis H37Rv
accgcgcccuucagcacgg

SEQ ID NO: 1270834 - RNA, 21 nt, Mycobacterium tuberculosis H37Rv
accgcgcccgcgggcaguggc

SEQ ID NO: 1270835 - RNA, 21 nt, Mycobacterium tuberculosis H37Rv
accgcgcccuagcuggugcgc

SEQ ID NO: 1270836 - RNA, 15 nt, Mycobacterium tuberculosis H37Rv
accgcgccgaucacc

SEQ ID NO: 1270837 - RNA, 17 nt, Mycobacterium tuberculosis H37Rv
accgcgccgagcagacg

SEQ ID NO: 1270838 - RNA, 15 nt, Mycobacterium tuberculosis H37Rv
accgcgccgaacacg

SEQ ID NO: 1270839 - RNA, 13 nt, Mycobacterium tuberculosis H37Rv
accgcgccgacga

SEQ ID NO: 1270840 - RNA, 16 nt, Mycobacterium tuberculosis H37Rv
accgcgccgucgucga

SEQ ID NO: 1270841 - RNA, 21 nt, Mycobacterium tuberculosis H37Rv
accgcaucucgggcgaagccg

SEQ ID NO: 1270842 - RNA, 14 nt, Mycobacterium tuberculosis H37Rv
accgcaucgguguc

SEQ ID NO: 1270843 - RNA, 18 nt, Mycobacterium tuberculosis H37Rv
accgcaggcacaucgcga

SEQ ID NO: 1270844 - RNA, 13 nt, Mycobacterium tuberculosis H37Rv
accgcagcgggcg

SEQ ID NO: 1270845 - RNA, 13 nt, Mycobacterium tuberculosis H37Rv
accgcagcggaac

SEQ ID NO: 1270846 - RNA, 22 nt, Mycobacterium tuberculosis H37Rv
accgacgaucaacggaacaucg

SEQ ID NO: 1270847 - RNA, 14 nt, Mycobacterium tuberculosis H37Rv
accgacgaugccgc

SEQ ID NO: 1270848 - RNA, 20 nt, Mycobacterium tuberculosis H37Rv
accgcacggugaccacgccg

SEQ ID NO: 1270849 - RNA, 14 nt, Mycobacterium tuberculosis H37Rv
accgacgaucaacg

SEQ ID NO: 1270850 - RNA, 14 nt, Mycobacterium tuberculosis H37Rv
accgcagacccucg

SEQ ID NO: 1270851 - RNA, 16 nt, Mycobacterium tuberculosis H37Rv
accgcagacccucguc

SEQ ID NO: 1270852 - RNA, 21 nt, Mycobacterium tuberculosis H37Rv
accgcagacccucgucgucga

SEQ ID NO: 1270853 - RNA, 21 nt, Mycobacterium tuberculosis H37Rv
accgaccgggccgcacgguca

SEQ ID NO: 1270854 - RNA, 12 nt, Mycobacterium tuberculosis H37Rv
accgaccgcguu

SEQ ID NO: 1270855 - RNA, 22 nt, Mycobacterium tuberculosis H37Rv
accgaccuacugcggucgccca

SEQ ID NO: 1270856 - RNA, 17 nt, Mycobacterium tuberculosis H37Rv
accgaccuaccgucgac

SEQ ID NO: 1270857 - RNA, 20 nt, Mycobacterium tuberculosis H37Rv
accgacgaagaucgcugcga

SEQ ID NO: 1270858 - RNA, 21 nt, Mycobacterium tuberculosis H37Rv
accgcauucggacgccacgga

SEQ ID NO: 1270859 - RNA, 17 nt, Mycobacterium tuberculosis H37Rv
accgccaaaaacgccag

SEQ ID NO: 1270860 - RNA, 21 nt, Mycobacterium tuberculosis H37Rv
accgccgaccuagucaccuug

SEQ ID NO: 1270861 - RNA, 14 nt, Mycobacterium tuberculosis H37Rv
accgccgacgccgu

SEQ ID NO: 1270862 - RNA, 20 nt, Mycobacterium tuberculosis H37Rv
accgccgaagcugcggguca

SEQ ID NO: 1270863 - RNA, 19 nt, Mycobacterium tuberculosis H37Rv
accgccagcaugacaccgg

SEQ ID NO: 1270864 - RNA, 14 nt, Mycobacterium tuberculosis H37Rv
accgccagcgccac

SEQ ID NO: 1270865 - RNA, 19 nt, Mycobacterium tuberculosis H37Rv
accgccggcagcaucggca

SEQ ID NO: 1270866 - RNA, 20 nt, Mycobacterium tuberculosis H37Rv
accgccggcagcaucggcac

SEQ ID NO: 1270867 - RNA, 12 nt, Mycobacterium tuberculosis H37Rv
accgccggcacc

SEQ ID NO: 1270868 - RNA, 13 nt, Mycobacterium tuberculosis H37Rv
accgccgcugcca

SEQ ID NO: 1270869 - RNA, 13 nt, Mycobacterium tuberculosis H37Rv
accgccgcaucgu

SEQ ID NO: 1270870 - RNA, 22 nt, Mycobacterium tuberculosis H37Rv
accgccgauguggucggcuguc

SEQ ID NO: 1270871 - RNA, 23 nt, Mycobacterium tuberculosis H37Rv
accgccgacgccguugcccacgu

SEQ ID NO: 1270872 - RNA, 14 nt, Mycobacterium tuberculosis H37Rv
accgccgagccugc

SEQ ID NO: 1270873 - RNA, 14 nt, Mycobacterium tuberculosis H37Rv
accgccgagcgggu

SEQ ID NO: 1270874 - RNA, 16 nt, Mycobacterium tuberculosis H37Rv
accgccgauacaacgc

SEQ ID NO: 1270875 - RNA, 20 nt, Mycobacterium tuberculosis H37Rv
accgccgauacaacgcggcu

SEQ ID NO: 1270876 - RNA, 18 nt, Mycobacterium tuberculosis H37Rv
accgggggaagcgguagc

SEQ ID NO: 1270877 - RNA, 15 nt, Mycobacterium tuberculosis H37Rv
accgggucgaugacg

SEQ ID NO: 1270878 - RNA, 22 nt, Mycobacterium tuberculosis H37Rv
accggggucaccuuggccgggu

SEQ ID NO: 1270879 - RNA, 13 nt, Mycobacterium tuberculosis H37Rv
accgggucgcaac

SEQ ID NO: 1270880 - RNA, 14 nt, Mycobacterium tuberculosis H37Rv
accgggugcaggug

SEQ ID NO: 1270881 - RNA, 21 nt, Mycobacterium tuberculosis H37Rv
accgguaacgguccucgaaac

SEQ ID NO: 1270882 - RNA, 19 nt, Mycobacterium tuberculosis H37Rv
accgggucgggcaccgcgc

SEQ ID NO: 1270883 - RNA, 23 nt, Mycobacterium tuberculosis H37Rv
accgggucguagccgaacccgcc

SEQ ID NO: 1270884 - RNA, 13 nt, Mycobacterium tuberculosis H37Rv
accgggucgccga

SEQ ID NO: 1270885 - RNA, 13 nt, Mycobacterium tuberculosis H37Rv
accgggcggccaa

SEQ ID NO: 1270886 - RNA, 12 nt, Mycobacterium tuberculosis H37Rv
accgggcucugg

SEQ ID NO: 1270887 - RNA, 20 nt, Mycobacterium tuberculosis H37Rv
accgggcgugcggcggccca

SEQ ID NO: 1270888 - RNA, 18 nt, Mycobacterium tuberculosis H37Rv
accggcuggcccagcgac

SEQ ID NO: 1270889 - RNA, 21 nt, Mycobacterium tuberculosis H37Rv
accggcugcaaccagcggcac

SEQ ID NO: 1270890 - RNA, 15 nt, Mycobacterium tuberculosis H37Rv
accggcucgaucucg

SEQ ID NO: 1270891 - RNA, 22 nt, Mycobacterium tuberculosis H37Rv
accggcucggaaaccgccccgu

SEQ ID NO: 1270892 - RNA, 23 nt, Mycobacterium tuberculosis H37Rv
accggcucgucgaugucgacguc

SEQ ID NO: 1270893 - RNA, 22 nt, Mycobacterium tuberculosis H37Rv
accggcggcaucgaguucggcc

SEQ ID NO: 1270894 - RNA, 12 nt, Mycobacterium tuberculosis H37Rv
accggcggcagc

SEQ ID NO: 1270895 - RNA, 14 nt, Mycobacterium tuberculosis H37Rv
accggcggcgccga

SEQ ID NO: 1270896 - RNA, 14 nt, Mycobacterium tuberculosis H37Rv
accggcgaucgggc

SEQ ID NO: 1270897 - RNA, 21 nt, Mycobacterium tuberculosis H37Rv
accggcgcgccccgccgcacg

SEQ ID NO: 1270898 - RNA, 13 nt, Mycobacterium tuberculosis H37Rv
accggcgcgggca

SEQ ID NO: 1270899 - RNA, 23 nt, Mycobacterium tuberculosis H37Rv
accggcgcggaacgcgucgccga

SEQ ID NO: 1270900 - RNA, 21 nt, Mycobacterium tuberculosis H37Rv
accggccuucaaggaagccgc

SEQ ID NO: 1270901 - RNA, 15 nt, Mycobacterium tuberculosis H37Rv
accggccugcgcgac

SEQ ID NO: 1270902 - RNA, 15 nt, Mycobacterium tuberculosis H37Rv
accggccggugggua

SEQ ID NO: 1270903 - RNA, 16 nt, Mycobacterium tuberculosis H37Rv
accggccgucgacgca

SEQ ID NO: 1270904 - RNA, 15 nt, Mycobacterium tuberculosis H37Rv
accggccgucgacgc

SEQ ID NO: 1270905 - RNA, 21 nt, Mycobacterium tuberculosis H37Rv
accggccgggugaaccaauug

SEQ ID NO: 1270906 - RNA, 19 nt, Mycobacterium tuberculosis H37Rv
accggcacccccgucgcca

SEQ ID NO: 1270907 - RNA, 13 nt, Mycobacterium tuberculosis H37Rv
accggcacccgcg

SEQ ID NO: 1270908 - RNA, 23 nt, Mycobacterium tuberculosis H37Rv
accgcuucccccgguccggucgg

SEQ ID NO: 1270909 - RNA, 23 nt, Mycobacterium tuberculosis H37Rv
accgcugccgcugccgaagcggc

SEQ ID NO: 1270910 - RNA, 21 nt, Mycobacterium tuberculosis H37Rv
accgcugauagcggucgguca

SEQ ID NO: 1270911 - RNA, 15 nt, Mycobacterium tuberculosis H37Rv
accggaacguuccug

SEQ ID NO: 1270912 - RNA, 23 nt, Mycobacterium tuberculosis H37Rv
accggaaaccacagcgccaucag

SEQ ID NO: 1270913 - RNA, 16 nt, Mycobacterium tuberculosis H37Rv
accggaaacggucagg

SEQ ID NO: 1270914 - RNA, 20 nt, Mycobacterium tuberculosis H37Rv
accggagucggcgucgaaga

SEQ ID NO: 1270915 - RNA, 23 nt, Mycobacterium tuberculosis H37Rv
accggaucgucgaacagcaccgc

SEQ ID NO: 1270916 - RNA, 14 nt, Mycobacterium tuberculosis H37Rv
accggaucaucgcc

SEQ ID NO: 1270917 - RNA, 23 nt, Mycobacterium tuberculosis H37Rv
accggauccauuagcacaucgcc

SEQ ID NO: 1270918 - RNA, 20 nt, Mycobacterium tuberculosis H37Rv
accggcaacaucagcaggac

SEQ ID NO: 1270919 - RNA, 16 nt, Mycobacterium tuberculosis H37Rv
accggcaaucggcggc

SEQ ID NO: 1270920 - RNA, 18 nt, Mycobacterium tuberculosis H37Rv
accgcgcucucggucaga

SEQ ID NO: 1270921 - RNA, 22 nt, Mycobacterium tuberculosis H37Rv
accgcgcuguugccaucgacgc

SEQ ID NO: 1270922 - RNA, 17 nt, Mycobacterium tuberculosis H37Rv
accgcgcguugaagucg

SEQ ID NO: 1270923 - RNA, 13 nt, Mycobacterium tuberculosis H37Rv
accgcgcgucaua

SEQ ID NO: 1270924 - RNA, 17 nt, Mycobacterium tuberculosis H37Rv
accgcgcucccggcguc

SEQ ID NO: 1270925 - RNA, 16 nt, Mycobacterium tuberculosis H37Rv
accgcgcgcgacacga

SEQ ID NO: 1270926 - RNA, 20 nt, Mycobacterium tuberculosis H37Rv
accgcgcggcgcagcaccgu

SEQ ID NO: 1270927 - RNA, 21 nt, Mycobacterium tuberculosis H37Rv
accgcucgccguuauccgacg

SEQ ID NO: 1270928 - RNA, 24 nt, Mycobacterium tuberculosis H37Rv
accgcucggaguugagcugucgca

SEQ ID NO: 1270929 - RNA, 20 nt, Mycobacterium tuberculosis H37Rv
accgcguuccgggccggcga

SEQ ID NO: 1270930 - RNA, 21 nt, Mycobacterium tuberculosis H37Rv
accgcuaacagauuguccggc

SEQ ID NO: 1270931 - RNA, 15 nt, Mycobacterium tuberculosis H37Rv
accgcuaacagauug

SEQ ID NO: 1270932 - RNA, 21 nt, Mycobacterium tuberculosis H37Rv
accgcguggucggcgaacgcg

SEQ ID NO: 1270933 - RNA, 17 nt, Mycobacterium tuberculosis H37Rv
acccagcucgucgcuga

SEQ ID NO: 1270934 - RNA, 19 nt, Mycobacterium tuberculosis H37Rv
acccaggcacaacaucgcc

SEQ ID NO: 1270935 - RNA, 16 nt, Mycobacterium tuberculosis H37Rv
acccaggcacaacauc

SEQ ID NO: 1270936 - RNA, 17 nt, Mycobacterium tuberculosis H37Rv
acccagcugggucccgc

SEQ ID NO: 1270937 - RNA, 17 nt, Mycobacterium tuberculosis H37Rv
acccaggccgucgcgcc

SEQ ID NO: 1270938 - RNA, 17 nt, Mycobacterium tuberculosis H37Rv
acccagcggcgccacgu

SEQ ID NO: 1270939 - RNA, 12 nt, Mycobacterium tuberculosis H37Rv
acccagcgccga

SEQ ID NO: 1270940 - RNA, 17 nt, Mycobacterium tuberculosis H37Rv
acccagcgugcccgcca

SEQ ID NO: 1270941 - RNA, 12 nt, Mycobacterium tuberculosis H37Rv
acccagcgcagc

SEQ ID NO: 1270942 - RNA, 19 nt, Mycobacterium tuberculosis H37Rv
acccaucgaccgcccgcca

SEQ ID NO: 1270943 - RNA, 15 nt, Mycobacterium tuberculosis H37Rv
acccaucgaccgccc

SEQ ID NO: 1270944 - RNA, 19 nt, Mycobacterium tuberculosis H37Rv
acccaucaacgccggcgac

SEQ ID NO: 1270945 - RNA, 21 nt, Mycobacterium tuberculosis H37Rv
acccaguuucggcgucgucga

SEQ ID NO: 1270946 - RNA, 13 nt, Mycobacterium tuberculosis H37Rv
acccaucgaccgc

SEQ ID NO: 1270947 - RNA, 12 nt, Mycobacterium tuberculosis H37Rv
acccaguccggu

SEQ ID NO: 1270948 - RNA, 20 nt, Mycobacterium tuberculosis H37Rv
acccaguccgguagcagcgc

SEQ ID NO: 1270949 - RNA, 16 nt, Mycobacterium tuberculosis H37Rv
accaggaaguagauga

SEQ ID NO: 1270950 - RNA, 13 nt, Mycobacterium tuberculosis H37Rv
accaggaccaccg

SEQ ID NO: 1270951 - RNA, 14 nt, Mycobacterium tuberculosis H37Rv
accaggaccaccgc

SEQ ID NO: 1270952 - RNA, 17 nt, Mycobacterium tuberculosis H37Rv
accaggccagagccgcc

SEQ ID NO: 1270953 - RNA, 12 nt, Mycobacterium tuberculosis H37Rv
acccacgccgac

SEQ ID NO: 1270954 - RNA, 22 nt, Mycobacterium tuberculosis H37Rv
accaggaugguugcgacggcgu

SEQ ID NO: 1270955 - RNA, 12 nt, Mycobacterium tuberculosis H37Rv
accaggccaacg

SEQ ID NO: 1270956 - RNA, 20 nt, Mycobacterium tuberculosis H37Rv
acccagccggccugucccgc

SEQ ID NO: 1270957 - RNA, 15 nt, Mycobacterium tuberculosis H37Rv
acccagcagcggcac

SEQ ID NO: 1270958 - RNA, 19 nt, Mycobacterium tuberculosis H37Rv
acccagccagcagcggcga

SEQ ID NO: 1270959 - RNA, 23 nt, Mycobacterium tuberculosis H37Rv
acccacuuuucgguggcggcagc

SEQ ID NO: 1270960 - RNA, 17 nt, Mycobacterium tuberculosis H37Rv
acccacuggaccaccgc

SEQ ID NO: 1270961 - RNA, 13 nt, Mycobacterium tuberculosis H37Rv
acccagaccgccg

SEQ ID NO: 1270962 - RNA, 19 nt, Mycobacterium tuberculosis H37Rv
accccguuccacgaucacc

SEQ ID NO: 1270963 - RNA, 17 nt, Mycobacterium tuberculosis H37Rv
accccguccucgaucgc

SEQ ID NO: 1270964 - RNA, 17 nt, Mycobacterium tuberculosis H37Rv
accccggucccgccgac

SEQ ID NO: 1270965 - RNA, 13 nt, Mycobacterium tuberculosis H37Rv
accccggcugcgc

SEQ ID NO: 1270966 - RNA, 22 nt, Mycobacterium tuberculosis H37Rv
accccggcugcgcuucgaccga

SEQ ID NO: 1270967 - RNA, 20 nt, Mycobacterium tuberculosis H37Rv
accccgcagcucaccucaug

SEQ ID NO: 1270968 - RNA, 22 nt, Mycobacterium tuberculosis H37Rv
accccgccggcacauugaucga

SEQ ID NO: 1270969 - RNA, 16 nt, Mycobacterium tuberculosis H37Rv
accccgcgcggugccc

SEQ ID NO: 1270970 - RNA, 23 nt, Mycobacterium tuberculosis H37Rv
accccggaauccccaagcccgau

SEQ ID NO: 1270971 - RNA, 21 nt, Mycobacterium tuberculosis H37Rv
accccggaccgcggccaccgc

SEQ ID NO: 1270972 - RNA, 17 nt, Mycobacterium tuberculosis H37Rv
accccgccgaucaccgc

SEQ ID NO: 1270973 - RNA, 22 nt, Mycobacterium tuberculosis H37Rv
accccgccgccacgggugacga

SEQ ID NO: 1270974 - RNA, 12 nt, Mycobacterium tuberculosis H37Rv
accccagcuugg

SEQ ID NO: 1270975 - RNA, 16 nt, Mycobacterium tuberculosis H37Rv
acccauuucgucagcg

SEQ ID NO: 1270976 - RNA, 15 nt, Mycobacterium tuberculosis H37Rv
accccacccagcgac

SEQ ID NO: 1270977 - RNA, 15 nt, Mycobacterium tuberculosis H37Rv
accccgacgaugcgc

SEQ ID NO: 1270978 - RNA, 16 nt, Mycobacterium tuberculosis H37Rv
accccgagaccaacgc

SEQ ID NO: 1270979 - RNA, 15 nt, Mycobacterium tuberculosis H37Rv
accccgagaccucgu

SEQ ID NO: 1270980 - RNA, 15 nt, Mycobacterium tuberculosis H37Rv
accccgaacauccgc

SEQ ID NO: 1270981 - RNA, 13 nt, Mycobacterium tuberculosis H37Rv
accccccagcgac

SEQ ID NO: 1270982 - RNA, 15 nt, Mycobacterium tuberculosis H37Rv
accccauggccaccg

SEQ ID NO: 1270983 - RNA, 21 nt, Mycobacterium tuberculosis H37Rv
accgaaacgaugcggccugca

SEQ ID NO: 1270984 - RNA, 20 nt, Mycobacterium tuberculosis H37Rv
accgaaaccggucagcacau

SEQ ID NO: 1270985 - RNA, 16 nt, Mycobacterium tuberculosis H37Rv
accgaaacgaugcggc

SEQ ID NO: 1270986 - RNA, 16 nt, Mycobacterium tuberculosis H37Rv
accgaaaccggucagc

SEQ ID NO: 1270987 - RNA, 14 nt, Mycobacterium tuberculosis H37Rv
acccuuugcacggu

SEQ ID NO: 1270988 - RNA, 23 nt, Mycobacterium tuberculosis H37Rv
accgaaaagccguucgcgucgcc

SEQ ID NO: 1270989 - RNA, 22 nt, Mycobacterium tuberculosis H37Rv
acccugcccuagcccgauucug

SEQ ID NO: 1270990 - RNA, 19 nt, Mycobacterium tuberculosis H37Rv
acccugaugugaguccagc

SEQ ID NO: 1270991 - RNA, 15 nt, Mycobacterium tuberculosis H37Rv
accgaaagccgcacc

SEQ ID NO: 1270992 - RNA, 21 nt, Mycobacterium tuberculosis H37Rv
accgaaauacccagcgcagca

SEQ ID NO: 1270993 - RNA, 15 nt, Mycobacterium tuberculosis H37Rv
accgaacagcaccga

SEQ ID NO: 1270994 - RNA, 15 nt, Mycobacterium tuberculosis H37Rv
accgaacagcaccuc

SEQ ID NO: 1270995 - RNA, 15 nt, Mycobacterium tuberculosis H37Rv
accgacaucgucauc

SEQ ID NO: 1270996 - RNA, 16 nt, Mycobacterium tuberculosis H37Rv
accgacaucgucaucc

SEQ ID NO: 1270997 - RNA, 22 nt, Mycobacterium tuberculosis H37Rv
accgacauguguggcagcccca

SEQ ID NO: 1270998 - RNA, 14 nt, Mycobacterium tuberculosis H37Rv
accgacagcggcac

SEQ ID NO: 1270999 - RNA, 22 nt, Mycobacterium tuberculosis H37Rv
accgacagccccaucaccaccg

SEQ ID NO: 1271000 - RNA, 18 nt, Mycobacterium tuberculosis H37Rv
acccggcggacgacgucg

SEQ ID NO: 1271001 - RNA, 19 nt, Mycobacterium tuberculosis H37Rv
acccggcgggcggugggca

SEQ ID NO: 1271002 - RNA, 15 nt, Mycobacterium tuberculosis H37Rv
acccggcgucgacga

SEQ ID NO: 1271003 - RNA, 21 nt, Mycobacterium tuberculosis H37Rv
acccggcgggcggugggcagc

SEQ ID NO: 1271004 - RNA, 19 nt, Mycobacterium tuberculosis H37Rv
acccggcgcaacaaccggu

SEQ ID NO: 1271005 - RNA, 15 nt, Mycobacterium tuberculosis H37Rv
acccggcgcgauggc

SEQ ID NO: 1271006 - RNA, 12 nt, Mycobacterium tuberculosis H37Rv
acccggcgcagc

SEQ ID NO: 1271007 - RNA, 18 nt, Mycobacterium tuberculosis H37Rv
acccggcgcagcaacgca

SEQ ID NO: 1271008 - RNA, 20 nt, Mycobacterium tuberculosis H37Rv
acccggcgauuggaccgcca

SEQ ID NO: 1271009 - RNA, 21 nt, Mycobacterium tuberculosis H37Rv
acccggccguugggccaccgg

SEQ ID NO: 1271010 - RNA, 22 nt, Mycobacterium tuberculosis H37Rv
acccggcccauugucgaucacc

SEQ ID NO: 1271011 - RNA, 22 nt, Mycobacterium tuberculosis H37Rv
acccggccagguauguccgcca

SEQ ID NO: 1271012 - RNA, 21 nt, Mycobacterium tuberculosis H37Rv
acccggcccauugucgaucac

SEQ ID NO: 1271013 - RNA, 18 nt, Mycobacterium tuberculosis H37Rv
acccgucuuaucggcguc

SEQ ID NO: 1271014 - RNA, 16 nt, Mycobacterium tuberculosis H37Rv
acccguguggcacgug

SEQ ID NO: 1271015 - RNA, 16 nt, Mycobacterium tuberculosis H37Rv
acccucgccggucagc

SEQ ID NO: 1271016 - RNA, 14 nt, Mycobacterium tuberculosis H37Rv
acccucgucgucga

SEQ ID NO: 1271017 - RNA, 20 nt, Mycobacterium tuberculosis H37Rv
acccgugccgccgaugccgc

SEQ ID NO: 1271018 - RNA, 13 nt, Mycobacterium tuberculosis H37Rv
acccgugccguca

SEQ ID NO: 1271019 - RNA, 18 nt, Mycobacterium tuberculosis H37Rv
acccggcuccagcaccgu

SEQ ID NO: 1271020 - RNA, 12 nt, Mycobacterium tuberculosis H37Rv
acccgucaccgc

SEQ ID NO: 1271021 - RNA, 16 nt, Mycobacterium tuberculosis H37Rv
acccgucgagcagcau

SEQ ID NO: 1271022 - RNA, 16 nt, Mycobacterium tuberculosis H37Rv
acccggcacccaguuc

SEQ ID NO: 1271023 - RNA, 16 nt, Mycobacterium tuberculosis H37Rv
acccggcagagcacgc

SEQ ID NO: 1271024 - RNA, 17 nt, Mycobacterium tuberculosis H37Rv
acccggauaucgaccac

SEQ ID NO: 1271025 - RNA, 15 nt, Mycobacterium tuberculosis H37Rv
acccggaagaacucg

SEQ ID NO: 1271026 - RNA, 16 nt, Mycobacterium tuberculosis H37Rv
acccggacgaacgccg

SEQ ID NO: 1271027 - RNA, 19 nt, Mycobacterium tuberculosis H37Rv
acccggaggcaauccgauc

SEQ ID NO: 1271028 - RNA, 23 nt, Mycobacterium tuberculosis H37Rv
acccggaccugggcgacuaccgg

SEQ ID NO: 1271029 - RNA, 17 nt, Mycobacterium tuberculosis H37Rv
acccggagaaucggucc

SEQ ID NO: 1271030 - RNA, 14 nt, Mycobacterium tuberculosis H37Rv
acccgcgucgagug

SEQ ID NO: 1271031 - RNA, 17 nt, Mycobacterium tuberculosis H37Rv
acccgcucacgcucacc

SEQ ID NO: 1271032 - RNA, 16 nt, Mycobacterium tuberculosis H37Rv
acccgccgucaccgcg

SEQ ID NO: 1271033 - RNA, 21 nt, Mycobacterium tuberculosis H37Rv
acccgccgcgguuaucgccga

SEQ ID NO: 1271034 - RNA, 18 nt, Mycobacterium tuberculosis H37Rv
acccgccggccgucggcc

SEQ ID NO: 1271035 - RNA, 21 nt, Mycobacterium tuberculosis H37Rv
acccgccgaugaugcggcgca

SEQ ID NO: 1271036 - RNA, 14 nt, Mycobacterium tuberculosis H37Rv
acccgccgaugccg

SEQ ID NO: 1271037 - RNA, 16 nt, Mycobacterium tuberculosis H37Rv
acccgccgaugccgcc

SEQ ID NO: 1271038 - RNA, 18 nt, Mycobacterium tuberculosis H37Rv
acccgcccauucccauau

SEQ ID NO: 1271039 - RNA, 17 nt, Mycobacterium tuberculosis H37Rv
acccgcccggaacgggu

SEQ ID NO: 1271040 - RNA, 16 nt, Mycobacterium tuberculosis H37Rv
acccgccgacgaccgc

SEQ ID NO: 1271041 - RNA, 21 nt, Mycobacterium tuberculosis H37Rv
accccugguagcacccacggc

SEQ ID NO: 1271042 - RNA, 22 nt, Mycobacterium tuberculosis H37Rv
accccugguagcacccacggcg

SEQ ID NO: 1271043 - RNA, 13 nt, Mycobacterium tuberculosis H37Rv
accccucgaccga

SEQ ID NO: 1271044 - RNA, 12 nt, Mycobacterium tuberculosis H37Rv
acccgcaucggc

SEQ ID NO: 1271045 - RNA, 18 nt, Mycobacterium tuberculosis H37Rv
acccgcauccacgucgcc

SEQ ID NO: 1271046 - RNA, 14 nt, Mycobacterium tuberculosis H37Rv
acccgaagccggcg

SEQ ID NO: 1271047 - RNA, 14 nt, Mycobacterium tuberculosis H37Rv
acacucccauccgc

SEQ ID NO: 1271048 - RNA, 12 nt, Mycobacterium tuberculosis H37Rv
acacucgcagca

SEQ ID NO: 1271049 - RNA, 20 nt, Mycobacterium tuberculosis H37Rv
acacggcgacauacccgauc

SEQ ID NO: 1271050 - RNA, 13 nt, Mycobacterium tuberculosis H37Rv
acagcaccgccgg

SEQ ID NO: 1271051 - RNA, 14 nt, Mycobacterium tuberculosis H37Rv
acagcaccgcgacg

SEQ ID NO: 1271052 - RNA, 20 nt, Mycobacterium tuberculosis H37Rv
acagcaccguccucggucac

SEQ ID NO: 1271053 - RNA, 17 nt, Mycobacterium tuberculosis H37Rv
acagcaccguccucggu

SEQ ID NO: 1271054 - RNA, 21 nt, Mycobacterium tuberculosis H37Rv
acagcacgacugcggcaaacg

SEQ ID NO: 1271055 - RNA, 15 nt, Mycobacterium tuberculosis H37Rv
acagccaccagccgg

SEQ ID NO: 1271056 - RNA, 14 nt, Mycobacterium tuberculosis H37Rv
acagccgucgcacc

SEQ ID NO: 1271057 - RNA, 13 nt, Mycobacterium tuberculosis H37Rv
acagcccgaugcc

SEQ ID NO: 1271058 - RNA, 18 nt, Mycobacterium tuberculosis H37Rv
acagccccaucaccaccg

SEQ ID NO: 1271059 - RNA, 21 nt, Mycobacterium tuberculosis H37Rv
acagcccgaacgaggcgccca

SEQ ID NO: 1271060 - RNA, 20 nt, Mycobacterium tuberculosis H37Rv
acagcgaacagacaugcgca

SEQ ID NO: 1271061 - RNA, 14 nt, Mycobacterium tuberculosis H37Rv
acagcgaucgccgc

SEQ ID NO: 1271062 - RNA, 15 nt, Mycobacterium tuberculosis H37Rv
acagcgaaccgccgg

SEQ ID NO: 1271063 - RNA, 22 nt, Mycobacterium tuberculosis H37Rv
acagcgccaucgaugcggugaa

SEQ ID NO: 1271064 - RNA, 13 nt, Mycobacterium tuberculosis H37Rv
acagcgacgccau

SEQ ID NO: 1271065 - RNA, 22 nt, Mycobacterium tuberculosis H37Rv
acagcgccaugcccucggcgcc

SEQ ID NO: 1271066 - RNA, 15 nt, Mycobacterium tuberculosis H37Rv
acagcggaccgauug

SEQ ID NO: 1271067 - RNA, 13 nt, Mycobacterium tuberculosis H37Rv
acagcgcugggcc

SEQ ID NO: 1271068 - RNA, 13 nt, Mycobacterium tuberculosis H37Rv
acagcgcgcgcuc

SEQ ID NO: 1271069 - RNA, 20 nt, Mycobacterium tuberculosis H37Rv
acacgagucgccagaccgca

SEQ ID NO: 1271070 - RNA, 20 nt, Mycobacterium tuberculosis H37Rv
acacgagcaugcuggaccuc

SEQ ID NO: 1271071 - RNA, 18 nt, Mycobacterium tuberculosis H37Rv
acaccgugucgccggcga

SEQ ID NO: 1271072 - RNA, 19 nt, Mycobacterium tuberculosis H37Rv
acaccgugcaccagcucac

SEQ ID NO: 1271073 - RNA, 13 nt, Mycobacterium tuberculosis H37Rv
acaccgugaccgc

SEQ ID NO: 1271074 - RNA, 19 nt, Mycobacterium tuberculosis H37Rv
acaccguccagcagcucgg

SEQ ID NO: 1271075 - RNA, 18 nt, Mycobacterium tuberculosis H37Rv
acaccgacucgcaauugc

SEQ ID NO: 1271076 - RNA, 17 nt, Mycobacterium tuberculosis H37Rv
acaccggucggcagcuu

SEQ ID NO: 1271077 - RNA, 21 nt, Mycobacterium tuberculosis H37Rv
acacgcuguacaagcauuggc

SEQ ID NO: 1271078 - RNA, 12 nt, Mycobacterium tuberculosis H37Rv
acacgccgucga

SEQ ID NO: 1271079 - RNA, 15 nt, Mycobacterium tuberculosis H37Rv
acacgcccgcgagcu

SEQ ID NO: 1271080 - RNA, 18 nt, Mycobacterium tuberculosis H37Rv
acacagcccacaggcggc

SEQ ID NO: 1271081 - RNA, 19 nt, Mycobacterium tuberculosis H37Rv
acacaccgcauaaggccca

SEQ ID NO: 1271082 - RNA, 21 nt, Mycobacterium tuberculosis H37Rv
acacaccgaacagucgcagcc

SEQ ID NO: 1271083 - RNA, 15 nt, Mycobacterium tuberculosis H37Rv
acaccgccagcucac

SEQ ID NO: 1271084 - RNA, 17 nt, Mycobacterium tuberculosis H37Rv
acaccgcccgacccauc

SEQ ID NO: 1271085 - RNA, 19 nt, Mycobacterium tuberculosis H37Rv
acaccgccgaccuagucac

SEQ ID NO: 1271086 - RNA, 21 nt, Mycobacterium tuberculosis H37Rv
acaccgcggacccgcagcugc

SEQ ID NO: 1271087 - RNA, 16 nt, Mycobacterium tuberculosis H37Rv
acaccgcaacgcgugc

SEQ ID NO: 1271088 - RNA, 20 nt, Mycobacterium tuberculosis H37Rv
acaccgcauaaaucgggguu

SEQ ID NO: 1271089 - RNA, 20 nt, Mycobacterium tuberculosis H37Rv
acaccgccagcggcaauggc

SEQ ID NO: 1271090 - RNA, 18 nt, Mycobacterium tuberculosis H37Rv
acaaccgugaacucgcgc

SEQ ID NO: 1271091 - RNA, 18 nt, Mycobacterium tuberculosis H37Rv
acaaccccgaggcaacaa

SEQ ID NO: 1271092 - RNA, 12 nt, Mycobacterium tuberculosis H37Rv
acaacaucgcca

SEQ ID NO: 1271093 - RNA, 13 nt, Mycobacterium tuberculosis H37Rv
acaacaucgaauc

SEQ ID NO: 1271094 - RNA, 14 nt, Mycobacterium tuberculosis H37Rv
acaacagcgcucca

SEQ ID NO: 1271095 - RNA, 21 nt, Mycobacterium tuberculosis H37Rv
acaaagcugcucgucggcgcc

SEQ ID NO: 1271096 - RNA, 13 nt, Mycobacterium tuberculosis H37Rv
acaaaucggcggu

SEQ ID NO: 1271097 - RNA, 17 nt, Mycobacterium tuberculosis H37Rv
acaacaccaccagcacg

SEQ ID NO: 1271098 - RNA, 13 nt, Mycobacterium tuberculosis H37Rv
acaaacaucgcac

SEQ ID NO: 1271099 - RNA, 13 nt, Mycobacterium tuberculosis H37Rv
acaaacagcgcca

SEQ ID NO: 1271100 - RNA, 22 nt, Mycobacterium tuberculosis H37Rv
acaaggccgccgccgucggcga

SEQ ID NO: 1271101 - RNA, 13 nt, Mycobacterium tuberculosis H37Rv
acaaguccgcgau

SEQ ID NO: 1271102 - RNA, 16 nt, Mycobacterium tuberculosis H37Rv
acaagccgugcagcuc

SEQ ID NO: 1271103 - RNA, 12 nt, Mycobacterium tuberculosis H37Rv
acaagaccgcgg

SEQ ID NO: 1271104 - RNA, 13 nt, Mycobacterium tuberculosis H37Rv
acaacgucgccgc

SEQ ID NO: 1271105 - RNA, 15 nt, Mycobacterium tuberculosis H37Rv
acaacgaugucaccc

SEQ ID NO: 1271106 - RNA, 17 nt, Mycobacterium tuberculosis H37Rv
acaacgacuccuggcga

SEQ ID NO: 1271107 - RNA, 17 nt, Mycobacterium tuberculosis H37Rv
acaacgcuucggcgugc

SEQ ID NO: 1271108 - RNA, 14 nt, Mycobacterium tuberculosis H37Rv
acaacugcccgaug

SEQ ID NO: 1271109 - RNA, 22 nt, Mycobacterium tuberculosis H37Rv
acaacuaucgucgugucgccgc

SEQ ID NO: 1271110 - RNA, 19 nt, Mycobacterium tuberculosis H37Rv
acaacguggugucucggcu

SEQ ID NO: 1271111 - RNA, 16 nt, Mycobacterium tuberculosis H37Rv
acaaugacucggccgc

SEQ ID NO: 1271112 - RNA, 17 nt, Mycobacterium tuberculosis H37Rv
acaaugacucggccgca

SEQ ID NO: 1271113 - RNA, 19 nt, Mycobacterium tuberculosis H37Rv
acacaacgggugucggcgu

SEQ ID NO: 1271114 - RNA, 13 nt, Mycobacterium tuberculosis H37Rv
acacaaacgccgc

SEQ ID NO: 1271115 - RNA, 14 nt, Mycobacterium tuberculosis H37Rv
acaaucucggcguu

SEQ ID NO: 1271116 - RNA, 13 nt, Mycobacterium tuberculosis H37Rv
acaaucggugguc

SEQ ID NO: 1271117 - RNA, 20 nt, Mycobacterium tuberculosis H37Rv
acaauccacgucgcggcguu

SEQ ID NO: 1271118 - RNA, 15 nt, Mycobacterium tuberculosis H37Rv
accacggcggccacc

SEQ ID NO: 1271119 - RNA, 13 nt, Mycobacterium tuberculosis H37Rv
accacggcgcgca

SEQ ID NO: 1271120 - RNA, 20 nt, Mycobacterium tuberculosis H37Rv
accacgguagacaagucggc

SEQ ID NO: 1271121 - RNA, 23 nt, Mycobacterium tuberculosis H37Rv
accacgguagacaagucggcgcu

SEQ ID NO: 1271122 - RNA, 14 nt, Mycobacterium tuberculosis H37Rv
accacggcaccgau

SEQ ID NO: 1271123 - RNA, 22 nt, Mycobacterium tuberculosis H37Rv
accaccuguccgguggaaucca

SEQ ID NO: 1271124 - RNA, 13 nt, Mycobacterium tuberculosis H37Rv
accacggcgcagu

SEQ ID NO: 1271125 - RNA, 22 nt, Mycobacterium tuberculosis H37Rv
accacggcgauccggucggcca

SEQ ID NO: 1271126 - RNA, 14 nt, Mycobacterium tuberculosis H37Rv
accacggcgauccg

SEQ ID NO: 1271127 - RNA, 20 nt, Mycobacterium tuberculosis H37Rv
accaccguugccgccgucac

SEQ ID NO: 1271128 - RNA, 21 nt, Mycobacterium tuberculosis H37Rv
accaccguugccgccgucacc

SEQ ID NO: 1271129 - RNA, 23 nt, Mycobacterium tuberculosis H37Rv
accaccguugccgccgucaccgc

SEQ ID NO: 1271130 - RNA, 16 nt, Mycobacterium tuberculosis H37Rv
accaccguuugagcgg

SEQ ID NO: 1271131 - RNA, 21 nt, Mycobacterium tuberculosis H37Rv
accaccuggugcaaccgugcc

SEQ ID NO: 1271132 - RNA, 18 nt, Mycobacterium tuberculosis H37Rv
accaccuggugcaaccgu

SEQ ID NO: 1271133 - RNA, 13 nt, Mycobacterium tuberculosis H37Rv
accaccugcugca

SEQ ID NO: 1271134 - RNA, 16 nt, Mycobacterium tuberculosis H37Rv
accaccgucucgccgc

SEQ ID NO: 1271135 - RNA, 14 nt, Mycobacterium tuberculosis H37Rv
accaccgucaccgc

SEQ ID NO: 1271136 - RNA, 12 nt, Mycobacterium tuberculosis H37Rv
accaccgucacc

SEQ ID NO: 1271137 - RNA, 14 nt, Mycobacterium tuberculosis H37Rv
accaccgucgagcc

SEQ ID NO: 1271138 - RNA, 18 nt, Mycobacterium tuberculosis H37Rv
accaccgggccgacagca

SEQ ID NO: 1271139 - RNA, 21 nt, Mycobacterium tuberculosis H37Rv
accaccggccccaccggcacc

SEQ ID NO: 1271140 - RNA, 23 nt, Mycobacterium tuberculosis H37Rv
accaccggcgccccugucgaccg

SEQ ID NO: 1271141 - RNA, 15 nt, Mycobacterium tuberculosis H37Rv
accacccacccgcac

SEQ ID NO: 1271142 - RNA, 18 nt, Mycobacterium tuberculosis H37Rv
accaccccagcggccacc

SEQ ID NO: 1271143 - RNA, 21 nt, Mycobacterium tuberculosis H37Rv
accaccaguaccaccggcacc

SEQ ID NO: 1271144 - RNA, 13 nt, Mycobacterium tuberculosis H37Rv
accacccaacagc

SEQ ID NO: 1271145 - RNA, 17 nt, Mycobacterium tuberculosis H37Rv
accaccgcugagccggu

SEQ ID NO: 1271146 - RNA, 20 nt, Mycobacterium tuberculosis H37Rv
accaccggccccaccggcac

SEQ ID NO: 1271147 - RNA, 18 nt, Mycobacterium tuberculosis H37Rv
accaaugaccgccagcag

SEQ ID NO: 1271148 - RNA, 13 nt, Mycobacterium tuberculosis H37Rv
accacaccgugac

SEQ ID NO: 1271149 - RNA, 13 nt, Mycobacterium tuberculosis H37Rv
accacaucaccgg

SEQ ID NO: 1271150 - RNA, 14 nt, Mycobacterium tuberculosis H37Rv
accacaucaccggc

SEQ ID NO: 1271151 - RNA, 21 nt, Mycobacterium tuberculosis H37Rv
accacaucgcgggcgugccga

SEQ ID NO: 1271152 - RNA, 17 nt, Mycobacterium tuberculosis H37Rv
accaccaccgccgccga

SEQ ID NO: 1271153 - RNA, 13 nt, Mycobacterium tuberculosis H37Rv
accaccacccgga

SEQ ID NO: 1271154 - RNA, 17 nt, Mycobacterium tuberculosis H37Rv
accagcucagcugcgga

SEQ ID NO: 1271155 - RNA, 19 nt, Mycobacterium tuberculosis H37Rv
accagcugcucgucgucga

SEQ ID NO: 1271156 - RNA, 16 nt, Mycobacterium tuberculosis H37Rv
accagcuugaccgacc

SEQ ID NO: 1271157 - RNA, 18 nt, Mycobacterium tuberculosis H37Rv
accagcuguugucgcgga

SEQ ID NO: 1271158 - RNA, 18 nt, Mycobacterium tuberculosis H37Rv
accagcgucgcggccacg

SEQ ID NO: 1271159 - RNA, 22 nt, Mycobacterium tuberculosis H37Rv
accagcguguggagcucgcggc

SEQ ID NO: 1271160 - RNA, 17 nt, Mycobacterium tuberculosis H37Rv
accagcggucagccggc

SEQ ID NO: 1271161 - RNA, 17 nt, Mycobacterium tuberculosis H37Rv
accagcgggcaucgcga

SEQ ID NO: 1271162 - RNA, 19 nt, Mycobacterium tuberculosis H37Rv
accagcggggucuugacgg

SEQ ID NO: 1271163 - RNA, 18 nt, Mycobacterium tuberculosis H37Rv
accagccgguagccgggc

SEQ ID NO: 1271164 - RNA, 24 nt, Mycobacterium tuberculosis H37Rv
accagccggugagcgagcgcgcgu

SEQ ID NO: 1271165 - RNA, 14 nt, Mycobacterium tuberculosis H37Rv
accagccgucagcg

SEQ ID NO: 1271166 - RNA, 15 nt, Mycobacterium tuberculosis H37Rv
accagccgucagcgc

SEQ ID NO: 1271167 - RNA, 16 nt, Mycobacterium tuberculosis H37Rv
accagccgucguccgc

SEQ ID NO: 1271168 - RNA, 20 nt, Mycobacterium tuberculosis H37Rv
accagcccggccggucgaga

SEQ ID NO: 1271169 - RNA, 17 nt, Mycobacterium tuberculosis H37Rv
accagcccggccgccga

SEQ ID NO: 1271170 - RNA, 22 nt, Mycobacterium tuberculosis H37Rv
accagcgacgccaugucgaugu

SEQ ID NO: 1271171 - RNA, 17 nt, Mycobacterium tuberculosis H37Rv
accagaaccuggagccg

SEQ ID NO: 1271172 - RNA, 14 nt, Mycobacterium tuberculosis H37Rv
accagaacgacgcc

SEQ ID NO: 1271173 - RNA, 13 nt, Mycobacterium tuberculosis H37Rv
accagcagcacca

SEQ ID NO: 1271174 - RNA, 22 nt, Mycobacterium tuberculosis H37Rv
accagcagauccaggcgucggu

SEQ ID NO: 1271175 - RNA, 22 nt, Mycobacterium tuberculosis H37Rv
accagcaggccgggcgcaagca

SEQ ID NO: 1271176 - RNA, 19 nt, Mycobacterium tuberculosis H37Rv
accagcaggcggcucaacc

SEQ ID NO: 1271177 - RNA, 14 nt, Mycobacterium tuberculosis H37Rv
accacugaucggca

SEQ ID NO: 1271178 - RNA, 15 nt, Mycobacterium tuberculosis H37Rv
accacugaucggcau

SEQ ID NO: 1271179 - RNA, 16 nt, Mycobacterium tuberculosis H37Rv
accacugcacccgauc

SEQ ID NO: 1271180 - RNA, 23 nt, Mycobacterium tuberculosis H37Rv
accacuggcgguguaacccggaa

SEQ ID NO: 1271181 - RNA, 18 nt, Mycobacterium tuberculosis H37Rv
accacuuuccggccgaug

SEQ ID NO: 1271182 - RNA, 13 nt, Mycobacterium tuberculosis H37Rv
accacuucggcgu

SEQ ID NO: 1271183 - RNA, 14 nt, Mycobacterium tuberculosis H37Rv
accacuucggcguc

SEQ ID NO: 1271184 - RNA, 17 nt, Mycobacterium tuberculosis H37Rv
accacucggcggccacc

SEQ ID NO: 1271185 - RNA, 23 nt, Mycobacterium tuberculosis H37Rv
accacuccacgcagcccgucggc

SEQ ID NO: 1271186 - RNA, 13 nt, Mycobacterium tuberculosis H37Rv
accaaaccgccgg

SEQ ID NO: 1271187 - RNA, 15 nt, Mycobacterium tuberculosis H37Rv
accaaagcgacgagc

SEQ ID NO: 1271188 - RNA, 18 nt, Mycobacterium tuberculosis H37Rv
accaaagcugucgaccgc

SEQ ID NO: 1271189 - RNA, 14 nt, Mycobacterium tuberculosis H37Rv
accaacaccgcggc

SEQ ID NO: 1271190 - RNA, 20 nt, Mycobacterium tuberculosis H37Rv
accaacauguugucgucgcc

SEQ ID NO: 1271191 - RNA, 17 nt, Mycobacterium tuberculosis H37Rv
accaaccugcgcggcga

SEQ ID NO: 1271192 - RNA, 22 nt, Mycobacterium tuberculosis H37Rv
accaacgccaacgccacggcaa

SEQ ID NO: 1271193 - RNA, 22 nt, Mycobacterium tuberculosis H37Rv
accaacauguugucgucgccgc

SEQ ID NO: 1271194 - RNA, 24 nt, Mycobacterium tuberculosis H37Rv
accaacccucgccggucagcgugc

SEQ ID NO: 1271195 - RNA, 20 nt, Mycobacterium tuberculosis H37Rv
accaacucguggaacuccgu

SEQ ID NO: 1271196 - RNA, 16 nt, Mycobacterium tuberculosis H37Rv
accaacgcgaccgcau

SEQ ID NO: 1271197 - RNA, 18 nt, Mycobacterium tuberculosis H37Rv
accaaggacgaacgcgcc

SEQ ID NO: 1271198 - RNA, 19 nt, Mycobacterium tuberculosis H37Rv
accaagcccgucgucgugc

SEQ ID NO: 1271199 - RNA, 14 nt, Mycobacterium tuberculosis H37Rv
accaaggucggcga

SEQ ID NO: 1271200 - RNA, 16 nt, Mycobacterium tuberculosis H37Rv
acaugagcgucgcuga

SEQ ID NO: 1271201 - RNA, 15 nt, Mycobacterium tuberculosis H37Rv
acaucugccggucga

SEQ ID NO: 1271202 - RNA, 11 nt, Mycobacterium tuberculosis H37Rv
acauugcccgu

SEQ ID NO: 1271203 - RNA, 12 nt, Mycobacterium tuberculosis H37Rv
acauugccaccg

SEQ ID NO: 1271204 - RNA, 19 nt, Mycobacterium tuberculosis H37Rv
acauuggccaggucggcca

SEQ ID NO: 1271205 - RNA, 18 nt, Mycobacterium tuberculosis H37Rv
acauuggugaggugguca

SEQ ID NO: 1271206 - RNA, 22 nt, Mycobacterium tuberculosis H37Rv
acaguaggccuccgcugccgcc

SEQ ID NO: 1271207 - RNA, 23 nt, Mycobacterium tuberculosis H37Rv
acagucgugagccagcuugcgca

SEQ ID NO: 1271208 - RNA, 14 nt, Mycobacterium tuberculosis H37Rv
acagucgcgcgcuc

SEQ ID NO: 1271209 - RNA, 19 nt, Mycobacterium tuberculosis H37Rv
acagcgguccagccaccgc

SEQ ID NO: 1271210 - RNA, 23 nt, Mycobacterium tuberculosis H37Rv
acagugcugccuugggaccgcgc

SEQ ID NO: 1271211 - RNA, 18 nt, Mycobacterium tuberculosis H37Rv
acaguucggcgagcacau

SEQ ID NO: 1271212 - RNA, 16 nt, Mycobacterium tuberculosis H37Rv
acaucgucaucagcgc

SEQ ID NO: 1271213 - RNA, 17 nt, Mycobacterium tuberculosis H37Rv
acaucguucugacggcu

SEQ ID NO: 1271214 - RNA, 20 nt, Mycobacterium tuberculosis H37Rv
acaucguaggccggcauggc

SEQ ID NO: 1271215 - RNA, 16 nt, Mycobacterium tuberculosis H37Rv
acauccuugacgcggc

SEQ ID NO: 1271216 - RNA, 13 nt, Mycobacterium tuberculosis H37Rv
acauccuggcggc

SEQ ID NO: 1271217 - RNA, 10 nt, Mycobacterium tuberculosis H37Rv
acaucccgga

SEQ ID NO: 1271218 - RNA, 13 nt, Mycobacterium tuberculosis H37Rv
acauaggcgaucg

SEQ ID NO: 1271219 - RNA, 23 nt, Mycobacterium tuberculosis H37Rv
acauccaggcuguggccagcauc

SEQ ID NO: 1271220 - RNA, 19 nt, Mycobacterium tuberculosis H37Rv
acauacgagcagugaccgc

SEQ ID NO: 1271221 - RNA, 18 nt, Mycobacterium tuberculosis H37Rv
acggcacccccgacgaga

SEQ ID NO: 1271222 - RNA, 21 nt, Mycobacterium tuberculosis H37Rv
acggauuguccgggaccgcga

SEQ ID NO: 1271223 - RNA, 18 nt, Mycobacterium tuberculosis H37Rv
acggcacccugcggcacc

SEQ ID NO: 1271224 - RNA, 18 nt, Mycobacterium tuberculosis H37Rv
acggaugcgauggccgac

SEQ ID NO: 1271225 - RNA, 20 nt, Mycobacterium tuberculosis H37Rv
acggaugcggccggugauga

SEQ ID NO: 1271226 - RNA, 12 nt, Mycobacterium tuberculosis H37Rv
acggaucgcggc

SEQ ID NO: 1271227 - RNA, 17 nt, Mycobacterium tuberculosis H37Rv
acgcuugcggcugccca

SEQ ID NO: 1271228 - RNA, 17 nt, Mycobacterium tuberculosis H37Rv
acgcuuucccgaugacg

SEQ ID NO: 1271229 - RNA, 15 nt, Mycobacterium tuberculosis H37Rv
acgcuuuccggcggu

SEQ ID NO: 1271230 - RNA, 19 nt, Mycobacterium tuberculosis H37Rv
acgcuggcgcccccgacga

SEQ ID NO: 1271231 - RNA, 19 nt, Mycobacterium tuberculosis H37Rv
acgcuggccuccagcuugg

SEQ ID NO: 1271232 - RNA, 22 nt, Mycobacterium tuberculosis H37Rv
acgcuggcguuguugacgauca

SEQ ID NO: 1271233 - RNA, 14 nt, Mycobacterium tuberculosis H37Rv
acgcuggcguuguu

SEQ ID NO: 1271234 - RNA, 18 nt, Mycobacterium tuberculosis H37Rv
acgcggccucgucgaguu

SEQ ID NO: 1271235 - RNA, 22 nt, Mycobacterium tuberculosis H37Rv
acgcuggaacuuggcgucgaca

SEQ ID NO: 1271236 - RNA, 21 nt, Mycobacterium tuberculosis H37Rv
acgcuggccacgauccgcggu

SEQ ID NO: 1271237 - RNA, 12 nt, Mycobacterium tuberculosis H37Rv
acgcggccaacg

SEQ ID NO: 1271238 - RNA, 20 nt, Mycobacterium tuberculosis H37Rv
acgcggccaacgaacgugcc

SEQ ID NO: 1271239 - RNA, 16 nt, Mycobacterium tuberculosis H37Rv
acgcggccagcggcaa

SEQ ID NO: 1271240 - RNA, 23 nt, Mycobacterium tuberculosis H37Rv
acgcgcguuuagucuccggcguc

SEQ ID NO: 1271241 - RNA, 20 nt, Mycobacterium tuberculosis H37Rv
acgcgcucgcgcaagcggac

SEQ ID NO: 1271242 - RNA, 18 nt, Mycobacterium tuberculosis H37Rv
acggcagcaccggugacc

SEQ ID NO: 1271243 - RNA, 22 nt, Mycobacterium tuberculosis H37Rv
acggcauagcagccagcgucca

SEQ ID NO: 1271244 - RNA, 21 nt, Mycobacterium tuberculosis H37Rv
acggcagccaccagcgacgac

SEQ ID NO: 1271245 - RNA, 21 nt, Mycobacterium tuberculosis H37Rv
acggcagcgccggucggaucg

SEQ ID NO: 1271246 - RNA, 23 nt, Mycobacterium tuberculosis H37Rv
acggcagcgccggucggaucggu

SEQ ID NO: 1271247 - RNA, 15 nt, Mycobacterium tuberculosis H37Rv
acggccaccaggugc

SEQ ID NO: 1271248 - RNA, 18 nt, Mycobacterium tuberculosis H37Rv
acggccaccggggucacc

SEQ ID NO: 1271249 - RNA, 16 nt, Mycobacterium tuberculosis H37Rv
acggccaucgccagcc

SEQ ID NO: 1271250 - RNA, 14 nt, Mycobacterium tuberculosis H37Rv
acggcccgaucccg

SEQ ID NO: 1271251 - RNA, 24 nt, Mycobacterium tuberculosis H37Rv
acggcccgaucccgaucgaucagc

SEQ ID NO: 1271252 - RNA, 11 nt, Mycobacterium tuberculosis H37Rv
acggcccgcau

SEQ ID NO: 1271253 - RNA, 18 nt, Mycobacterium tuberculosis H37Rv
acggcccgaucccgaucg

SEQ ID NO: 1271254 - RNA, 14 nt, Mycobacterium tuberculosis H37Rv
acggcccgccgucc

SEQ ID NO: 1271255 - RNA, 17 nt, Mycobacterium tuberculosis H37Rv
acggccaggacaacgca

SEQ ID NO: 1271256 - RNA, 16 nt, Mycobacterium tuberculosis H37Rv
acggccaggucgacgg

SEQ ID NO: 1271257 - RNA, 22 nt, Mycobacterium tuberculosis H37Rv
acggccauauugggaguccggc

SEQ ID NO: 1271258 - RNA, 21 nt, Mycobacterium tuberculosis H37Rv
acggccgcucgggccagcgau

SEQ ID NO: 1271259 - RNA, 19 nt, Mycobacterium tuberculosis H37Rv
acggccggccgcggucucc

SEQ ID NO: 1271260 - RNA, 13 nt, Mycobacterium tuberculosis H37Rv
acggccggcaagc

SEQ ID NO: 1271261 - RNA, 13 nt, Mycobacterium tuberculosis H37Rv
acggcccggcacc

SEQ ID NO: 1271262 - RNA, 17 nt, Mycobacterium tuberculosis H37Rv
acggcgcucggcgagcu

SEQ ID NO: 1271263 - RNA, 23 nt, Mycobacterium tuberculosis H37Rv
acggcggccccggcauugcccga

SEQ ID NO: 1271264 - RNA, 11 nt, Mycobacterium tuberculosis H37Rv
acggcggccag

SEQ ID NO: 1271265 - RNA, 16 nt, Mycobacterium tuberculosis H37Rv
acggcggccaaggucg

SEQ ID NO: 1271266 - RNA, 18 nt, Mycobacterium tuberculosis H37Rv
acggcggcaucaccuggc

SEQ ID NO: 1271267 - RNA, 17 nt, Mycobacterium tuberculosis H37Rv
acggcgcaguuggcacc

SEQ ID NO: 1271268 - RNA, 12 nt, Mycobacterium tuberculosis H37Rv
acggcgaucacc

SEQ ID NO: 1271269 - RNA, 15 nt, Mycobacterium tuberculosis H37Rv
acggcgaucaccgag

SEQ ID NO: 1271270 - RNA, 17 nt, Mycobacterium tuberculosis H37Rv
acggcgauccccgacgu

SEQ ID NO: 1271271 - RNA, 17 nt, Mycobacterium tuberculosis H37Rv
acggcgaguaggcgugg

SEQ ID NO: 1271272 - RNA, 15 nt, Mycobacterium tuberculosis H37Rv
acggcgcgagccgca

SEQ ID NO: 1271273 - RNA, 13 nt, Mycobacterium tuberculosis H37Rv
acggcgccgcuca

SEQ ID NO: 1271274 - RNA, 14 nt, Mycobacterium tuberculosis H37Rv
acggcgccgacccg

SEQ ID NO: 1271275 - RNA, 19 nt, Mycobacterium tuberculosis H37Rv
acggcgccgccacggaucg

SEQ ID NO: 1271276 - RNA, 15 nt, Mycobacterium tuberculosis H37Rv
acggcgacucgagga

SEQ ID NO: 1271277 - RNA, 20 nt, Mycobacterium tuberculosis H37Rv
acggcgacgaucucggcggc

SEQ ID NO: 1271278 - RNA, 14 nt, Mycobacterium tuberculosis H37Rv
acggcgaguaggcg

SEQ ID NO: 1271279 - RNA, 22 nt, Mycobacterium tuberculosis H37Rv
acggcgaaucgguggucgaugg

SEQ ID NO: 1271280 - RNA, 18 nt, Mycobacterium tuberculosis H37Rv
acggcgaacuuggccgag

SEQ ID NO: 1271281 - RNA, 15 nt, Mycobacterium tuberculosis H37Rv
acggcgaagucgagu

SEQ ID NO: 1271282 - RNA, 15 nt, Mycobacterium tuberculosis H37Rv
acggcgaccaggagc

SEQ ID NO: 1271283 - RNA, 15 nt, Mycobacterium tuberculosis H37Rv
acggccuucagcggu

SEQ ID NO: 1271284 - RNA, 20 nt, Mycobacterium tuberculosis H37Rv
acggcgaaaucgacagcagc

SEQ ID NO: 1271285 - RNA, 15 nt, Mycobacterium tuberculosis H37Rv
acggccucgucgaug

SEQ ID NO: 1271286 - RNA, 16 nt, Mycobacterium tuberculosis H37Rv
acggccuccaucgcga

SEQ ID NO: 1271287 - RNA, 19 nt, Mycobacterium tuberculosis H37Rv
acggccguggaaagccggc

SEQ ID NO: 1271288 - RNA, 20 nt, Mycobacterium tuberculosis H37Rv
acggcgggcgauuucggcgc

SEQ ID NO: 1271289 - RNA, 15 nt, Mycobacterium tuberculosis H37Rv
acggcggccgcgaug

SEQ ID NO: 1271290 - RNA, 17 nt, Mycobacterium tuberculosis H37Rv
acggcggccuucggccg

SEQ ID NO: 1271291 - RNA, 21 nt, Mycobacterium tuberculosis H37Rv
acgggaccgaucuuggccacc

SEQ ID NO: 1271292 - RNA, 13 nt, Mycobacterium tuberculosis H37Rv
acgggacgucacc

SEQ ID NO: 1271293 - RNA, 16 nt, Mycobacterium tuberculosis H37Rv
acgggacaaggucauc

SEQ ID NO: 1271294 - RNA, 19 nt, Mycobacterium tuberculosis H37Rv
acgggcaggccgcugggcc

SEQ ID NO: 1271295 - RNA, 12 nt, Mycobacterium tuberculosis H37Rv
acgggcagugaa

SEQ ID NO: 1271296 - RNA, 13 nt, Mycobacterium tuberculosis H37Rv
acggcuuggcguc

SEQ ID NO: 1271297 - RNA, 21 nt, Mycobacterium tuberculosis H37Rv
acggcuugggucuccggaucg

SEQ ID NO: 1271298 - RNA, 17 nt, Mycobacterium tuberculosis H37Rv
acgggccacgaugcgca

SEQ ID NO: 1271299 - RNA, 17 nt, Mycobacterium tuberculosis H37Rv
acgggccgcaucgucgc

SEQ ID NO: 1271300 - RNA, 18 nt, Mycobacterium tuberculosis H37Rv
acgggcgaaauuccgggc

SEQ ID NO: 1271301 - RNA, 14 nt, Mycobacterium tuberculosis H37Rv
acgggcgugcugcc

SEQ ID NO: 1271302 - RNA, 13 nt, Mycobacterium tuberculosis H37Rv
acgggcgcgucgg

SEQ ID NO: 1271303 - RNA, 23 nt, Mycobacterium tuberculosis H37Rv
acgguaaucgcgaacgaagucga

SEQ ID NO: 1271304 - RNA, 21 nt, Mycobacterium tuberculosis H37Rv
acgguaccccaacgaccggca

SEQ ID NO: 1271305 - RNA, 15 nt, Mycobacterium tuberculosis H37Rv
acgggugucggcgug

SEQ ID NO: 1271306 - RNA, 23 nt, Mycobacterium tuberculosis H37Rv
acggguuggcgucgcuacgcaac

SEQ ID NO: 1271307 - RNA, 12 nt, Mycobacterium tuberculosis H37Rv
acgggucgccgg

SEQ ID NO: 1271308 - RNA, 12 nt, Mycobacterium tuberculosis H37Rv
acgggucgaugu

SEQ ID NO: 1271309 - RNA, 17 nt, Mycobacterium tuberculosis H37Rv
acgggucgaugucggca

SEQ ID NO: 1271310 - RNA, 23 nt, Mycobacterium tuberculosis H37Rv
acgggucguaggacaccaccgug

SEQ ID NO: 1271311 - RNA, 18 nt, Mycobacterium tuberculosis H37Rv
acgucgaugugcgcccaa

SEQ ID NO: 1271312 - RNA, 20 nt, Mycobacterium tuberculosis H37Rv
acgucgagauccucgucgag

SEQ ID NO: 1271313 - RNA, 14 nt, Mycobacterium tuberculosis H37Rv
acgucggcgaccag

SEQ ID NO: 1271314 - RNA, 12 nt, Mycobacterium tuberculosis H37Rv
acgucggcgaau

SEQ ID NO: 1271315 - RNA, 22 nt, Mycobacterium tuberculosis H37Rv
acgucggcgcguccgcaggcga

SEQ ID NO: 1271316 - RNA, 14 nt, Mycobacterium tuberculosis H37Rv
acgucaucgccgac

SEQ ID NO: 1271317 - RNA, 16 nt, Mycobacterium tuberculosis H37Rv
acgucgacuucgcccg

SEQ ID NO: 1271318 - RNA, 19 nt, Mycobacterium tuberculosis H37Rv
acgucgagcagccgcgaca

SEQ ID NO: 1271319 - RNA, 15 nt, Mycobacterium tuberculosis H37Rv
acguccaucccggcg

SEQ ID NO: 1271320 - RNA, 13 nt, Mycobacterium tuberculosis H37Rv
acggucgucgcga

SEQ ID NO: 1271321 - RNA, 18 nt, Mycobacterium tuberculosis H37Rv
acggucgucgcgagcgga

SEQ ID NO: 1271322 - RNA, 15 nt, Mycobacterium tuberculosis H37Rv
acggucgucgaucac

SEQ ID NO: 1271323 - RNA, 23 nt, Mycobacterium tuberculosis H37Rv
acggucgccgaccacucgagcgc

SEQ ID NO: 1271324 - RNA, 16 nt, Mycobacterium tuberculosis H37Rv
acgguagcacggucug

SEQ ID NO: 1271325 - RNA, 19 nt, Mycobacterium tuberculosis H37Rv
acgguaggcccgcgcgaga

SEQ ID NO: 1271326 - RNA, 19 nt, Mycobacterium tuberculosis H37Rv
acggugaucagguaagcga

SEQ ID NO: 1271327 - RNA, 19 nt, Mycobacterium tuberculosis H37Rv
acggugagggcgucgucga

SEQ ID NO: 1271328 - RNA, 17 nt, Mycobacterium tuberculosis H37Rv
acguaggccaggucgcc

SEQ ID NO: 1271329 - RNA, 15 nt, Mycobacterium tuberculosis H37Rv
acguagugcaccgcc

SEQ ID NO: 1271330 - RNA, 15 nt, Mycobacterium tuberculosis H37Rv
acguaguggaagccg

SEQ ID NO: 1271331 - RNA, 16 nt, Mycobacterium tuberculosis H37Rv
acguaguggaagccga

SEQ ID NO: 1271332 - RNA, 14 nt, Mycobacterium tuberculosis H37Rv
acguagucgccgau

SEQ ID NO: 1271333 - RNA, 16 nt, Mycobacterium tuberculosis H37Rv
acguucgguggcgaug

SEQ ID NO: 1271334 - RNA, 23 nt, Mycobacterium tuberculosis H37Rv
acguuggccgagcagggccggca

SEQ ID NO: 1271335 - RNA, 20 nt, Mycobacterium tuberculosis H37Rv
acguuuagggugcccgcguu

SEQ ID NO: 1271336 - RNA, 19 nt, Mycobacterium tuberculosis H37Rv
acguuguaggagaacguca

SEQ ID NO: 1271337 - RNA, 19 nt, Mycobacterium tuberculosis H37Rv
acguuguucagcccgccga

SEQ ID NO: 1271338 - RNA, 16 nt, Mycobacterium tuberculosis H37Rv
acuacuccugagauga

SEQ ID NO: 1271339 - RNA, 19 nt, Mycobacterium tuberculosis H37Rv
acuaaagcccucgacacgc

SEQ ID NO: 1271340 - RNA, 21 nt, Mycobacterium tuberculosis H37Rv
acgugcgagggcacggcggug

SEQ ID NO: 1271341 - RNA, 20 nt, Mycobacterium tuberculosis H37Rv
acgugcgagggcacggcggu

SEQ ID NO: 1271342 - RNA, 21 nt, Mycobacterium tuberculosis H37Rv
acgugcccgguguucaucacg

SEQ ID NO: 1271343 - RNA, 13 nt, Mycobacterium tuberculosis H37Rv
acgugccgguccc

SEQ ID NO: 1271344 - RNA, 21 nt, Mycobacterium tuberculosis H37Rv
acgugccccggcgguaccaga

SEQ ID NO: 1271345 - RNA, 13 nt, Mycobacterium tuberculosis H37Rv
acgucgucgccgc

SEQ ID NO: 1271346 - RNA, 17 nt, Mycobacterium tuberculosis H37Rv
acgugcgucggcccggu

SEQ ID NO: 1271347 - RNA, 15 nt, Mycobacterium tuberculosis H37Rv
acugauggcgcgcaa

SEQ ID NO: 1271348 - RNA, 14 nt, Mycobacterium tuberculosis H37Rv
acugaugucgccga

SEQ ID NO: 1271349 - RNA, 16 nt, Mycobacterium tuberculosis H37Rv
acugcgcccgccacgu

SEQ ID NO: 1271350 - RNA, 16 nt, Mycobacterium tuberculosis H37Rv
acugcgaaugcugggc

SEQ ID NO: 1271351 - RNA, 17 nt, Mycobacterium tuberculosis H37Rv
acugcgaaugcugggcc

SEQ ID NO: 1271352 - RNA, 20 nt, Mycobacterium tuberculosis H37Rv
acugaucgccacccgguccc

SEQ ID NO: 1271353 - RNA, 22 nt, Mycobacterium tuberculosis H37Rv
acugaacgguuucuuucggcag

SEQ ID NO: 1271354 - RNA, 23 nt, Mycobacterium tuberculosis H37Rv
acugaacaguugcacaccggcac

SEQ ID NO: 1271355 - RNA, 22 nt, Mycobacterium tuberculosis H37Rv
acucgcggccggcgucggcguc

SEQ ID NO: 1271356 - RNA, 18 nt, Mycobacterium tuberculosis H37Rv
acucgccgacgucgacgc

SEQ ID NO: 1271357 - RNA, 19 nt, Mycobacterium tuberculosis H37Rv
acucgccgaaucgcugacc

SEQ ID NO: 1271358 - RNA, 23 nt, Mycobacterium tuberculosis H37Rv
acucgccgaaucgcugaccgcgu

SEQ ID NO: 1271359 - RNA, 16 nt, Mycobacterium tuberculosis H37Rv
acuagcggcucaccgc

SEQ ID NO: 1271360 - RNA, 19 nt, Mycobacterium tuberculosis H37Rv
acucauuacgguagacguu

SEQ ID NO: 1271361 - RNA, 13 nt, Mycobacterium tuberculosis H37Rv
acuccaccgcgcc

SEQ ID NO: 1271362 - RNA, 21 nt, Mycobacterium tuberculosis H37Rv
acucaucuuugacaccggucg

SEQ ID NO: 1271363 - RNA, 22 nt, Mycobacterium tuberculosis H37Rv
acucaucggccgcggucggcca

SEQ ID NO: 1271364 - RNA, 15 nt, Mycobacterium tuberculosis H37Rv
acuccacgcggaccu

SEQ ID NO: 1271365 - RNA, 17 nt, Mycobacterium tuberculosis H37Rv
acuccagcaccagcacg

SEQ ID NO: 1271366 - RNA, 20 nt, Mycobacterium tuberculosis H37Rv
acuccagcaaggccagcacg

SEQ ID NO: 1271367 - RNA, 18 nt, Mycobacterium tuberculosis H37Rv
acuccagcuugccgaccu

SEQ ID NO: 1271368 - RNA, 18 nt, Mycobacterium tuberculosis H37Rv
acuccaucagcgcgaccg

SEQ ID NO: 1271369 - RNA, 12 nt, Mycobacterium tuberculosis H37Rv
acucccgcgauc

SEQ ID NO: 1271370 - RNA, 20 nt, Mycobacterium tuberculosis H37Rv
acucccccgaaccugcggca

SEQ ID NO: 1271371 - RNA, 16 nt, Mycobacterium tuberculosis H37Rv
acucgaccaccgccgg

SEQ ID NO: 1271372 - RNA, 15 nt, Mycobacterium tuberculosis H37Rv
acucgaccgcgagca

SEQ ID NO: 1271373 - RNA, 18 nt, Mycobacterium tuberculosis H37Rv
acucgagagcgaucaacg

SEQ ID NO: 1271374 - RNA, 16 nt, Mycobacterium tuberculosis H37Rv
acucgccgaaaucggc

SEQ ID NO: 1271375 - RNA, 14 nt, Mycobacterium tuberculosis H37Rv
acucgccgaaaucg

SEQ ID NO: 1271376 - RNA, 22 nt, Mycobacterium tuberculosis H37Rv
acucgcagcgccgucaucgugc

SEQ ID NO: 1271377 - RNA, 16 nt, Mycobacterium tuberculosis H37Rv
acuccggccgcacgcc

SEQ ID NO: 1271378 - RNA, 16 nt, Mycobacterium tuberculosis H37Rv
acuccgguggccaaca

SEQ ID NO: 1271379 - RNA, 22 nt, Mycobacterium tuberculosis H37Rv
acuccgucguaguuggugaaca

SEQ ID NO: 1271380 - RNA, 15 nt, Mycobacterium tuberculosis H37Rv
acuccucagccgccu

SEQ ID NO: 1271381 - RNA, 17 nt, Mycobacterium tuberculosis H37Rv
acuccggucagcgcggc

SEQ ID NO: 1271382 - RNA, 20 nt, Mycobacterium tuberculosis H37Rv
acuccggcgcuaugaagucg

SEQ ID NO: 1271383 - RNA, 15 nt, Mycobacterium tuberculosis H37Rv
acucccucgaucacg

SEQ ID NO: 1271384 - RNA, 15 nt, Mycobacterium tuberculosis H37Rv
accugccgggccacg

SEQ ID NO: 1271385 - RNA, 18 nt, Mycobacterium tuberculosis H37Rv
accugccgggccacggcu

SEQ ID NO: 1271386 - RNA, 19 nt, Mycobacterium tuberculosis H37Rv
accugcgcaaauugcaaca

SEQ ID NO: 1271387 - RNA, 22 nt, Mycobacterium tuberculosis H37Rv
accugccggaccaccgggccga

SEQ ID NO: 1271388 - RNA, 15 nt, Mycobacterium tuberculosis H37Rv
accugccaccagaca

SEQ ID NO: 1271389 - RNA, 16 nt, Mycobacterium tuberculosis H37Rv
accugcaucgucgcca

SEQ ID NO: 1271390 - RNA, 15 nt, Mycobacterium tuberculosis H37Rv
accugaagccgcgcu

SEQ ID NO: 1271391 - RNA, 21 nt, Mycobacterium tuberculosis H37Rv
accucuugcccuucuucgacc

SEQ ID NO: 1271392 - RNA, 20 nt, Mycobacterium tuberculosis H37Rv
accugaaccggccgcgacga

SEQ ID NO: 1271393 - RNA, 19 nt, Mycobacterium tuberculosis H37Rv
accugaccgguggccaucg

SEQ ID NO: 1271394 - RNA, 15 nt, Mycobacterium tuberculosis H37Rv
accugcacccaggca

SEQ ID NO: 1271395 - RNA, 16 nt, Mycobacterium tuberculosis H37Rv
accucgccggugacgg

SEQ ID NO: 1271396 - RNA, 20 nt, Mycobacterium tuberculosis H37Rv
accucggccuugaucaccgu

SEQ ID NO: 1271397 - RNA, 19 nt, Mycobacterium tuberculosis H37Rv
accucggcgacgaugucga

SEQ ID NO: 1271398 - RNA, 13 nt, Mycobacterium tuberculosis H37Rv
accucgucaccgg

SEQ ID NO: 1271399 - RNA, 15 nt, Mycobacterium tuberculosis H37Rv
accucgucacccggu

SEQ ID NO: 1271400 - RNA, 14 nt, Mycobacterium tuberculosis H37Rv
accucgucgaccgg

SEQ ID NO: 1271401 - RNA, 19 nt, Mycobacterium tuberculosis H37Rv
accucgucgagcgugcgca

SEQ ID NO: 1271402 - RNA, 13 nt, Mycobacterium tuberculosis H37Rv
accucgucgaucu

SEQ ID NO: 1271403 - RNA, 13 nt, Mycobacterium tuberculosis H37Rv
accucgggaucgg

SEQ ID NO: 1271404 - RNA, 17 nt, Mycobacterium tuberculosis H37Rv
accucgguacuugccac

SEQ ID NO: 1271405 - RNA, 21 nt, Mycobacterium tuberculosis H37Rv
accucuucgaucuguuccugc

SEQ ID NO: 1271406 - RNA, 17 nt, Mycobacterium tuberculosis H37Rv
accucguucgucaccac

SEQ ID NO: 1271407 - RNA, 14 nt, Mycobacterium tuberculosis H37Rv
accucgucggccga

SEQ ID NO: 1271408 - RNA, 18 nt, Mycobacterium tuberculosis H37Rv
accucgucgucgaaguug

SEQ ID NO: 1271409 - RNA, 19 nt, Mycobacterium tuberculosis H37Rv
accucccagggcucggcgg

SEQ ID NO: 1271410 - RNA, 14 nt, Mycobacterium tuberculosis H37Rv
accuccagugcggc

SEQ ID NO: 1271411 - RNA, 12 nt, Mycobacterium tuberculosis H37Rv
accucccgcgug

SEQ ID NO: 1271412 - RNA, 23 nt, Mycobacterium tuberculosis H37Rv
accuccggauaacccagcggcgc

SEQ ID NO: 1271413 - RNA, 21 nt, Mycobacterium tuberculosis H37Rv
accucgaaaccguggccaucg

SEQ ID NO: 1271414 - RNA, 16 nt, Mycobacterium tuberculosis H37Rv
accucgaagugcaggu

SEQ ID NO: 1271415 - RNA, 18 nt, Mycobacterium tuberculosis H37Rv
accucgaacggggugagc

SEQ ID NO: 1271416 - RNA, 18 nt, Mycobacterium tuberculosis H37Rv
accucaacaccaggccgu

SEQ ID NO: 1271417 - RNA, 18 nt, Mycobacterium tuberculosis H37Rv
accucaccaaccgcccga

SEQ ID NO: 1271418 - RNA, 16 nt, Mycobacterium tuberculosis H37Rv
accuauuggucgcucg

SEQ ID NO: 1271419 - RNA, 19 nt, Mycobacterium tuberculosis H37Rv
accuauggucaaccgcgcc

SEQ ID NO: 1271420 - RNA, 16 nt, Mycobacterium tuberculosis H37Rv
accuccaacaggccua

SEQ ID NO: 1271421 - RNA, 19 nt, Mycobacterium tuberculosis H37Rv
accucaugcacgccguagc

SEQ ID NO: 1271422 - RNA, 18 nt, Mycobacterium tuberculosis H37Rv
accucaucgcggucgcca

SEQ ID NO: 1271423 - RNA, 22 nt, Mycobacterium tuberculosis H37Rv
accucaucgcagacggcugcca

SEQ ID NO: 1271424 - RNA, 11 nt, Mycobacterium tuberculosis H37Rv
accuagccgca

SEQ ID NO: 1271425 - RNA, 20 nt, Mycobacterium tuberculosis H37Rv
accuacgaagcguugaccgc

SEQ ID NO: 1271426 - RNA, 14 nt, Mycobacterium tuberculosis H37Rv
accgguaccgccac

SEQ ID NO: 1271427 - RNA, 20 nt, Mycobacterium tuberculosis H37Rv
accggguuggaagccgcacc

SEQ ID NO: 1271428 - RNA, 15 nt, Mycobacterium tuberculosis H37Rv
accggucagcaccuc

SEQ ID NO: 1271429 - RNA, 23 nt, Mycobacterium tuberculosis H37Rv
accggucagcaccuccaccgcgc

SEQ ID NO: 1271430 - RNA, 13 nt, Mycobacterium tuberculosis H37Rv
accggucacccgu

SEQ ID NO: 1271431 - RNA, 13 nt, Mycobacterium tuberculosis H37Rv
accggucaccgcg

SEQ ID NO: 1271432 - RNA, 19 nt, Mycobacterium tuberculosis H37Rv
accugcgcgcggccgcgcu

SEQ ID NO: 1271433 - RNA, 14 nt, Mycobacterium tuberculosis H37Rv
accugcggcgucaa

SEQ ID NO: 1271434 - RNA, 21 nt, Mycobacterium tuberculosis H37Rv
accugcugagccgucggcgcc

SEQ ID NO: 1271435 - RNA, 17 nt, Mycobacterium tuberculosis H37Rv
accugcuggaucucggu

SEQ ID NO: 1271436 - RNA, 23 nt, Mycobacterium tuberculosis H37Rv
accugcugcacggucaugccgcc

SEQ ID NO: 1271437 - RNA, 15 nt, Mycobacterium tuberculosis H37Rv
accugcuggaagccg

SEQ ID NO: 1271438 - RNA, 18 nt, Mycobacterium tuberculosis H37Rv
accuggcccgccacgaug

SEQ ID NO: 1271439 - RNA, 19 nt, Mycobacterium tuberculosis H37Rv
accuggcgauaaccgacga

SEQ ID NO: 1271440 - RNA, 19 nt, Mycobacterium tuberculosis H37Rv
accuggccugcggcaggug

SEQ ID NO: 1271441 - RNA, 16 nt, Mycobacterium tuberculosis H37Rv
accuuggcaagcacgc

SEQ ID NO: 1271442 - RNA, 23 nt, Mycobacterium tuberculosis H37Rv
accuuggccagacccaccaccgc

SEQ ID NO: 1271443 - RNA, 19 nt, Mycobacterium tuberculosis H37Rv
accuuggcguugaccagca

SEQ ID NO: 1271444 - RNA, 17 nt, Mycobacterium tuberculosis H37Rv
accuggcgugucgccgc

SEQ ID NO: 1271445 - RNA, 16 nt, Mycobacterium tuberculosis H37Rv
accuggcucaucgaug

SEQ ID NO: 1271446 - RNA, 16 nt, Mycobacterium tuberculosis H37Rv
accugggcgacuaccg

SEQ ID NO: 1271447 - RNA, 19 nt, Mycobacterium tuberculosis H37Rv
accugggcgacuaccggcu

SEQ ID NO: 1271448 - RNA, 20 nt, Mycobacterium tuberculosis H37Rv
accugguaugccgcccgcag

SEQ ID NO: 1271449 - RNA, 16 nt, Mycobacterium tuberculosis H37Rv
acgacguucgacgaca

SEQ ID NO: 1271450 - RNA, 15 nt, Mycobacterium tuberculosis H37Rv
acgacguucgacgac

SEQ ID NO: 1271451 - RNA, 21 nt, Mycobacterium tuberculosis H37Rv
acgacuccggcaagcacaccg

SEQ ID NO: 1271452 - RNA, 16 nt, Mycobacterium tuberculosis H37Rv
acgacuccggcaagca

SEQ ID NO: 1271453 - RNA, 17 nt, Mycobacterium tuberculosis H37Rv
acgacgccaaugccgcg

SEQ ID NO: 1271454 - RNA, 16 nt, Mycobacterium tuberculosis H37Rv
acgacgcccaccguug

SEQ ID NO: 1271455 - RNA, 19 nt, Mycobacterium tuberculosis H37Rv
acgacgcccaccguugcga

SEQ ID NO: 1271456 - RNA, 20 nt, Mycobacterium tuberculosis H37Rv
acgacgucggccgcaucgcc

SEQ ID NO: 1271457 - RNA, 23 nt, Mycobacterium tuberculosis H37Rv
acgacgucggccgcaucgcccaa

SEQ ID NO: 1271458 - RNA, 18 nt, Mycobacterium tuberculosis H37Rv
acgacgccgucggacacc

SEQ ID NO: 1271459 - RNA, 20 nt, Mycobacterium tuberculosis H37Rv
acgacgccgucggacaccgc

SEQ ID NO: 1271460 - RNA, 16 nt, Mycobacterium tuberculosis H37Rv
acgacgcgauggccgc

SEQ ID NO: 1271461 - RNA, 21 nt, Mycobacterium tuberculosis H37Rv
acgaaucugcgguacugagcc

SEQ ID NO: 1271462 - RNA, 21 nt, Mycobacterium tuberculosis H37Rv
acgaauccacuggucaacggg

SEQ ID NO: 1271463 - RNA, 16 nt, Mycobacterium tuberculosis H37Rv
acgaaucccacggcaa

SEQ ID NO: 1271464 - RNA, 21 nt, Mycobacterium tuberculosis H37Rv
acgaccaccuucugacgcggc

SEQ ID NO: 1271465 - RNA, 13 nt, Mycobacterium tuberculosis H37Rv
acgaccagcagau

SEQ ID NO: 1271466 - RNA, 15 nt, Mycobacterium tuberculosis H37Rv
acgacccccgaucag

SEQ ID NO: 1271467 - RNA, 14 nt, Mycobacterium tuberculosis H37Rv
acgaccccgucgac

SEQ ID NO: 1271468 - RNA, 21 nt, Mycobacterium tuberculosis H37Rv
acgacccgcuggucgaugccu

SEQ ID NO: 1271469 - RNA, 22 nt, Mycobacterium tuberculosis H37Rv
acgacccgggaaggaaccgggc

SEQ ID NO: 1271470 - RNA, 22 nt, Mycobacterium tuberculosis H37Rv
acgccgaucaacaugccgguca

SEQ ID NO: 1271471 - RNA, 17 nt, Mycobacterium tuberculosis H37Rv
acgccgauaccgugcac

SEQ ID NO: 1271472 - RNA, 18 nt, Mycobacterium tuberculosis H37Rv
acgccgagcugguugacg

SEQ ID NO: 1271473 - RNA, 13 nt, Mycobacterium tuberculosis H37Rv
acgccgcaaugga

SEQ ID NO: 1271474 - RNA, 13 nt, Mycobacterium tuberculosis H37Rv
acgccgccagcag

SEQ ID NO: 1271475 - RNA, 15 nt, Mycobacterium tuberculosis H37Rv
acgccgacuccgcgu

SEQ ID NO: 1271476 - RNA, 23 nt, Mycobacterium tuberculosis H37Rv
acgccgacgaugacgcgcgaaac

SEQ ID NO: 1271477 - RNA, 15 nt, Mycobacterium tuberculosis H37Rv
acgccgagaccgccg

SEQ ID NO: 1271478 - RNA, 16 nt, Mycobacterium tuberculosis H37Rv
acgccgagaccgccgc

SEQ ID NO: 1271479 - RNA, 13 nt, Mycobacterium tuberculosis H37Rv
acgccgaggcguu

SEQ ID NO: 1271480 - RNA, 19 nt, Mycobacterium tuberculosis H37Rv
acgccgagcgccaguucgc

SEQ ID NO: 1271481 - RNA, 17 nt, Mycobacterium tuberculosis H37Rv
acgccgcccgcugggcu

SEQ ID NO: 1271482 - RNA, 22 nt, Mycobacterium tuberculosis H37Rv
acgccggauuauucgcgguagc

SEQ ID NO: 1271483 - RNA, 15 nt, Mycobacterium tuberculosis H37Rv
acgccggcaucgcgc

SEQ ID NO: 1271484 - RNA, 15 nt, Mycobacterium tuberculosis H37Rv
acgccguggugcgca

SEQ ID NO: 1271485 - RNA, 19 nt, Mycobacterium tuberculosis H37Rv
acgccguggugcgcauggc

SEQ ID NO: 1271486 - RNA, 16 nt, Mycobacterium tuberculosis H37Rv
acgccguugcccacgu

SEQ ID NO: 1271487 - RNA, 22 nt, Mycobacterium tuberculosis H37Rv
acgccguugcccacguugacgg

SEQ ID NO: 1271488 - RNA, 17 nt, Mycobacterium tuberculosis H37Rv
acgccggcgacggcguc

SEQ ID NO: 1271489 - RNA, 13 nt, Mycobacterium tuberculosis H37Rv
acgccggcgaugc

SEQ ID NO: 1271490 - RNA, 15 nt, Mycobacterium tuberculosis H37Rv
acgccggccgcgcug

SEQ ID NO: 1271491 - RNA, 17 nt, Mycobacterium tuberculosis H37Rv
acgccggccgccgaccg

SEQ ID NO: 1271492 - RNA, 15 nt, Mycobacterium tuberculosis H37Rv
acgcgcaggaagccg

SEQ ID NO: 1271493 - RNA, 17 nt, Mycobacterium tuberculosis H37Rv
acgcgcaggaagccggc

SEQ ID NO: 1271494 - RNA, 14 nt, Mycobacterium tuberculosis H37Rv
acgcgcaggccgac

SEQ ID NO: 1271495 - RNA, 15 nt, Mycobacterium tuberculosis H37Rv
acgcgcaggccgaca

SEQ ID NO: 1271496 - RNA, 16 nt, Mycobacterium tuberculosis H37Rv
acgcgcaggccgacac

SEQ ID NO: 1271497 - RNA, 17 nt, Mycobacterium tuberculosis H37Rv
acgcgcgcucgcucacc

SEQ ID NO: 1271498 - RNA, 20 nt, Mycobacterium tuberculosis H37Rv
acgcgcgcucgcucaccggc

SEQ ID NO: 1271499 - RNA, 23 nt, Mycobacterium tuberculosis H37Rv
acgcgcgcguggucgccccgaug

SEQ ID NO: 1271500 - RNA, 20 nt, Mycobacterium tuberculosis H37Rv
acgcgccccaguucgacggc

SEQ ID NO: 1271501 - RNA, 12 nt, Mycobacterium tuberculosis H37Rv
acgcgccgcaca

SEQ ID NO: 1271502 - RNA, 20 nt, Mycobacterium tuberculosis H37Rv
acgcgaucaccucgccacac

SEQ ID NO: 1271503 - RNA, 17 nt, Mycobacterium tuberculosis H37Rv
acgcgaucuguccgcga

SEQ ID NO: 1271504 - RNA, 14 nt, Mycobacterium tuberculosis H37Rv
acgcgaugaccgca

SEQ ID NO: 1271505 - RNA, 20 nt, Mycobacterium tuberculosis H37Rv
acgcgaugaucaugaacgcc

SEQ ID NO: 1271506 - RNA, 17 nt, Mycobacterium tuberculosis H37Rv
acgcgaugacacaccgc

SEQ ID NO: 1271507 - RNA, 17 nt, Mycobacterium tuberculosis H37Rv
acgcgaugaccgcaccg

SEQ ID NO: 1271508 - RNA, 19 nt, Mycobacterium tuberculosis H37Rv
acgcgaugguggccgccac

SEQ ID NO: 1271509 - RNA, 13 nt, Mycobacterium tuberculosis H37Rv
acgccucgccauc

SEQ ID NO: 1271510 - RNA, 19 nt, Mycobacterium tuberculosis H37Rv
acgccucgacagcggcaau

SEQ ID NO: 1271511 - RNA, 16 nt, Mycobacterium tuberculosis H37Rv
acgccucaccgacguc

SEQ ID NO: 1271512 - RNA, 19 nt, Mycobacterium tuberculosis H37Rv
acgccguuggggccguuca

SEQ ID NO: 1271513 - RNA, 13 nt, Mycobacterium tuberculosis H37Rv
acgccucgccgaa

SEQ ID NO: 1271514 - RNA, 16 nt, Mycobacterium tuberculosis H37Rv
acgcaguucggucagc

SEQ ID NO: 1271515 - RNA, 22 nt, Mycobacterium tuberculosis H37Rv
acgcagucgcccacuauggccc

SEQ ID NO: 1271516 - RNA, 19 nt, Mycobacterium tuberculosis H37Rv
acgcagugcccgaucgcuu

SEQ ID NO: 1271517 - RNA, 12 nt, Mycobacterium tuberculosis H37Rv
acgccaaugccg

SEQ ID NO: 1271518 - RNA, 13 nt, Mycobacterium tuberculosis H37Rv
acgccaccgcggu

SEQ ID NO: 1271519 - RNA, 15 nt, Mycobacterium tuberculosis H37Rv
acgccacgaccgccg

SEQ ID NO: 1271520 - RNA, 23 nt, Mycobacterium tuberculosis H37Rv
acgccacccccaaccgccggcca

SEQ ID NO: 1271521 - RNA, 14 nt, Mycobacterium tuberculosis H37Rv
acgccagcgcgacc

SEQ ID NO: 1271522 - RNA, 12 nt, Mycobacterium tuberculosis H37Rv
acgccagccggu

SEQ ID NO: 1271523 - RNA, 13 nt, Mycobacterium tuberculosis H37Rv
acgccagccuggc

SEQ ID NO: 1271524 - RNA, 13 nt, Mycobacterium tuberculosis H37Rv
acgccagcgcgac

SEQ ID NO: 1271525 - RNA, 18 nt, Mycobacterium tuberculosis H37Rv
acgccagcugcccgacgu

SEQ ID NO: 1271526 - RNA, 17 nt, Mycobacterium tuberculosis H37Rv
acgcccgcacucggcgg

SEQ ID NO: 1271527 - RNA, 18 nt, Mycobacterium tuberculosis H37Rv
acgcccgcacucggcggu

SEQ ID NO: 1271528 - RNA, 21 nt, Mycobacterium tuberculosis H37Rv
acgcccgccaccggguucacc

SEQ ID NO: 1271529 - RNA, 19 nt, Mycobacterium tuberculosis H37Rv
acgccccuucccuaucacg

SEQ ID NO: 1271530 - RNA, 19 nt, Mycobacterium tuberculosis H37Rv
acgcccacuccagcagcuc

SEQ ID NO: 1271531 - RNA, 18 nt, Mycobacterium tuberculosis H37Rv
acgccauucaucggcauc

SEQ ID NO: 1271532 - RNA, 15 nt, Mycobacterium tuberculosis H37Rv
acgccauggaaaccc

SEQ ID NO: 1271533 - RNA, 15 nt, Mycobacterium tuberculosis H37Rv
acgccauucaucggc

SEQ ID NO: 1271534 - RNA, 14 nt, Mycobacterium tuberculosis H37Rv
acgaugucggcacc

SEQ ID NO: 1271535 - RNA, 21 nt, Mycobacterium tuberculosis H37Rv
acgcaagggaauccgaacucg

SEQ ID NO: 1271536 - RNA, 23 nt, Mycobacterium tuberculosis H37Rv
acgaugucggucggaucggcgcc

SEQ ID NO: 1271537 - RNA, 15 nt, Mycobacterium tuberculosis H37Rv
acgauguccucgaug

SEQ ID NO: 1271538 - RNA, 16 nt, Mycobacterium tuberculosis H37Rv
acgauguccgcgcgaa

SEQ ID NO: 1271539 - RNA, 15 nt, Mycobacterium tuberculosis H37Rv
acgcacagcccgaug

SEQ ID NO: 1271540 - RNA, 22 nt, Mycobacterium tuberculosis H37Rv
acgcacaauacggucagcagac

SEQ ID NO: 1271541 - RNA, 17 nt, Mycobacterium tuberculosis H37Rv
acgcaauagccaucacg

SEQ ID NO: 1271542 - RNA, 15 nt, Mycobacterium tuberculosis H37Rv
acgcagccccucguc

SEQ ID NO: 1271543 - RNA, 18 nt, Mycobacterium tuberculosis H37Rv
acgcagccccucgucguc

SEQ ID NO: 1271544 - RNA, 20 nt, Mycobacterium tuberculosis H37Rv
acgcagcccgucggcgccga

SEQ ID NO: 1271545 - RNA, 16 nt, Mycobacterium tuberculosis H37Rv
acgcaggugaacgccg

SEQ ID NO: 1271546 - RNA, 13 nt, Mycobacterium tuberculosis H37Rv
acgcagcacggca

SEQ ID NO: 1271547 - RNA, 14 nt, Mycobacterium tuberculosis H37Rv
acgcagcacggcac

SEQ ID NO: 1271548 - RNA, 15 nt, Mycobacterium tuberculosis H37Rv
acgcagcacggcacc

SEQ ID NO: 1271549 - RNA, 19 nt, Mycobacterium tuberculosis H37Rv
acgaucugcagcacucggu

SEQ ID NO: 1271550 - RNA, 13 nt, Mycobacterium tuberculosis H37Rv
acgaucucggcgg

SEQ ID NO: 1271551 - RNA, 14 nt, Mycobacterium tuberculosis H37Rv
acgaggcaaugcga

SEQ ID NO: 1271552 - RNA, 22 nt, Mycobacterium tuberculosis H37Rv
acgaugacagacaucgcgacga

SEQ ID NO: 1271553 - RNA, 16 nt, Mycobacterium tuberculosis H37Rv
acgauggcgucggcca

SEQ ID NO: 1271554 - RNA, 15 nt, Mycobacterium tuberculosis H37Rv
acgauggcggccacc

SEQ ID NO: 1271555 - RNA, 21 nt, Mycobacterium tuberculosis H37Rv
acgauguaaacaacgcgauag

SEQ ID NO: 1271556 - RNA, 14 nt, Mycobacterium tuberculosis H37Rv
acgauggcgaugag

SEQ ID NO: 1271557 - RNA, 23 nt, Mycobacterium tuberculosis H37Rv
acgaugaccgcgcggcccgccga

SEQ ID NO: 1271558 - RNA, 14 nt, Mycobacterium tuberculosis H37Rv
acgaugaccgcgcg

SEQ ID NO: 1271559 - RNA, 14 nt, Mycobacterium tuberculosis H37Rv
acgaugacgucgac

SEQ ID NO: 1271560 - RNA, 15 nt, Mycobacterium tuberculosis H37Rv
acgaugacgcgcgaa

SEQ ID NO: 1271561 - RNA, 20 nt, Mycobacterium tuberculosis H37Rv
acgagccagagguggaucag

SEQ ID NO: 1271562 - RNA, 14 nt, Mycobacterium tuberculosis H37Rv
acgagcccacgcgc

SEQ ID NO: 1271563 - RNA, 15 nt, Mycobacterium tuberculosis H37Rv
acgagcaugcggcua

SEQ ID NO: 1271564 - RNA, 19 nt, Mycobacterium tuberculosis H37Rv
acgacugugcgccgcagcc

SEQ ID NO: 1271565 - RNA, 14 nt, Mycobacterium tuberculosis H37Rv
acgacuggcgccca

SEQ ID NO: 1271566 - RNA, 24 nt, Mycobacterium tuberculosis H37Rv
acgaucgugagacgccgucgacgu

SEQ ID NO: 1271567 - RNA, 17 nt, Mycobacterium tuberculosis H37Rv
acgagcgauacgucguc

SEQ ID NO: 1271568 - RNA, 21 nt, Mycobacterium tuberculosis H37Rv
acgagcgauacgucgucagcc

SEQ ID NO: 1271569 - RNA, 12 nt, Mycobacterium tuberculosis H37Rv
acgagcgauacg

SEQ ID NO: 1271570 - RNA, 23 nt, Mycobacterium tuberculosis H37Rv
acgagcgcgcugcggaucguggc

SEQ ID NO: 1271571 - RNA, 23 nt, Mycobacterium tuberculosis H37Rv
acgagcuguacuugggauugcgg

SEQ ID NO: 1271572 - RNA, 17 nt, Mycobacterium tuberculosis H37Rv
uggccaaaaaccgugau

SEQ ID NO: 1271573 - RNA, 21 nt, Mycobacterium tuberculosis H37Rv
uggacacguuguucaccgacg

SEQ ID NO: 1271574 - RNA, 17 nt, Mycobacterium tuberculosis H37Rv
uggacaaccucgucgau

SEQ ID NO: 1271575 - RNA, 13 nt, Mycobacterium tuberculosis H37Rv
uggccacccgcgg

SEQ ID NO: 1271576 - RNA, 13 nt, Mycobacterium tuberculosis H37Rv
uggccaccggcgg

SEQ ID NO: 1271577 - RNA, 12 nt, Mycobacterium tuberculosis H37Rv
uggccaccaucg

SEQ ID NO: 1271578 - RNA, 19 nt, Mycobacterium tuberculosis H37Rv
uggccaacucuucagcaag

SEQ ID NO: 1271579 - RNA, 14 nt, Mycobacterium tuberculosis H37Rv
uggccaaccccaug

SEQ ID NO: 1271580 - RNA, 14 nt, Mycobacterium tuberculosis H37Rv
uggccaauccggcg

SEQ ID NO: 1271581 - RNA, 16 nt, Mycobacterium tuberculosis H37Rv
uggccacacagucacg

SEQ ID NO: 1271582 - RNA, 13 nt, Mycobacterium tuberculosis H37Rv
uggccaauccggc

SEQ ID NO: 1271583 - RNA, 17 nt, Mycobacterium tuberculosis H37Rv
uggccaggcuggcguca

SEQ ID NO: 1271584 - RNA, 20 nt, Mycobacterium tuberculosis H37Rv
uggccaggucggccaccgug

SEQ ID NO: 1271585 - RNA, 12 nt, Mycobacterium tuberculosis H37Rv
uggccagcugcg

SEQ ID NO: 1271586 - RNA, 21 nt, Mycobacterium tuberculosis H37Rv
uggccacucccagccaacccg

SEQ ID NO: 1271587 - RNA, 15 nt, Mycobacterium tuberculosis H37Rv
uggccacggggcugc

SEQ ID NO: 1271588 - RNA, 19 nt, Mycobacterium tuberculosis H37Rv
uggccacggaaguaucgcc

SEQ ID NO: 1271589 - RNA, 18 nt, Mycobacterium tuberculosis H37Rv
uggccacgcccaggcaag

SEQ ID NO: 1271590 - RNA, 12 nt, Mycobacterium tuberculosis H37Rv
uggccagcacca

SEQ ID NO: 1271591 - RNA, 17 nt, Mycobacterium tuberculosis H37Rv
uggccagcagccgcgac

SEQ ID NO: 1271592 - RNA, 13 nt, Mycobacterium tuberculosis H37Rv
uggccagcagguu

SEQ ID NO: 1271593 - RNA, 14 nt, Mycobacterium tuberculosis H37Rv
uggccagccgacaa

SEQ ID NO: 1271594 - RNA, 19 nt, Mycobacterium tuberculosis H37Rv
uggccagcgccaacucgag

SEQ ID NO: 1271595 - RNA, 24 nt, Mycobacterium tuberculosis H37Rv
uggccgccaugaaaucacccaucg

SEQ ID NO: 1271596 - RNA, 16 nt, Mycobacterium tuberculosis H37Rv
uggccgcccagaccgc

SEQ ID NO: 1271597 - RNA, 13 nt, Mycobacterium tuberculosis H37Rv
uggccgccgacaa

SEQ ID NO: 1271598 - RNA, 17 nt, Mycobacterium tuberculosis H37Rv
uggccgcccgcugcggc

SEQ ID NO: 1271599 - RNA, 19 nt, Mycobacterium tuberculosis H37Rv
uggccgccgcgcaccgcgg

SEQ ID NO: 1271600 - RNA, 13 nt, Mycobacterium tuberculosis H37Rv
uggccgccgcgag

SEQ ID NO: 1271601 - RNA, 19 nt, Mycobacterium tuberculosis H37Rv
uggccgccggcgccgccau

SEQ ID NO: 1271602 - RNA, 16 nt, Mycobacterium tuberculosis H37Rv
uggccgcgcuggucaa

SEQ ID NO: 1271603 - RNA, 19 nt, Mycobacterium tuberculosis H37Rv
uggccgcgccucggucugc

SEQ ID NO: 1271604 - RNA, 22 nt, Mycobacterium tuberculosis H37Rv
uggccgccuccgcggcauuggc

SEQ ID NO: 1271605 - RNA, 18 nt, Mycobacterium tuberculosis H37Rv
uggccgccaccgcgacga

SEQ ID NO: 1271606 - RNA, 17 nt, Mycobacterium tuberculosis H37Rv
uggccgcaucgacgcuc

SEQ ID NO: 1271607 - RNA, 14 nt, Mycobacterium tuberculosis H37Rv
uggccgcaccgauu

SEQ ID NO: 1271608 - RNA, 21 nt, Mycobacterium tuberculosis H37Rv
uggccgacuuguacgcaucgc

SEQ ID NO: 1271609 - RNA, 22 nt, Mycobacterium tuberculosis H37Rv
uggccgaguagauggucgacgg

SEQ ID NO: 1271610 - RNA, 15 nt, Mycobacterium tuberculosis H37Rv
uggcccagcgugucu

SEQ ID NO: 1271611 - RNA, 21 nt, Mycobacterium tuberculosis H37Rv
uggcccaccuccucgccggau

SEQ ID NO: 1271612 - RNA, 23 nt, Mycobacterium tuberculosis H37Rv
uggccaugccacaacgccucgau

SEQ ID NO: 1271613 - RNA, 15 nt, Mycobacterium tuberculosis H37Rv
uggcccaguccgcug

SEQ ID NO: 1271614 - RNA, 19 nt, Mycobacterium tuberculosis H37Rv
uggcccgcacgaaccgguc

SEQ ID NO: 1271615 - RNA, 19 nt, Mycobacterium tuberculosis H37Rv
uggccccgccagcggcagc

SEQ ID NO: 1271616 - RNA, 14 nt, Mycobacterium tuberculosis H37Rv
uggcccgacgcagc

SEQ ID NO: 1271617 - RNA, 22 nt, Mycobacterium tuberculosis H37Rv
uggccccgggcggugaggcagc

SEQ ID NO: 1271618 - RNA, 18 nt, Mycobacterium tuberculosis H37Rv
uggcccgcucccugcacc

SEQ ID NO: 1271619 - RNA, 15 nt, Mycobacterium tuberculosis H37Rv
uggcccggacaugcg

SEQ ID NO: 1271620 - RNA, 22 nt, Mycobacterium tuberculosis H37Rv
uggcccgcggugacgcaacauc

SEQ ID NO: 1271621 - RNA, 17 nt, Mycobacterium tuberculosis H37Rv
uggccgacagccaccgc

SEQ ID NO: 1271622 - RNA, 19 nt, Mycobacterium tuberculosis H37Rv
uggccgacagccaccgcga

SEQ ID NO: 1271623 - RNA, 15 nt, Mycobacterium tuberculosis H37Rv
uggccgacagccacc

SEQ ID NO: 1271624 - RNA, 18 nt, Mycobacterium tuberculosis H37Rv
uggcccuuccggccgaca

SEQ ID NO: 1271625 - RNA, 13 nt, Mycobacterium tuberculosis H37Rv
uggccgggaccgc

SEQ ID NO: 1271626 - RNA, 23 nt, Mycobacterium tuberculosis H37Rv
uggccgcucuccaccccgucugc

SEQ ID NO: 1271627 - RNA, 18 nt, Mycobacterium tuberculosis H37Rv
uggccgcucuccaccccg

SEQ ID NO: 1271628 - RNA, 14 nt, Mycobacterium tuberculosis H37Rv
uggccgggucgucu

SEQ ID NO: 1271629 - RNA, 14 nt, Mycobacterium tuberculosis H37Rv
uggccgggcuggcg

SEQ ID NO: 1271630 - RNA, 21 nt, Mycobacterium tuberculosis H37Rv
uggccguagucggcgaugcgc

SEQ ID NO: 1271631 - RNA, 17 nt, Mycobacterium tuberculosis H37Rv
uggccguauagcgugac

SEQ ID NO: 1271632 - RNA, 15 nt, Mycobacterium tuberculosis H37Rv
uggccguccgaccga

SEQ ID NO: 1271633 - RNA, 19 nt, Mycobacterium tuberculosis H37Rv
uggccguccgguccgucgg

SEQ ID NO: 1271634 - RNA, 18 nt, Mycobacterium tuberculosis H37Rv
uggcgaaccgucagcgcg

SEQ ID NO: 1271635 - RNA, 15 nt, Mycobacterium tuberculosis H37Rv
uggcgagguggucac

SEQ ID NO: 1271636 - RNA, 13 nt, Mycobacterium tuberculosis H37Rv
uggcgaccaccgc

SEQ ID NO: 1271637 - RNA, 12 nt, Mycobacterium tuberculosis H37Rv
uggcgaggcagc

SEQ ID NO: 1271638 - RNA, 18 nt, Mycobacterium tuberculosis H37Rv
uggcgaagucgucgaggu

SEQ ID NO: 1271639 - RNA, 16 nt, Mycobacterium tuberculosis H37Rv
uggcgaaggccgcaau

SEQ ID NO: 1271640 - RNA, 13 nt, Mycobacterium tuberculosis H37Rv
uggcgaucucacc

SEQ ID NO: 1271641 - RNA, 14 nt, Mycobacterium tuberculosis H37Rv
uggcgaucaaccgc

SEQ ID NO: 1271642 - RNA, 21 nt, Mycobacterium tuberculosis H37Rv
uggcgaucaaccgcugucacc

SEQ ID NO: 1271643 - RNA, 14 nt, Mycobacterium tuberculosis H37Rv
uggcgaugccgaga

SEQ ID NO: 1271644 - RNA, 13 nt, Mycobacterium tuberculosis H37Rv
uggcgcaccggcg

SEQ ID NO: 1271645 - RNA, 20 nt, Mycobacterium tuberculosis H37Rv
uggcgauuucggcgccuggc

SEQ ID NO: 1271646 - RNA, 21 nt, Mycobacterium tuberculosis H37Rv
uggcgcgggccggcgacuguc

SEQ ID NO: 1271647 - RNA, 17 nt, Mycobacterium tuberculosis H37Rv
uggcgcgaccuccgcga

SEQ ID NO: 1271648 - RNA, 20 nt, Mycobacterium tuberculosis H37Rv
uggcgccguuaccgccguug

SEQ ID NO: 1271649 - RNA, 20 nt, Mycobacterium tuberculosis H37Rv
uggcgccggggcgcagguug

SEQ ID NO: 1271650 - RNA, 23 nt, Mycobacterium tuberculosis H37Rv
uggcgcguggucgggaacccggu

SEQ ID NO: 1271651 - RNA, 14 nt, Mycobacterium tuberculosis H37Rv
uggcgcgaccgaug

SEQ ID NO: 1271652 - RNA, 13 nt, Mycobacterium tuberculosis H37Rv
uggcgcugaucgg

SEQ ID NO: 1271653 - RNA, 19 nt, Mycobacterium tuberculosis H37Rv
uggcgcugagggugcucuc

SEQ ID NO: 1271654 - RNA, 14 nt, Mycobacterium tuberculosis H37Rv
uggcgcucggcgag

SEQ ID NO: 1271655 - RNA, 17 nt, Mycobacterium tuberculosis H37Rv
uggcggcggugccacga

SEQ ID NO: 1271656 - RNA, 21 nt, Mycobacterium tuberculosis H37Rv
uggcggcgggccucggcgacc

SEQ ID NO: 1271657 - RNA, 20 nt, Mycobacterium tuberculosis H37Rv
uggcggcgcgcgcugcgcag

SEQ ID NO: 1271658 - RNA, 22 nt, Mycobacterium tuberculosis H37Rv
uggcggcgccgcagaucaccgc

SEQ ID NO: 1271659 - RNA, 20 nt, Mycobacterium tuberculosis H37Rv
uggcggcgaugguaucgccg

SEQ ID NO: 1271660 - RNA, 14 nt, Mycobacterium tuberculosis H37Rv
uggcggcgagcagc

SEQ ID NO: 1271661 - RNA, 23 nt, Mycobacterium tuberculosis H37Rv
uggcggccucgggcucaaacgga

SEQ ID NO: 1271662 - RNA, 19 nt, Mycobacterium tuberculosis H37Rv
uggcggccuccuccccgac

SEQ ID NO: 1271663 - RNA, 17 nt, Mycobacterium tuberculosis H37Rv
uggcggcgacacgccag

SEQ ID NO: 1271664 - RNA, 19 nt, Mycobacterium tuberculosis H37Rv
uggcggcgacacgccaggu

SEQ ID NO: 1271665 - RNA, 19 nt, Mycobacterium tuberculosis H37Rv
uggcgggagcaccgaccag

SEQ ID NO: 1271666 - RNA, 16 nt, Mycobacterium tuberculosis H37Rv
uggcggcuucgacguc

SEQ ID NO: 1271667 - RNA, 17 nt, Mycobacterium tuberculosis H37Rv
uggcggcugcagccgac

SEQ ID NO: 1271668 - RNA, 20 nt, Mycobacterium tuberculosis H37Rv
uggcggcugcagccgaccga

SEQ ID NO: 1271669 - RNA, 18 nt, Mycobacterium tuberculosis H37Rv
uggcgggagaucgucgcc

SEQ ID NO: 1271670 - RNA, 12 nt, Mycobacterium tuberculosis H37Rv
uggcgggcugaa

SEQ ID NO: 1271671 - RNA, 15 nt, Mycobacterium tuberculosis H37Rv
uggcggucgguuccg

SEQ ID NO: 1271672 - RNA, 17 nt, Mycobacterium tuberculosis H37Rv
uggcggugcugcuucaa

SEQ ID NO: 1271673 - RNA, 19 nt, Mycobacterium tuberculosis H37Rv
uggcggugaacaccgccag

SEQ ID NO: 1271674 - RNA, 17 nt, Mycobacterium tuberculosis H37Rv
uggcggugagccgccag

SEQ ID NO: 1271675 - RNA, 16 nt, Mycobacterium tuberculosis H37Rv
uggcgucgaugccggc

SEQ ID NO: 1271676 - RNA, 14 nt, Mycobacterium tuberculosis H37Rv
uggcgucgcgguug

SEQ ID NO: 1271677 - RNA, 13 nt, Mycobacterium tuberculosis H37Rv
ugguccaaccggg

SEQ ID NO: 1271678 - RNA, 14 nt, Mycobacterium tuberculosis H37Rv
uggucugcgcggug

SEQ ID NO: 1271679 - RNA, 15 nt, Mycobacterium tuberculosis H37Rv
uggucccacaccucc

SEQ ID NO: 1271680 - RNA, 18 nt, Mycobacterium tuberculosis H37Rv
uggugaagccguagacgu

SEQ ID NO: 1271681 - RNA, 23 nt, Mycobacterium tuberculosis H37Rv
uggugacagagcggguucgacgu

SEQ ID NO: 1271682 - RNA, 17 nt, Mycobacterium tuberculosis H37Rv
ugguggacgaugcggua

SEQ ID NO: 1271683 - RNA, 22 nt, Mycobacterium tuberculosis H37Rv
ugguggccgaacgggucggcga

SEQ ID NO: 1271684 - RNA, 15 nt, Mycobacterium tuberculosis H37Rv
uggugggaucgcagc

SEQ ID NO: 1271685 - RNA, 14 nt, Mycobacterium tuberculosis H37Rv
ugguggcgggguug

SEQ ID NO: 1271686 - RNA, 16 nt, Mycobacterium tuberculosis H37Rv
ugguggcgguuccggc

SEQ ID NO: 1271687 - RNA, 19 nt, Mycobacterium tuberculosis H37Rv
uggugggcgcagagucaac

SEQ ID NO: 1271688 - RNA, 15 nt, Mycobacterium tuberculosis H37Rv
ugguggcgaccccgc

SEQ ID NO: 1271689 - RNA, 17 nt, Mycobacterium tuberculosis H37Rv
ugguggccggggugccg

SEQ ID NO: 1271690 - RNA, 23 nt, Mycobacterium tuberculosis H37Rv
uggugcacggcuuuucgacgcug

SEQ ID NO: 1271691 - RNA, 13 nt, Mycobacterium tuberculosis H37Rv
uggugcagaccac

SEQ ID NO: 1271692 - RNA, 23 nt, Mycobacterium tuberculosis H37Rv
uggugcagaauucggcgcgacag

SEQ ID NO: 1271693 - RNA, 20 nt, Mycobacterium tuberculosis H37Rv
uggugccgccaccaccggcg

SEQ ID NO: 1271694 - RNA, 13 nt, Mycobacterium tuberculosis H37Rv
uggugcgggguug

SEQ ID NO: 1271695 - RNA, 15 nt, Mycobacterium tuberculosis H37Rv
uguagggccggugac

SEQ ID NO: 1271696 - RNA, 16 nt, Mycobacterium tuberculosis H37Rv
uguacugcggugccac

SEQ ID NO: 1271697 - RNA, 18 nt, Mycobacterium tuberculosis H37Rv
uguagagcgcaccgcgaa

SEQ ID NO: 1271698 - RNA, 16 nt, Mycobacterium tuberculosis H37Rv
ugguugcguccgccga

SEQ ID NO: 1271699 - RNA, 22 nt, Mycobacterium tuberculosis H37Rv
uggugggcgggaucgacuccgg

SEQ ID NO: 1271700 - RNA, 14 nt, Mycobacterium tuberculosis H37Rv
uguacccggcgacg

SEQ ID NO: 1271701 - RNA, 14 nt, Mycobacterium tuberculosis H37Rv
ugggguccggugac

SEQ ID NO: 1271702 - RNA, 15 nt, Mycobacterium tuberculosis H37Rv
uggggucgacgcagu

SEQ ID NO: 1271703 - RNA, 13 nt, Mycobacterium tuberculosis H37Rv
uggggguggcagc

SEQ ID NO: 1271704 - RNA, 19 nt, Mycobacterium tuberculosis H37Rv
ugggguggcaucgaacgcc

SEQ ID NO: 1271705 - RNA, 20 nt, Mycobacterium tuberculosis H37Rv
ugggggcuucugcgucugcu

SEQ ID NO: 1271706 - RNA, 16 nt, Mycobacterium tuberculosis H37Rv
ugggggagccggugac

SEQ ID NO: 1271707 - RNA, 17 nt, Mycobacterium tuberculosis H37Rv
uggggccguguucuacc

SEQ ID NO: 1271708 - RNA, 18 nt, Mycobacterium tuberculosis H37Rv
uggggcggcaugcucacc

SEQ ID NO: 1271709 - RNA, 14 nt, Mycobacterium tuberculosis H37Rv
uggguucgcgguug

SEQ ID NO: 1271710 - RNA, 18 nt, Mycobacterium tuberculosis H37Rv
ugggugucaaugugguuc

SEQ ID NO: 1271711 - RNA, 16 nt, Mycobacterium tuberculosis H37Rv
ugguaggccggugcgu

SEQ ID NO: 1271712 - RNA, 15 nt, Mycobacterium tuberculosis H37Rv
uggguggugcucacc

SEQ ID NO: 1271713 - RNA, 15 nt, Mycobacterium tuberculosis H37Rv
ugggugaacgccugc

SEQ ID NO: 1271714 - RNA, 20 nt, Mycobacterium tuberculosis H37Rv
ugggugccguugcgucugcu

SEQ ID NO: 1271715 - RNA, 21 nt, Mycobacterium tuberculosis H37Rv
ugggcuucgaguuuggcgacg

SEQ ID NO: 1271716 - RNA, 19 nt, Mycobacterium tuberculosis H37Rv
ugggcugggauagcgcggu

SEQ ID NO: 1271717 - RNA, 19 nt, Mycobacterium tuberculosis H37Rv
ugggcuuuugcgucugcuc

SEQ ID NO: 1271718 - RNA, 17 nt, Mycobacterium tuberculosis H37Rv
ugggcuuuugcgucugc

SEQ ID NO: 1271719 - RNA, 16 nt, Mycobacterium tuberculosis H37Rv
ugggcuuuugcgucug

SEQ ID NO: 1271720 - RNA, 21 nt, Mycobacterium tuberculosis H37Rv
uggggaggaaggucgaaucgc

SEQ ID NO: 1271721 - RNA, 13 nt, Mycobacterium tuberculosis H37Rv
uggggcacgacgc

SEQ ID NO: 1271722 - RNA, 19 nt, Mycobacterium tuberculosis H37Rv
uggggccggaugucgacga

SEQ ID NO: 1271723 - RNA, 20 nt, Mycobacterium tuberculosis H37Rv
ugggcgggauggccgccgac

SEQ ID NO: 1271724 - RNA, 19 nt, Mycobacterium tuberculosis H37Rv
ugggcgggauggccgccga

SEQ ID NO: 1271725 - RNA, 16 nt, Mycobacterium tuberculosis H37Rv
ugggcggguucggacg

SEQ ID NO: 1271726 - RNA, 21 nt, Mycobacterium tuberculosis H37Rv
ugggcgugacguagugcaccg

SEQ ID NO: 1271727 - RNA, 15 nt, Mycobacterium tuberculosis H37Rv
ugggcgucaagcaag

SEQ ID NO: 1271728 - RNA, 22 nt, Mycobacterium tuberculosis H37Rv
ugggcgucaagcaaguccaccg

SEQ ID NO: 1271729 - RNA, 19 nt, Mycobacterium tuberculosis H37Rv
ugggcggugucgucgaggu

SEQ ID NO: 1271730 - RNA, 16 nt, Mycobacterium tuberculosis H37Rv
ugggcguuggcgacga

SEQ ID NO: 1271731 - RNA, 21 nt, Mycobacterium tuberculosis H37Rv
ugggcccaggagauccaccgg

SEQ ID NO: 1271732 - RNA, 18 nt, Mycobacterium tuberculosis H37Rv
ugggcccagcggccgcga

SEQ ID NO: 1271733 - RNA, 20 nt, Mycobacterium tuberculosis H37Rv
ugggccgacugggcgcgacc

SEQ ID NO: 1271734 - RNA, 14 nt, Mycobacterium tuberculosis H37Rv
ugggccgacgggac

SEQ ID NO: 1271735 - RNA, 19 nt, Mycobacterium tuberculosis H37Rv
ugggcccugcacagcagcg

SEQ ID NO: 1271736 - RNA, 22 nt, Mycobacterium tuberculosis H37Rv
ugggcgaucgacaccgugaccg

SEQ ID NO: 1271737 - RNA, 16 nt, Mycobacterium tuberculosis H37Rv
ugggcgacgucaucgc

SEQ ID NO: 1271738 - RNA, 19 nt, Mycobacterium tuberculosis H37Rv
ugggcgacgucaucgccga

SEQ ID NO: 1271739 - RNA, 22 nt, Mycobacterium tuberculosis H37Rv
ugggcggaacgaugccggcaag

SEQ ID NO: 1271740 - RNA, 17 nt, Mycobacterium tuberculosis H37Rv
ugggcggcauuaccaac

SEQ ID NO: 1271741 - RNA, 23 nt, Mycobacterium tuberculosis H37Rv
ugggcggccuggucggccagguc

SEQ ID NO: 1271742 - RNA, 15 nt, Mycobacterium tuberculosis H37Rv
ugggcgcugucacgu

SEQ ID NO: 1271743 - RNA, 20 nt, Mycobacterium tuberculosis H37Rv
ugggcgcuuaugcgucugcu

SEQ ID NO: 1271744 - RNA, 16 nt, Mycobacterium tuberculosis H37Rv
ugggcgcgcucaucga

SEQ ID NO: 1271745 - RNA, 16 nt, Mycobacterium tuberculosis H37Rv
ugggcgccgucgccgu

SEQ ID NO: 1271746 - RNA, 15 nt, Mycobacterium tuberculosis H37Rv
ugggcgccaccaucg

SEQ ID NO: 1271747 - RNA, 18 nt, Mycobacterium tuberculosis H37Rv
ugggcgccgacaccggcu

SEQ ID NO: 1271748 - RNA, 16 nt, Mycobacterium tuberculosis H37Rv
ugggcgccgacaccgg

SEQ ID NO: 1271749 - RNA, 21 nt, Mycobacterium tuberculosis H37Rv
ugggcgcccgcgguccggcga

SEQ ID NO: 1271750 - RNA, 20 nt, Mycobacterium tuberculosis H37Rv
ugggcgauucugcgucugcu

SEQ ID NO: 1271751 - RNA, 19 nt, Mycobacterium tuberculosis H37Rv
ugggcgauucugcgucugc

SEQ ID NO: 1271752 - RNA, 20 nt, Mycobacterium tuberculosis H37Rv
ugggcgauuuugcgucugcu

SEQ ID NO: 1271753 - RNA, 23 nt, Mycobacterium tuberculosis H37Rv
ugggcgauucugugucugcucgc

SEQ ID NO: 1271754 - RNA, 18 nt, Mycobacterium tuberculosis H37Rv
ugggcgauuuugcgucug

SEQ ID NO: 1271755 - RNA, 15 nt, Mycobacterium tuberculosis H37Rv
ugccgcuggucgucg

SEQ ID NO: 1271756 - RNA, 17 nt, Mycobacterium tuberculosis H37Rv
ugccgcugcauccgcag

SEQ ID NO: 1271757 - RNA, 21 nt, Mycobacterium tuberculosis H37Rv
ugccgcugcauccgcagcacc

SEQ ID NO: 1271758 - RNA, 14 nt, Mycobacterium tuberculosis H37Rv
ugccgcugacgguu

SEQ ID NO: 1271759 - RNA, 19 nt, Mycobacterium tuberculosis H37Rv
ugccgcguugccgggguug

SEQ ID NO: 1271760 - RNA, 16 nt, Mycobacterium tuberculosis H37Rv
ugcccuucugacuauc

SEQ ID NO: 1271761 - RNA, 19 nt, Mycobacterium tuberculosis H37Rv
ugcccuucuucgaccgcga

SEQ ID NO: 1271762 - RNA, 16 nt, Mycobacterium tuberculosis H37Rv
ugcccuuggccagcag

SEQ ID NO: 1271763 - RNA, 21 nt, Mycobacterium tuberculosis H37Rv
ugccgaacagggaggucgccg

SEQ ID NO: 1271764 - RNA, 18 nt, Mycobacterium tuberculosis H37Rv
ugccgaacagcgaaccgc

SEQ ID NO: 1271765 - RNA, 15 nt, Mycobacterium tuberculosis H37Rv
ugccgacccgucgga

SEQ ID NO: 1271766 - RNA, 12 nt, Mycobacterium tuberculosis H37Rv
ugccgaccgguc

SEQ ID NO: 1271767 - RNA, 23 nt, Mycobacterium tuberculosis H37Rv
ugccgacgcuccaggguccggac

SEQ ID NO: 1271768 - RNA, 18 nt, Mycobacterium tuberculosis H37Rv
ugccgacgcgcggccagc

SEQ ID NO: 1271769 - RNA, 18 nt, Mycobacterium tuberculosis H37Rv
ugccggagacgucgccgc

SEQ ID NO: 1271770 - RNA, 19 nt, Mycobacterium tuberculosis H37Rv
ugccggagacacccgccag

SEQ ID NO: 1271771 - RNA, 23 nt, Mycobacterium tuberculosis H37Rv
ugccggaguugucgacggccacc

SEQ ID NO: 1271772 - RNA, 13 nt, Mycobacterium tuberculosis H37Rv
ugccggaccaccg

SEQ ID NO: 1271773 - RNA, 19 nt, Mycobacterium tuberculosis H37Rv
ugccggaccaccgggccga

SEQ ID NO: 1271774 - RNA, 21 nt, Mycobacterium tuberculosis H37Rv
ugccggaccaccgggccgaca

SEQ ID NO: 1271775 - RNA, 15 nt, Mycobacterium tuberculosis H37Rv
ugccggaaacgccag

SEQ ID NO: 1271776 - RNA, 23 nt, Mycobacterium tuberculosis H37Rv
ugccggcacccgucgggugcuga

SEQ ID NO: 1271777 - RNA, 17 nt, Mycobacterium tuberculosis H37Rv
ugccggcagcgguggca

SEQ ID NO: 1271778 - RNA, 17 nt, Mycobacterium tuberculosis H37Rv
ugccggauugacgccga

SEQ ID NO: 1271779 - RNA, 14 nt, Mycobacterium tuberculosis H37Rv
ugccggccaucgcc

SEQ ID NO: 1271780 - RNA, 12 nt, Mycobacterium tuberculosis H37Rv
ugccggugcuga

SEQ ID NO: 1271781 - RNA, 14 nt, Mycobacterium tuberculosis H37Rv
ugccgguuuucggg

SEQ ID NO: 1271782 - RNA, 14 nt, Mycobacterium tuberculosis H37Rv
ugccgguugccacc

SEQ ID NO: 1271783 - RNA, 16 nt, Mycobacterium tuberculosis H37Rv
ugccgguuuccgucug

SEQ ID NO: 1271784 - RNA, 19 nt, Mycobacterium tuberculosis H37Rv
ugccgguguugauuccggc

SEQ ID NO: 1271785 - RNA, 18 nt, Mycobacterium tuberculosis H37Rv
aauagcaacucgaucgcc

SEQ ID NO: 1271786 - RNA, 21 nt, Mycobacterium tuberculosis H37Rv
ugccgucggugccggggcugc

SEQ ID NO: 1271787 - RNA, 22 nt, Mycobacterium tuberculosis H37Rv
ugccggguuugaucagcucggu

SEQ ID NO: 1271788 - RNA, 16 nt, Mycobacterium tuberculosis H37Rv
ugccggggcugccgcc

SEQ ID NO: 1271789 - RNA, 15 nt, Mycobacterium tuberculosis H37Rv
ugccgggcgacgguu

SEQ ID NO: 1271790 - RNA, 21 nt, Mycobacterium tuberculosis H37Rv
ugccggcuuugagccgcucga

SEQ ID NO: 1271791 - RNA, 14 nt, Mycobacterium tuberculosis H37Rv
ugccggcuucggcg

SEQ ID NO: 1271792 - RNA, 22 nt, Mycobacterium tuberculosis H37Rv
ugccgggaaccaacaccagguc

SEQ ID NO: 1271793 - RNA, 19 nt, Mycobacterium tuberculosis H37Rv
ugccgggacauucccaggu

SEQ ID NO: 1271794 - RNA, 17 nt, Mycobacterium tuberculosis H37Rv
ugccgggccauucaccg

SEQ ID NO: 1271795 - RNA, 18 nt, Mycobacterium tuberculosis H37Rv
ugccggcgugcgcgagau

SEQ ID NO: 1271796 - RNA, 18 nt, Mycobacterium tuberculosis H37Rv
ugccggcgguggccgaca

SEQ ID NO: 1271797 - RNA, 16 nt, Mycobacterium tuberculosis H37Rv
ugccggcggcgacguc

SEQ ID NO: 1271798 - RNA, 15 nt, Mycobacterium tuberculosis H37Rv
ugccggcgccgccag

SEQ ID NO: 1271799 - RNA, 15 nt, Mycobacterium tuberculosis H37Rv
ugccggcgaacucgc

SEQ ID NO: 1271800 - RNA, 14 nt, Mycobacterium tuberculosis H37Rv
ugccggcgaacucg

SEQ ID NO: 1271801 - RNA, 14 nt, Mycobacterium tuberculosis H37Rv
ugccggcgacgcua

SEQ ID NO: 1271802 - RNA, 13 nt, Mycobacterium tuberculosis H37Rv
ugcgccaggaacc

SEQ ID NO: 1271803 - RNA, 22 nt, Mycobacterium tuberculosis H37Rv
ugcgccaucucgacggugaccg

SEQ ID NO: 1271804 - RNA, 16 nt, Mycobacterium tuberculosis H37Rv
ugcgcccaggugaucg

SEQ ID NO: 1271805 - RNA, 23 nt, Mycobacterium tuberculosis H37Rv
ugcgcccgacggaguucgacguc

SEQ ID NO: 1271806 - RNA, 21 nt, Mycobacterium tuberculosis H37Rv
ugcgcccgacggaguucgacg

SEQ ID NO: 1271807 - RNA, 21 nt, Mycobacterium tuberculosis H37Rv
ugcgccgagcuggcaacgccg

SEQ ID NO: 1271808 - RNA, 14 nt, Mycobacterium tuberculosis H37Rv
ugcgccggcgcugc

SEQ ID NO: 1271809 - RNA, 12 nt, Mycobacterium tuberculosis H37Rv
ugcgccgcagcg

SEQ ID NO: 1271810 - RNA, 15 nt, Mycobacterium tuberculosis H37Rv
ugcgccggcuggcgg

SEQ ID NO: 1271811 - RNA, 23 nt, Mycobacterium tuberculosis H37Rv
ugcgccgaccggccacgaccucg

SEQ ID NO: 1271812 - RNA, 22 nt, Mycobacterium tuberculosis H37Rv
ugcgccgaaugccaccucgacg

SEQ ID NO: 1271813 - RNA, 23 nt, Mycobacterium tuberculosis H37Rv
ugcgccgaaugccaccucgacgc

SEQ ID NO: 1271814 - RNA, 21 nt, Mycobacterium tuberculosis H37Rv
ugcgcccggccaagccggcga

SEQ ID NO: 1271815 - RNA, 17 nt, Mycobacterium tuberculosis H37Rv
ugcgcagaacaccaccg

SEQ ID NO: 1271816 - RNA, 18 nt, Mycobacterium tuberculosis H37Rv
ugcgcacucuagccgggu

SEQ ID NO: 1271817 - RNA, 13 nt, Mycobacterium tuberculosis H37Rv
ugcgccacacccg

SEQ ID NO: 1271818 - RNA, 16 nt, Mycobacterium tuberculosis H37Rv
ugcgcacuaccgccuu

SEQ ID NO: 1271819 - RNA, 20 nt, Mycobacterium tuberculosis H37Rv
ugcgcaccagcggcugaccg

SEQ ID NO: 1271820 - RNA, 20 nt, Mycobacterium tuberculosis H37Rv
ugcgcaccggucaacgugga

SEQ ID NO: 1271821 - RNA, 19 nt, Mycobacterium tuberculosis H37Rv
ugcgcaccugggucgacga

SEQ ID NO: 1271822 - RNA, 18 nt, Mycobacterium tuberculosis H37Rv
ugcgcaccugggucgacg

SEQ ID NO: 1271823 - RNA, 19 nt, Mycobacterium tuberculosis H37Rv
ugcgccagaucaccgucga

SEQ ID NO: 1271824 - RNA, 19 nt, Mycobacterium tuberculosis H37Rv
ugcgccagcaacagcgcgg

SEQ ID NO: 1271825 - RNA, 12 nt, Mycobacterium tuberculosis H37Rv
ugcgccaccgug

SEQ ID NO: 1271826 - RNA, 21 nt, Mycobacterium tuberculosis H37Rv
ugccuuacacgccuggcuacg

SEQ ID NO: 1271827 - RNA, 21 nt, Mycobacterium tuberculosis H37Rv
ugccugucagaaggaucagcg

SEQ ID NO: 1271828 - RNA, 13 nt, Mycobacterium tuberculosis H37Rv
ugccguucggacc

SEQ ID NO: 1271829 - RNA, 14 nt, Mycobacterium tuberculosis H37Rv
ugccuuagcccggc

SEQ ID NO: 1271830 - RNA, 22 nt, Mycobacterium tuberculosis H37Rv
ugccuuccucggcaagucgacg

SEQ ID NO: 1271831 - RNA, 15 nt, Mycobacterium tuberculosis H37Rv
ugcgaaacaucucgg

SEQ ID NO: 1271832 - RNA, 20 nt, Mycobacterium tuberculosis H37Rv
ugcgaaaauccgugccgaaa

SEQ ID NO: 1271833 - RNA, 18 nt, Mycobacterium tuberculosis H37Rv
ugcgaaacgaauccgcca

SEQ ID NO: 1271834 - RNA, 16 nt, Mycobacterium tuberculosis H37Rv
ugcgaaaauccgugcc

SEQ ID NO: 1271835 - RNA, 12 nt, Mycobacterium tuberculosis H37Rv
ugcgauggccga

SEQ ID NO: 1271836 - RNA, 16 nt, Mycobacterium tuberculosis H37Rv
ugcgauucugcgucug

SEQ ID NO: 1271837 - RNA, 18 nt, Mycobacterium tuberculosis H37Rv
ugcgauuccgcgucugcu

SEQ ID NO: 1271838 - RNA, 19 nt, Mycobacterium tuberculosis H37Rv
ugcgauucugcgucugcuc

SEQ ID NO: 1271839 - RNA, 18 nt, Mycobacterium tuberculosis H37Rv
ugcgauucugcgucugcu

SEQ ID NO: 1271840 - RNA, 17 nt, Mycobacterium tuberculosis H37Rv
ugcgauucugcgucugc

SEQ ID NO: 1271841 - RNA, 13 nt, Mycobacterium tuberculosis H37Rv
ugcgcaaccgcgg

SEQ ID NO: 1271842 - RNA, 17 nt, Mycobacterium tuberculosis H37Rv
ugcgacucugcgucugc

SEQ ID NO: 1271843 - RNA, 16 nt, Mycobacterium tuberculosis H37Rv
ugcgacucugcgucug

SEQ ID NO: 1271844 - RNA, 17 nt, Mycobacterium tuberculosis H37Rv
ugcgaugcugaucaccg

SEQ ID NO: 1271845 - RNA, 12 nt, Mycobacterium tuberculosis H37Rv
ugcgaugcccac

SEQ ID NO: 1271846 - RNA, 21 nt, Mycobacterium tuberculosis H37Rv
ugcgaucgucaacgacgacga

SEQ ID NO: 1271847 - RNA, 15 nt, Mycobacterium tuberculosis H37Rv
ugcgaucgccgcuaa

SEQ ID NO: 1271848 - RNA, 14 nt, Mycobacterium tuberculosis H37Rv
ugcgagcgacaccg

SEQ ID NO: 1271849 - RNA, 13 nt, Mycobacterium tuberculosis H37Rv
ugcggcgguaugc

SEQ ID NO: 1271850 - RNA, 20 nt, Mycobacterium tuberculosis H37Rv
ugcgggaaguugcccaggug

SEQ ID NO: 1271851 - RNA, 23 nt, Mycobacterium tuberculosis H37Rv
ugcggcugaauucggcgagcgcc

SEQ ID NO: 1271852 - RNA, 13 nt, Mycobacterium tuberculosis H37Rv
ugcggcugcccac

SEQ ID NO: 1271853 - RNA, 19 nt, Mycobacterium tuberculosis H37Rv
ugcggcggcccaucgaccg

SEQ ID NO: 1271854 - RNA, 14 nt, Mycobacterium tuberculosis H37Rv
ugcggccccgacau

SEQ ID NO: 1271855 - RNA, 18 nt, Mycobacterium tuberculosis H37Rv
ugcggccccaugcgccag

SEQ ID NO: 1271856 - RNA, 14 nt, Mycobacterium tuberculosis H37Rv
ugcggcaagcgcac

SEQ ID NO: 1271857 - RNA, 12 nt, Mycobacterium tuberculosis H37Rv
ugcggaucggac

SEQ ID NO: 1271858 - RNA, 15 nt, Mycobacterium tuberculosis H37Rv
ugcggcacgaucgcc

SEQ ID NO: 1271859 - RNA, 18 nt, Mycobacterium tuberculosis H37Rv
ugcggcaccucauugccg

SEQ ID NO: 1271860 - RNA, 18 nt, Mycobacterium tuberculosis H37Rv
ugcggcaacgaggucugc

SEQ ID NO: 1271861 - RNA, 20 nt, Mycobacterium tuberculosis H37Rv
ugcgcuuggucgaccgccga

SEQ ID NO: 1271862 - RNA, 18 nt, Mycobacterium tuberculosis H37Rv
ugcggaacaccaccaggc

SEQ ID NO: 1271863 - RNA, 18 nt, Mycobacterium tuberculosis H37Rv
ugcggauguccuugcggu

SEQ ID NO: 1271864 - RNA, 15 nt, Mycobacterium tuberculosis H37Rv
ugcggaugucgucga

SEQ ID NO: 1271865 - RNA, 20 nt, Mycobacterium tuberculosis H37Rv
ugcgccguucgcucccccgc

SEQ ID NO: 1271866 - RNA, 17 nt, Mycobacterium tuberculosis H37Rv
ugcgccguggcaucgcc

SEQ ID NO: 1271867 - RNA, 15 nt, Mycobacterium tuberculosis H37Rv
ugcgccgguccucgu

SEQ ID NO: 1271868 - RNA, 22 nt, Mycobacterium tuberculosis H37Rv
ugcgccgggcguccgccggcga

SEQ ID NO: 1271869 - RNA, 22 nt, Mycobacterium tuberculosis H37Rv
ugcgccgggcucgcgaucguca

SEQ ID NO: 1271870 - RNA, 18 nt, Mycobacterium tuberculosis H37Rv
ugcgccggggacacagcg

SEQ ID NO: 1271871 - RNA, 11 nt, Mycobacterium tuberculosis H37Rv
ugcgccgucag

SEQ ID NO: 1271872 - RNA, 14 nt, Mycobacterium tuberculosis H37Rv
ugcgcuuccaucgc

SEQ ID NO: 1271873 - RNA, 22 nt, Mycobacterium tuberculosis H37Rv
ugcgccuaaccccggcucgacg

SEQ ID NO: 1271874 - RNA, 19 nt, Mycobacterium tuberculosis H37Rv
ugcgggugggcacaccggu

SEQ ID NO: 1271875 - RNA, 19 nt, Mycobacterium tuberculosis H37Rv
ugcgggugggacaccaucu

SEQ ID NO: 1271876 - RNA, 21 nt, Mycobacterium tuberculosis H37Rv
ugcgguaaucgccaccgcaag

SEQ ID NO: 1271877 - RNA, 16 nt, Mycobacterium tuberculosis H37Rv
ugcgguaaucgccacc

SEQ ID NO: 1271878 - RNA, 19 nt, Mycobacterium tuberculosis H37Rv
ugcgggggcuuaugcgacu

SEQ ID NO: 1271879 - RNA, 20 nt, Mycobacterium tuberculosis H37Rv
ugcgggggcuuaugcgacug

SEQ ID NO: 1271880 - RNA, 16 nt, Mycobacterium tuberculosis H37Rv
ugcggguaaaccaggu

SEQ ID NO: 1271881 - RNA, 16 nt, Mycobacterium tuberculosis H37Rv
ugcggguagccgucga

SEQ ID NO: 1271882 - RNA, 17 nt, Mycobacterium tuberculosis H37Rv
ugcggguaaaccaggug

SEQ ID NO: 1271883 - RNA, 20 nt, Mycobacterium tuberculosis H37Rv
ugcggguaggugacgacguc

SEQ ID NO: 1271884 - RNA, 13 nt, Mycobacterium tuberculosis H37Rv
ugcgggucucgcc

SEQ ID NO: 1271885 - RNA, 14 nt, Mycobacterium tuberculosis H37Rv
ugcgggucucgccg

SEQ ID NO: 1271886 - RNA, 20 nt, Mycobacterium tuberculosis H37Rv
ugcggguagccgucgauccc

SEQ ID NO: 1271887 - RNA, 15 nt, Mycobacterium tuberculosis H37Rv
ugcgggccgcucggu

SEQ ID NO: 1271888 - RNA, 23 nt, Mycobacterium tuberculosis H37Rv
ugcgggccgcucgguaggacagg

SEQ ID NO: 1271889 - RNA, 15 nt, Mycobacterium tuberculosis H37Rv
ugcgggcgaucucga

SEQ ID NO: 1271890 - RNA, 15 nt, Mycobacterium tuberculosis H37Rv
ugcgggcaugccggc

SEQ ID NO: 1271891 - RNA, 20 nt, Mycobacterium tuberculosis H37Rv
ugcgggcagcacucuucgau

SEQ ID NO: 1271892 - RNA, 14 nt, Mycobacterium tuberculosis H37Rv
ugcgggaucgccga

SEQ ID NO: 1271893 - RNA, 22 nt, Mycobacterium tuberculosis H37Rv
ugcgggcaaccacaucaccggc

SEQ ID NO: 1271894 - RNA, 17 nt, Mycobacterium tuberculosis H37Rv
ugcggggcgccugaugc

SEQ ID NO: 1271895 - RNA, 20 nt, Mycobacterium tuberculosis H37Rv
ugcgggggacgggucgccgc

SEQ ID NO: 1271896 - RNA, 16 nt, Mycobacterium tuberculosis H37Rv
ugcgggcucucggcgu

SEQ ID NO: 1271897 - RNA, 20 nt, Mycobacterium tuberculosis H37Rv
ugcggggccgggcgaucgcc

SEQ ID NO: 1271898 - RNA, 20 nt, Mycobacterium tuberculosis H37Rv
ugcgucgcggacggugcggu

SEQ ID NO: 1271899 - RNA, 17 nt, Mycobacterium tuberculosis H37Rv
ugcgucgaugcgcugcu

SEQ ID NO: 1271900 - RNA, 20 nt, Mycobacterium tuberculosis H37Rv
ugcguccggaaccaaccucg

SEQ ID NO: 1271901 - RNA, 14 nt, Mycobacterium tuberculosis H37Rv
ugcgguugcgcgga

SEQ ID NO: 1271902 - RNA, 23 nt, Mycobacterium tuberculosis H37Rv
ugcgguugcgcggaugaggaauu

SEQ ID NO: 1271903 - RNA, 14 nt, Mycobacterium tuberculosis H37Rv
ugcgucggcccggu

SEQ ID NO: 1271904 - RNA, 14 nt, Mycobacterium tuberculosis H37Rv
ugcgucgucgacga

SEQ ID NO: 1271905 - RNA, 13 nt, Mycobacterium tuberculosis H37Rv
ugcgucugcucgc

SEQ ID NO: 1271906 - RNA, 15 nt, Mycobacterium tuberculosis H37Rv
ugcgugaacaagauu

SEQ ID NO: 1271907 - RNA, 15 nt, Mycobacterium tuberculosis H37Rv
ugcgugacccgacau

SEQ ID NO: 1271908 - RNA, 17 nt, Mycobacterium tuberculosis H37Rv
ugcgucugcucggcgca

SEQ ID NO: 1271909 - RNA, 23 nt, Mycobacterium tuberculosis H37Rv
ugcgucugcucgcgcagccgggu

SEQ ID NO: 1271910 - RNA, 20 nt, Mycobacterium tuberculosis H37Rv
ugcgucugcucggcgcggug

SEQ ID NO: 1271911 - RNA, 18 nt, Mycobacterium tuberculosis H37Rv
ugcggugauauccgugaa

SEQ ID NO: 1271912 - RNA, 23 nt, Mycobacterium tuberculosis H37Rv
ugcggucucacucaucggugugc

SEQ ID NO: 1271913 - RNA, 19 nt, Mycobacterium tuberculosis H37Rv
ugcggucgacguuggcaaa

SEQ ID NO: 1271914 - RNA, 21 nt, Mycobacterium tuberculosis H37Rv
ugcggugcaggauucggcggu

SEQ ID NO: 1271915 - RNA, 16 nt, Mycobacterium tuberculosis H37Rv
ugcgguuccgauagcc

SEQ ID NO: 1271916 - RNA, 23 nt, Mycobacterium tuberculosis H37Rv
ugcggugccacggugacccuggu

SEQ ID NO: 1271917 - RNA, 15 nt, Mycobacterium tuberculosis H37Rv
ugcugcgcggugccg

SEQ ID NO: 1271918 - RNA, 17 nt, Mycobacterium tuberculosis H37Rv
ugcugcgggaauccggu

SEQ ID NO: 1271919 - RNA, 14 nt, Mycobacterium tuberculosis H37Rv
ugcuggaucucggu

SEQ ID NO: 1271920 - RNA, 17 nt, Mycobacterium tuberculosis H37Rv
ugcugucgucuuggcga

SEQ ID NO: 1271921 - RNA, 16 nt, Mycobacterium tuberculosis H37Rv
ugcugcuugacuccgc

SEQ ID NO: 1271922 - RNA, 20 nt, Mycobacterium tuberculosis H37Rv
ugcuucccggaugccgaccu

SEQ ID NO: 1271923 - RNA, 18 nt, Mycobacterium tuberculosis H37Rv
ugcuuguguucgugguug

SEQ ID NO: 1271924 - RNA, 17 nt, Mycobacterium tuberculosis H37Rv
ugcuucguugucggcgg

SEQ ID NO: 1271925 - RNA, 14 nt, Mycobacterium tuberculosis H37Rv
ugcuuugcuggcgc

SEQ ID NO: 1271926 - RNA, 14 nt, Mycobacterium tuberculosis H37Rv
ugcucgcgcucguu

SEQ ID NO: 1271927 - RNA, 16 nt, Mycobacterium tuberculosis H37Rv
ugcucgacaaccacgg

SEQ ID NO: 1271928 - RNA, 22 nt, Mycobacterium tuberculosis H37Rv
ugcucgaugcgacgaaccucgg

SEQ ID NO: 1271929 - RNA, 23 nt, Mycobacterium tuberculosis H37Rv
ugcucgcacagcaccacgugcga

SEQ ID NO: 1271930 - RNA, 19 nt, Mycobacterium tuberculosis H37Rv
ugcucgccaggggaacgcu

SEQ ID NO: 1271931 - RNA, 13 nt, Mycobacterium tuberculosis H37Rv
ugcucgccgacca

SEQ ID NO: 1271932 - RNA, 14 nt, Mycobacterium tuberculosis H37Rv
ugcucgcgcccgcu

SEQ ID NO: 1271933 - RNA, 20 nt, Mycobacterium tuberculosis H37Rv
ugcucgcgcaaggcgccgca

SEQ ID NO: 1271934 - RNA, 12 nt, Mycobacterium tuberculosis H37Rv
ugcguuacgccg

SEQ ID NO: 1271935 - RNA, 13 nt, Mycobacterium tuberculosis H37Rv
ugcucccacguga

SEQ ID NO: 1271936 - RNA, 13 nt, Mycobacterium tuberculosis H37Rv
ugcuccaccgucg

SEQ ID NO: 1271937 - RNA, 14 nt, Mycobacterium tuberculosis H37Rv
uugaugcucgaugc

SEQ ID NO: 1271938 - RNA, 22 nt, Mycobacterium tuberculosis H37Rv
uucuguaccggcugguugaccg

SEQ ID NO: 1271939 - RNA, 14 nt, Mycobacterium tuberculosis H37Rv
uucuucacuggcga

SEQ ID NO: 1271940 - RNA, 22 nt, Mycobacterium tuberculosis H37Rv
uucuggucgaaauugggugccg

SEQ ID NO: 1271941 - RNA, 16 nt, Mycobacterium tuberculosis H37Rv
uucuggccguagucgg

SEQ ID NO: 1271942 - RNA, 16 nt, Mycobacterium tuberculosis H37Rv
uugcaggcgcagcugg

SEQ ID NO: 1271943 - RNA, 21 nt, Mycobacterium tuberculosis H37Rv
uugcaucaaaaacgaacccag

SEQ ID NO: 1271944 - RNA, 19 nt, Mycobacterium tuberculosis H37Rv
uugccaccgagaucaugcc

SEQ ID NO: 1271945 - RNA, 20 nt, Mycobacterium tuberculosis H37Rv
uugccgccgaacgccucugc

SEQ ID NO: 1271946 - RNA, 18 nt, Mycobacterium tuberculosis H37Rv
uugccgccguuaccgccg

SEQ ID NO: 1271947 - RNA, 17 nt, Mycobacterium tuberculosis H37Rv
uugccggagacgucgcc

SEQ ID NO: 1271948 - RNA, 13 nt, Mycobacterium tuberculosis H37Rv
uugccggcguugc

SEQ ID NO: 1271949 - RNA, 17 nt, Mycobacterium tuberculosis H37Rv
uugccggcuucggcgag

SEQ ID NO: 1271950 - RNA, 22 nt, Mycobacterium tuberculosis H37Rv
uugccggcuucggcgagcguac

SEQ ID NO: 1271951 - RNA, 22 nt, Mycobacterium tuberculosis H37Rv
uugcccacggcgaccacgccgc

SEQ ID NO: 1271952 - RNA, 18 nt, Mycobacterium tuberculosis H37Rv
uugccaccgguaccgccg

SEQ ID NO: 1271953 - RNA, 17 nt, Mycobacterium tuberculosis H37Rv
uugccaccgguaccgcc

SEQ ID NO: 1271954 - RNA, 19 nt, Mycobacterium tuberculosis H37Rv
uugccacuccaggagccga

SEQ ID NO: 1271955 - RNA, 23 nt, Mycobacterium tuberculosis H37Rv
aauccgcccuaaugaagccguug

SEQ ID NO: 1271956 - RNA, 16 nt, Mycobacterium tuberculosis H37Rv
aauccgcacagcgacg

SEQ ID NO: 1271957 - RNA, 22 nt, Mycobacterium tuberculosis H37Rv
aauccgcacagcgacgagauca

SEQ ID NO: 1271958 - RNA, 13 nt, Mycobacterium tuberculosis H37Rv
aauccgagccgcg

SEQ ID NO: 1271959 - RNA, 22 nt, Mycobacterium tuberculosis H37Rv
uuggcgaucucaccuggagcua

SEQ ID NO: 1271960 - RNA, 15 nt, Mycobacterium tuberculosis H37Rv
uuggcgaucucgacg

SEQ ID NO: 1271961 - RNA, 16 nt, Mycobacterium tuberculosis H37Rv
uuggcgaucagcagcc

SEQ ID NO: 1271962 - RNA, 20 nt, Mycobacterium tuberculosis H37Rv
uuggcgacgaagaagaacuc

SEQ ID NO: 1271963 - RNA, 13 nt, Mycobacterium tuberculosis H37Rv
uuggcgaccaugc

SEQ ID NO: 1271964 - RNA, 20 nt, Mycobacterium tuberculosis H37Rv
uuggcgacgucggcggugac

SEQ ID NO: 1271965 - RNA, 11 nt, Mycobacterium tuberculosis H37Rv
uuggucgccau

SEQ ID NO: 1271966 - RNA, 18 nt, Mycobacterium tuberculosis H37Rv
uuggucagcguggacgcc

SEQ ID NO: 1271967 - RNA, 20 nt, Mycobacterium tuberculosis H37Rv
uugggugccguugcgucugc

SEQ ID NO: 1271968 - RNA, 13 nt, Mycobacterium tuberculosis H37Rv
uuggguuucgaca

SEQ ID NO: 1271969 - RNA, 20 nt, Mycobacterium tuberculosis H37Rv
uuggcgcccgccggcaaccg

SEQ ID NO: 1271970 - RNA, 20 nt, Mycobacterium tuberculosis H37Rv
uugggggcuucugcgucugc

SEQ ID NO: 1271971 - RNA, 13 nt, Mycobacterium tuberculosis H37Rv
uuggggccagguu

SEQ ID NO: 1271972 - RNA, 20 nt, Mycobacterium tuberculosis H37Rv
uugggcgcuuaugcgucugc

SEQ ID NO: 1271973 - RNA, 23 nt, Mycobacterium tuberculosis H37Rv
uugcgcccggcacgcucggugaa

SEQ ID NO: 1271974 - RNA, 12 nt, Mycobacterium tuberculosis H37Rv
aauccagcgccg

SEQ ID NO: 1271975 - RNA, 17 nt, Mycobacterium tuberculosis H37Rv
aauccacgcacucgucg

SEQ ID NO: 1271976 - RNA, 21 nt, Mycobacterium tuberculosis H37Rv
aauccccugcgcugcagcuga

SEQ ID NO: 1271977 - RNA, 22 nt, Mycobacterium tuberculosis H37Rv
uuggccaggucggccaccgugg

SEQ ID NO: 1271978 - RNA, 19 nt, Mycobacterium tuberculosis H37Rv
aaucccgcgaugcgcacca

SEQ ID NO: 1271979 - RNA, 22 nt, Mycobacterium tuberculosis H37Rv
aaucccgggcucugcugccagc

SEQ ID NO: 1271980 - RNA, 16 nt, Mycobacterium tuberculosis H37Rv
uuggccagcagcgcgg

SEQ ID NO: 1271981 - RNA, 15 nt, Mycobacterium tuberculosis H37Rv
uuggccaggaagucc

SEQ ID NO: 1271982 - RNA, 15 nt, Mycobacterium tuberculosis H37Rv
uuggcagagccgacu

SEQ ID NO: 1271983 - RNA, 19 nt, Mycobacterium tuberculosis H37Rv
uugcgccggaugacaccga

SEQ ID NO: 1271984 - RNA, 17 nt, Mycobacterium tuberculosis H37Rv
uuggccaccaucgccgc

SEQ ID NO: 1271985 - RNA, 13 nt, Mycobacterium tuberculosis H37Rv
aaucgacucagcc

SEQ ID NO: 1271986 - RNA, 14 nt, Mycobacterium tuberculosis H37Rv
aaucgagcaccgca

SEQ ID NO: 1271987 - RNA, 11 nt, Mycobacterium tuberculosis H37Rv
aaucgcacgcg

SEQ ID NO: 1271988 - RNA, 17 nt, Mycobacterium tuberculosis H37Rv
uugguguggcccaaccg

SEQ ID NO: 1271989 - RNA, 22 nt, Mycobacterium tuberculosis H37Rv
uugguggcguggcccucggcga

SEQ ID NO: 1271990 - RNA, 13 nt, Mycobacterium tuberculosis H37Rv
uugguggcuggug

SEQ ID NO: 1271991 - RNA, 13 nt, Mycobacterium tuberculosis H37Rv
uugguguccacca

SEQ ID NO: 1271992 - RNA, 19 nt, Mycobacterium tuberculosis H37Rv
uugucggagcuagacccgu

SEQ ID NO: 1271993 - RNA, 22 nt, Mycobacterium tuberculosis H37Rv
uugucgagcaggcccaacgcga

SEQ ID NO: 1271994 - RNA, 11 nt, Mycobacterium tuberculosis H37Rv
uugucggcgau

SEQ ID NO: 1271995 - RNA, 22 nt, Mycobacterium tuberculosis H37Rv
uuugcgucugcucgcgccggug

SEQ ID NO: 1271996 - RNA, 14 nt, Mycobacterium tuberculosis H37Rv
uuugggucggcgau

SEQ ID NO: 1271997 - RNA, 18 nt, Mycobacterium tuberculosis H37Rv
uuugacgcccucggcgac

SEQ ID NO: 1271998 - RNA, 13 nt, Mycobacterium tuberculosis H37Rv
uuugagcggccac

SEQ ID NO: 1271999 - RNA, 16 nt, Mycobacterium tuberculosis H37Rv
uuugccaucgggaccg

SEQ ID NO: 1272000 - RNA, 12 nt, Mycobacterium tuberculosis H37Rv
uuuccagccgac

SEQ ID NO: 1272001 - RNA, 15 nt, Mycobacterium tuberculosis H37Rv
uuuccaucgcgaccu

SEQ ID NO: 1272002 - RNA, 20 nt, Mycobacterium tuberculosis H37Rv
uuuccaccguuagccagguc

SEQ ID NO: 1272003 - RNA, 21 nt, Mycobacterium tuberculosis H37Rv
uuucgcgacgucugccaggcg

SEQ ID NO: 1272004 - RNA, 20 nt, Mycobacterium tuberculosis H37Rv
uuucgggguggcggcaggug

SEQ ID NO: 1272005 - RNA, 15 nt, Mycobacterium tuberculosis H37Rv
aaucgccugcgacag

SEQ ID NO: 1272006 - RNA, 19 nt, Mycobacterium tuberculosis H37Rv
aaucgccgucagcaccgcu

SEQ ID NO: 1272007 - RNA, 23 nt, Mycobacterium tuberculosis H37Rv
aaucgguggaagaguuggggcac

SEQ ID NO: 1272008 - RNA, 23 nt, Mycobacterium tuberculosis H37Rv
aaucgugcggguaauacggcgcc

SEQ ID NO: 1272009 - RNA, 21 nt, Mycobacterium tuberculosis H37Rv
aaucguuggcgaucgcgaucg

SEQ ID NO: 1272010 - RNA, 14 nt, Mycobacterium tuberculosis H37Rv
aaucgucggccagc

SEQ ID NO: 1272011 - RNA, 15 nt, Mycobacterium tuberculosis H37Rv
aaugaaggcaccgaa

SEQ ID NO: 1272012 - RNA, 16 nt, Mycobacterium tuberculosis H37Rv
aauguccaggcgcgca

SEQ ID NO: 1272013 - RNA, 17 nt, Mycobacterium tuberculosis H37Rv
aaugucuucgccgucac

SEQ ID NO: 1272014 - RNA, 23 nt, Mycobacterium tuberculosis H37Rv
aaugucggcgaugcguccgccca

SEQ ID NO: 1272015 - RNA, 21 nt, Mycobacterium tuberculosis H37Rv
aauggcugagcccgccgcgac

SEQ ID NO: 1272016 - RNA, 15 nt, Mycobacterium tuberculosis H37Rv
aauggccgaaccguu

SEQ ID NO: 1272017 - RNA, 22 nt, Mycobacterium tuberculosis H37Rv
aaugcgcugucgcccucgaucg

SEQ ID NO: 1272018 - RNA, 17 nt, Mycobacterium tuberculosis H37Rv
ugugacggcggccacgu

SEQ ID NO: 1272019 - RNA, 19 nt, Mycobacterium tuberculosis H37Rv
ugugaaucgcacgacgcga

SEQ ID NO: 1272020 - RNA, 14 nt, Mycobacterium tuberculosis H37Rv
ugugcacggugugc

SEQ ID NO: 1272021 - RNA, 13 nt, Mycobacterium tuberculosis H37Rv
ugugaucaccgau

SEQ ID NO: 1272022 - RNA, 17 nt, Mycobacterium tuberculosis H37Rv
ugugaaagacaacccgc

SEQ ID NO: 1272023 - RNA, 11 nt, Mycobacterium tuberculosis H37Rv
ugucugaaccg

SEQ ID NO: 1272024 - RNA, 19 nt, Mycobacterium tuberculosis H37Rv
ugucugcccgauacccggu

SEQ ID NO: 1272025 - RNA, 22 nt, Mycobacterium tuberculosis H37Rv
ugucaaugacaccggggcagau

SEQ ID NO: 1272026 - RNA, 17 nt, Mycobacterium tuberculosis H37Rv
ugucaaccaagugaccg

SEQ ID NO: 1272027 - RNA, 18 nt, Mycobacterium tuberculosis H37Rv
ugucagccgguuccgcaa

SEQ ID NO: 1272028 - RNA, 14 nt, Mycobacterium tuberculosis H37Rv
ugucgggccaggcg

SEQ ID NO: 1272029 - RNA, 12 nt, Mycobacterium tuberculosis H37Rv
ugucgggcugga

SEQ ID NO: 1272030 - RNA, 16 nt, Mycobacterium tuberculosis H37Rv
ugucguaccagccaug

SEQ ID NO: 1272031 - RNA, 19 nt, Mycobacterium tuberculosis H37Rv
ugucguaccgcggaucgga

SEQ ID NO: 1272032 - RNA, 20 nt, Mycobacterium tuberculosis H37Rv
ugucgggguuucaggcggca

SEQ ID NO: 1272033 - RNA, 20 nt, Mycobacterium tuberculosis H37Rv
ugucggggugcacaccgucg

SEQ ID NO: 1272034 - RNA, 20 nt, Mycobacterium tuberculosis H37Rv
ugucgggggcuuaugcgucu

SEQ ID NO: 1272035 - RNA, 18 nt, Mycobacterium tuberculosis H37Rv
ugucggucggaucggcgc

SEQ ID NO: 1272036 - RNA, 15 nt, Mycobacterium tuberculosis H37Rv
ugucggugccgucga

SEQ ID NO: 1272037 - RNA, 17 nt, Mycobacterium tuberculosis H37Rv
ugugcguuccugaucga

SEQ ID NO: 1272038 - RNA, 15 nt, Mycobacterium tuberculosis H37Rv
ugugcguugcgcugc

SEQ ID NO: 1272039 - RNA, 13 nt, Mycobacterium tuberculosis H37Rv
ugugcucggccaa

SEQ ID NO: 1272040 - RNA, 13 nt, Mycobacterium tuberculosis H37Rv
ugugcucggugac

SEQ ID NO: 1272041 - RNA, 15 nt, Mycobacterium tuberculosis H37Rv
ugugcucggugacgu

SEQ ID NO: 1272042 - RNA, 18 nt, Mycobacterium tuberculosis H37Rv
uguggcacguggcgaccg

SEQ ID NO: 1272043 - RNA, 18 nt, Mycobacterium tuberculosis H37Rv
uguggacugggccagguc

SEQ ID NO: 1272044 - RNA, 12 nt, Mycobacterium tuberculosis H37Rv
uguggacgcccg

SEQ ID NO: 1272045 - RNA, 14 nt, Mycobacterium tuberculosis H37Rv
ugugccugcgucuc

SEQ ID NO: 1272046 - RNA, 15 nt, Mycobacterium tuberculosis H37Rv
uguggcgcuccggcg

SEQ ID NO: 1272047 - RNA, 21 nt, Mycobacterium tuberculosis H37Rv
ugugggccccgccgaugcgau

SEQ ID NO: 1272048 - RNA, 15 nt, Mycobacterium tuberculosis H37Rv
uguucgccggagacc

SEQ ID NO: 1272049 - RNA, 21 nt, Mycobacterium tuberculosis H37Rv
uguugagcggcagccaagcga

SEQ ID NO: 1272050 - RNA, 22 nt, Mycobacterium tuberculosis H37Rv
uguugcacgcgggugccgacgu

SEQ ID NO: 1272051 - RNA, 19 nt, Mycobacterium tuberculosis H37Rv
uguugccccggucggcgac

SEQ ID NO: 1272052 - RNA, 15 nt, Mycobacterium tuberculosis H37Rv
uguucuuggugacca

SEQ ID NO: 1272053 - RNA, 15 nt, Mycobacterium tuberculosis H37Rv
uguucugcacguuga

SEQ ID NO: 1272054 - RNA, 15 nt, Mycobacterium tuberculosis H37Rv
uguucuuggucaccg

SEQ ID NO: 1272055 - RNA, 14 nt, Mycobacterium tuberculosis H37Rv
uucggcgucguccg

SEQ ID NO: 1272056 - RNA, 15 nt, Mycobacterium tuberculosis H37Rv
uucggcggucgccgc

SEQ ID NO: 1272057 - RNA, 18 nt, Mycobacterium tuberculosis H37Rv
uucggcggcgguggcgaa

SEQ ID NO: 1272058 - RNA, 18 nt, Mycobacterium tuberculosis H37Rv
uucgggcauggucgccgg

SEQ ID NO: 1272059 - RNA, 19 nt, Mycobacterium tuberculosis H37Rv
uucgggagucuucggcgac

SEQ ID NO: 1272060 - RNA, 23 nt, Mycobacterium tuberculosis H37Rv
uucgggacgaaaaaaucgugcgg

SEQ ID NO: 1272061 - RNA, 15 nt, Mycobacterium tuberculosis H37Rv
uucgggagucuucgg

SEQ ID NO: 1272062 - RNA, 22 nt, Mycobacterium tuberculosis H37Rv
uucgucggagucuucgucgucg

SEQ ID NO: 1272063 - RNA, 20 nt, Mycobacterium tuberculosis H37Rv
uucguuaggucacuccauga

SEQ ID NO: 1272064 - RNA, 15 nt, Mycobacterium tuberculosis H37Rv
uucgugcguugucgg

SEQ ID NO: 1272065 - RNA, 20 nt, Mycobacterium tuberculosis H37Rv
uucgugcacggcgaggccga

SEQ ID NO: 1272066 - RNA, 11 nt, Mycobacterium tuberculosis H37Rv
uucgucgucgc

SEQ ID NO: 1272067 - RNA, 11 nt, Mycobacterium tuberculosis H37Rv
uucgucgucgu

SEQ ID NO: 1272068 - RNA, 22 nt, Mycobacterium tuberculosis H37Rv
uucgucggcggugcgcugauga

SEQ ID NO: 1272069 - RNA, 21 nt, Mycobacterium tuberculosis H37Rv
aaucagccccguuucgccaga

SEQ ID NO: 1272070 - RNA, 16 nt, Mycobacterium tuberculosis H37Rv
uucggaccggcucuuu

SEQ ID NO: 1272071 - RNA, 14 nt, Mycobacterium tuberculosis H37Rv
uucggcggcgauga

SEQ ID NO: 1272072 - RNA, 15 nt, Mycobacterium tuberculosis H37Rv
uucggcgcugaucgc

SEQ ID NO: 1272073 - RNA, 17 nt, Mycobacterium tuberculosis H37Rv
uucgcggccgucuucgg

SEQ ID NO: 1272074 - RNA, 16 nt, Mycobacterium tuberculosis H37Rv
uucgccgaguugaccg

SEQ ID NO: 1272075 - RNA, 17 nt, Mycobacterium tuberculosis H37Rv
uucgccgccaccggcga

SEQ ID NO: 1272076 - RNA, 21 nt, Mycobacterium tuberculosis H37Rv
uucgcgccgcgaggcaccgac

SEQ ID NO: 1272077 - RNA, 16 nt, Mycobacterium tuberculosis H37Rv
uucgcgggugcgcugc

SEQ ID NO: 1272078 - RNA, 15 nt, Mycobacterium tuberculosis H37Rv
uucgaauuggugcgc

SEQ ID NO: 1272079 - RNA, 17 nt, Mycobacterium tuberculosis H37Rv
uucgcccggggaaccgu

SEQ ID NO: 1272080 - RNA, 15 nt, Mycobacterium tuberculosis H37Rv
uuccuugccgaucgc

SEQ ID NO: 1272081 - RNA, 21 nt, Mycobacterium tuberculosis H37Rv
uuccgccgccgccaucgccga

SEQ ID NO: 1272082 - RNA, 21 nt, Mycobacterium tuberculosis H37Rv
uuccgcccagugaacucguga

SEQ ID NO: 1272083 - RNA, 22 nt, Mycobacterium tuberculosis H37Rv
uucacuuccgggcagcugggca

SEQ ID NO: 1272084 - RNA, 21 nt, Mycobacterium tuberculosis H37Rv
uucagcacccaccgaagcgaa

SEQ ID NO: 1272085 - RNA, 16 nt, Mycobacterium tuberculosis H37Rv
uucagcaccggaucga

SEQ ID NO: 1272086 - RNA, 15 nt, Mycobacterium tuberculosis H37Rv
uucaggaucggcgau

SEQ ID NO: 1272087 - RNA, 16 nt, Mycobacterium tuberculosis H37Rv
uucacgccagucccac

SEQ ID NO: 1272088 - RNA, 13 nt, Mycobacterium tuberculosis H37Rv
uucacucacgacg

SEQ ID NO: 1272089 - RNA, 17 nt, Mycobacterium tuberculosis H37Rv
uucacucacgacgccgu

SEQ ID NO: 1272090 - RNA, 15 nt, Mycobacterium tuberculosis H37Rv
uucacguucggcgac

SEQ ID NO: 1272091 - RNA, 16 nt, Mycobacterium tuberculosis H37Rv
uucaucgccucgagga

SEQ ID NO: 1272092 - RNA, 19 nt, Mycobacterium tuberculosis H37Rv
uucauccguguuucgaaca

SEQ ID NO: 1272093 - RNA, 13 nt, Mycobacterium tuberculosis H37Rv
uuccagcgucugc

SEQ ID NO: 1272094 - RNA, 17 nt, Mycobacterium tuberculosis H37Rv
uuccgcacccccgucga

SEQ ID NO: 1272095 - RNA, 15 nt, Mycobacterium tuberculosis H37Rv
uucccgguagcggcg

SEQ ID NO: 1272096 - RNA, 15 nt, Mycobacterium tuberculosis H37Rv
uucccggcucgaugg

SEQ ID NO: 1272097 - RNA, 18 nt, Mycobacterium tuberculosis H37Rv
uucccggauagacggcga

SEQ ID NO: 1272098 - RNA, 18 nt, Mycobacterium tuberculosis H37Rv
uucccggccacuccauga

SEQ ID NO: 1272099 - RNA, 21 nt, Mycobacterium tuberculosis H37Rv
uuccacgaucggcucacgacu

SEQ ID NO: 1272100 - RNA, 21 nt, Mycobacterium tuberculosis H37Rv
uuccacgaguccgcggaucac

SEQ ID NO: 1272101 - RNA, 21 nt, Mycobacterium tuberculosis H37Rv
aaauacccagcgcagcagcgg

SEQ ID NO: 1272102 - RNA, 12 nt, Mycobacterium tuberculosis H37Rv
aaacuccgcggc

SEQ ID NO: 1272103 - RNA, 17 nt, Mycobacterium tuberculosis H37Rv
aacaggcccacggcgac

SEQ ID NO: 1272104 - RNA, 14 nt, Mycobacterium tuberculosis H37Rv
aacaggccgucgau

SEQ ID NO: 1272105 - RNA, 19 nt, Mycobacterium tuberculosis H37Rv
aacaggccgccaccgucac

SEQ ID NO: 1272106 - RNA, 16 nt, Mycobacterium tuberculosis H37Rv
aacaggccuaggucga

SEQ ID NO: 1272107 - RNA, 18 nt, Mycobacterium tuberculosis H37Rv
aacagguccaccggccag

SEQ ID NO: 1272108 - RNA, 17 nt, Mycobacterium tuberculosis H37Rv
aacagcaccgaacccgc

SEQ ID NO: 1272109 - RNA, 19 nt, Mycobacterium tuberculosis H37Rv
aacagcgaaccgccggcac

SEQ ID NO: 1272110 - RNA, 15 nt, Mycobacterium tuberculosis H37Rv
aacagcgaaccgccg

SEQ ID NO: 1272111 - RNA, 16 nt, Mycobacterium tuberculosis H37Rv
aacagcucguuggcga

SEQ ID NO: 1272112 - RNA, 23 nt, Mycobacterium tuberculosis H37Rv
aacaacgcauuuggugucggcgc

SEQ ID NO: 1272113 - RNA, 11 nt, Mycobacterium tuberculosis H37Rv
aacagagcgug

SEQ ID NO: 1272114 - RNA, 19 nt, Mycobacterium tuberculosis H37Rv
aacagagcgcuuuggucgu

SEQ ID NO: 1272115 - RNA, 22 nt, Mycobacterium tuberculosis H37Rv
aaaucgucggguaccagcaccg

SEQ ID NO: 1272116 - RNA, 20 nt, Mycobacterium tuberculosis H37Rv
aaaugggugugcugccaccg

SEQ ID NO: 1272117 - RNA, 22 nt, Mycobacterium tuberculosis H37Rv
aaaagcccccauuucggcacga

SEQ ID NO: 1272118 - RNA, 18 nt, Mycobacterium tuberculosis H37Rv
aaaacgaacccaggcaca

SEQ ID NO: 1272119 - RNA, 20 nt, Mycobacterium tuberculosis H37Rv
aaccaggaugguugcgacgg

SEQ ID NO: 1272120 - RNA, 13 nt, Mycobacterium tuberculosis H37Rv
aaccagucgaccc

SEQ ID NO: 1272121 - RNA, 11 nt, Mycobacterium tuberculosis H37Rv
aacccgaucag

SEQ ID NO: 1272122 - RNA, 21 nt, Mycobacterium tuberculosis H37Rv
aacccgagcguguugaaauug

SEQ ID NO: 1272123 - RNA, 13 nt, Mycobacterium tuberculosis H37Rv
aacccgccgucac

SEQ ID NO: 1272124 - RNA, 19 nt, Mycobacterium tuberculosis H37Rv
aacccgauguggcgcuguu

SEQ ID NO: 1272125 - RNA, 15 nt, Mycobacterium tuberculosis H37Rv
aacccaggccgucgc

SEQ ID NO: 1272126 - RNA, 12 nt, Mycobacterium tuberculosis H37Rv
aacccagccgcg

SEQ ID NO: 1272127 - RNA, 11 nt, Mycobacterium tuberculosis H37Rv
aaccgaccgug

SEQ ID NO: 1272128 - RNA, 18 nt, Mycobacterium tuberculosis H37Rv
aaccgagcgcccuccucg

SEQ ID NO: 1272129 - RNA, 16 nt, Mycobacterium tuberculosis H37Rv
aacccugccgcgauga

SEQ ID NO: 1272130 - RNA, 19 nt, Mycobacterium tuberculosis H37Rv
aacccguaaaagccgauga

SEQ ID NO: 1272131 - RNA, 13 nt, Mycobacterium tuberculosis H37Rv
aacccugcggcgu

SEQ ID NO: 1272132 - RNA, 22 nt, Mycobacterium tuberculosis H37Rv
aacccugcuugggcagcucguc

SEQ ID NO: 1272133 - RNA, 14 nt, Mycobacterium tuberculosis H37Rv
aacccggcgucgac

SEQ ID NO: 1272134 - RNA, 18 nt, Mycobacterium tuberculosis H37Rv
aaccacccacccgcacca

SEQ ID NO: 1272135 - RNA, 14 nt, Mycobacterium tuberculosis H37Rv
aaccacaucaccgg

SEQ ID NO: 1272136 - RNA, 17 nt, Mycobacterium tuberculosis H37Rv
aaccacggucagcacgc

SEQ ID NO: 1272137 - RNA, 18 nt, Mycobacterium tuberculosis H37Rv
aaccagaguucggccagc

SEQ ID NO: 1272138 - RNA, 16 nt, Mycobacterium tuberculosis H37Rv
aacaucaccucgaugc

SEQ ID NO: 1272139 - RNA, 15 nt, Mycobacterium tuberculosis H37Rv
aacagugccaccuga

SEQ ID NO: 1272140 - RNA, 23 nt, Mycobacterium tuberculosis H37Rv
aacauccccaugucggugaccgu

SEQ ID NO: 1272141 - RNA, 22 nt, Mycobacterium tuberculosis H37Rv
aacggcgggcgauuucggcgcc

SEQ ID NO: 1272142 - RNA, 20 nt, Mycobacterium tuberculosis H37Rv
aacggcguuggcgccguuac

SEQ ID NO: 1272143 - RNA, 18 nt, Mycobacterium tuberculosis H37Rv
aacggacccggcgcgaug

SEQ ID NO: 1272144 - RNA, 21 nt, Mycobacterium tuberculosis H37Rv
aacgucugccacgucggcgaa

SEQ ID NO: 1272145 - RNA, 22 nt, Mycobacterium tuberculosis H37Rv
aacgucgauguccccggcggca

SEQ ID NO: 1272146 - RNA, 18 nt, Mycobacterium tuberculosis H37Rv
aacgucgagauccucguc

SEQ ID NO: 1272147 - RNA, 19 nt, Mycobacterium tuberculosis H37Rv
aacgguacgccgccgcgac

SEQ ID NO: 1272148 - RNA, 18 nt, Mycobacterium tuberculosis H37Rv
aacggucggugaacccgc

SEQ ID NO: 1272149 - RNA, 14 nt, Mycobacterium tuberculosis H37Rv
aacggucgaccgug

SEQ ID NO: 1272150 - RNA, 20 nt, Mycobacterium tuberculosis H37Rv
aacggguagucgggcaaggc

SEQ ID NO: 1272151 - RNA, 22 nt, Mycobacterium tuberculosis H37Rv
aacggggugagccauacgcgcu

SEQ ID NO: 1272152 - RNA, 18 nt, Mycobacterium tuberculosis H37Rv
aaccgccggugccgauga

SEQ ID NO: 1272153 - RNA, 22 nt, Mycobacterium tuberculosis H37Rv
aaccgccccgugggccucgauc

SEQ ID NO: 1272154 - RNA, 20 nt, Mycobacterium tuberculosis H37Rv
aaccgcggaucgaccgccag

SEQ ID NO: 1272155 - RNA, 21 nt, Mycobacterium tuberculosis H37Rv
aacgacaacacccacgugcug

SEQ ID NO: 1272156 - RNA, 17 nt, Mycobacterium tuberculosis H37Rv
aacgaucgacaccaggg

SEQ ID NO: 1272157 - RNA, 21 nt, Mycobacterium tuberculosis H37Rv
aacgauagaacguagcgccca

SEQ ID NO: 1272158 - RNA, 22 nt, Mycobacterium tuberculosis H37Rv
aacgaucccgugauccgccgac

SEQ ID NO: 1272159 - RNA, 15 nt, Mycobacterium tuberculosis H37Rv
aacgccggcaccgac

SEQ ID NO: 1272160 - RNA, 14 nt, Mycobacterium tuberculosis H37Rv
aacgccggcaccga

SEQ ID NO: 1272161 - RNA, 23 nt, Mycobacterium tuberculosis H37Rv
aacgcgaccaucucgacgucggu

SEQ ID NO: 1272162 - RNA, 16 nt, Mycobacterium tuberculosis H37Rv
aacgcgaacccgcgag

SEQ ID NO: 1272163 - RNA, 22 nt, Mycobacterium tuberculosis H37Rv
aacgccgcccgcugggcucgcu

SEQ ID NO: 1272164 - RNA, 15 nt, Mycobacterium tuberculosis H37Rv
aacgccgagcgccag

SEQ ID NO: 1272165 - RNA, 16 nt, Mycobacterium tuberculosis H37Rv
aacgauguccgcgcga

SEQ ID NO: 1272166 - RNA, 17 nt, Mycobacterium tuberculosis H37Rv
aagcggacccgaccguc

SEQ ID NO: 1272167 - RNA, 23 nt, Mycobacterium tuberculosis H37Rv
aagcgucguugcucggucucguc

SEQ ID NO: 1272168 - RNA, 17 nt, Mycobacterium tuberculosis H37Rv
aagcgcguuguugucga

SEQ ID NO: 1272169 - RNA, 16 nt, Mycobacterium tuberculosis H37Rv
aagcucggccagcacg

SEQ ID NO: 1272170 - RNA, 18 nt, Mycobacterium tuberculosis H37Rv
aagcucgcaaccgagaug

SEQ ID NO: 1272171 - RNA, 13 nt, Mycobacterium tuberculosis H37Rv
aagcucaucaccg

SEQ ID NO: 1272172 - RNA, 21 nt, Mycobacterium tuberculosis H37Rv
aagcuaccggcccgaugccga

SEQ ID NO: 1272173 - RNA, 13 nt, Mycobacterium tuberculosis H37Rv
aagcgccggccga

SEQ ID NO: 1272174 - RNA, 17 nt, Mycobacterium tuberculosis H37Rv
aagcgacucgccggcga

SEQ ID NO: 1272175 - RNA, 16 nt, Mycobacterium tuberculosis H37Rv
aagccuugccgucgag

SEQ ID NO: 1272176 - RNA, 21 nt, Mycobacterium tuberculosis H37Rv
aagcccgucgucgugcacgac

SEQ ID NO: 1272177 - RNA, 12 nt, Mycobacterium tuberculosis H37Rv
aagcccgagacg

SEQ ID NO: 1272178 - RNA, 12 nt, Mycobacterium tuberculosis H37Rv
aagccccucacc

SEQ ID NO: 1272179 - RNA, 12 nt, Mycobacterium tuberculosis H37Rv
aagcccaacagc

SEQ ID NO: 1272180 - RNA, 16 nt, Mycobacterium tuberculosis H37Rv
aacuagguucagcgac

SEQ ID NO: 1272181 - RNA, 19 nt, Mycobacterium tuberculosis H37Rv
aacgugaugcguucggccg

SEQ ID NO: 1272182 - RNA, 17 nt, Mycobacterium tuberculosis H37Rv
aagcacagcccggcgac

SEQ ID NO: 1272183 - RNA, 14 nt, Mycobacterium tuberculosis H37Rv
aagcacaccgccag

SEQ ID NO: 1272184 - RNA, 19 nt, Mycobacterium tuberculosis H37Rv
aagaugaccucggcgacga

SEQ ID NO: 1272185 - RNA, 15 nt, Mycobacterium tuberculosis H37Rv
aagaucacgcgucgu

SEQ ID NO: 1272186 - RNA, 19 nt, Mycobacterium tuberculosis H37Rv
aagcugcgggucagcgccg

SEQ ID NO: 1272187 - RNA, 19 nt, Mycobacterium tuberculosis H37Rv
aaggacguuucagccgggu

SEQ ID NO: 1272188 - RNA, 21 nt, Mycobacterium tuberculosis H37Rv
aaggcggccacaaacccgaug

SEQ ID NO: 1272189 - RNA, 21 nt, Mycobacterium tuberculosis H37Rv
aagggggucgagcgcuucguc

SEQ ID NO: 1272190 - RNA, 23 nt, Mycobacterium tuberculosis H37Rv
aauacaccuuguggacccgccag

SEQ ID NO: 1272191 - RNA, 14 nt, Mycobacterium tuberculosis H37Rv
aagucccgaguggc

SEQ ID NO: 1272192 - RNA, 14 nt, Mycobacterium tuberculosis H37Rv
aaguccagcagcga

SEQ ID NO: 1272193 - RNA, 18 nt, Mycobacterium tuberculosis H37Rv
aaguccuucacugcgacc

SEQ ID NO: 1272194 - RNA, 20 nt, Mycobacterium tuberculosis H37Rv
aagucgaucuccgucgguga

SEQ ID NO: 1272195 - RNA, 21 nt, Mycobacterium tuberculosis H37Rv
aauggucguucccgccggcac

SEQ ID NO: 1272196 - RNA, 23 nt, Mycobacterium tuberculosis H37Rv
aaugguucgcacaccuccucgac

SEQ ID NO: 1272197 - RNA, 12 nt, Mycobacterium tuberculosis H37Rv
aauggcaccgag

SEQ ID NO: 1272198 - RNA, 15 nt, Mycobacterium tuberculosis H37Rv
aauggauugcggcac

SEQ ID NO: 1272199 - RNA, 11 nt, Mycobacterium tuberculosis H37Rv
aaugcgagcgc

SEQ ID NO: 1272200 - RNA, 19 nt, Mycobacterium tuberculosis H37Rv
aaugcgaugcggucgucac

SEQ ID NO: 1272201 - RNA, 21 nt, Mycobacterium tuberculosis H37Rv
aaucugcgguacugagccgcg

SEQ ID NO: 1272202 - RNA, 17 nt, Mycobacterium tuberculosis H37Rv
aaugagcggucagcguc

SEQ ID NO: 1272203 - RNA, 15 nt, Mycobacterium tuberculosis H37Rv
aauucaacagcaccg

SEQ ID NO: 1272204 - RNA, 19 nt, Mycobacterium tuberculosis H37Rv
aauucguagggaugcggcc

SEQ ID NO: 1272205 - RNA, 18 nt, Mycobacterium tuberculosis H37Rv
aauccggaauagcaacgc

SEQ ID NO: 1272206 - RNA, 18 nt, Mycobacterium tuberculosis H37Rv
aauccggugcccgcacca

SEQ ID NO: 1272207 - RNA, 19 nt, Mycobacterium tuberculosis H37Rv
aaucgaaaaggugcaccau

SEQ ID NO: 1272208 - RNA, 14 nt, Mycobacterium tuberculosis H37Rv
aauccuucggcgug

SEQ ID NO: 1272209 - RNA, 13 nt, Mycobacterium tuberculosis H37Rv
aaucgagcaccgc

SEQ ID NO: 1272210 - RNA, 14 nt, Mycobacterium tuberculosis H37Rv
aaucgaugaccgca

SEQ ID NO: 1272211 - RNA, 12 nt, Mycobacterium tuberculosis H37Rv
aaucgccgucag

SEQ ID NO: 1272212 - RNA, 22 nt, Mycobacterium tuberculosis H37Rv
aaucgcacagcgcgaucaacgc

SEQ ID NO: 1272213 - RNA, 22 nt, Mycobacterium tuberculosis H37Rv
aaucgauguccaaugcaccguu

SEQ ID NO: 1272214 - RNA, 18 nt, Mycobacterium tuberculosis H37Rv
aaucgcccauuucggcac

SEQ ID NO: 1272215 - RNA, 18 nt, Mycobacterium tuberculosis H37Rv
aaucgcgacgcgacgguu

SEQ ID NO: 1272216 - RNA, 23 nt, Mycobacterium tuberculosis H37Rv
aaucgcucugugucgccgaucac

SEQ ID NO: 1272217 - RNA, 12 nt, Mycobacterium tuberculosis H37Rv
aaucggcaccgu

SEQ ID NO: 1272218 - RNA, 22 nt, Mycobacterium tuberculosis H37Rv
aaucgucggguaccagcaccga

SEQ ID NO: 1272219 - RNA, 20 nt, Mycobacterium tuberculosis H37Rv
aauccaaggcucagcagcgc

SEQ ID NO: 1272220 - RNA, 19 nt, Mycobacterium tuberculosis H37Rv
aauccacacacagccggug

SEQ ID NO: 1272221 - RNA, 14 nt, Mycobacterium tuberculosis H37Rv
aauccccgacaucg

SEQ ID NO: 1272222 - RNA, 22 nt, Mycobacterium tuberculosis H37Rv
aauaguccuugcgccagcgggc

SEQ ID NO: 1272223 - RNA, 13 nt, Mycobacterium tuberculosis H37Rv
aauagccggaucc

SEQ ID NO: 1272224 - RNA, 21 nt, Mycobacterium tuberculosis H37Rv
accacgacgcgauggccgcca

SEQ ID NO: 1272225 - RNA, 22 nt, Mycobacterium tuberculosis H37Rv
accacgacgucggugaacgcgu

SEQ ID NO: 1272226 - RNA, 19 nt, Mycobacterium tuberculosis H37Rv
accacgauggcggccaccg

SEQ ID NO: 1272227 - RNA, 19 nt, Mycobacterium tuberculosis H37Rv
accacgaucaacucgugcg

SEQ ID NO: 1272228 - RNA, 12 nt, Mycobacterium tuberculosis H37Rv
accacgcaccgc

SEQ ID NO: 1272229 - RNA, 14 nt, Mycobacterium tuberculosis H37Rv
accaccucgguuga

SEQ ID NO: 1272230 - RNA, 15 nt, Mycobacterium tuberculosis H37Rv
accaccuccccgauc

SEQ ID NO: 1272231 - RNA, 15 nt, Mycobacterium tuberculosis H37Rv
accaccucgaugccg

SEQ ID NO: 1272232 - RNA, 14 nt, Mycobacterium tuberculosis H37Rv
accaccggcaccgc

SEQ ID NO: 1272233 - RNA, 14 nt, Mycobacterium tuberculosis H37Rv
accaccgugaccga

SEQ ID NO: 1272234 - RNA, 19 nt, Mycobacterium tuberculosis H37Rv
accaccguggcgcccgcgu

SEQ ID NO: 1272235 - RNA, 14 nt, Mycobacterium tuberculosis H37Rv
accaccucagcugc

SEQ ID NO: 1272236 - RNA, 20 nt, Mycobacterium tuberculosis H37Rv
accacgcgcccgcaccaccg

SEQ ID NO: 1272237 - RNA, 14 nt, Mycobacterium tuberculosis H37Rv
accacgccgucgac

SEQ ID NO: 1272238 - RNA, 14 nt, Mycobacterium tuberculosis H37Rv
accacgccgacgug

SEQ ID NO: 1272239 - RNA, 22 nt, Mycobacterium tuberculosis H37Rv
accacggcagccaaccggcgca

SEQ ID NO: 1272240 - RNA, 18 nt, Mycobacterium tuberculosis H37Rv
accacggcagauugacgg

SEQ ID NO: 1272241 - RNA, 19 nt, Mycobacterium tuberculosis H37Rv
accacgcguuucgaaccgc

SEQ ID NO: 1272242 - RNA, 17 nt, Mycobacterium tuberculosis H37Rv
accacgcuuaacagcgg

SEQ ID NO: 1272243 - RNA, 16 nt, Mycobacterium tuberculosis H37Rv
accacggccagcgggu

SEQ ID NO: 1272244 - RNA, 16 nt, Mycobacterium tuberculosis H37Rv
accacggucagcacgc

SEQ ID NO: 1272245 - RNA, 18 nt, Mycobacterium tuberculosis H37Rv
accacggucaagccggcg

SEQ ID NO: 1272246 - RNA, 17 nt, Mycobacterium tuberculosis H37Rv
accacgugaucgacgac

SEQ ID NO: 1272247 - RNA, 19 nt, Mycobacterium tuberculosis H37Rv
accacaccacgauggcggc

SEQ ID NO: 1272248 - RNA, 14 nt, Mycobacterium tuberculosis H37Rv
accaauucgaccgc

SEQ ID NO: 1272249 - RNA, 16 nt, Mycobacterium tuberculosis H37Rv
accaaugugccgguca

SEQ ID NO: 1272250 - RNA, 22 nt, Mycobacterium tuberculosis H37Rv
accaaugcgucgaugcgcugcu

SEQ ID NO: 1272251 - RNA, 14 nt, Mycobacterium tuberculosis H37Rv
accaccaccgccgc

SEQ ID NO: 1272252 - RNA, 24 nt, Mycobacterium tuberculosis H37Rv
accacaucggugccacguucgcgg

SEQ ID NO: 1272253 - RNA, 17 nt, Mycobacterium tuberculosis H37Rv
accacaucaugccagcc

SEQ ID NO: 1272254 - RNA, 20 nt, Mycobacterium tuberculosis H37Rv
accacaugcgagucgcacuc

SEQ ID NO: 1272255 - RNA, 15 nt, Mycobacterium tuberculosis H37Rv
accaccaccggcaac

SEQ ID NO: 1272256 - RNA, 13 nt, Mycobacterium tuberculosis H37Rv
accaccagcgcuc

SEQ ID NO: 1272257 - RNA, 20 nt, Mycobacterium tuberculosis H37Rv
accaccccguagcggucucc

SEQ ID NO: 1272258 - RNA, 16 nt, Mycobacterium tuberculosis H37Rv
accacccagauugccu

SEQ ID NO: 1272259 - RNA, 17 nt, Mycobacterium tuberculosis H37Rv
accacccaccggccacc

SEQ ID NO: 1272260 - RNA, 14 nt, Mycobacterium tuberculosis H37Rv
accacccagauugc

SEQ ID NO: 1272261 - RNA, 21 nt, Mycobacterium tuberculosis H37Rv
accacccaacagcccaccggu

SEQ ID NO: 1272262 - RNA, 16 nt, Mycobacterium tuberculosis H37Rv
accaccgccgcacgcu

SEQ ID NO: 1272263 - RNA, 20 nt, Mycobacterium tuberculosis H37Rv
accaccgccgccggcaccgc

SEQ ID NO: 1272264 - RNA, 23 nt, Mycobacterium tuberculosis H37Rv
accaccgccgccggcaccgccgg

SEQ ID NO: 1272265 - RNA, 14 nt, Mycobacterium tuberculosis H37Rv
accaccgcgaccuc

SEQ ID NO: 1272266 - RNA, 20 nt, Mycobacterium tuberculosis H37Rv
accaccgcgaaagcaccgag

SEQ ID NO: 1272267 - RNA, 17 nt, Mycobacterium tuberculosis H37Rv
accaccgccuggaucag

SEQ ID NO: 1272268 - RNA, 18 nt, Mycobacterium tuberculosis H37Rv
accaccgcucgucguccg

SEQ ID NO: 1272269 - RNA, 16 nt, Mycobacterium tuberculosis H37Rv
accagaucgucgggca

SEQ ID NO: 1272270 - RNA, 15 nt, Mycobacterium tuberculosis H37Rv
accagcaaugccgac

SEQ ID NO: 1272271 - RNA, 13 nt, Mycobacterium tuberculosis H37Rv
accagcacaccgg

SEQ ID NO: 1272272 - RNA, 22 nt, Mycobacterium tuberculosis H37Rv
accagcagccagcccagccgcc

SEQ ID NO: 1272273 - RNA, 14 nt, Mycobacterium tuberculosis H37Rv
accagcaccgccgc

SEQ ID NO: 1272274 - RNA, 22 nt, Mycobacterium tuberculosis H37Rv
accagcagcucguugaugcggc

SEQ ID NO: 1272275 - RNA, 16 nt, Mycobacterium tuberculosis H37Rv
accagcaccagaaccg

SEQ ID NO: 1272276 - RNA, 20 nt, Mycobacterium tuberculosis H37Rv
accagcaucguggccgcacc

SEQ ID NO: 1272277 - RNA, 14 nt, Mycobacterium tuberculosis H37Rv
accacuucggcgcc

SEQ ID NO: 1272278 - RNA, 23 nt, Mycobacterium tuberculosis H37Rv
accagaacgacgccgcggucgug

SEQ ID NO: 1272279 - RNA, 22 nt, Mycobacterium tuberculosis H37Rv
accagacccacgauggcaaacg

SEQ ID NO: 1272280 - RNA, 22 nt, Mycobacterium tuberculosis H37Rv
accagauagaucgugaucgacc

SEQ ID NO: 1272281 - RNA, 14 nt, Mycobacterium tuberculosis H37Rv
accagaggucacgc

SEQ ID NO: 1272282 - RNA, 21 nt, Mycobacterium tuberculosis H37Rv
accagaggucacgcagcaccc

SEQ ID NO: 1272283 - RNA, 13 nt, Mycobacterium tuberculosis H37Rv
accagaucgacgc

SEQ ID NO: 1272284 - RNA, 20 nt, Mycobacterium tuberculosis H37Rv
accacugaaccguucgaccc

SEQ ID NO: 1272285 - RNA, 14 nt, Mycobacterium tuberculosis H37Rv
accacuguuacggc

SEQ ID NO: 1272286 - RNA, 18 nt, Mycobacterium tuberculosis H37Rv
accacugugacacccgag

SEQ ID NO: 1272287 - RNA, 20 nt, Mycobacterium tuberculosis H37Rv
accacuaguucgagcugcca

SEQ ID NO: 1272288 - RNA, 20 nt, Mycobacterium tuberculosis H37Rv
accacuagcggcucaccgcg

SEQ ID NO: 1272289 - RNA, 21 nt, Mycobacterium tuberculosis H37Rv
accacuagcggcucaccgcgc

SEQ ID NO: 1272290 - RNA, 16 nt, Mycobacterium tuberculosis H37Rv
accacgucgaccgaac

SEQ ID NO: 1272291 - RNA, 22 nt, Mycobacterium tuberculosis H37Rv
accacguggcccuccucgguga

SEQ ID NO: 1272292 - RNA, 15 nt, Mycobacterium tuberculosis H37Rv
accagccaccaccag

SEQ ID NO: 1272293 - RNA, 11 nt, Mycobacterium tuberculosis H37Rv
accagccaccg

SEQ ID NO: 1272294 - RNA, 18 nt, Mycobacterium tuberculosis H37Rv
accagccaggugauuacc

SEQ ID NO: 1272295 - RNA, 14 nt, Mycobacterium tuberculosis H37Rv
accagccagccugc

SEQ ID NO: 1272296 - RNA, 17 nt, Mycobacterium tuberculosis H37Rv
accagcccgaugauccc

SEQ ID NO: 1272297 - RNA, 23 nt, Mycobacterium tuberculosis H37Rv
accagccguggugguugaucagc

SEQ ID NO: 1272298 - RNA, 23 nt, Mycobacterium tuberculosis H37Rv
accagccgguuggcugccggcaa

SEQ ID NO: 1272299 - RNA, 13 nt, Mycobacterium tuberculosis H37Rv
accagccggucgu

SEQ ID NO: 1272300 - RNA, 22 nt, Mycobacterium tuberculosis H37Rv
accagcccggccggucgagacg

SEQ ID NO: 1272301 - RNA, 15 nt, Mycobacterium tuberculosis H37Rv
accagcccgccgucg

SEQ ID NO: 1272302 - RNA, 19 nt, Mycobacterium tuberculosis H37Rv
accagccgaucaucaccgg

SEQ ID NO: 1272303 - RNA, 16 nt, Mycobacterium tuberculosis H37Rv
accagcgcaucggcca

SEQ ID NO: 1272304 - RNA, 14 nt, Mycobacterium tuberculosis H37Rv
accagcgcaucggc

SEQ ID NO: 1272305 - RNA, 14 nt, Mycobacterium tuberculosis H37Rv
accagcgcagccga

SEQ ID NO: 1272306 - RNA, 21 nt, Mycobacterium tuberculosis H37Rv
accagccgucguccgcugacc

SEQ ID NO: 1272307 - RNA, 15 nt, Mycobacterium tuberculosis H37Rv
accagcgcccgucgc

SEQ ID NO: 1272308 - RNA, 16 nt, Mycobacterium tuberculosis H37Rv
accagcgccgacccgu

SEQ ID NO: 1272309 - RNA, 18 nt, Mycobacterium tuberculosis H37Rv
accagcgccccggcgcgu

SEQ ID NO: 1272310 - RNA, 23 nt, Mycobacterium tuberculosis H37Rv
accagcgucuucagguccaccgc

SEQ ID NO: 1272311 - RNA, 21 nt, Mycobacterium tuberculosis H37Rv
accagcggucggcgaccacca

SEQ ID NO: 1272312 - RNA, 13 nt, Mycobacterium tuberculosis H37Rv
accagcggucagc

SEQ ID NO: 1272313 - RNA, 15 nt, Mycobacterium tuberculosis H37Rv
accagcgggcaucgc

SEQ ID NO: 1272314 - RNA, 16 nt, Mycobacterium tuberculosis H37Rv
accagcgggcaucgcg

SEQ ID NO: 1272315 - RNA, 14 nt, Mycobacterium tuberculosis H37Rv
accagcucagcugc

SEQ ID NO: 1272316 - RNA, 18 nt, Mycobacterium tuberculosis H37Rv
accagcggccgaccgcga

SEQ ID NO: 1272317 - RNA, 16 nt, Mycobacterium tuberculosis H37Rv
accagcggccgaccgc

SEQ ID NO: 1272318 - RNA, 23 nt, Mycobacterium tuberculosis H37Rv
accagcggcggcggcggcaagug

SEQ ID NO: 1272319 - RNA, 14 nt, Mycobacterium tuberculosis H37Rv
accagcggcaccgc

SEQ ID NO: 1272320 - RNA, 18 nt, Mycobacterium tuberculosis H37Rv
accagcgcuccagcaccc

SEQ ID NO: 1272321 - RNA, 17 nt, Mycobacterium tuberculosis H37Rv
accagcgccuugacgcc

SEQ ID NO: 1272322 - RNA, 19 nt, Mycobacterium tuberculosis H37Rv
acauagcgauucgcgcugc

SEQ ID NO: 1272323 - RNA, 20 nt, Mycobacterium tuberculosis H37Rv
acauagcgauucgcgcugcu

SEQ ID NO: 1272324 - RNA, 19 nt, Mycobacterium tuberculosis H37Rv
acagugugaagaccaccgc

SEQ ID NO: 1272325 - RNA, 23 nt, Mycobacterium tuberculosis H37Rv
acauacaccggccgguccacggu

SEQ ID NO: 1272326 - RNA, 16 nt, Mycobacterium tuberculosis H37Rv
acaguggucccgguga

SEQ ID NO: 1272327 - RNA, 20 nt, Mycobacterium tuberculosis H37Rv
acagucgcgcgcucgcggcu

SEQ ID NO: 1272328 - RNA, 14 nt, Mycobacterium tuberculosis H37Rv
acaucacucgcgcc

SEQ ID NO: 1272329 - RNA, 12 nt, Mycobacterium tuberculosis H37Rv
acagucgcagcc

SEQ ID NO: 1272330 - RNA, 22 nt, Mycobacterium tuberculosis H37Rv
acaggaucagcgacuugcuggc

SEQ ID NO: 1272331 - RNA, 23 nt, Mycobacterium tuberculosis H37Rv
acaggauauugaccuucucgucg

SEQ ID NO: 1272332 - RNA, 14 nt, Mycobacterium tuberculosis H37Rv
acagcugacgagcc

SEQ ID NO: 1272333 - RNA, 16 nt, Mycobacterium tuberculosis H37Rv
acaggccacgcaccgg

SEQ ID NO: 1272334 - RNA, 17 nt, Mycobacterium tuberculosis H37Rv
acaaaccugcaugccca

SEQ ID NO: 1272335 - RNA, 21 nt, Mycobacterium tuberculosis H37Rv
acaaaccgucggggaugccga

SEQ ID NO: 1272336 - RNA, 22 nt, Mycobacterium tuberculosis H37Rv
acagcaugucgcggacccgcgc

SEQ ID NO: 1272337 - RNA, 20 nt, Mycobacterium tuberculosis H37Rv
acaaagacgccgucggcgcc

SEQ ID NO: 1272338 - RNA, 16 nt, Mycobacterium tuberculosis H37Rv
acaaacguguugaccg

SEQ ID NO: 1272339 - RNA, 22 nt, Mycobacterium tuberculosis H37Rv
acagccaguaaaaaggcaggac

SEQ ID NO: 1272340 - RNA, 22 nt, Mycobacterium tuberculosis H37Rv
acagccccaucaccaccggcac

SEQ ID NO: 1272341 - RNA, 19 nt, Mycobacterium tuberculosis H37Rv
acagcgcgguguucgcggc

SEQ ID NO: 1272342 - RNA, 16 nt, Mycobacterium tuberculosis H37Rv
acagcguccgucgucg

SEQ ID NO: 1272343 - RNA, 17 nt, Mycobacterium tuberculosis H37Rv
acagcguugccaggugc

SEQ ID NO: 1272344 - RNA, 16 nt, Mycobacterium tuberculosis H37Rv
acagcucgccgugacc

SEQ ID NO: 1272345 - RNA, 12 nt, Mycobacterium tuberculosis H37Rv
acagcccggcga

SEQ ID NO: 1272346 - RNA, 16 nt, Mycobacterium tuberculosis H37Rv
acagcccggcgacgac

SEQ ID NO: 1272347 - RNA, 19 nt, Mycobacterium tuberculosis H37Rv
acagcccguagcacaccgg

SEQ ID NO: 1272348 - RNA, 14 nt, Mycobacterium tuberculosis H37Rv
acagccgcgccgac

SEQ ID NO: 1272349 - RNA, 22 nt, Mycobacterium tuberculosis H37Rv
acaugaccugauccggccgguu

SEQ ID NO: 1272350 - RNA, 17 nt, Mycobacterium tuberculosis H37Rv
acaugauccgccggcaa

SEQ ID NO: 1272351 - RNA, 14 nt, Mycobacterium tuberculosis H37Rv
acaugaucgagcag

SEQ ID NO: 1272352 - RNA, 15 nt, Mycobacterium tuberculosis H37Rv
acaugaaccggucga

SEQ ID NO: 1272353 - RNA, 21 nt, Mycobacterium tuberculosis H37Rv
acauggcaagucaacaccgcg

SEQ ID NO: 1272354 - RNA, 21 nt, Mycobacterium tuberculosis H37Rv
acauggcggugcgcagcuugg

SEQ ID NO: 1272355 - RNA, 16 nt, Mycobacterium tuberculosis H37Rv
acauggccagcaucag

SEQ ID NO: 1272356 - RNA, 23 nt, Mycobacterium tuberculosis H37Rv
acaugcucgacgcccgccaccgg

SEQ ID NO: 1272357 - RNA, 17 nt, Mycobacterium tuberculosis H37Rv
acaugcucacgaucacc

SEQ ID NO: 1272358 - RNA, 16 nt, Mycobacterium tuberculosis H37Rv
acaucgucaucgacga

SEQ ID NO: 1272359 - RNA, 14 nt, Mycobacterium tuberculosis H37Rv
acaucgucgagcgc

SEQ ID NO: 1272360 - RNA, 20 nt, Mycobacterium tuberculosis H37Rv
acaucguucaugaucggcag

SEQ ID NO: 1272361 - RNA, 20 nt, Mycobacterium tuberculosis H37Rv
acaucggcggcgucgacguc

SEQ ID NO: 1272362 - RNA, 16 nt, Mycobacterium tuberculosis H37Rv
acaucgggcgugguga

SEQ ID NO: 1272363 - RNA, 23 nt, Mycobacterium tuberculosis H37Rv
acaucggugccacguucgcgggc

SEQ ID NO: 1272364 - RNA, 19 nt, Mycobacterium tuberculosis H37Rv
acaucggugguuagguggc

SEQ ID NO: 1272365 - RNA, 21 nt, Mycobacterium tuberculosis H37Rv
acaucgcgggcgugccgacca

SEQ ID NO: 1272366 - RNA, 18 nt, Mycobacterium tuberculosis H37Rv
acaucgcgaggcgucacc

SEQ ID NO: 1272367 - RNA, 11 nt, Mycobacterium tuberculosis H37Rv
acaucgccagc

SEQ ID NO: 1272368 - RNA, 18 nt, Mycobacterium tuberculosis H37Rv
acaucgaccaccucgaug

SEQ ID NO: 1272369 - RNA, 22 nt, Mycobacterium tuberculosis H37Rv
acaucgcaggcaccccgaucac

SEQ ID NO: 1272370 - RNA, 17 nt, Mycobacterium tuberculosis H37Rv
acaucgaaaaccgaggc

SEQ ID NO: 1272371 - RNA, 20 nt, Mycobacterium tuberculosis H37Rv
acaucgaauaugacugcgcu

SEQ ID NO: 1272372 - RNA, 13 nt, Mycobacterium tuberculosis H37Rv
acauccugcagcu

SEQ ID NO: 1272373 - RNA, 13 nt, Mycobacterium tuberculosis H37Rv
acauccagcccug

SEQ ID NO: 1272374 - RNA, 20 nt, Mycobacterium tuberculosis H37Rv
acauccagggccgagcagcu

SEQ ID NO: 1272375 - RNA, 20 nt, Mycobacterium tuberculosis H37Rv
accaaaauccuucgcgcuca

SEQ ID NO: 1272376 - RNA, 20 nt, Mycobacterium tuberculosis H37Rv
accaaagcugucgaccgcga

SEQ ID NO: 1272377 - RNA, 19 nt, Mycobacterium tuberculosis H37Rv
acauugcgcccagcgaccc

SEQ ID NO: 1272378 - RNA, 17 nt, Mycobacterium tuberculosis H37Rv
accaacaccgcccgcaa

SEQ ID NO: 1272379 - RNA, 16 nt, Mycobacterium tuberculosis H37Rv
accaaccucaucgcgg

SEQ ID NO: 1272380 - RNA, 15 nt, Mycobacterium tuberculosis H37Rv
accaaccgucgguga

SEQ ID NO: 1272381 - RNA, 16 nt, Mycobacterium tuberculosis H37Rv
accaaccgucggugaa

SEQ ID NO: 1272382 - RNA, 17 nt, Mycobacterium tuberculosis H37Rv
accaaccucaucgcggu

SEQ ID NO: 1272383 - RNA, 15 nt, Mycobacterium tuberculosis H37Rv
accaacucggcgacc

SEQ ID NO: 1272384 - RNA, 15 nt, Mycobacterium tuberculosis H37Rv
accaacgucgcuccg

SEQ ID NO: 1272385 - RNA, 22 nt, Mycobacterium tuberculosis H37Rv
accaacgcgggaacgaugccgc

SEQ ID NO: 1272386 - RNA, 17 nt, Mycobacterium tuberculosis H37Rv
accaagucguaaucggc

SEQ ID NO: 1272387 - RNA, 15 nt, Mycobacterium tuberculosis H37Rv
accaagugucgccgc

SEQ ID NO: 1272388 - RNA, 14 nt, Mycobacterium tuberculosis H37Rv
accaagcucggcca

SEQ ID NO: 1272389 - RNA, 18 nt, Mycobacterium tuberculosis H37Rv
accaagcucggccagcac

SEQ ID NO: 1272390 - RNA, 20 nt, Mycobacterium tuberculosis H37Rv
accaagcucggccagcacgc

SEQ ID NO: 1272391 - RNA, 23 nt, Mycobacterium tuberculosis H37Rv
accaagguuggucggugcugacc

SEQ ID NO: 1272392 - RNA, 17 nt, Mycobacterium tuberculosis H37Rv
accggaccgaccaccgc

SEQ ID NO: 1272393 - RNA, 22 nt, Mycobacterium tuberculosis H37Rv
accggacauccgaugcgucaca

SEQ ID NO: 1272394 - RNA, 20 nt, Mycobacterium tuberculosis H37Rv
accggacaaagcugcucguc

SEQ ID NO: 1272395 - RNA, 23 nt, Mycobacterium tuberculosis H37Rv
accggaauccccccugucgccga

SEQ ID NO: 1272396 - RNA, 13 nt, Mycobacterium tuberculosis H37Rv
accgcucgucguc

SEQ ID NO: 1272397 - RNA, 15 nt, Mycobacterium tuberculosis H37Rv
accggcaugccgcca

SEQ ID NO: 1272398 - RNA, 14 nt, Mycobacterium tuberculosis H37Rv
accggcaugccgcc

SEQ ID NO: 1272399 - RNA, 17 nt, Mycobacterium tuberculosis H37Rv
accggcauacagccggc

SEQ ID NO: 1272400 - RNA, 20 nt, Mycobacterium tuberculosis H37Rv
accggcauaacgaucccgug

SEQ ID NO: 1272401 - RNA, 16 nt, Mycobacterium tuberculosis H37Rv
accggcagcgcgaucg

SEQ ID NO: 1272402 - RNA, 17 nt, Mycobacterium tuberculosis H37Rv
accggcacugcccagca

SEQ ID NO: 1272403 - RNA, 18 nt, Mycobacterium tuberculosis H37Rv
accggccaccagcccgau

SEQ ID NO: 1272404 - RNA, 20 nt, Mycobacterium tuberculosis H37Rv
accggccaccagggccaccg

SEQ ID NO: 1272405 - RNA, 15 nt, Mycobacterium tuberculosis H37Rv
accggccacgaccuc

SEQ ID NO: 1272406 - RNA, 15 nt, Mycobacterium tuberculosis H37Rv
accggccagccgacg

SEQ ID NO: 1272407 - RNA, 19 nt, Mycobacterium tuberculosis H37Rv
accggccagccgacgcggc

SEQ ID NO: 1272408 - RNA, 23 nt, Mycobacterium tuberculosis H37Rv
accggcccagaucgguugaucgg

SEQ ID NO: 1272409 - RNA, 14 nt, Mycobacterium tuberculosis H37Rv
accggcccagaucg

SEQ ID NO: 1272410 - RNA, 21 nt, Mycobacterium tuberculosis H37Rv
accggcccagaucgguugauc

SEQ ID NO: 1272411 - RNA, 15 nt, Mycobacterium tuberculosis H37Rv
accggcccgaugccg

SEQ ID NO: 1272412 - RNA, 20 nt, Mycobacterium tuberculosis H37Rv
accggccagcggcccgucac

SEQ ID NO: 1272413 - RNA, 18 nt, Mycobacterium tuberculosis H37Rv
accggccgugccgccgac

SEQ ID NO: 1272414 - RNA, 19 nt, Mycobacterium tuberculosis H37Rv
accggccgggugaaccaau

SEQ ID NO: 1272415 - RNA, 15 nt, Mycobacterium tuberculosis H37Rv
accggccggugauga

SEQ ID NO: 1272416 - RNA, 19 nt, Mycobacterium tuberculosis H37Rv
accggccuuuccagcaccc

SEQ ID NO: 1272417 - RNA, 19 nt, Mycobacterium tuberculosis H37Rv
accggccgugccgccgaca

SEQ ID NO: 1272418 - RNA, 21 nt, Mycobacterium tuberculosis H37Rv
accggccugcgcgaccgacca

SEQ ID NO: 1272419 - RNA, 18 nt, Mycobacterium tuberculosis H37Rv
accggccgccaucaucgc

SEQ ID NO: 1272420 - RNA, 15 nt, Mycobacterium tuberculosis H37Rv
accggccgcgacgac

SEQ ID NO: 1272421 - RNA, 16 nt, Mycobacterium tuberculosis H37Rv
accggcccucgccaga

SEQ ID NO: 1272422 - RNA, 18 nt, Mycobacterium tuberculosis H37Rv
accggcgugucacgucgc

SEQ ID NO: 1272423 - RNA, 15 nt, Mycobacterium tuberculosis H37Rv
accggcgugcugugc

SEQ ID NO: 1272424 - RNA, 21 nt, Mycobacterium tuberculosis H37Rv
accggcguucccacuggaggu

SEQ ID NO: 1272425 - RNA, 15 nt, Mycobacterium tuberculosis H37Rv
accggcgugcagcac

SEQ ID NO: 1272426 - RNA, 15 nt, Mycobacterium tuberculosis H37Rv
accggcgucggcgcg

SEQ ID NO: 1272427 - RNA, 22 nt, Mycobacterium tuberculosis H37Rv
accggcguccaguccgaucacc

SEQ ID NO: 1272428 - RNA, 14 nt, Mycobacterium tuberculosis H37Rv
accggcgucgacgu

SEQ ID NO: 1272429 - RNA, 15 nt, Mycobacterium tuberculosis H37Rv
accggcgucgacguc

SEQ ID NO: 1272430 - RNA, 20 nt, Mycobacterium tuberculosis H37Rv
accggcucuuuuucgaucgc

SEQ ID NO: 1272431 - RNA, 19 nt, Mycobacterium tuberculosis H37Rv
accggcucgccggcgcgca

SEQ ID NO: 1272432 - RNA, 14 nt, Mycobacterium tuberculosis H37Rv
accggcugcaggug

SEQ ID NO: 1272433 - RNA, 14 nt, Mycobacterium tuberculosis H37Rv
accggcucgaucuc

SEQ ID NO: 1272434 - RNA, 17 nt, Mycobacterium tuberculosis H37Rv
accgggaaccacgguca

SEQ ID NO: 1272435 - RNA, 19 nt, Mycobacterium tuberculosis H37Rv
accgggacaaccgcgccga

SEQ ID NO: 1272436 - RNA, 19 nt, Mycobacterium tuberculosis H37Rv
accgggcaaaucaagcaca

SEQ ID NO: 1272437 - RNA, 21 nt, Mycobacterium tuberculosis H37Rv
accgggcaaaucaagcacagc

SEQ ID NO: 1272438 - RNA, 16 nt, Mycobacterium tuberculosis H37Rv
accggcuggugccaac

SEQ ID NO: 1272439 - RNA, 17 nt, Mycobacterium tuberculosis H37Rv
accggcugguugaccga

SEQ ID NO: 1272440 - RNA, 19 nt, Mycobacterium tuberculosis H37Rv
accggcugguugaccgagu

SEQ ID NO: 1272441 - RNA, 14 nt, Mycobacterium tuberculosis H37Rv
accggcgagcccgc

SEQ ID NO: 1272442 - RNA, 14 nt, Mycobacterium tuberculosis H37Rv
accggcgccgcaau

SEQ ID NO: 1272443 - RNA, 23 nt, Mycobacterium tuberculosis H37Rv
accggcgccccugucgaccgcca

SEQ ID NO: 1272444 - RNA, 16 nt, Mycobacterium tuberculosis H37Rv
accggcgcgaccgcgg

SEQ ID NO: 1272445 - RNA, 16 nt, Mycobacterium tuberculosis H37Rv
accggcgccggaguug

SEQ ID NO: 1272446 - RNA, 22 nt, Mycobacterium tuberculosis H37Rv
accggcgcgccccgccgcacgc

SEQ ID NO: 1272447 - RNA, 21 nt, Mycobacterium tuberculosis H37Rv
accggcgccgccgucgccgcc

SEQ ID NO: 1272448 - RNA, 17 nt, Mycobacterium tuberculosis H37Rv
accggcgccgccggcac

SEQ ID NO: 1272449 - RNA, 17 nt, Mycobacterium tuberculosis H37Rv
accggcgccgcgcggcu

SEQ ID NO: 1272450 - RNA, 20 nt, Mycobacterium tuberculosis H37Rv
accggcgccgccgucgccgc

SEQ ID NO: 1272451 - RNA, 18 nt, Mycobacterium tuberculosis H37Rv
accggcguaaccggcagc

SEQ ID NO: 1272452 - RNA, 19 nt, Mycobacterium tuberculosis H37Rv
accggcgggacgucgccgc

SEQ ID NO: 1272453 - RNA, 15 nt, Mycobacterium tuberculosis H37Rv
accggcggcgagcgg

SEQ ID NO: 1272454 - RNA, 17 nt, Mycobacterium tuberculosis H37Rv
accggcggcgagcggcc

SEQ ID NO: 1272455 - RNA, 17 nt, Mycobacterium tuberculosis H37Rv
accggcggauucggcgc

SEQ ID NO: 1272456 - RNA, 23 nt, Mycobacterium tuberculosis H37Rv
accgagcaaacacgccucgccga

SEQ ID NO: 1272457 - RNA, 20 nt, Mycobacterium tuberculosis H37Rv
accgagcaucucgucgucga

SEQ ID NO: 1272458 - RNA, 16 nt, Mycobacterium tuberculosis H37Rv
accgagcgcaacccgu

SEQ ID NO: 1272459 - RNA, 20 nt, Mycobacterium tuberculosis H37Rv
accgcaugguggugggugau

SEQ ID NO: 1272460 - RNA, 20 nt, Mycobacterium tuberculosis H37Rv
accgccacacggggccgcca

SEQ ID NO: 1272461 - RNA, 16 nt, Mycobacterium tuberculosis H37Rv
accgccaaacgcugcg

SEQ ID NO: 1272462 - RNA, 16 nt, Mycobacterium tuberculosis H37Rv
accgccaccgccagcg

SEQ ID NO: 1272463 - RNA, 21 nt, Mycobacterium tuberculosis H37Rv
accgccaccacgccgucgaca

SEQ ID NO: 1272464 - RNA, 22 nt, Mycobacterium tuberculosis H37Rv
accgccaauuacagcuugcgca

SEQ ID NO: 1272465 - RNA, 21 nt, Mycobacterium tuberculosis H37Rv
accgccaccuuggcguugacc

SEQ ID NO: 1272466 - RNA, 19 nt, Mycobacterium tuberculosis H37Rv
accgccgacgccguugccc

SEQ ID NO: 1272467 - RNA, 22 nt, Mycobacterium tuberculosis H37Rv
accgccgcaucguuuucgccga

SEQ ID NO: 1272468 - RNA, 20 nt, Mycobacterium tuberculosis H37Rv
accgccgcauucggcgauga

SEQ ID NO: 1272469 - RNA, 15 nt, Mycobacterium tuberculosis H37Rv
accgccgggaagccg

SEQ ID NO: 1272470 - RNA, 22 nt, Mycobacterium tuberculosis H37Rv
accgccgggcccucgccauggc

SEQ ID NO: 1272471 - RNA, 18 nt, Mycobacterium tuberculosis H37Rv
accgccgccgccgacgcc

SEQ ID NO: 1272472 - RNA, 21 nt, Mycobacterium tuberculosis H37Rv
accgccgcccaaaacgucacc

SEQ ID NO: 1272473 - RNA, 23 nt, Mycobacterium tuberculosis H37Rv
accgccgcccaaaacgucaccgc

SEQ ID NO: 1272474 - RNA, 19 nt, Mycobacterium tuberculosis H37Rv
accgccuuugccgccggca

SEQ ID NO: 1272475 - RNA, 15 nt, Mycobacterium tuberculosis H37Rv
accgccuuggucacc

SEQ ID NO: 1272476 - RNA, 13 nt, Mycobacterium tuberculosis H37Rv
accgccgucgcca

SEQ ID NO: 1272477 - RNA, 14 nt, Mycobacterium tuberculosis H37Rv
accgccggugccga

SEQ ID NO: 1272478 - RNA, 19 nt, Mycobacterium tuberculosis H37Rv
accgccguuccacgucgua

SEQ ID NO: 1272479 - RNA, 22 nt, Mycobacterium tuberculosis H37Rv
accgccguugccgaucgcuccg

SEQ ID NO: 1272480 - RNA, 21 nt, Mycobacterium tuberculosis H37Rv
accgccguugccaagcagcug

SEQ ID NO: 1272481 - RNA, 17 nt, Mycobacterium tuberculosis H37Rv
accgccguugccgauca

SEQ ID NO: 1272482 - RNA, 21 nt, Mycobacterium tuberculosis H37Rv
accgcgaaugugaucacccgc

SEQ ID NO: 1272483 - RNA, 15 nt, Mycobacterium tuberculosis H37Rv
accgcgccgcaucau

SEQ ID NO: 1272484 - RNA, 18 nt, Mycobacterium tuberculosis H37Rv
accgcgaaugugaucacc

SEQ ID NO: 1272485 - RNA, 18 nt, Mycobacterium tuberculosis H37Rv
accgcggacacgaucgcg

SEQ ID NO: 1272486 - RNA, 19 nt, Mycobacterium tuberculosis H37Rv
accgcggacccgcagcugc

SEQ ID NO: 1272487 - RNA, 15 nt, Mycobacterium tuberculosis H37Rv
accgcggaccggcgu

SEQ ID NO: 1272488 - RNA, 16 nt, Mycobacterium tuberculosis H37Rv
accgcggaccggcguc

SEQ ID NO: 1272489 - RNA, 17 nt, Mycobacterium tuberculosis H37Rv
accgcggaucgaccgcc

SEQ ID NO: 1272490 - RNA, 17 nt, Mycobacterium tuberculosis H37Rv
accgcggccccgccguu

SEQ ID NO: 1272491 - RNA, 14 nt, Mycobacterium tuberculosis H37Rv
accgcggccagcac

SEQ ID NO: 1272492 - RNA, 18 nt, Mycobacterium tuberculosis H37Rv
accgcgccgucgucgcgc

SEQ ID NO: 1272493 - RNA, 15 nt, Mycobacterium tuberculosis H37Rv
accgcgccgucgucg

SEQ ID NO: 1272494 - RNA, 12 nt, Mycobacterium tuberculosis H37Rv
accgcgcgcgac

SEQ ID NO: 1272495 - RNA, 21 nt, Mycobacterium tuberculosis H37Rv
accgcgccggcggaagcggcg

SEQ ID NO: 1272496 - RNA, 23 nt, Mycobacterium tuberculosis H37Rv
accgcgccguaaagccaacuggu

SEQ ID NO: 1272497 - RNA, 23 nt, Mycobacterium tuberculosis H37Rv
accgcgccgucgucgagcaccac

SEQ ID NO: 1272498 - RNA, 18 nt, Mycobacterium tuberculosis H37Rv
accgcuacccgcgcgacc

SEQ ID NO: 1272499 - RNA, 14 nt, Mycobacterium tuberculosis H37Rv
accgcucggaguug

SEQ ID NO: 1272500 - RNA, 12 nt, Mycobacterium tuberculosis H37Rv
accgcucggcga

SEQ ID NO: 1272501 - RNA, 21 nt, Mycobacterium tuberculosis H37Rv
accgcucgguccagccggucc

SEQ ID NO: 1272502 - RNA, 17 nt, Mycobacterium tuberculosis H37Rv
accgcuaugaugccgcc

SEQ ID NO: 1272503 - RNA, 16 nt, Mycobacterium tuberculosis H37Rv
accgcguuuugcaggc

SEQ ID NO: 1272504 - RNA, 23 nt, Mycobacterium tuberculosis H37Rv
accgcguuuugcaggcccgaguu

SEQ ID NO: 1272505 - RNA, 17 nt, Mycobacterium tuberculosis H37Rv
accgcgucaucaccggu

SEQ ID NO: 1272506 - RNA, 16 nt, Mycobacterium tuberculosis H37Rv
accgcgucaucaccgg

SEQ ID NO: 1272507 - RNA, 17 nt, Mycobacterium tuberculosis H37Rv
accgcgucacuucccgg

SEQ ID NO: 1272508 - RNA, 17 nt, Mycobacterium tuberculosis H37Rv
accgcgucaacgcuguu

SEQ ID NO: 1272509 - RNA, 20 nt, Mycobacterium tuberculosis H37Rv
accgcggugugcgugucacc

SEQ ID NO: 1272510 - RNA, 20 nt, Mycobacterium tuberculosis H37Rv
accgcgguggggucgacgca

SEQ ID NO: 1272511 - RNA, 22 nt, Mycobacterium tuberculosis H37Rv
accgcgggcaguagcuguggcc

SEQ ID NO: 1272512 - RNA, 19 nt, Mycobacterium tuberculosis H37Rv
accgcgguggggucgacgc

SEQ ID NO: 1272513 - RNA, 22 nt, Mycobacterium tuberculosis H37Rv
accgcggcgaagauaucggcac

SEQ ID NO: 1272514 - RNA, 22 nt, Mycobacterium tuberculosis H37Rv
accccagccggcagcagcgggc

SEQ ID NO: 1272515 - RNA, 18 nt, Mycobacterium tuberculosis H37Rv
accccacagucgugagcc

SEQ ID NO: 1272516 - RNA, 15 nt, Mycobacterium tuberculosis H37Rv
accccaccacagacg

SEQ ID NO: 1272517 - RNA, 23 nt, Mycobacterium tuberculosis H37Rv
acccaguuucggcgucgucgaug

SEQ ID NO: 1272518 - RNA, 14 nt, Mycobacterium tuberculosis H37Rv
acccagucggcgcc

SEQ ID NO: 1272519 - RNA, 20 nt, Mycobacterium tuberculosis H37Rv
acccagaaugacaucgucgc

SEQ ID NO: 1272520 - RNA, 21 nt, Mycobacterium tuberculosis H37Rv
acccagaaugacaucgucgcc

SEQ ID NO: 1272521 - RNA, 22 nt, Mycobacterium tuberculosis H37Rv
acccacucgacgucgucgucga

SEQ ID NO: 1272522 - RNA, 14 nt, Mycobacterium tuberculosis H37Rv
acccagcagcggca

SEQ ID NO: 1272523 - RNA, 20 nt, Mycobacterium tuberculosis H37Rv
acccagcauggggucagcuc

SEQ ID NO: 1272524 - RNA, 15 nt, Mycobacterium tuberculosis H37Rv
acccagaauuccggc

SEQ ID NO: 1272525 - RNA, 21 nt, Mycobacterium tuberculosis H37Rv
acccagcaccacaacgucggc

SEQ ID NO: 1272526 - RNA, 13 nt, Mycobacterium tuberculosis H37Rv
accaggaucgaca

SEQ ID NO: 1272527 - RNA, 19 nt, Mycobacterium tuberculosis H37Rv
accaggagcggauagcggc

SEQ ID NO: 1272528 - RNA, 15 nt, Mycobacterium tuberculosis H37Rv
accagcugucgggca

SEQ ID NO: 1272529 - RNA, 13 nt, Mycobacterium tuberculosis H37Rv
accagcuggcgau

SEQ ID NO: 1272530 - RNA, 14 nt, Mycobacterium tuberculosis H37Rv
acccaauggagccg

SEQ ID NO: 1272531 - RNA, 23 nt, Mycobacterium tuberculosis H37Rv
acccacacccagcgugcccgcca

SEQ ID NO: 1272532 - RNA, 15 nt, Mycobacterium tuberculosis H37Rv
acccaacgaccacca

SEQ ID NO: 1272533 - RNA, 18 nt, Mycobacterium tuberculosis H37Rv
acccaacuccaucagcgc

SEQ ID NO: 1272534 - RNA, 15 nt, Mycobacterium tuberculosis H37Rv
acccacagucgccgg

SEQ ID NO: 1272535 - RNA, 19 nt, Mycobacterium tuberculosis H37Rv
acccacaucaggucggcga

SEQ ID NO: 1272536 - RNA, 17 nt, Mycobacterium tuberculosis H37Rv
acccacgaucagcagcg

SEQ ID NO: 1272537 - RNA, 22 nt, Mycobacterium tuberculosis H37Rv
acccacgcauguuggugaucaa

SEQ ID NO: 1272538 - RNA, 13 nt, Mycobacterium tuberculosis H37Rv
acccaccgucacc

SEQ ID NO: 1272539 - RNA, 14 nt, Mycobacterium tuberculosis H37Rv
acccaccgucaccc

SEQ ID NO: 1272540 - RNA, 17 nt, Mycobacterium tuberculosis H37Rv
accccugcacggugccc

SEQ ID NO: 1272541 - RNA, 21 nt, Mycobacterium tuberculosis H37Rv
accccgcgccggcgacaccgc

SEQ ID NO: 1272542 - RNA, 17 nt, Mycobacterium tuberculosis H37Rv
accccgggcgccgauca

SEQ ID NO: 1272543 - RNA, 12 nt, Mycobacterium tuberculosis H37Rv
accccgccgcca

SEQ ID NO: 1272544 - RNA, 15 nt, Mycobacterium tuberculosis H37Rv
accccgccgaucacc

SEQ ID NO: 1272545 - RNA, 16 nt, Mycobacterium tuberculosis H37Rv
accccgccgagcgguu

SEQ ID NO: 1272546 - RNA, 21 nt, Mycobacterium tuberculosis H37Rv
accccgcagcucaccucauga

SEQ ID NO: 1272547 - RNA, 16 nt, Mycobacterium tuberculosis H37Rv
accccagcggccaccg

SEQ ID NO: 1272548 - RNA, 22 nt, Mycobacterium tuberculosis H37Rv
acccgaagauuucgggcgccga

SEQ ID NO: 1272549 - RNA, 21 nt, Mycobacterium tuberculosis H37Rv
acccgaaucccacagcaggag

SEQ ID NO: 1272550 - RNA, 13 nt, Mycobacterium tuberculosis H37Rv
acccgacaucggc

SEQ ID NO: 1272551 - RNA, 18 nt, Mycobacterium tuberculosis H37Rv
acccgacaucggccagcg

SEQ ID NO: 1272552 - RNA, 14 nt, Mycobacterium tuberculosis H37Rv
acccgacgaugccg

SEQ ID NO: 1272553 - RNA, 12 nt, Mycobacterium tuberculosis H37Rv
accccuggcgau

SEQ ID NO: 1272554 - RNA, 21 nt, Mycobacterium tuberculosis H37Rv
acccgagcuugggccggugca

SEQ ID NO: 1272555 - RNA, 12 nt, Mycobacterium tuberculosis H37Rv
acccgagccgcc

SEQ ID NO: 1272556 - RNA, 13 nt, Mycobacterium tuberculosis H37Rv
acccgcaccgggg

SEQ ID NO: 1272557 - RNA, 13 nt, Mycobacterium tuberculosis H37Rv
acccgagccugga

SEQ ID NO: 1272558 - RNA, 14 nt, Mycobacterium tuberculosis H37Rv
acccgcagaccggu

SEQ ID NO: 1272559 - RNA, 16 nt, Mycobacterium tuberculosis H37Rv
acccgcagccgcgagu

SEQ ID NO: 1272560 - RNA, 15 nt, Mycobacterium tuberculosis H37Rv
acccgcagaccgcca

SEQ ID NO: 1272561 - RNA, 21 nt, Mycobacterium tuberculosis H37Rv
acccgcacuccaagucacagc

SEQ ID NO: 1272562 - RNA, 20 nt, Mycobacterium tuberculosis H37Rv
acccgcagcuguggcccacu

SEQ ID NO: 1272563 - RNA, 22 nt, Mycobacterium tuberculosis H37Rv
acccguugagcauaugacgucg

SEQ ID NO: 1272564 - RNA, 22 nt, Mycobacterium tuberculosis H37Rv
acccguuggauguuuuccgguc

SEQ ID NO: 1272565 - RNA, 19 nt, Mycobacterium tuberculosis H37Rv
acccguuaugcgccgccca

SEQ ID NO: 1272566 - RNA, 18 nt, Mycobacterium tuberculosis H37Rv
acccguuccacgccggca

SEQ ID NO: 1272567 - RNA, 14 nt, Mycobacterium tuberculosis H37Rv
acccguugaacucg

SEQ ID NO: 1272568 - RNA, 16 nt, Mycobacterium tuberculosis H37Rv
acccucaggcaaucgc

SEQ ID NO: 1272569 - RNA, 14 nt, Mycobacterium tuberculosis H37Rv
acccucgccgguca

SEQ ID NO: 1272570 - RNA, 19 nt, Mycobacterium tuberculosis H37Rv
acccucgggcgucacggug

SEQ ID NO: 1272571 - RNA, 21 nt, Mycobacterium tuberculosis H37Rv
acccguguucgccacacccgu

SEQ ID NO: 1272572 - RNA, 17 nt, Mycobacterium tuberculosis H37Rv
acccgugcggccacggu

SEQ ID NO: 1272573 - RNA, 23 nt, Mycobacterium tuberculosis H37Rv
acccguccgccgcagacgccgac

SEQ ID NO: 1272574 - RNA, 13 nt, Mycobacterium tuberculosis H37Rv
acccgucgaacgc

SEQ ID NO: 1272575 - RNA, 19 nt, Mycobacterium tuberculosis H37Rv
acccgugcacgaucgcggu

SEQ ID NO: 1272576 - RNA, 17 nt, Mycobacterium tuberculosis H37Rv
acccguaggguggccga

SEQ ID NO: 1272577 - RNA, 20 nt, Mycobacterium tuberculosis H37Rv
acccggucgccggucaucgc

SEQ ID NO: 1272578 - RNA, 15 nt, Mycobacterium tuberculosis H37Rv
acccggugaccagca

SEQ ID NO: 1272579 - RNA, 14 nt, Mycobacterium tuberculosis H37Rv
acccggugacccgc

SEQ ID NO: 1272580 - RNA, 19 nt, Mycobacterium tuberculosis H37Rv
acccggugagaagaagccc

SEQ ID NO: 1272581 - RNA, 14 nt, Mycobacterium tuberculosis H37Rv
acccguagcuuggc

SEQ ID NO: 1272582 - RNA, 23 nt, Mycobacterium tuberculosis H37Rv
accgagaagcccaccgucugcug

SEQ ID NO: 1272583 - RNA, 18 nt, Mycobacterium tuberculosis H37Rv
accgagacggcgucgggc

SEQ ID NO: 1272584 - RNA, 21 nt, Mycobacterium tuberculosis H37Rv
accgagacuugcuggcccgca

SEQ ID NO: 1272585 - RNA, 15 nt, Mycobacterium tuberculosis H37Rv
accgacgucgcccau

SEQ ID NO: 1272586 - RNA, 13 nt, Mycobacterium tuberculosis H37Rv
accgacgucgcca

SEQ ID NO: 1272587 - RNA, 20 nt, Mycobacterium tuberculosis H37Rv
accgacugcggguucgccga

SEQ ID NO: 1272588 - RNA, 19 nt, Mycobacterium tuberculosis H37Rv
accgacguggccagcccgc

SEQ ID NO: 1272589 - RNA, 15 nt, Mycobacterium tuberculosis H37Rv
accgacgcugaccaa

SEQ ID NO: 1272590 - RNA, 20 nt, Mycobacterium tuberculosis H37Rv
accgacgcguccggugcacc

SEQ ID NO: 1272591 - RNA, 18 nt, Mycobacterium tuberculosis H37Rv
accgaacaacagcggcaa

SEQ ID NO: 1272592 - RNA, 20 nt, Mycobacterium tuberculosis H37Rv
accgaacaacagcggcaacg

SEQ ID NO: 1272593 - RNA, 22 nt, Mycobacterium tuberculosis H37Rv
accgacgcgcccgcgcgcuccg

SEQ ID NO: 1272594 - RNA, 14 nt, Mycobacterium tuberculosis H37Rv
acccggccucggug

SEQ ID NO: 1272595 - RNA, 20 nt, Mycobacterium tuberculosis H37Rv
acccggcccauugucgauca

SEQ ID NO: 1272596 - RNA, 18 nt, Mycobacterium tuberculosis H37Rv
acccggcgcaacaaccgg

SEQ ID NO: 1272597 - RNA, 15 nt, Mycobacterium tuberculosis H37Rv
acccggcgaccacgg

SEQ ID NO: 1272598 - RNA, 17 nt, Mycobacterium tuberculosis H37Rv
acccggcagagcacgcg

SEQ ID NO: 1272599 - RNA, 15 nt, Mycobacterium tuberculosis H37Rv
acccggaggcaaucc

SEQ ID NO: 1272600 - RNA, 19 nt, Mycobacterium tuberculosis H37Rv
acccgccggcgacugcagc

SEQ ID NO: 1272601 - RNA, 15 nt, Mycobacterium tuberculosis H37Rv
acccgccgucaccgc

SEQ ID NO: 1272602 - RNA, 18 nt, Mycobacterium tuberculosis H37Rv
acccgccgacgaccgccu

SEQ ID NO: 1272603 - RNA, 14 nt, Mycobacterium tuberculosis H37Rv
acccgccgcgugcu

SEQ ID NO: 1272604 - RNA, 17 nt, Mycobacterium tuberculosis H37Rv
acccggcggugccguca

SEQ ID NO: 1272605 - RNA, 15 nt, Mycobacterium tuberculosis H37Rv
acccggcuucgccgc

SEQ ID NO: 1272606 - RNA, 19 nt, Mycobacterium tuberculosis H37Rv
acccgggaugaccaccggu

SEQ ID NO: 1272607 - RNA, 23 nt, Mycobacterium tuberculosis H37Rv
acccgggacguuguccaccgcca

SEQ ID NO: 1272608 - RNA, 18 nt, Mycobacterium tuberculosis H37Rv
acccggcuucgccgcgcu

SEQ ID NO: 1272609 - RNA, 21 nt, Mycobacterium tuberculosis H37Rv
acccgggacguuguccaccgc

SEQ ID NO: 1272610 - RNA, 16 nt, Mycobacterium tuberculosis H37Rv
acccgggccacgucga

SEQ ID NO: 1272611 - RNA, 18 nt, Mycobacterium tuberculosis H37Rv
acccgggccaguucgucg

SEQ ID NO: 1272612 - RNA, 14 nt, Mycobacterium tuberculosis H37Rv
acccgggccucggc

SEQ ID NO: 1272613 - RNA, 16 nt, Mycobacterium tuberculosis H37Rv
acccgggccgggccga

SEQ ID NO: 1272614 - RNA, 20 nt, Mycobacterium tuberculosis H37Rv
acccgggccggucggugagc

SEQ ID NO: 1272615 - RNA, 19 nt, Mycobacterium tuberculosis H37Rv
acccgggccuuguucuugg

SEQ ID NO: 1272616 - RNA, 19 nt, Mycobacterium tuberculosis H37Rv
acccggucgauucggcuca

SEQ ID NO: 1272617 - RNA, 21 nt, Mycobacterium tuberculosis H37Rv
acccggucgccggucaucgcc

SEQ ID NO: 1272618 - RNA, 21 nt, Mycobacterium tuberculosis H37Rv
acccggucggccauccaccgc

SEQ ID NO: 1272619 - RNA, 18 nt, Mycobacterium tuberculosis H37Rv
acccggucccccgaagug

SEQ ID NO: 1272620 - RNA, 18 nt, Mycobacterium tuberculosis H37Rv
acccgguccauucguccg

SEQ ID NO: 1272621 - RNA, 22 nt, Mycobacterium tuberculosis H37Rv
acccgguccugcucgcacagca

SEQ ID NO: 1272622 - RNA, 14 nt, Mycobacterium tuberculosis H37Rv
acccgggcguccca

SEQ ID NO: 1272623 - RNA, 17 nt, Mycobacterium tuberculosis H37Rv
acccggggggccucguu

SEQ ID NO: 1272624 - RNA, 20 nt, Mycobacterium tuberculosis H37Rv
acccggguagacaccgcgau

SEQ ID NO: 1272625 - RNA, 15 nt, Mycobacterium tuberculosis H37Rv
acugcucgccggacg

SEQ ID NO: 1272626 - RNA, 14 nt, Mycobacterium tuberculosis H37Rv
acugcgaaucucgu

SEQ ID NO: 1272627 - RNA, 22 nt, Mycobacterium tuberculosis H37Rv
acugcgaccgguucggcguaca

SEQ ID NO: 1272628 - RNA, 17 nt, Mycobacterium tuberculosis H37Rv
acucucgcgacaucacc

SEQ ID NO: 1272629 - RNA, 15 nt, Mycobacterium tuberculosis H37Rv
acucguugccgacca

SEQ ID NO: 1272630 - RNA, 17 nt, Mycobacterium tuberculosis H37Rv
acuggauggcucgccga

SEQ ID NO: 1272631 - RNA, 14 nt, Mycobacterium tuberculosis H37Rv
acuggcgucgaugu

SEQ ID NO: 1272632 - RNA, 20 nt, Mycobacterium tuberculosis H37Rv
acuggcgucgaugucgccgc

SEQ ID NO: 1272633 - RNA, 16 nt, Mycobacterium tuberculosis H37Rv
acuggggugcugcgcg

SEQ ID NO: 1272634 - RNA, 18 nt, Mycobacterium tuberculosis H37Rv
acugguggcgauccguag

SEQ ID NO: 1272635 - RNA, 18 nt, Mycobacterium tuberculosis H37Rv
acugggcgcccaagcgcg

SEQ ID NO: 1272636 - RNA, 16 nt, Mycobacterium tuberculosis H37Rv
acugggcgcccgcggu

SEQ ID NO: 1272637 - RNA, 14 nt, Mycobacterium tuberculosis H37Rv
acugggccggucga

SEQ ID NO: 1272638 - RNA, 23 nt, Mycobacterium tuberculosis H37Rv
acuguccgggugggcgcugucac

SEQ ID NO: 1272639 - RNA, 16 nt, Mycobacterium tuberculosis H37Rv
acuucggggucaccgg

SEQ ID NO: 1272640 - RNA, 17 nt, Mycobacterium tuberculosis H37Rv
acuucauauaccgcucg

SEQ ID NO: 1272641 - RNA, 14 nt, Mycobacterium tuberculosis H37Rv
acuuggcaucgcga

SEQ ID NO: 1272642 - RNA, 17 nt, Mycobacterium tuberculosis H37Rv
acuuggcaucgcgagcc

SEQ ID NO: 1272643 - RNA, 17 nt, Mycobacterium tuberculosis H37Rv
acuuggugauccgagac

SEQ ID NO: 1272644 - RNA, 23 nt, Mycobacterium tuberculosis H37Rv
acuugugccgggcgaugcugggc

SEQ ID NO: 1272645 - RNA, 17 nt, Mycobacterium tuberculosis H37Rv
acuugcccgucggcgcc

SEQ ID NO: 1272646 - RNA, 19 nt, Mycobacterium tuberculosis H37Rv
acuugccacggcgauuccu

SEQ ID NO: 1272647 - RNA, 14 nt, Mycobacterium tuberculosis H37Rv
acuugccgccgcac

SEQ ID NO: 1272648 - RNA, 16 nt, Mycobacterium tuberculosis H37Rv
acuugaugcucgaugc

SEQ ID NO: 1272649 - RNA, 15 nt, Mycobacterium tuberculosis H37Rv
acuugaucucggcga

SEQ ID NO: 1272650 - RNA, 18 nt, Mycobacterium tuberculosis H37Rv
acuugcaggcgucccagc

SEQ ID NO: 1272651 - RNA, 21 nt, Mycobacterium tuberculosis H37Rv
acuccgcgcgcggacagcauc

SEQ ID NO: 1272652 - RNA, 22 nt, Mycobacterium tuberculosis H37Rv
acuccgugcuuccauucgcggu

SEQ ID NO: 1272653 - RNA, 21 nt, Mycobacterium tuberculosis H37Rv
acuccguugagguaggugagc

SEQ ID NO: 1272654 - RNA, 17 nt, Mycobacterium tuberculosis H37Rv
acucgaacaaccccggu

SEQ ID NO: 1272655 - RNA, 21 nt, Mycobacterium tuberculosis H37Rv
acuccggcaagcacaccgcca

SEQ ID NO: 1272656 - RNA, 22 nt, Mycobacterium tuberculosis H37Rv
acuccggucagcgcggcgaccu

SEQ ID NO: 1272657 - RNA, 15 nt, Mycobacterium tuberculosis H37Rv
acucgaucaccggca

SEQ ID NO: 1272658 - RNA, 15 nt, Mycobacterium tuberculosis H37Rv
acucgcccaagcgca

SEQ ID NO: 1272659 - RNA, 15 nt, Mycobacterium tuberculosis H37Rv
acucgaccaccgccg

SEQ ID NO: 1272660 - RNA, 18 nt, Mycobacterium tuberculosis H37Rv
acucgacaauucgcagcc

SEQ ID NO: 1272661 - RNA, 20 nt, Mycobacterium tuberculosis H37Rv
acucgaguagucgcuggcca

SEQ ID NO: 1272662 - RNA, 13 nt, Mycobacterium tuberculosis H37Rv
acucgaccgacug

SEQ ID NO: 1272663 - RNA, 12 nt, Mycobacterium tuberculosis H37Rv
acucgaccgcga

SEQ ID NO: 1272664 - RNA, 15 nt, Mycobacterium tuberculosis H37Rv
acucgagcgcucaca

SEQ ID NO: 1272665 - RNA, 13 nt, Mycobacterium tuberculosis H37Rv
acucggucucgau

SEQ ID NO: 1272666 - RNA, 15 nt, Mycobacterium tuberculosis H37Rv
acucggucucgaucc

SEQ ID NO: 1272667 - RNA, 19 nt, Mycobacterium tuberculosis H37Rv
acucggucucauagugcag

SEQ ID NO: 1272668 - RNA, 22 nt, Mycobacterium tuberculosis H37Rv
acucggcggccagcgagaucag

SEQ ID NO: 1272669 - RNA, 20 nt, Mycobacterium tuberculosis H37Rv
acucguggaacuccguccgc

SEQ ID NO: 1272670 - RNA, 23 nt, Mycobacterium tuberculosis H37Rv
acucguggaacuccguccgccgu

SEQ ID NO: 1272671 - RNA, 13 nt, Mycobacterium tuberculosis H37Rv
acucgugcgggca

SEQ ID NO: 1272672 - RNA, 22 nt, Mycobacterium tuberculosis H37Rv
acucguccaacugaaccgagug

SEQ ID NO: 1272673 - RNA, 20 nt, Mycobacterium tuberculosis H37Rv
acucgguucgccccugcaca

SEQ ID NO: 1272674 - RNA, 21 nt, Mycobacterium tuberculosis H37Rv
acucggcggaagaccggaucg

SEQ ID NO: 1272675 - RNA, 16 nt, Mycobacterium tuberculosis H37Rv
acucggcauccaggcu

SEQ ID NO: 1272676 - RNA, 17 nt, Mycobacterium tuberculosis H37Rv
acucggaauucggcguc

SEQ ID NO: 1272677 - RNA, 22 nt, Mycobacterium tuberculosis H37Rv
acucgccugcacccggcgauug

SEQ ID NO: 1272678 - RNA, 13 nt, Mycobacterium tuberculosis H37Rv
acuccagcgcccg

SEQ ID NO: 1272679 - RNA, 17 nt, Mycobacterium tuberculosis H37Rv
acuccaucagcgcgacc

SEQ ID NO: 1272680 - RNA, 22 nt, Mycobacterium tuberculosis H37Rv
acuccaugagccguagugcaau

SEQ ID NO: 1272681 - RNA, 13 nt, Mycobacterium tuberculosis H37Rv
acuccaugccgcu

SEQ ID NO: 1272682 - RNA, 22 nt, Mycobacterium tuberculosis H37Rv
acuccgaucgggcccaccgcug

SEQ ID NO: 1272683 - RNA, 20 nt, Mycobacterium tuberculosis H37Rv
acucauuacgguagacguug

SEQ ID NO: 1272684 - RNA, 13 nt, Mycobacterium tuberculosis H37Rv
acucaucggcgug

SEQ ID NO: 1272685 - RNA, 17 nt, Mycobacterium tuberculosis H37Rv
acuccaagucacagcuc

SEQ ID NO: 1272686 - RNA, 13 nt, Mycobacterium tuberculosis H37Rv
acuccacgcagcc

SEQ ID NO: 1272687 - RNA, 21 nt, Mycobacterium tuberculosis H37Rv
acuccaacugaucccguagcc

SEQ ID NO: 1272688 - RNA, 20 nt, Mycobacterium tuberculosis H37Rv
acuccaccgggauagccgcg

SEQ ID NO: 1272689 - RNA, 18 nt, Mycobacterium tuberculosis H37Rv
acuccagcaccagcacgg

SEQ ID NO: 1272690 - RNA, 22 nt, Mycobacterium tuberculosis H37Rv
acucacgaggcacaaucaccgc

SEQ ID NO: 1272691 - RNA, 15 nt, Mycobacterium tuberculosis H37Rv
acguugcagccggca

SEQ ID NO: 1272692 - RNA, 16 nt, Mycobacterium tuberculosis H37Rv
acguugccgaagccgg

SEQ ID NO: 1272693 - RNA, 15 nt, Mycobacterium tuberculosis H37Rv
acguugccgaucccg

SEQ ID NO: 1272694 - RNA, 14 nt, Mycobacterium tuberculosis H37Rv
acgucggccagugc

SEQ ID NO: 1272695 - RNA, 14 nt, Mycobacterium tuberculosis H37Rv
acgucggcgagcaa

SEQ ID NO: 1272696 - RNA, 16 nt, Mycobacterium tuberculosis H37Rv
acgucggcggccguca

SEQ ID NO: 1272697 - RNA, 18 nt, Mycobacterium tuberculosis H37Rv
acgucugcagccucgaug

SEQ ID NO: 1272698 - RNA, 20 nt, Mycobacterium tuberculosis H37Rv
acgucgguaagcgccaaggc

SEQ ID NO: 1272699 - RNA, 21 nt, Mycobacterium tuberculosis H37Rv
acgucggucaucgguugaccg

SEQ ID NO: 1272700 - RNA, 15 nt, Mycobacterium tuberculosis H37Rv
acgucggugaagucc

SEQ ID NO: 1272701 - RNA, 22 nt, Mycobacterium tuberculosis H37Rv
acgucggcguggucgcgcggca

SEQ ID NO: 1272702 - RNA, 17 nt, Mycobacterium tuberculosis H37Rv
acgucgaccucggcaac

SEQ ID NO: 1272703 - RNA, 16 nt, Mycobacterium tuberculosis H37Rv
acgucgacggcgaugg

SEQ ID NO: 1272704 - RNA, 18 nt, Mycobacterium tuberculosis H37Rv
acgucgacccccugccac

SEQ ID NO: 1272705 - RNA, 22 nt, Mycobacterium tuberculosis H37Rv
acgucgaccgugucaccgccgg

SEQ ID NO: 1272706 - RNA, 17 nt, Mycobacterium tuberculosis H37Rv
acgucgacggcgauggc

SEQ ID NO: 1272707 - RNA, 22 nt, Mycobacterium tuberculosis H37Rv
acgucgacggcgauggcgcgca

SEQ ID NO: 1272708 - RNA, 19 nt, Mycobacterium tuberculosis H37Rv
acgucgacuucagcggccg

SEQ ID NO: 1272709 - RNA, 19 nt, Mycobacterium tuberculosis H37Rv
acgucgaucucggcgcagg

SEQ ID NO: 1272710 - RNA, 23 nt, Mycobacterium tuberculosis H37Rv
acgugguugccccgcagcaucgc

SEQ ID NO: 1272711 - RNA, 17 nt, Mycobacterium tuberculosis H37Rv
acguggucggagcgggu

SEQ ID NO: 1272712 - RNA, 15 nt, Mycobacterium tuberculosis H37Rv
acgugucaucacggu

SEQ ID NO: 1272713 - RNA, 22 nt, Mycobacterium tuberculosis H37Rv
acgugucaucacggucagccgu

SEQ ID NO: 1272714 - RNA, 18 nt, Mycobacterium tuberculosis H37Rv
acgugacgguccacgacg

SEQ ID NO: 1272715 - RNA, 20 nt, Mycobacterium tuberculosis H37Rv
acgucugcccaguguccggc

SEQ ID NO: 1272716 - RNA, 19 nt, Mycobacterium tuberculosis H37Rv
acgucuugcuggucgaugg

SEQ ID NO: 1272717 - RNA, 20 nt, Mycobacterium tuberculosis H37Rv
acguaacgccgcucauccag

SEQ ID NO: 1272718 - RNA, 18 nt, Mycobacterium tuberculosis H37Rv
acggugcgauaccgacac

SEQ ID NO: 1272719 - RNA, 20 nt, Mycobacterium tuberculosis H37Rv
acggugcgauuccgcgucug

SEQ ID NO: 1272720 - RNA, 18 nt, Mycobacterium tuberculosis H37Rv
acggugccggcacccgag

SEQ ID NO: 1272721 - RNA, 14 nt, Mycobacterium tuberculosis H37Rv
acgguggccgcacg

SEQ ID NO: 1272722 - RNA, 15 nt, Mycobacterium tuberculosis H37Rv
acggugagaucgggu

SEQ ID NO: 1272723 - RNA, 18 nt, Mycobacterium tuberculosis H37Rv
acggugaucuugccggcc

SEQ ID NO: 1272724 - RNA, 14 nt, Mycobacterium tuberculosis H37Rv
acggugccggcacc

SEQ ID NO: 1272725 - RNA, 21 nt, Mycobacterium tuberculosis H37Rv
acggugagggcgucgucgagu

SEQ ID NO: 1272726 - RNA, 19 nt, Mycobacterium tuberculosis H37Rv
acgggguggugguggaguu

SEQ ID NO: 1272727 - RNA, 17 nt, Mycobacterium tuberculosis H37Rv
acgggguugaccgccac

SEQ ID NO: 1272728 - RNA, 22 nt, Mycobacterium tuberculosis H37Rv
acgucaucuggcgcugcuggca

SEQ ID NO: 1272729 - RNA, 15 nt, Mycobacterium tuberculosis H37Rv
acgucauaucucgag

SEQ ID NO: 1272730 - RNA, 21 nt, Mycobacterium tuberculosis H37Rv
acgucccagagaaucagcgug

SEQ ID NO: 1272731 - RNA, 20 nt, Mycobacterium tuberculosis H37Rv
acgucacguggucggccacc

SEQ ID NO: 1272732 - RNA, 11 nt, Mycobacterium tuberculosis H37Rv
acgucaccggg

SEQ ID NO: 1272733 - RNA, 22 nt, Mycobacterium tuberculosis H37Rv
acgucaccggguccggugaacc

SEQ ID NO: 1272734 - RNA, 14 nt, Mycobacterium tuberculosis H37Rv
acguagcagcagac

SEQ ID NO: 1272735 - RNA, 15 nt, Mycobacterium tuberculosis H37Rv
acguacuuggacgac

SEQ ID NO: 1272736 - RNA, 17 nt, Mycobacterium tuberculosis H37Rv
acguaccgucauggcga

SEQ ID NO: 1272737 - RNA, 16 nt, Mycobacterium tuberculosis H37Rv
acguagaagucgaucg

SEQ ID NO: 1272738 - RNA, 17 nt, Mycobacterium tuberculosis H37Rv
acguagaaguaggcggc

SEQ ID NO: 1272739 - RNA, 17 nt, Mycobacterium tuberculosis H37Rv
acguagaagucgaucgc

SEQ ID NO: 1272740 - RNA, 15 nt, Mycobacterium tuberculosis H37Rv
acggcgcugacgaac

SEQ ID NO: 1272741 - RNA, 15 nt, Mycobacterium tuberculosis H37Rv
acggcgucggccacc

SEQ ID NO: 1272742 - RNA, 18 nt, Mycobacterium tuberculosis H37Rv
acggcgcgggccaccacg

SEQ ID NO: 1272743 - RNA, 13 nt, Mycobacterium tuberculosis H37Rv
acggcgcgggcca

SEQ ID NO: 1272744 - RNA, 14 nt, Mycobacterium tuberculosis H37Rv
acggcgcguagugc

SEQ ID NO: 1272745 - RNA, 12 nt, Mycobacterium tuberculosis H37Rv
acggcugcccau

SEQ ID NO: 1272746 - RNA, 20 nt, Mycobacterium tuberculosis H37Rv
acggcucgggaacuucgccg

SEQ ID NO: 1272747 - RNA, 21 nt, Mycobacterium tuberculosis H37Rv
acggcucgggaacuucgccga

SEQ ID NO: 1272748 - RNA, 20 nt, Mycobacterium tuberculosis H37Rv
acggcuccuccgguaucggc

SEQ ID NO: 1272749 - RNA, 23 nt, Mycobacterium tuberculosis H37Rv
acggcuccuccgguaucggcgac

SEQ ID NO: 1272750 - RNA, 16 nt, Mycobacterium tuberculosis H37Rv
acggcguugucgacga

SEQ ID NO: 1272751 - RNA, 21 nt, Mycobacterium tuberculosis H37Rv
acggcgucuuccucggccacc

SEQ ID NO: 1272752 - RNA, 16 nt, Mycobacterium tuberculosis H37Rv
acggcugccgucagcc

SEQ ID NO: 1272753 - RNA, 22 nt, Mycobacterium tuberculosis H37Rv
acggcuucgaccaucaccacgg

SEQ ID NO: 1272754 - RNA, 17 nt, Mycobacterium tuberculosis H37Rv
acggggcugaccgccac

SEQ ID NO: 1272755 - RNA, 22 nt, Mycobacterium tuberculosis H37Rv
acggggcgugacagggcggcaa

SEQ ID NO: 1272756 - RNA, 20 nt, Mycobacterium tuberculosis H37Rv
acggggccgccagcugcgca

SEQ ID NO: 1272757 - RNA, 17 nt, Mycobacterium tuberculosis H37Rv
acgggccgucgccgucc

SEQ ID NO: 1272758 - RNA, 16 nt, Mycobacterium tuberculosis H37Rv
acgggccgucgccguc

SEQ ID NO: 1272759 - RNA, 15 nt, Mycobacterium tuberculosis H37Rv
acgggccuucgccac

SEQ ID NO: 1272760 - RNA, 13 nt, Mycobacterium tuberculosis H37Rv
acggcgaggccga

SEQ ID NO: 1272761 - RNA, 20 nt, Mycobacterium tuberculosis H37Rv
acggcgaggugcucggaucg

SEQ ID NO: 1272762 - RNA, 19 nt, Mycobacterium tuberculosis H37Rv
acggcgauccccgacgucg

SEQ ID NO: 1272763 - RNA, 16 nt, Mycobacterium tuberculosis H37Rv
acggcgaaaguccugc

SEQ ID NO: 1272764 - RNA, 12 nt, Mycobacterium tuberculosis H37Rv
acggcgacccag

SEQ ID NO: 1272765 - RNA, 12 nt, Mycobacterium tuberculosis H37Rv
acggcgcgagcc

SEQ ID NO: 1272766 - RNA, 21 nt, Mycobacterium tuberculosis H37Rv
acggcgccggcaucggucagc

SEQ ID NO: 1272767 - RNA, 12 nt, Mycobacterium tuberculosis H37Rv
acggcgccgaac

SEQ ID NO: 1272768 - RNA, 13 nt, Mycobacterium tuberculosis H37Rv
acggcgccgaacc

SEQ ID NO: 1272769 - RNA, 16 nt, Mycobacterium tuberculosis H37Rv
acggcgauggcgcgca

SEQ ID NO: 1272770 - RNA, 20 nt, Mycobacterium tuberculosis H37Rv
acggcgcaacaccucguaug

SEQ ID NO: 1272771 - RNA, 16 nt, Mycobacterium tuberculosis H37Rv
acggcgccaccaccgg

SEQ ID NO: 1272772 - RNA, 13 nt, Mycobacterium tuberculosis H37Rv
aaaccagcgucca

SEQ ID NO: 1272773 - RNA, 14 nt, Mycobacterium tuberculosis H37Rv
aaaccaguuggcga

SEQ ID NO: 1272774 - RNA, 20 nt, Mycobacterium tuberculosis H37Rv
acgcugggcggcuacccaug

SEQ ID NO: 1272775 - RNA, 13 nt, Mycobacterium tuberculosis H37Rv
acggcccgauccc

SEQ ID NO: 1272776 - RNA, 21 nt, Mycobacterium tuberculosis H37Rv
acggcccuuguggaguacggc

SEQ ID NO: 1272777 - RNA, 13 nt, Mycobacterium tuberculosis H37Rv
acggccugcaacg

SEQ ID NO: 1272778 - RNA, 16 nt, Mycobacterium tuberculosis H37Rv
acggccucgucgaugu

SEQ ID NO: 1272779 - RNA, 14 nt, Mycobacterium tuberculosis H37Rv
acggccgucgacga

SEQ ID NO: 1272780 - RNA, 17 nt, Mycobacterium tuberculosis H37Rv
acggccccugccacgac

SEQ ID NO: 1272781 - RNA, 17 nt, Mycobacterium tuberculosis H37Rv
acggccgggacggcgau

SEQ ID NO: 1272782 - RNA, 17 nt, Mycobacterium tuberculosis H37Rv
acggccggcaagcaguc

SEQ ID NO: 1272783 - RNA, 12 nt, Mycobacterium tuberculosis H37Rv
acggccgccgac

SEQ ID NO: 1272784 - RNA, 22 nt, Mycobacterium tuberculosis H37Rv
acgccgugcugggugacaccgg

SEQ ID NO: 1272785 - RNA, 19 nt, Mycobacterium tuberculosis H37Rv
acgccguugaucuugacgg

SEQ ID NO: 1272786 - RNA, 23 nt, Mycobacterium tuberculosis H37Rv
acgccguaucggcgugucucguc

SEQ ID NO: 1272787 - RNA, 12 nt, Mycobacterium tuberculosis H37Rv
acgccgucagcg

SEQ ID NO: 1272788 - RNA, 15 nt, Mycobacterium tuberculosis H37Rv
acgccgucgacgucg

SEQ ID NO: 1272789 - RNA, 14 nt, Mycobacterium tuberculosis H37Rv
acgccgucgaccgg

SEQ ID NO: 1272790 - RNA, 22 nt, Mycobacterium tuberculosis H37Rv
acgccugaaacgauugcugcgg

SEQ ID NO: 1272791 - RNA, 17 nt, Mycobacterium tuberculosis H37Rv
acgccucaccgacgucg

SEQ ID NO: 1272792 - RNA, 21 nt, Mycobacterium tuberculosis H37Rv
acgccucgccggccgccagcc

SEQ ID NO: 1272793 - RNA, 16 nt, Mycobacterium tuberculosis H37Rv
acgccucgacacccag

SEQ ID NO: 1272794 - RNA, 18 nt, Mycobacterium tuberculosis H37Rv
acgccuccggagaauccg

SEQ ID NO: 1272795 - RNA, 20 nt, Mycobacterium tuberculosis H37Rv
acgccgcuggagaucacgcc

SEQ ID NO: 1272796 - RNA, 15 nt, Mycobacterium tuberculosis H37Rv
acgccggacccgguc

SEQ ID NO: 1272797 - RNA, 16 nt, Mycobacterium tuberculosis H37Rv
acgccggccagcggcc

SEQ ID NO: 1272798 - RNA, 13 nt, Mycobacterium tuberculosis H37Rv
acgccggugguca

SEQ ID NO: 1272799 - RNA, 20 nt, Mycobacterium tuberculosis H37Rv
acgccgguggcagagccgcc

SEQ ID NO: 1272800 - RNA, 15 nt, Mycobacterium tuberculosis H37Rv
acgccgggcaucggc

SEQ ID NO: 1272801 - RNA, 15 nt, Mycobacterium tuberculosis H37Rv
acgccgagcacacgu

SEQ ID NO: 1272802 - RNA, 18 nt, Mycobacterium tuberculosis H37Rv
acgccgagaugcugcacc

SEQ ID NO: 1272803 - RNA, 23 nt, Mycobacterium tuberculosis H37Rv
acgccgagcagacgcaacggcac

SEQ ID NO: 1272804 - RNA, 23 nt, Mycobacterium tuberculosis H37Rv
acgccgaugccgaacuccgcgga

SEQ ID NO: 1272805 - RNA, 23 nt, Mycobacterium tuberculosis H37Rv
acgccgaucugguaagucagcuc

SEQ ID NO: 1272806 - RNA, 13 nt, Mycobacterium tuberculosis H37Rv
acgccgaugcggu

SEQ ID NO: 1272807 - RNA, 23 nt, Mycobacterium tuberculosis H37Rv
acgccgaacgugcaaccacggcg

SEQ ID NO: 1272808 - RNA, 15 nt, Mycobacterium tuberculosis H37Rv
acgcccuguucuccg

SEQ ID NO: 1272809 - RNA, 19 nt, Mycobacterium tuberculosis H37Rv
acgcccuggugucgaucgu

SEQ ID NO: 1272810 - RNA, 17 nt, Mycobacterium tuberculosis H37Rv
acgccgaccggcccgca

SEQ ID NO: 1272811 - RNA, 23 nt, Mycobacterium tuberculosis H37Rv
acgccgaccaauucgcaaucggc

SEQ ID NO: 1272812 - RNA, 23 nt, Mycobacterium tuberculosis H37Rv
acgccgccagcaccucggccagc

SEQ ID NO: 1272813 - RNA, 16 nt, Mycobacterium tuberculosis H37Rv
acgccgccagccuggu

SEQ ID NO: 1272814 - RNA, 16 nt, Mycobacterium tuberculosis H37Rv
acgccgauucgccguc

SEQ ID NO: 1272815 - RNA, 21 nt, Mycobacterium tuberculosis H37Rv
acgccgcgcagccggcccguc

SEQ ID NO: 1272816 - RNA, 16 nt, Mycobacterium tuberculosis H37Rv
acgccgcgcagccggc

SEQ ID NO: 1272817 - RNA, 21 nt, Mycobacterium tuberculosis H37Rv
acgccgccggcgccaccguug

SEQ ID NO: 1272818 - RNA, 16 nt, Mycobacterium tuberculosis H37Rv
acgcgcgaccgcgaug

SEQ ID NO: 1272819 - RNA, 16 nt, Mycobacterium tuberculosis H37Rv
acgcggaucgggcacc

SEQ ID NO: 1272820 - RNA, 18 nt, Mycobacterium tuberculosis H37Rv
acgcggccaccgaccgca

SEQ ID NO: 1272821 - RNA, 13 nt, Mycobacterium tuberculosis H37Rv
acgcggcaauggu

SEQ ID NO: 1272822 - RNA, 17 nt, Mycobacterium tuberculosis H37Rv
acgcggccgaggucacc

SEQ ID NO: 1272823 - RNA, 14 nt, Mycobacterium tuberculosis H37Rv
acgcggccaauggc

SEQ ID NO: 1272824 - RNA, 21 nt, Mycobacterium tuberculosis H37Rv
acgcggccuugcgcacaggcg

SEQ ID NO: 1272825 - RNA, 14 nt, Mycobacterium tuberculosis H37Rv
acgcggcgcgagcc

SEQ ID NO: 1272826 - RNA, 20 nt, Mycobacterium tuberculosis H37Rv
acgcggccgggcguccucgu

SEQ ID NO: 1272827 - RNA, 22 nt, Mycobacterium tuberculosis H37Rv
acgcggccggccgcccgcucga

SEQ ID NO: 1272828 - RNA, 15 nt, Mycobacterium tuberculosis H37Rv
acgcgacucggcggu

SEQ ID NO: 1272829 - RNA, 19 nt, Mycobacterium tuberculosis H37Rv
acgcgagcgcuaucaccgc

SEQ ID NO: 1272830 - RNA, 24 nt, Mycobacterium tuberculosis H37Rv
acgccuuccagcccgagcagaaac

SEQ ID NO: 1272831 - RNA, 15 nt, Mycobacterium tuberculosis H37Rv
acgccugggcacggc

SEQ ID NO: 1272832 - RNA, 17 nt, Mycobacterium tuberculosis H37Rv
acgccugggcgacgacg

SEQ ID NO: 1272833 - RNA, 14 nt, Mycobacterium tuberculosis H37Rv
acgcgaucggcguc

SEQ ID NO: 1272834 - RNA, 20 nt, Mycobacterium tuberculosis H37Rv
acgcgauggccaucaucgac

SEQ ID NO: 1272835 - RNA, 14 nt, Mycobacterium tuberculosis H37Rv
acgcgcccgcacca

SEQ ID NO: 1272836 - RNA, 15 nt, Mycobacterium tuberculosis H37Rv
acgcgcccgcaccac

SEQ ID NO: 1272837 - RNA, 23 nt, Mycobacterium tuberculosis H37Rv
acgcgccccaguucgacggcguc

SEQ ID NO: 1272838 - RNA, 23 nt, Mycobacterium tuberculosis H37Rv
acgcucggugcugcgccgauacg

SEQ ID NO: 1272839 - RNA, 17 nt, Mycobacterium tuberculosis H37Rv
acgcucgguucggaguc

SEQ ID NO: 1272840 - RNA, 21 nt, Mycobacterium tuberculosis H37Rv
acgcucggugaaggucaccgu

SEQ ID NO: 1272841 - RNA, 16 nt, Mycobacterium tuberculosis H37Rv
acgcucguuugcgagc

SEQ ID NO: 1272842 - RNA, 19 nt, Mycobacterium tuberculosis H37Rv
acgcuaggcgauccagacg

SEQ ID NO: 1272843 - RNA, 18 nt, Mycobacterium tuberculosis H37Rv
acgcucgggggauccggc

SEQ ID NO: 1272844 - RNA, 23 nt, Mycobacterium tuberculosis H37Rv
acgcucgggggauccggcgcagc

SEQ ID NO: 1272845 - RNA, 13 nt, Mycobacterium tuberculosis H37Rv
acgcuagccgaca

SEQ ID NO: 1272846 - RNA, 14 nt, Mycobacterium tuberculosis H37Rv
acgcuggccucguc

SEQ ID NO: 1272847 - RNA, 20 nt, Mycobacterium tuberculosis H37Rv
acgcuggccuccagcuuggc

SEQ ID NO: 1272848 - RNA, 19 nt, Mycobacterium tuberculosis H37Rv
acgcgucguggucggcgac

SEQ ID NO: 1272849 - RNA, 13 nt, Mycobacterium tuberculosis H37Rv
acgcguuccucga

SEQ ID NO: 1272850 - RNA, 15 nt, Mycobacterium tuberculosis H37Rv
acgcguuccucgacg

SEQ ID NO: 1272851 - RNA, 22 nt, Mycobacterium tuberculosis H37Rv
acgcgugugcgcgugcugcgga

SEQ ID NO: 1272852 - RNA, 20 nt, Mycobacterium tuberculosis H37Rv
acgcguugcacagcagcggu

SEQ ID NO: 1272853 - RNA, 18 nt, Mycobacterium tuberculosis H37Rv
acgcguugcacagcagcg

SEQ ID NO: 1272854 - RNA, 18 nt, Mycobacterium tuberculosis H37Rv
acgcgguuuugugcgggc

SEQ ID NO: 1272855 - RNA, 22 nt, Mycobacterium tuberculosis H37Rv
acgcguacugggugucgguguc

SEQ ID NO: 1272856 - RNA, 21 nt, Mycobacterium tuberculosis H37Rv
acgcguauucggcaucgccga

SEQ ID NO: 1272857 - RNA, 16 nt, Mycobacterium tuberculosis H37Rv
acgcguauucggcauc

SEQ ID NO: 1272858 - RNA, 15 nt, Mycobacterium tuberculosis H37Rv
acgcgucgccgacgc

SEQ ID NO: 1272859 - RNA, 13 nt, Mycobacterium tuberculosis H37Rv
acgcgucggucga

SEQ ID NO: 1272860 - RNA, 12 nt, Mycobacterium tuberculosis H37Rv
accuucggcccg

SEQ ID NO: 1272861 - RNA, 16 nt, Mycobacterium tuberculosis H37Rv
acgagauagcauccgc

SEQ ID NO: 1272862 - RNA, 13 nt, Mycobacterium tuberculosis H37Rv
acgagaugccgcg

SEQ ID NO: 1272863 - RNA, 17 nt, Mycobacterium tuberculosis H37Rv
accuucgacaaguccgc

SEQ ID NO: 1272864 - RNA, 22 nt, Mycobacterium tuberculosis H37Rv
accuucaccgcguguaccgcga

SEQ ID NO: 1272865 - RNA, 21 nt, Mycobacterium tuberculosis H37Rv
accuuagcgcuugccgcugag

SEQ ID NO: 1272866 - RNA, 20 nt, Mycobacterium tuberculosis H37Rv
accuuauggcgaagaccgca

SEQ ID NO: 1272867 - RNA, 17 nt, Mycobacterium tuberculosis H37Rv
accuguuggcaugccgc

SEQ ID NO: 1272868 - RNA, 20 nt, Mycobacterium tuberculosis H37Rv
acgagccacggcuucgccgc

SEQ ID NO: 1272869 - RNA, 13 nt, Mycobacterium tuberculosis H37Rv
acgagauugccgg

SEQ ID NO: 1272870 - RNA, 23 nt, Mycobacterium tuberculosis H37Rv
acgagccagggaggggccgucag

SEQ ID NO: 1272871 - RNA, 17 nt, Mycobacterium tuberculosis H37Rv
acgagcgucagauccgg

SEQ ID NO: 1272872 - RNA, 14 nt, Mycobacterium tuberculosis H37Rv
acgagcguccgggu

SEQ ID NO: 1272873 - RNA, 16 nt, Mycobacterium tuberculosis H37Rv
acgagcgaaggugaac

SEQ ID NO: 1272874 - RNA, 19 nt, Mycobacterium tuberculosis H37Rv
acgaucaacucgugcgggc

SEQ ID NO: 1272875 - RNA, 22 nt, Mycobacterium tuberculosis H37Rv
acgaucaccccgccaugcggcg

SEQ ID NO: 1272876 - RNA, 20 nt, Mycobacterium tuberculosis H37Rv
acgaucaucgggguggccac

SEQ ID NO: 1272877 - RNA, 17 nt, Mycobacterium tuberculosis H37Rv
acgaucagcuugugggc

SEQ ID NO: 1272878 - RNA, 23 nt, Mycobacterium tuberculosis H37Rv
acgaugaccggaaaugucuccuc

SEQ ID NO: 1272879 - RNA, 14 nt, Mycobacterium tuberculosis H37Rv
acgaugacgcgcga

SEQ ID NO: 1272880 - RNA, 17 nt, Mycobacterium tuberculosis H37Rv
acgaugauguuggccgg

SEQ ID NO: 1272881 - RNA, 16 nt, Mycobacterium tuberculosis H37Rv
accugggacaggacga

SEQ ID NO: 1272882 - RNA, 14 nt, Mycobacterium tuberculosis H37Rv
accuggggccgcac

SEQ ID NO: 1272883 - RNA, 21 nt, Mycobacterium tuberculosis H37Rv
accugguucgacucaugccga

SEQ ID NO: 1272884 - RNA, 14 nt, Mycobacterium tuberculosis H37Rv
accugguaugccgc

SEQ ID NO: 1272885 - RNA, 18 nt, Mycobacterium tuberculosis H37Rv
accuggaucagcgucggu

SEQ ID NO: 1272886 - RNA, 22 nt, Mycobacterium tuberculosis H37Rv
accuggagcuaugucauagcgc

SEQ ID NO: 1272887 - RNA, 16 nt, Mycobacterium tuberculosis H37Rv
accuggacaaccucgu

SEQ ID NO: 1272888 - RNA, 19 nt, Mycobacterium tuberculosis H37Rv
accuggcgugucgccgcca

SEQ ID NO: 1272889 - RNA, 15 nt, Mycobacterium tuberculosis H37Rv
accuggcuaucgcag

SEQ ID NO: 1272890 - RNA, 22 nt, Mycobacterium tuberculosis H37Rv
accuggcucaucgaugcgauga

SEQ ID NO: 1272891 - RNA, 23 nt, Mycobacterium tuberculosis H37Rv
accuggcgcagcaacucgacguc

SEQ ID NO: 1272892 - RNA, 23 nt, Mycobacterium tuberculosis H37Rv
accugccggaccaccgggccgac

SEQ ID NO: 1272893 - RNA, 13 nt, Mycobacterium tuberculosis H37Rv
accugccguuccg

SEQ ID NO: 1272894 - RNA, 15 nt, Mycobacterium tuberculosis H37Rv
accugccgcagugac

SEQ ID NO: 1272895 - RNA, 14 nt, Mycobacterium tuberculosis H37Rv
accugcgccgguga

SEQ ID NO: 1272896 - RNA, 17 nt, Mycobacterium tuberculosis H37Rv
accgggcaccagucgcc

SEQ ID NO: 1272897 - RNA, 17 nt, Mycobacterium tuberculosis H37Rv
accgggcccgacgacga

SEQ ID NO: 1272898 - RNA, 16 nt, Mycobacterium tuberculosis H37Rv
accgggcccgccgucc

SEQ ID NO: 1272899 - RNA, 20 nt, Mycobacterium tuberculosis H37Rv
accugcggcagcggaccgcu

SEQ ID NO: 1272900 - RNA, 15 nt, Mycobacterium tuberculosis H37Rv
accugcgggcccacg

SEQ ID NO: 1272901 - RNA, 23 nt, Mycobacterium tuberculosis H37Rv
accugcggcugcuuggucgccca

SEQ ID NO: 1272902 - RNA, 19 nt, Mycobacterium tuberculosis H37Rv
accugcuggaagccgucuc

SEQ ID NO: 1272903 - RNA, 13 nt, Mycobacterium tuberculosis H37Rv
accugcuggcgca

SEQ ID NO: 1272904 - RNA, 19 nt, Mycobacterium tuberculosis H37Rv
accugcuggcgcacgaacc

SEQ ID NO: 1272905 - RNA, 20 nt, Mycobacterium tuberculosis H37Rv
accugcucgucggucaccga

SEQ ID NO: 1272906 - RNA, 14 nt, Mycobacterium tuberculosis H37Rv
accugcugcacggu

SEQ ID NO: 1272907 - RNA, 15 nt, Mycobacterium tuberculosis H37Rv
acgauggccgucgau

SEQ ID NO: 1272908 - RNA, 15 nt, Mycobacterium tuberculosis H37Rv
acgauggcgaugagg

SEQ ID NO: 1272909 - RNA, 22 nt, Mycobacterium tuberculosis H37Rv
acgauggcgaugagguggccgc

SEQ ID NO: 1272910 - RNA, 16 nt, Mycobacterium tuberculosis H37Rv
acgaugccgcgggaca

SEQ ID NO: 1272911 - RNA, 21 nt, Mycobacterium tuberculosis H37Rv
acgaugcgggcgaucucgaug

SEQ ID NO: 1272912 - RNA, 14 nt, Mycobacterium tuberculosis H37Rv
acgcagcggcaagg

SEQ ID NO: 1272913 - RNA, 13 nt, Mycobacterium tuberculosis H37Rv
acgcagucgccca

SEQ ID NO: 1272914 - RNA, 23 nt, Mycobacterium tuberculosis H37Rv
acgcagcggugaggugaccaacg

SEQ ID NO: 1272915 - RNA, 17 nt, Mycobacterium tuberculosis H37Rv
acgcaggugaacgccgg

SEQ ID NO: 1272916 - RNA, 13 nt, Mycobacterium tuberculosis H37Rv
acgcaugcucgau

SEQ ID NO: 1272917 - RNA, 15 nt, Mycobacterium tuberculosis H37Rv
acgcaucgccgucaa

SEQ ID NO: 1272918 - RNA, 20 nt, Mycobacterium tuberculosis H37Rv
acgcauaagcccccgcacgc

SEQ ID NO: 1272919 - RNA, 21 nt, Mycobacterium tuberculosis H37Rv
acgccaaguacgcgaccgcga

SEQ ID NO: 1272920 - RNA, 18 nt, Mycobacterium tuberculosis H37Rv
acgccaaguacgcgaccg

SEQ ID NO: 1272921 - RNA, 18 nt, Mycobacterium tuberculosis H37Rv
acgccaaguccgcucacc

SEQ ID NO: 1272922 - RNA, 21 nt, Mycobacterium tuberculosis H37Rv
acgccaacgugacgccggcca

SEQ ID NO: 1272923 - RNA, 19 nt, Mycobacterium tuberculosis H37Rv
acgccaccaccuccgcguc

SEQ ID NO: 1272924 - RNA, 17 nt, Mycobacterium tuberculosis H37Rv
acgccaugucgaugucc

SEQ ID NO: 1272925 - RNA, 21 nt, Mycobacterium tuberculosis H37Rv
acgcccaacgucgccagguca

SEQ ID NO: 1272926 - RNA, 16 nt, Mycobacterium tuberculosis H37Rv
acgccagugaacgcgc

SEQ ID NO: 1272927 - RNA, 24 nt, Mycobacterium tuberculosis H37Rv
acgccagugaacgcgcgugcagcc

SEQ ID NO: 1272928 - RNA, 17 nt, Mycobacterium tuberculosis H37Rv
acgccagcccguccggc

SEQ ID NO: 1272929 - RNA, 20 nt, Mycobacterium tuberculosis H37Rv
acgccacggacgugacgucg

SEQ ID NO: 1272930 - RNA, 16 nt, Mycobacterium tuberculosis H37Rv
acgccaccgcggucac

SEQ ID NO: 1272931 - RNA, 15 nt, Mycobacterium tuberculosis H37Rv
acgccagcaaugccc

SEQ ID NO: 1272932 - RNA, 17 nt, Mycobacterium tuberculosis H37Rv
acgcccgcccgcacgac

SEQ ID NO: 1272933 - RNA, 12 nt, Mycobacterium tuberculosis H37Rv
acgcccggcacc

SEQ ID NO: 1272934 - RNA, 15 nt, Mycobacterium tuberculosis H37Rv
agcgccugagcggcc

SEQ ID NO: 1272935 - RNA, 16 nt, Mycobacterium tuberculosis H37Rv
agcgccucgccggcca

SEQ ID NO: 1272936 - RNA, 22 nt, Mycobacterium tuberculosis H37Rv
agcgccucgguaaagccgcgga

SEQ ID NO: 1272937 - RNA, 22 nt, Mycobacterium tuberculosis H37Rv
agcgccgccaccgaagccgccg

SEQ ID NO: 1272938 - RNA, 17 nt, Mycobacterium tuberculosis H37Rv
agcgccgcagugacggg

SEQ ID NO: 1272939 - RNA, 13 nt, Mycobacterium tuberculosis H37Rv
agcgccgccaccg

SEQ ID NO: 1272940 - RNA, 16 nt, Mycobacterium tuberculosis H37Rv
agcgccguggcgcggu

SEQ ID NO: 1272941 - RNA, 20 nt, Mycobacterium tuberculosis H37Rv
agcgccagccgcugccacag

SEQ ID NO: 1272942 - RNA, 19 nt, Mycobacterium tuberculosis H37Rv
agcgccaggccgcacagca

SEQ ID NO: 1272943 - RNA, 18 nt, Mycobacterium tuberculosis H37Rv
agcgccaggccgcacagc

SEQ ID NO: 1272944 - RNA, 13 nt, Mycobacterium tuberculosis H37Rv
agcgccaggccgc

SEQ ID NO: 1272945 - RNA, 20 nt, Mycobacterium tuberculosis H37Rv
agcgcaggauucugcugacc

SEQ ID NO: 1272946 - RNA, 17 nt, Mycobacterium tuberculosis H37Rv
agcgcaggagcgcgaug

SEQ ID NO: 1272947 - RNA, 15 nt, Mycobacterium tuberculosis H37Rv
agcgcagcgccggca

SEQ ID NO: 1272948 - RNA, 15 nt, Mycobacterium tuberculosis H37Rv
agcgcagcgccuccu

SEQ ID NO: 1272949 - RNA, 14 nt, Mycobacterium tuberculosis H37Rv
agcgcccgccggca

SEQ ID NO: 1272950 - RNA, 16 nt, Mycobacterium tuberculosis H37Rv
agcgccgagagcaccg

SEQ ID NO: 1272951 - RNA, 17 nt, Mycobacterium tuberculosis H37Rv
agcgccgagagcaccgc

SEQ ID NO: 1272952 - RNA, 17 nt, Mycobacterium tuberculosis H37Rv
agcgccgagcucggcgc

SEQ ID NO: 1272953 - RNA, 17 nt, Mycobacterium tuberculosis H37Rv
agcgccgacagccgauc

SEQ ID NO: 1272954 - RNA, 22 nt, Mycobacterium tuberculosis H37Rv
agcgccaucaucuuggcgcggu

SEQ ID NO: 1272955 - RNA, 12 nt, Mycobacterium tuberculosis H37Rv
agcgcccggaug

SEQ ID NO: 1272956 - RNA, 20 nt, Mycobacterium tuberculosis H37Rv
agcgcccggauguccgccga

SEQ ID NO: 1272957 - RNA, 13 nt, Mycobacterium tuberculosis H37Rv
agcgcccggucac

SEQ ID NO: 1272958 - RNA, 20 nt, Mycobacterium tuberculosis H37Rv
agcgccuuucggucacgcgu

SEQ ID NO: 1272959 - RNA, 14 nt, Mycobacterium tuberculosis H37Rv
agcgccuuugcccg

SEQ ID NO: 1272960 - RNA, 21 nt, Mycobacterium tuberculosis H37Rv
agcgccuuguuggcgaagucg

SEQ ID NO: 1272961 - RNA, 16 nt, Mycobacterium tuberculosis H37Rv
agcgccuugucgaucu

SEQ ID NO: 1272962 - RNA, 15 nt, Mycobacterium tuberculosis H37Rv
agcgcgaacaccaug

SEQ ID NO: 1272963 - RNA, 18 nt, Mycobacterium tuberculosis H37Rv
agcgcgaaagcgccgaaa

SEQ ID NO: 1272964 - RNA, 13 nt, Mycobacterium tuberculosis H37Rv
agcgcgccacgag

SEQ ID NO: 1272965 - RNA, 16 nt, Mycobacterium tuberculosis H37Rv
agcgcgccaaucgccc

SEQ ID NO: 1272966 - RNA, 15 nt, Mycobacterium tuberculosis H37Rv
agcgcgccaaucgcc

SEQ ID NO: 1272967 - RNA, 22 nt, Mycobacterium tuberculosis H37Rv
agcgcgaucgggccggcgcggu

SEQ ID NO: 1272968 - RNA, 15 nt, Mycobacterium tuberculosis H37Rv
agcgcgaugaccucg

SEQ ID NO: 1272969 - RNA, 22 nt, Mycobacterium tuberculosis H37Rv
agcgcgacccguagcuuggcga

SEQ ID NO: 1272970 - RNA, 18 nt, Mycobacterium tuberculosis H37Rv
agcgcgagcagacgcaga

SEQ ID NO: 1272971 - RNA, 16 nt, Mycobacterium tuberculosis H37Rv
agcgcgaucgauuccg

SEQ ID NO: 1272972 - RNA, 16 nt, Mycobacterium tuberculosis H37Rv
agcgcgaucgcgguca

SEQ ID NO: 1272973 - RNA, 22 nt, Mycobacterium tuberculosis H37Rv
agcgcgcgcgggugcaaccgga

SEQ ID NO: 1272974 - RNA, 20 nt, Mycobacterium tuberculosis H37Rv
agcgcgcgcucgggcccagc

SEQ ID NO: 1272975 - RNA, 21 nt, Mycobacterium tuberculosis H37Rv
agcgcggcaacuccggucaac

SEQ ID NO: 1272976 - RNA, 19 nt, Mycobacterium tuberculosis H37Rv
agcgcggcaacuccgguca

SEQ ID NO: 1272977 - RNA, 18 nt, Mycobacterium tuberculosis H37Rv
agcgcggaugucggcauc

SEQ ID NO: 1272978 - RNA, 22 nt, Mycobacterium tuberculosis H37Rv
agcgcgcuggccagcccgguca

SEQ ID NO: 1272979 - RNA, 22 nt, Mycobacterium tuberculosis H37Rv
agcgcgcugcggaucguggcgc

SEQ ID NO: 1272980 - RNA, 18 nt, Mycobacterium tuberculosis H37Rv
agcgcggagacgaugccg

SEQ ID NO: 1272981 - RNA, 22 nt, Mycobacterium tuberculosis H37Rv
agcgcgcgcaguuguacggcac

SEQ ID NO: 1272982 - RNA, 14 nt, Mycobacterium tuberculosis H37Rv
agccguucgcagcu

SEQ ID NO: 1272983 - RNA, 23 nt, Mycobacterium tuberculosis H37Rv
agccuggcaaccacguccgcaac

SEQ ID NO: 1272984 - RNA, 20 nt, Mycobacterium tuberculosis H37Rv
agccguggcagucgcacggu

SEQ ID NO: 1272985 - RNA, 19 nt, Mycobacterium tuberculosis H37Rv
agccgugucaaccggucgg

SEQ ID NO: 1272986 - RNA, 17 nt, Mycobacterium tuberculosis H37Rv
agccgugccgccagcaa

SEQ ID NO: 1272987 - RNA, 18 nt, Mycobacterium tuberculosis H37Rv
agccgugggccacgauga

SEQ ID NO: 1272988 - RNA, 18 nt, Mycobacterium tuberculosis H37Rv
agccguggcagucgcacg

SEQ ID NO: 1272989 - RNA, 18 nt, Mycobacterium tuberculosis H37Rv
agccgugcgggccggucg

SEQ ID NO: 1272990 - RNA, 13 nt, Mycobacterium tuberculosis H37Rv
agccguagccgcc

SEQ ID NO: 1272991 - RNA, 18 nt, Mycobacterium tuberculosis H37Rv
agccguagugucggcguc

SEQ ID NO: 1272992 - RNA, 15 nt, Mycobacterium tuberculosis H37Rv
agccguccaauuccg

SEQ ID NO: 1272993 - RNA, 19 nt, Mycobacterium tuberculosis H37Rv
agccggugcgcgcggucga

SEQ ID NO: 1272994 - RNA, 17 nt, Mycobacterium tuberculosis H37Rv
agccggugagcgagcgc

SEQ ID NO: 1272995 - RNA, 18 nt, Mycobacterium tuberculosis H37Rv
agccggugccgacggcgc

SEQ ID NO: 1272996 - RNA, 23 nt, Mycobacterium tuberculosis H37Rv
agccgguagaucagcgccugguc

SEQ ID NO: 1272997 - RNA, 16 nt, Mycobacterium tuberculosis H37Rv
agccggucgaugccga

SEQ ID NO: 1272998 - RNA, 20 nt, Mycobacterium tuberculosis H37Rv
agccgcuaggaucggauggc

SEQ ID NO: 1272999 - RNA, 23 nt, Mycobacterium tuberculosis H37Rv
agccgcuacguuacgccgagaug

SEQ ID NO: 1273000 - RNA, 22 nt, Mycobacterium tuberculosis H37Rv
agccgcuaggacggcgcgagcc

SEQ ID NO: 1273001 - RNA, 16 nt, Mycobacterium tuberculosis H37Rv
agccgcuccacguacg

SEQ ID NO: 1273002 - RNA, 17 nt, Mycobacterium tuberculosis H37Rv
agccgcuccacguacgc

SEQ ID NO: 1273003 - RNA, 16 nt, Mycobacterium tuberculosis H37Rv
agccgcuccgcccauu

SEQ ID NO: 1273004 - RNA, 23 nt, Mycobacterium tuberculosis H37Rv
agccggguguuggggaucgcacc

SEQ ID NO: 1273005 - RNA, 17 nt, Mycobacterium tuberculosis H37Rv
agccgggugggagcagc

SEQ ID NO: 1273006 - RNA, 21 nt, Mycobacterium tuberculosis H37Rv
agcgaaugucugcgcaggugg

SEQ ID NO: 1273007 - RNA, 16 nt, Mycobacterium tuberculosis H37Rv
agcgacaacaccacgg

SEQ ID NO: 1273008 - RNA, 17 nt, Mycobacterium tuberculosis H37Rv
agcgacagcagcgccac

SEQ ID NO: 1273009 - RNA, 13 nt, Mycobacterium tuberculosis H37Rv
aaacgccgaccgc

SEQ ID NO: 1273010 - RNA, 22 nt, Mycobacterium tuberculosis H37Rv
agcgacgguaccccaacgaccg

SEQ ID NO: 1273011 - RNA, 23 nt, Mycobacterium tuberculosis H37Rv
agcgacgcugacacccacggcgc

SEQ ID NO: 1273012 - RNA, 12 nt, Mycobacterium tuberculosis H37Rv
agcgacggcaaa

SEQ ID NO: 1273013 - RNA, 16 nt, Mycobacterium tuberculosis H37Rv
agcgacgcggccagcg

SEQ ID NO: 1273014 - RNA, 13 nt, Mycobacterium tuberculosis H37Rv
agcgacgcgguca

SEQ ID NO: 1273015 - RNA, 20 nt, Mycobacterium tuberculosis H37Rv
agcgacagcgcggcgcgaca

SEQ ID NO: 1273016 - RNA, 16 nt, Mycobacterium tuberculosis H37Rv
agcgacagcgugccga

SEQ ID NO: 1273017 - RNA, 13 nt, Mycobacterium tuberculosis H37Rv
aaacgcugcuggc

SEQ ID NO: 1273018 - RNA, 17 nt, Mycobacterium tuberculosis H37Rv
agcgaauccaggccgua

SEQ ID NO: 1273019 - RNA, 19 nt, Mycobacterium tuberculosis H37Rv
agcgcaccgcugaccgcaa

SEQ ID NO: 1273020 - RNA, 14 nt, Mycobacterium tuberculosis H37Rv
agcgcaccgcgaaa

SEQ ID NO: 1273021 - RNA, 19 nt, Mycobacterium tuberculosis H37Rv
agcgcacccggucggcggc

SEQ ID NO: 1273022 - RNA, 12 nt, Mycobacterium tuberculosis H37Rv
agcgcaccgcga

SEQ ID NO: 1273023 - RNA, 17 nt, Mycobacterium tuberculosis H37Rv
agcgcacacuaccgccg

SEQ ID NO: 1273024 - RNA, 22 nt, Mycobacterium tuberculosis H37Rv
agcgcaagguugccaacgccuu

SEQ ID NO: 1273025 - RNA, 12 nt, Mycobacterium tuberculosis H37Rv
agcgaggccagc

SEQ ID NO: 1273026 - RNA, 15 nt, Mycobacterium tuberculosis H37Rv
agcgagucgacgucg

SEQ ID NO: 1273027 - RNA, 21 nt, Mycobacterium tuberculosis H37Rv
agcgcaccacggcggucaacg

SEQ ID NO: 1273028 - RNA, 14 nt, Mycobacterium tuberculosis H37Rv
agcgcaaugcggcc

SEQ ID NO: 1273029 - RNA, 13 nt, Mycobacterium tuberculosis H37Rv
agcgaggccagcg

SEQ ID NO: 1273030 - RNA, 21 nt, Mycobacterium tuberculosis H37Rv
agcgagcgcaaaucgauugcg

SEQ ID NO: 1273031 - RNA, 20 nt, Mycobacterium tuberculosis H37Rv
agcgagcgcaaaucgauugc

SEQ ID NO: 1273032 - RNA, 19 nt, Mycobacterium tuberculosis H37Rv
agcggagccacucggcccg

SEQ ID NO: 1273033 - RNA, 14 nt, Mycobacterium tuberculosis H37Rv
agcggagccgccga

SEQ ID NO: 1273034 - RNA, 12 nt, Mycobacterium tuberculosis H37Rv
agcggaucccgc

SEQ ID NO: 1273035 - RNA, 13 nt, Mycobacterium tuberculosis H37Rv
agcggaucgcggu

SEQ ID NO: 1273036 - RNA, 18 nt, Mycobacterium tuberculosis H37Rv
agcggauccaggccucgc

SEQ ID NO: 1273037 - RNA, 21 nt, Mycobacterium tuberculosis H37Rv
agcggcaccgcgccggcggaa

SEQ ID NO: 1273038 - RNA, 22 nt, Mycobacterium tuberculosis H37Rv
agcgcuucgagguggcugcgcc

SEQ ID NO: 1273039 - RNA, 19 nt, Mycobacterium tuberculosis H37Rv
agcgcuucaaagaucgccu

SEQ ID NO: 1273040 - RNA, 19 nt, Mycobacterium tuberculosis H37Rv
agcgcuucgucggccggca

SEQ ID NO: 1273041 - RNA, 21 nt, Mycobacterium tuberculosis H37Rv
agcgcuugaccccgccgaacg

SEQ ID NO: 1273042 - RNA, 17 nt, Mycobacterium tuberculosis H37Rv
agcggacccgaccgucg

SEQ ID NO: 1273043 - RNA, 17 nt, Mycobacterium tuberculosis H37Rv
agcgcuugcgaccccgg

SEQ ID NO: 1273044 - RNA, 20 nt, Mycobacterium tuberculosis H37Rv
agcgcuccagcugagcggcc

SEQ ID NO: 1273045 - RNA, 18 nt, Mycobacterium tuberculosis H37Rv
agcgcuauaggccgcaug

SEQ ID NO: 1273046 - RNA, 17 nt, Mycobacterium tuberculosis H37Rv
agcgcuauaggccgcau

SEQ ID NO: 1273047 - RNA, 21 nt, Mycobacterium tuberculosis H37Rv
agcgcuacguaaucagccccg

SEQ ID NO: 1273048 - RNA, 15 nt, Mycobacterium tuberculosis H37Rv
agcgcguucggcacc

SEQ ID NO: 1273049 - RNA, 14 nt, Mycobacterium tuberculosis H37Rv
agcgcguaguccgc

SEQ ID NO: 1273050 - RNA, 18 nt, Mycobacterium tuberculosis H37Rv
agcgcggugccgccaccg

SEQ ID NO: 1273051 - RNA, 16 nt, Mycobacterium tuberculosis H37Rv
agcgcgguuucggcga

SEQ ID NO: 1273052 - RNA, 19 nt, Mycobacterium tuberculosis H37Rv
agcgcggguggcagcggcg

SEQ ID NO: 1273053 - RNA, 19 nt, Mycobacterium tuberculosis H37Rv
agcgcggccagugcucgca

SEQ ID NO: 1273054 - RNA, 17 nt, Mycobacterium tuberculosis H37Rv
agcgcgggacacgucgc

SEQ ID NO: 1273055 - RNA, 15 nt, Mycobacterium tuberculosis H37Rv
agcgcggccgauacg

SEQ ID NO: 1273056 - RNA, 17 nt, Mycobacterium tuberculosis H37Rv
agcgcggccagcagcag

SEQ ID NO: 1273057 - RNA, 19 nt, Mycobacterium tuberculosis H37Rv
agcgcggccagcagcagau

SEQ ID NO: 1273058 - RNA, 21 nt, Mycobacterium tuberculosis H37Rv
agcgcggccaccagaucgcac

SEQ ID NO: 1273059 - RNA, 18 nt, Mycobacterium tuberculosis H37Rv
agcgguacguaaucgagc

SEQ ID NO: 1273060 - RNA, 15 nt, Mycobacterium tuberculosis H37Rv
agcgguacgcccgaa

SEQ ID NO: 1273061 - RNA, 22 nt, Mycobacterium tuberculosis H37Rv
agcgguacgcccgaaucgccgg

SEQ ID NO: 1273062 - RNA, 15 nt, Mycobacterium tuberculosis H37Rv
agcgguacggacagc

SEQ ID NO: 1273063 - RNA, 21 nt, Mycobacterium tuberculosis H37Rv
agcgguaaugccagcggcaca

SEQ ID NO: 1273064 - RNA, 17 nt, Mycobacterium tuberculosis H37Rv
agcggguugcggucacc

SEQ ID NO: 1273065 - RNA, 19 nt, Mycobacterium tuberculosis H37Rv
agcggguggccaucaccgc

SEQ ID NO: 1273066 - RNA, 19 nt, Mycobacterium tuberculosis H37Rv
agcggguucaacgcgcgca

SEQ ID NO: 1273067 - RNA, 23 nt, Mycobacterium tuberculosis H37Rv
agcgggugccagcccguugcagg

SEQ ID NO: 1273068 - RNA, 13 nt, Mycobacterium tuberculosis H37Rv
agcggcucggcgg

SEQ ID NO: 1273069 - RNA, 16 nt, Mycobacterium tuberculosis H37Rv
agcggggucuugacgg

SEQ ID NO: 1273070 - RNA, 19 nt, Mycobacterium tuberculosis H37Rv
agcgggggagcgaacggcg

SEQ ID NO: 1273071 - RNA, 17 nt, Mycobacterium tuberculosis H37Rv
agcgggggagcgaacgg

SEQ ID NO: 1273072 - RNA, 16 nt, Mycobacterium tuberculosis H37Rv
agcgggggagcgaacg

SEQ ID NO: 1273073 - RNA, 16 nt, Mycobacterium tuberculosis H37Rv
agcggguccccgguca

SEQ ID NO: 1273074 - RNA, 19 nt, Mycobacterium tuberculosis H37Rv
agcggguccgucagcaccc

SEQ ID NO: 1273075 - RNA, 20 nt, Mycobacterium tuberculosis H37Rv
agcggcugcccgagaucgcg

SEQ ID NO: 1273076 - RNA, 17 nt, Mycobacterium tuberculosis H37Rv
agcggcugcugcgcggu

SEQ ID NO: 1273077 - RNA, 21 nt, Mycobacterium tuberculosis H37Rv
agcggcucuauccggcgcagg

SEQ ID NO: 1273078 - RNA, 18 nt, Mycobacterium tuberculosis H37Rv
agcggcugcccgagaucg

SEQ ID NO: 1273079 - RNA, 19 nt, Mycobacterium tuberculosis H37Rv
agcggcgcucuugcucacc

SEQ ID NO: 1273080 - RNA, 20 nt, Mycobacterium tuberculosis H37Rv
agcggcgccaguauggccgc

SEQ ID NO: 1273081 - RNA, 18 nt, Mycobacterium tuberculosis H37Rv
agcggcagcggcgucguc

SEQ ID NO: 1273082 - RNA, 23 nt, Mycobacterium tuberculosis H37Rv
agcggcagcggcgucgucgucga

SEQ ID NO: 1273083 - RNA, 19 nt, Mycobacterium tuberculosis H37Rv
agcggccagcagugcggua

SEQ ID NO: 1273084 - RNA, 12 nt, Mycobacterium tuberculosis H37Rv
agcggccagcag

SEQ ID NO: 1273085 - RNA, 23 nt, Mycobacterium tuberculosis H37Rv
agcggccaccgccgccgccaccg

SEQ ID NO: 1273086 - RNA, 16 nt, Mycobacterium tuberculosis H37Rv
agcggccaccgaggcg

SEQ ID NO: 1273087 - RNA, 17 nt, Mycobacterium tuberculosis H37Rv
agcggcauugccagccg

SEQ ID NO: 1273088 - RNA, 18 nt, Mycobacterium tuberculosis H37Rv
agcggcaucggccagccg

SEQ ID NO: 1273089 - RNA, 14 nt, Mycobacterium tuberculosis H37Rv
agcggcaucgcggg

SEQ ID NO: 1273090 - RNA, 23 nt, Mycobacterium tuberculosis H37Rv
agcggcauccacaccgaccgcgg

SEQ ID NO: 1273091 - RNA, 17 nt, Mycobacterium tuberculosis H37Rv
agcggucggucaccaug

SEQ ID NO: 1273092 - RNA, 16 nt, Mycobacterium tuberculosis H37Rv
agcggucagccggcca

SEQ ID NO: 1273093 - RNA, 20 nt, Mycobacterium tuberculosis H37Rv
agcgguccagccaccgccgc

SEQ ID NO: 1273094 - RNA, 16 nt, Mycobacterium tuberculosis H37Rv
agcgguccagcgucgc

SEQ ID NO: 1273095 - RNA, 18 nt, Mycobacterium tuberculosis H37Rv
agcgguggcccgccggca

SEQ ID NO: 1273096 - RNA, 22 nt, Mycobacterium tuberculosis H37Rv
agcguccgcgcccgagccggua

SEQ ID NO: 1273097 - RNA, 20 nt, Mycobacterium tuberculosis H37Rv
agcguccgacaacgacugcg

SEQ ID NO: 1273098 - RNA, 12 nt, Mycobacterium tuberculosis H37Rv
agcguccgucgu

SEQ ID NO: 1273099 - RNA, 17 nt, Mycobacterium tuberculosis H37Rv
agcguccgaaccaccug

SEQ ID NO: 1273100 - RNA, 19 nt, Mycobacterium tuberculosis H37Rv
agcgucgcacccagggcgu

SEQ ID NO: 1273101 - RNA, 18 nt, Mycobacterium tuberculosis H37Rv
agcgucugagcgccggca

SEQ ID NO: 1273102 - RNA, 21 nt, Mycobacterium tuberculosis H37Rv
agcuaucccaggggcaccgag

SEQ ID NO: 1273103 - RNA, 23 nt, Mycobacterium tuberculosis H37Rv
agcuagcccucagcuagcgcggg

SEQ ID NO: 1273104 - RNA, 17 nt, Mycobacterium tuberculosis H37Rv
agcguuggccgcugucg

SEQ ID NO: 1273105 - RNA, 15 nt, Mycobacterium tuberculosis H37Rv
agcguugaccgcggu

SEQ ID NO: 1273106 - RNA, 20 nt, Mycobacterium tuberculosis H37Rv
agcgugcaaucacugcgaaa

SEQ ID NO: 1273107 - RNA, 14 nt, Mycobacterium tuberculosis H37Rv
agcgugagugcagc

SEQ ID NO: 1273108 - RNA, 22 nt, Mycobacterium tuberculosis H37Rv
agcgugcccgccaccggcgcga

SEQ ID NO: 1273109 - RNA, 21 nt, Mycobacterium tuberculosis H37Rv
agcguggagcgcaaguugagc

SEQ ID NO: 1273110 - RNA, 23 nt, Mycobacterium tuberculosis H37Rv
agcguggacguacugucgucgcc

SEQ ID NO: 1273111 - RNA, 19 nt, Mycobacterium tuberculosis H37Rv
agcugaccagcguccagcc

SEQ ID NO: 1273112 - RNA, 14 nt, Mycobacterium tuberculosis H37Rv
agcugcugccaccg

SEQ ID NO: 1273113 - RNA, 17 nt, Mycobacterium tuberculosis H37Rv
agcugacgugucggcug

SEQ ID NO: 1273114 - RNA, 15 nt, Mycobacterium tuberculosis H37Rv
agcugagcggccagc

SEQ ID NO: 1273115 - RNA, 13 nt, Mycobacterium tuberculosis H37Rv
agcucacgccggg

SEQ ID NO: 1273116 - RNA, 20 nt, Mycobacterium tuberculosis H37Rv
agcucacgcugaagccgcug

SEQ ID NO: 1273117 - RNA, 13 nt, Mycobacterium tuberculosis H37Rv
agcucaccgacgg

SEQ ID NO: 1273118 - RNA, 21 nt, Mycobacterium tuberculosis H37Rv
agcucaauuccaugcaguugu

SEQ ID NO: 1273119 - RNA, 17 nt, Mycobacterium tuberculosis H37Rv
agcucccgccacgucgc

SEQ ID NO: 1273120 - RNA, 16 nt, Mycobacterium tuberculosis H37Rv
agcucccgccacgucg

SEQ ID NO: 1273121 - RNA, 18 nt, Mycobacterium tuberculosis H37Rv
agcuccgggucgacgacg

SEQ ID NO: 1273122 - RNA, 23 nt, Mycobacterium tuberculosis H37Rv
agcuccucacggauccgccggug

SEQ ID NO: 1273123 - RNA, 17 nt, Mycobacterium tuberculosis H37Rv
agcuccgccugccgcug

SEQ ID NO: 1273124 - RNA, 18 nt, Mycobacterium tuberculosis H37Rv
agcucgcgcucgcucacg

SEQ ID NO: 1273125 - RNA, 16 nt, Mycobacterium tuberculosis H37Rv
agcucgccggcacgca

SEQ ID NO: 1273126 - RNA, 22 nt, Mycobacterium tuberculosis H37Rv
agcucgcugaccuuguugacca

SEQ ID NO: 1273127 - RNA, 21 nt, Mycobacterium tuberculosis H37Rv
agcucgcugcgcgcccaccgg

SEQ ID NO: 1273128 - RNA, 17 nt, Mycobacterium tuberculosis H37Rv
agcucggugcacggcgc

SEQ ID NO: 1273129 - RNA, 15 nt, Mycobacterium tuberculosis H37Rv
agcucgucgacgucg

SEQ ID NO: 1273130 - RNA, 13 nt, Mycobacterium tuberculosis H37Rv
agcagcgaccagc

SEQ ID NO: 1273131 - RNA, 20 nt, Mycobacterium tuberculosis H37Rv
agcaggacgaugaugaucac

SEQ ID NO: 1273132 - RNA, 16 nt, Mycobacterium tuberculosis H37Rv
agcaguggaguauccg

SEQ ID NO: 1273133 - RNA, 16 nt, Mycobacterium tuberculosis H37Rv
agcagugccucggcga

SEQ ID NO: 1273134 - RNA, 23 nt, Mycobacterium tuberculosis H37Rv
agcaguacuaacaacaccaccag

SEQ ID NO: 1273135 - RNA, 15 nt, Mycobacterium tuberculosis H37Rv
agcagguuggucacc

SEQ ID NO: 1273136 - RNA, 19 nt, Mycobacterium tuberculosis H37Rv
agcaggucucguaucgcac

SEQ ID NO: 1273137 - RNA, 23 nt, Mycobacterium tuberculosis H37Rv
agcaguagcugcucaucgcgccc

SEQ ID NO: 1273138 - RNA, 14 nt, Mycobacterium tuberculosis H37Rv
agcagguacucgcc

SEQ ID NO: 1273139 - RNA, 19 nt, Mycobacterium tuberculosis H37Rv
agcaggucgccugcccccg

SEQ ID NO: 1273140 - RNA, 15 nt, Mycobacterium tuberculosis H37Rv
agcaggaucggcagc

SEQ ID NO: 1273141 - RNA, 22 nt, Mycobacterium tuberculosis H37Rv
agccagaccaacaugaacguca

SEQ ID NO: 1273142 - RNA, 22 nt, Mycobacterium tuberculosis H37Rv
agccagaucuccccgaccgcgc

SEQ ID NO: 1273143 - RNA, 15 nt, Mycobacterium tuberculosis H37Rv
agccagaugccggua

SEQ ID NO: 1273144 - RNA, 16 nt, Mycobacterium tuberculosis H37Rv
agccagauccgucagc

SEQ ID NO: 1273145 - RNA, 18 nt, Mycobacterium tuberculosis H37Rv
agccagccaccgaucgac

SEQ ID NO: 1273146 - RNA, 17 nt, Mycobacterium tuberculosis H37Rv
agccaggcaaccgguca

SEQ ID NO: 1273147 - RNA, 16 nt, Mycobacterium tuberculosis H37Rv
agccaggcacguccga

SEQ ID NO: 1273148 - RNA, 19 nt, Mycobacterium tuberculosis H37Rv
agccaggccagugccaccu

SEQ ID NO: 1273149 - RNA, 12 nt, Mycobacterium tuberculosis H37Rv
agccaggccagu

SEQ ID NO: 1273150 - RNA, 19 nt, Mycobacterium tuberculosis H37Rv
agcauguggccgccgucga

SEQ ID NO: 1273151 - RNA, 20 nt, Mycobacterium tuberculosis H37Rv
agcauguggccgccgucgac

SEQ ID NO: 1273152 - RNA, 17 nt, Mycobacterium tuberculosis H37Rv
agcaucucgucggugaa

SEQ ID NO: 1273153 - RNA, 20 nt, Mycobacterium tuberculosis H37Rv
agcaucagcucgaugccgug

SEQ ID NO: 1273154 - RNA, 15 nt, Mycobacterium tuberculosis H37Rv
agcaucacgaucacg

SEQ ID NO: 1273155 - RNA, 17 nt, Mycobacterium tuberculosis H37Rv
agcccgcgcagcagugc

SEQ ID NO: 1273156 - RNA, 22 nt, Mycobacterium tuberculosis H37Rv
agcccgcccugaccgcccgcac

SEQ ID NO: 1273157 - RNA, 15 nt, Mycobacterium tuberculosis H37Rv
agcccgccauccgcc

SEQ ID NO: 1273158 - RNA, 14 nt, Mycobacterium tuberculosis H37Rv
agcccgcgaucucg

SEQ ID NO: 1273159 - RNA, 17 nt, Mycobacterium tuberculosis H37Rv
agcccgccgucggcauc

SEQ ID NO: 1273160 - RNA, 17 nt, Mycobacterium tuberculosis H37Rv
agcccaugucgagcacg

SEQ ID NO: 1273161 - RNA, 15 nt, Mycobacterium tuberculosis H37Rv
agccccgcuggucga

SEQ ID NO: 1273162 - RNA, 18 nt, Mycobacterium tuberculosis H37Rv
agccccucaccucggcuu

SEQ ID NO: 1273163 - RNA, 19 nt, Mycobacterium tuberculosis H37Rv
agccccuccgcgccgauca

SEQ ID NO: 1273164 - RNA, 12 nt, Mycobacterium tuberculosis H37Rv
agccccugccga

SEQ ID NO: 1273165 - RNA, 21 nt, Mycobacterium tuberculosis H37Rv
agcccgccacagccccagggu

SEQ ID NO: 1273166 - RNA, 17 nt, Mycobacterium tuberculosis H37Rv
agcccgaaccaccgcgu

SEQ ID NO: 1273167 - RNA, 15 nt, Mycobacterium tuberculosis H37Rv
agccaggcggcaagg

SEQ ID NO: 1273168 - RNA, 17 nt, Mycobacterium tuberculosis H37Rv
agccaggcgauugcccg

SEQ ID NO: 1273169 - RNA, 20 nt, Mycobacterium tuberculosis H37Rv
agcccaaaucccagagcauc

SEQ ID NO: 1273170 - RNA, 18 nt, Mycobacterium tuberculosis H37Rv
agcccaaaaagaccgccg

SEQ ID NO: 1273171 - RNA, 16 nt, Mycobacterium tuberculosis H37Rv
agccaguaccagguac

SEQ ID NO: 1273172 - RNA, 16 nt, Mycobacterium tuberculosis H37Rv
agcccaucggcagcag

SEQ ID NO: 1273173 - RNA, 14 nt, Mycobacterium tuberculosis H37Rv
agcccagccgggca

SEQ ID NO: 1273174 - RNA, 14 nt, Mycobacterium tuberculosis H37Rv
agcccagcacgcug

SEQ ID NO: 1273175 - RNA, 17 nt, Mycobacterium tuberculosis H37Rv
agcccacgacgaagucg

SEQ ID NO: 1273176 - RNA, 12 nt, Mycobacterium tuberculosis H37Rv
agcccaccgucg

SEQ ID NO: 1273177 - RNA, 18 nt, Mycobacterium tuberculosis H37Rv
agcccggucgcucgacga

SEQ ID NO: 1273178 - RNA, 22 nt, Mycobacterium tuberculosis H37Rv
agcccguccaggcgcugcagca

SEQ ID NO: 1273179 - RNA, 14 nt, Mycobacterium tuberculosis H37Rv
agccgaagcgcccg

SEQ ID NO: 1273180 - RNA, 16 nt, Mycobacterium tuberculosis H37Rv
agcccguccucgucgg

SEQ ID NO: 1273181 - RNA, 19 nt, Mycobacterium tuberculosis H37Rv
agccgacagcucaucgauc

SEQ ID NO: 1273182 - RNA, 19 nt, Mycobacterium tuberculosis H37Rv
agccgacaacgacgucgcc

SEQ ID NO: 1273183 - RNA, 16 nt, Mycobacterium tuberculosis H37Rv
agccgacccgcccgaa

SEQ ID NO: 1273184 - RNA, 13 nt, Mycobacterium tuberculosis H37Rv
agccgacccgacg

SEQ ID NO: 1273185 - RNA, 15 nt, Mycobacterium tuberculosis H37Rv
agccgaccguaccga

SEQ ID NO: 1273186 - RNA, 24 nt, Mycobacterium tuberculosis H37Rv
agccgacuaucggccgccggauca

SEQ ID NO: 1273187 - RNA, 22 nt, Mycobacterium tuberculosis H37Rv
agccgacggcggcggcgugccc

SEQ ID NO: 1273188 - RNA, 16 nt, Mycobacterium tuberculosis H37Rv
agccgacgaccagcag

SEQ ID NO: 1273189 - RNA, 16 nt, Mycobacterium tuberculosis H37Rv
agccgacgaacgacgg

SEQ ID NO: 1273190 - RNA, 16 nt, Mycobacterium tuberculosis H37Rv
agccgagcgcccgcaa

SEQ ID NO: 1273191 - RNA, 13 nt, Mycobacterium tuberculosis H37Rv
agccgagcaucag

SEQ ID NO: 1273192 - RNA, 17 nt, Mycobacterium tuberculosis H37Rv
agccgcgaaaucaccgc

SEQ ID NO: 1273193 - RNA, 23 nt, Mycobacterium tuberculosis H37Rv
agccgccguggaacacgaagucg

SEQ ID NO: 1273194 - RNA, 18 nt, Mycobacterium tuberculosis H37Rv
agccgccguggauacgca

SEQ ID NO: 1273195 - RNA, 13 nt, Mycobacterium tuberculosis H37Rv
agccgccgucgcc

SEQ ID NO: 1273196 - RNA, 23 nt, Mycobacterium tuberculosis H37Rv
agccgccuaggacuucggugagc

SEQ ID NO: 1273197 - RNA, 20 nt, Mycobacterium tuberculosis H37Rv
agccgccucaaugaccaccg

SEQ ID NO: 1273198 - RNA, 19 nt, Mycobacterium tuberculosis H37Rv
agccgcacgguugccguca

SEQ ID NO: 1273199 - RNA, 20 nt, Mycobacterium tuberculosis H37Rv
agccgcacgaugccgggaac

SEQ ID NO: 1273200 - RNA, 20 nt, Mycobacterium tuberculosis H37Rv
agccgcaccaguggcgccca

SEQ ID NO: 1273201 - RNA, 15 nt, Mycobacterium tuberculosis H37Rv
agccgcaccgcuguu

SEQ ID NO: 1273202 - RNA, 17 nt, Mycobacterium tuberculosis H37Rv
agcaccaagaccguucg

SEQ ID NO: 1273203 - RNA, 17 nt, Mycobacterium tuberculosis H37Rv
agcacagcccggcgacg

SEQ ID NO: 1273204 - RNA, 14 nt, Mycobacterium tuberculosis H37Rv
agcacagcgcagcc

SEQ ID NO: 1273205 - RNA, 22 nt, Mycobacterium tuberculosis H37Rv
agcaccaccccagcggccaccg

SEQ ID NO: 1273206 - RNA, 16 nt, Mycobacterium tuberculosis H37Rv
agcaccaccgcggugu

SEQ ID NO: 1273207 - RNA, 13 nt, Mycobacterium tuberculosis H37Rv
agcaccacggcgc

SEQ ID NO: 1273208 - RNA, 16 nt, Mycobacterium tuberculosis H37Rv
agcaccacggccagcg

SEQ ID NO: 1273209 - RNA, 13 nt, Mycobacterium tuberculosis H37Rv
agcaccagccacg

SEQ ID NO: 1273210 - RNA, 20 nt, Mycobacterium tuberculosis H37Rv
agcaccaguuugugccgccg

SEQ ID NO: 1273211 - RNA, 14 nt, Mycobacterium tuberculosis H37Rv
agcacccacggcga

SEQ ID NO: 1273212 - RNA, 12 nt, Mycobacterium tuberculosis H37Rv
agcacccgagcg

SEQ ID NO: 1273213 - RNA, 23 nt, Mycobacterium tuberculosis H37Rv
agcacccgcgccaguaacgccca

SEQ ID NO: 1273214 - RNA, 16 nt, Mycobacterium tuberculosis H37Rv
agcacccgcagccgcg

SEQ ID NO: 1273215 - RNA, 19 nt, Mycobacterium tuberculosis H37Rv
agcaccgaacccgccaccg

SEQ ID NO: 1273216 - RNA, 22 nt, Mycobacterium tuberculosis H37Rv
agcaccgucgggcccagccgga

SEQ ID NO: 1273217 - RNA, 22 nt, Mycobacterium tuberculosis H37Rv
agcaccggucccugcgccguca

SEQ ID NO: 1273218 - RNA, 22 nt, Mycobacterium tuberculosis H37Rv
agcaccgggcucagacuuucgc

SEQ ID NO: 1273219 - RNA, 22 nt, Mycobacterium tuberculosis H37Rv
agcaccgcucgguccagccggu

SEQ ID NO: 1273220 - RNA, 15 nt, Mycobacterium tuberculosis H37Rv
agcaccgggaagucg

SEQ ID NO: 1273221 - RNA, 18 nt, Mycobacterium tuberculosis H37Rv
agcaacaccagaugcacc

SEQ ID NO: 1273222 - RNA, 14 nt, Mycobacterium tuberculosis H37Rv
agcaacagcgcggu

SEQ ID NO: 1273223 - RNA, 13 nt, Mycobacterium tuberculosis H37Rv
agcaaagccagcg

SEQ ID NO: 1273224 - RNA, 16 nt, Mycobacterium tuberculosis H37Rv
agcaacgaagccggcg

SEQ ID NO: 1273225 - RNA, 22 nt, Mycobacterium tuberculosis H37Rv
agcaacccgccguugccaccgg

SEQ ID NO: 1273226 - RNA, 22 nt, Mycobacterium tuberculosis H37Rv
agcaacgacccgaagccgaccg

SEQ ID NO: 1273227 - RNA, 20 nt, Mycobacterium tuberculosis H37Rv
agcaacggcagcgugggcga

SEQ ID NO: 1273228 - RNA, 23 nt, Mycobacterium tuberculosis H37Rv
acuuucacgcucguuugcgagca

SEQ ID NO: 1273229 - RNA, 18 nt, Mycobacterium tuberculosis H37Rv
agcaaaaaccagcgucca

SEQ ID NO: 1273230 - RNA, 12 nt, Mycobacterium tuberculosis H37Rv
agcaaaccgcgc

SEQ ID NO: 1273231 - RNA, 22 nt, Mycobacterium tuberculosis H37Rv
agcaaaccgcgcagaacgaucg

SEQ ID NO: 1273232 - RNA, 14 nt, Mycobacterium tuberculosis H37Rv
agcaaugcccgcac

SEQ ID NO: 1273233 - RNA, 21 nt, Mycobacterium tuberculosis H37Rv
agcaauuccaccgccgagaug

SEQ ID NO: 1273234 - RNA, 13 nt, Mycobacterium tuberculosis H37Rv
agcaaugccaacg

SEQ ID NO: 1273235 - RNA, 15 nt, Mycobacterium tuberculosis H37Rv
agcaauccgcacagc

SEQ ID NO: 1273236 - RNA, 14 nt, Mycobacterium tuberculosis H37Rv
agcaaucagccgcc

SEQ ID NO: 1273237 - RNA, 13 nt, Mycobacterium tuberculosis H37Rv
agcaagucgccga

SEQ ID NO: 1273238 - RNA, 14 nt, Mycobacterium tuberculosis H37Rv
agcaagagccgcag

SEQ ID NO: 1273239 - RNA, 23 nt, Mycobacterium tuberculosis H37Rv
agcaagaucaccuucgucgcggc

SEQ ID NO: 1273240 - RNA, 20 nt, Mycobacterium tuberculosis H37Rv
agcaacugccgcacccgguc

SEQ ID NO: 1273241 - RNA, 22 nt, Mycobacterium tuberculosis H37Rv
agcaacugccgcacccggucga

SEQ ID NO: 1273242 - RNA, 17 nt, Mycobacterium tuberculosis H37Rv
agcaacucguccagcag

SEQ ID NO: 1273243 - RNA, 22 nt, Mycobacterium tuberculosis H37Rv
agcagauggguacccgaucacu

SEQ ID NO: 1273244 - RNA, 20 nt, Mycobacterium tuberculosis H37Rv
agcagauucucccuugccga

SEQ ID NO: 1273245 - RNA, 12 nt, Mycobacterium tuberculosis H37Rv
aaaccgcaccgu

SEQ ID NO: 1273246 - RNA, 14 nt, Mycobacterium tuberculosis H37Rv
aaaccgcagcgcga

SEQ ID NO: 1273247 - RNA, 16 nt, Mycobacterium tuberculosis H37Rv
aaaccgauaucgcugc

SEQ ID NO: 1273248 - RNA, 14 nt, Mycobacterium tuberculosis H37Rv
aaacccgauguggc

SEQ ID NO: 1273249 - RNA, 16 nt, Mycobacterium tuberculosis H37Rv
agcagagccaacgcgc

SEQ ID NO: 1273250 - RNA, 20 nt, Mycobacterium tuberculosis H37Rv
agcagacguaaaagccccca

SEQ ID NO: 1273251 - RNA, 20 nt, Mycobacterium tuberculosis H37Rv
agcagacgcggaaucgcauc

SEQ ID NO: 1273252 - RNA, 20 nt, Mycobacterium tuberculosis H37Rv
agcagacguaaaagcccccg

SEQ ID NO: 1273253 - RNA, 20 nt, Mycobacterium tuberculosis H37Rv
agcagacgcauaagcccccg

SEQ ID NO: 1273254 - RNA, 20 nt, Mycobacterium tuberculosis H37Rv
agcagacgcagagucgcacu

SEQ ID NO: 1273255 - RNA, 20 nt, Mycobacterium tuberculosis H37Rv
agcagacgcagaaucgccua

SEQ ID NO: 1273256 - RNA, 20 nt, Mycobacterium tuberculosis H37Rv
agcagacgcagaaucgccca

SEQ ID NO: 1273257 - RNA, 20 nt, Mycobacterium tuberculosis H37Rv
agcagacgcuaaagcccccg

SEQ ID NO: 1273258 - RNA, 19 nt, Mycobacterium tuberculosis H37Rv
agcagacgcggaaucgcac

SEQ ID NO: 1273259 - RNA, 20 nt, Mycobacterium tuberculosis H37Rv
agcagacgcagaaucgcauu

SEQ ID NO: 1273260 - RNA, 20 nt, Mycobacterium tuberculosis H37Rv
agcagacgcagaaucgcaug

SEQ ID NO: 1273261 - RNA, 19 nt, Mycobacterium tuberculosis H37Rv
agcagacgcagaaucgcac

SEQ ID NO: 1273262 - RNA, 18 nt, Mycobacterium tuberculosis H37Rv
agcagacgcagaaucgca

SEQ ID NO: 1273263 - RNA, 21 nt, Mycobacterium tuberculosis H37Rv
agcagacgcaaaaucgcccau

SEQ ID NO: 1273264 - RNA, 18 nt, Mycobacterium tuberculosis H37Rv
agcagacgcaaaaucgca

SEQ ID NO: 1273265 - RNA, 23 nt, Mycobacterium tuberculosis H37Rv
agcagcaccaacugaauggcacc

SEQ ID NO: 1273266 - RNA, 14 nt, Mycobacterium tuberculosis H37Rv
agcagcaccgacgu

SEQ ID NO: 1273267 - RNA, 14 nt, Mycobacterium tuberculosis H37Rv
agcagcaacgcggu

SEQ ID NO: 1273268 - RNA, 23 nt, Mycobacterium tuberculosis H37Rv
agcagcaauccaaggcucagcag

SEQ ID NO: 1273269 - RNA, 19 nt, Mycobacterium tuberculosis H37Rv
agcagcaauccaaggcuca

SEQ ID NO: 1273270 - RNA, 15 nt, Mycobacterium tuberculosis H37Rv
agcagcacgucugcg

SEQ ID NO: 1273271 - RNA, 22 nt, Mycobacterium tuberculosis H37Rv
agcagcagcgugaccaccgccg

SEQ ID NO: 1273272 - RNA, 19 nt, Mycobacterium tuberculosis H37Rv
agcacgacugcggcaaacg

SEQ ID NO: 1273273 - RNA, 17 nt, Mycobacterium tuberculosis H37Rv
agcacgacgacaaccgg

SEQ ID NO: 1273274 - RNA, 23 nt, Mycobacterium tuberculosis H37Rv
agcaccugccguuccggcugcuu

SEQ ID NO: 1273275 - RNA, 21 nt, Mycobacterium tuberculosis H37Rv
agcacgaaagucaaucgcguc

SEQ ID NO: 1273276 - RNA, 18 nt, Mycobacterium tuberculosis H37Rv
agcaccucuaccguggca

SEQ ID NO: 1273277 - RNA, 19 nt, Mycobacterium tuberculosis H37Rv
agcacggcgauccccgacg

SEQ ID NO: 1273278 - RNA, 15 nt, Mycobacterium tuberculosis H37Rv
agcacgcugaccaca

SEQ ID NO: 1273279 - RNA, 15 nt, Mycobacterium tuberculosis H37Rv
agcacgcgcggcguc

SEQ ID NO: 1273280 - RNA, 20 nt, Mycobacterium tuberculosis H37Rv
agcacgaugucgaugccgug

SEQ ID NO: 1273281 - RNA, 15 nt, Mycobacterium tuberculosis H37Rv
agcacgcccucgacg

SEQ ID NO: 1273282 - RNA, 19 nt, Mycobacterium tuberculosis H37Rv
agcagacacuaaagcccuc

SEQ ID NO: 1273283 - RNA, 19 nt, Mycobacterium tuberculosis H37Rv
agcagacacagaaucgcac

SEQ ID NO: 1273284 - RNA, 19 nt, Mycobacterium tuberculosis H37Rv
agcagacacagaaucgccc

SEQ ID NO: 1273285 - RNA, 21 nt, Mycobacterium tuberculosis H37Rv
agcagacgacgaucagcccca

SEQ ID NO: 1273286 - RNA, 22 nt, Mycobacterium tuberculosis H37Rv
agcagaccaagcccuagcgcau

SEQ ID NO: 1273287 - RNA, 22 nt, Mycobacterium tuberculosis H37Rv
agcacuucgucgaaccugucga

SEQ ID NO: 1273288 - RNA, 18 nt, Mycobacterium tuberculosis H37Rv
agcacuccgucguaguug

SEQ ID NO: 1273289 - RNA, 21 nt, Mycobacterium tuberculosis H37Rv
agcacucgggauucggcagcg

SEQ ID NO: 1273290 - RNA, 15 nt, Mycobacterium tuberculosis H37Rv
agcacgucgaacucg

SEQ ID NO: 1273291 - RNA, 15 nt, Mycobacterium tuberculosis H37Rv
agcacguugcacagc

SEQ ID NO: 1273292 - RNA, 20 nt, Mycobacterium tuberculosis H37Rv
agcacuccggagcccacacg

SEQ ID NO: 1273293 - RNA, 15 nt, Mycobacterium tuberculosis H37Rv
agcacuaaucggcca

SEQ ID NO: 1273294 - RNA, 11 nt, Mycobacterium tuberculosis H37Rv
agcacguccgc

SEQ ID NO: 1273295 - RNA, 13 nt, Mycobacterium tuberculosis H37Rv
agcacguccucga

SEQ ID NO: 1273296 - RNA, 20 nt, Mycobacterium tuberculosis H37Rv
agcacgguggcuucgacggc

SEQ ID NO: 1273297 - RNA, 15 nt, Mycobacterium tuberculosis H37Rv
agcacggugagccgg

SEQ ID NO: 1273298 - RNA, 15 nt, Mycobacterium tuberculosis H37Rv
agcacguaacgccgc

SEQ ID NO: 1273299 - RNA, 18 nt, Mycobacterium tuberculosis H37Rv
agcacguaacgccgcuca

SEQ ID NO: 1273300 - RNA, 16 nt, Mycobacterium tuberculosis H37Rv
agcacguaucgaagcu

SEQ ID NO: 1273301 - RNA, 17 nt, Mycobacterium tuberculosis H37Rv
agcacggguagcgucca

SEQ ID NO: 1273302 - RNA, 15 nt, Mycobacterium tuberculosis H37Rv
agcacggcuucgacc

SEQ ID NO: 1273303 - RNA, 19 nt, Mycobacterium tuberculosis H37Rv
aggccgugaugccacggcg

SEQ ID NO: 1273304 - RNA, 14 nt, Mycobacterium tuberculosis H37Rv
aggccguugaucgu

SEQ ID NO: 1273305 - RNA, 14 nt, Mycobacterium tuberculosis H37Rv
aggccuagcgcggc

SEQ ID NO: 1273306 - RNA, 17 nt, Mycobacterium tuberculosis H37Rv
aggccucagaaccgggu

SEQ ID NO: 1273307 - RNA, 15 nt, Mycobacterium tuberculosis H37Rv
aggccucggcagcaa

SEQ ID NO: 1273308 - RNA, 21 nt, Mycobacterium tuberculosis H37Rv
aggccugagcgugucuggcga

SEQ ID NO: 1273309 - RNA, 23 nt, Mycobacterium tuberculosis H37Rv
aggccucggcgccgcccagcauc

SEQ ID NO: 1273310 - RNA, 20 nt, Mycobacterium tuberculosis H37Rv
aggccuugacguagaagucg

SEQ ID NO: 1273311 - RNA, 14 nt, Mycobacterium tuberculosis H37Rv
aggcgauugcccgc

SEQ ID NO: 1273312 - RNA, 20 nt, Mycobacterium tuberculosis H37Rv
aggcgauucugcgucugcuc

SEQ ID NO: 1273313 - RNA, 19 nt, Mycobacterium tuberculosis H37Rv
aggcgauucugcgucugcu

SEQ ID NO: 1273314 - RNA, 22 nt, Mycobacterium tuberculosis H37Rv
aggcgauggucuccucggucac

SEQ ID NO: 1273315 - RNA, 16 nt, Mycobacterium tuberculosis H37Rv
aggcgagucaccgggu

SEQ ID NO: 1273316 - RNA, 13 nt, Mycobacterium tuberculosis H37Rv
aggcgauccagac

SEQ ID NO: 1273317 - RNA, 16 nt, Mycobacterium tuberculosis H37Rv
aggcgagaagcgucgc

SEQ ID NO: 1273318 - RNA, 15 nt, Mycobacterium tuberculosis H37Rv
aggcgagaagcgucg

SEQ ID NO: 1273319 - RNA, 19 nt, Mycobacterium tuberculosis H37Rv
aggcgacccgcugggucga

SEQ ID NO: 1273320 - RNA, 12 nt, Mycobacterium tuberculosis H37Rv
aggcgcgggcga

SEQ ID NO: 1273321 - RNA, 22 nt, Mycobacterium tuberculosis H37Rv
aggcgcgacguacgaguagugc

SEQ ID NO: 1273322 - RNA, 15 nt, Mycobacterium tuberculosis H37Rv
aggcgcggcccaggu

SEQ ID NO: 1273323 - RNA, 18 nt, Mycobacterium tuberculosis H37Rv
aggcgcugaacgcgagca

SEQ ID NO: 1273324 - RNA, 14 nt, Mycobacterium tuberculosis H37Rv
aggcgcugaacgcg

SEQ ID NO: 1273325 - RNA, 17 nt, Mycobacterium tuberculosis H37Rv
aggcgcuggugcgcggu

SEQ ID NO: 1273326 - RNA, 20 nt, Mycobacterium tuberculosis H37Rv
aggcgcuucgccacaccaug

SEQ ID NO: 1273327 - RNA, 17 nt, Mycobacterium tuberculosis H37Rv
aggcgccgucucgcggu

SEQ ID NO: 1273328 - RNA, 13 nt, Mycobacterium tuberculosis H37Rv
aggcgccggucgc

SEQ ID NO: 1273329 - RNA, 14 nt, Mycobacterium tuberculosis H37Rv
aggcgccgcuaucg

SEQ ID NO: 1273330 - RNA, 14 nt, Mycobacterium tuberculosis H37Rv
aggcgcagcugguu

SEQ ID NO: 1273331 - RNA, 16 nt, Mycobacterium tuberculosis H37Rv
aggcgcccaacaggcg

SEQ ID NO: 1273332 - RNA, 18 nt, Mycobacterium tuberculosis H37Rv
aggcagcggcgacacauc

SEQ ID NO: 1273333 - RNA, 13 nt, Mycobacterium tuberculosis H37Rv
agcuggacuccgg

SEQ ID NO: 1273334 - RNA, 15 nt, Mycobacterium tuberculosis H37Rv
agcuggaacggcagc

SEQ ID NO: 1273335 - RNA, 23 nt, Mycobacterium tuberculosis H37Rv
aggccagcaugucgggccgcucg

SEQ ID NO: 1273336 - RNA, 22 nt, Mycobacterium tuberculosis H37Rv
aggccagcaugucgggccgcuc

SEQ ID NO: 1273337 - RNA, 19 nt, Mycobacterium tuberculosis H37Rv
aggccccgccagcgccggu

SEQ ID NO: 1273338 - RNA, 18 nt, Mycobacterium tuberculosis H37Rv
aggcccgaguuugaccag

SEQ ID NO: 1273339 - RNA, 23 nt, Mycobacterium tuberculosis H37Rv
aggcccgcgcgagagccuccaug

SEQ ID NO: 1273340 - RNA, 18 nt, Mycobacterium tuberculosis H37Rv
aggcccgcgguggaccgg

SEQ ID NO: 1273341 - RNA, 21 nt, Mycobacterium tuberculosis H37Rv
aggccaccuccgaggccgcca

SEQ ID NO: 1273342 - RNA, 12 nt, Mycobacterium tuberculosis H37Rv
aggccacugcgu

SEQ ID NO: 1273343 - RNA, 23 nt, Mycobacterium tuberculosis H37Rv
aggccacugcguuccaucgccga

SEQ ID NO: 1273344 - RNA, 21 nt, Mycobacterium tuberculosis H37Rv
aggccagaguuugcgaugccc

SEQ ID NO: 1273345 - RNA, 20 nt, Mycobacterium tuberculosis H37Rv
aggccagagucgcccgcaca

SEQ ID NO: 1273346 - RNA, 13 nt, Mycobacterium tuberculosis H37Rv
aggccagagucgc

SEQ ID NO: 1273347 - RNA, 19 nt, Mycobacterium tuberculosis H37Rv
aggccgucgaguuccggcc

SEQ ID NO: 1273348 - RNA, 18 nt, Mycobacterium tuberculosis H37Rv
aggccguccucggucagc

SEQ ID NO: 1273349 - RNA, 14 nt, Mycobacterium tuberculosis H37Rv
aggccgucaggcgu

SEQ ID NO: 1273350 - RNA, 18 nt, Mycobacterium tuberculosis H37Rv
aggccgggcgcaagcagc

SEQ ID NO: 1273351 - RNA, 18 nt, Mycobacterium tuberculosis H37Rv
aggccggugaacgguagc

SEQ ID NO: 1273352 - RNA, 23 nt, Mycobacterium tuberculosis H37Rv
aggccggugaacggcagcacggu

SEQ ID NO: 1273353 - RNA, 20 nt, Mycobacterium tuberculosis H37Rv
aggccggccaccaguccgau

SEQ ID NO: 1273354 - RNA, 19 nt, Mycobacterium tuberculosis H37Rv
aggccggaagauccgggcc

SEQ ID NO: 1273355 - RNA, 18 nt, Mycobacterium tuberculosis H37Rv
aggccggagucgacgacg

SEQ ID NO: 1273356 - RNA, 19 nt, Mycobacterium tuberculosis H37Rv
aggccggcggucagcagcg

SEQ ID NO: 1273357 - RNA, 15 nt, Mycobacterium tuberculosis H37Rv
aggccggcggucagc

SEQ ID NO: 1273358 - RNA, 20 nt, Mycobacterium tuberculosis H37Rv
aggccggccgcgauccagcg

SEQ ID NO: 1273359 - RNA, 17 nt, Mycobacterium tuberculosis H37Rv
aggcccgggcggccagc

SEQ ID NO: 1273360 - RNA, 13 nt, Mycobacterium tuberculosis H37Rv
aggccgaccgcgc

SEQ ID NO: 1273361 - RNA, 23 nt, Mycobacterium tuberculosis H37Rv
aggccgaccuguaugccgcggug

SEQ ID NO: 1273362 - RNA, 21 nt, Mycobacterium tuberculosis H37Rv
aggcccggucuuacggucggc

SEQ ID NO: 1273363 - RNA, 22 nt, Mycobacterium tuberculosis H37Rv
aggccgcgcggacccagcaccc

SEQ ID NO: 1273364 - RNA, 15 nt, Mycobacterium tuberculosis H37Rv
aggccgcguugccgg

SEQ ID NO: 1273365 - RNA, 18 nt, Mycobacterium tuberculosis H37Rv
aggccgcguugccggucg

SEQ ID NO: 1273366 - RNA, 13 nt, Mycobacterium tuberculosis H37Rv
agggccgacgucg

SEQ ID NO: 1273367 - RNA, 22 nt, Mycobacterium tuberculosis H37Rv
agggccgcucgccucgauggcg

SEQ ID NO: 1273368 - RNA, 19 nt, Mycobacterium tuberculosis H37Rv
agggcgccgacgacuccgg

SEQ ID NO: 1273369 - RNA, 14 nt, Mycobacterium tuberculosis H37Rv
agggccagcggcag

SEQ ID NO: 1273370 - RNA, 14 nt, Mycobacterium tuberculosis H37Rv
aggcugguccgggu

SEQ ID NO: 1273371 - RNA, 17 nt, Mycobacterium tuberculosis H37Rv
aggcugggcagaccgau

SEQ ID NO: 1273372 - RNA, 20 nt, Mycobacterium tuberculosis H37Rv
aggcuguccgaaccgacguu

SEQ ID NO: 1273373 - RNA, 22 nt, Mycobacterium tuberculosis H37Rv
aggcuguccgacuucuccaggc

SEQ ID NO: 1273374 - RNA, 20 nt, Mycobacterium tuberculosis H37Rv
aggcugugccccagggcagu

SEQ ID NO: 1273375 - RNA, 18 nt, Mycobacterium tuberculosis H37Rv
aggggcgcagcgcggcaa

SEQ ID NO: 1273376 - RNA, 20 nt, Mycobacterium tuberculosis H37Rv
aggggcgucugcagcgggcg

SEQ ID NO: 1273377 - RNA, 23 nt, Mycobacterium tuberculosis H37Rv
agggcugugucugacgcuacgac

SEQ ID NO: 1273378 - RNA, 19 nt, Mycobacterium tuberculosis H37Rv
agggucgaguucgcagucg

SEQ ID NO: 1273379 - RNA, 14 nt, Mycobacterium tuberculosis H37Rv
aggggaucaccggc

SEQ ID NO: 1273380 - RNA, 20 nt, Mycobacterium tuberculosis H37Rv
aggggaucccccgcgcgaac

SEQ ID NO: 1273381 - RNA, 16 nt, Mycobacterium tuberculosis H37Rv
agggcuuccagggcga

SEQ ID NO: 1273382 - RNA, 16 nt, Mycobacterium tuberculosis H37Rv
agggcugcgaugcggu

SEQ ID NO: 1273383 - RNA, 22 nt, Mycobacterium tuberculosis H37Rv
agggcuaucguggcggcgucga

SEQ ID NO: 1273384 - RNA, 11 nt, Mycobacterium tuberculosis H37Rv
agggcucggcg

SEQ ID NO: 1273385 - RNA, 16 nt, Mycobacterium tuberculosis H37Rv
agggcgcgcaucugcu

SEQ ID NO: 1273386 - RNA, 11 nt, Mycobacterium tuberculosis H37Rv
aggcggucacc

SEQ ID NO: 1273387 - RNA, 14 nt, Mycobacterium tuberculosis H37Rv
aggcgggucgccgc

SEQ ID NO: 1273388 - RNA, 18 nt, Mycobacterium tuberculosis H37Rv
aggcggcugaacggcagc

SEQ ID NO: 1273389 - RNA, 13 nt, Mycobacterium tuberculosis H37Rv
aggcggcugaacg

SEQ ID NO: 1273390 - RNA, 16 nt, Mycobacterium tuberculosis H37Rv
aggcggcggcccgcag

SEQ ID NO: 1273391 - RNA, 14 nt, Mycobacterium tuberculosis H37Rv
aggcggcggccagc

SEQ ID NO: 1273392 - RNA, 14 nt, Mycobacterium tuberculosis H37Rv
aggcggcgccgcac

SEQ ID NO: 1273393 - RNA, 15 nt, Mycobacterium tuberculosis H37Rv
aggcggcgccagugc

SEQ ID NO: 1273394 - RNA, 24 nt, Mycobacterium tuberculosis H37Rv
aggcggccgcgucgucgagaaucg

SEQ ID NO: 1273395 - RNA, 13 nt, Mycobacterium tuberculosis H37Rv
aggcggccagcau

SEQ ID NO: 1273396 - RNA, 23 nt, Mycobacterium tuberculosis H37Rv
aggcucauccgccgggccaggcc

SEQ ID NO: 1273397 - RNA, 14 nt, Mycobacterium tuberculosis H37Rv
aggcucucguagcg

SEQ ID NO: 1273398 - RNA, 18 nt, Mycobacterium tuberculosis H37Rv
aggcguaaucaagcagcg

SEQ ID NO: 1273399 - RNA, 18 nt, Mycobacterium tuberculosis H37Rv
aggcgucccagccgauca

SEQ ID NO: 1273400 - RNA, 21 nt, Mycobacterium tuberculosis H37Rv
aggucgagcgccuuugcccga

SEQ ID NO: 1273401 - RNA, 17 nt, Mycobacterium tuberculosis H37Rv
agguccugcgccgcacg

SEQ ID NO: 1273402 - RNA, 23 nt, Mycobacterium tuberculosis H37Rv
aggucgacauaggccaccuccga

SEQ ID NO: 1273403 - RNA, 18 nt, Mycobacterium tuberculosis H37Rv
aggucgacggaaucgucg

SEQ ID NO: 1273404 - RNA, 15 nt, Mycobacterium tuberculosis H37Rv
aggucggugcgguca

SEQ ID NO: 1273405 - RNA, 19 nt, Mycobacterium tuberculosis H37Rv
aggucgggcccccggcagc

SEQ ID NO: 1273406 - RNA, 14 nt, Mycobacterium tuberculosis H37Rv
aggucggcgaucug

SEQ ID NO: 1273407 - RNA, 21 nt, Mycobacterium tuberculosis H37Rv
aggugacgaucaggucgccga

SEQ ID NO: 1273408 - RNA, 16 nt, Mycobacterium tuberculosis H37Rv
aggugaggucgaucag

SEQ ID NO: 1273409 - RNA, 19 nt, Mycobacterium tuberculosis H37Rv
aggucauggcuuuggccgc

SEQ ID NO: 1273410 - RNA, 21 nt, Mycobacterium tuberculosis H37Rv
aggucaggugauucgcgcagc

SEQ ID NO: 1273411 - RNA, 22 nt, Mycobacterium tuberculosis H37Rv
agguccgccccguugugucacc

SEQ ID NO: 1273412 - RNA, 22 nt, Mycobacterium tuberculosis H37Rv
agguccaaguccuccacggcgg

SEQ ID NO: 1273413 - RNA, 18 nt, Mycobacterium tuberculosis H37Rv
agguccgccggugccgcc

SEQ ID NO: 1273414 - RNA, 21 nt, Mycobacterium tuberculosis H37Rv
aggucacuccaugauccagcc

SEQ ID NO: 1273415 - RNA, 23 nt, Mycobacterium tuberculosis H37Rv
aggugaugagugcggacaucguu

SEQ ID NO: 1273416 - RNA, 21 nt, Mycobacterium tuberculosis H37Rv
aggugauggcuuggaccagcg

SEQ ID NO: 1273417 - RNA, 16 nt, Mycobacterium tuberculosis H37Rv
aggugcaugucgauga

SEQ ID NO: 1273418 - RNA, 15 nt, Mycobacterium tuberculosis H37Rv
aggugcgcuggguga

SEQ ID NO: 1273419 - RNA, 20 nt, Mycobacterium tuberculosis H37Rv
aggugcgccguggcaucgcc

SEQ ID NO: 1273420 - RNA, 18 nt, Mycobacterium tuberculosis H37Rv
aggugcggggccggucgg

SEQ ID NO: 1273421 - RNA, 20 nt, Mycobacterium tuberculosis H37Rv
agguuggugcucagcggcuc

SEQ ID NO: 1273422 - RNA, 20 nt, Mycobacterium tuberculosis H37Rv
aguagugaucgaucgcggcg

SEQ ID NO: 1273423 - RNA, 15 nt, Mycobacterium tuberculosis H37Rv
aguagaacuucgcca

SEQ ID NO: 1273424 - RNA, 19 nt, Mycobacterium tuberculosis H37Rv
aguacuggcguugccaccg

SEQ ID NO: 1273425 - RNA, 20 nt, Mycobacterium tuberculosis H37Rv
aguacggcgaugcggucggc

SEQ ID NO: 1273426 - RNA, 13 nt, Mycobacterium tuberculosis H37Rv
aguacgucgauca

SEQ ID NO: 1273427 - RNA, 22 nt, Mycobacterium tuberculosis H37Rv
aguugcaacggguacacccgcu

SEQ ID NO: 1273428 - RNA, 16 nt, Mycobacterium tuberculosis H37Rv
aguugcagcgggccac

SEQ ID NO: 1273429 - RNA, 18 nt, Mycobacterium tuberculosis H37Rv
aguucgggcaacggcagc

SEQ ID NO: 1273430 - RNA, 21 nt, Mycobacterium tuberculosis H37Rv
aguugaacguucccucggcac

SEQ ID NO: 1273431 - RNA, 14 nt, Mycobacterium tuberculosis H37Rv
aguugaagaagccc

SEQ ID NO: 1273432 - RNA, 15 nt, Mycobacterium tuberculosis H37Rv
aguugaccaggccga

SEQ ID NO: 1273433 - RNA, 14 nt, Mycobacterium tuberculosis H37Rv
aguugacaccaggg

SEQ ID NO: 1273434 - RNA, 21 nt, Mycobacterium tuberculosis H37Rv
aguucgacggugccgucugcg

SEQ ID NO: 1273435 - RNA, 18 nt, Mycobacterium tuberculosis H37Rv
aguucgcggcugcguugu

SEQ ID NO: 1273436 - RNA, 18 nt, Mycobacterium tuberculosis H37Rv
aguuccgcaccgaacgug

SEQ ID NO: 1273437 - RNA, 23 nt, Mycobacterium tuberculosis H37Rv
aguggugaccgacgcggacagga

SEQ ID NO: 1273438 - RNA, 15 nt, Mycobacterium tuberculosis H37Rv
aguggugaccgacgc

SEQ ID NO: 1273439 - RNA, 17 nt, Mycobacterium tuberculosis H37Rv
agugguuagucggccug

SEQ ID NO: 1273440 - RNA, 15 nt, Mycobacterium tuberculosis H37Rv
agugguugcccgcac

SEQ ID NO: 1273441 - RNA, 15 nt, Mycobacterium tuberculosis H37Rv
agugucguaggcgau

SEQ ID NO: 1273442 - RNA, 15 nt, Mycobacterium tuberculosis H37Rv
agugucggcgucugu

SEQ ID NO: 1273443 - RNA, 15 nt, Mycobacterium tuberculosis H37Rv
agugcggcugcaacg

SEQ ID NO: 1273444 - RNA, 19 nt, Mycobacterium tuberculosis H37Rv
agugcgggcaugccggcga

SEQ ID NO: 1273445 - RNA, 13 nt, Mycobacterium tuberculosis H37Rv
agugcucgcagcc

SEQ ID NO: 1273446 - RNA, 19 nt, Mycobacterium tuberculosis H37Rv
agugcgugauggcggcgca

SEQ ID NO: 1273447 - RNA, 19 nt, Mycobacterium tuberculosis H37Rv
agugcguuggcgccggcca

SEQ ID NO: 1273448 - RNA, 18 nt, Mycobacterium tuberculosis H37Rv
aguggacgugucaucacg

SEQ ID NO: 1273449 - RNA, 20 nt, Mycobacterium tuberculosis H37Rv
agugacgccacgaccgccga

SEQ ID NO: 1273450 - RNA, 20 nt, Mycobacterium tuberculosis H37Rv
agugcgacucugcgucugcu

SEQ ID NO: 1273451 - RNA, 13 nt, Mycobacterium tuberculosis H37Rv
agugcgccggcga

SEQ ID NO: 1273452 - RNA, 21 nt, Mycobacterium tuberculosis H37Rv
agugcggccuuggcgacgucg

SEQ ID NO: 1273453 - RNA, 18 nt, Mycobacterium tuberculosis H37Rv
agugcgaaccacgccauc

SEQ ID NO: 1273454 - RNA, 23 nt, Mycobacterium tuberculosis H37Rv
agugcgaacucaucgugguaacc

SEQ ID NO: 1273455 - RNA, 22 nt, Mycobacterium tuberculosis H37Rv
agugacagugcgucgagcauca

SEQ ID NO: 1273456 - RNA, 15 nt, Mycobacterium tuberculosis H37Rv
agugaccacgcugcu

SEQ ID NO: 1273457 - RNA, 15 nt, Mycobacterium tuberculosis H37Rv
agucaacucaccguc

SEQ ID NO: 1273458 - RNA, 17 nt, Mycobacterium tuberculosis H37Rv
agucaacgaacgauggg

SEQ ID NO: 1273459 - RNA, 11 nt, Mycobacterium tuberculosis H37Rv
aguauggccgc

SEQ ID NO: 1273460 - RNA, 15 nt, Mycobacterium tuberculosis H37Rv
agucuccggcgucgg

SEQ ID NO: 1273461 - RNA, 12 nt, Mycobacterium tuberculosis H37Rv
agucacggucgu

SEQ ID NO: 1273462 - RNA, 20 nt, Mycobacterium tuberculosis H37Rv
agucaccgcgcuggucagcc

SEQ ID NO: 1273463 - RNA, 17 nt, Mycobacterium tuberculosis H37Rv
agucaccguccacgaca

SEQ ID NO: 1273464 - RNA, 17 nt, Mycobacterium tuberculosis H37Rv
auaagcccccgacacgc

SEQ ID NO: 1273465 - RNA, 16 nt, Mycobacterium tuberculosis H37Rv
aguuugauuccagguc

SEQ ID NO: 1273466 - RNA, 18 nt, Mycobacterium tuberculosis H37Rv
auacaggcccggcaccgc

SEQ ID NO: 1273467 - RNA, 15 nt, Mycobacterium tuberculosis H37Rv
auacgaacucaccgc

SEQ ID NO: 1273468 - RNA, 18 nt, Mycobacterium tuberculosis H37Rv
auaccgaaaucaccucac

SEQ ID NO: 1273469 - RNA, 19 nt, Mycobacterium tuberculosis H37Rv
auaccgcugggucgccguu

SEQ ID NO: 1273470 - RNA, 20 nt, Mycobacterium tuberculosis H37Rv
auaccggcggcgagcggccu

SEQ ID NO: 1273471 - RNA, 15 nt, Mycobacterium tuberculosis H37Rv
auacucaccgacgcg

SEQ ID NO: 1273472 - RNA, 19 nt, Mycobacterium tuberculosis H37Rv
auacucgaguggcgaacgg

SEQ ID NO: 1273473 - RNA, 20 nt, Mycobacterium tuberculosis H37Rv
auagccaagugagcgaucgg

SEQ ID NO: 1273474 - RNA, 22 nt, Mycobacterium tuberculosis H37Rv
auaucgcccaccacgaacacgu

SEQ ID NO: 1273475 - RNA, 20 nt, Mycobacterium tuberculosis H37Rv
auaucucgagcccucguuau

SEQ ID NO: 1273476 - RNA, 14 nt, Mycobacterium tuberculosis H37Rv
auaguuguuccugg

SEQ ID NO: 1273477 - RNA, 18 nt, Mycobacterium tuberculosis H37Rv
auaggcggccaucgacga

SEQ ID NO: 1273478 - RNA, 21 nt, Mycobacterium tuberculosis H37Rv
auagcgcaccaccgucucgcc

SEQ ID NO: 1273479 - RNA, 12 nt, Mycobacterium tuberculosis H37Rv
auagcgcacugc

SEQ ID NO: 1273480 - RNA, 21 nt, Mycobacterium tuberculosis H37Rv
auagcgcucgaacucggcggc

SEQ ID NO: 1273481 - RNA, 18 nt, Mycobacterium tuberculosis H37Rv
auagcggcaaagccgggu

SEQ ID NO: 1273482 - RNA, 17 nt, Mycobacterium tuberculosis H37Rv
aucaaagucggcgucac

SEQ ID NO: 1273483 - RNA, 16 nt, Mycobacterium tuberculosis H37Rv
aucacauagccgguca

SEQ ID NO: 1273484 - RNA, 20 nt, Mycobacterium tuberculosis H37Rv
aucaacucgggcagcgcggc

SEQ ID NO: 1273485 - RNA, 15 nt, Mycobacterium tuberculosis H37Rv
aucagcagccgccga

SEQ ID NO: 1273486 - RNA, 16 nt, Mycobacterium tuberculosis H37Rv
aucagcaccccauggc

SEQ ID NO: 1273487 - RNA, 16 nt, Mycobacterium tuberculosis H37Rv
aucagcgcaucgccgc

SEQ ID NO: 1273488 - RNA, 14 nt, Mycobacterium tuberculosis H37Rv
aucagcgcgaacgc

SEQ ID NO: 1273489 - RNA, 16 nt, Mycobacterium tuberculosis H37Rv
aucaccgaugagccga

SEQ ID NO: 1273490 - RNA, 15 nt, Mycobacterium tuberculosis H37Rv
aucaccgaacggcga

SEQ ID NO: 1273491 - RNA, 14 nt, Mycobacterium tuberculosis H37Rv
aucaccgacaccgu

SEQ ID NO: 1273492 - RNA, 17 nt, Mycobacterium tuberculosis H37Rv
aucaccaccggcaccgc

SEQ ID NO: 1273493 - RNA, 17 nt, Mycobacterium tuberculosis H37Rv
aucaccacuggacccgc

SEQ ID NO: 1273494 - RNA, 14 nt, Mycobacterium tuberculosis H37Rv
aucacggucagcuc

SEQ ID NO: 1273495 - RNA, 23 nt, Mycobacterium tuberculosis H37Rv
aucacggugggcgccgacaccgg

SEQ ID NO: 1273496 - RNA, 21 nt, Mycobacterium tuberculosis H37Rv
aucaccuggcgugucgccgcc

SEQ ID NO: 1273497 - RNA, 20 nt, Mycobacterium tuberculosis H37Rv
aucaccuggcgugucgccgc

SEQ ID NO: 1273498 - RNA, 15 nt, Mycobacterium tuberculosis H37Rv
augacccgcggguga

SEQ ID NO: 1273499 - RNA, 17 nt, Mycobacterium tuberculosis H37Rv
augaccgaagagcgcgc

SEQ ID NO: 1273500 - RNA, 18 nt, Mycobacterium tuberculosis H37Rv
augaauucauguggcgcg

SEQ ID NO: 1273501 - RNA, 16 nt, Mycobacterium tuberculosis H37Rv
augacuugcgacccgu

SEQ ID NO: 1273502 - RNA, 15 nt, Mycobacterium tuberculosis H37Rv
augagguucaucgcc

SEQ ID NO: 1273503 - RNA, 23 nt, Mycobacterium tuberculosis H37Rv
augacguacggcugugcgagcga

SEQ ID NO: 1273504 - RNA, 15 nt, Mycobacterium tuberculosis H37Rv
augaccugauccggc

SEQ ID NO: 1273505 - RNA, 13 nt, Mycobacterium tuberculosis H37Rv
augaccucggcga

SEQ ID NO: 1273506 - RNA, 14 nt, Mycobacterium tuberculosis H37Rv
augaccucggcgau

SEQ ID NO: 1273507 - RNA, 14 nt, Mycobacterium tuberculosis H37Rv
augaccgggcuggc

SEQ ID NO: 1273508 - RNA, 16 nt, Mycobacterium tuberculosis H37Rv
augauagcggcgcagc

SEQ ID NO: 1273509 - RNA, 18 nt, Mycobacterium tuberculosis H37Rv
augaguggcaaucccgcc

SEQ ID NO: 1273510 - RNA, 22 nt, Mycobacterium tuberculosis H37Rv
aucuguuugggcaucucggcua

SEQ ID NO: 1273511 - RNA, 14 nt, Mycobacterium tuberculosis H37Rv
aucugcucggcauc

SEQ ID NO: 1273512 - RNA, 18 nt, Mycobacterium tuberculosis H37Rv
aucugcucgcguagcgca

SEQ ID NO: 1273513 - RNA, 18 nt, Mycobacterium tuberculosis H37Rv
aucugcugggcaagaucg

SEQ ID NO: 1273514 - RNA, 19 nt, Mycobacterium tuberculosis H37Rv
aucucgauguacagcggga

SEQ ID NO: 1273515 - RNA, 18 nt, Mycobacterium tuberculosis H37Rv
aucugcgggacgucgucg

SEQ ID NO: 1273516 - RNA, 16 nt, Mycobacterium tuberculosis H37Rv
aucuccucuugcacca

SEQ ID NO: 1273517 - RNA, 21 nt, Mycobacterium tuberculosis H37Rv
aucuccuuggccguucggcgc

SEQ ID NO: 1273518 - RNA, 17 nt, Mycobacterium tuberculosis H37Rv
aucggcggcguccagca

SEQ ID NO: 1273519 - RNA, 19 nt, Mycobacterium tuberculosis H37Rv
aucggcggcgucuucgucg

SEQ ID NO: 1273520 - RNA, 17 nt, Mycobacterium tuberculosis H37Rv
aucggcggcgucgacgu

SEQ ID NO: 1273521 - RNA, 13 nt, Mycobacterium tuberculosis H37Rv
aucggcgucacga

SEQ ID NO: 1273522 - RNA, 16 nt, Mycobacterium tuberculosis H37Rv
aucggcucaccgaacg

SEQ ID NO: 1273523 - RNA, 16 nt, Mycobacterium tuberculosis H37Rv
aucggcggcgcgccga

SEQ ID NO: 1273524 - RNA, 15 nt, Mycobacterium tuberculosis H37Rv
aucggcggaccgcag

SEQ ID NO: 1273525 - RNA, 13 nt, Mycobacterium tuberculosis H37Rv
aucggcgcgccga

SEQ ID NO: 1273526 - RNA, 20 nt, Mycobacterium tuberculosis H37Rv
aucggcgaggucccggccga

SEQ ID NO: 1273527 - RNA, 17 nt, Mycobacterium tuberculosis H37Rv
aucggcgccuugguccg

SEQ ID NO: 1273528 - RNA, 17 nt, Mycobacterium tuberculosis H37Rv
aucggccaccaucgccc

SEQ ID NO: 1273529 - RNA, 20 nt, Mycobacterium tuberculosis H37Rv
aucggccaucaugagcgacc

SEQ ID NO: 1273530 - RNA, 20 nt, Mycobacterium tuberculosis H37Rv
aucggcagucccagcgccgc

SEQ ID NO: 1273531 - RNA, 18 nt, Mycobacterium tuberculosis H37Rv
aucggcccccaacgcggu

SEQ ID NO: 1273532 - RNA, 22 nt, Mycobacterium tuberculosis H37Rv
aucggcccccaagcucugcguc

SEQ ID NO: 1273533 - RNA, 22 nt, Mycobacterium tuberculosis H37Rv
aucggcccagcccuucagcguc

SEQ ID NO: 1273534 - RNA, 18 nt, Mycobacterium tuberculosis H37Rv
aucggccuguucgccguc

SEQ ID NO: 1273535 - RNA, 21 nt, Mycobacterium tuberculosis H37Rv
aucggccuguccaccgaugcc

SEQ ID NO: 1273536 - RNA, 22 nt, Mycobacterium tuberculosis H37Rv
aucggccggguuaucggcagca

SEQ ID NO: 1273537 - RNA, 21 nt, Mycobacterium tuberculosis H37Rv
aucggccgguauuucggcgac

SEQ ID NO: 1273538 - RNA, 18 nt, Mycobacterium tuberculosis H37Rv
aucggccgugaauucgcc

SEQ ID NO: 1273539 - RNA, 18 nt, Mycobacterium tuberculosis H37Rv
aucggcacggucacacgc

SEQ ID NO: 1273540 - RNA, 20 nt, Mycobacterium tuberculosis H37Rv
aucggcagccccugccgauc

SEQ ID NO: 1273541 - RNA, 16 nt, Mycobacterium tuberculosis H37Rv
aucggcaaugagcuac

SEQ ID NO: 1273542 - RNA, 14 nt, Mycobacterium tuberculosis H37Rv
aucggaugaccagu

SEQ ID NO: 1273543 - RNA, 17 nt, Mycobacterium tuberculosis H37Rv
aucggucaacucgaacg

SEQ ID NO: 1273544 - RNA, 17 nt, Mycobacterium tuberculosis H37Rv
aucgggggcguugacga

SEQ ID NO: 1273545 - RNA, 13 nt, Mycobacterium tuberculosis H37Rv
aucggggcgacga

SEQ ID NO: 1273546 - RNA, 13 nt, Mycobacterium tuberculosis H37Rv
aucgucucggcua

SEQ ID NO: 1273547 - RNA, 17 nt, Mycobacterium tuberculosis H37Rv
aucgucgugucgccgcc

SEQ ID NO: 1273548 - RNA, 18 nt, Mycobacterium tuberculosis H37Rv
aucgucgucgcugccgcc

SEQ ID NO: 1273549 - RNA, 15 nt, Mycobacterium tuberculosis H37Rv
aucgucgaaccggau

SEQ ID NO: 1273550 - RNA, 17 nt, Mycobacterium tuberculosis H37Rv
aucgucgaaagccugga

SEQ ID NO: 1273551 - RNA, 18 nt, Mycobacterium tuberculosis H37Rv
aucgucgaacagcaccgc

SEQ ID NO: 1273552 - RNA, 18 nt, Mycobacterium tuberculosis H37Rv
aucgucgaauccucgcga

SEQ ID NO: 1273553 - RNA, 19 nt, Mycobacterium tuberculosis H37Rv
aucgugaacacgucgcggu

SEQ ID NO: 1273554 - RNA, 19 nt, Mycobacterium tuberculosis H37Rv
aucgugaaaguaagccgcg

SEQ ID NO: 1273555 - RNA, 21 nt, Mycobacterium tuberculosis H37Rv
aucgugagacgccgucgacgu

SEQ ID NO: 1273556 - RNA, 20 nt, Mycobacterium tuberculosis H37Rv
aucgugagcuuuaucugcau

SEQ ID NO: 1273557 - RNA, 16 nt, Mycobacterium tuberculosis H37Rv
aucguugccucgucgc

SEQ ID NO: 1273558 - RNA, 16 nt, Mycobacterium tuberculosis H37Rv
aucguugccgaccgug

SEQ ID NO: 1273559 - RNA, 14 nt, Mycobacterium tuberculosis H37Rv
aucguuggcgacca

SEQ ID NO: 1273560 - RNA, 21 nt, Mycobacterium tuberculosis H37Rv
aucguuggcgaucgcgaucgc

SEQ ID NO: 1273561 - RNA, 14 nt, Mycobacterium tuberculosis H37Rv
aucguugugcaccc

SEQ ID NO: 1273562 - RNA, 14 nt, Mycobacterium tuberculosis H37Rv
aucgccucgacgcg

SEQ ID NO: 1273563 - RNA, 18 nt, Mycobacterium tuberculosis H37Rv
aucgccuccucgacgucg

SEQ ID NO: 1273564 - RNA, 13 nt, Mycobacterium tuberculosis H37Rv
aucgccucgacgc

SEQ ID NO: 1273565 - RNA, 19 nt, Mycobacterium tuberculosis H37Rv
aucgccucggcgcugcgca

SEQ ID NO: 1273566 - RNA, 13 nt, Mycobacterium tuberculosis H37Rv
aucgccucggcgc

SEQ ID NO: 1273567 - RNA, 21 nt, Mycobacterium tuberculosis H37Rv
aucgcgagaaggugcugcgcg

SEQ ID NO: 1273568 - RNA, 21 nt, Mycobacterium tuberculosis H37Rv
aucgcgaagucguccagaaug

SEQ ID NO: 1273569 - RNA, 23 nt, Mycobacterium tuberculosis H37Rv
aucgcgacggggucgcgaugcuc

SEQ ID NO: 1273570 - RNA, 17 nt, Mycobacterium tuberculosis H37Rv
aucgcgacgaucgucca

SEQ ID NO: 1273571 - RNA, 17 nt, Mycobacterium tuberculosis H37Rv
aucgcgaggcgucaccc

SEQ ID NO: 1273572 - RNA, 23 nt, Mycobacterium tuberculosis H37Rv
aucgccgcgcgucaagucugugc

SEQ ID NO: 1273573 - RNA, 17 nt, Mycobacterium tuberculosis H37Rv
aucgccgcgauggcggu

SEQ ID NO: 1273574 - RNA, 13 nt, Mycobacterium tuberculosis H37Rv
aucgccgcgauca

SEQ ID NO: 1273575 - RNA, 12 nt, Mycobacterium tuberculosis H37Rv
aucgccgggaac

SEQ ID NO: 1273576 - RNA, 21 nt, Mycobacterium tuberculosis H37Rv
aucgccgucagcaccgcuacg

SEQ ID NO: 1273577 - RNA, 15 nt, Mycobacterium tuberculosis H37Rv
aucgccgacgccaga

SEQ ID NO: 1273578 - RNA, 16 nt, Mycobacterium tuberculosis H37Rv
aucgccgaaucggcag

SEQ ID NO: 1273579 - RNA, 16 nt, Mycobacterium tuberculosis H37Rv
aucgcccugacccgga

SEQ ID NO: 1273580 - RNA, 23 nt, Mycobacterium tuberculosis H37Rv
aucgccgccaaccacuuuccggc

SEQ ID NO: 1273581 - RNA, 22 nt, Mycobacterium tuberculosis H37Rv
aucgccgacgcccaggcauggc

SEQ ID NO: 1273582 - RNA, 18 nt, Mycobacterium tuberculosis H37Rv
aucgccgaugcgggaaac

SEQ ID NO: 1273583 - RNA, 14 nt, Mycobacterium tuberculosis H37Rv
aucgccgcccccgu

SEQ ID NO: 1273584 - RNA, 19 nt, Mycobacterium tuberculosis H37Rv
aucgcguuagccaggucga

SEQ ID NO: 1273585 - RNA, 17 nt, Mycobacterium tuberculosis H37Rv
aucgcuaggaccgcggu

SEQ ID NO: 1273586 - RNA, 22 nt, Mycobacterium tuberculosis H37Rv
aucggagucuucaacgucgaga

SEQ ID NO: 1273587 - RNA, 17 nt, Mycobacterium tuberculosis H37Rv
aucggaagagucgacgc

SEQ ID NO: 1273588 - RNA, 21 nt, Mycobacterium tuberculosis H37Rv
aucgcggagccaggacgacgc

SEQ ID NO: 1273589 - RNA, 18 nt, Mycobacterium tuberculosis H37Rv
aucgcgccgucggcgaug

SEQ ID NO: 1273590 - RNA, 16 nt, Mycobacterium tuberculosis H37Rv
aucgcgccgucggcga

SEQ ID NO: 1273591 - RNA, 12 nt, Mycobacterium tuberculosis H37Rv
aucgcgcgagcg

SEQ ID NO: 1273592 - RNA, 20 nt, Mycobacterium tuberculosis H37Rv
aucgcgccgggcucggcguu

SEQ ID NO: 1273593 - RNA, 18 nt, Mycobacterium tuberculosis H37Rv
aucgcgcccugcggaucg

SEQ ID NO: 1273594 - RNA, 15 nt, Mycobacterium tuberculosis H37Rv
aucgcgucggcgaug

SEQ ID NO: 1273595 - RNA, 15 nt, Mycobacterium tuberculosis H37Rv
aucgcguccuccucg

SEQ ID NO: 1273596 - RNA, 19 nt, Mycobacterium tuberculosis H37Rv
aucgcggugggccccgauc

SEQ ID NO: 1273597 - RNA, 18 nt, Mycobacterium tuberculosis H37Rv
aucgcguacguacugcuu

SEQ ID NO: 1273598 - RNA, 16 nt, Mycobacterium tuberculosis H37Rv
aucgcgguccaacagc

SEQ ID NO: 1273599 - RNA, 16 nt, Mycobacterium tuberculosis H37Rv
aucgcggcgcccagga

SEQ ID NO: 1273600 - RNA, 20 nt, Mycobacterium tuberculosis H37Rv
aucgcggcgaacaucaccgu

SEQ ID NO: 1273601 - RNA, 14 nt, Mycobacterium tuberculosis H37Rv
aucgcccgaugcgc

SEQ ID NO: 1273602 - RNA, 15 nt, Mycobacterium tuberculosis H37Rv
aucgcccaacaacgc

SEQ ID NO: 1273603 - RNA, 13 nt, Mycobacterium tuberculosis H37Rv
aucgccacccggu

SEQ ID NO: 1273604 - RNA, 22 nt, Mycobacterium tuberculosis H37Rv
aucgccagcaggaagccgaaga

SEQ ID NO: 1273605 - RNA, 15 nt, Mycobacterium tuberculosis H37Rv
aucgccaaauccggu

SEQ ID NO: 1273606 - RNA, 19 nt, Mycobacterium tuberculosis H37Rv
aucgccaaauccggugccc

SEQ ID NO: 1273607 - RNA, 21 nt, Mycobacterium tuberculosis H37Rv
aucgccacagucgucgagcgc

SEQ ID NO: 1273608 - RNA, 21 nt, Mycobacterium tuberculosis H37Rv
aucgccacgccugcucggaga

SEQ ID NO: 1273609 - RNA, 18 nt, Mycobacterium tuberculosis H37Rv
aucgcaggcaccccgauc

SEQ ID NO: 1273610 - RNA, 12 nt, Mycobacterium tuberculosis H37Rv
aucgcauccgcg

SEQ ID NO: 1273611 - RNA, 13 nt, Mycobacterium tuberculosis H37Rv
aucgcauccccag

SEQ ID NO: 1273612 - RNA, 18 nt, Mycobacterium tuberculosis H37Rv
aucgcauugggcgggcug

SEQ ID NO: 1273613 - RNA, 19 nt, Mycobacterium tuberculosis H37Rv
aucgcagacacugcugcgg

SEQ ID NO: 1273614 - RNA, 24 nt, Mycobacterium tuberculosis H37Rv
aucgcagaacggaccucggcgguc

SEQ ID NO: 1273615 - RNA, 19 nt, Mycobacterium tuberculosis H37Rv
aucgcacgacgcgacacgc

SEQ ID NO: 1273616 - RNA, 12 nt, Mycobacterium tuberculosis H37Rv
aucgaucggauc

SEQ ID NO: 1273617 - RNA, 22 nt, Mycobacterium tuberculosis H37Rv
aucgaugaccuuugagucgaga

SEQ ID NO: 1273618 - RNA, 17 nt, Mycobacterium tuberculosis H37Rv
aucgauuccgccgcacu

SEQ ID NO: 1273619 - RNA, 21 nt, Mycobacterium tuberculosis H37Rv
aucgcaagcgcggcgaagccg

SEQ ID NO: 1273620 - RNA, 15 nt, Mycobacterium tuberculosis H37Rv
aucgcacagcgcgau

SEQ ID NO: 1273621 - RNA, 23 nt, Mycobacterium tuberculosis H37Rv
aucgcacagcgcgaucaacgcgu

SEQ ID NO: 1273622 - RNA, 18 nt, Mycobacterium tuberculosis H37Rv
aucgcacaccaacaccgc

SEQ ID NO: 1273623 - RNA, 17 nt, Mycobacterium tuberculosis H37Rv
aucgcaaugggcucaca

SEQ ID NO: 1273624 - RNA, 19 nt, Mycobacterium tuberculosis H37Rv
aucgcacaaaaucagcgau

SEQ ID NO: 1273625 - RNA, 20 nt, Mycobacterium tuberculosis H37Rv
aucgcacaacugcgccagca

SEQ ID NO: 1273626 - RNA, 22 nt, Mycobacterium tuberculosis H37Rv
aucgacagccccgcggccagca

SEQ ID NO: 1273627 - RNA, 12 nt, Mycobacterium tuberculosis H37Rv
aucgacaucguu

SEQ ID NO: 1273628 - RNA, 22 nt, Mycobacterium tuberculosis H37Rv
aucgacagugugaagaccaccg

SEQ ID NO: 1273629 - RNA, 20 nt, Mycobacterium tuberculosis H37Rv
aucaggccgaugacgaugcc

SEQ ID NO: 1273630 - RNA, 22 nt, Mycobacterium tuberculosis H37Rv
aucgaccguccgggucaccagc

SEQ ID NO: 1273631 - RNA, 20 nt, Mycobacterium tuberculosis H37Rv
aucgacgccugcggcgguua

SEQ ID NO: 1273632 - RNA, 20 nt, Mycobacterium tuberculosis H37Rv
aucgaccaauucgaccgcgc

SEQ ID NO: 1273633 - RNA, 14 nt, Mycobacterium tuberculosis H37Rv
aucgacccgcccau

SEQ ID NO: 1273634 - RNA, 14 nt, Mycobacterium tuberculosis H37Rv
aucgaccuggccac

SEQ ID NO: 1273635 - RNA, 14 nt, Mycobacterium tuberculosis H37Rv
aucgacgaccguca

SEQ ID NO: 1273636 - RNA, 21 nt, Mycobacterium tuberculosis H37Rv
aucgaccgccuccucgauagc

SEQ ID NO: 1273637 - RNA, 13 nt, Mycobacterium tuberculosis H37Rv
aucgaguccacca

SEQ ID NO: 1273638 - RNA, 15 nt, Mycobacterium tuberculosis H37Rv
aucgaguuccgcauc

SEQ ID NO: 1273639 - RNA, 14 nt, Mycobacterium tuberculosis H37Rv
aucgaggccagcag

SEQ ID NO: 1273640 - RNA, 21 nt, Mycobacterium tuberculosis H37Rv
aucgaggauauggaucaacgc

SEQ ID NO: 1273641 - RNA, 20 nt, Mycobacterium tuberculosis H37Rv
aucgaggaggcggucgauca

SEQ ID NO: 1273642 - RNA, 19 nt, Mycobacterium tuberculosis H37Rv
aucgaggagaugccgacga

SEQ ID NO: 1273643 - RNA, 21 nt, Mycobacterium tuberculosis H37Rv
aucgaucaacaccaaucgggu

SEQ ID NO: 1273644 - RNA, 21 nt, Mycobacterium tuberculosis H37Rv
aucgaguugucucgcaucggc

SEQ ID NO: 1273645 - RNA, 22 nt, Mycobacterium tuberculosis H37Rv
aucgaguugucucgcaucggcc

SEQ ID NO: 1273646 - RNA, 16 nt, Mycobacterium tuberculosis H37Rv
aucgagcugaccuggu

SEQ ID NO: 1273647 - RNA, 17 nt, Mycobacterium tuberculosis H37Rv
aucgaggaacucggacc

SEQ ID NO: 1273648 - RNA, 19 nt, Mycobacterium tuberculosis H37Rv
aucgagcuaguucggcguc

SEQ ID NO: 1273649 - RNA, 16 nt, Mycobacterium tuberculosis H37Rv
aucgagccgacccgac

SEQ ID NO: 1273650 - RNA, 17 nt, Mycobacterium tuberculosis H37Rv
aucgacugaucgccacc

SEQ ID NO: 1273651 - RNA, 15 nt, Mycobacterium tuberculosis H37Rv
aucgacugaucgcca

SEQ ID NO: 1273652 - RNA, 22 nt, Mycobacterium tuberculosis H37Rv
aucgagaugccaucggugauga

SEQ ID NO: 1273653 - RNA, 19 nt, Mycobacterium tuberculosis H37Rv
aucgagacuucuucgacgc

SEQ ID NO: 1273654 - RNA, 13 nt, Mycobacterium tuberculosis H37Rv
augucgucgauga

SEQ ID NO: 1273655 - RNA, 12 nt, Mycobacterium tuberculosis H37Rv
augucgucgaca

SEQ ID NO: 1273656 - RNA, 23 nt, Mycobacterium tuberculosis H37Rv
augucugcgcagguggucgauca

SEQ ID NO: 1273657 - RNA, 19 nt, Mycobacterium tuberculosis H37Rv
augucuucgaucuccaggc

SEQ ID NO: 1273658 - RNA, 20 nt, Mycobacterium tuberculosis H37Rv
augucguaguagcggaucag

SEQ ID NO: 1273659 - RNA, 13 nt, Mycobacterium tuberculosis H37Rv
augucggugauca

SEQ ID NO: 1273660 - RNA, 22 nt, Mycobacterium tuberculosis H37Rv
augucggggccgucgucgguca

SEQ ID NO: 1273661 - RNA, 21 nt, Mycobacterium tuberculosis H37Rv
augucgaagaaccggccgacg

SEQ ID NO: 1273662 - RNA, 17 nt, Mycobacterium tuberculosis H37Rv
augucgaacaggaucag

SEQ ID NO: 1273663 - RNA, 16 nt, Mycobacterium tuberculosis H37Rv
augucgaagaaccggc

SEQ ID NO: 1273664 - RNA, 15 nt, Mycobacterium tuberculosis H37Rv
auguccauagccggc

SEQ ID NO: 1273665 - RNA, 18 nt, Mycobacterium tuberculosis H37Rv
auguccauagccggcauu

SEQ ID NO: 1273666 - RNA, 20 nt, Mycobacterium tuberculosis H37Rv
auguaguuggcgaccugcgc

SEQ ID NO: 1273667 - RNA, 14 nt, Mycobacterium tuberculosis H37Rv
auguccgcggccac

SEQ ID NO: 1273668 - RNA, 15 nt, Mycobacterium tuberculosis H37Rv
auggugguggcccgg

SEQ ID NO: 1273669 - RNA, 21 nt, Mycobacterium tuberculosis H37Rv
augguggugggugaugguacc

SEQ ID NO: 1273670 - RNA, 22 nt, Mycobacterium tuberculosis H37Rv
auggugugcacggcuucggcga

SEQ ID NO: 1273671 - RNA, 19 nt, Mycobacterium tuberculosis H37Rv
auguaccugguugcugacg

SEQ ID NO: 1273672 - RNA, 15 nt, Mycobacterium tuberculosis H37Rv
auguaccgaccgcgu

SEQ ID NO: 1273673 - RNA, 16 nt, Mycobacterium tuberculosis H37Rv
augguggugccgucag

SEQ ID NO: 1273674 - RNA, 14 nt, Mycobacterium tuberculosis H37Rv
augguggugccgac

SEQ ID NO: 1273675 - RNA, 15 nt, Mycobacterium tuberculosis H37Rv
auggugccgacccgc

SEQ ID NO: 1273676 - RNA, 20 nt, Mycobacterium tuberculosis H37Rv
auggugaugggggagccggu

SEQ ID NO: 1273677 - RNA, 13 nt, Mycobacterium tuberculosis H37Rv
auggucgucgcga

SEQ ID NO: 1273678 - RNA, 17 nt, Mycobacterium tuberculosis H37Rv
auggucgucgcgaucag

SEQ ID NO: 1273679 - RNA, 11 nt, Mycobacterium tuberculosis H37Rv
augggccaccc

SEQ ID NO: 1273680 - RNA, 18 nt, Mycobacterium tuberculosis H37Rv
auggucgaauaguugacc

SEQ ID NO: 1273681 - RNA, 23 nt, Mycobacterium tuberculosis H37Rv
auggcucaccccguucgaggucg

SEQ ID NO: 1273682 - RNA, 17 nt, Mycobacterium tuberculosis H37Rv
auggcuuggaccagcgu

SEQ ID NO: 1273683 - RNA, 16 nt, Mycobacterium tuberculosis H37Rv
auggcuugcucugcgc

SEQ ID NO: 1273684 - RNA, 23 nt, Mycobacterium tuberculosis H37Rv
augggauucggccagacgcucuu

SEQ ID NO: 1273685 - RNA, 24 nt, Mycobacterium tuberculosis H37Rv
auggcuuuggccgcuucgggcguc

SEQ ID NO: 1273686 - RNA, 22 nt, Mycobacterium tuberculosis H37Rv
auggcggcgcguucgucgucgc

SEQ ID NO: 1273687 - RNA, 13 nt, Mycobacterium tuberculosis H37Rv
auggcgucgccgg

SEQ ID NO: 1273688 - RNA, 15 nt, Mycobacterium tuberculosis H37Rv
auggcggcgacccgu

SEQ ID NO: 1273689 - RNA, 20 nt, Mycobacterium tuberculosis H37Rv
auggcgacgaacgccgucag

SEQ ID NO: 1273690 - RNA, 24 nt, Mycobacterium tuberculosis H37Rv
auggcgcugggauguucgaucagc

SEQ ID NO: 1273691 - RNA, 18 nt, Mycobacterium tuberculosis H37Rv
auggccaccgaacgcggc

SEQ ID NO: 1273692 - RNA, 17 nt, Mycobacterium tuberculosis H37Rv
auggccagcaucagcgc

SEQ ID NO: 1273693 - RNA, 17 nt, Mycobacterium tuberculosis H37Rv
auggccagcgcggcguc

SEQ ID NO: 1273694 - RNA, 19 nt, Mycobacterium tuberculosis H37Rv
auggccaggcuggcgucac

SEQ ID NO: 1273695 - RNA, 17 nt, Mycobacterium tuberculosis H37Rv
auggacaccagccagau

SEQ ID NO: 1273696 - RNA, 22 nt, Mycobacterium tuberculosis H37Rv
auggcgaccacccccggcaggc

SEQ ID NO: 1273697 - RNA, 22 nt, Mycobacterium tuberculosis H37Rv
auggccuugcugcgcgauggcc

SEQ ID NO: 1273698 - RNA, 15 nt, Mycobacterium tuberculosis H37Rv
auggccuugcugcgc

SEQ ID NO: 1273699 - RNA, 16 nt, Mycobacterium tuberculosis H37Rv
auggccuugcugcgcg

SEQ ID NO: 1273700 - RNA, 23 nt, Mycobacterium tuberculosis H37Rv
auggccccugucauguccugggc

SEQ ID NO: 1273701 - RNA, 21 nt, Mycobacterium tuberculosis H37Rv
auggccguugccaacaacauc

SEQ ID NO: 1273702 - RNA, 18 nt, Mycobacterium tuberculosis H37Rv
auggcccgaucgaccgcu

SEQ ID NO: 1273703 - RNA, 17 nt, Mycobacterium tuberculosis H37Rv
auggcccgaucgaccgc

SEQ ID NO: 1273704 - RNA, 12 nt, Mycobacterium tuberculosis H37Rv
augcgaugcggu

SEQ ID NO: 1273705 - RNA, 12 nt, Mycobacterium tuberculosis H37Rv
augcgaugcccg

SEQ ID NO: 1273706 - RNA, 19 nt, Mycobacterium tuberculosis H37Rv
augcgauuccgcgucugcu

SEQ ID NO: 1273707 - RNA, 15 nt, Mycobacterium tuberculosis H37Rv
augcgauucugcguc

SEQ ID NO: 1273708 - RNA, 19 nt, Mycobacterium tuberculosis H37Rv
augcgauucugcgucugcu

SEQ ID NO: 1273709 - RNA, 20 nt, Mycobacterium tuberculosis H37Rv
augcgauucugcgucugcuu

SEQ ID NO: 1273710 - RNA, 17 nt, Mycobacterium tuberculosis H37Rv
augcgauucugcgucug

SEQ ID NO: 1273711 - RNA, 18 nt, Mycobacterium tuberculosis H37Rv
augcgcaauagaccgcag

SEQ ID NO: 1273712 - RNA, 16 nt, Mycobacterium tuberculosis H37Rv
augcgguagucgccga

SEQ ID NO: 1273713 - RNA, 21 nt, Mycobacterium tuberculosis H37Rv
augcgggucugacaucggcca

SEQ ID NO: 1273714 - RNA, 19 nt, Mycobacterium tuberculosis H37Rv
augcgggucugcggucauc

SEQ ID NO: 1273715 - RNA, 13 nt, Mycobacterium tuberculosis H37Rv
augcgugccggca

SEQ ID NO: 1273716 - RNA, 16 nt, Mycobacterium tuberculosis H37Rv
augcgugccgacccgc

SEQ ID NO: 1273717 - RNA, 18 nt, Mycobacterium tuberculosis H37Rv
augcguugacgucgagca

SEQ ID NO: 1273718 - RNA, 15 nt, Mycobacterium tuberculosis H37Rv
augcguccaggcgag

SEQ ID NO: 1273719 - RNA, 17 nt, Mycobacterium tuberculosis H37Rv
augcgguccucgaucgg

SEQ ID NO: 1273720 - RNA, 12 nt, Mycobacterium tuberculosis H37Rv
augcuucccgga

SEQ ID NO: 1273721 - RNA, 13 nt, Mycobacterium tuberculosis H37Rv
augcuucggcguc

SEQ ID NO: 1273722 - RNA, 14 nt, Mycobacterium tuberculosis H37Rv
augcuggucggcga

SEQ ID NO: 1273723 - RNA, 17 nt, Mycobacterium tuberculosis H37Rv
augcuggucgugccgcc

SEQ ID NO: 1273724 - RNA, 17 nt, Mycobacterium tuberculosis H37Rv
augcugucguagcgcga

SEQ ID NO: 1273725 - RNA, 12 nt, Mycobacterium tuberculosis H37Rv
augccucggcgg

SEQ ID NO: 1273726 - RNA, 18 nt, Mycobacterium tuberculosis H37Rv
augccgucuuugucacgc

SEQ ID NO: 1273727 - RNA, 16 nt, Mycobacterium tuberculosis H37Rv
augccgucgccgguca

SEQ ID NO: 1273728 - RNA, 12 nt, Mycobacterium tuberculosis H37Rv
augccgucguca

SEQ ID NO: 1273729 - RNA, 15 nt, Mycobacterium tuberculosis H37Rv
augccggucggcguc

SEQ ID NO: 1273730 - RNA, 18 nt, Mycobacterium tuberculosis H37Rv
augccggacgccaugccc

SEQ ID NO: 1273731 - RNA, 16 nt, Mycobacterium tuberculosis H37Rv
augccggacagcucgc

SEQ ID NO: 1273732 - RNA, 22 nt, Mycobacterium tuberculosis H37Rv
augccgcgggacaucaccgcag

SEQ ID NO: 1273733 - RNA, 19 nt, Mycobacterium tuberculosis H37Rv
augccgcgguggaugcgau

SEQ ID NO: 1273734 - RNA, 20 nt, Mycobacterium tuberculosis H37Rv
augccgcggccaguacgucg

SEQ ID NO: 1273735 - RNA, 20 nt, Mycobacterium tuberculosis H37Rv
augccgcggaggcggccagc

SEQ ID NO: 1273736 - RNA, 17 nt, Mycobacterium tuberculosis H37Rv
augccgccaaccgcgug

SEQ ID NO: 1273737 - RNA, 14 nt, Mycobacterium tuberculosis H37Rv
augccgaugcgacg

SEQ ID NO: 1273738 - RNA, 18 nt, Mycobacterium tuberculosis H37Rv
augccgagcgaccguccc

SEQ ID NO: 1273739 - RNA, 12 nt, Mycobacterium tuberculosis H37Rv
augccgaugccc

SEQ ID NO: 1273740 - RNA, 13 nt, Mycobacterium tuberculosis H37Rv
augauggccagca

SEQ ID NO: 1273741 - RNA, 16 nt, Mycobacterium tuberculosis H37Rv
augccgaugaccgccu

SEQ ID NO: 1273742 - RNA, 13 nt, Mycobacterium tuberculosis H37Rv
augaugaccggca

SEQ ID NO: 1273743 - RNA, 12 nt, Mycobacterium tuberculosis H37Rv
augaucgccgac

SEQ ID NO: 1273744 - RNA, 23 nt, Mycobacterium tuberculosis H37Rv
augaugccggcgccggcccgcag

SEQ ID NO: 1273745 - RNA, 20 nt, Mycobacterium tuberculosis H37Rv
augaugcggcgcagcgacgc

SEQ ID NO: 1273746 - RNA, 10 nt, Mycobacterium tuberculosis H37Rv
augaugccgg

SEQ ID NO: 1273747 - RNA, 20 nt, Mycobacterium tuberculosis H37Rv
auugccgucgugaucggcga

SEQ ID NO: 1273748 - RNA, 21 nt, Mycobacterium tuberculosis H37Rv
auugccgcgguugugcugggu

SEQ ID NO: 1273749 - RNA, 20 nt, Mycobacterium tuberculosis H37Rv
auugcgaagggcaccggcga

SEQ ID NO: 1273750 - RNA, 17 nt, Mycobacterium tuberculosis H37Rv
auugccguucucgucga

SEQ ID NO: 1273751 - RNA, 15 nt, Mycobacterium tuberculosis H37Rv
auuggucgcucgcgg

SEQ ID NO: 1273752 - RNA, 22 nt, Mycobacterium tuberculosis H37Rv
auugggcgauuuugcgucugcu

SEQ ID NO: 1273753 - RNA, 20 nt, Mycobacterium tuberculosis H37Rv
auugggcgcuuaugcgucug

SEQ ID NO: 1273754 - RNA, 20 nt, Mycobacterium tuberculosis H37Rv
auugggcgauuuugcgucug

SEQ ID NO: 1273755 - RNA, 14 nt, Mycobacterium tuberculosis H37Rv
auucauggccgcga

SEQ ID NO: 1273756 - RNA, 22 nt, Mycobacterium tuberculosis H37Rv
auuccucuucaggcccucggga

SEQ ID NO: 1273757 - RNA, 16 nt, Mycobacterium tuberculosis H37Rv
auucgcuggcgaugcc

SEQ ID NO: 1273758 - RNA, 20 nt, Mycobacterium tuberculosis H37Rv
auucggugccagcaggccga

SEQ ID NO: 1273759 - RNA, 16 nt, Mycobacterium tuberculosis H37Rv
auucugacgaccggcu

SEQ ID NO: 1273760 - RNA, 20 nt, Mycobacterium tuberculosis H37Rv
auugacccccuagaccgggc

SEQ ID NO: 1273761 - RNA, 20 nt, Mycobacterium tuberculosis H37Rv
auucugugucugcucggcga

SEQ ID NO: 1273762 - RNA, 18 nt, Mycobacterium tuberculosis H37Rv
auucuugacgccgaugug

SEQ ID NO: 1273763 - RNA, 19 nt, Mycobacterium tuberculosis H37Rv
auucuugaaauagucgcga

SEQ ID NO: 1273764 - RNA, 19 nt, Mycobacterium tuberculosis H37Rv
auuagccauuaaugcggcc

SEQ ID NO: 1273765 - RNA, 18 nt, Mycobacterium tuberculosis H37Rv
augugcgagaagcaggga

SEQ ID NO: 1273766 - RNA, 21 nt, Mycobacterium tuberculosis H37Rv
augugcauucgggauucgggc

SEQ ID NO: 1273767 - RNA, 19 nt, Mycobacterium tuberculosis H37Rv
auguuggccguaccgguga

SEQ ID NO: 1273768 - RNA, 16 nt, Mycobacterium tuberculosis H37Rv
auguucucgaccgcgu

SEQ ID NO: 1273769 - RNA, 24 nt, Mycobacterium tuberculosis H37Rv
auguucggccaccagaaccagcga

SEQ ID NO: 1273770 - RNA, 18 nt, Mycobacterium tuberculosis H37Rv
auguuggcagggccagcg

SEQ ID NO: 1273771 - RNA, 15 nt, Mycobacterium tuberculosis H37Rv
auguucuuggucacc

SEQ ID NO: 1273772 - RNA, 21 nt, Mycobacterium tuberculosis H37Rv
cacccuauuggucggucgcgc

SEQ ID NO: 1273773 - RNA, 19 nt, Mycobacterium tuberculosis H37Rv
cacccguugcucccacggc

SEQ ID NO: 1273774 - RNA, 16 nt, Mycobacterium tuberculosis H37Rv
cacccgugccgccgau

SEQ ID NO: 1273775 - RNA, 20 nt, Mycobacterium tuberculosis H37Rv
cacccgugccgccgaugccg

SEQ ID NO: 1273776 - RNA, 13 nt, Mycobacterium tuberculosis H37Rv
cacccugucgcgc

SEQ ID NO: 1273777 - RNA, 20 nt, Mycobacterium tuberculosis H37Rv
cacccuuggcccggugcagc

SEQ ID NO: 1273778 - RNA, 14 nt, Mycobacterium tuberculosis H37Rv
caccgaaaaguccg

SEQ ID NO: 1273779 - RNA, 16 nt, Mycobacterium tuberculosis H37Rv
caccgaacuugcggac

SEQ ID NO: 1273780 - RNA, 17 nt, Mycobacterium tuberculosis H37Rv
caccgaacgcggccacc

SEQ ID NO: 1273781 - RNA, 13 nt, Mycobacterium tuberculosis H37Rv
caccgaacgcgau

SEQ ID NO: 1273782 - RNA, 17 nt, Mycobacterium tuberculosis H37Rv
caccgaaaccggucagc

SEQ ID NO: 1273783 - RNA, 15 nt, Mycobacterium tuberculosis H37Rv
caccgaacacggcgu

SEQ ID NO: 1273784 - RNA, 18 nt, Mycobacterium tuberculosis H37Rv
caccgaacagucgcagcc

SEQ ID NO: 1273785 - RNA, 17 nt, Mycobacterium tuberculosis H37Rv
caccgaacccgccaccg

SEQ ID NO: 1273786 - RNA, 21 nt, Mycobacterium tuberculosis H37Rv
caccgaauaccgccgcgcagc

SEQ ID NO: 1273787 - RNA, 18 nt, Mycobacterium tuberculosis H37Rv
cacccguguucgccacac

SEQ ID NO: 1273788 - RNA, 20 nt, Mycobacterium tuberculosis H37Rv
cacccgucacaagcugacac

SEQ ID NO: 1273789 - RNA, 14 nt, Mycobacterium tuberculosis H37Rv
cacccggugccgca

SEQ ID NO: 1273790 - RNA, 23 nt, Mycobacterium tuberculosis H37Rv
cacccgguggcugaucaccguug

SEQ ID NO: 1273791 - RNA, 15 nt, Mycobacterium tuberculosis H37Rv
cacccgguugugcgc

SEQ ID NO: 1273792 - RNA, 13 nt, Mycobacterium tuberculosis H37Rv
cacccgggcgugg

SEQ ID NO: 1273793 - RNA, 15 nt, Mycobacterium tuberculosis H37Rv
cacccgggccaucgc

SEQ ID NO: 1273794 - RNA, 22 nt, Mycobacterium tuberculosis H37Rv
cacccggcccaaggaacggcgu

SEQ ID NO: 1273795 - RNA, 13 nt, Mycobacterium tuberculosis H37Rv
cacccggccguug

SEQ ID NO: 1273796 - RNA, 21 nt, Mycobacterium tuberculosis H37Rv
cacccgggacguuguccaccg

SEQ ID NO: 1273797 - RNA, 23 nt, Mycobacterium tuberculosis H37Rv
cacccgcucgcccgccgccacca

SEQ ID NO: 1273798 - RNA, 17 nt, Mycobacterium tuberculosis H37Rv
cacccgcuggucgagca

SEQ ID NO: 1273799 - RNA, 23 nt, Mycobacterium tuberculosis H37Rv
cacccgcuuaucgaacgucucgg

SEQ ID NO: 1273800 - RNA, 20 nt, Mycobacterium tuberculosis H37Rv
cacccgcucggccgccgggu

SEQ ID NO: 1273801 - RNA, 15 nt, Mycobacterium tuberculosis H37Rv
cacccggcagagcac

SEQ ID NO: 1273802 - RNA, 16 nt, Mycobacterium tuberculosis H37Rv
caccgaucucgaccag

SEQ ID NO: 1273803 - RNA, 19 nt, Mycobacterium tuberculosis H37Rv
caccgauacccccggcauu

SEQ ID NO: 1273804 - RNA, 17 nt, Mycobacterium tuberculosis H37Rv
caccgauaccgucagcg

SEQ ID NO: 1273805 - RNA, 14 nt, Mycobacterium tuberculosis H37Rv
caccgacgucaggc

SEQ ID NO: 1273806 - RNA, 19 nt, Mycobacterium tuberculosis H37Rv
caccgacggaaugucagcc

SEQ ID NO: 1273807 - RNA, 21 nt, Mycobacterium tuberculosis H37Rv
caccgacgacggcgacggcgc

SEQ ID NO: 1273808 - RNA, 16 nt, Mycobacterium tuberculosis H37Rv
caccgacgaugccgcg

SEQ ID NO: 1273809 - RNA, 13 nt, Mycobacterium tuberculosis H37Rv
caccgacgccgau

SEQ ID NO: 1273810 - RNA, 20 nt, Mycobacterium tuberculosis H37Rv
caccgacgcgucggcgacgc

SEQ ID NO: 1273811 - RNA, 17 nt, Mycobacterium tuberculosis H37Rv
caccgccaacuccucag

SEQ ID NO: 1273812 - RNA, 13 nt, Mycobacterium tuberculosis H37Rv
caccgauuccagc

SEQ ID NO: 1273813 - RNA, 17 nt, Mycobacterium tuberculosis H37Rv
caccgauggcgcaccgg

SEQ ID NO: 1273814 - RNA, 21 nt, Mycobacterium tuberculosis H37Rv
caccgauggcgguggugccgc

SEQ ID NO: 1273815 - RNA, 14 nt, Mycobacterium tuberculosis H37Rv
caccgaugagccga

SEQ ID NO: 1273816 - RNA, 17 nt, Mycobacterium tuberculosis H37Rv
caccgaugcguucgggc

SEQ ID NO: 1273817 - RNA, 12 nt, Mycobacterium tuberculosis H37Rv
caccgaucggca

SEQ ID NO: 1273818 - RNA, 20 nt, Mycobacterium tuberculosis H37Rv
caccgccgagcagacgcgga

SEQ ID NO: 1273819 - RNA, 12 nt, Mycobacterium tuberculosis H37Rv
caccgccgacau

SEQ ID NO: 1273820 - RNA, 12 nt, Mycobacterium tuberculosis H37Rv
caccgccgacac

SEQ ID NO: 1273821 - RNA, 20 nt, Mycobacterium tuberculosis H37Rv
caccgcccuugccgccguug

SEQ ID NO: 1273822 - RNA, 15 nt, Mycobacterium tuberculosis H37Rv
caccgcccgccgaac

SEQ ID NO: 1273823 - RNA, 14 nt, Mycobacterium tuberculosis H37Rv
caccgcccggcccu

SEQ ID NO: 1273824 - RNA, 20 nt, Mycobacterium tuberculosis H37Rv
caccgccgccaccaccgcug

SEQ ID NO: 1273825 - RNA, 13 nt, Mycobacterium tuberculosis H37Rv
caccgccgcccaa

SEQ ID NO: 1273826 - RNA, 14 nt, Mycobacterium tuberculosis H37Rv
caccgccgccgaag

SEQ ID NO: 1273827 - RNA, 17 nt, Mycobacterium tuberculosis H37Rv
caccgccuuugccgccg

SEQ ID NO: 1273828 - RNA, 15 nt, Mycobacterium tuberculosis H37Rv
caccgccuuugccgc

SEQ ID NO: 1273829 - RNA, 15 nt, Mycobacterium tuberculosis H37Rv
caccgccuuggucac

SEQ ID NO: 1273830 - RNA, 21 nt, Mycobacterium tuberculosis H37Rv
caccgccuggaucagcgcguu

SEQ ID NO: 1273831 - RNA, 17 nt, Mycobacterium tuberculosis H37Rv
caccgccugugccgccg

SEQ ID NO: 1273832 - RNA, 22 nt, Mycobacterium tuberculosis H37Rv
caccgccuggaucagcgcguug

SEQ ID NO: 1273833 - RNA, 17 nt, Mycobacterium tuberculosis H37Rv
caccgccguugccgccg

SEQ ID NO: 1273834 - RNA, 15 nt, Mycobacterium tuberculosis H37Rv
caccgccguugccgc

SEQ ID NO: 1273835 - RNA, 18 nt, Mycobacterium tuberculosis H37Rv
caccgccguugccgaucg

SEQ ID NO: 1273836 - RNA, 22 nt, Mycobacterium tuberculosis H37Rv
caccgccgccgaagcgaugccg

SEQ ID NO: 1273837 - RNA, 19 nt, Mycobacterium tuberculosis H37Rv
caccgccgggaugccggcc

SEQ ID NO: 1273838 - RNA, 14 nt, Mycobacterium tuberculosis H37Rv
caccggcaaucggc

SEQ ID NO: 1273839 - RNA, 18 nt, Mycobacterium tuberculosis H37Rv
caccggcaccacgaucaa

SEQ ID NO: 1273840 - RNA, 13 nt, Mycobacterium tuberculosis H37Rv
caccggaucgacc

SEQ ID NO: 1273841 - RNA, 16 nt, Mycobacterium tuberculosis H37Rv
caccggcaccggccgu

SEQ ID NO: 1273842 - RNA, 23 nt, Mycobacterium tuberculosis H37Rv
caccggcacggugaacggcaagg

SEQ ID NO: 1273843 - RNA, 23 nt, Mycobacterium tuberculosis H37Rv
caccggcacccccgucgccaccg

SEQ ID NO: 1273844 - RNA, 13 nt, Mycobacterium tuberculosis H37Rv
caccggcacccgc

SEQ ID NO: 1273845 - RNA, 15 nt, Mycobacterium tuberculosis H37Rv
caccggccaccagcc

SEQ ID NO: 1273846 - RNA, 18 nt, Mycobacterium tuberculosis H37Rv
caccggccaccagcccga

SEQ ID NO: 1273847 - RNA, 19 nt, Mycobacterium tuberculosis H37Rv
caccggccaccagggccac

SEQ ID NO: 1273848 - RNA, 17 nt, Mycobacterium tuberculosis H37Rv
caccggccacucgggac

SEQ ID NO: 1273849 - RNA, 15 nt, Mycobacterium tuberculosis H37Rv
caccggccaggccgg

SEQ ID NO: 1273850 - RNA, 21 nt, Mycobacterium tuberculosis H37Rv
caccggccaccagggccaccg

SEQ ID NO: 1273851 - RNA, 17 nt, Mycobacterium tuberculosis H37Rv
caccggccgugccgccg

SEQ ID NO: 1273852 - RNA, 18 nt, Mycobacterium tuberculosis H37Rv
caccggccccaccggcac

SEQ ID NO: 1273853 - RNA, 16 nt, Mycobacterium tuberculosis H37Rv
caccggccccaccgac

SEQ ID NO: 1273854 - RNA, 18 nt, Mycobacterium tuberculosis H37Rv
caccggagucggcgucga

SEQ ID NO: 1273855 - RNA, 13 nt, Mycobacterium tuberculosis H37Rv
caccggagucggc

SEQ ID NO: 1273856 - RNA, 19 nt, Mycobacterium tuberculosis H37Rv
caccgcuguucuuggugac

SEQ ID NO: 1273857 - RNA, 13 nt, Mycobacterium tuberculosis H37Rv
caccgcucgccac

SEQ ID NO: 1273858 - RNA, 15 nt, Mycobacterium tuberculosis H37Rv
caccgcugccggcac

SEQ ID NO: 1273859 - RNA, 23 nt, Mycobacterium tuberculosis H37Rv
caccgcguuucgcgacgucugcc

SEQ ID NO: 1273860 - RNA, 17 nt, Mycobacterium tuberculosis H37Rv
caccgcguuggccacac

SEQ ID NO: 1273861 - RNA, 21 nt, Mycobacterium tuberculosis H37Rv
caccgccuuugccgccggcac

SEQ ID NO: 1273862 - RNA, 20 nt, Mycobacterium tuberculosis H37Rv
caccgcgucguagccacgca

SEQ ID NO: 1273863 - RNA, 16 nt, Mycobacterium tuberculosis H37Rv
caccgcgucggccgaa

SEQ ID NO: 1273864 - RNA, 16 nt, Mycobacterium tuberculosis H37Rv
caccgcguuggccaca

SEQ ID NO: 1273865 - RNA, 13 nt, Mycobacterium tuberculosis H37Rv
caccgcgucggcc

SEQ ID NO: 1273866 - RNA, 23 nt, Mycobacterium tuberculosis H37Rv
caccgcgacgacgaggucgguca

SEQ ID NO: 1273867 - RNA, 12 nt, Mycobacterium tuberculosis H37Rv
caccgcgucacc

SEQ ID NO: 1273868 - RNA, 17 nt, Mycobacterium tuberculosis H37Rv
caccguuaccgccgucg

SEQ ID NO: 1273869 - RNA, 14 nt, Mycobacterium tuberculosis H37Rv
caccguuaccgccg

SEQ ID NO: 1273870 - RNA, 13 nt, Mycobacterium tuberculosis H37Rv
caccgugguggac

SEQ ID NO: 1273871 - RNA, 19 nt, Mycobacterium tuberculosis H37Rv
caccgugucacgcgaccac

SEQ ID NO: 1273872 - RNA, 12 nt, Mycobacterium tuberculosis H37Rv
caccgugucgac

SEQ ID NO: 1273873 - RNA, 15 nt, Mycobacterium tuberculosis H37Rv
caccgugccgggcga

SEQ ID NO: 1273874 - RNA, 14 nt, Mycobacterium tuberculosis H37Rv
caccgucgcaccca

SEQ ID NO: 1273875 - RNA, 16 nt, Mycobacterium tuberculosis H37Rv
caccgugacagcggca

SEQ ID NO: 1273876 - RNA, 14 nt, Mycobacterium tuberculosis H37Rv
caccgugaccagcc

SEQ ID NO: 1273877 - RNA, 19 nt, Mycobacterium tuberculosis H37Rv
caccgugcaccagcucacc

SEQ ID NO: 1273878 - RNA, 18 nt, Mycobacterium tuberculosis H37Rv
caccgucugcggaccggc

SEQ ID NO: 1273879 - RNA, 19 nt, Mycobacterium tuberculosis H37Rv
caccgucugcuggccgggu

SEQ ID NO: 1273880 - RNA, 17 nt, Mycobacterium tuberculosis H37Rv
caccgucgagucgacgg

SEQ ID NO: 1273881 - RNA, 12 nt, Mycobacterium tuberculosis H37Rv
caccgucgagcc

SEQ ID NO: 1273882 - RNA, 22 nt, Mycobacterium tuberculosis H37Rv
caccgucccugugucgccgucg

SEQ ID NO: 1273883 - RNA, 15 nt, Mycobacterium tuberculosis H37Rv
caccgguaccgauca

SEQ ID NO: 1273884 - RNA, 15 nt, Mycobacterium tuberculosis H37Rv
caccgucaguucggu

SEQ ID NO: 1273885 - RNA, 20 nt, Mycobacterium tuberculosis H37Rv
caccgucccugugucgccgu

SEQ ID NO: 1273886 - RNA, 23 nt, Mycobacterium tuberculosis H37Rv
caccguccagcagcucggggcga

SEQ ID NO: 1273887 - RNA, 20 nt, Mycobacterium tuberculosis H37Rv
caccguccaauagcugacac

SEQ ID NO: 1273888 - RNA, 16 nt, Mycobacterium tuberculosis H37Rv
caccgucaugccguug

SEQ ID NO: 1273889 - RNA, 14 nt, Mycobacterium tuberculosis H37Rv
caccggggucaccu

SEQ ID NO: 1273890 - RNA, 15 nt, Mycobacterium tuberculosis H37Rv
caccggggcggccga

SEQ ID NO: 1273891 - RNA, 21 nt, Mycobacterium tuberculosis H37Rv
caccgggcgucgucggugauc

SEQ ID NO: 1273892 - RNA, 17 nt, Mycobacterium tuberculosis H37Rv
caccggggccgucggca

SEQ ID NO: 1273893 - RNA, 12 nt, Mycobacterium tuberculosis H37Rv
caccgguaccga

SEQ ID NO: 1273894 - RNA, 18 nt, Mycobacterium tuberculosis H37Rv
caccgggugcgacggcgu

SEQ ID NO: 1273895 - RNA, 21 nt, Mycobacterium tuberculosis H37Rv
caccgguaacgcgacaagguc

SEQ ID NO: 1273896 - RNA, 19 nt, Mycobacterium tuberculosis H37Rv
caccggguuggaagccgca

SEQ ID NO: 1273897 - RNA, 21 nt, Mycobacterium tuberculosis H37Rv
caccggguuggaagccgcacc

SEQ ID NO: 1273898 - RNA, 15 nt, Mycobacterium tuberculosis H37Rv
caccgggcccgacgc

SEQ ID NO: 1273899 - RNA, 14 nt, Mycobacterium tuberculosis H37Rv
caccgggccgacag

SEQ ID NO: 1273900 - RNA, 16 nt, Mycobacterium tuberculosis H37Rv
caccggcgccguguca

SEQ ID NO: 1273901 - RNA, 20 nt, Mycobacterium tuberculosis H37Rv
caccggcgccgugucaccgg

SEQ ID NO: 1273902 - RNA, 19 nt, Mycobacterium tuberculosis H37Rv
caccggcgaucguguccac

SEQ ID NO: 1273903 - RNA, 14 nt, Mycobacterium tuberculosis H37Rv
caccggcgaucacc

SEQ ID NO: 1273904 - RNA, 19 nt, Mycobacterium tuberculosis H37Rv
caccggcgcaccggagucg

SEQ ID NO: 1273905 - RNA, 19 nt, Mycobacterium tuberculosis H37Rv
caccggcgcaccgucgcgg

SEQ ID NO: 1273906 - RNA, 22 nt, Mycobacterium tuberculosis H37Rv
caccggccugcgcgaccgacca

SEQ ID NO: 1273907 - RNA, 14 nt, Mycobacterium tuberculosis H37Rv
caccccgagcggcu

SEQ ID NO: 1273908 - RNA, 21 nt, Mycobacterium tuberculosis H37Rv
caccccgaucacccgcaggua

SEQ ID NO: 1273909 - RNA, 15 nt, Mycobacterium tuberculosis H37Rv
caccccgccgaucac

SEQ ID NO: 1273910 - RNA, 22 nt, Mycobacterium tuberculosis H37Rv
caccaugauugccaggaccgcg

SEQ ID NO: 1273911 - RNA, 19 nt, Mycobacterium tuberculosis H37Rv
cacccgagggccugacgcg

SEQ ID NO: 1273912 - RNA, 13 nt, Mycobacterium tuberculosis H37Rv
cacccgcagccgc

SEQ ID NO: 1273913 - RNA, 16 nt, Mycobacterium tuberculosis H37Rv
cacccgcagaccgguu

SEQ ID NO: 1273914 - RNA, 14 nt, Mycobacterium tuberculosis H37Rv
cacccgcaccgccg

SEQ ID NO: 1273915 - RNA, 16 nt, Mycobacterium tuberculosis H37Rv
cacccgcaccaccggc

SEQ ID NO: 1273916 - RNA, 19 nt, Mycobacterium tuberculosis H37Rv
cacccgaauuugucggcga

SEQ ID NO: 1273917 - RNA, 15 nt, Mycobacterium tuberculosis H37Rv
cacccgacucgucgg

SEQ ID NO: 1273918 - RNA, 16 nt, Mycobacterium tuberculosis H37Rv
cacccgauuggccaac

SEQ ID NO: 1273919 - RNA, 13 nt, Mycobacterium tuberculosis H37Rv
cacccgcaccacc

SEQ ID NO: 1273920 - RNA, 17 nt, Mycobacterium tuberculosis H37Rv
cacccgcggcgccguug

SEQ ID NO: 1273921 - RNA, 23 nt, Mycobacterium tuberculosis H37Rv
cacccgcggcgccguugccgccg

SEQ ID NO: 1273922 - RNA, 23 nt, Mycobacterium tuberculosis H37Rv
cacccgcgcgaugcuggcgaacu

SEQ ID NO: 1273923 - RNA, 15 nt, Mycobacterium tuberculosis H37Rv
cacccgcggugacgc

SEQ ID NO: 1273924 - RNA, 14 nt, Mycobacterium tuberculosis H37Rv
cacccgcaggucgc

SEQ ID NO: 1273925 - RNA, 12 nt, Mycobacterium tuberculosis H37Rv
cacccgcaucgg

SEQ ID NO: 1273926 - RNA, 15 nt, Mycobacterium tuberculosis H37Rv
cacccgccaggccgc

SEQ ID NO: 1273927 - RNA, 20 nt, Mycobacterium tuberculosis H37Rv
cacccgccagggcggcaucc

SEQ ID NO: 1273928 - RNA, 21 nt, Mycobacterium tuberculosis H37Rv
cacccgcaggucgaucugcgc

SEQ ID NO: 1273929 - RNA, 19 nt, Mycobacterium tuberculosis H37Rv
caccagugcgggguccagc

SEQ ID NO: 1273930 - RNA, 20 nt, Mycobacterium tuberculosis H37Rv
caccauaauggucgucgcga

SEQ ID NO: 1273931 - RNA, 18 nt, Mycobacterium tuberculosis H37Rv
caccagguccaccccgcc

SEQ ID NO: 1273932 - RNA, 19 nt, Mycobacterium tuberculosis H37Rv
caccaggucauugccggcg

SEQ ID NO: 1273933 - RNA, 16 nt, Mycobacterium tuberculosis H37Rv
caccaggggcgcguca

SEQ ID NO: 1273934 - RNA, 22 nt, Mycobacterium tuberculosis H37Rv
caccaggggcgcgucauggcga

SEQ ID NO: 1273935 - RNA, 22 nt, Mycobacterium tuberculosis H37Rv
caccagggcgcggaucugcagc

SEQ ID NO: 1273936 - RNA, 18 nt, Mycobacterium tuberculosis H37Rv
caccagggcgugcgcgaa

SEQ ID NO: 1273937 - RNA, 20 nt, Mycobacterium tuberculosis H37Rv
caccagggcacguucggcgc

SEQ ID NO: 1273938 - RNA, 15 nt, Mycobacterium tuberculosis H37Rv
caccagcgcagcauu

SEQ ID NO: 1273939 - RNA, 15 nt, Mycobacterium tuberculosis H37Rv
caccagcgcaucggc

SEQ ID NO: 1273940 - RNA, 17 nt, Mycobacterium tuberculosis H37Rv
caccagcgcccgucgcu

SEQ ID NO: 1273941 - RNA, 20 nt, Mycobacterium tuberculosis H37Rv
caccagcucacccggagcac

SEQ ID NO: 1273942 - RNA, 15 nt, Mycobacterium tuberculosis H37Rv
caccagcucggugau

SEQ ID NO: 1273943 - RNA, 14 nt, Mycobacterium tuberculosis H37Rv
caccagcgucgcgg

SEQ ID NO: 1273944 - RNA, 23 nt, Mycobacterium tuberculosis H37Rv
caccagcgucgcggccacgguca

SEQ ID NO: 1273945 - RNA, 15 nt, Mycobacterium tuberculosis H37Rv
caccagccgucagcg

SEQ ID NO: 1273946 - RNA, 14 nt, Mycobacterium tuberculosis H37Rv
caccacgucgacga

SEQ ID NO: 1273947 - RNA, 16 nt, Mycobacterium tuberculosis H37Rv
caccacgucgucgggg

SEQ ID NO: 1273948 - RNA, 15 nt, Mycobacterium tuberculosis H37Rv
caccacgugcgccac

SEQ ID NO: 1273949 - RNA, 18 nt, Mycobacterium tuberculosis H37Rv
cacauacgauuucgacga

SEQ ID NO: 1273950 - RNA, 17 nt, Mycobacterium tuberculosis H37Rv
cacauacagcaggccgc

SEQ ID NO: 1273951 - RNA, 13 nt, Mycobacterium tuberculosis H37Rv
cacaucaugggcg

SEQ ID NO: 1273952 - RNA, 19 nt, Mycobacterium tuberculosis H37Rv
cacaucaaaacggcggugg

SEQ ID NO: 1273953 - RNA, 20 nt, Mycobacterium tuberculosis H37Rv
cacauccagggugccgguca

SEQ ID NO: 1273954 - RNA, 13 nt, Mycobacterium tuberculosis H37Rv
cacaucaccggcg

SEQ ID NO: 1273955 - RNA, 18 nt, Mycobacterium tuberculosis H37Rv
cacagccgucgcaccaga

SEQ ID NO: 1273956 - RNA, 18 nt, Mycobacterium tuberculosis H37Rv
cacagccucguagaacgc

SEQ ID NO: 1273957 - RNA, 15 nt, Mycobacterium tuberculosis H37Rv
cacagccccagggug

SEQ ID NO: 1273958 - RNA, 14 nt, Mycobacterium tuberculosis H37Rv
cacagccgaccucg

SEQ ID NO: 1273959 - RNA, 14 nt, Mycobacterium tuberculosis H37Rv
cacagccgcgccga

SEQ ID NO: 1273960 - RNA, 14 nt, Mycobacterium tuberculosis H37Rv
cacaggaucaccca

SEQ ID NO: 1273961 - RNA, 18 nt, Mycobacterium tuberculosis H37Rv
cacaggauccguggccaa

SEQ ID NO: 1273962 - RNA, 16 nt, Mycobacterium tuberculosis H37Rv
cacaggcguccaucgc

SEQ ID NO: 1273963 - RNA, 19 nt, Mycobacterium tuberculosis H37Rv
cacaggcguccaucgccac

SEQ ID NO: 1273964 - RNA, 13 nt, Mycobacterium tuberculosis H37Rv
cacagcagcgguu

SEQ ID NO: 1273965 - RNA, 14 nt, Mycobacterium tuberculosis H37Rv
cacagcaggcucga

SEQ ID NO: 1273966 - RNA, 14 nt, Mycobacterium tuberculosis H37Rv
cacagccaccagcc

SEQ ID NO: 1273967 - RNA, 24 nt, Mycobacterium tuberculosis H37Rv
cacaaacaccccacacagucggug

SEQ ID NO: 1273968 - RNA, 13 nt, Mycobacterium tuberculosis H37Rv
caccaaccgcccg

SEQ ID NO: 1273969 - RNA, 14 nt, Mycobacterium tuberculosis H37Rv
caccaccaccgccg

SEQ ID NO: 1273970 - RNA, 14 nt, Mycobacterium tuberculosis H37Rv
caccaccacgccga

SEQ ID NO: 1273971 - RNA, 22 nt, Mycobacterium tuberculosis H37Rv
caccaccagagacgaucaucuc

SEQ ID NO: 1273972 - RNA, 14 nt, Mycobacterium tuberculosis H37Rv
caccaccacggcca

SEQ ID NO: 1273973 - RNA, 12 nt, Mycobacterium tuberculosis H37Rv
caccaccacggc

SEQ ID NO: 1273974 - RNA, 15 nt, Mycobacterium tuberculosis H37Rv
caccaccacgugauc

SEQ ID NO: 1273975 - RNA, 19 nt, Mycobacterium tuberculosis H37Rv
caccaccaggcugucgugg

SEQ ID NO: 1273976 - RNA, 18 nt, Mycobacterium tuberculosis H37Rv
caccaccaucacgguggc

SEQ ID NO: 1273977 - RNA, 16 nt, Mycobacterium tuberculosis H37Rv
caccaccgccgccgga

SEQ ID NO: 1273978 - RNA, 19 nt, Mycobacterium tuberculosis H37Rv
cacauguucuccucgucgc

SEQ ID NO: 1273979 - RNA, 19 nt, Mycobacterium tuberculosis H37Rv
cacaugguacggacgcugc

SEQ ID NO: 1273980 - RNA, 14 nt, Mycobacterium tuberculosis H37Rv
cacauugccaccgu

SEQ ID NO: 1273981 - RNA, 18 nt, Mycobacterium tuberculosis H37Rv
caccaaaaggaucaacgu

SEQ ID NO: 1273982 - RNA, 20 nt, Mycobacterium tuberculosis H37Rv
caccaaaagcccgguacgcc

SEQ ID NO: 1273983 - RNA, 23 nt, Mycobacterium tuberculosis H37Rv
caccaaaaacccggugaccagca

SEQ ID NO: 1273984 - RNA, 22 nt, Mycobacterium tuberculosis H37Rv
caccaaccagugcagcucgaua

SEQ ID NO: 1273985 - RNA, 14 nt, Mycobacterium tuberculosis H37Rv
caccacgaucgcga

SEQ ID NO: 1273986 - RNA, 20 nt, Mycobacterium tuberculosis H37Rv
caccacgaggcuugcggcac

SEQ ID NO: 1273987 - RNA, 13 nt, Mycobacterium tuberculosis H37Rv
caccacgauggcg

SEQ ID NO: 1273988 - RNA, 16 nt, Mycobacterium tuberculosis H37Rv
caccacgacgcgaugg

SEQ ID NO: 1273989 - RNA, 21 nt, Mycobacterium tuberculosis H37Rv
caccaccggcaacaucagcag

SEQ ID NO: 1273990 - RNA, 11 nt, Mycobacterium tuberculosis H37Rv
caccaccggca

SEQ ID NO: 1273991 - RNA, 20 nt, Mycobacterium tuberculosis H37Rv
caccaccgcucgucguccgg

SEQ ID NO: 1273992 - RNA, 14 nt, Mycobacterium tuberculosis H37Rv
caccaccgcgccgu

SEQ ID NO: 1273993 - RNA, 19 nt, Mycobacterium tuberculosis H37Rv
caccacgguuuuacagcgu

SEQ ID NO: 1273994 - RNA, 14 nt, Mycobacterium tuberculosis H37Rv
caccacggcggcca

SEQ ID NO: 1273995 - RNA, 14 nt, Mycobacterium tuberculosis H37Rv
caccacgcgccgca

SEQ ID NO: 1273996 - RNA, 21 nt, Mycobacterium tuberculosis H37Rv
caccacgcuggccucgucgcu

SEQ ID NO: 1273997 - RNA, 15 nt, Mycobacterium tuberculosis H37Rv
caccacgcccgacga

SEQ ID NO: 1273998 - RNA, 15 nt, Mycobacterium tuberculosis H37Rv
caacugcccgaugau

SEQ ID NO: 1273999 - RNA, 13 nt, Mycobacterium tuberculosis H37Rv
caagacgccaccc

SEQ ID NO: 1274000 - RNA, 14 nt, Mycobacterium tuberculosis H37Rv
caagaccgcggcgu

SEQ ID NO: 1274001 - RNA, 17 nt, Mycobacterium tuberculosis H37Rv
caagacgucggcguggu

SEQ ID NO: 1274002 - RNA, 14 nt, Mycobacterium tuberculosis H37Rv
caagccguagacca

SEQ ID NO: 1274003 - RNA, 15 nt, Mycobacterium tuberculosis H37Rv
caagccgugccgcac

SEQ ID NO: 1274004 - RNA, 19 nt, Mycobacterium tuberculosis H37Rv
caagccguguucgaccgca

SEQ ID NO: 1274005 - RNA, 20 nt, Mycobacterium tuberculosis H37Rv
caagccguguucgaccgcag

SEQ ID NO: 1274006 - RNA, 20 nt, Mycobacterium tuberculosis H37Rv
caagccggggaacuuaccga

SEQ ID NO: 1274007 - RNA, 16 nt, Mycobacterium tuberculosis H37Rv
caagccgcgagucgcc

SEQ ID NO: 1274008 - RNA, 22 nt, Mycobacterium tuberculosis H37Rv
caagccggccacgcauuccagc

SEQ ID NO: 1274009 - RNA, 12 nt, Mycobacterium tuberculosis H37Rv
caagcgauccga

SEQ ID NO: 1274010 - RNA, 21 nt, Mycobacterium tuberculosis H37Rv
caagcucagggugggcgacgu

SEQ ID NO: 1274011 - RNA, 14 nt, Mycobacterium tuberculosis H37Rv
caagcgugcugccg

SEQ ID NO: 1274012 - RNA, 22 nt, Mycobacterium tuberculosis H37Rv
caagcucgccggauucgaugac

SEQ ID NO: 1274013 - RNA, 14 nt, Mycobacterium tuberculosis H37Rv
caaggaagccgcgg

SEQ ID NO: 1274014 - RNA, 15 nt, Mycobacterium tuberculosis H37Rv
caaggaccgcucugc

SEQ ID NO: 1274015 - RNA, 17 nt, Mycobacterium tuberculosis H37Rv
caaggcggcggccagcc

SEQ ID NO: 1274016 - RNA, 14 nt, Mycobacterium tuberculosis H37Rv
caaggcggucacca

SEQ ID NO: 1274017 - RNA, 17 nt, Mycobacterium tuberculosis H37Rv
caagggcaaccgccccu

SEQ ID NO: 1274018 - RNA, 22 nt, Mycobacterium tuberculosis H37Rv
caaggcgugagcuaugcuggca

SEQ ID NO: 1274019 - RNA, 14 nt, Mycobacterium tuberculosis H37Rv
caaggccaccgucg

SEQ ID NO: 1274020 - RNA, 15 nt, Mycobacterium tuberculosis H37Rv
caaggcccgcaccgc

SEQ ID NO: 1274021 - RNA, 13 nt, Mycobacterium tuberculosis H37Rv
caaggccgccugc

SEQ ID NO: 1274022 - RNA, 20 nt, Mycobacterium tuberculosis H37Rv
caacggguacacccgcucgc

SEQ ID NO: 1274023 - RNA, 19 nt, Mycobacterium tuberculosis H37Rv
caacgggccuucagcucac

SEQ ID NO: 1274024 - RNA, 14 nt, Mycobacterium tuberculosis H37Rv
caacgguacgcgcu

SEQ ID NO: 1274025 - RNA, 22 nt, Mycobacterium tuberculosis H37Rv
caacgggccgcaucgucgccgc

SEQ ID NO: 1274026 - RNA, 20 nt, Mycobacterium tuberculosis H37Rv
caacggcguaaucgggaagu

SEQ ID NO: 1274027 - RNA, 17 nt, Mycobacterium tuberculosis H37Rv
caacggcagcgccaccg

SEQ ID NO: 1274028 - RNA, 16 nt, Mycobacterium tuberculosis H37Rv
caacggcgcggcaagg

SEQ ID NO: 1274029 - RNA, 19 nt, Mycobacterium tuberculosis H37Rv
caacggcggcgccguucgu

SEQ ID NO: 1274030 - RNA, 13 nt, Mycobacterium tuberculosis H37Rv
caacggcagcccg

SEQ ID NO: 1274031 - RNA, 19 nt, Mycobacterium tuberculosis H37Rv
caacggcacccugcggcac

SEQ ID NO: 1274032 - RNA, 20 nt, Mycobacterium tuberculosis H37Rv
caacggcacccugcggcacc

SEQ ID NO: 1274033 - RNA, 21 nt, Mycobacterium tuberculosis H37Rv
caacggcagaucccacgccag

SEQ ID NO: 1274034 - RNA, 14 nt, Mycobacterium tuberculosis H37Rv
caacggcacccgaa

SEQ ID NO: 1274035 - RNA, 23 nt, Mycobacterium tuberculosis H37Rv
caacggcaccucgacgucgagca

SEQ ID NO: 1274036 - RNA, 15 nt, Mycobacterium tuberculosis H37Rv
caacgcuucggcgug

SEQ ID NO: 1274037 - RNA, 18 nt, Mycobacterium tuberculosis H37Rv
caacgugccgaacgccag

SEQ ID NO: 1274038 - RNA, 21 nt, Mycobacterium tuberculosis H37Rv
caacguucaacgacggcaagc

SEQ ID NO: 1274039 - RNA, 16 nt, Mycobacterium tuberculosis H37Rv
caacgucggcaccggu

SEQ ID NO: 1274040 - RNA, 22 nt, Mycobacterium tuberculosis H37Rv
caacgucgcuccgaugugccga

SEQ ID NO: 1274041 - RNA, 21 nt, Mycobacterium tuberculosis H37Rv
caacgucuugcuggucgaugg

SEQ ID NO: 1274042 - RNA, 22 nt, Mycobacterium tuberculosis H37Rv
caacgucuugcuggucgauggc

SEQ ID NO: 1274043 - RNA, 13 nt, Mycobacterium tuberculosis H37Rv
caacgugaacugu

SEQ ID NO: 1274044 - RNA, 21 nt, Mycobacterium tuberculosis H37Rv
caacgucgagauccucgucga

SEQ ID NO: 1274045 - RNA, 14 nt, Mycobacterium tuberculosis H37Rv
caacgucacgucga

SEQ ID NO: 1274046 - RNA, 15 nt, Mycobacterium tuberculosis H37Rv
caacguucggcacaa

SEQ ID NO: 1274047 - RNA, 19 nt, Mycobacterium tuberculosis H37Rv
caacguugcgccagcggug

SEQ ID NO: 1274048 - RNA, 14 nt, Mycobacterium tuberculosis H37Rv
caauccggcugcgg

SEQ ID NO: 1274049 - RNA, 14 nt, Mycobacterium tuberculosis H37Rv
caaucgaccacgac

SEQ ID NO: 1274050 - RNA, 14 nt, Mycobacterium tuberculosis H37Rv
caauccgcacagcg

SEQ ID NO: 1274051 - RNA, 17 nt, Mycobacterium tuberculosis H37Rv
caauccgcucggucgcc

SEQ ID NO: 1274052 - RNA, 21 nt, Mycobacterium tuberculosis H37Rv
caauccgcucggucgccuccu

SEQ ID NO: 1274053 - RNA, 13 nt, Mycobacterium tuberculosis H37Rv
caaucccuccgcc

SEQ ID NO: 1274054 - RNA, 18 nt, Mycobacterium tuberculosis H37Rv
caauauccuccagcaggu

SEQ ID NO: 1274055 - RNA, 22 nt, Mycobacterium tuberculosis H37Rv
caaucaccugguaguccccgaa

SEQ ID NO: 1274056 - RNA, 16 nt, Mycobacterium tuberculosis H37Rv
caagucaccauagcuc

SEQ ID NO: 1274057 - RNA, 13 nt, Mycobacterium tuberculosis H37Rv
caagucagcccga

SEQ ID NO: 1274058 - RNA, 11 nt, Mycobacterium tuberculosis H37Rv
caagucgacgc

SEQ ID NO: 1274059 - RNA, 22 nt, Mycobacterium tuberculosis H37Rv
caauacgugauguagcugcagg

SEQ ID NO: 1274060 - RNA, 19 nt, Mycobacterium tuberculosis H37Rv
caagucgaccaugagccgg

SEQ ID NO: 1274061 - RNA, 19 nt, Mycobacterium tuberculosis H37Rv
caaguacgcgucggugacc

SEQ ID NO: 1274062 - RNA, 14 nt, Mycobacterium tuberculosis H37Rv
caaguacgcuccga

SEQ ID NO: 1274063 - RNA, 18 nt, Mycobacterium tuberculosis H37Rv
caaguacgcgucggugac

SEQ ID NO: 1274064 - RNA, 21 nt, Mycobacterium tuberculosis H37Rv
caauucaacacacggcgcguu

SEQ ID NO: 1274065 - RNA, 15 nt, Mycobacterium tuberculosis H37Rv
caauggccugcagcg

SEQ ID NO: 1274066 - RNA, 21 nt, Mycobacterium tuberculosis H37Rv
caauggcuucgaagcgaucgc

SEQ ID NO: 1274067 - RNA, 14 nt, Mycobacterium tuberculosis H37Rv
caaucucggcguug

SEQ ID NO: 1274068 - RNA, 16 nt, Mycobacterium tuberculosis H37Rv
caaucguuuucguguc

SEQ ID NO: 1274069 - RNA, 14 nt, Mycobacterium tuberculosis H37Rv
caaucguuggccau

SEQ ID NO: 1274070 - RNA, 23 nt, Mycobacterium tuberculosis H37Rv
caaucgcaaugaccugcagcgca

SEQ ID NO: 1274071 - RNA, 22 nt, Mycobacterium tuberculosis H37Rv
caaucgcaaugaccugcagcgc

SEQ ID NO: 1274072 - RNA, 14 nt, Mycobacterium tuberculosis H37Rv
caaucgucggccag

SEQ ID NO: 1274073 - RNA, 13 nt, Mycobacterium tuberculosis H37Rv
caaucgucggcca

SEQ ID NO: 1274074 - RNA, 14 nt, Mycobacterium tuberculosis H37Rv
caaucugcacgcgc

SEQ ID NO: 1274075 - RNA, 12 nt, Mycobacterium tuberculosis H37Rv
caaugauucggc

SEQ ID NO: 1274076 - RNA, 19 nt, Mycobacterium tuberculosis H37Rv
caaugcacaccgggcacca

SEQ ID NO: 1274077 - RNA, 20 nt, Mycobacterium tuberculosis H37Rv
caaugcacaccgggcaccag

SEQ ID NO: 1274078 - RNA, 17 nt, Mycobacterium tuberculosis H37Rv
caauggccagcaccacg

SEQ ID NO: 1274079 - RNA, 20 nt, Mycobacterium tuberculosis H37Rv
caaugcguugacgucgagca

SEQ ID NO: 1274080 - RNA, 15 nt, Mycobacterium tuberculosis H37Rv
caaugcccgcaccgc

SEQ ID NO: 1274081 - RNA, 22 nt, Mycobacterium tuberculosis H37Rv
caaugcguugaccgauacgcgg

SEQ ID NO: 1274082 - RNA, 14 nt, Mycobacterium tuberculosis H37Rv
caaccggccgguga

SEQ ID NO: 1274083 - RNA, 15 nt, Mycobacterium tuberculosis H37Rv
caaccggcgugucga

SEQ ID NO: 1274084 - RNA, 14 nt, Mycobacterium tuberculosis H37Rv
caaccgcucggcga

SEQ ID NO: 1274085 - RNA, 17 nt, Mycobacterium tuberculosis H37Rv
caaccgggucguucggg

SEQ ID NO: 1274086 - RNA, 22 nt, Mycobacterium tuberculosis H37Rv
caaccgggucguucgggugagc

SEQ ID NO: 1274087 - RNA, 19 nt, Mycobacterium tuberculosis H37Rv
caaccgguaucgccgcuac

SEQ ID NO: 1274088 - RNA, 17 nt, Mycobacterium tuberculosis H37Rv
caaccgggugugcgucg

SEQ ID NO: 1274089 - RNA, 19 nt, Mycobacterium tuberculosis H37Rv
caaccgguggaugaacacc

SEQ ID NO: 1274090 - RNA, 22 nt, Mycobacterium tuberculosis H37Rv
caaccggucgguguagcaacgg

SEQ ID NO: 1274091 - RNA, 23 nt, Mycobacterium tuberculosis H37Rv
caaccgguggaugaacaccucau

SEQ ID NO: 1274092 - RNA, 23 nt, Mycobacterium tuberculosis H37Rv
caaccgucggugaaauucgcggc

SEQ ID NO: 1274093 - RNA, 14 nt, Mycobacterium tuberculosis H37Rv
caaccgucggugaa

SEQ ID NO: 1274094 - RNA, 22 nt, Mycobacterium tuberculosis H37Rv
caaccgugaacucgcgcgucgu

SEQ ID NO: 1274095 - RNA, 16 nt, Mycobacterium tuberculosis H37Rv
caaccucaugcacgcc

SEQ ID NO: 1274096 - RNA, 13 nt, Mycobacterium tuberculosis H37Rv
caaccucaucgcg

SEQ ID NO: 1274097 - RNA, 23 nt, Mycobacterium tuberculosis H37Rv
caaccugcgaccaggcgcggcga

SEQ ID NO: 1274098 - RNA, 14 nt, Mycobacterium tuberculosis H37Rv
caaccuugaccggg

SEQ ID NO: 1274099 - RNA, 21 nt, Mycobacterium tuberculosis H37Rv
caaccugagcaucuccucgcc

SEQ ID NO: 1274100 - RNA, 23 nt, Mycobacterium tuberculosis H37Rv
caaccucgguugguccucggcgg

SEQ ID NO: 1274101 - RNA, 15 nt, Mycobacterium tuberculosis H37Rv
caaccucgccgucgu

SEQ ID NO: 1274102 - RNA, 18 nt, Mycobacterium tuberculosis H37Rv
caaccucgccgucgucga

SEQ ID NO: 1274103 - RNA, 21 nt, Mycobacterium tuberculosis H37Rv
caaccuccgcgagcagucgcu

SEQ ID NO: 1274104 - RNA, 23 nt, Mycobacterium tuberculosis H37Rv
caacccgccguugccaccggugc

SEQ ID NO: 1274105 - RNA, 14 nt, Mycobacterium tuberculosis H37Rv
caacccugcccggc

SEQ ID NO: 1274106 - RNA, 18 nt, Mycobacterium tuberculosis H37Rv
caaccgaucggucguccg

SEQ ID NO: 1274107 - RNA, 19 nt, Mycobacterium tuberculosis H37Rv
caaccgccaucgucgaaga

SEQ ID NO: 1274108 - RNA, 14 nt, Mycobacterium tuberculosis H37Rv
caaccgcgccaccu

SEQ ID NO: 1274109 - RNA, 17 nt, Mycobacterium tuberculosis H37Rv
caaccgcgugcgucagc

SEQ ID NO: 1274110 - RNA, 17 nt, Mycobacterium tuberculosis H37Rv
caaccaucgcgaucuga

SEQ ID NO: 1274111 - RNA, 23 nt, Mycobacterium tuberculosis H37Rv
caaccccggaccgcggccaccgc

SEQ ID NO: 1274112 - RNA, 22 nt, Mycobacterium tuberculosis H37Rv
caacccgcgauucgcggcagcc

SEQ ID NO: 1274113 - RNA, 17 nt, Mycobacterium tuberculosis H37Rv
caacccggcgucgacga

SEQ ID NO: 1274114 - RNA, 21 nt, Mycobacterium tuberculosis H37Rv
caacccggacgaacgccgucg

SEQ ID NO: 1274115 - RNA, 19 nt, Mycobacterium tuberculosis H37Rv
caacgcgguggaccgcucg

SEQ ID NO: 1274116 - RNA, 20 nt, Mycobacterium tuberculosis H37Rv
caacgcgcagagcguuccgc

SEQ ID NO: 1274117 - RNA, 15 nt, Mycobacterium tuberculosis H37Rv
caacgcgcaggccga

SEQ ID NO: 1274118 - RNA, 15 nt, Mycobacterium tuberculosis H37Rv
caacgcgcgaccgcg

SEQ ID NO: 1274119 - RNA, 19 nt, Mycobacterium tuberculosis H37Rv
caacgcgcgcacgccaccg

SEQ ID NO: 1274120 - RNA, 18 nt, Mycobacterium tuberculosis H37Rv
caacgcggugggcacagc

SEQ ID NO: 1274121 - RNA, 12 nt, Mycobacterium tuberculosis H37Rv
caacgcugcagc

SEQ ID NO: 1274122 - RNA, 16 nt, Mycobacterium tuberculosis H37Rv
caacgcugcagcaggu

SEQ ID NO: 1274123 - RNA, 22 nt, Mycobacterium tuberculosis H37Rv
caacgcugcagcaggucgaugc

SEQ ID NO: 1274124 - RNA, 14 nt, Mycobacterium tuberculosis H37Rv
caacgcccgggcga

SEQ ID NO: 1274125 - RNA, 17 nt, Mycobacterium tuberculosis H37Rv
caacgccggcgacggcg

SEQ ID NO: 1274126 - RNA, 18 nt, Mycobacterium tuberculosis H37Rv
caacgccucugcucagcc

SEQ ID NO: 1274127 - RNA, 15 nt, Mycobacterium tuberculosis H37Rv
caacgcgcaaccagc

SEQ ID NO: 1274128 - RNA, 15 nt, Mycobacterium tuberculosis H37Rv
caacgcgcagagcgu

SEQ ID NO: 1274129 - RNA, 14 nt, Mycobacterium tuberculosis H37Rv
caacgaaaccgacc

SEQ ID NO: 1274130 - RNA, 14 nt, Mycobacterium tuberculosis H37Rv
caacgacggcaagc

SEQ ID NO: 1274131 - RNA, 15 nt, Mycobacterium tuberculosis H37Rv
caacgacacgccgca

SEQ ID NO: 1274132 - RNA, 18 nt, Mycobacterium tuberculosis H37Rv
caacgacuuucaucgcga

SEQ ID NO: 1274133 - RNA, 20 nt, Mycobacterium tuberculosis H37Rv
caacgagagcggcuccggga

SEQ ID NO: 1274134 - RNA, 23 nt, Mycobacterium tuberculosis H37Rv
caacgacuguggcgccgccggca

SEQ ID NO: 1274135 - RNA, 15 nt, Mycobacterium tuberculosis H37Rv
caacgagcgcgcugc

SEQ ID NO: 1274136 - RNA, 21 nt, Mycobacterium tuberculosis H37Rv
caacgcauuuggugucggcgc

SEQ ID NO: 1274137 - RNA, 18 nt, Mycobacterium tuberculosis H37Rv
caacgcaucgaugcgugc

SEQ ID NO: 1274138 - RNA, 17 nt, Mycobacterium tuberculosis H37Rv
caacgcauccgacaccc

SEQ ID NO: 1274139 - RNA, 18 nt, Mycobacterium tuberculosis H37Rv
caacgccaaaacggucga

SEQ ID NO: 1274140 - RNA, 20 nt, Mycobacterium tuberculosis H37Rv
caacgcccgcaucgccucga

SEQ ID NO: 1274141 - RNA, 15 nt, Mycobacterium tuberculosis H37Rv
caacgcccgcaucgc

SEQ ID NO: 1274142 - RNA, 20 nt, Mycobacterium tuberculosis H37Rv
caacgcccccauccggucga

SEQ ID NO: 1274143 - RNA, 21 nt, Mycobacterium tuberculosis H37Rv
caacgccaucaccccggccuu

SEQ ID NO: 1274144 - RNA, 13 nt, Mycobacterium tuberculosis H37Rv
caacgccagcugc

SEQ ID NO: 1274145 - RNA, 16 nt, Mycobacterium tuberculosis H37Rv
caacgcaaucgacuga

SEQ ID NO: 1274146 - RNA, 19 nt, Mycobacterium tuberculosis H37Rv
caacgcaaucgucgccuuc

SEQ ID NO: 1274147 - RNA, 14 nt, Mycobacterium tuberculosis H37Rv
caacgaucgcgcga

SEQ ID NO: 1274148 - RNA, 14 nt, Mycobacterium tuberculosis H37Rv
caacgagauccagc

SEQ ID NO: 1274149 - RNA, 23 nt, Mycobacterium tuberculosis H37Rv
caacgcaacacgggcgccggaac

SEQ ID NO: 1274150 - RNA, 19 nt, Mycobacterium tuberculosis H37Rv
caacgcagcacguucaggu

SEQ ID NO: 1274151 - RNA, 21 nt, Mycobacterium tuberculosis H37Rv
caacagcgcgguguucgcggc

SEQ ID NO: 1274152 - RNA, 20 nt, Mycobacterium tuberculosis H37Rv
caacagcggggugugcgguu

SEQ ID NO: 1274153 - RNA, 11 nt, Mycobacterium tuberculosis H37Rv
caacagcgggg

SEQ ID NO: 1274154 - RNA, 14 nt, Mycobacterium tuberculosis H37Rv
caacagccgcucgc

SEQ ID NO: 1274155 - RNA, 13 nt, Mycobacterium tuberculosis H37Rv
caacagccgaacu

SEQ ID NO: 1274156 - RNA, 19 nt, Mycobacterium tuberculosis H37Rv
caacaccucguaugccgug

SEQ ID NO: 1274157 - RNA, 14 nt, Mycobacterium tuberculosis H37Rv
caacaucagcagga

SEQ ID NO: 1274158 - RNA, 19 nt, Mycobacterium tuberculosis H37Rv
caacagggccaggacaacc

SEQ ID NO: 1274159 - RNA, 19 nt, Mycobacterium tuberculosis H37Rv
caacagcuuggagaucgcc

SEQ ID NO: 1274160 - RNA, 20 nt, Mycobacterium tuberculosis H37Rv
caacagcugggucaugccgu

SEQ ID NO: 1274161 - RNA, 14 nt, Mycobacterium tuberculosis H37Rv
caacaggccgucga

SEQ ID NO: 1274162 - RNA, 16 nt, Mycobacterium tuberculosis H37Rv
caacaggccggcucgc

SEQ ID NO: 1274163 - RNA, 21 nt, Mycobacterium tuberculosis H37Rv
caaccaccggaucggaacgau

SEQ ID NO: 1274164 - RNA, 18 nt, Mycobacterium tuberculosis H37Rv
caaccacgcacgguggcu

SEQ ID NO: 1274165 - RNA, 18 nt, Mycobacterium tuberculosis H37Rv
caaccaggugagcgacgc

SEQ ID NO: 1274166 - RNA, 15 nt, Mycobacterium tuberculosis H37Rv
caaccagcagcaggu

SEQ ID NO: 1274167 - RNA, 13 nt, Mycobacterium tuberculosis H37Rv
caaccagcauggc

SEQ ID NO: 1274168 - RNA, 21 nt, Mycobacterium tuberculosis H37Rv
caacccacacgcccucgacgc

SEQ ID NO: 1274169 - RNA, 13 nt, Mycobacterium tuberculosis H37Rv
caaccagcggcac

SEQ ID NO: 1274170 - RNA, 16 nt, Mycobacterium tuberculosis H37Rv
caacauuuucgcccgc

SEQ ID NO: 1274171 - RNA, 18 nt, Mycobacterium tuberculosis H37Rv
caacauugugcucgccga

SEQ ID NO: 1274172 - RNA, 20 nt, Mycobacterium tuberculosis H37Rv
caacauguugucgucgccgc

SEQ ID NO: 1274173 - RNA, 16 nt, Mycobacterium tuberculosis H37Rv
caacauguugucgucg

SEQ ID NO: 1274174 - RNA, 22 nt, Mycobacterium tuberculosis H37Rv
caacauccgguggugcucgucg

SEQ ID NO: 1274175 - RNA, 23 nt, Mycobacterium tuberculosis H37Rv
caacaugccggucauccgggcga

SEQ ID NO: 1274176 - RNA, 11 nt, Mycobacterium tuberculosis H37Rv
caaagcagcgc

SEQ ID NO: 1274177 - RNA, 18 nt, Mycobacterium tuberculosis H37Rv
caaaguuggccgcccgaa

SEQ ID NO: 1274178 - RNA, 15 nt, Mycobacterium tuberculosis H37Rv
caaagcggccucgac

SEQ ID NO: 1274179 - RNA, 18 nt, Mycobacterium tuberculosis H37Rv
caaagcugcucgucggcg

SEQ ID NO: 1274180 - RNA, 18 nt, Mycobacterium tuberculosis H37Rv
caaagccgaacgacagca

SEQ ID NO: 1274181 - RNA, 18 nt, Mycobacterium tuberculosis H37Rv
caacaccggcgaucaccg

SEQ ID NO: 1274182 - RNA, 14 nt, Mycobacterium tuberculosis H37Rv
caacaccggcgugg

SEQ ID NO: 1274183 - RNA, 14 nt, Mycobacterium tuberculosis H37Rv
caacaccgcccgca

SEQ ID NO: 1274184 - RNA, 15 nt, Mycobacterium tuberculosis H37Rv
caacaaggggcagca

SEQ ID NO: 1274185 - RNA, 21 nt, Mycobacterium tuberculosis H37Rv
caacaaggggcagcacgucac

SEQ ID NO: 1274186 - RNA, 21 nt, Mycobacterium tuberculosis H37Rv
cacugcccucaacgaucgcgc

SEQ ID NO: 1274187 - RNA, 22 nt, Mycobacterium tuberculosis H37Rv
cacugccgcgcucgcgcaccgu

SEQ ID NO: 1274188 - RNA, 17 nt, Mycobacterium tuberculosis H37Rv
cacugccggccaacuuc

SEQ ID NO: 1274189 - RNA, 22 nt, Mycobacterium tuberculosis H37Rv
cacugccuuaaccgagccgacc

SEQ ID NO: 1274190 - RNA, 20 nt, Mycobacterium tuberculosis H37Rv
cacugccguugccgccggug

SEQ ID NO: 1274191 - RNA, 16 nt, Mycobacterium tuberculosis H37Rv
cacuggguccacgcgc

SEQ ID NO: 1274192 - RNA, 19 nt, Mycobacterium tuberculosis H37Rv
cacugcgaaucuccgcgcg

SEQ ID NO: 1274193 - RNA, 10 nt, Mycobacterium tuberculosis H37Rv
cacugcgagc

SEQ ID NO: 1274194 - RNA, 12 nt, Mycobacterium tuberculosis H37Rv
cacugaccgcgg

SEQ ID NO: 1274195 - RNA, 16 nt, Mycobacterium tuberculosis H37Rv
cacugaacaggccggu

SEQ ID NO: 1274196 - RNA, 16 nt, Mycobacterium tuberculosis H37Rv
cacucguugaccggcc

SEQ ID NO: 1274197 - RNA, 23 nt, Mycobacterium tuberculosis H37Rv
cacucggucguugccgcggucgg

SEQ ID NO: 1274198 - RNA, 20 nt, Mycobacterium tuberculosis H37Rv
cacucggucucgauccagcg

SEQ ID NO: 1274199 - RNA, 18 nt, Mycobacterium tuberculosis H37Rv
cacucggggacggcgaau

SEQ ID NO: 1274200 - RNA, 22 nt, Mycobacterium tuberculosis H37Rv
cacucggggcugucggcgaugg

SEQ ID NO: 1274201 - RNA, 12 nt, Mycobacterium tuberculosis H37Rv
cacguucgcggc

SEQ ID NO: 1274202 - RNA, 17 nt, Mycobacterium tuberculosis H37Rv
cacguucagcccaugcc

SEQ ID NO: 1274203 - RNA, 19 nt, Mycobacterium tuberculosis H37Rv
cacguucgguggagggcga

SEQ ID NO: 1274204 - RNA, 15 nt, Mycobacterium tuberculosis H37Rv
cacguucggcgucgu

SEQ ID NO: 1274205 - RNA, 19 nt, Mycobacterium tuberculosis H37Rv
cacguucggcgcacagcga

SEQ ID NO: 1274206 - RNA, 12 nt, Mycobacterium tuberculosis H37Rv
cacguucggcgu

SEQ ID NO: 1274207 - RNA, 13 nt, Mycobacterium tuberculosis H37Rv
cacguucggcguc

SEQ ID NO: 1274208 - RNA, 23 nt, Mycobacterium tuberculosis H37Rv
cacguuuacauagaccaccggca

SEQ ID NO: 1274209 - RNA, 14 nt, Mycobacterium tuberculosis H37Rv
cacguuugccggcc

SEQ ID NO: 1274210 - RNA, 21 nt, Mycobacterium tuberculosis H37Rv
cacuaccccacaagcgauggc

SEQ ID NO: 1274211 - RNA, 22 nt, Mycobacterium tuberculosis H37Rv
cacuacggccuggccaccuggu

SEQ ID NO: 1274212 - RNA, 22 nt, Mycobacterium tuberculosis H37Rv
cacucgaccaggaccggcugca

SEQ ID NO: 1274213 - RNA, 23 nt, Mycobacterium tuberculosis H37Rv
cacuagcgccccuggcaccucgc

SEQ ID NO: 1274214 - RNA, 13 nt, Mycobacterium tuberculosis H37Rv
cacucgacgucgu

SEQ ID NO: 1274215 - RNA, 23 nt, Mycobacterium tuberculosis H37Rv
cacucgaugcuuucguauucggc

SEQ ID NO: 1274216 - RNA, 16 nt, Mycobacterium tuberculosis H37Rv
cacucgccagggccau

SEQ ID NO: 1274217 - RNA, 12 nt, Mycobacterium tuberculosis H37Rv
cacucggaaucg

SEQ ID NO: 1274218 - RNA, 20 nt, Mycobacterium tuberculosis H37Rv
cacucgcccgauccggaucc

SEQ ID NO: 1274219 - RNA, 17 nt, Mycobacterium tuberculosis H37Rv
cacgucgacaccgagga

SEQ ID NO: 1274220 - RNA, 19 nt, Mycobacterium tuberculosis H37Rv
cacgucgaucucccaguga

SEQ ID NO: 1274221 - RNA, 22 nt, Mycobacterium tuberculosis H37Rv
cacgucgaucucccagugagca

SEQ ID NO: 1274222 - RNA, 14 nt, Mycobacterium tuberculosis H37Rv
cacguccggcgaug

SEQ ID NO: 1274223 - RNA, 16 nt, Mycobacterium tuberculosis H37Rv
cacguccggcgaugac

SEQ ID NO: 1274224 - RNA, 12 nt, Mycobacterium tuberculosis H37Rv
cacguccgcgga

SEQ ID NO: 1274225 - RNA, 20 nt, Mycobacterium tuberculosis H37Rv
cacguccucgacccggcgca

SEQ ID NO: 1274226 - RNA, 18 nt, Mycobacterium tuberculosis H37Rv
cacguccugaaucgguuc

SEQ ID NO: 1274227 - RNA, 21 nt, Mycobacterium tuberculosis H37Rv
cacguccaacucggcccgggu

SEQ ID NO: 1274228 - RNA, 23 nt, Mycobacterium tuberculosis H37Rv
cacgucaucuggcgcugcuggca

SEQ ID NO: 1274229 - RNA, 17 nt, Mycobacterium tuberculosis H37Rv
cacguauccacggucga

SEQ ID NO: 1274230 - RNA, 20 nt, Mycobacterium tuberculosis H37Rv
cacguauccacggucgacca

SEQ ID NO: 1274231 - RNA, 20 nt, Mycobacterium tuberculosis H37Rv
cacgucagcggaugggcuga

SEQ ID NO: 1274232 - RNA, 16 nt, Mycobacterium tuberculosis H37Rv
cacguagcgaccgcgg

SEQ ID NO: 1274233 - RNA, 20 nt, Mycobacterium tuberculosis H37Rv
cacguagaaguaggcggcga

SEQ ID NO: 1274234 - RNA, 14 nt, Mycobacterium tuberculosis H37Rv
cacguacucggcca

SEQ ID NO: 1274235 - RNA, 17 nt, Mycobacterium tuberculosis H37Rv
cacguacucggccagcu

SEQ ID NO: 1274236 - RNA, 15 nt, Mycobacterium tuberculosis H37Rv
cacguggugggcgca

SEQ ID NO: 1274237 - RNA, 14 nt, Mycobacterium tuberculosis H37Rv
cacgugugcgggca

SEQ ID NO: 1274238 - RNA, 14 nt, Mycobacterium tuberculosis H37Rv
cacguuacgcucgc

SEQ ID NO: 1274239 - RNA, 19 nt, Mycobacterium tuberculosis H37Rv
cacguggucgagcaggcga

SEQ ID NO: 1274240 - RNA, 13 nt, Mycobacterium tuberculosis H37Rv
cacguggucggca

SEQ ID NO: 1274241 - RNA, 17 nt, Mycobacterium tuberculosis H37Rv
cacgugaucagaucggg

SEQ ID NO: 1274242 - RNA, 20 nt, Mycobacterium tuberculosis H37Rv
cacgugccaaaugaugacga

SEQ ID NO: 1274243 - RNA, 17 nt, Mycobacterium tuberculosis H37Rv
cacgucuccuucggcga

SEQ ID NO: 1274244 - RNA, 22 nt, Mycobacterium tuberculosis H37Rv
cacgucuugcugcacgcucugc

SEQ ID NO: 1274245 - RNA, 19 nt, Mycobacterium tuberculosis H37Rv
cacgugaaagccgaccagc

SEQ ID NO: 1274246 - RNA, 15 nt, Mycobacterium tuberculosis H37Rv
cacgucgucucggcg

SEQ ID NO: 1274247 - RNA, 21 nt, Mycobacterium tuberculosis H37Rv
cacgucgucgcccaggcgugu

SEQ ID NO: 1274248 - RNA, 12 nt, Mycobacterium tuberculosis H37Rv
cacgucgcccag

SEQ ID NO: 1274249 - RNA, 18 nt, Mycobacterium tuberculosis H37Rv
cagagccgcgcgccgguu

SEQ ID NO: 1274250 - RNA, 17 nt, Mycobacterium tuberculosis H37Rv
cagagccgggcuggccg

SEQ ID NO: 1274251 - RNA, 16 nt, Mycobacterium tuberculosis H37Rv
cagagccgucgaagcg

SEQ ID NO: 1274252 - RNA, 14 nt, Mycobacterium tuberculosis H37Rv
cagagccccggcaa

SEQ ID NO: 1274253 - RNA, 23 nt, Mycobacterium tuberculosis H37Rv
cagacggugaagccgagcgcccg

SEQ ID NO: 1274254 - RNA, 14 nt, Mycobacterium tuberculosis H37Rv
cagacggggaucgg

SEQ ID NO: 1274255 - RNA, 14 nt, Mycobacterium tuberculosis H37Rv
cagaccgcaccauu

SEQ ID NO: 1274256 - RNA, 18 nt, Mycobacterium tuberculosis H37Rv
cagaccgaucggcaggcc

SEQ ID NO: 1274257 - RNA, 12 nt, Mycobacterium tuberculosis H37Rv
cagaccgccgaa

SEQ ID NO: 1274258 - RNA, 16 nt, Mycobacterium tuberculosis H37Rv
cagaccgcgaacagcg

SEQ ID NO: 1274259 - RNA, 15 nt, Mycobacterium tuberculosis H37Rv
cagaccggccgacgu

SEQ ID NO: 1274260 - RNA, 21 nt, Mycobacterium tuberculosis H37Rv
cagaccuagcaccgcgccgaa

SEQ ID NO: 1274261 - RNA, 20 nt, Mycobacterium tuberculosis H37Rv
cagaccuagcaccgcgccga

SEQ ID NO: 1274262 - RNA, 14 nt, Mycobacterium tuberculosis H37Rv
cagaccguccagca

SEQ ID NO: 1274263 - RNA, 20 nt, Mycobacterium tuberculosis H37Rv
cagaccguccagcaacagcg

SEQ ID NO: 1274264 - RNA, 11 nt, Mycobacterium tuberculosis H37Rv
cagaccggugc

SEQ ID NO: 1274265 - RNA, 16 nt, Mycobacterium tuberculosis H37Rv
cagaccggcucgucgg

SEQ ID NO: 1274266 - RNA, 16 nt, Mycobacterium tuberculosis H37Rv
cagacgacgaucagcc

SEQ ID NO: 1274267 - RNA, 14 nt, Mycobacterium tuberculosis H37Rv
cagacgacgucggc

SEQ ID NO: 1274268 - RNA, 13 nt, Mycobacterium tuberculosis H37Rv
cagacgaccaggg

SEQ ID NO: 1274269 - RNA, 16 nt, Mycobacterium tuberculosis H37Rv
cagacgcggaaucgca

SEQ ID NO: 1274270 - RNA, 16 nt, Mycobacterium tuberculosis H37Rv
cagacgccgacuccgc

SEQ ID NO: 1274271 - RNA, 17 nt, Mycobacterium tuberculosis H37Rv
cagaccagggcagcggc

SEQ ID NO: 1274272 - RNA, 22 nt, Mycobacterium tuberculosis H37Rv
cagacccgugccgucaacgaug

SEQ ID NO: 1274273 - RNA, 17 nt, Mycobacterium tuberculosis H37Rv
cagacccgagcgcucga

SEQ ID NO: 1274274 - RNA, 17 nt, Mycobacterium tuberculosis H37Rv
cagaccgaucggcaggc

SEQ ID NO: 1274275 - RNA, 13 nt, Mycobacterium tuberculosis H37Rv
cagaccgaucggc

SEQ ID NO: 1274276 - RNA, 12 nt, Mycobacterium tuberculosis H37Rv
cagaccgacugc

SEQ ID NO: 1274277 - RNA, 19 nt, Mycobacterium tuberculosis H37Rv
cagaccagggcagcggcca

SEQ ID NO: 1274278 - RNA, 14 nt, Mycobacterium tuberculosis H37Rv
cagacccagcucgu

SEQ ID NO: 1274279 - RNA, 20 nt, Mycobacterium tuberculosis H37Rv
cagaaggaucagcgcacugg

SEQ ID NO: 1274280 - RNA, 18 nt, Mycobacterium tuberculosis H37Rv
cagaaucaggcucgccga

SEQ ID NO: 1274281 - RNA, 18 nt, Mycobacterium tuberculosis H37Rv
cagaccaccgugaccgag

SEQ ID NO: 1274282 - RNA, 20 nt, Mycobacterium tuberculosis H37Rv
cacuggugcagcgccgacag

SEQ ID NO: 1274283 - RNA, 21 nt, Mycobacterium tuberculosis H37Rv
cacuggugaucugguccggca

SEQ ID NO: 1274284 - RNA, 13 nt, Mycobacterium tuberculosis H37Rv
cacuggugcagcg

SEQ ID NO: 1274285 - RNA, 18 nt, Mycobacterium tuberculosis H37Rv
cacuguaccgggcgacac

SEQ ID NO: 1274286 - RNA, 16 nt, Mycobacterium tuberculosis H37Rv
cacuguuggugccgcc

SEQ ID NO: 1274287 - RNA, 20 nt, Mycobacterium tuberculosis H37Rv
cacuguuggugccgccacca

SEQ ID NO: 1274288 - RNA, 18 nt, Mycobacterium tuberculosis H37Rv
cacuguugcccaauucga

SEQ ID NO: 1274289 - RNA, 22 nt, Mycobacterium tuberculosis H37Rv
cacuguugcccuugggacugcg

SEQ ID NO: 1274290 - RNA, 16 nt, Mycobacterium tuberculosis H37Rv
cacuguuacggccaca

SEQ ID NO: 1274291 - RNA, 13 nt, Mycobacterium tuberculosis H37Rv
cacugugcucgcc

SEQ ID NO: 1274292 - RNA, 15 nt, Mycobacterium tuberculosis H37Rv
cacugugcgccugcg

SEQ ID NO: 1274293 - RNA, 14 nt, Mycobacterium tuberculosis H37Rv
cagaaaccggguag

SEQ ID NO: 1274294 - RNA, 15 nt, Mycobacterium tuberculosis H37Rv
cagaaaccggguagc

SEQ ID NO: 1274295 - RNA, 19 nt, Mycobacterium tuberculosis H37Rv
cagaaacaccgacgacggc

SEQ ID NO: 1274296 - RNA, 22 nt, Mycobacterium tuberculosis H37Rv
cacgcugcccaaaaggaagacc

SEQ ID NO: 1274297 - RNA, 19 nt, Mycobacterium tuberculosis H37Rv
cacgcuggaacuuggcguc

SEQ ID NO: 1274298 - RNA, 13 nt, Mycobacterium tuberculosis H37Rv
cacgcugcugcgg

SEQ ID NO: 1274299 - RNA, 14 nt, Mycobacterium tuberculosis H37Rv
cacgcuggccucgu

SEQ ID NO: 1274300 - RNA, 21 nt, Mycobacterium tuberculosis H37Rv
cacgcuggaacuuggcgucga

SEQ ID NO: 1274301 - RNA, 13 nt, Mycobacterium tuberculosis H37Rv
cacgcuggcguug

SEQ ID NO: 1274302 - RNA, 20 nt, Mycobacterium tuberculosis H37Rv
cacggacggucgggcggauc

SEQ ID NO: 1274303 - RNA, 15 nt, Mycobacterium tuberculosis H37Rv
cacggaccgccaccu

SEQ ID NO: 1274304 - RNA, 22 nt, Mycobacterium tuberculosis H37Rv
cacggacccgaagucacaggau

SEQ ID NO: 1274305 - RNA, 16 nt, Mycobacterium tuberculosis H37Rv
cacggaaguaucgccg

SEQ ID NO: 1274306 - RNA, 16 nt, Mycobacterium tuberculosis H37Rv
cacgcuguccgcguga

SEQ ID NO: 1274307 - RNA, 22 nt, Mycobacterium tuberculosis H37Rv
cacgcugucccgcgggccagca

SEQ ID NO: 1274308 - RNA, 16 nt, Mycobacterium tuberculosis H37Rv
cacgcugugcucgacg

SEQ ID NO: 1274309 - RNA, 22 nt, Mycobacterium tuberculosis H37Rv
cacgcuucggccugugcgggca

SEQ ID NO: 1274310 - RNA, 17 nt, Mycobacterium tuberculosis H37Rv
cacggcaagcgugaccc

SEQ ID NO: 1274311 - RNA, 21 nt, Mycobacterium tuberculosis H37Rv
cacggcacccacccguucggc

SEQ ID NO: 1274312 - RNA, 14 nt, Mycobacterium tuberculosis H37Rv
cacggcaccgauca

SEQ ID NO: 1274313 - RNA, 13 nt, Mycobacterium tuberculosis H37Rv
cacggcagcugca

SEQ ID NO: 1274314 - RNA, 13 nt, Mycobacterium tuberculosis H37Rv
cacggcagcgccc

SEQ ID NO: 1274315 - RNA, 13 nt, Mycobacterium tuberculosis H37Rv
cacggauucgggc

SEQ ID NO: 1274316 - RNA, 24 nt, Mycobacterium tuberculosis H37Rv
cacggaugucgcccaaccgaaccg

SEQ ID NO: 1274317 - RNA, 21 nt, Mycobacterium tuberculosis H37Rv
cacggaugcgauggccgacgc

SEQ ID NO: 1274318 - RNA, 19 nt, Mycobacterium tuberculosis H37Rv
cacggcaaaggcgcucugc

SEQ ID NO: 1274319 - RNA, 17 nt, Mycobacterium tuberculosis H37Rv
cacggccaggucgacgg

SEQ ID NO: 1274320 - RNA, 15 nt, Mycobacterium tuberculosis H37Rv
cacggccaugaucac

SEQ ID NO: 1274321 - RNA, 15 nt, Mycobacterium tuberculosis H37Rv
cacggccaggucgac

SEQ ID NO: 1274322 - RNA, 23 nt, Mycobacterium tuberculosis H37Rv
cacggccccugccacgacgaaca

SEQ ID NO: 1274323 - RNA, 17 nt, Mycobacterium tuberculosis H37Rv
cacgcgcucaccgacgc

SEQ ID NO: 1274324 - RNA, 22 nt, Mycobacterium tuberculosis H37Rv
cacgcggaaaccaucgccagcc

SEQ ID NO: 1274325 - RNA, 18 nt, Mycobacterium tuberculosis H37Rv
cacgcggaccucgaagcc

SEQ ID NO: 1274326 - RNA, 13 nt, Mycobacterium tuberculosis H37Rv
cacgcggaccucg

SEQ ID NO: 1274327 - RNA, 18 nt, Mycobacterium tuberculosis H37Rv
cacgcgcccgcaccaccg

SEQ ID NO: 1274328 - RNA, 20 nt, Mycobacterium tuberculosis H37Rv
caccucccagggcucggcgg

SEQ ID NO: 1274329 - RNA, 19 nt, Mycobacterium tuberculosis H37Rv
caccguuugggcgccggug

SEQ ID NO: 1274330 - RNA, 16 nt, Mycobacterium tuberculosis H37Rv
caccguuugcgcaccg

SEQ ID NO: 1274331 - RNA, 18 nt, Mycobacterium tuberculosis H37Rv
caccguuugcgcaccggu

SEQ ID NO: 1274332 - RNA, 18 nt, Mycobacterium tuberculosis H37Rv
caccguuugagcggccac

SEQ ID NO: 1274333 - RNA, 15 nt, Mycobacterium tuberculosis H37Rv
caccuccagcaccac

SEQ ID NO: 1274334 - RNA, 18 nt, Mycobacterium tuberculosis H37Rv
caccguuaccgccgucgc

SEQ ID NO: 1274335 - RNA, 19 nt, Mycobacterium tuberculosis H37Rv
cacgcgucuucggucgcgg

SEQ ID NO: 1274336 - RNA, 15 nt, Mycobacterium tuberculosis H37Rv
cacgcguuccacugg

SEQ ID NO: 1274337 - RNA, 17 nt, Mycobacterium tuberculosis H37Rv
cacgcguugacgaucuc

SEQ ID NO: 1274338 - RNA, 20 nt, Mycobacterium tuberculosis H37Rv
cacgcgggcacugguggcga

SEQ ID NO: 1274339 - RNA, 18 nt, Mycobacterium tuberculosis H37Rv
cacgcggcgaugauggcg

SEQ ID NO: 1274340 - RNA, 15 nt, Mycobacterium tuberculosis H37Rv
cacgcuccagcucgg

SEQ ID NO: 1274341 - RNA, 14 nt, Mycobacterium tuberculosis H37Rv
cacgcucgcgcacc

SEQ ID NO: 1274342 - RNA, 13 nt, Mycobacterium tuberculosis H37Rv
cacgcucggcgcc

SEQ ID NO: 1274343 - RNA, 15 nt, Mycobacterium tuberculosis H37Rv
cacgcucggcgccgu

SEQ ID NO: 1274344 - RNA, 22 nt, Mycobacterium tuberculosis H37Rv
cacgcucggugcugcgccgaua

SEQ ID NO: 1274345 - RNA, 20 nt, Mycobacterium tuberculosis H37Rv
cacgcucgugacgaucagcg

SEQ ID NO: 1274346 - RNA, 18 nt, Mycobacterium tuberculosis H37Rv
cacgcucaugaccgcucg

SEQ ID NO: 1274347 - RNA, 14 nt, Mycobacterium tuberculosis H37Rv
cacgcucacccggc

SEQ ID NO: 1274348 - RNA, 12 nt, Mycobacterium tuberculosis H37Rv
cacggccgucga

SEQ ID NO: 1274349 - RNA, 21 nt, Mycobacterium tuberculosis H37Rv
cacggccgucauuuccacauc

SEQ ID NO: 1274350 - RNA, 16 nt, Mycobacterium tuberculosis H37Rv
cacggccgcagccgau

SEQ ID NO: 1274351 - RNA, 19 nt, Mycobacterium tuberculosis H37Rv
cacggccggauacggcgac

SEQ ID NO: 1274352 - RNA, 18 nt, Mycobacterium tuberculosis H37Rv
cacggccggccgcugcca

SEQ ID NO: 1274353 - RNA, 16 nt, Mycobacterium tuberculosis H37Rv
aaacugccgcggcacc

SEQ ID NO: 1274354 - RNA, 13 nt, Mycobacterium tuberculosis H37Rv
cacggcgauccgg

SEQ ID NO: 1274355 - RNA, 13 nt, Mycobacterium tuberculosis H37Rv
cacggcgaggccg

SEQ ID NO: 1274356 - RNA, 21 nt, Mycobacterium tuberculosis H37Rv
cacggcgacauacccgaucaa

SEQ ID NO: 1274357 - RNA, 18 nt, Mycobacterium tuberculosis H37Rv
cacggcgaccacgccgcc

SEQ ID NO: 1274358 - RNA, 12 nt, Mycobacterium tuberculosis H37Rv
cacggcggccac

SEQ ID NO: 1274359 - RNA, 22 nt, Mycobacterium tuberculosis H37Rv
cacggcggccaccugcuggccg

SEQ ID NO: 1274360 - RNA, 15 nt, Mycobacterium tuberculosis H37Rv
cacggcgcguuggga

SEQ ID NO: 1274361 - RNA, 22 nt, Mycobacterium tuberculosis H37Rv
cacggcgcguugggaccagugc

SEQ ID NO: 1274362 - RNA, 21 nt, Mycobacterium tuberculosis H37Rv
cacggcugcccaugguggcga

SEQ ID NO: 1274363 - RNA, 15 nt, Mycobacterium tuberculosis H37Rv
cacggcguggucggc

SEQ ID NO: 1274364 - RNA, 18 nt, Mycobacterium tuberculosis H37Rv
cacgggaaucgcucgcgc

SEQ ID NO: 1274365 - RNA, 21 nt, Mycobacterium tuberculosis H37Rv
cacggcuuugcggcgcgacca

SEQ ID NO: 1274366 - RNA, 14 nt, Mycobacterium tuberculosis H37Rv
cacggcuucggcga

SEQ ID NO: 1274367 - RNA, 13 nt, Mycobacterium tuberculosis H37Rv
cacggcuucggcg

SEQ ID NO: 1274368 - RNA, 19 nt, Mycobacterium tuberculosis H37Rv
cacggcuaccccgcagaau

SEQ ID NO: 1274369 - RNA, 21 nt, Mycobacterium tuberculosis H37Rv
cacggcgucuuccucggccac

SEQ ID NO: 1274370 - RNA, 14 nt, Mycobacterium tuberculosis H37Rv
cacggcgucggcca

SEQ ID NO: 1274371 - RNA, 13 nt, Mycobacterium tuberculosis H37Rv
cacggucaagccg

SEQ ID NO: 1274372 - RNA, 12 nt, Mycobacterium tuberculosis H37Rv
cacgggugacuc

SEQ ID NO: 1274373 - RNA, 13 nt, Mycobacterium tuberculosis H37Rv
cacggucaugccg

SEQ ID NO: 1274374 - RNA, 22 nt, Mycobacterium tuberculosis H37Rv
cacggucauugggugucaaugu

SEQ ID NO: 1274375 - RNA, 22 nt, Mycobacterium tuberculosis H37Rv
cacggucgccgaccacucgagc

SEQ ID NO: 1274376 - RNA, 20 nt, Mycobacterium tuberculosis H37Rv
cacggucgcccgaucggcgg

SEQ ID NO: 1274377 - RNA, 12 nt, Mycobacterium tuberculosis H37Rv
cacggucgacga

SEQ ID NO: 1274378 - RNA, 19 nt, Mycobacterium tuberculosis H37Rv
cacggucgaccaggacggu

SEQ ID NO: 1274379 - RNA, 16 nt, Mycobacterium tuberculosis H37Rv
cacggucgaccaggac

SEQ ID NO: 1274380 - RNA, 17 nt, Mycobacterium tuberculosis H37Rv
cacggcuuuucgacgcu

SEQ ID NO: 1274381 - RNA, 22 nt, Mycobacterium tuberculosis H37Rv
cacgggcagauacgccaaccgc

SEQ ID NO: 1274382 - RNA, 15 nt, Mycobacterium tuberculosis H37Rv
cacgggcggccaccg

SEQ ID NO: 1274383 - RNA, 17 nt, Mycobacterium tuberculosis H37Rv
cacgggguccgaugcgu

SEQ ID NO: 1274384 - RNA, 23 nt, Mycobacterium tuberculosis H37Rv
cacgggcgucgucgguaaugccg

SEQ ID NO: 1274385 - RNA, 19 nt, Mycobacterium tuberculosis H37Rv
cacggugccgacgaugacg

SEQ ID NO: 1274386 - RNA, 14 nt, Mycobacterium tuberculosis H37Rv
cacggugccggcac

SEQ ID NO: 1274387 - RNA, 18 nt, Mycobacterium tuberculosis H37Rv
cacggugccgccgucgau

SEQ ID NO: 1274388 - RNA, 20 nt, Mycobacterium tuberculosis H37Rv
cacgguggccgcaucgacgc

SEQ ID NO: 1274389 - RNA, 16 nt, Mycobacterium tuberculosis H37Rv
cacggugaacaauccg

SEQ ID NO: 1274390 - RNA, 13 nt, Mycobacterium tuberculosis H37Rv
cacgguggcuucg

SEQ ID NO: 1274391 - RNA, 22 nt, Mycobacterium tuberculosis H37Rv
cacgguggcucuguagcgucgc

SEQ ID NO: 1274392 - RNA, 18 nt, Mycobacterium tuberculosis H37Rv
cacggugggcgccgacac

SEQ ID NO: 1274393 - RNA, 19 nt, Mycobacterium tuberculosis H37Rv
cacgguugccgcgaucggg

SEQ ID NO: 1274394 - RNA, 15 nt, Mycobacterium tuberculosis H37Rv
cacgguuggccacca

SEQ ID NO: 1274395 - RNA, 21 nt, Mycobacterium tuberculosis H37Rv
cacgguugccggcggcgacgu

SEQ ID NO: 1274396 - RNA, 14 nt, Mycobacterium tuberculosis H37Rv
cacgguugccguca

SEQ ID NO: 1274397 - RNA, 22 nt, Mycobacterium tuberculosis H37Rv
cacgguugccgucagggucagc

SEQ ID NO: 1274398 - RNA, 19 nt, Mycobacterium tuberculosis H37Rv
cacgguuuucgagggaugg

SEQ ID NO: 1274399 - RNA, 21 nt, Mycobacterium tuberculosis H37Rv
cacgguucgggcagcacccgc

SEQ ID NO: 1274400 - RNA, 22 nt, Mycobacterium tuberculosis H37Rv
cagcgaaaugcccaucaccaga

SEQ ID NO: 1274401 - RNA, 21 nt, Mycobacterium tuberculosis H37Rv
cagcgaaaugcccaucaccag

SEQ ID NO: 1274402 - RNA, 15 nt, Mycobacterium tuberculosis H37Rv
cagcgaaaaccgucg

SEQ ID NO: 1274403 - RNA, 20 nt, Mycobacterium tuberculosis H37Rv
cagcgaaacaccggccagcg

SEQ ID NO: 1274404 - RNA, 20 nt, Mycobacterium tuberculosis H37Rv
cagcgaccaaugcagugcga

SEQ ID NO: 1274405 - RNA, 21 nt, Mycobacterium tuberculosis H37Rv
cagcgacagcugccugaccgg

SEQ ID NO: 1274406 - RNA, 16 nt, Mycobacterium tuberculosis H37Rv
cagcgacaugcccgcc

SEQ ID NO: 1274407 - RNA, 19 nt, Mycobacterium tuberculosis H37Rv
cagcgacaugcccgccaau

SEQ ID NO: 1274408 - RNA, 16 nt, Mycobacterium tuberculosis H37Rv
cagcgaaccaccggcg

SEQ ID NO: 1274409 - RNA, 13 nt, Mycobacterium tuberculosis H37Rv
cagcgaaccgccg

SEQ ID NO: 1274410 - RNA, 20 nt, Mycobacterium tuberculosis H37Rv
cagcgaccucacgaaucgcu

SEQ ID NO: 1274411 - RNA, 17 nt, Mycobacterium tuberculosis H37Rv
cagcgacgagaucagcc

SEQ ID NO: 1274412 - RNA, 12 nt, Mycobacterium tuberculosis H37Rv
cagcgaccggua

SEQ ID NO: 1274413 - RNA, 19 nt, Mycobacterium tuberculosis H37Rv
cagcgacgaccacaccacg

SEQ ID NO: 1274414 - RNA, 17 nt, Mycobacterium tuberculosis H37Rv
cagcgacgccaugucga

SEQ ID NO: 1274415 - RNA, 13 nt, Mycobacterium tuberculosis H37Rv
cagcgacgccggc

SEQ ID NO: 1274416 - RNA, 18 nt, Mycobacterium tuberculosis H37Rv
cagcgacuugcggugcuc

SEQ ID NO: 1274417 - RNA, 14 nt, Mycobacterium tuberculosis H37Rv
cagcgagacgucga

SEQ ID NO: 1274418 - RNA, 17 nt, Mycobacterium tuberculosis H37Rv
cagcgagcauaccgccg

SEQ ID NO: 1274419 - RNA, 22 nt, Mycobacterium tuberculosis H37Rv
cagccguucucgcccacccgcu

SEQ ID NO: 1274420 - RNA, 15 nt, Mycobacterium tuberculosis H37Rv
cagccuccaccaggu

SEQ ID NO: 1274421 - RNA, 14 nt, Mycobacterium tuberculosis H37Rv
cagccggccgcgac

SEQ ID NO: 1274422 - RNA, 20 nt, Mycobacterium tuberculosis H37Rv
cagccggcccugcggccaau

SEQ ID NO: 1274423 - RNA, 18 nt, Mycobacterium tuberculosis H37Rv
cagccggccauacgcgcg

SEQ ID NO: 1274424 - RNA, 18 nt, Mycobacterium tuberculosis H37Rv
cagccugauauccgcgga

SEQ ID NO: 1274425 - RNA, 16 nt, Mycobacterium tuberculosis H37Rv
cagcgcaucgccgcug

SEQ ID NO: 1274426 - RNA, 13 nt, Mycobacterium tuberculosis H37Rv
cagcgcaucgccg

SEQ ID NO: 1274427 - RNA, 18 nt, Mycobacterium tuberculosis H37Rv
cagcgcaucguugccgca

SEQ ID NO: 1274428 - RNA, 20 nt, Mycobacterium tuberculosis H37Rv
cagcgcauggacgaacgcgg

SEQ ID NO: 1274429 - RNA, 20 nt, Mycobacterium tuberculosis H37Rv
cagcgcauuucggaucucga

SEQ ID NO: 1274430 - RNA, 16 nt, Mycobacterium tuberculosis H37Rv
cagcgccaagacgucg

SEQ ID NO: 1274431 - RNA, 17 nt, Mycobacterium tuberculosis H37Rv
cagcgccaagacgucgg

SEQ ID NO: 1274432 - RNA, 17 nt, Mycobacterium tuberculosis H37Rv
cagcgaugcggcguugg

SEQ ID NO: 1274433 - RNA, 13 nt, Mycobacterium tuberculosis H37Rv
cagcgauucagcc

SEQ ID NO: 1274434 - RNA, 18 nt, Mycobacterium tuberculosis H37Rv
cagcgcaacaucgaaaac

SEQ ID NO: 1274435 - RNA, 15 nt, Mycobacterium tuberculosis H37Rv
cagcgcaaccgaccg

SEQ ID NO: 1274436 - RNA, 17 nt, Mycobacterium tuberculosis H37Rv
cagcgcaaccgaccggg

SEQ ID NO: 1274437 - RNA, 14 nt, Mycobacterium tuberculosis H37Rv
cagcgcaacaucga

SEQ ID NO: 1274438 - RNA, 19 nt, Mycobacterium tuberculosis H37Rv
cagcgcaaagcccuccucg

SEQ ID NO: 1274439 - RNA, 19 nt, Mycobacterium tuberculosis H37Rv
cagcgccagugccucgcgg

SEQ ID NO: 1274440 - RNA, 20 nt, Mycobacterium tuberculosis H37Rv
cagcgccaggggugugccgu

SEQ ID NO: 1274441 - RNA, 19 nt, Mycobacterium tuberculosis H37Rv
cagcgccaucgaugcggug

SEQ ID NO: 1274442 - RNA, 15 nt, Mycobacterium tuberculosis H37Rv
cagcgccaugcuguc

SEQ ID NO: 1274443 - RNA, 21 nt, Mycobacterium tuberculosis H37Rv
cagcgccaccgaccgagucga

SEQ ID NO: 1274444 - RNA, 18 nt, Mycobacterium tuberculosis H37Rv
cagcgccacccgaucggg

SEQ ID NO: 1274445 - RNA, 13 nt, Mycobacterium tuberculosis H37Rv
cagcgccacccga

SEQ ID NO: 1274446 - RNA, 20 nt, Mycobacterium tuberculosis H37Rv
cagcgccaccguuaccgccg

SEQ ID NO: 1274447 - RNA, 15 nt, Mycobacterium tuberculosis H37Rv
cagcgccaccguuac

SEQ ID NO: 1274448 - RNA, 14 nt, Mycobacterium tuberculosis H37Rv
cagcgccgccggca

SEQ ID NO: 1274449 - RNA, 15 nt, Mycobacterium tuberculosis H37Rv
cagcgccgccggcac

SEQ ID NO: 1274450 - RNA, 15 nt, Mycobacterium tuberculosis H37Rv
cagcgccgccgaggu

SEQ ID NO: 1274451 - RNA, 22 nt, Mycobacterium tuberculosis H37Rv
cagcgccgcgccccagacgcgc

SEQ ID NO: 1274452 - RNA, 19 nt, Mycobacterium tuberculosis H37Rv
cagcgccgcggcccgcucg

SEQ ID NO: 1274453 - RNA, 19 nt, Mycobacterium tuberculosis H37Rv
cagcgccgcgcgcgccgca

SEQ ID NO: 1274454 - RNA, 17 nt, Mycobacterium tuberculosis H37Rv
cagcgcccagaucgccg

SEQ ID NO: 1274455 - RNA, 14 nt, Mycobacterium tuberculosis H37Rv
cagcccgcgcagca

SEQ ID NO: 1274456 - RNA, 14 nt, Mycobacterium tuberculosis H37Rv
cagcccggacgcgc

SEQ ID NO: 1274457 - RNA, 19 nt, Mycobacterium tuberculosis H37Rv
cagcccgcuggccuccugg

SEQ ID NO: 1274458 - RNA, 16 nt, Mycobacterium tuberculosis H37Rv
cagcccggccggucga

SEQ ID NO: 1274459 - RNA, 19 nt, Mycobacterium tuberculosis H37Rv
cagcccggcacugaccgcg

SEQ ID NO: 1274460 - RNA, 17 nt, Mycobacterium tuberculosis H37Rv
cagccgagcggcggcac

SEQ ID NO: 1274461 - RNA, 21 nt, Mycobacterium tuberculosis H37Rv
cagccgcccugaauccucucg

SEQ ID NO: 1274462 - RNA, 14 nt, Mycobacterium tuberculosis H37Rv
cagccgcggggcga

SEQ ID NO: 1274463 - RNA, 16 nt, Mycobacterium tuberculosis H37Rv
cagccgcucacccggu

SEQ ID NO: 1274464 - RNA, 15 nt, Mycobacterium tuberculosis H37Rv
cagccggcagcgaga

SEQ ID NO: 1274465 - RNA, 15 nt, Mycobacterium tuberculosis H37Rv
cagccgcucgacggc

SEQ ID NO: 1274466 - RNA, 16 nt, Mycobacterium tuberculosis H37Rv
cagccgcgucgucggc

SEQ ID NO: 1274467 - RNA, 19 nt, Mycobacterium tuberculosis H37Rv
cagccgcgagccggugauc

SEQ ID NO: 1274468 - RNA, 17 nt, Mycobacterium tuberculosis H37Rv
cagccgcgagccgguga

SEQ ID NO: 1274469 - RNA, 20 nt, Mycobacterium tuberculosis H37Rv
cagccgcgacacgugcaucu

SEQ ID NO: 1274470 - RNA, 13 nt, Mycobacterium tuberculosis H37Rv
cagccgcgccagc

SEQ ID NO: 1274471 - RNA, 16 nt, Mycobacterium tuberculosis H37Rv
cagccagggcgccgaa

SEQ ID NO: 1274472 - RNA, 23 nt, Mycobacterium tuberculosis H37Rv
cagcccacaggcggcgcugcagc

SEQ ID NO: 1274473 - RNA, 14 nt, Mycobacterium tuberculosis H37Rv
cagccauucuucga

SEQ ID NO: 1274474 - RNA, 21 nt, Mycobacterium tuberculosis H37Rv
cagccaucucuugcaaccugg

SEQ ID NO: 1274475 - RNA, 18 nt, Mycobacterium tuberculosis H37Rv
cagccaugcucgucuugg

SEQ ID NO: 1274476 - RNA, 13 nt, Mycobacterium tuberculosis H37Rv
cagcccaccggug

SEQ ID NO: 1274477 - RNA, 14 nt, Mycobacterium tuberculosis H37Rv
cagcccaccggugc

SEQ ID NO: 1274478 - RNA, 23 nt, Mycobacterium tuberculosis H37Rv
cagcccaaagcgccagcagccac

SEQ ID NO: 1274479 - RNA, 18 nt, Mycobacterium tuberculosis H37Rv
cagccccccggcgacggc

SEQ ID NO: 1274480 - RNA, 15 nt, Mycobacterium tuberculosis H37Rv
cagccccccggcgac

SEQ ID NO: 1274481 - RNA, 13 nt, Mycobacterium tuberculosis H37Rv
cagccccaacccu

SEQ ID NO: 1274482 - RNA, 22 nt, Mycobacterium tuberculosis H37Rv
cagcccaugucgagcacgccaa

SEQ ID NO: 1274483 - RNA, 16 nt, Mycobacterium tuberculosis H37Rv
cagcccaugucgagca

SEQ ID NO: 1274484 - RNA, 22 nt, Mycobacterium tuberculosis H37Rv
cagccccuccgcgccgaucagc

SEQ ID NO: 1274485 - RNA, 22 nt, Mycobacterium tuberculosis H37Rv
cagcccgcccugaccgcccgca

SEQ ID NO: 1274486 - RNA, 19 nt, Mycobacterium tuberculosis H37Rv
cagccccgacugcgcccau

SEQ ID NO: 1274487 - RNA, 13 nt, Mycobacterium tuberculosis H37Rv
cagcccgcgcagc

SEQ ID NO: 1274488 - RNA, 22 nt, Mycobacterium tuberculosis H37Rv
cagcccgccggacccgcccuug

SEQ ID NO: 1274489 - RNA, 16 nt, Mycobacterium tuberculosis H37Rv
cagcccgccgaucggg

SEQ ID NO: 1274490 - RNA, 14 nt, Mycobacterium tuberculosis H37Rv
cagcccgccgucgg

SEQ ID NO: 1274491 - RNA, 15 nt, Mycobacterium tuberculosis H37Rv
cagcccgccgucggc

SEQ ID NO: 1274492 - RNA, 23 nt, Mycobacterium tuberculosis H37Rv
cagccccgccggggccgccgucg

SEQ ID NO: 1274493 - RNA, 12 nt, Mycobacterium tuberculosis H37Rv
cagcccgccgga

SEQ ID NO: 1274494 - RNA, 16 nt, Mycobacterium tuberculosis H37Rv
cagccaggcgauugcc

SEQ ID NO: 1274495 - RNA, 12 nt, Mycobacterium tuberculosis H37Rv
cagccaggccgc

SEQ ID NO: 1274496 - RNA, 19 nt, Mycobacterium tuberculosis H37Rv
cagccagcguccauggucg

SEQ ID NO: 1274497 - RNA, 14 nt, Mycobacterium tuberculosis H37Rv
cagccagcgggcga

SEQ ID NO: 1274498 - RNA, 20 nt, Mycobacterium tuberculosis H37Rv
cagccagcgccaugcugucg

SEQ ID NO: 1274499 - RNA, 12 nt, Mycobacterium tuberculosis H37Rv
cagccagccgga

SEQ ID NO: 1274500 - RNA, 15 nt, Mycobacterium tuberculosis H37Rv
cagccagaugccggu

SEQ ID NO: 1274501 - RNA, 20 nt, Mycobacterium tuberculosis H37Rv
cagccacguuacgcucgcgg

SEQ ID NO: 1274502 - RNA, 19 nt, Mycobacterium tuberculosis H37Rv
cagccaaugccggaucggg

SEQ ID NO: 1274503 - RNA, 14 nt, Mycobacterium tuberculosis H37Rv
cagccacagccgac

SEQ ID NO: 1274504 - RNA, 15 nt, Mycobacterium tuberculosis H37Rv
cagccaagcgagcgg

SEQ ID NO: 1274505 - RNA, 18 nt, Mycobacterium tuberculosis H37Rv
cagcaucguggccgcacc

SEQ ID NO: 1274506 - RNA, 13 nt, Mycobacterium tuberculosis H37Rv
cagcaucugcggg

SEQ ID NO: 1274507 - RNA, 16 nt, Mycobacterium tuberculosis H37Rv
cagcaucuuuggcggc

SEQ ID NO: 1274508 - RNA, 18 nt, Mycobacterium tuberculosis H37Rv
cagcaucagcucgaugcc

SEQ ID NO: 1274509 - RNA, 14 nt, Mycobacterium tuberculosis H37Rv
cagcaucucggcgg

SEQ ID NO: 1274510 - RNA, 16 nt, Mycobacterium tuberculosis H37Rv
cagcaucuccgucggc

SEQ ID NO: 1274511 - RNA, 19 nt, Mycobacterium tuberculosis H37Rv
cagcagguuuucgaucugg

SEQ ID NO: 1274512 - RNA, 12 nt, Mycobacterium tuberculosis H37Rv
cagcaguacuaa

SEQ ID NO: 1274513 - RNA, 16 nt, Mycobacterium tuberculosis H37Rv
cagcagguuccacggc

SEQ ID NO: 1274514 - RNA, 23 nt, Mycobacterium tuberculosis H37Rv
cagcagguccgcggccgcgguga

SEQ ID NO: 1274515 - RNA, 18 nt, Mycobacterium tuberculosis H37Rv
cagcagguccgccaccgc

SEQ ID NO: 1274516 - RNA, 22 nt, Mycobacterium tuberculosis H37Rv
cagcaggucgaugcugccagcc

SEQ ID NO: 1274517 - RNA, 17 nt, Mycobacterium tuberculosis H37Rv
cagcagccgcgacgcgg

SEQ ID NO: 1274518 - RNA, 22 nt, Mycobacterium tuberculosis H37Rv
cagcagcgaaaaccgucgcaga

SEQ ID NO: 1274519 - RNA, 11 nt, Mycobacterium tuberculosis H37Rv
cagcaggccgg

SEQ ID NO: 1274520 - RNA, 21 nt, Mycobacterium tuberculosis H37Rv
cagcagcgccgcguggcuggc

SEQ ID NO: 1274521 - RNA, 13 nt, Mycobacterium tuberculosis H37Rv
cagcacgcccgaa

SEQ ID NO: 1274522 - RNA, 21 nt, Mycobacterium tuberculosis H37Rv
cagcacgccgccggccgccag

SEQ ID NO: 1274523 - RNA, 18 nt, Mycobacterium tuberculosis H37Rv
cagcacgauccagcugua

SEQ ID NO: 1274524 - RNA, 23 nt, Mycobacterium tuberculosis H37Rv
cagcacguaaccuggggugaacu

SEQ ID NO: 1274525 - RNA, 22 nt, Mycobacterium tuberculosis H37Rv
cagcacgguguacgcccgcucg

SEQ ID NO: 1274526 - RNA, 13 nt, Mycobacterium tuberculosis H37Rv
cagcacggcgauc

SEQ ID NO: 1274527 - RNA, 20 nt, Mycobacterium tuberculosis H37Rv
cagcacgggugagcaccacg

SEQ ID NO: 1274528 - RNA, 23 nt, Mycobacterium tuberculosis H37Rv
cagcagccagcccagccgccagc

SEQ ID NO: 1274529 - RNA, 23 nt, Mycobacterium tuberculosis H37Rv
cagcagcccgcccugaccgcccg

SEQ ID NO: 1274530 - RNA, 18 nt, Mycobacterium tuberculosis H37Rv
cagcagcaacgacccgaa

SEQ ID NO: 1274531 - RNA, 18 nt, Mycobacterium tuberculosis H37Rv
cagcagcaaacaucgcag

SEQ ID NO: 1274532 - RNA, 20 nt, Mycobacterium tuberculosis H37Rv
cagcagcaaugcgguaccaa

SEQ ID NO: 1274533 - RNA, 15 nt, Mycobacterium tuberculosis H37Rv
cagcagcaaucagcc

SEQ ID NO: 1274534 - RNA, 22 nt, Mycobacterium tuberculosis H37Rv
cagcagauugucgacggucacc

SEQ ID NO: 1274535 - RNA, 23 nt, Mycobacterium tuberculosis H37Rv
cagcagauugucgacggucaccg

SEQ ID NO: 1274536 - RNA, 20 nt, Mycobacterium tuberculosis H37Rv
cagcagaugcgaaaguggug

SEQ ID NO: 1274537 - RNA, 18 nt, Mycobacterium tuberculosis H37Rv
cagcagauccuggccggu

SEQ ID NO: 1274538 - RNA, 14 nt, Mycobacterium tuberculosis H37Rv
cagcacucgguguc

SEQ ID NO: 1274539 - RNA, 19 nt, Mycobacterium tuberculosis H37Rv
cagcacuccaccgcuggcc

SEQ ID NO: 1274540 - RNA, 22 nt, Mycobacterium tuberculosis H37Rv
cagcagauccaggcgucgguga

SEQ ID NO: 1274541 - RNA, 13 nt, Mycobacterium tuberculosis H37Rv
cagcacgucgcgg

SEQ ID NO: 1274542 - RNA, 18 nt, Mycobacterium tuberculosis H37Rv
cagcacgucuugcugcac

SEQ ID NO: 1274543 - RNA, 17 nt, Mycobacterium tuberculosis H37Rv
cagcacauucugcagcg

SEQ ID NO: 1274544 - RNA, 13 nt, Mycobacterium tuberculosis H37Rv
cagcacauccagc

SEQ ID NO: 1274545 - RNA, 16 nt, Mycobacterium tuberculosis H37Rv
cagcacaggcuggcga

SEQ ID NO: 1274546 - RNA, 20 nt, Mycobacterium tuberculosis H37Rv
cagcacaggcuggcgauggc

SEQ ID NO: 1274547 - RNA, 16 nt, Mycobacterium tuberculosis H37Rv
cagcaccagcgccuug

SEQ ID NO: 1274548 - RNA, 14 nt, Mycobacterium tuberculosis H37Rv
cagcaccguacggc

SEQ ID NO: 1274549 - RNA, 15 nt, Mycobacterium tuberculosis H37Rv
cagcaccguccucgg

SEQ ID NO: 1274550 - RNA, 18 nt, Mycobacterium tuberculosis H37Rv
cagcaccggcucgacugc

SEQ ID NO: 1274551 - RNA, 13 nt, Mycobacterium tuberculosis H37Rv
cagcacaccgucg

SEQ ID NO: 1274552 - RNA, 16 nt, Mycobacterium tuberculosis H37Rv
cagcaacggcagcgug

SEQ ID NO: 1274553 - RNA, 21 nt, Mycobacterium tuberculosis H37Rv
cagcaacgacccgaagccgac

SEQ ID NO: 1274554 - RNA, 16 nt, Mycobacterium tuberculosis H37Rv
cagauacaucgggauc

SEQ ID NO: 1274555 - RNA, 22 nt, Mycobacterium tuberculosis H37Rv
cagcguauuggacgcugccgca

SEQ ID NO: 1274556 - RNA, 20 nt, Mycobacterium tuberculosis H37Rv
cagcgggucgcgggugccga

SEQ ID NO: 1274557 - RNA, 23 nt, Mycobacterium tuberculosis H37Rv
cagcgggucgaccccggccagga

SEQ ID NO: 1274558 - RNA, 21 nt, Mycobacterium tuberculosis H37Rv
cagcgggggcagcgcgaacac

SEQ ID NO: 1274559 - RNA, 15 nt, Mycobacterium tuberculosis H37Rv
cagcggcugaccggg

SEQ ID NO: 1274560 - RNA, 21 nt, Mycobacterium tuberculosis H37Rv
cagcgucgacugaacgguuuc

SEQ ID NO: 1274561 - RNA, 16 nt, Mycobacterium tuberculosis H37Rv
cagcguccgcggaugc

SEQ ID NO: 1274562 - RNA, 18 nt, Mycobacterium tuberculosis H37Rv
cagcgucauccucgucgu

SEQ ID NO: 1274563 - RNA, 23 nt, Mycobacterium tuberculosis H37Rv
cagcgucacccugucgcgcaccg

SEQ ID NO: 1274564 - RNA, 21 nt, Mycobacterium tuberculosis H37Rv
cagcgccucauccuccaguuc

SEQ ID NO: 1274565 - RNA, 19 nt, Mycobacterium tuberculosis H37Rv
cagcgccuccacucuucgg

SEQ ID NO: 1274566 - RNA, 14 nt, Mycobacterium tuberculosis H37Rv
cagcggcucggcgg

SEQ ID NO: 1274567 - RNA, 18 nt, Mycobacterium tuberculosis H37Rv
cagcggcgucgucgucga

SEQ ID NO: 1274568 - RNA, 12 nt, Mycobacterium tuberculosis H37Rv
cagcggcgucgg

SEQ ID NO: 1274569 - RNA, 21 nt, Mycobacterium tuberculosis H37Rv
cagcggcgugacgucgucggu

SEQ ID NO: 1274570 - RNA, 21 nt, Mycobacterium tuberculosis H37Rv
cagcgccggccaagaccgcgg

SEQ ID NO: 1274571 - RNA, 21 nt, Mycobacterium tuberculosis H37Rv
cagcgccggccauaccgcucg

SEQ ID NO: 1274572 - RNA, 13 nt, Mycobacterium tuberculosis H37Rv
cagcgugaacuga

SEQ ID NO: 1274573 - RNA, 17 nt, Mycobacterium tuberculosis H37Rv
cagcgucuggccgucgc

SEQ ID NO: 1274574 - RNA, 20 nt, Mycobacterium tuberculosis H37Rv
cagcucacccggagcacccg

SEQ ID NO: 1274575 - RNA, 19 nt, Mycobacterium tuberculosis H37Rv
cagcuagcccggcagcacg

SEQ ID NO: 1274576 - RNA, 18 nt, Mycobacterium tuberculosis H37Rv
cagcguuugaacgcaugc

SEQ ID NO: 1274577 - RNA, 21 nt, Mycobacterium tuberculosis H37Rv
cagcguucgguugaacgaccu

SEQ ID NO: 1274578 - RNA, 20 nt, Mycobacterium tuberculosis H37Rv
cagcgucugugucccgucga

SEQ ID NO: 1274579 - RNA, 15 nt, Mycobacterium tuberculosis H37Rv
cagcguuggcggcga

SEQ ID NO: 1274580 - RNA, 21 nt, Mycobacterium tuberculosis H37Rv
cagcucacggacgcugggcgg

SEQ ID NO: 1274581 - RNA, 13 nt, Mycobacterium tuberculosis H37Rv
cagcucaucgcgc

SEQ ID NO: 1274582 - RNA, 16 nt, Mycobacterium tuberculosis H37Rv
cagcucacgcugaagc

SEQ ID NO: 1274583 - RNA, 14 nt, Mycobacterium tuberculosis H37Rv
cagcucacgacugg

SEQ ID NO: 1274584 - RNA, 15 nt, Mycobacterium tuberculosis H37Rv
cagcucacgacuggc

SEQ ID NO: 1274585 - RNA, 17 nt, Mycobacterium tuberculosis H37Rv
cagcuccacuggcgucu

SEQ ID NO: 1274586 - RNA, 15 nt, Mycobacterium tuberculosis H37Rv
cagcuccccgccgga

SEQ ID NO: 1274587 - RNA, 21 nt, Mycobacterium tuberculosis H37Rv
cagcuccguaaacgaggucgc

SEQ ID NO: 1274588 - RNA, 24 nt, Mycobacterium tuberculosis H37Rv
cagcucccgccacgucgccggcua

SEQ ID NO: 1274589 - RNA, 22 nt, Mycobacterium tuberculosis H37Rv
cagcucccgcggcgccacccgc

SEQ ID NO: 1274590 - RNA, 18 nt, Mycobacterium tuberculosis H37Rv
cagcucgaccugaggcac

SEQ ID NO: 1274591 - RNA, 22 nt, Mycobacterium tuberculosis H37Rv
cagcuccuguaacugcuccugg

SEQ ID NO: 1274592 - RNA, 19 nt, Mycobacterium tuberculosis H37Rv
cagcucgaacagcucgauc

SEQ ID NO: 1274593 - RNA, 20 nt, Mycobacterium tuberculosis H37Rv
cagcugauuaccgacaccgu

SEQ ID NO: 1274594 - RNA, 15 nt, Mycobacterium tuberculosis H37Rv
cagcugcccgccagc

SEQ ID NO: 1274595 - RNA, 17 nt, Mycobacterium tuberculosis H37Rv
cagcugacgucaccacg

SEQ ID NO: 1274596 - RNA, 14 nt, Mycobacterium tuberculosis H37Rv
cagcugacggcgca

SEQ ID NO: 1274597 - RNA, 13 nt, Mycobacterium tuberculosis H37Rv
cagcugaccagcg

SEQ ID NO: 1274598 - RNA, 23 nt, Mycobacterium tuberculosis H37Rv
cagcugcaaugacuggaccgcgg

SEQ ID NO: 1274599 - RNA, 17 nt, Mycobacterium tuberculosis H37Rv
cagcugcaaugacugga

SEQ ID NO: 1274600 - RNA, 15 nt, Mycobacterium tuberculosis H37Rv
cagcugaucccagau

SEQ ID NO: 1274601 - RNA, 12 nt, Mycobacterium tuberculosis H37Rv
cagcucgucggc

SEQ ID NO: 1274602 - RNA, 22 nt, Mycobacterium tuberculosis H37Rv
cagcucgugaucuucggcgauc

SEQ ID NO: 1274603 - RNA, 24 nt, Mycobacterium tuberculosis H37Rv
cagcucgugaucuucggcgaucgu

SEQ ID NO: 1274604 - RNA, 15 nt, Mycobacterium tuberculosis H37Rv
cagcugaaucgggau

SEQ ID NO: 1274605 - RNA, 18 nt, Mycobacterium tuberculosis H37Rv
cagcucgcgcacccagcc

SEQ ID NO: 1274606 - RNA, 21 nt, Mycobacterium tuberculosis H37Rv
cagcucggccagugccgguuc

SEQ ID NO: 1274607 - RNA, 23 nt, Mycobacterium tuberculosis H37Rv
cagcucgaggaccaccuggucgc

SEQ ID NO: 1274608 - RNA, 16 nt, Mycobacterium tuberculosis H37Rv
cagcucgccgugacca

SEQ ID NO: 1274609 - RNA, 14 nt, Mycobacterium tuberculosis H37Rv
cagcucggugaugu

SEQ ID NO: 1274610 - RNA, 16 nt, Mycobacterium tuberculosis H37Rv
cagcucggggcgauga

SEQ ID NO: 1274611 - RNA, 17 nt, Mycobacterium tuberculosis H37Rv
cagcucggggcgaugag

SEQ ID NO: 1274612 - RNA, 14 nt, Mycobacterium tuberculosis H37Rv
cagcucgggcucgu

SEQ ID NO: 1274613 - RNA, 20 nt, Mycobacterium tuberculosis H37Rv
cagcucggguugcgcgaugg

SEQ ID NO: 1274614 - RNA, 15 nt, Mycobacterium tuberculosis H37Rv
cagcuggcggcagcg

SEQ ID NO: 1274615 - RNA, 20 nt, Mycobacterium tuberculosis H37Rv
cagcuguaauuccucggaua

SEQ ID NO: 1274616 - RNA, 23 nt, Mycobacterium tuberculosis H37Rv
cagcugggugaccucgucgaccg

SEQ ID NO: 1274617 - RNA, 16 nt, Mycobacterium tuberculosis H37Rv
cagcugguaaccggcg

SEQ ID NO: 1274618 - RNA, 22 nt, Mycobacterium tuberculosis H37Rv
cagcugguaaccggcggcagcg

SEQ ID NO: 1274619 - RNA, 14 nt, Mycobacterium tuberculosis H37Rv
cagcugggcgacca

SEQ ID NO: 1274620 - RNA, 23 nt, Mycobacterium tuberculosis H37Rv
cagcuggcucaccgacaugacgc

SEQ ID NO: 1274621 - RNA, 15 nt, Mycobacterium tuberculosis H37Rv
cagcugcuccaguuc

SEQ ID NO: 1274622 - RNA, 16 nt, Mycobacterium tuberculosis H37Rv
cagcugcggauccacc

SEQ ID NO: 1274623 - RNA, 22 nt, Mycobacterium tuberculosis H37Rv
cagcugcggacuggcauccgcc

SEQ ID NO: 1274624 - RNA, 17 nt, Mycobacterium tuberculosis H37Rv
cagcugcggauacagcc

SEQ ID NO: 1274625 - RNA, 15 nt, Mycobacterium tuberculosis H37Rv
cagcugcggucgcgg

SEQ ID NO: 1274626 - RNA, 16 nt, Mycobacterium tuberculosis H37Rv
cagcugcugccaccgg

SEQ ID NO: 1274627 - RNA, 19 nt, Mycobacterium tuberculosis H37Rv
cagcugcggauccaccacg

SEQ ID NO: 1274628 - RNA, 20 nt, Mycobacterium tuberculosis H37Rv
cagcugcggauccaccacgc

SEQ ID NO: 1274629 - RNA, 16 nt, Mycobacterium tuberculosis H37Rv
cagcugcggacuggca

SEQ ID NO: 1274630 - RNA, 14 nt, Mycobacterium tuberculosis H37Rv
cagcugcgccgaac

SEQ ID NO: 1274631 - RNA, 21 nt, Mycobacterium tuberculosis H37Rv
cagcuucucagcaccaugcuc

SEQ ID NO: 1274632 - RNA, 18 nt, Mycobacterium tuberculosis H37Rv
cagcugugaacaggccga

SEQ ID NO: 1274633 - RNA, 16 nt, Mycobacterium tuberculosis H37Rv
cagcuguucgagccgc

SEQ ID NO: 1274634 - RNA, 19 nt, Mycobacterium tuberculosis H37Rv
cagcuucggacuggggcac

SEQ ID NO: 1274635 - RNA, 14 nt, Mycobacterium tuberculosis H37Rv
cagcuuggccagcc

SEQ ID NO: 1274636 - RNA, 17 nt, Mycobacterium tuberculosis H37Rv
cagcuuggagaucgccg

SEQ ID NO: 1274637 - RNA, 18 nt, Mycobacterium tuberculosis H37Rv
cagcuuggcaaccuguuc

SEQ ID NO: 1274638 - RNA, 16 nt, Mycobacterium tuberculosis H37Rv
cagcuugcugcgcacc

SEQ ID NO: 1274639 - RNA, 16 nt, Mycobacterium tuberculosis H37Rv
cagcuuggacccugcg

SEQ ID NO: 1274640 - RNA, 22 nt, Mycobacterium tuberculosis H37Rv
cagcuuggacucaucggcgugc

SEQ ID NO: 1274641 - RNA, 16 nt, Mycobacterium tuberculosis H37Rv
cagcuugccgaccugc

SEQ ID NO: 1274642 - RNA, 17 nt, Mycobacterium tuberculosis H37Rv
cagcuugccgaccugcg

SEQ ID NO: 1274643 - RNA, 16 nt, Mycobacterium tuberculosis H37Rv
cagcuugcccgacggc

SEQ ID NO: 1274644 - RNA, 17 nt, Mycobacterium tuberculosis H37Rv
caggcgcucgaaggccg

SEQ ID NO: 1274645 - RNA, 16 nt, Mycobacterium tuberculosis H37Rv
caggcgcgcaccaccg

SEQ ID NO: 1274646 - RNA, 18 nt, Mycobacterium tuberculosis H37Rv
caggcgcgaucgcucauu

SEQ ID NO: 1274647 - RNA, 14 nt, Mycobacterium tuberculosis H37Rv
caggcgcgcaccac

SEQ ID NO: 1274648 - RNA, 14 nt, Mycobacterium tuberculosis H37Rv
caggcucauccgcc

SEQ ID NO: 1274649 - RNA, 17 nt, Mycobacterium tuberculosis H37Rv
caggcuggcgauggccg

SEQ ID NO: 1274650 - RNA, 20 nt, Mycobacterium tuberculosis H37Rv
cagggaagcaagggcgaugg

SEQ ID NO: 1274651 - RNA, 14 nt, Mycobacterium tuberculosis H37Rv
cagggaagccugcg

SEQ ID NO: 1274652 - RNA, 20 nt, Mycobacterium tuberculosis H37Rv
caggcugggcagaccgaucg

SEQ ID NO: 1274653 - RNA, 18 nt, Mycobacterium tuberculosis H37Rv
caggccuuuuggcgaacc

SEQ ID NO: 1274654 - RNA, 19 nt, Mycobacterium tuberculosis H37Rv
caggccuuuuggcgaaccg

SEQ ID NO: 1274655 - RNA, 19 nt, Mycobacterium tuberculosis H37Rv
caggccuugggauaggccg

SEQ ID NO: 1274656 - RNA, 19 nt, Mycobacterium tuberculosis H37Rv
caggccgucgaugaucugc

SEQ ID NO: 1274657 - RNA, 14 nt, Mycobacterium tuberculosis H37Rv
caggccguccucgg

SEQ ID NO: 1274658 - RNA, 23 nt, Mycobacterium tuberculosis H37Rv
caggccguccucggucagcucgu

SEQ ID NO: 1274659 - RNA, 16 nt, Mycobacterium tuberculosis H37Rv
caggcgagugaacucg

SEQ ID NO: 1274660 - RNA, 21 nt, Mycobacterium tuberculosis H37Rv
caggcgaucuggccgaacgac

SEQ ID NO: 1274661 - RNA, 22 nt, Mycobacterium tuberculosis H37Rv
caggccgagccgcccgcccgga

SEQ ID NO: 1274662 - RNA, 19 nt, Mycobacterium tuberculosis H37Rv
caggccgaggaaggagcca

SEQ ID NO: 1274663 - RNA, 19 nt, Mycobacterium tuberculosis H37Rv
caggccgccaccgucaccg

SEQ ID NO: 1274664 - RNA, 13 nt, Mycobacterium tuberculosis H37Rv
caggccgcacagc

SEQ ID NO: 1274665 - RNA, 13 nt, Mycobacterium tuberculosis H37Rv
caggccgccaccg

SEQ ID NO: 1274666 - RNA, 19 nt, Mycobacterium tuberculosis H37Rv
caggccgcaaugcguugac

SEQ ID NO: 1274667 - RNA, 17 nt, Mycobacterium tuberculosis H37Rv
caggccguacgacggca

SEQ ID NO: 1274668 - RNA, 15 nt, Mycobacterium tuberculosis H37Rv
caggccgguaccggg

SEQ ID NO: 1274669 - RNA, 14 nt, Mycobacterium tuberculosis H37Rv
caggccggugacgg

SEQ ID NO: 1274670 - RNA, 17 nt, Mycobacterium tuberculosis H37Rv
caggccggcgucgauca

SEQ ID NO: 1274671 - RNA, 16 nt, Mycobacterium tuberculosis H37Rv
caggacuggcaccgcc

SEQ ID NO: 1274672 - RNA, 22 nt, Mycobacterium tuberculosis H37Rv
caggagccuccagcgcaccggu

SEQ ID NO: 1274673 - RNA, 16 nt, Mycobacterium tuberculosis H37Rv
caggaugaagacgcgg

SEQ ID NO: 1274674 - RNA, 16 nt, Mycobacterium tuberculosis H37Rv
caggaucgccugagcg

SEQ ID NO: 1274675 - RNA, 17 nt, Mycobacterium tuberculosis H37Rv
caggaccagcaccgccg

SEQ ID NO: 1274676 - RNA, 12 nt, Mycobacterium tuberculosis H37Rv
caggaccgcgcc

SEQ ID NO: 1274677 - RNA, 15 nt, Mycobacterium tuberculosis H37Rv
caggaccagcaccgc

SEQ ID NO: 1274678 - RNA, 16 nt, Mycobacterium tuberculosis H37Rv
caggacuccggccgca

SEQ ID NO: 1274679 - RNA, 21 nt, Mycobacterium tuberculosis H37Rv
caggaacgccgugccguacgc

SEQ ID NO: 1274680 - RNA, 21 nt, Mycobacterium tuberculosis H37Rv
cagcuuugacgcccucggcga

SEQ ID NO: 1274681 - RNA, 18 nt, Mycobacterium tuberculosis H37Rv
cagcuugugggcgacggc

SEQ ID NO: 1274682 - RNA, 19 nt, Mycobacterium tuberculosis H37Rv
cagcuuggcgucgaugcgg

SEQ ID NO: 1274683 - RNA, 17 nt, Mycobacterium tuberculosis H37Rv
caggccacgcaccgggu

SEQ ID NO: 1274684 - RNA, 16 nt, Mycobacterium tuberculosis H37Rv
caggccacugccgacc

SEQ ID NO: 1274685 - RNA, 19 nt, Mycobacterium tuberculosis H37Rv
caggccagagccgcccuug

SEQ ID NO: 1274686 - RNA, 22 nt, Mycobacterium tuberculosis H37Rv
caggcauuuucacugugccgcu

SEQ ID NO: 1274687 - RNA, 17 nt, Mycobacterium tuberculosis H37Rv
caggcauggcgccguug

SEQ ID NO: 1274688 - RNA, 19 nt, Mycobacterium tuberculosis H37Rv
caggcauggcgccguugcc

SEQ ID NO: 1274689 - RNA, 13 nt, Mycobacterium tuberculosis H37Rv
caggaugaugacc

SEQ ID NO: 1274690 - RNA, 14 nt, Mycobacterium tuberculosis H37Rv
caggcacaacaucg

SEQ ID NO: 1274691 - RNA, 16 nt, Mycobacterium tuberculosis H37Rv
caggccagggugacca

SEQ ID NO: 1274692 - RNA, 18 nt, Mycobacterium tuberculosis H37Rv
caggccagggugaccagg

SEQ ID NO: 1274693 - RNA, 13 nt, Mycobacterium tuberculosis H37Rv
caggccagcgcuc

SEQ ID NO: 1274694 - RNA, 15 nt, Mycobacterium tuberculosis H37Rv
caggccagcaugucg

SEQ ID NO: 1274695 - RNA, 23 nt, Mycobacterium tuberculosis H37Rv
caggcccugccgacgcuccaggg

SEQ ID NO: 1274696 - RNA, 20 nt, Mycobacterium tuberculosis H37Rv
caggcccggcggugugcgca

SEQ ID NO: 1274697 - RNA, 19 nt, Mycobacterium tuberculosis H37Rv
caggcccucgggacugcgc

SEQ ID NO: 1274698 - RNA, 20 nt, Mycobacterium tuberculosis H37Rv
caggcccgugccuggccggu

SEQ ID NO: 1274699 - RNA, 17 nt, Mycobacterium tuberculosis H37Rv
cauccgccgggccaggc

SEQ ID NO: 1274700 - RNA, 22 nt, Mycobacterium tuberculosis H37Rv
cauccagaaguaggcgaccgcc

SEQ ID NO: 1274701 - RNA, 14 nt, Mycobacterium tuberculosis H37Rv
cauccagccgugcg

SEQ ID NO: 1274702 - RNA, 15 nt, Mycobacterium tuberculosis H37Rv
caucaugucggcgca

SEQ ID NO: 1274703 - RNA, 17 nt, Mycobacterium tuberculosis H37Rv
caucauguggucaacgg

SEQ ID NO: 1274704 - RNA, 12 nt, Mycobacterium tuberculosis H37Rv
caucaugccgcc

SEQ ID NO: 1274705 - RNA, 22 nt, Mycobacterium tuberculosis H37Rv
caucaccggagcuuguugcagc

SEQ ID NO: 1274706 - RNA, 12 nt, Mycobacterium tuberculosis H37Rv
caucaccggcau

SEQ ID NO: 1274707 - RNA, 22 nt, Mycobacterium tuberculosis H37Rv
caucaccggaacccccagcugc

SEQ ID NO: 1274708 - RNA, 13 nt, Mycobacterium tuberculosis H37Rv
caucgcagacggc

SEQ ID NO: 1274709 - RNA, 21 nt, Mycobacterium tuberculosis H37Rv
caucgcacaacugcgccagca

SEQ ID NO: 1274710 - RNA, 20 nt, Mycobacterium tuberculosis H37Rv
caucgcacagcgccgcguug

SEQ ID NO: 1274711 - RNA, 17 nt, Mycobacterium tuberculosis H37Rv
caucgaucccguucggg

SEQ ID NO: 1274712 - RNA, 17 nt, Mycobacterium tuberculosis H37Rv
caucgaugucagugauc

SEQ ID NO: 1274713 - RNA, 15 nt, Mycobacterium tuberculosis H37Rv
caucgaugcggugaa

SEQ ID NO: 1274714 - RNA, 14 nt, Mycobacterium tuberculosis H37Rv
caucgaguccacca

SEQ ID NO: 1274715 - RNA, 17 nt, Mycobacterium tuberculosis H37Rv
caucgagcgggaucggg

SEQ ID NO: 1274716 - RNA, 14 nt, Mycobacterium tuberculosis H37Rv
caucgagcgggauc

SEQ ID NO: 1274717 - RNA, 17 nt, Mycobacterium tuberculosis H37Rv
caucgaaggugcuggug

SEQ ID NO: 1274718 - RNA, 16 nt, Mycobacterium tuberculosis H37Rv
caucgaaaaccgaggc

SEQ ID NO: 1274719 - RNA, 19 nt, Mycobacterium tuberculosis H37Rv
caucgaaaaaccucgacgc

SEQ ID NO: 1274720 - RNA, 12 nt, Mycobacterium tuberculosis H37Rv
caucgaacgacg

SEQ ID NO: 1274721 - RNA, 19 nt, Mycobacterium tuberculosis H37Rv
cauccuuaugcgcggugac

SEQ ID NO: 1274722 - RNA, 21 nt, Mycobacterium tuberculosis H37Rv
cauccuggucaccagccaccg

SEQ ID NO: 1274723 - RNA, 21 nt, Mycobacterium tuberculosis H37Rv
cauccucugaaccugcugagc

SEQ ID NO: 1274724 - RNA, 21 nt, Mycobacterium tuberculosis H37Rv
cauaccaguaccgucaucgcg

SEQ ID NO: 1274725 - RNA, 16 nt, Mycobacterium tuberculosis H37Rv
cauacagcaugucgcg

SEQ ID NO: 1274726 - RNA, 13 nt, Mycobacterium tuberculosis H37Rv
caguuggcaccag

SEQ ID NO: 1274727 - RNA, 17 nt, Mycobacterium tuberculosis H37Rv
caguuggaacugcccga

SEQ ID NO: 1274728 - RNA, 16 nt, Mycobacterium tuberculosis H37Rv
caguuggcaccagccg

SEQ ID NO: 1274729 - RNA, 20 nt, Mycobacterium tuberculosis H37Rv
caguuggccaugcaccgaug

SEQ ID NO: 1274730 - RNA, 20 nt, Mycobacterium tuberculosis H37Rv
caguugucuggucauggccg

SEQ ID NO: 1274731 - RNA, 20 nt, Mycobacterium tuberculosis H37Rv
cauagcucaacggaaccgau

SEQ ID NO: 1274732 - RNA, 22 nt, Mycobacterium tuberculosis H37Rv
cauagcucaacggaaccgauac

SEQ ID NO: 1274733 - RNA, 14 nt, Mycobacterium tuberculosis H37Rv
cauaccccgaacau

SEQ ID NO: 1274734 - RNA, 16 nt, Mycobacterium tuberculosis H37Rv
cauagcgccgcgccca

SEQ ID NO: 1274735 - RNA, 21 nt, Mycobacterium tuberculosis H37Rv
cauagcgacggcgcucggcga

SEQ ID NO: 1274736 - RNA, 15 nt, Mycobacterium tuberculosis H37Rv
cauagugcggcaccg

SEQ ID NO: 1274737 - RNA, 23 nt, Mycobacterium tuberculosis H37Rv
cauaguuggcgcccgaagccggg

SEQ ID NO: 1274738 - RNA, 17 nt, Mycobacterium tuberculosis H37Rv
cauaggcgcugaacgcg

SEQ ID NO: 1274739 - RNA, 16 nt, Mycobacterium tuberculosis H37Rv
cauaggcuuccggcgc

SEQ ID NO: 1274740 - RNA, 19 nt, Mycobacterium tuberculosis H37Rv
caucaacgccacgaugacc

SEQ ID NO: 1274741 - RNA, 14 nt, Mycobacterium tuberculosis H37Rv
caucaacgacacca

SEQ ID NO: 1274742 - RNA, 13 nt, Mycobacterium tuberculosis H37Rv
caucaccagcggc

SEQ ID NO: 1274743 - RNA, 23 nt, Mycobacterium tuberculosis H37Rv
cauaucgugaugugcccauucau

SEQ ID NO: 1274744 - RNA, 22 nt, Mycobacterium tuberculosis H37Rv
caggucaauggucuuuguccac

SEQ ID NO: 1274745 - RNA, 21 nt, Mycobacterium tuberculosis H37Rv
caggucaucggcuaucgcuag

SEQ ID NO: 1274746 - RNA, 13 nt, Mycobacterium tuberculosis H37Rv
cagguaggcgcga

SEQ ID NO: 1274747 - RNA, 17 nt, Mycobacterium tuberculosis H37Rv
cagguaauucguccacu

SEQ ID NO: 1274748 - RNA, 18 nt, Mycobacterium tuberculosis H37Rv
cagguaaccccgcacgag

SEQ ID NO: 1274749 - RNA, 17 nt, Mycobacterium tuberculosis H37Rv
cagguaaacggauucga

SEQ ID NO: 1274750 - RNA, 14 nt, Mycobacterium tuberculosis H37Rv
caggguuggcagca

SEQ ID NO: 1274751 - RNA, 13 nt, Mycobacterium tuberculosis H37Rv
cagggugccggcg

SEQ ID NO: 1274752 - RNA, 20 nt, Mycobacterium tuberculosis H37Rv
cagggugacuucgcugcggu

SEQ ID NO: 1274753 - RNA, 21 nt, Mycobacterium tuberculosis H37Rv
cagggugacuucgcugcggug

SEQ ID NO: 1274754 - RNA, 14 nt, Mycobacterium tuberculosis H37Rv
cagggugcccucgg

SEQ ID NO: 1274755 - RNA, 15 nt, Mycobacterium tuberculosis H37Rv
cagggccagaccgaa

SEQ ID NO: 1274756 - RNA, 13 nt, Mycobacterium tuberculosis H37Rv
cagggacgaugcc

SEQ ID NO: 1274757 - RNA, 18 nt, Mycobacterium tuberculosis H37Rv
cagggccaccgcgccgua

SEQ ID NO: 1274758 - RNA, 17 nt, Mycobacterium tuberculosis H37Rv
caggucuucgcugucga

SEQ ID NO: 1274759 - RNA, 19 nt, Mycobacterium tuberculosis H37Rv
caggugaccuugaugccau

SEQ ID NO: 1274760 - RNA, 20 nt, Mycobacterium tuberculosis H37Rv
caggugaccgagaucgucgc

SEQ ID NO: 1274761 - RNA, 15 nt, Mycobacterium tuberculosis H37Rv
caggucgucggcguc

SEQ ID NO: 1274762 - RNA, 23 nt, Mycobacterium tuberculosis H37Rv
caggucggugugcaucgccggca

SEQ ID NO: 1274763 - RNA, 18 nt, Mycobacterium tuberculosis H37Rv
caggucggugggcggcga

SEQ ID NO: 1274764 - RNA, 17 nt, Mycobacterium tuberculosis H37Rv
caggucgucacgccccu

SEQ ID NO: 1274765 - RNA, 13 nt, Mycobacterium tuberculosis H37Rv
caggucgcaccac

SEQ ID NO: 1274766 - RNA, 16 nt, Mycobacterium tuberculosis H37Rv
caggucgccuucccag

SEQ ID NO: 1274767 - RNA, 20 nt, Mycobacterium tuberculosis H37Rv
caggucggugacgaagagca

SEQ ID NO: 1274768 - RNA, 15 nt, Mycobacterium tuberculosis H37Rv
caggucggugcgguc

SEQ ID NO: 1274769 - RNA, 17 nt, Mycobacterium tuberculosis H37Rv
cagguuuccggccugca

SEQ ID NO: 1274770 - RNA, 21 nt, Mycobacterium tuberculosis H37Rv
cagguuugcgccgcgcagcga

SEQ ID NO: 1274771 - RNA, 17 nt, Mycobacterium tuberculosis H37Rv
cagguggucaucgccac

SEQ ID NO: 1274772 - RNA, 14 nt, Mycobacterium tuberculosis H37Rv
caggugggugaacg

SEQ ID NO: 1274773 - RNA, 18 nt, Mycobacterium tuberculosis H37Rv
caggugcucagcuucgcg

SEQ ID NO: 1274774 - RNA, 17 nt, Mycobacterium tuberculosis H37Rv
caggugacgaucagguc

SEQ ID NO: 1274775 - RNA, 19 nt, Mycobacterium tuberculosis H37Rv
caggugccagaccagggca

SEQ ID NO: 1274776 - RNA, 22 nt, Mycobacterium tuberculosis H37Rv
caggugcggugaucgauccggc

SEQ ID NO: 1274777 - RNA, 21 nt, Mycobacterium tuberculosis H37Rv
cagugccgcacccagaccgcc

SEQ ID NO: 1274778 - RNA, 17 nt, Mycobacterium tuberculosis H37Rv
cagugccccgccgagcg

SEQ ID NO: 1274779 - RNA, 19 nt, Mycobacterium tuberculosis H37Rv
cagugcccgcacugccgcc

SEQ ID NO: 1274780 - RNA, 17 nt, Mycobacterium tuberculosis H37Rv
cagugacagugcgucga

SEQ ID NO: 1274781 - RNA, 19 nt, Mycobacterium tuberculosis H37Rv
cagugacaacgcgaugccg

SEQ ID NO: 1274782 - RNA, 15 nt, Mycobacterium tuberculosis H37Rv
cagugaccucgucgg

SEQ ID NO: 1274783 - RNA, 16 nt, Mycobacterium tuberculosis H37Rv
cagugacucgaucacc

SEQ ID NO: 1274784 - RNA, 19 nt, Mycobacterium tuberculosis H37Rv
cagugaccucgucggcgac

SEQ ID NO: 1274785 - RNA, 13 nt, Mycobacterium tuberculosis H37Rv
cagucgcucucgg

SEQ ID NO: 1274786 - RNA, 23 nt, Mycobacterium tuberculosis H37Rv
cagugaaauugccgccgccggga

SEQ ID NO: 1274787 - RNA, 17 nt, Mycobacterium tuberculosis H37Rv
cagugaaaccaccggcc

SEQ ID NO: 1274788 - RNA, 19 nt, Mycobacterium tuberculosis H37Rv
cagugaaucggaccgaccg

SEQ ID NO: 1274789 - RNA, 14 nt, Mycobacterium tuberculosis H37Rv
caguccgacaccgg

SEQ ID NO: 1274790 - RNA, 18 nt, Mycobacterium tuberculosis H37Rv
cagucccggugggcggcu

SEQ ID NO: 1274791 - RNA, 20 nt, Mycobacterium tuberculosis H37Rv
caguaccaccggcaccggcc

SEQ ID NO: 1274792 - RNA, 14 nt, Mycobacterium tuberculosis H37Rv
caguaccaccggca

SEQ ID NO: 1274793 - RNA, 20 nt, Mycobacterium tuberculosis H37Rv
caguccucgggcaggcggcc

SEQ ID NO: 1274794 - RNA, 16 nt, Mycobacterium tuberculosis H37Rv
caguccgacaccggcg

SEQ ID NO: 1274795 - RNA, 20 nt, Mycobacterium tuberculosis H37Rv
caguaauacugccguucggg

SEQ ID NO: 1274796 - RNA, 13 nt, Mycobacterium tuberculosis H37Rv
caguacaccggcg

SEQ ID NO: 1274797 - RNA, 19 nt, Mycobacterium tuberculosis H37Rv
cagguuuugccgcguacga

SEQ ID NO: 1274798 - RNA, 17 nt, Mycobacterium tuberculosis H37Rv
caguucgacggcgucaa

SEQ ID NO: 1274799 - RNA, 21 nt, Mycobacterium tuberculosis H37Rv
caguucgacauaaccggccga

SEQ ID NO: 1274800 - RNA, 15 nt, Mycobacterium tuberculosis H37Rv
caguucgccggaucg

SEQ ID NO: 1274801 - RNA, 15 nt, Mycobacterium tuberculosis H37Rv
caguucgugacgugc

SEQ ID NO: 1274802 - RNA, 14 nt, Mycobacterium tuberculosis H37Rv
caguucguggcugg

SEQ ID NO: 1274803 - RNA, 16 nt, Mycobacterium tuberculosis H37Rv
cagugcgcagaacacc

SEQ ID NO: 1274804 - RNA, 15 nt, Mycobacterium tuberculosis H37Rv
caguggauccggcag

SEQ ID NO: 1274805 - RNA, 20 nt, Mycobacterium tuberculosis H37Rv
cagugcgacguaaagggcgu

SEQ ID NO: 1274806 - RNA, 17 nt, Mycobacterium tuberculosis H37Rv
cagugccucggcgaugg

SEQ ID NO: 1274807 - RNA, 23 nt, Mycobacterium tuberculosis H37Rv
caguggcaacagcaacggcagcg

SEQ ID NO: 1274808 - RNA, 17 nt, Mycobacterium tuberculosis H37Rv
caguggcgcgugcagcg

SEQ ID NO: 1274809 - RNA, 22 nt, Mycobacterium tuberculosis H37Rv
caguggccaccaucaccucgca

SEQ ID NO: 1274810 - RNA, 21 nt, Mycobacterium tuberculosis H37Rv
caguggcguuacgcucggcga

SEQ ID NO: 1274811 - RNA, 20 nt, Mycobacterium tuberculosis H37Rv
caguggucgauuucggcgcg

SEQ ID NO: 1274812 - RNA, 12 nt, Mycobacterium tuberculosis H37Rv
caguggugcacc

SEQ ID NO: 1274813 - RNA, 22 nt, Mycobacterium tuberculosis H37Rv
caguuccgcugcggugccggcc

SEQ ID NO: 1274814 - RNA, 14 nt, Mycobacterium tuberculosis H37Rv
caguuccagcucgc

SEQ ID NO: 1274815 - RNA, 20 nt, Mycobacterium tuberculosis H37Rv
caguuccacccggugccgca

SEQ ID NO: 1274816 - RNA, 18 nt, Mycobacterium tuberculosis H37Rv
caguucacgcucgacgac

SEQ ID NO: 1274817 - RNA, 15 nt, Mycobacterium tuberculosis H37Rv
caguucacgccggug

SEQ ID NO: 1274818 - RNA, 15 nt, Mycobacterium tuberculosis H37Rv
caguucacguucggc

SEQ ID NO: 1274819 - RNA, 16 nt, Mycobacterium tuberculosis H37Rv
cauggcccgaucgacc

SEQ ID NO: 1274820 - RNA, 21 nt, Mycobacterium tuberculosis H37Rv
cauggcgaacacgucggccag

SEQ ID NO: 1274821 - RNA, 18 nt, Mycobacterium tuberculosis H37Rv
cauggccgauuccgcgcg

SEQ ID NO: 1274822 - RNA, 15 nt, Mycobacterium tuberculosis H37Rv
cauggccagcgcuuc

SEQ ID NO: 1274823 - RNA, 22 nt, Mycobacterium tuberculosis H37Rv
cauggcggcuccgcccggcgug

SEQ ID NO: 1274824 - RNA, 19 nt, Mycobacterium tuberculosis H37Rv
cauggcgccguugccggcg

SEQ ID NO: 1274825 - RNA, 18 nt, Mycobacterium tuberculosis H37Rv
cauggcgcgagcagacgc

SEQ ID NO: 1274826 - RNA, 22 nt, Mycobacterium tuberculosis H37Rv
caugggacacaauccacgucgc

SEQ ID NO: 1274827 - RNA, 21 nt, Mycobacterium tuberculosis H37Rv
caugggggaacccccucgcga

SEQ ID NO: 1274828 - RNA, 18 nt, Mycobacterium tuberculosis H37Rv
caugggcgccaucccgcc

SEQ ID NO: 1274829 - RNA, 21 nt, Mycobacterium tuberculosis H37Rv
caugggucuggcaggccagca

SEQ ID NO: 1274830 - RNA, 22 nt, Mycobacterium tuberculosis H37Rv
caugggugaugcaacgcggcga

SEQ ID NO: 1274831 - RNA, 17 nt, Mycobacterium tuberculosis H37Rv
cauggucgacgaacacc

SEQ ID NO: 1274832 - RNA, 16 nt, Mycobacterium tuberculosis H37Rv
caugguccgaccagcg

SEQ ID NO: 1274833 - RNA, 23 nt, Mycobacterium tuberculosis H37Rv
caugguggcuuugcucgccagca

SEQ ID NO: 1274834 - RNA, 15 nt, Mycobacterium tuberculosis H37Rv
caugguuggugucgu

SEQ ID NO: 1274835 - RNA, 20 nt, Mycobacterium tuberculosis H37Rv
caugguugaugacggcgucg

SEQ ID NO: 1274836 - RNA, 19 nt, Mycobacterium tuberculosis H37Rv
caugcggguaaaccaggug

SEQ ID NO: 1274837 - RNA, 20 nt, Mycobacterium tuberculosis H37Rv
caugcggauucgcgcugucc

SEQ ID NO: 1274838 - RNA, 16 nt, Mycobacterium tuberculosis H37Rv
caugcucacgaucugc

SEQ ID NO: 1274839 - RNA, 21 nt, Mycobacterium tuberculosis H37Rv
caugcucgacgcccgccaccg

SEQ ID NO: 1274840 - RNA, 15 nt, Mycobacterium tuberculosis H37Rv
caugcugcucgagga

SEQ ID NO: 1274841 - RNA, 18 nt, Mycobacterium tuberculosis H37Rv
cauggaaacccucgaggc

SEQ ID NO: 1274842 - RNA, 20 nt, Mycobacterium tuberculosis H37Rv
caugcgcuccggcgcgacgc

SEQ ID NO: 1274843 - RNA, 19 nt, Mycobacterium tuberculosis H37Rv
caugcgcuggaaugcgguc

SEQ ID NO: 1274844 - RNA, 21 nt, Mycobacterium tuberculosis H37Rv
caugcggaucacaucggccau

SEQ ID NO: 1274845 - RNA, 13 nt, Mycobacterium tuberculosis H37Rv
caugcgcaccagu

SEQ ID NO: 1274846 - RNA, 13 nt, Mycobacterium tuberculosis H37Rv
caugcgacgucag

SEQ ID NO: 1274847 - RNA, 19 nt, Mycobacterium tuberculosis H37Rv
caugcgacuucaucuucga

SEQ ID NO: 1274848 - RNA, 14 nt, Mycobacterium tuberculosis H37Rv
caucgccgacccgc

SEQ ID NO: 1274849 - RNA, 15 nt, Mycobacterium tuberculosis H37Rv
caucgccgacccgcc

SEQ ID NO: 1274850 - RNA, 17 nt, Mycobacterium tuberculosis H37Rv
caucgccgacacccucg

SEQ ID NO: 1274851 - RNA, 16 nt, Mycobacterium tuberculosis H37Rv
cauguguggcagcccc

SEQ ID NO: 1274852 - RNA, 13 nt, Mycobacterium tuberculosis H37Rv
cauguucggccac

SEQ ID NO: 1274853 - RNA, 15 nt, Mycobacterium tuberculosis H37Rv
cauguucggccacca

SEQ ID NO: 1274854 - RNA, 14 nt, Mycobacterium tuberculosis H37Rv
cauguugcggacca

SEQ ID NO: 1274855 - RNA, 21 nt, Mycobacterium tuberculosis H37Rv
cauguugcccugcaacccggu

SEQ ID NO: 1274856 - RNA, 12 nt, Mycobacterium tuberculosis H37Rv
cauuagccggac

SEQ ID NO: 1274857 - RNA, 17 nt, Mycobacterium tuberculosis H37Rv
cauuagcagcacccggg

SEQ ID NO: 1274858 - RNA, 21 nt, Mycobacterium tuberculosis H37Rv
caugucaagcgaugucccauc

SEQ ID NO: 1274859 - RNA, 20 nt, Mycobacterium tuberculosis H37Rv
caugucgaagaaccggccga

SEQ ID NO: 1274860 - RNA, 19 nt, Mycobacterium tuberculosis H37Rv
caugucgaagaaccggccg

SEQ ID NO: 1274861 - RNA, 11 nt, Mycobacterium tuberculosis H37Rv
caugucgagga

SEQ ID NO: 1274862 - RNA, 15 nt, Mycobacterium tuberculosis H37Rv
cauguccagugccgu

SEQ ID NO: 1274863 - RNA, 17 nt, Mycobacterium tuberculosis H37Rv
caugugcgcgucgcgcg

SEQ ID NO: 1274864 - RNA, 16 nt, Mycobacterium tuberculosis H37Rv
caugugggugaacacc

SEQ ID NO: 1274865 - RNA, 13 nt, Mycobacterium tuberculosis H37Rv
cauguucaucgca

SEQ ID NO: 1274866 - RNA, 23 nt, Mycobacterium tuberculosis H37Rv
caugucgguuuccucgagccagc

SEQ ID NO: 1274867 - RNA, 20 nt, Mycobacterium tuberculosis H37Rv
caugucggccggggccaccc

SEQ ID NO: 1274868 - RNA, 16 nt, Mycobacterium tuberculosis H37Rv
cauucucgccgacggc

SEQ ID NO: 1274869 - RNA, 17 nt, Mycobacterium tuberculosis H37Rv
cauucgugggaaccacc

SEQ ID NO: 1274870 - RNA, 18 nt, Mycobacterium tuberculosis H37Rv
cauugaguucggccacca

SEQ ID NO: 1274871 - RNA, 19 nt, Mycobacterium tuberculosis H37Rv
cauugaucgacggccagcc

SEQ ID NO: 1274872 - RNA, 17 nt, Mycobacterium tuberculosis H37Rv
cauucccgcucgcaggc

SEQ ID NO: 1274873 - RNA, 13 nt, Mycobacterium tuberculosis H37Rv
cauuccggcaccu

SEQ ID NO: 1274874 - RNA, 21 nt, Mycobacterium tuberculosis H37Rv
cauucgcccggccgcagcggc

SEQ ID NO: 1274875 - RNA, 16 nt, Mycobacterium tuberculosis H37Rv
cauucgccccacccga

SEQ ID NO: 1274876 - RNA, 22 nt, Mycobacterium tuberculosis H37Rv
cauugcugcccaauggcguucg

SEQ ID NO: 1274877 - RNA, 23 nt, Mycobacterium tuberculosis H37Rv
cauugcugcccaauggcguucgu

SEQ ID NO: 1274878 - RNA, 19 nt, Mycobacterium tuberculosis H37Rv
cauuggccaggucggccac

SEQ ID NO: 1274879 - RNA, 18 nt, Mycobacterium tuberculosis H37Rv
cauuggaugccauaggac

SEQ ID NO: 1274880 - RNA, 22 nt, Mycobacterium tuberculosis H37Rv
cauugggguggcaucgaacgcc

SEQ ID NO: 1274881 - RNA, 17 nt, Mycobacterium tuberculosis H37Rv
cauugguaccggcuucg

SEQ ID NO: 1274882 - RNA, 21 nt, Mycobacterium tuberculosis H37Rv
cauugucgccaaauaccguga

SEQ ID NO: 1274883 - RNA, 22 nt, Mycobacterium tuberculosis H37Rv
cauuguugaagaaagcgaccgu

SEQ ID NO: 1274884 - RNA, 23 nt, Mycobacterium tuberculosis H37Rv
cauuucggcaaaauaaccguuga

SEQ ID NO: 1274885 - RNA, 20 nt, Mycobacterium tuberculosis H37Rv
cauuucgagggcaacggcac

SEQ ID NO: 1274886 - RNA, 21 nt, Mycobacterium tuberculosis H37Rv
ccaacguuuugggcgccggag

SEQ ID NO: 1274887 - RNA, 13 nt, Mycobacterium tuberculosis H37Rv
ccaacucgaccga

SEQ ID NO: 1274888 - RNA, 14 nt, Mycobacterium tuberculosis H37Rv
ccaacuccucagcc

SEQ ID NO: 1274889 - RNA, 16 nt, Mycobacterium tuberculosis H37Rv
ccaaccgguucgucga

SEQ ID NO: 1274890 - RNA, 20 nt, Mycobacterium tuberculosis H37Rv
ccaaccccgccggccggaac

SEQ ID NO: 1274891 - RNA, 16 nt, Mycobacterium tuberculosis H37Rv
ccaaccccauggccag

SEQ ID NO: 1274892 - RNA, 19 nt, Mycobacterium tuberculosis H37Rv
ccaacccgauuuauccgga

SEQ ID NO: 1274893 - RNA, 13 nt, Mycobacterium tuberculosis H37Rv
ccaaccgaaccgc

SEQ ID NO: 1274894 - RNA, 15 nt, Mycobacterium tuberculosis H37Rv
ccaaccgaaccgcgu

SEQ ID NO: 1274895 - RNA, 18 nt, Mycobacterium tuberculosis H37Rv
ccaagcgagcggcgaacu

SEQ ID NO: 1274896 - RNA, 22 nt, Mycobacterium tuberculosis H37Rv
ccaagccgggugggagcagccg

SEQ ID NO: 1274897 - RNA, 17 nt, Mycobacterium tuberculosis H37Rv
ccaagcuaacucgaccc

SEQ ID NO: 1274898 - RNA, 19 nt, Mycobacterium tuberculosis H37Rv
ccaagcuaacucgacccgu

SEQ ID NO: 1274899 - RNA, 16 nt, Mycobacterium tuberculosis H37Rv
ccaagcucggccacca

SEQ ID NO: 1274900 - RNA, 13 nt, Mycobacterium tuberculosis H37Rv
ccaacucggccaa

SEQ ID NO: 1274901 - RNA, 13 nt, Mycobacterium tuberculosis H37Rv
ccaacucggcccg

SEQ ID NO: 1274902 - RNA, 14 nt, Mycobacterium tuberculosis H37Rv
ccaacugaaccgag

SEQ ID NO: 1274903 - RNA, 18 nt, Mycobacterium tuberculosis H37Rv
ccaacugaauggcaccga

SEQ ID NO: 1274904 - RNA, 18 nt, Mycobacterium tuberculosis H37Rv
ccaacaccggcgaucacc

SEQ ID NO: 1274905 - RNA, 20 nt, Mycobacterium tuberculosis H37Rv
ccaacaccgcgccgacgaaa

SEQ ID NO: 1274906 - RNA, 19 nt, Mycobacterium tuberculosis H37Rv
ccaacaccgccagcaugac

SEQ ID NO: 1274907 - RNA, 14 nt, Mycobacterium tuberculosis H37Rv
ccaacaccagguca

SEQ ID NO: 1274908 - RNA, 15 nt, Mycobacterium tuberculosis H37Rv
ccaaaacgucaccgc

SEQ ID NO: 1274909 - RNA, 13 nt, Mycobacterium tuberculosis H37Rv
ccaccaucgccuc

SEQ ID NO: 1274910 - RNA, 23 nt, Mycobacterium tuberculosis H37Rv
ccacccagugccacgccugagcc

SEQ ID NO: 1274911 - RNA, 19 nt, Mycobacterium tuberculosis H37Rv
ccacccagaugcagcgguc

SEQ ID NO: 1274912 - RNA, 16 nt, Mycobacterium tuberculosis H37Rv
ccaccagggccaccgc

SEQ ID NO: 1274913 - RNA, 19 nt, Mycobacterium tuberculosis H37Rv
ccacaugacgaucgcggcg

SEQ ID NO: 1274914 - RNA, 20 nt, Mycobacterium tuberculosis H37Rv
ccacauuccgcagucccgaa

SEQ ID NO: 1274915 - RNA, 23 nt, Mycobacterium tuberculosis H37Rv
ccacaucgaacgacgcauccgga

SEQ ID NO: 1274916 - RNA, 22 nt, Mycobacterium tuberculosis H37Rv
ccacaugaacgaccaccgcuga

SEQ ID NO: 1274917 - RNA, 14 nt, Mycobacterium tuberculosis H37Rv
ccacaucgccagca

SEQ ID NO: 1274918 - RNA, 17 nt, Mycobacterium tuberculosis H37Rv
ccacaucaccggcgauc

SEQ ID NO: 1274919 - RNA, 14 nt, Mycobacterium tuberculosis H37Rv
ccacaucaggucgg

SEQ ID NO: 1274920 - RNA, 14 nt, Mycobacterium tuberculosis H37Rv
ccaccagacaacgc

SEQ ID NO: 1274921 - RNA, 13 nt, Mycobacterium tuberculosis H37Rv
ccaccagcaccgc

SEQ ID NO: 1274922 - RNA, 13 nt, Mycobacterium tuberculosis H37Rv
ccaccacccggaa

SEQ ID NO: 1274923 - RNA, 13 nt, Mycobacterium tuberculosis H37Rv
ccacagcgugcgg

SEQ ID NO: 1274924 - RNA, 15 nt, Mycobacterium tuberculosis H37Rv
ccacaccacgauggc

SEQ ID NO: 1274925 - RNA, 14 nt, Mycobacterium tuberculosis H37Rv
ccacacccaguuga

SEQ ID NO: 1274926 - RNA, 18 nt, Mycobacterium tuberculosis H37Rv
ccacacccaguugaugcg

SEQ ID NO: 1274927 - RNA, 16 nt, Mycobacterium tuberculosis H37Rv
ccacagucgugagcca

SEQ ID NO: 1274928 - RNA, 12 nt, Mycobacterium tuberculosis H37Rv
ccacaggugacc

SEQ ID NO: 1274929 - RNA, 11 nt, Mycobacterium tuberculosis H37Rv
ccacagcuugc

SEQ ID NO: 1274930 - RNA, 17 nt, Mycobacterium tuberculosis H37Rv
ccaauggccgcggcacc

SEQ ID NO: 1274931 - RNA, 18 nt, Mycobacterium tuberculosis H37Rv
ccaauucacgacgccgag

SEQ ID NO: 1274932 - RNA, 21 nt, Mycobacterium tuberculosis H37Rv
ccaaugcguugacgucgagca

SEQ ID NO: 1274933 - RNA, 14 nt, Mycobacterium tuberculosis H37Rv
ccaauggcguucgu

SEQ ID NO: 1274934 - RNA, 13 nt, Mycobacterium tuberculosis H37Rv
ccaagcucggccc

SEQ ID NO: 1274935 - RNA, 23 nt, Mycobacterium tuberculosis H37Rv
ccacgccgccggcgcugaucgcg

SEQ ID NO: 1274936 - RNA, 13 nt, Mycobacterium tuberculosis H37Rv
ccacgccgaucaa

SEQ ID NO: 1274937 - RNA, 12 nt, Mycobacterium tuberculosis H37Rv
ccacgccgaucu

SEQ ID NO: 1274938 - RNA, 22 nt, Mycobacterium tuberculosis H37Rv
ccacgccguagcgcagcgccuc

SEQ ID NO: 1274939 - RNA, 21 nt, Mycobacterium tuberculosis H37Rv
ccacgccggcaucgucgacgc

SEQ ID NO: 1274940 - RNA, 14 nt, Mycobacterium tuberculosis H37Rv
ccacgccgucgaca

SEQ ID NO: 1274941 - RNA, 16 nt, Mycobacterium tuberculosis H37Rv
ccacgaguuggccaag

SEQ ID NO: 1274942 - RNA, 22 nt, Mycobacterium tuberculosis H37Rv
ccacgaucagcagcgucggugc

SEQ ID NO: 1274943 - RNA, 19 nt, Mycobacterium tuberculosis H37Rv
ccacggcgggaacggugcc

SEQ ID NO: 1274944 - RNA, 16 nt, Mycobacterium tuberculosis H37Rv
ccacgcucaacccgug

SEQ ID NO: 1274945 - RNA, 20 nt, Mycobacterium tuberculosis H37Rv
ccacgcgucgcuguuggcga

SEQ ID NO: 1274946 - RNA, 14 nt, Mycobacterium tuberculosis H37Rv
ccacgcguugacga

SEQ ID NO: 1274947 - RNA, 17 nt, Mycobacterium tuberculosis H37Rv
ccacgcguugacgaucu

SEQ ID NO: 1274948 - RNA, 17 nt, Mycobacterium tuberculosis H37Rv
ccacgcguuucgaaccg

SEQ ID NO: 1274949 - RNA, 17 nt, Mycobacterium tuberculosis H37Rv
ccacgcgucgcuguugg

SEQ ID NO: 1274950 - RNA, 14 nt, Mycobacterium tuberculosis H37Rv
ccaccgggccgaca

SEQ ID NO: 1274951 - RNA, 23 nt, Mycobacterium tuberculosis H37Rv
ccaccggggaagaucucggccag

SEQ ID NO: 1274952 - RNA, 14 nt, Mycobacterium tuberculosis H37Rv
ccaccguggccgca

SEQ ID NO: 1274953 - RNA, 17 nt, Mycobacterium tuberculosis H37Rv
ccaccgguaccgaucag

SEQ ID NO: 1274954 - RNA, 16 nt, Mycobacterium tuberculosis H37Rv
ccaccggugccggcga

SEQ ID NO: 1274955 - RNA, 19 nt, Mycobacterium tuberculosis H37Rv
ccaccgaaaccggucagca

SEQ ID NO: 1274956 - RNA, 20 nt, Mycobacterium tuberculosis H37Rv
ccaccgaacgugugggccau

SEQ ID NO: 1274957 - RNA, 16 nt, Mycobacterium tuberculosis H37Rv
ccaccgaagcggugac

SEQ ID NO: 1274958 - RNA, 15 nt, Mycobacterium tuberculosis H37Rv
ccaccgaccgcguaa

SEQ ID NO: 1274959 - RNA, 13 nt, Mycobacterium tuberculosis H37Rv
ccacccgcaccgc

SEQ ID NO: 1274960 - RNA, 22 nt, Mycobacterium tuberculosis H37Rv
ccaccguugccgccgucaccgc

SEQ ID NO: 1274961 - RNA, 15 nt, Mycobacterium tuberculosis H37Rv
ccaccuccugguuga

SEQ ID NO: 1274962 - RNA, 19 nt, Mycobacterium tuberculosis H37Rv
ccaccuccgaggccgccau

SEQ ID NO: 1274963 - RNA, 20 nt, Mycobacterium tuberculosis H37Rv
ccaccuggaguccagcucgg

SEQ ID NO: 1274964 - RNA, 21 nt, Mycobacterium tuberculosis H37Rv
ccaccucaccgaucucgacca

SEQ ID NO: 1274965 - RNA, 15 nt, Mycobacterium tuberculosis H37Rv
ccaccucgacgcacc

SEQ ID NO: 1274966 - RNA, 16 nt, Mycobacterium tuberculosis H37Rv
ccaccugugcgaacag

SEQ ID NO: 1274967 - RNA, 15 nt, Mycobacterium tuberculosis H37Rv
ccaccuuggacacca

SEQ ID NO: 1274968 - RNA, 18 nt, Mycobacterium tuberculosis H37Rv
ccagcaacgcgguggacc

SEQ ID NO: 1274969 - RNA, 19 nt, Mycobacterium tuberculosis H37Rv
ccagaggcgcuucgccaca

SEQ ID NO: 1274970 - RNA, 18 nt, Mycobacterium tuberculosis H37Rv
ccagcaagugugagcaga

SEQ ID NO: 1274971 - RNA, 13 nt, Mycobacterium tuberculosis H37Rv
ccagcaagugcgg

SEQ ID NO: 1274972 - RNA, 14 nt, Mycobacterium tuberculosis H37Rv
ccagcaacgguugg

SEQ ID NO: 1274973 - RNA, 22 nt, Mycobacterium tuberculosis H37Rv
ccagcaaugcccgcaccgcguu

SEQ ID NO: 1274974 - RNA, 19 nt, Mycobacterium tuberculosis H37Rv
ccagcacaccgucgacgac

SEQ ID NO: 1274975 - RNA, 18 nt, Mycobacterium tuberculosis H37Rv
ccagcacaccgucgacga

SEQ ID NO: 1274976 - RNA, 23 nt, Mycobacterium tuberculosis H37Rv
ccagaaucggguucuuuugcguc

SEQ ID NO: 1274977 - RNA, 18 nt, Mycobacterium tuberculosis H37Rv
ccagaauuccggcggagc

SEQ ID NO: 1274978 - RNA, 16 nt, Mycobacterium tuberculosis H37Rv
ccagacacaaccgcuu

SEQ ID NO: 1274979 - RNA, 15 nt, Mycobacterium tuberculosis H37Rv
ccagacccacgaugg

SEQ ID NO: 1274980 - RNA, 23 nt, Mycobacterium tuberculosis H37Rv
ccagagccgcgcgccgguuggcc

SEQ ID NO: 1274981 - RNA, 15 nt, Mycobacterium tuberculosis H37Rv
ccagagcuucgccgc

SEQ ID NO: 1274982 - RNA, 22 nt, Mycobacterium tuberculosis H37Rv
ccagagcagcucacuggugacc

SEQ ID NO: 1274983 - RNA, 19 nt, Mycobacterium tuberculosis H37Rv
ccagaccgccgacgccguu

SEQ ID NO: 1274984 - RNA, 18 nt, Mycobacterium tuberculosis H37Rv
ccagagacaugucgcugc

SEQ ID NO: 1274985 - RNA, 20 nt, Mycobacterium tuberculosis H37Rv
ccacguugacggcgaacccg

SEQ ID NO: 1274986 - RNA, 16 nt, Mycobacterium tuberculosis H37Rv
ccacgucgacggucug

SEQ ID NO: 1274987 - RNA, 12 nt, Mycobacterium tuberculosis H37Rv
ccacgucgagca

SEQ ID NO: 1274988 - RNA, 21 nt, Mycobacterium tuberculosis H37Rv
ccacguguggugugucaccgg

SEQ ID NO: 1274989 - RNA, 15 nt, Mycobacterium tuberculosis H37Rv
ccacguuacgcucgc

SEQ ID NO: 1274990 - RNA, 15 nt, Mycobacterium tuberculosis H37Rv
ccacuacaucgauca

SEQ ID NO: 1274991 - RNA, 20 nt, Mycobacterium tuberculosis H37Rv
ccacguugaugaugccggcg

SEQ ID NO: 1274992 - RNA, 16 nt, Mycobacterium tuberculosis H37Rv
ccacguccaacucggc

SEQ ID NO: 1274993 - RNA, 14 nt, Mycobacterium tuberculosis H37Rv
ccacguagcagcag

SEQ ID NO: 1274994 - RNA, 21 nt, Mycobacterium tuberculosis H37Rv
ccacguccgcaaccucgccgu

SEQ ID NO: 1274995 - RNA, 19 nt, Mycobacterium tuberculosis H37Rv
ccacgucgaugugcgccca

SEQ ID NO: 1274996 - RNA, 15 nt, Mycobacterium tuberculosis H37Rv
ccacgucgacgaugu

SEQ ID NO: 1274997 - RNA, 23 nt, Mycobacterium tuberculosis H37Rv
ccacguccgcaaccucgccgucg

SEQ ID NO: 1274998 - RNA, 17 nt, Mycobacterium tuberculosis H37Rv
ccacggcuuugcggcgc

SEQ ID NO: 1274999 - RNA, 22 nt, Mycobacterium tuberculosis H37Rv
ccacgguggucccccgcagcca

SEQ ID NO: 1275000 - RNA, 15 nt, Mycobacterium tuberculosis H37Rv
ccacgguugccggcg

SEQ ID NO: 1275001 - RNA, 21 nt, Mycobacterium tuberculosis H37Rv
ccacgguucuuccuggucgac

SEQ ID NO: 1275002 - RNA, 12 nt, Mycobacterium tuberculosis H37Rv
ccacggugucgu

SEQ ID NO: 1275003 - RNA, 16 nt, Mycobacterium tuberculosis H37Rv
ccacgguuggccacca

SEQ ID NO: 1275004 - RNA, 20 nt, Mycobacterium tuberculosis H37Rv
ccacguaagcgguuguccgg

SEQ ID NO: 1275005 - RNA, 18 nt, Mycobacterium tuberculosis H37Rv
ccacguaagcgguugucc

SEQ ID NO: 1275006 - RNA, 16 nt, Mycobacterium tuberculosis H37Rv
ccacguacuccaccgc

SEQ ID NO: 1275007 - RNA, 22 nt, Mycobacterium tuberculosis H37Rv
ccacuuggggcgccagggucgg

SEQ ID NO: 1275008 - RNA, 19 nt, Mycobacterium tuberculosis H37Rv
ccacuuguuguccgucgau

SEQ ID NO: 1275009 - RNA, 15 nt, Mycobacterium tuberculosis H37Rv
ccacuuuucgguggc

SEQ ID NO: 1275010 - RNA, 21 nt, Mycobacterium tuberculosis H37Rv
ccacuuuucgguggcggcagc

SEQ ID NO: 1275011 - RNA, 16 nt, Mycobacterium tuberculosis H37Rv
ccacuuccacggcgug

SEQ ID NO: 1275012 - RNA, 13 nt, Mycobacterium tuberculosis H37Rv
ccacuucgguguu

SEQ ID NO: 1275013 - RNA, 14 nt, Mycobacterium tuberculosis H37Rv
ccacuugaugcucg

SEQ ID NO: 1275014 - RNA, 12 nt, Mycobacterium tuberculosis H37Rv
ccacuacggccu

SEQ ID NO: 1275015 - RNA, 20 nt, Mycobacterium tuberculosis H37Rv
ccacucggucguugccgcgg

SEQ ID NO: 1275016 - RNA, 15 nt, Mycobacterium tuberculosis H37Rv
ccacugccagccgug

SEQ ID NO: 1275017 - RNA, 14 nt, Mycobacterium tuberculosis H37Rv
ccacugcacccgau

SEQ ID NO: 1275018 - RNA, 13 nt, Mycobacterium tuberculosis H37Rv
ccagccugcuggc

SEQ ID NO: 1275019 - RNA, 17 nt, Mycobacterium tuberculosis H37Rv
ccagccguucucgccca

SEQ ID NO: 1275020 - RNA, 20 nt, Mycobacterium tuberculosis H37Rv
ccagccgacaacuguccugc

SEQ ID NO: 1275021 - RNA, 13 nt, Mycobacterium tuberculosis H37Rv
ccagccggugagc

SEQ ID NO: 1275022 - RNA, 15 nt, Mycobacterium tuberculosis H37Rv
ccagccggcagcagc

SEQ ID NO: 1275023 - RNA, 20 nt, Mycobacterium tuberculosis H37Rv
ccagccgacguaccagggug

SEQ ID NO: 1275024 - RNA, 12 nt, Mycobacterium tuberculosis H37Rv
ccagccgaucac

SEQ ID NO: 1275025 - RNA, 15 nt, Mycobacterium tuberculosis H37Rv
aaaucaagcacagcc

SEQ ID NO: 1275026 - RNA, 18 nt, Mycobacterium tuberculosis H37Rv
ccagcgcgacguccacca

SEQ ID NO: 1275027 - RNA, 22 nt, Mycobacterium tuberculosis H37Rv
ccagcgccuugacgccaguugc

SEQ ID NO: 1275028 - RNA, 13 nt, Mycobacterium tuberculosis H37Rv
ccagcgcguggaa

SEQ ID NO: 1275029 - RNA, 12 nt, Mycobacterium tuberculosis H37Rv
ccagcgcggcga

SEQ ID NO: 1275030 - RNA, 22 nt, Mycobacterium tuberculosis H37Rv
ccagcgccggccaagaccgcgg

SEQ ID NO: 1275031 - RNA, 16 nt, Mycobacterium tuberculosis H37Rv
ccagcgccacgaugac

SEQ ID NO: 1275032 - RNA, 13 nt, Mycobacterium tuberculosis H37Rv
ccagcgccaccgu

SEQ ID NO: 1275033 - RNA, 21 nt, Mycobacterium tuberculosis H37Rv
ccagcgccgccgccgacgaag

SEQ ID NO: 1275034 - RNA, 18 nt, Mycobacterium tuberculosis H37Rv
ccagcaccacggccagcg

SEQ ID NO: 1275035 - RNA, 22 nt, Mycobacterium tuberculosis H37Rv
ccagcaccaccgcggugugcgu

SEQ ID NO: 1275036 - RNA, 15 nt, Mycobacterium tuberculosis H37Rv
ccagcacgcuggcgu

SEQ ID NO: 1275037 - RNA, 16 nt, Mycobacterium tuberculosis H37Rv
ccagcacggcaaccag

SEQ ID NO: 1275038 - RNA, 13 nt, Mycobacterium tuberculosis H37Rv
ccagcacggccac

SEQ ID NO: 1275039 - RNA, 15 nt, Mycobacterium tuberculosis H37Rv
ccagcacggucaacg

SEQ ID NO: 1275040 - RNA, 13 nt, Mycobacterium tuberculosis H37Rv
aaauagcgagcgu

SEQ ID NO: 1275041 - RNA, 19 nt, Mycobacterium tuberculosis H37Rv
aaauagauucccggcucga

SEQ ID NO: 1275042 - RNA, 17 nt, Mycobacterium tuberculosis H37Rv
ccagcagcaaucagccg

SEQ ID NO: 1275043 - RNA, 14 nt, Mycobacterium tuberculosis H37Rv
ccagcagcaccgac

SEQ ID NO: 1275044 - RNA, 22 nt, Mycobacterium tuberculosis H37Rv
ccagcagcaccugcaccgcauu

SEQ ID NO: 1275045 - RNA, 16 nt, Mycobacterium tuberculosis H37Rv
ccagcagcgcaaccag

SEQ ID NO: 1275046 - RNA, 13 nt, Mycobacterium tuberculosis H37Rv
ccagcagcgcaac

SEQ ID NO: 1275047 - RNA, 15 nt, Mycobacterium tuberculosis H37Rv
ccagcagcgaaaacc

SEQ ID NO: 1275048 - RNA, 23 nt, Mycobacterium tuberculosis H37Rv
ccagcagcgaaaaccgucgcaga

SEQ ID NO: 1275049 - RNA, 12 nt, Mycobacterium tuberculosis H37Rv
ccagcagcugaa

SEQ ID NO: 1275050 - RNA, 13 nt, Mycobacterium tuberculosis H37Rv
ccagcagcugcga

SEQ ID NO: 1275051 - RNA, 15 nt, Mycobacterium tuberculosis H37Rv
ccagcagcucggccg

SEQ ID NO: 1275052 - RNA, 23 nt, Mycobacterium tuberculosis H37Rv
ccagcauggcuuuugcgccgaau

SEQ ID NO: 1275053 - RNA, 20 nt, Mycobacterium tuberculosis H37Rv
ccagcauggggucagcucgc

SEQ ID NO: 1275054 - RNA, 21 nt, Mycobacterium tuberculosis H37Rv
ccagcaugcccgccauccgau

SEQ ID NO: 1275055 - RNA, 14 nt, Mycobacterium tuberculosis H37Rv
ccagcaucucggcc

SEQ ID NO: 1275056 - RNA, 22 nt, Mycobacterium tuberculosis H37Rv
ccagcaucggcagcagcgcaac

SEQ ID NO: 1275057 - RNA, 21 nt, Mycobacterium tuberculosis H37Rv
ccagcaucucggcggccaaca

SEQ ID NO: 1275058 - RNA, 12 nt, Mycobacterium tuberculosis H37Rv
ccagcaggccgg

SEQ ID NO: 1275059 - RNA, 14 nt, Mycobacterium tuberculosis H37Rv
ccagcaggcggcuc

SEQ ID NO: 1275060 - RNA, 15 nt, Mycobacterium tuberculosis H37Rv
cccggcagcgugcgg

SEQ ID NO: 1275061 - RNA, 15 nt, Mycobacterium tuberculosis H37Rv
cccggcaaugaucau

SEQ ID NO: 1275062 - RNA, 17 nt, Mycobacterium tuberculosis H37Rv
cccggcacacggccuug

SEQ ID NO: 1275063 - RNA, 20 nt, Mycobacterium tuberculosis H37Rv
cccggaggguucggacggcu

SEQ ID NO: 1275064 - RNA, 17 nt, Mycobacterium tuberculosis H37Rv
cccggcacugaccgcga

SEQ ID NO: 1275065 - RNA, 14 nt, Mycobacterium tuberculosis H37Rv
cccggcacgcucgg

SEQ ID NO: 1275066 - RNA, 19 nt, Mycobacterium tuberculosis H37Rv
cccggcaccccuuugacgc

SEQ ID NO: 1275067 - RNA, 20 nt, Mycobacterium tuberculosis H37Rv
cccggccaggucgacaccgc

SEQ ID NO: 1275068 - RNA, 17 nt, Mycobacterium tuberculosis H37Rv
cccggccagccgcacgg

SEQ ID NO: 1275069 - RNA, 14 nt, Mycobacterium tuberculosis H37Rv
cccggccaggccga

SEQ ID NO: 1275070 - RNA, 18 nt, Mycobacterium tuberculosis H37Rv
cccggccagcucgggcgc

SEQ ID NO: 1275071 - RNA, 16 nt, Mycobacterium tuberculosis H37Rv
cccggccaccagcaug

SEQ ID NO: 1275072 - RNA, 14 nt, Mycobacterium tuberculosis H37Rv
cccggccaccagca

SEQ ID NO: 1275073 - RNA, 13 nt, Mycobacterium tuberculosis H37Rv
cccggccaagccg

SEQ ID NO: 1275074 - RNA, 21 nt, Mycobacterium tuberculosis H37Rv
cccggcgaugagcaugcccag

SEQ ID NO: 1275075 - RNA, 13 nt, Mycobacterium tuberculosis H37Rv
cccggcgaucagc

SEQ ID NO: 1275076 - RNA, 15 nt, Mycobacterium tuberculosis H37Rv
cccggcgacccgguc

SEQ ID NO: 1275077 - RNA, 16 nt, Mycobacterium tuberculosis H37Rv
cccggcgacccgguca

SEQ ID NO: 1275078 - RNA, 14 nt, Mycobacterium tuberculosis H37Rv
cccggcgaccgggu

SEQ ID NO: 1275079 - RNA, 15 nt, Mycobacterium tuberculosis H37Rv
cccggccggucgaga

SEQ ID NO: 1275080 - RNA, 14 nt, Mycobacterium tuberculosis H37Rv
cccggccgccgaaa

SEQ ID NO: 1275081 - RNA, 13 nt, Mycobacterium tuberculosis H37Rv
cccggccgcgcac

SEQ ID NO: 1275082 - RNA, 18 nt, Mycobacterium tuberculosis H37Rv
cccggccgccagcgcgcc

SEQ ID NO: 1275083 - RNA, 18 nt, Mycobacterium tuberculosis H37Rv
cccggccgaacgccucgc

SEQ ID NO: 1275084 - RNA, 17 nt, Mycobacterium tuberculosis H37Rv
cccggccgccagcgcgc

SEQ ID NO: 1275085 - RNA, 14 nt, Mycobacterium tuberculosis H37Rv
cccggcccguagcg

SEQ ID NO: 1275086 - RNA, 19 nt, Mycobacterium tuberculosis H37Rv
cccggcccaaggaacggcg

SEQ ID NO: 1275087 - RNA, 14 nt, Mycobacterium tuberculosis H37Rv
cccggcccgccacc

SEQ ID NO: 1275088 - RNA, 15 nt, Mycobacterium tuberculosis H37Rv
cccggcccagcgccc

SEQ ID NO: 1275089 - RNA, 14 nt, Mycobacterium tuberculosis H37Rv
cccggcggaucccg

SEQ ID NO: 1275090 - RNA, 13 nt, Mycobacterium tuberculosis H37Rv
cccggcucgaugg

SEQ ID NO: 1275091 - RNA, 21 nt, Mycobacterium tuberculosis H37Rv
cccggcucggccagccagcgg

SEQ ID NO: 1275092 - RNA, 15 nt, Mycobacterium tuberculosis H37Rv
cccggcuccagcacc

SEQ ID NO: 1275093 - RNA, 15 nt, Mycobacterium tuberculosis H37Rv
cccggcgcgauggcg

SEQ ID NO: 1275094 - RNA, 12 nt, Mycobacterium tuberculosis H37Rv
cccggcgcgaau

SEQ ID NO: 1275095 - RNA, 22 nt, Mycobacterium tuberculosis H37Rv
cccggucuacgacgucgcugua

SEQ ID NO: 1275096 - RNA, 20 nt, Mycobacterium tuberculosis H37Rv
cccggucggagcggugccga

SEQ ID NO: 1275097 - RNA, 15 nt, Mycobacterium tuberculosis H37Rv
cccggucuagcuggg

SEQ ID NO: 1275098 - RNA, 22 nt, Mycobacterium tuberculosis H37Rv
cccggucggguccaacgccgcc

SEQ ID NO: 1275099 - RNA, 12 nt, Mycobacterium tuberculosis H37Rv
cccggucgagcg

SEQ ID NO: 1275100 - RNA, 23 nt, Mycobacterium tuberculosis H37Rv
cccggucgauucggcucaucccg

SEQ ID NO: 1275101 - RNA, 18 nt, Mycobacterium tuberculosis H37Rv
cccgggaucgggucaccg

SEQ ID NO: 1275102 - RNA, 18 nt, Mycobacterium tuberculosis H37Rv
cccgguagcggcggcaug

SEQ ID NO: 1275103 - RNA, 19 nt, Mycobacterium tuberculosis H37Rv
cccggucgacgggucggcg

SEQ ID NO: 1275104 - RNA, 22 nt, Mycobacterium tuberculosis H37Rv
cccgggaucuagaugcggaacg

SEQ ID NO: 1275105 - RNA, 16 nt, Mycobacterium tuberculosis H37Rv
cccgggaugaccaccg

SEQ ID NO: 1275106 - RNA, 12 nt, Mycobacterium tuberculosis H37Rv
cccgggauaccg

SEQ ID NO: 1275107 - RNA, 21 nt, Mycobacterium tuberculosis H37Rv
cccggguggcccggaacaccg

SEQ ID NO: 1275108 - RNA, 14 nt, Mycobacterium tuberculosis H37Rv
cccgggccaggcug

SEQ ID NO: 1275109 - RNA, 19 nt, Mycobacterium tuberculosis H37Rv
cccgggccaguucgucggc

SEQ ID NO: 1275110 - RNA, 24 nt, Mycobacterium tuberculosis H37Rv
cccgugguggcgccaugaagccgg

SEQ ID NO: 1275111 - RNA, 19 nt, Mycobacterium tuberculosis H37Rv
cccuaucagccgagacacc

SEQ ID NO: 1275112 - RNA, 18 nt, Mycobacterium tuberculosis H37Rv
cccucaguucacguucgg

SEQ ID NO: 1275113 - RNA, 14 nt, Mycobacterium tuberculosis H37Rv
cccucaguucacgu

SEQ ID NO: 1275114 - RNA, 13 nt, Mycobacterium tuberculosis H37Rv
cccucggugccac

SEQ ID NO: 1275115 - RNA, 15 nt, Mycobacterium tuberculosis H37Rv
cccgucuccagcacc

SEQ ID NO: 1275116 - RNA, 17 nt, Mycobacterium tuberculosis H37Rv
cccgugccgccgaugcc

SEQ ID NO: 1275117 - RNA, 21 nt, Mycobacterium tuberculosis H37Rv
cccgugccgccgaugccgccg

SEQ ID NO: 1275118 - RNA, 14 nt, Mycobacterium tuberculosis H37Rv
cccgugcgacuucg

SEQ ID NO: 1275119 - RNA, 17 nt, Mycobacterium tuberculosis H37Rv
cccgugccacagcucgc

SEQ ID NO: 1275120 - RNA, 23 nt, Mycobacterium tuberculosis H37Rv
cccgguugcggucagacgccggc

SEQ ID NO: 1275121 - RNA, 23 nt, Mycobacterium tuberculosis H37Rv
cccgguugugcgcgcgcccgaau

SEQ ID NO: 1275122 - RNA, 13 nt, Mycobacterium tuberculosis H37Rv
cccguacacgauc

SEQ ID NO: 1275123 - RNA, 12 nt, Mycobacterium tuberculosis H37Rv
cccgguugacuc

SEQ ID NO: 1275124 - RNA, 12 nt, Mycobacterium tuberculosis H37Rv
cccgguugacgc

SEQ ID NO: 1275125 - RNA, 16 nt, Mycobacterium tuberculosis H37Rv
cccggucuuacggucg

SEQ ID NO: 1275126 - RNA, 15 nt, Mycobacterium tuberculosis H37Rv
cccugucaacgccgc

SEQ ID NO: 1275127 - RNA, 14 nt, Mycobacterium tuberculosis H37Rv
cccugguucggcga

SEQ ID NO: 1275128 - RNA, 21 nt, Mycobacterium tuberculosis H37Rv
cccugguagugaacggaucgu

SEQ ID NO: 1275129 - RNA, 19 nt, Mycobacterium tuberculosis H37Rv
cccuguucuccgugaucga

SEQ ID NO: 1275130 - RNA, 23 nt, Mycobacterium tuberculosis H37Rv
cccuucaaagcggccucgaccuc

SEQ ID NO: 1275131 - RNA, 20 nt, Mycobacterium tuberculosis H37Rv
ccgaaacaccgucuggccgu

SEQ ID NO: 1275132 - RNA, 14 nt, Mycobacterium tuberculosis H37Rv
ccgaaaaguccgcc

SEQ ID NO: 1275133 - RNA, 14 nt, Mycobacterium tuberculosis H37Rv
ccgaaacccgaugu

SEQ ID NO: 1275134 - RNA, 12 nt, Mycobacterium tuberculosis H37Rv
ccgaaacgccgg

SEQ ID NO: 1275135 - RNA, 15 nt, Mycobacterium tuberculosis H37Rv
ccgaaacgauggccg

SEQ ID NO: 1275136 - RNA, 13 nt, Mycobacterium tuberculosis H37Rv
ccgaaacgauggc

SEQ ID NO: 1275137 - RNA, 16 nt, Mycobacterium tuberculosis H37Rv
ccgaaacgaugcggcc

SEQ ID NO: 1275138 - RNA, 13 nt, Mycobacterium tuberculosis H37Rv
cccugccacgcgu

SEQ ID NO: 1275139 - RNA, 23 nt, Mycobacterium tuberculosis H37Rv
cccugccaugggaguucaucgca

SEQ ID NO: 1275140 - RNA, 13 nt, Mycobacterium tuberculosis H37Rv
cccugcgugcggc

SEQ ID NO: 1275141 - RNA, 23 nt, Mycobacterium tuberculosis H37Rv
cccugaucgugaacacgucgcgg

SEQ ID NO: 1275142 - RNA, 21 nt, Mycobacterium tuberculosis H37Rv
cccugaucgugaacacgucgc

SEQ ID NO: 1275143 - RNA, 22 nt, Mycobacterium tuberculosis H37Rv
cccugcacggugcccagggcga

SEQ ID NO: 1275144 - RNA, 17 nt, Mycobacterium tuberculosis H37Rv
cccugcacggugcccag

SEQ ID NO: 1275145 - RNA, 12 nt, Mycobacterium tuberculosis H37Rv
cccugcacagca

SEQ ID NO: 1275146 - RNA, 21 nt, Mycobacterium tuberculosis H37Rv
cccugcacagcagcgucauca

SEQ ID NO: 1275147 - RNA, 21 nt, Mycobacterium tuberculosis H37Rv
cccgauuuauccggaucggcc

SEQ ID NO: 1275148 - RNA, 18 nt, Mycobacterium tuberculosis H37Rv
cccgauugaguucggcgg

SEQ ID NO: 1275149 - RNA, 14 nt, Mycobacterium tuberculosis H37Rv
cccgcaacuacggc

SEQ ID NO: 1275150 - RNA, 12 nt, Mycobacterium tuberculosis H37Rv
cccgcaacgcgu

SEQ ID NO: 1275151 - RNA, 13 nt, Mycobacterium tuberculosis H37Rv
cccgaucgaccgc

SEQ ID NO: 1275152 - RNA, 15 nt, Mycobacterium tuberculosis H37Rv
cccgaucccggccag

SEQ ID NO: 1275153 - RNA, 12 nt, Mycobacterium tuberculosis H37Rv
cccgaucccgag

SEQ ID NO: 1275154 - RNA, 13 nt, Mycobacterium tuberculosis H37Rv
cccgcaggucgca

SEQ ID NO: 1275155 - RNA, 21 nt, Mycobacterium tuberculosis H37Rv
cccgccagaacggcgucgaau

SEQ ID NO: 1275156 - RNA, 16 nt, Mycobacterium tuberculosis H37Rv
cccgcaauuguucgcg

SEQ ID NO: 1275157 - RNA, 14 nt, Mycobacterium tuberculosis H37Rv
cccgcagcugcgga

SEQ ID NO: 1275158 - RNA, 22 nt, Mycobacterium tuberculosis H37Rv
cccgccagcgccgccgcgagcg

SEQ ID NO: 1275159 - RNA, 17 nt, Mycobacterium tuberculosis H37Rv
cccgccagggcggcauc

SEQ ID NO: 1275160 - RNA, 14 nt, Mycobacterium tuberculosis H37Rv
cccgccgagcaccg

SEQ ID NO: 1275161 - RNA, 21 nt, Mycobacterium tuberculosis H37Rv
cccgccgagcggugccggcgu

SEQ ID NO: 1275162 - RNA, 14 nt, Mycobacterium tuberculosis H37Rv
cccgccgacgccgc

SEQ ID NO: 1275163 - RNA, 15 nt, Mycobacterium tuberculosis H37Rv
cccgccgucggcauc

SEQ ID NO: 1275164 - RNA, 13 nt, Mycobacterium tuberculosis H37Rv
cccgccgucggca

SEQ ID NO: 1275165 - RNA, 21 nt, Mycobacterium tuberculosis H37Rv
cccgccgucaccgcgcggcuc

SEQ ID NO: 1275166 - RNA, 15 nt, Mycobacterium tuberculosis H37Rv
cccgccgguggccgc

SEQ ID NO: 1275167 - RNA, 14 nt, Mycobacterium tuberculosis H37Rv
cccgccguagacca

SEQ ID NO: 1275168 - RNA, 12 nt, Mycobacterium tuberculosis H37Rv
cccgccgucgcc

SEQ ID NO: 1275169 - RNA, 23 nt, Mycobacterium tuberculosis H37Rv
cccgccguugccgccgacgccgc

SEQ ID NO: 1275170 - RNA, 22 nt, Mycobacterium tuberculosis H37Rv
cccgccguuuccgccgccgcca

SEQ ID NO: 1275171 - RNA, 13 nt, Mycobacterium tuberculosis H37Rv
cccgccgcgacgg

SEQ ID NO: 1275172 - RNA, 13 nt, Mycobacterium tuberculosis H37Rv
cccgcgccggcga

SEQ ID NO: 1275173 - RNA, 14 nt, Mycobacterium tuberculosis H37Rv
cccgcgccggcguu

SEQ ID NO: 1275174 - RNA, 22 nt, Mycobacterium tuberculosis H37Rv
cccgcguuugcgaagcccacgu

SEQ ID NO: 1275175 - RNA, 16 nt, Mycobacterium tuberculosis H37Rv
cccgcguggccgguca

SEQ ID NO: 1275176 - RNA, 20 nt, Mycobacterium tuberculosis H37Rv
cccgcgucuacgucguccag

SEQ ID NO: 1275177 - RNA, 21 nt, Mycobacterium tuberculosis H37Rv
cccgcgucgacgagcggcuuc

SEQ ID NO: 1275178 - RNA, 23 nt, Mycobacterium tuberculosis H37Rv
cccgccguugccgccgucaccgc

SEQ ID NO: 1275179 - RNA, 12 nt, Mycobacterium tuberculosis H37Rv
cccgccucgacc

SEQ ID NO: 1275180 - RNA, 16 nt, Mycobacterium tuberculosis H37Rv
cccgccucgaccgcca

SEQ ID NO: 1275181 - RNA, 13 nt, Mycobacterium tuberculosis H37Rv
cccgcgcccaacg

SEQ ID NO: 1275182 - RNA, 13 nt, Mycobacterium tuberculosis H37Rv
cccgcuucgcccg

SEQ ID NO: 1275183 - RNA, 22 nt, Mycobacterium tuberculosis H37Rv
cccggacgauggcgucggccag

SEQ ID NO: 1275184 - RNA, 12 nt, Mycobacterium tuberculosis H37Rv
cccggaccuggg

SEQ ID NO: 1275185 - RNA, 21 nt, Mycobacterium tuberculosis H37Rv
cccggacuucaugaucggacc

SEQ ID NO: 1275186 - RNA, 16 nt, Mycobacterium tuberculosis H37Rv
cccgcuccuccggcac

SEQ ID NO: 1275187 - RNA, 20 nt, Mycobacterium tuberculosis H37Rv
cccgcuccauaucgucgggc

SEQ ID NO: 1275188 - RNA, 15 nt, Mycobacterium tuberculosis H37Rv
cccgcuccacgguca

SEQ ID NO: 1275189 - RNA, 16 nt, Mycobacterium tuberculosis H37Rv
cccgcucagccguccg

SEQ ID NO: 1275190 - RNA, 14 nt, Mycobacterium tuberculosis H37Rv
cccccgucggccuu

SEQ ID NO: 1275191 - RNA, 16 nt, Mycobacterium tuberculosis H37Rv
cccccgucgaucagcg

SEQ ID NO: 1275192 - RNA, 23 nt, Mycobacterium tuberculosis H37Rv
ccccgacacuuaaccugaaccgg

SEQ ID NO: 1275193 - RNA, 19 nt, Mycobacterium tuberculosis H37Rv
ccccgacgagauacggcca

SEQ ID NO: 1275194 - RNA, 20 nt, Mycobacterium tuberculosis H37Rv
ccccgacgucaggcagcucc

SEQ ID NO: 1275195 - RNA, 13 nt, Mycobacterium tuberculosis H37Rv
cccccggcgacgg

SEQ ID NO: 1275196 - RNA, 19 nt, Mycobacterium tuberculosis H37Rv
cccccgaaccugcggcagc

SEQ ID NO: 1275197 - RNA, 17 nt, Mycobacterium tuberculosis H37Rv
cccccgaaguggugacc

SEQ ID NO: 1275198 - RNA, 13 nt, Mycobacterium tuberculosis H37Rv
cccccauugccgc

SEQ ID NO: 1275199 - RNA, 18 nt, Mycobacterium tuberculosis H37Rv
ccccgccgccguucccgc

SEQ ID NO: 1275200 - RNA, 13 nt, Mycobacterium tuberculosis H37Rv
ccccgacugccgc

SEQ ID NO: 1275201 - RNA, 17 nt, Mycobacterium tuberculosis H37Rv
ccccgagauccguccgc

SEQ ID NO: 1275202 - RNA, 13 nt, Mycobacterium tuberculosis H37Rv
ccccgagcccgcc

SEQ ID NO: 1275203 - RNA, 16 nt, Mycobacterium tuberculosis H37Rv
ccccgagcccgccagc

SEQ ID NO: 1275204 - RNA, 12 nt, Mycobacterium tuberculosis H37Rv
ccccgcgcugag

SEQ ID NO: 1275205 - RNA, 15 nt, Mycobacterium tuberculosis H37Rv
ccccgccgucgccac

SEQ ID NO: 1275206 - RNA, 15 nt, Mycobacterium tuberculosis H37Rv
ccccgccguugccgc

SEQ ID NO: 1275207 - RNA, 14 nt, Mycobacterium tuberculosis H37Rv
ccccagacaaagau

SEQ ID NO: 1275208 - RNA, 20 nt, Mycobacterium tuberculosis H37Rv
cccaggcgcucaucacccag

SEQ ID NO: 1275209 - RNA, 12 nt, Mycobacterium tuberculosis H37Rv
cccaggcgaaca

SEQ ID NO: 1275210 - RNA, 22 nt, Mycobacterium tuberculosis H37Rv
ccccagggugcgccauucgccc

SEQ ID NO: 1275211 - RNA, 15 nt, Mycobacterium tuberculosis H37Rv
ccccaguucggcguc

SEQ ID NO: 1275212 - RNA, 18 nt, Mycobacterium tuberculosis H37Rv
ccccaguucgacggcguc

SEQ ID NO: 1275213 - RNA, 23 nt, Mycobacterium tuberculosis H37Rv
ccccauaguuguuccuggucgag

SEQ ID NO: 1275214 - RNA, 12 nt, Mycobacterium tuberculosis H37Rv
ccccagaccgcc

SEQ ID NO: 1275215 - RNA, 18 nt, Mycobacterium tuberculosis H37Rv
ccccagacaauccgccgc

SEQ ID NO: 1275216 - RNA, 17 nt, Mycobacterium tuberculosis H37Rv
ccccagcaccacgguga

SEQ ID NO: 1275217 - RNA, 23 nt, Mycobacterium tuberculosis H37Rv
cccgacgucgcggaguagccgca

SEQ ID NO: 1275218 - RNA, 23 nt, Mycobacterium tuberculosis H37Rv
cccgauaucaauggcagcugaau

SEQ ID NO: 1275219 - RNA, 16 nt, Mycobacterium tuberculosis H37Rv
cccgauauucggccau

SEQ ID NO: 1275220 - RNA, 16 nt, Mycobacterium tuberculosis H37Rv
cccgaucaggccgacg

SEQ ID NO: 1275221 - RNA, 19 nt, Mycobacterium tuberculosis H37Rv
cccgacuucaagacagccg

SEQ ID NO: 1275222 - RNA, 19 nt, Mycobacterium tuberculosis H37Rv
cccgaaguggugaccgacg

SEQ ID NO: 1275223 - RNA, 22 nt, Mycobacterium tuberculosis H37Rv
cccgaaguggugaccgacgcgg

SEQ ID NO: 1275224 - RNA, 15 nt, Mycobacterium tuberculosis H37Rv
cccgaccgccaccgc

SEQ ID NO: 1275225 - RNA, 14 nt, Mycobacterium tuberculosis H37Rv
cccgaaucgccugc

SEQ ID NO: 1275226 - RNA, 12 nt, Mycobacterium tuberculosis H37Rv
cccgaccgcgua

SEQ ID NO: 1275227 - RNA, 15 nt, Mycobacterium tuberculosis H37Rv
cccgacgagucgccg

SEQ ID NO: 1275228 - RNA, 13 nt, Mycobacterium tuberculosis H37Rv
cccgacgaugccg

SEQ ID NO: 1275229 - RNA, 15 nt, Mycobacterium tuberculosis H37Rv
cccgacgccacgcgu

SEQ ID NO: 1275230 - RNA, 16 nt, Mycobacterium tuberculosis H37Rv
ccccucggcuucggag

SEQ ID NO: 1275231 - RNA, 19 nt, Mycobacterium tuberculosis H37Rv
cccgaacaauucacgcacc

SEQ ID NO: 1275232 - RNA, 12 nt, Mycobacterium tuberculosis H37Rv
cccgaacacgcu

SEQ ID NO: 1275233 - RNA, 23 nt, Mycobacterium tuberculosis H37Rv
cccgaagaugaccucggcgacga

SEQ ID NO: 1275234 - RNA, 21 nt, Mycobacterium tuberculosis H37Rv
cccgaacgaggcgcccagcga

SEQ ID NO: 1275235 - RNA, 15 nt, Mycobacterium tuberculosis H37Rv
cccgaaccccgaccg

SEQ ID NO: 1275236 - RNA, 15 nt, Mycobacterium tuberculosis H37Rv
cccgaaccaccgcgu

SEQ ID NO: 1275237 - RNA, 22 nt, Mycobacterium tuberculosis H37Rv
ccccguuucgccagauggccac

SEQ ID NO: 1275238 - RNA, 17 nt, Mycobacterium tuberculosis H37Rv
ccccguuucggucgaca

SEQ ID NO: 1275239 - RNA, 20 nt, Mycobacterium tuberculosis H37Rv
ccccguugacccagaccggc

SEQ ID NO: 1275240 - RNA, 20 nt, Mycobacterium tuberculosis H37Rv
ccccggcgcuggugcgccac

SEQ ID NO: 1275241 - RNA, 23 nt, Mycobacterium tuberculosis H37Rv
ccccggccacuugguaguccugc

SEQ ID NO: 1275242 - RNA, 15 nt, Mycobacterium tuberculosis H37Rv
ccagugucagcacga

SEQ ID NO: 1275243 - RNA, 22 nt, Mycobacterium tuberculosis H37Rv
ccaguggcgcccauggccacca

SEQ ID NO: 1275244 - RNA, 22 nt, Mycobacterium tuberculosis H37Rv
ccaguguguccugucgcaccag

SEQ ID NO: 1275245 - RNA, 12 nt, Mycobacterium tuberculosis H37Rv
ccaguuacguug

SEQ ID NO: 1275246 - RNA, 21 nt, Mycobacterium tuberculosis H37Rv
ccaguuccacccggugccgca

SEQ ID NO: 1275247 - RNA, 17 nt, Mycobacterium tuberculosis H37Rv
ccaguuccacccggugc

SEQ ID NO: 1275248 - RNA, 20 nt, Mycobacterium tuberculosis H37Rv
ccaguucuucgggcgggaug

SEQ ID NO: 1275249 - RNA, 22 nt, Mycobacterium tuberculosis H37Rv
ccaguucuucgggcgggaugac

SEQ ID NO: 1275250 - RNA, 12 nt, Mycobacterium tuberculosis H37Rv
ccagucggcgcc

SEQ ID NO: 1275251 - RNA, 14 nt, Mycobacterium tuberculosis H37Rv
ccagucccggcgca

SEQ ID NO: 1275252 - RNA, 20 nt, Mycobacterium tuberculosis H37Rv
ccaguccaggacggucgcca

SEQ ID NO: 1275253 - RNA, 18 nt, Mycobacterium tuberculosis H37Rv
ccagugccccgccgagcg

SEQ ID NO: 1275254 - RNA, 19 nt, Mycobacterium tuberculosis H37Rv
ccagugcaucgaucaccgc

SEQ ID NO: 1275255 - RNA, 22 nt, Mycobacterium tuberculosis H37Rv
ccagugauggcgcggucgcuga

SEQ ID NO: 1275256 - RNA, 16 nt, Mycobacterium tuberculosis H37Rv
ccagugacucaccgug

SEQ ID NO: 1275257 - RNA, 15 nt, Mycobacterium tuberculosis H37Rv
ccagugacucaccgu

SEQ ID NO: 1275258 - RNA, 21 nt, Mycobacterium tuberculosis H37Rv
ccagugcgcaacccagccgcg

SEQ ID NO: 1275259 - RNA, 18 nt, Mycobacterium tuberculosis H37Rv
ccagugcgguggcaggug

SEQ ID NO: 1275260 - RNA, 19 nt, Mycobacterium tuberculosis H37Rv
ccagugcggucucgaccgu

SEQ ID NO: 1275261 - RNA, 16 nt, Mycobacterium tuberculosis H37Rv
ccaucaacugcaucac

SEQ ID NO: 1275262 - RNA, 14 nt, Mycobacterium tuberculosis H37Rv
ccaucaagagcgcg

SEQ ID NO: 1275263 - RNA, 12 nt, Mycobacterium tuberculosis H37Rv
ccaucaaccgcg

SEQ ID NO: 1275264 - RNA, 20 nt, Mycobacterium tuberculosis H37Rv
ccauagugcggcagcggugg

SEQ ID NO: 1275265 - RNA, 12 nt, Mycobacterium tuberculosis H37Rv
ccaucacggacc

SEQ ID NO: 1275266 - RNA, 18 nt, Mycobacterium tuberculosis H37Rv
ccaucaccggcggcccca

SEQ ID NO: 1275267 - RNA, 20 nt, Mycobacterium tuberculosis H37Rv
ccauaggcaaggucaacccg

SEQ ID NO: 1275268 - RNA, 14 nt, Mycobacterium tuberculosis H37Rv
ccauacgucgccuc

SEQ ID NO: 1275269 - RNA, 16 nt, Mycobacterium tuberculosis H37Rv
ccauacgugccgccga

SEQ ID NO: 1275270 - RNA, 19 nt, Mycobacterium tuberculosis H37Rv
ccauaccugccggaccacc

SEQ ID NO: 1275271 - RNA, 16 nt, Mycobacterium tuberculosis H37Rv
ccauaccuucggcgau

SEQ ID NO: 1275272 - RNA, 18 nt, Mycobacterium tuberculosis H37Rv
ccauaauggucgucgcga

SEQ ID NO: 1275273 - RNA, 15 nt, Mycobacterium tuberculosis H37Rv
ccauaaucacaucgc

SEQ ID NO: 1275274 - RNA, 19 nt, Mycobacterium tuberculosis H37Rv
ccaguugugcggccaggcg

SEQ ID NO: 1275275 - RNA, 14 nt, Mycobacterium tuberculosis H37Rv
ccaguugguagccg

SEQ ID NO: 1275276 - RNA, 16 nt, Mycobacterium tuberculosis H37Rv
ccagcgcugcugccga

SEQ ID NO: 1275277 - RNA, 19 nt, Mycobacterium tuberculosis H37Rv
ccagcggaagcgguugacc

SEQ ID NO: 1275278 - RNA, 21 nt, Mycobacterium tuberculosis H37Rv
ccagcgcuucgucggccggca

SEQ ID NO: 1275279 - RNA, 19 nt, Mycobacterium tuberculosis H37Rv
ccaggccacguagcagcgc

SEQ ID NO: 1275280 - RNA, 14 nt, Mycobacterium tuberculosis H37Rv
ccaggccgagcucg

SEQ ID NO: 1275281 - RNA, 15 nt, Mycobacterium tuberculosis H37Rv
ccaggccgaccgcgc

SEQ ID NO: 1275282 - RNA, 15 nt, Mycobacterium tuberculosis H37Rv
ccaggcccuggccag

SEQ ID NO: 1275283 - RNA, 18 nt, Mycobacterium tuberculosis H37Rv
ccaggcuggcgucaccgc

SEQ ID NO: 1275284 - RNA, 14 nt, Mycobacterium tuberculosis H37Rv
ccaggcugucgcgg

SEQ ID NO: 1275285 - RNA, 21 nt, Mycobacterium tuberculosis H37Rv
ccaggcugucgcgggccacca

SEQ ID NO: 1275286 - RNA, 17 nt, Mycobacterium tuberculosis H37Rv
ccaggcuguggccagca

SEQ ID NO: 1275287 - RNA, 22 nt, Mycobacterium tuberculosis H37Rv
ccaggcggcgcgggucggcgac

SEQ ID NO: 1275288 - RNA, 15 nt, Mycobacterium tuberculosis H37Rv
ccaggcggacgccgc

SEQ ID NO: 1275289 - RNA, 14 nt, Mycobacterium tuberculosis H37Rv
ccaggugaugccgc

SEQ ID NO: 1275290 - RNA, 22 nt, Mycobacterium tuberculosis H37Rv
ccaggucuccaucaaccgcgcu

SEQ ID NO: 1275291 - RNA, 14 nt, Mycobacterium tuberculosis H37Rv
ccaggucgaugcgg

SEQ ID NO: 1275292 - RNA, 19 nt, Mycobacterium tuberculosis H37Rv
ccaggucgaggcaggccuc

SEQ ID NO: 1275293 - RNA, 21 nt, Mycobacterium tuberculosis H37Rv
ccaggucgacauaggccaccu

SEQ ID NO: 1275294 - RNA, 16 nt, Mycobacterium tuberculosis H37Rv
ccaggucgagcaccgg

SEQ ID NO: 1275295 - RNA, 21 nt, Mycobacterium tuberculosis H37Rv
ccaguauggccgccaccgcga

SEQ ID NO: 1275296 - RNA, 14 nt, Mycobacterium tuberculosis H37Rv
ccaggucgacaccg

SEQ ID NO: 1275297 - RNA, 18 nt, Mycobacterium tuberculosis H37Rv
ccagguaaacggauucga

SEQ ID NO: 1275298 - RNA, 22 nt, Mycobacterium tuberculosis H37Rv
ccaggguguccgucgaaccuac

SEQ ID NO: 1275299 - RNA, 15 nt, Mycobacterium tuberculosis H37Rv
ccagggucgaugucg

SEQ ID NO: 1275300 - RNA, 22 nt, Mycobacterium tuberculosis H37Rv
ccagggucaccucgucgccuag

SEQ ID NO: 1275301 - RNA, 15 nt, Mycobacterium tuberculosis H37Rv
ccagggucagcucgg

SEQ ID NO: 1275302 - RNA, 13 nt, Mycobacterium tuberculosis H37Rv
ccaggggcgcaac

SEQ ID NO: 1275303 - RNA, 13 nt, Mycobacterium tuberculosis H37Rv
ccaggggcgcguc

SEQ ID NO: 1275304 - RNA, 17 nt, Mycobacterium tuberculosis H37Rv
cccagauauugaaccgg

SEQ ID NO: 1275305 - RNA, 15 nt, Mycobacterium tuberculosis H37Rv
cccagccgcagcacc

SEQ ID NO: 1275306 - RNA, 16 nt, Mycobacterium tuberculosis H37Rv
cccagccgcaucgggc

SEQ ID NO: 1275307 - RNA, 19 nt, Mycobacterium tuberculosis H37Rv
cccagccggaccgcgacgg

SEQ ID NO: 1275308 - RNA, 21 nt, Mycobacterium tuberculosis H37Rv
cccagcgacccggccagcggc

SEQ ID NO: 1275309 - RNA, 24 nt, Mycobacterium tuberculosis H37Rv
cccagcgaauccaggccguacucg

SEQ ID NO: 1275310 - RNA, 17 nt, Mycobacterium tuberculosis H37Rv
cccagcgacucggccag

SEQ ID NO: 1275311 - RNA, 21 nt, Mycobacterium tuberculosis H37Rv
cccagcgcacggaccaucgcc

SEQ ID NO: 1275312 - RNA, 17 nt, Mycobacterium tuberculosis H37Rv
cccagcgcagcggacgg

SEQ ID NO: 1275313 - RNA, 15 nt, Mycobacterium tuberculosis H37Rv
cccagcgcgccagcu

SEQ ID NO: 1275314 - RNA, 21 nt, Mycobacterium tuberculosis H37Rv
cccaccuucaucaacgacacc

SEQ ID NO: 1275315 - RNA, 16 nt, Mycobacterium tuberculosis H37Rv
cccaccgguaccgcca

SEQ ID NO: 1275316 - RNA, 17 nt, Mycobacterium tuberculosis H37Rv
cccacagucgugagcca

SEQ ID NO: 1275317 - RNA, 22 nt, Mycobacterium tuberculosis H37Rv
cccaccgucgucguuucgccag

SEQ ID NO: 1275318 - RNA, 12 nt, Mycobacterium tuberculosis H37Rv
cccacagcgugc

SEQ ID NO: 1275319 - RNA, 13 nt, Mycobacterium tuberculosis H37Rv
cccacacagucgg

SEQ ID NO: 1275320 - RNA, 18 nt, Mycobacterium tuberculosis H37Rv
cccacucgucgaacaccg

SEQ ID NO: 1275321 - RNA, 12 nt, Mycobacterium tuberculosis H37Rv
cccacgagagcg

SEQ ID NO: 1275322 - RNA, 13 nt, Mycobacterium tuberculosis H37Rv
cccacgccagcgc

SEQ ID NO: 1275323 - RNA, 13 nt, Mycobacterium tuberculosis H37Rv
cccaccuggauca

SEQ ID NO: 1275324 - RNA, 20 nt, Mycobacterium tuberculosis H37Rv
cccaauucagauagucgccg

SEQ ID NO: 1275325 - RNA, 21 nt, Mycobacterium tuberculosis H37Rv
cccacaaucagcccgacaccg

SEQ ID NO: 1275326 - RNA, 19 nt, Mycobacterium tuberculosis H37Rv
cccacaaagauccggccaa

SEQ ID NO: 1275327 - RNA, 15 nt, Mycobacterium tuberculosis H37Rv
cccacaaccgcacca

SEQ ID NO: 1275328 - RNA, 16 nt, Mycobacterium tuberculosis H37Rv
cccaaucgucggccag

SEQ ID NO: 1275329 - RNA, 22 nt, Mycobacterium tuberculosis H37Rv
cccaaucgucggccagcagauc

SEQ ID NO: 1275330 - RNA, 15 nt, Mycobacterium tuberculosis H37Rv
cccaauagccggauc

SEQ ID NO: 1275331 - RNA, 19 nt, Mycobacterium tuberculosis H37Rv
cccaaucagugcagcgugg

SEQ ID NO: 1275332 - RNA, 17 nt, Mycobacterium tuberculosis H37Rv
cccaagcguccgcugca

SEQ ID NO: 1275333 - RNA, 18 nt, Mycobacterium tuberculosis H37Rv
ccauguggcgucgcucgu

SEQ ID NO: 1275334 - RNA, 14 nt, Mycobacterium tuberculosis H37Rv
cccaagccgaucgg

SEQ ID NO: 1275335 - RNA, 14 nt, Mycobacterium tuberculosis H37Rv
cccaagucgccgag

SEQ ID NO: 1275336 - RNA, 20 nt, Mycobacterium tuberculosis H37Rv
ccaugggucuggcaggccag

SEQ ID NO: 1275337 - RNA, 22 nt, Mycobacterium tuberculosis H37Rv
ccaugggucuggcaggccagca

SEQ ID NO: 1275338 - RNA, 12 nt, Mycobacterium tuberculosis H37Rv
ccaugucggcca

SEQ ID NO: 1275339 - RNA, 21 nt, Mycobacterium tuberculosis H37Rv
ccaugucggcgcgccgcacac

SEQ ID NO: 1275340 - RNA, 20 nt, Mycobacterium tuberculosis H37Rv
ccaugucggcgcgccgcaca

SEQ ID NO: 1275341 - RNA, 23 nt, Mycobacterium tuberculosis H37Rv
ccaucuucaucgccucgaggacc

SEQ ID NO: 1275342 - RNA, 16 nt, Mycobacterium tuberculosis H37Rv
ccaucuuaacgucggc

SEQ ID NO: 1275343 - RNA, 19 nt, Mycobacterium tuberculosis H37Rv
ccaucuacaucgucgagcg

SEQ ID NO: 1275344 - RNA, 21 nt, Mycobacterium tuberculosis H37Rv
ccaucugauccggugucgcga

SEQ ID NO: 1275345 - RNA, 22 nt, Mycobacterium tuberculosis H37Rv
ccaucucgggcaggccgucgag

SEQ ID NO: 1275346 - RNA, 14 nt, Mycobacterium tuberculosis H37Rv
ccaucucggaccac

SEQ ID NO: 1275347 - RNA, 18 nt, Mycobacterium tuberculosis H37Rv
ccaugaagccgggcgcuu

SEQ ID NO: 1275348 - RNA, 16 nt, Mycobacterium tuberculosis H37Rv
ccaugagcuugguggc

SEQ ID NO: 1275349 - RNA, 21 nt, Mycobacterium tuberculosis H37Rv
ccaugagcuugguggccacca

SEQ ID NO: 1275350 - RNA, 15 nt, Mycobacterium tuberculosis H37Rv
ccaugaucucggcga

SEQ ID NO: 1275351 - RNA, 12 nt, Mycobacterium tuberculosis H37Rv
ccaugauggccg

SEQ ID NO: 1275352 - RNA, 20 nt, Mycobacterium tuberculosis H37Rv
ccaugauugccaggaccgcg

SEQ ID NO: 1275353 - RNA, 16 nt, Mycobacterium tuberculosis H37Rv
ccaugcaacacaccgc

SEQ ID NO: 1275354 - RNA, 15 nt, Mycobacterium tuberculosis H37Rv
ccauggcuccgccca

SEQ ID NO: 1275355 - RNA, 13 nt, Mycobacterium tuberculosis H37Rv
ccauggccaccga

SEQ ID NO: 1275356 - RNA, 17 nt, Mycobacterium tuberculosis H37Rv
ccauggaucccacgagu

SEQ ID NO: 1275357 - RNA, 23 nt, Mycobacterium tuberculosis H37Rv
ccauggccaccgaacgcggccac

SEQ ID NO: 1275358 - RNA, 12 nt, Mycobacterium tuberculosis H37Rv
ccauggccacca

SEQ ID NO: 1275359 - RNA, 19 nt, Mycobacterium tuberculosis H37Rv
ccaugccgccgaagccgcg

SEQ ID NO: 1275360 - RNA, 18 nt, Mycobacterium tuberculosis H37Rv
ccaugccgaucggccugc

SEQ ID NO: 1275361 - RNA, 19 nt, Mycobacterium tuberculosis H37Rv
ccaugccgaccggcacccg

SEQ ID NO: 1275362 - RNA, 14 nt, Mycobacterium tuberculosis H37Rv
ccaugccgaucggc

SEQ ID NO: 1275363 - RNA, 19 nt, Mycobacterium tuberculosis H37Rv
ccaugccgaauaccggugg

SEQ ID NO: 1275364 - RNA, 19 nt, Mycobacterium tuberculosis H37Rv
ccaucgcggaaccguacgc

SEQ ID NO: 1275365 - RNA, 17 nt, Mycobacterium tuberculosis H37Rv
ccaucggugcgcacggc

SEQ ID NO: 1275366 - RNA, 19 nt, Mycobacterium tuberculosis H37Rv
ccaucgguuugcacucguc

SEQ ID NO: 1275367 - RNA, 13 nt, Mycobacterium tuberculosis H37Rv
ccaucgucgagcg

SEQ ID NO: 1275368 - RNA, 18 nt, Mycobacterium tuberculosis H37Rv
ccaucgcgacaucggugg

SEQ ID NO: 1275369 - RNA, 20 nt, Mycobacterium tuberculosis H37Rv
ccaucgccuccagccggcga

SEQ ID NO: 1275370 - RNA, 14 nt, Mycobacterium tuberculosis H37Rv
ccaucgcgcaccgc

SEQ ID NO: 1275371 - RNA, 13 nt, Mycobacterium tuberculosis H37Rv
ccaucgcgacggc

SEQ ID NO: 1275372 - RNA, 15 nt, Mycobacterium tuberculosis H37Rv
ccaucgcggaaccgu

SEQ ID NO: 1275373 - RNA, 15 nt, Mycobacterium tuberculosis H37Rv
ccaucccggccucca

SEQ ID NO: 1275374 - RNA, 16 nt, Mycobacterium tuberculosis H37Rv
ccauccgcagcaggug

SEQ ID NO: 1275375 - RNA, 21 nt, Mycobacterium tuberculosis H37Rv
ccaucaucaccucucgcuugc

SEQ ID NO: 1275376 - RNA, 16 nt, Mycobacterium tuberculosis H37Rv
ccaucaucgacgguga

SEQ ID NO: 1275377 - RNA, 22 nt, Mycobacterium tuberculosis H37Rv
ccauccgugaaucgagcaccgc

SEQ ID NO: 1275378 - RNA, 14 nt, Mycobacterium tuberculosis H37Rv
ccauccucgcggug

SEQ ID NO: 1275379 - RNA, 11 nt, Mycobacterium tuberculosis H37Rv
ccaucgaccga

SEQ ID NO: 1275380 - RNA, 15 nt, Mycobacterium tuberculosis H37Rv
ccgaguugaccgccg

SEQ ID NO: 1275381 - RNA, 15 nt, Mycobacterium tuberculosis H37Rv
ccgaguuaccgguga

SEQ ID NO: 1275382 - RNA, 22 nt, Mycobacterium tuberculosis H37Rv
ccgaguugaugaagauggcgcg

SEQ ID NO: 1275383 - RNA, 20 nt, Mycobacterium tuberculosis H37Rv
ccgaguugaaggugccggcg

SEQ ID NO: 1275384 - RNA, 22 nt, Mycobacterium tuberculosis H37Rv
ccgauaacaaggccgccgccgu

SEQ ID NO: 1275385 - RNA, 18 nt, Mycobacterium tuberculosis H37Rv
ccgaguuucugaagcccg

SEQ ID NO: 1275386 - RNA, 17 nt, Mycobacterium tuberculosis H37Rv
ccgaguaccggccagcc

SEQ ID NO: 1275387 - RNA, 14 nt, Mycobacterium tuberculosis H37Rv
ccgagugaccaggg

SEQ ID NO: 1275388 - RNA, 17 nt, Mycobacterium tuberculosis H37Rv
ccgagucuaaggaugac

SEQ ID NO: 1275389 - RNA, 22 nt, Mycobacterium tuberculosis H37Rv
ccgagucgacggccagugcgca

SEQ ID NO: 1275390 - RNA, 17 nt, Mycobacterium tuberculosis H37Rv
ccgaggcgaguucgcgc

SEQ ID NO: 1275391 - RNA, 18 nt, Mycobacterium tuberculosis H37Rv
ccgagcgccaguucgcgg

SEQ ID NO: 1275392 - RNA, 16 nt, Mycobacterium tuberculosis H37Rv
ccgagccgucgucgag

SEQ ID NO: 1275393 - RNA, 23 nt, Mycobacterium tuberculosis H37Rv
ccgagcggagccgccgacucggc

SEQ ID NO: 1275394 - RNA, 18 nt, Mycobacterium tuberculosis H37Rv
ccgagcggaccaccgcuc

SEQ ID NO: 1275395 - RNA, 16 nt, Mycobacterium tuberculosis H37Rv
ccgagcggaccaccgc

SEQ ID NO: 1275396 - RNA, 19 nt, Mycobacterium tuberculosis H37Rv
ccgagcgcucgaucacggc

SEQ ID NO: 1275397 - RNA, 18 nt, Mycobacterium tuberculosis H37Rv
ccgagcgcucgaucacgg

SEQ ID NO: 1275398 - RNA, 16 nt, Mycobacterium tuberculosis H37Rv
ccgagcuccuccacca

SEQ ID NO: 1275399 - RNA, 14 nt, Mycobacterium tuberculosis H37Rv
ccgagcugauccgg

SEQ ID NO: 1275400 - RNA, 16 nt, Mycobacterium tuberculosis H37Rv
ccgagcggugccggcg

SEQ ID NO: 1275401 - RNA, 18 nt, Mycobacterium tuberculosis H37Rv
ccgagcugccgucgcugc

SEQ ID NO: 1275402 - RNA, 20 nt, Mycobacterium tuberculosis H37Rv
ccgagcuuccaaacccggug

SEQ ID NO: 1275403 - RNA, 23 nt, Mycobacterium tuberculosis H37Rv
ccgagcuugagcgugagcgccgc

SEQ ID NO: 1275404 - RNA, 19 nt, Mycobacterium tuberculosis H37Rv
ccgagcuugggccggugca

SEQ ID NO: 1275405 - RNA, 20 nt, Mycobacterium tuberculosis H37Rv
ccgaaaucaguugcgcucca

SEQ ID NO: 1275406 - RNA, 14 nt, Mycobacterium tuberculosis H37Rv
ccgaaaucggccag

SEQ ID NO: 1275407 - RNA, 18 nt, Mycobacterium tuberculosis H37Rv
ccgaacaacagcggcaac

SEQ ID NO: 1275408 - RNA, 12 nt, Mycobacterium tuberculosis H37Rv
ccgaacagcugc

SEQ ID NO: 1275409 - RNA, 13 nt, Mycobacterium tuberculosis H37Rv
ccgaacagcaggc

SEQ ID NO: 1275410 - RNA, 17 nt, Mycobacterium tuberculosis H37Rv
ccgaacagcaggccucc

SEQ ID NO: 1275411 - RNA, 22 nt, Mycobacterium tuberculosis H37Rv
ccgaacacgcacacgaucgcgg

SEQ ID NO: 1275412 - RNA, 23 nt, Mycobacterium tuberculosis H37Rv
ccgaacacgcacacgaucgcggu

SEQ ID NO: 1275413 - RNA, 23 nt, Mycobacterium tuberculosis H37Rv
ccgaacacuuugcgcacuaccgc

SEQ ID NO: 1275414 - RNA, 16 nt, Mycobacterium tuberculosis H37Rv
ccgagccgacaucgau

SEQ ID NO: 1275415 - RNA, 20 nt, Mycobacterium tuberculosis H37Rv
ccgagccgaaguugaugucg

SEQ ID NO: 1275416 - RNA, 20 nt, Mycobacterium tuberculosis H37Rv
ccgagcccgggccugaacca

SEQ ID NO: 1275417 - RNA, 15 nt, Mycobacterium tuberculosis H37Rv
ccgagcccagccggg

SEQ ID NO: 1275418 - RNA, 14 nt, Mycobacterium tuberculosis H37Rv
ccgagccacgaccc

SEQ ID NO: 1275419 - RNA, 14 nt, Mycobacterium tuberculosis H37Rv
ccgagccagcaccc

SEQ ID NO: 1275420 - RNA, 22 nt, Mycobacterium tuberculosis H37Rv
ccgaugcaucggugcagcccgc

SEQ ID NO: 1275421 - RNA, 14 nt, Mycobacterium tuberculosis H37Rv
ccgaugacgcguuc

SEQ ID NO: 1275422 - RNA, 16 nt, Mycobacterium tuberculosis H37Rv
ccgaugccgaacuccg

SEQ ID NO: 1275423 - RNA, 20 nt, Mycobacterium tuberculosis H37Rv
ccgaugcccucgauggccag

SEQ ID NO: 1275424 - RNA, 17 nt, Mycobacterium tuberculosis H37Rv
ccgaugccgacggcgcc

SEQ ID NO: 1275425 - RNA, 19 nt, Mycobacterium tuberculosis H37Rv
ccgaugccgccggcaccgc

SEQ ID NO: 1275426 - RNA, 21 nt, Mycobacterium tuberculosis H37Rv
ccgaugaccgaagagcgcgcg

SEQ ID NO: 1275427 - RNA, 16 nt, Mycobacterium tuberculosis H37Rv
ccgaugacgaucggcg

SEQ ID NO: 1275428 - RNA, 18 nt, Mycobacterium tuberculosis H37Rv
ccgaugacgaucggcggc

SEQ ID NO: 1275429 - RNA, 17 nt, Mycobacterium tuberculosis H37Rv
ccgaugacgaugccgcc

SEQ ID NO: 1275430 - RNA, 16 nt, Mycobacterium tuberculosis H37Rv
ccgaucugcucgccga

SEQ ID NO: 1275431 - RNA, 23 nt, Mycobacterium tuberculosis H37Rv
ccgaucugguaagucagcucgau

SEQ ID NO: 1275432 - RNA, 17 nt, Mycobacterium tuberculosis H37Rv
ccgaucugcuccucggu

SEQ ID NO: 1275433 - RNA, 15 nt, Mycobacterium tuberculosis H37Rv
ccgaucgucucggcc

SEQ ID NO: 1275434 - RNA, 17 nt, Mycobacterium tuberculosis H37Rv
ccgaucgucucggccac

SEQ ID NO: 1275435 - RNA, 18 nt, Mycobacterium tuberculosis H37Rv
ccgaugcugacgaugcgg

SEQ ID NO: 1275436 - RNA, 13 nt, Mycobacterium tuberculosis H37Rv
ccgauggcgcacc

SEQ ID NO: 1275437 - RNA, 16 nt, Mycobacterium tuberculosis H37Rv
ccgaugcgggucucga

SEQ ID NO: 1275438 - RNA, 18 nt, Mycobacterium tuberculosis H37Rv
ccgaugcgugccgacccg

SEQ ID NO: 1275439 - RNA, 11 nt, Mycobacterium tuberculosis H37Rv
ccgaugccgcc

SEQ ID NO: 1275440 - RNA, 19 nt, Mycobacterium tuberculosis H37Rv
ccgaugcgcagugcaccgc

SEQ ID NO: 1275441 - RNA, 22 nt, Mycobacterium tuberculosis H37Rv
ccgaugcgaaacaucucggcgc

SEQ ID NO: 1275442 - RNA, 16 nt, Mycobacterium tuberculosis H37Rv
ccgaugccuugaccgc

SEQ ID NO: 1275443 - RNA, 13 nt, Mycobacterium tuberculosis H37Rv
ccgaugucaacgc

SEQ ID NO: 1275444 - RNA, 14 nt, Mycobacterium tuberculosis H37Rv
ccgaugugcucggu

SEQ ID NO: 1275445 - RNA, 20 nt, Mycobacterium tuberculosis H37Rv
ccgaugugggcgccgucgcc

SEQ ID NO: 1275446 - RNA, 14 nt, Mycobacterium tuberculosis H37Rv
ccgaugguacccgc

SEQ ID NO: 1275447 - RNA, 23 nt, Mycobacterium tuberculosis H37Rv
ccgaucgggcucacucgccgaau

SEQ ID NO: 1275448 - RNA, 21 nt, Mycobacterium tuberculosis H37Rv
ccgaucgggcucacucgccga

SEQ ID NO: 1275449 - RNA, 14 nt, Mycobacterium tuberculosis H37Rv
ccgaucggccugca

SEQ ID NO: 1275450 - RNA, 17 nt, Mycobacterium tuberculosis H37Rv
ccgaucggcaaucgacu

SEQ ID NO: 1275451 - RNA, 15 nt, Mycobacterium tuberculosis H37Rv
ccgaucggcggaucg

SEQ ID NO: 1275452 - RNA, 12 nt, Mycobacterium tuberculosis H37Rv
ccgaucggccag

SEQ ID NO: 1275453 - RNA, 12 nt, Mycobacterium tuberculosis H37Rv
ccgaucggccaa

SEQ ID NO: 1275454 - RNA, 15 nt, Mycobacterium tuberculosis H37Rv
ccgaucggcaccgug

SEQ ID NO: 1275455 - RNA, 15 nt, Mycobacterium tuberculosis H37Rv
ccgauccgcacagca

SEQ ID NO: 1275456 - RNA, 17 nt, Mycobacterium tuberculosis H37Rv
ccgaucgacacccgcuc

SEQ ID NO: 1275457 - RNA, 15 nt, Mycobacterium tuberculosis H37Rv
ccgauccuggccacu

SEQ ID NO: 1275458 - RNA, 17 nt, Mycobacterium tuberculosis H37Rv
ccgaucaccuucggccg

SEQ ID NO: 1275459 - RNA, 15 nt, Mycobacterium tuberculosis H37Rv
ccgaucacccgcacu

SEQ ID NO: 1275460 - RNA, 16 nt, Mycobacterium tuberculosis H37Rv
ccgaucagccguggca

SEQ ID NO: 1275461 - RNA, 23 nt, Mycobacterium tuberculosis H37Rv
ccgaucagcccggccuugccgcc

SEQ ID NO: 1275462 - RNA, 13 nt, Mycobacterium tuberculosis H37Rv
ccgaucagcaggg

SEQ ID NO: 1275463 - RNA, 17 nt, Mycobacterium tuberculosis H37Rv
ccgauaucgcugcggaa

SEQ ID NO: 1275464 - RNA, 13 nt, Mycobacterium tuberculosis H37Rv
ccgauaucgcaga

SEQ ID NO: 1275465 - RNA, 16 nt, Mycobacterium tuberculosis H37Rv
ccgauauuggcaucgu

SEQ ID NO: 1275466 - RNA, 15 nt, Mycobacterium tuberculosis H37Rv
ccgauauucggccau

SEQ ID NO: 1275467 - RNA, 15 nt, Mycobacterium tuberculosis H37Rv
ccgaucaacggaaug

SEQ ID NO: 1275468 - RNA, 18 nt, Mycobacterium tuberculosis H37Rv
ccgauacuucaucggcac

SEQ ID NO: 1275469 - RNA, 20 nt, Mycobacterium tuberculosis H37Rv
ccgauacuaaacaggccgcc

SEQ ID NO: 1275470 - RNA, 13 nt, Mycobacterium tuberculosis H37Rv
ccgauagcaccgg

SEQ ID NO: 1275471 - RNA, 16 nt, Mycobacterium tuberculosis H37Rv
ccgauacgaagccgcc

SEQ ID NO: 1275472 - RNA, 19 nt, Mycobacterium tuberculosis H37Rv
ccgauaccggcggcgagcg

SEQ ID NO: 1275473 - RNA, 17 nt, Mycobacterium tuberculosis H37Rv
ccgauacggccggccgu

SEQ ID NO: 1275474 - RNA, 20 nt, Mycobacterium tuberculosis H37Rv
ccgccaggccgcgcgacaac

SEQ ID NO: 1275475 - RNA, 16 nt, Mycobacterium tuberculosis H37Rv
ccgccauugacgccgu

SEQ ID NO: 1275476 - RNA, 12 nt, Mycobacterium tuberculosis H37Rv
ccgccaggccga

SEQ ID NO: 1275477 - RNA, 12 nt, Mycobacterium tuberculosis H37Rv
ccgccaggccgc

SEQ ID NO: 1275478 - RNA, 21 nt, Mycobacterium tuberculosis H37Rv
ccgccaggccguugccccguc

SEQ ID NO: 1275479 - RNA, 18 nt, Mycobacterium tuberculosis H37Rv
ccgccccggugaguccgg

SEQ ID NO: 1275480 - RNA, 22 nt, Mycobacterium tuberculosis H37Rv
ccgcccaugccuccagaaccga

SEQ ID NO: 1275481 - RNA, 20 nt, Mycobacterium tuberculosis H37Rv
ccgccccauacuugcgccga

SEQ ID NO: 1275482 - RNA, 14 nt, Mycobacterium tuberculosis H37Rv
ccgcccagugcggc

SEQ ID NO: 1275483 - RNA, 15 nt, Mycobacterium tuberculosis H37Rv
ccgcccacgcugccc

SEQ ID NO: 1275484 - RNA, 13 nt, Mycobacterium tuberculosis H37Rv
ccgcccacggcac

SEQ ID NO: 1275485 - RNA, 15 nt, Mycobacterium tuberculosis H37Rv
ccgcccacggcacca

SEQ ID NO: 1275486 - RNA, 16 nt, Mycobacterium tuberculosis H37Rv
ccgccauuucgcccga

SEQ ID NO: 1275487 - RNA, 21 nt, Mycobacterium tuberculosis H37Rv
ccgccauugccguccggugga

SEQ ID NO: 1275488 - RNA, 18 nt, Mycobacterium tuberculosis H37Rv
ccgcccacaugaacgacc

SEQ ID NO: 1275489 - RNA, 16 nt, Mycobacterium tuberculosis H37Rv
ccgcccaacgcgagcu

SEQ ID NO: 1275490 - RNA, 21 nt, Mycobacterium tuberculosis H37Rv
ccgccacuugcgcacaguucg

SEQ ID NO: 1275491 - RNA, 18 nt, Mycobacterium tuberculosis H37Rv
ccgccacuggcgccggug

SEQ ID NO: 1275492 - RNA, 21 nt, Mycobacterium tuberculosis H37Rv
ccgccacgguucgggcagcac

SEQ ID NO: 1275493 - RNA, 18 nt, Mycobacterium tuberculosis H37Rv
ccgccacggaucgcggcg

SEQ ID NO: 1275494 - RNA, 22 nt, Mycobacterium tuberculosis H37Rv
ccgccacacggggccgccagcu

SEQ ID NO: 1275495 - RNA, 19 nt, Mycobacterium tuberculosis H37Rv
ccgccacaaccaccggauc

SEQ ID NO: 1275496 - RNA, 15 nt, Mycobacterium tuberculosis H37Rv
ccgccaccgucaccg

SEQ ID NO: 1275497 - RNA, 20 nt, Mycobacterium tuberculosis H37Rv
ccgccaauccgcgucgucga

SEQ ID NO: 1275498 - RNA, 15 nt, Mycobacterium tuberculosis H37Rv
ccgccaaugccacca

SEQ ID NO: 1275499 - RNA, 15 nt, Mycobacterium tuberculosis H37Rv
ccgcaucgucgccga

SEQ ID NO: 1275500 - RNA, 18 nt, Mycobacterium tuberculosis H37Rv
ccgcaucgucgccgaccg

SEQ ID NO: 1275501 - RNA, 19 nt, Mycobacterium tuberculosis H37Rv
ccgcaucgucgccgaccgu

SEQ ID NO: 1275502 - RNA, 23 nt, Mycobacterium tuberculosis H37Rv
ccgcaucgucgccgaccgucacu

SEQ ID NO: 1275503 - RNA, 22 nt, Mycobacterium tuberculosis H37Rv
ccgcagcuccccgaccgaaccg

SEQ ID NO: 1275504 - RNA, 13 nt, Mycobacterium tuberculosis H37Rv
ccgcagcucgacc

SEQ ID NO: 1275505 - RNA, 15 nt, Mycobacterium tuberculosis H37Rv
ccgcaucguugccga

SEQ ID NO: 1275506 - RNA, 17 nt, Mycobacterium tuberculosis H37Rv
ccgcaucguugccgacc

SEQ ID NO: 1275507 - RNA, 19 nt, Mycobacterium tuberculosis H37Rv
ccgcaucguugccgaccgu

SEQ ID NO: 1275508 - RNA, 23 nt, Mycobacterium tuberculosis H37Rv
ccgcaucguugccgaccgucacu

SEQ ID NO: 1275509 - RNA, 22 nt, Mycobacterium tuberculosis H37Rv
ccgcaugcccuggaccagcggg

SEQ ID NO: 1275510 - RNA, 16 nt, Mycobacterium tuberculosis H37Rv
ccgcauggacgcgaug

SEQ ID NO: 1275511 - RNA, 17 nt, Mycobacterium tuberculosis H37Rv
ccgcauucgcgacaacu

SEQ ID NO: 1275512 - RNA, 19 nt, Mycobacterium tuberculosis H37Rv
ccgccaacaucuccgcguc

SEQ ID NO: 1275513 - RNA, 23 nt, Mycobacterium tuberculosis H37Rv
ccgccaaccccaacaucccggac

SEQ ID NO: 1275514 - RNA, 14 nt, Mycobacterium tuberculosis H37Rv
ccgccaaccgcgug

SEQ ID NO: 1275515 - RNA, 21 nt, Mycobacterium tuberculosis H37Rv
ccgccaaccggguguggucgg

SEQ ID NO: 1275516 - RNA, 22 nt, Mycobacterium tuberculosis H37Rv
ccgcauucguggagccggccgu

SEQ ID NO: 1275517 - RNA, 13 nt, Mycobacterium tuberculosis H37Rv
ccgcauucggacg

SEQ ID NO: 1275518 - RNA, 18 nt, Mycobacterium tuberculosis H37Rv
ccgcauucguggagccgg

SEQ ID NO: 1275519 - RNA, 21 nt, Mycobacterium tuberculosis H37Rv
ccgcacggaggcggaccaggc

SEQ ID NO: 1275520 - RNA, 18 nt, Mycobacterium tuberculosis H37Rv
ccgcacgcucgggggauc

SEQ ID NO: 1275521 - RNA, 15 nt, Mycobacterium tuberculosis H37Rv
ccgcacgccggccag

SEQ ID NO: 1275522 - RNA, 16 nt, Mycobacterium tuberculosis H37Rv
ccgcacgccggcaugc

SEQ ID NO: 1275523 - RNA, 16 nt, Mycobacterium tuberculosis H37Rv
ccgcacgcaaugcggg

SEQ ID NO: 1275524 - RNA, 17 nt, Mycobacterium tuberculosis H37Rv
ccgcacgaaccggucga

SEQ ID NO: 1275525 - RNA, 21 nt, Mycobacterium tuberculosis H37Rv
ccgcacgaagccggcuucggu

SEQ ID NO: 1275526 - RNA, 22 nt, Mycobacterium tuberculosis H37Rv
ccgcaccugggcggcgcgaagu

SEQ ID NO: 1275527 - RNA, 12 nt, Mycobacterium tuberculosis H37Rv
ccgcaccgucgc

SEQ ID NO: 1275528 - RNA, 20 nt, Mycobacterium tuberculosis H37Rv
ccgcaccguagccgcugcac

SEQ ID NO: 1275529 - RNA, 23 nt, Mycobacterium tuberculosis H37Rv
ccgcaccgcgguacgccggucgg

SEQ ID NO: 1275530 - RNA, 14 nt, Mycobacterium tuberculosis H37Rv
ccgcaaugcgagcg

SEQ ID NO: 1275531 - RNA, 17 nt, Mycobacterium tuberculosis H37Rv
ccgcaccgcgguacgcc

SEQ ID NO: 1275532 - RNA, 18 nt, Mycobacterium tuberculosis H37Rv
ccgcacccccgucgauca

SEQ ID NO: 1275533 - RNA, 14 nt, Mycobacterium tuberculosis H37Rv
ccgcaccgauuucc

SEQ ID NO: 1275534 - RNA, 19 nt, Mycobacterium tuberculosis H37Rv
ccgcacguuggcggccagc

SEQ ID NO: 1275535 - RNA, 21 nt, Mycobacterium tuberculosis H37Rv
ccgcacucacauccugguuga

SEQ ID NO: 1275536 - RNA, 21 nt, Mycobacterium tuberculosis H37Rv
ccgcacugcuagucgugccgc

SEQ ID NO: 1275537 - RNA, 13 nt, Mycobacterium tuberculosis H37Rv
ccgcagacgccga

SEQ ID NO: 1275538 - RNA, 12 nt, Mycobacterium tuberculosis H37Rv
ccgcagaccgcc

SEQ ID NO: 1275539 - RNA, 12 nt, Mycobacterium tuberculosis H37Rv
ccgcacguuggc

SEQ ID NO: 1275540 - RNA, 18 nt, Mycobacterium tuberculosis H37Rv
ccgcacgguguauccgac

SEQ ID NO: 1275541 - RNA, 14 nt, Mycobacterium tuberculosis H37Rv
ccgcacggugacca

SEQ ID NO: 1275542 - RNA, 13 nt, Mycobacterium tuberculosis H37Rv
ccgcacgggaucg

SEQ ID NO: 1275543 - RNA, 19 nt, Mycobacterium tuberculosis H37Rv
ccgcagacgugguagccgg

SEQ ID NO: 1275544 - RNA, 15 nt, Mycobacterium tuberculosis H37Rv
ccgcagagucgccga

SEQ ID NO: 1275545 - RNA, 15 nt, Mycobacterium tuberculosis H37Rv
ccgcagcaccgucgg

SEQ ID NO: 1275546 - RNA, 12 nt, Mycobacterium tuberculosis H37Rv
ccgcagccagca

SEQ ID NO: 1275547 - RNA, 15 nt, Mycobacterium tuberculosis H37Rv
ccgcagcaucgccag

SEQ ID NO: 1275548 - RNA, 19 nt, Mycobacterium tuberculosis H37Rv
ccgcacaagcccagcccga

SEQ ID NO: 1275549 - RNA, 12 nt, Mycobacterium tuberculosis H37Rv
ccgcaccagugg

SEQ ID NO: 1275550 - RNA, 15 nt, Mycobacterium tuberculosis H37Rv
ccgcacccagaccgc

SEQ ID NO: 1275551 - RNA, 15 nt, Mycobacterium tuberculosis H37Rv
ccgcacccccgucga

SEQ ID NO: 1275552 - RNA, 17 nt, Mycobacterium tuberculosis H37Rv
ccgcaauggaccgaacg

SEQ ID NO: 1275553 - RNA, 12 nt, Mycobacterium tuberculosis H37Rv
ccgcaaucgcga

SEQ ID NO: 1275554 - RNA, 14 nt, Mycobacterium tuberculosis H37Rv
ccgcaauucgcggu

SEQ ID NO: 1275555 - RNA, 16 nt, Mycobacterium tuberculosis H37Rv
ccgcaaugcguugacc

SEQ ID NO: 1275556 - RNA, 24 nt, Mycobacterium tuberculosis H37Rv
ccgcaagugucuccggcaacagca

SEQ ID NO: 1275557 - RNA, 14 nt, Mycobacterium tuberculosis H37Rv
ccgcaaggcgccga

SEQ ID NO: 1275558 - RNA, 12 nt, Mycobacterium tuberculosis H37Rv
ccgcaacggaug

SEQ ID NO: 1275559 - RNA, 15 nt, Mycobacterium tuberculosis H37Rv
ccgcaacgcuucggc

SEQ ID NO: 1275560 - RNA, 17 nt, Mycobacterium tuberculosis H37Rv
ccgcaacgcuucggcag

SEQ ID NO: 1275561 - RNA, 21 nt, Mycobacterium tuberculosis H37Rv
ccgcaacgcgucggucgcgga

SEQ ID NO: 1275562 - RNA, 16 nt, Mycobacterium tuberculosis H37Rv
ccgcaacgacggccgu

SEQ ID NO: 1275563 - RNA, 22 nt, Mycobacterium tuberculosis H37Rv
ccgcaaccacgccccgaucggu

SEQ ID NO: 1275564 - RNA, 12 nt, Mycobacterium tuberculosis H37Rv
ccgcaaccgcga

SEQ ID NO: 1275565 - RNA, 23 nt, Mycobacterium tuberculosis H37Rv
ccgauuuugggaucgugccggcg

SEQ ID NO: 1275566 - RNA, 18 nt, Mycobacterium tuberculosis H37Rv
ccgauugaguucggcggc

SEQ ID NO: 1275567 - RNA, 22 nt, Mycobacterium tuberculosis H37Rv
ccgauucuucgaugaugccggc

SEQ ID NO: 1275568 - RNA, 15 nt, Mycobacterium tuberculosis H37Rv
ccgauuccaugcgcg

SEQ ID NO: 1275569 - RNA, 17 nt, Mycobacterium tuberculosis H37Rv
ccgcgugcaccgagccg

SEQ ID NO: 1275570 - RNA, 18 nt, Mycobacterium tuberculosis H37Rv
ccgcgugcgcaucccgaa

SEQ ID NO: 1275571 - RNA, 17 nt, Mycobacterium tuberculosis H37Rv
ccgcgugcucgagcacc

SEQ ID NO: 1275572 - RNA, 15 nt, Mycobacterium tuberculosis H37Rv
ccgcgugccacucga

SEQ ID NO: 1275573 - RNA, 19 nt, Mycobacterium tuberculosis H37Rv
ccgcgugguuccggcgugc

SEQ ID NO: 1275574 - RNA, 12 nt, Mycobacterium tuberculosis H37Rv
ccgcgucggccg

SEQ ID NO: 1275575 - RNA, 12 nt, Mycobacterium tuberculosis H37Rv
ccgcgucgacga

SEQ ID NO: 1275576 - RNA, 18 nt, Mycobacterium tuberculosis H37Rv
ccgcgguacgccggucgg

SEQ ID NO: 1275577 - RNA, 21 nt, Mycobacterium tuberculosis H37Rv
ccgcgguacgccggucggugc

SEQ ID NO: 1275578 - RNA, 17 nt, Mycobacterium tuberculosis H37Rv
ccgcucacgaagaccgc

SEQ ID NO: 1275579 - RNA, 19 nt, Mycobacterium tuberculosis H37Rv
ccgcucacccgcccggaac

SEQ ID NO: 1275580 - RNA, 17 nt, Mycobacterium tuberculosis H37Rv
ccgcucaucgaucccgu

SEQ ID NO: 1275581 - RNA, 13 nt, Mycobacterium tuberculosis H37Rv
ccgcuccaagcgc

SEQ ID NO: 1275582 - RNA, 15 nt, Mycobacterium tuberculosis H37Rv
ccgcucggcggucgg

SEQ ID NO: 1275583 - RNA, 22 nt, Mycobacterium tuberculosis H37Rv
ccgcguuucgcgacgucugcca

SEQ ID NO: 1275584 - RNA, 13 nt, Mycobacterium tuberculosis H37Rv
ccgcguuguccgc

SEQ ID NO: 1275585 - RNA, 21 nt, Mycobacterium tuberculosis H37Rv
ccgcguucugguuguugccga

SEQ ID NO: 1275586 - RNA, 18 nt, Mycobacterium tuberculosis H37Rv
ccgcguugaugaccaggu

SEQ ID NO: 1275587 - RNA, 15 nt, Mycobacterium tuberculosis H37Rv
ccgcguugaugaccg

SEQ ID NO: 1275588 - RNA, 21 nt, Mycobacterium tuberculosis H37Rv
ccgcuaugcaggucacugggu

SEQ ID NO: 1275589 - RNA, 16 nt, Mycobacterium tuberculosis H37Rv
ccgcuauucggcggca

SEQ ID NO: 1275590 - RNA, 15 nt, Mycobacterium tuberculosis H37Rv
ccgcuagcggauuca

SEQ ID NO: 1275591 - RNA, 23 nt, Mycobacterium tuberculosis H37Rv
ccgcugugauagcgccguacagc

SEQ ID NO: 1275592 - RNA, 19 nt, Mycobacterium tuberculosis H37Rv
ccgcugucgagccggugcc

SEQ ID NO: 1275593 - RNA, 24 nt, Mycobacterium tuberculosis H37Rv
ccgcugucguaccgcucggcggca

SEQ ID NO: 1275594 - RNA, 14 nt, Mycobacterium tuberculosis H37Rv
ccgcugucgagccg

SEQ ID NO: 1275595 - RNA, 17 nt, Mycobacterium tuberculosis H37Rv
ccgcugggggcggucgc

SEQ ID NO: 1275596 - RNA, 17 nt, Mycobacterium tuberculosis H37Rv
ccgcuggggcgcccgag

SEQ ID NO: 1275597 - RNA, 13 nt, Mycobacterium tuberculosis H37Rv
ccgcuucagcacg

SEQ ID NO: 1275598 - RNA, 14 nt, Mycobacterium tuberculosis H37Rv
ccgcuuacgggugu

SEQ ID NO: 1275599 - RNA, 17 nt, Mycobacterium tuberculosis H37Rv
ccgcuguguucagcgca

SEQ ID NO: 1275600 - RNA, 19 nt, Mycobacterium tuberculosis H37Rv
ccgcuguguucagcgcauu

SEQ ID NO: 1275601 - RNA, 15 nt, Mycobacterium tuberculosis H37Rv
ccgcuucccccgguc

SEQ ID NO: 1275602 - RNA, 20 nt, Mycobacterium tuberculosis H37Rv
ccgcuucgcccggcugcgcc

SEQ ID NO: 1275603 - RNA, 16 nt, Mycobacterium tuberculosis H37Rv
ccgcucgucguccggc

SEQ ID NO: 1275604 - RNA, 23 nt, Mycobacterium tuberculosis H37Rv
ccgcucgggcaacgccucgagca

SEQ ID NO: 1275605 - RNA, 22 nt, Mycobacterium tuberculosis H37Rv
ccgcucgggguugcucgcgauc

SEQ ID NO: 1275606 - RNA, 18 nt, Mycobacterium tuberculosis H37Rv
ccgcucucggcgauuuug

SEQ ID NO: 1275607 - RNA, 14 nt, Mycobacterium tuberculosis H37Rv
ccgcugccggcacg

SEQ ID NO: 1275608 - RNA, 14 nt, Mycobacterium tuberculosis H37Rv
ccgcugccggcagc

SEQ ID NO: 1275609 - RNA, 19 nt, Mycobacterium tuberculosis H37Rv
ccgcugccggcagcguccg

SEQ ID NO: 1275610 - RNA, 14 nt, Mycobacterium tuberculosis H37Rv
ccgcugcggcacca

SEQ ID NO: 1275611 - RNA, 21 nt, Mycobacterium tuberculosis H37Rv
ccgcugcgcggcccgcaucgu

SEQ ID NO: 1275612 - RNA, 19 nt, Mycobacterium tuberculosis H37Rv
ccgcugcgagaucgcggcg

SEQ ID NO: 1275613 - RNA, 19 nt, Mycobacterium tuberculosis H37Rv
ccgcuggcgguaagcgaaa

SEQ ID NO: 1275614 - RNA, 20 nt, Mycobacterium tuberculosis H37Rv
ccgcuggcucaucgaagcuu

SEQ ID NO: 1275615 - RNA, 14 nt, Mycobacterium tuberculosis H37Rv
ccgcggcgcgcaac

SEQ ID NO: 1275616 - RNA, 18 nt, Mycobacterium tuberculosis H37Rv
ccgcggcgccguugccgc

SEQ ID NO: 1275617 - RNA, 19 nt, Mycobacterium tuberculosis H37Rv
ccgcggcgcagcacggcgg

SEQ ID NO: 1275618 - RNA, 15 nt, Mycobacterium tuberculosis H37Rv
ccgcggcgcagcacg

SEQ ID NO: 1275619 - RNA, 14 nt, Mycobacterium tuberculosis H37Rv
ccgcggcgauuacg

SEQ ID NO: 1275620 - RNA, 16 nt, Mycobacterium tuberculosis H37Rv
ccgcggccuuggcggc

SEQ ID NO: 1275621 - RNA, 13 nt, Mycobacterium tuberculosis H37Rv
ccgcggcgcagca

SEQ ID NO: 1275622 - RNA, 15 nt, Mycobacterium tuberculosis H37Rv
ccgcggcccgcgugc

SEQ ID NO: 1275623 - RNA, 23 nt, Mycobacterium tuberculosis H37Rv
ccgcggcccucgaugccgcguag

SEQ ID NO: 1275624 - RNA, 15 nt, Mycobacterium tuberculosis H37Rv
ccgcggcuaggccag

SEQ ID NO: 1275625 - RNA, 19 nt, Mycobacterium tuberculosis H37Rv
ccgcggcgguaaaccuggc

SEQ ID NO: 1275626 - RNA, 13 nt, Mycobacterium tuberculosis H37Rv
ccgcggcggucag

SEQ ID NO: 1275627 - RNA, 17 nt, Mycobacterium tuberculosis H37Rv
ccgcggcggcagcaccc

SEQ ID NO: 1275628 - RNA, 21 nt, Mycobacterium tuberculosis H37Rv
ccgcggcggcaucgaggccag

SEQ ID NO: 1275629 - RNA, 19 nt, Mycobacterium tuberculosis H37Rv
ccgcggcugggggauaccg

SEQ ID NO: 1275630 - RNA, 16 nt, Mycobacterium tuberculosis H37Rv
ccgcgggacaucaccg

SEQ ID NO: 1275631 - RNA, 17 nt, Mycobacterium tuberculosis H37Rv
ccgcgggccagcaccuc

SEQ ID NO: 1275632 - RNA, 16 nt, Mycobacterium tuberculosis H37Rv
ccgcggacugguauuc

SEQ ID NO: 1275633 - RNA, 13 nt, Mycobacterium tuberculosis H37Rv
ccgcggaucacca

SEQ ID NO: 1275634 - RNA, 13 nt, Mycobacterium tuberculosis H37Rv
ccgcggagcgcau

SEQ ID NO: 1275635 - RNA, 18 nt, Mycobacterium tuberculosis H37Rv
ccgcggacuuggcggucg

SEQ ID NO: 1275636 - RNA, 13 nt, Mycobacterium tuberculosis H37Rv
ccgcggaucgacc

SEQ ID NO: 1275637 - RNA, 20 nt, Mycobacterium tuberculosis H37Rv
ccgcggcagcauccucgacu

SEQ ID NO: 1275638 - RNA, 15 nt, Mycobacterium tuberculosis H37Rv
ccgcggcagcggaua

SEQ ID NO: 1275639 - RNA, 21 nt, Mycobacterium tuberculosis H37Rv
ccgcggaugcucaggucaccg

SEQ ID NO: 1275640 - RNA, 15 nt, Mycobacterium tuberculosis H37Rv
ccgcggccaccgccg

SEQ ID NO: 1275641 - RNA, 12 nt, Mycobacterium tuberculosis H37Rv
ccgcggccaccg

SEQ ID NO: 1275642 - RNA, 12 nt, Mycobacterium tuberculosis H37Rv
ccgcggccacca

SEQ ID NO: 1275643 - RNA, 20 nt, Mycobacterium tuberculosis H37Rv
ccgcgcuugcgaucggcacu

SEQ ID NO: 1275644 - RNA, 14 nt, Mycobacterium tuberculosis H37Rv
ccgcgcgccggcga

SEQ ID NO: 1275645 - RNA, 13 nt, Mycobacterium tuberculosis H37Rv
ccgccucgccgua

SEQ ID NO: 1275646 - RNA, 17 nt, Mycobacterium tuberculosis H37Rv
ccgccugccccacccgc

SEQ ID NO: 1275647 - RNA, 23 nt, Mycobacterium tuberculosis H37Rv
ccgccugcaacacgcgaugcacg

SEQ ID NO: 1275648 - RNA, 12 nt, Mycobacterium tuberculosis H37Rv
ccgccugcaccg

SEQ ID NO: 1275649 - RNA, 13 nt, Mycobacterium tuberculosis H37Rv
ccgccugacccgg

SEQ ID NO: 1275650 - RNA, 20 nt, Mycobacterium tuberculosis H37Rv
ccgcgacauccgcggcaugc

SEQ ID NO: 1275651 - RNA, 19 nt, Mycobacterium tuberculosis H37Rv
ccgcgaaugugaucacccg

SEQ ID NO: 1275652 - RNA, 20 nt, Mycobacterium tuberculosis H37Rv
ccgcgaaugugaucacccgc

SEQ ID NO: 1275653 - RNA, 18 nt, Mycobacterium tuberculosis H37Rv
ccgcgaaugugaucaccc

SEQ ID NO: 1275654 - RNA, 16 nt, Mycobacterium tuberculosis H37Rv
ccgcgaaugucgccgc

SEQ ID NO: 1275655 - RNA, 14 nt, Mycobacterium tuberculosis H37Rv
ccgcgacagcggcg

SEQ ID NO: 1275656 - RNA, 20 nt, Mycobacterium tuberculosis H37Rv
ccgcgaauacgaggacgacg

SEQ ID NO: 1275657 - RNA, 22 nt, Mycobacterium tuberculosis H37Rv
ccgcgaauacgaggacgacgau

SEQ ID NO: 1275658 - RNA, 20 nt, Mycobacterium tuberculosis H37Rv
ccgcgaucgugcagguugcc

SEQ ID NO: 1275659 - RNA, 17 nt, Mycobacterium tuberculosis H37Rv
ccgcgagagaguucgca

SEQ ID NO: 1275660 - RNA, 20 nt, Mycobacterium tuberculosis H37Rv
ccgcgagagaguucgcaugc

SEQ ID NO: 1275661 - RNA, 21 nt, Mycobacterium tuberculosis H37Rv
ccgcgacggccuuggcgacgu

SEQ ID NO: 1275662 - RNA, 21 nt, Mycobacterium tuberculosis H37Rv
ccgcgacguugaacucgaguu

SEQ ID NO: 1275663 - RNA, 13 nt, Mycobacterium tuberculosis H37Rv
ccgcgaccgcauu

SEQ ID NO: 1275664 - RNA, 13 nt, Mycobacterium tuberculosis H37Rv
ccgcgaccauggu

SEQ ID NO: 1275665 - RNA, 18 nt, Mycobacterium tuberculosis H37Rv
ccgcgcaucaucgcccac

SEQ ID NO: 1275666 - RNA, 20 nt, Mycobacterium tuberculosis H37Rv
ccgcgaugggauaccgcguc

SEQ ID NO: 1275667 - RNA, 22 nt, Mycobacterium tuberculosis H37Rv
ccgcgcaggugccuuucggcag

SEQ ID NO: 1275668 - RNA, 14 nt, Mycobacterium tuberculosis H37Rv
ccgcgaugacgacc

SEQ ID NO: 1275669 - RNA, 19 nt, Mycobacterium tuberculosis H37Rv
ccgcgaugacgacgaaccg

SEQ ID NO: 1275670 - RNA, 21 nt, Mycobacterium tuberculosis H37Rv
ccgcgaugacgacgaaccggu

SEQ ID NO: 1275671 - RNA, 21 nt, Mycobacterium tuberculosis H37Rv
ccgcgaugacggugccgaccg

SEQ ID NO: 1275672 - RNA, 21 nt, Mycobacterium tuberculosis H37Rv
ccgcgaugauaccugcccacg

SEQ ID NO: 1275673 - RNA, 17 nt, Mycobacterium tuberculosis H37Rv
ccgcgauggccgcgugc

SEQ ID NO: 1275674 - RNA, 19 nt, Mycobacterium tuberculosis H37Rv
ccgcgcccgagaccggcac

SEQ ID NO: 1275675 - RNA, 14 nt, Mycobacterium tuberculosis H37Rv
ccgcgcccgagccg

SEQ ID NO: 1275676 - RNA, 15 nt, Mycobacterium tuberculosis H37Rv
ccgcgcgccggccau

SEQ ID NO: 1275677 - RNA, 19 nt, Mycobacterium tuberculosis H37Rv
ccgcgcgcauuuuucgcca

SEQ ID NO: 1275678 - RNA, 19 nt, Mycobacterium tuberculosis H37Rv
ccgcgccgucgucgcgcag

SEQ ID NO: 1275679 - RNA, 22 nt, Mycobacterium tuberculosis H37Rv
ccgcgccggcagacccgggcca

SEQ ID NO: 1275680 - RNA, 19 nt, Mycobacterium tuberculosis H37Rv
ccgcgccgccccgcucggu

SEQ ID NO: 1275681 - RNA, 22 nt, Mycobacterium tuberculosis H37Rv
ccgcccgaggcacccgugccgc

SEQ ID NO: 1275682 - RNA, 17 nt, Mycobacterium tuberculosis H37Rv
ccgcccggaaaggccgc

SEQ ID NO: 1275683 - RNA, 14 nt, Mycobacterium tuberculosis H37Rv
ccgccgcggccaca

SEQ ID NO: 1275684 - RNA, 22 nt, Mycobacterium tuberculosis H37Rv
ccgcccggcuaggagaucagca

SEQ ID NO: 1275685 - RNA, 13 nt, Mycobacterium tuberculosis H37Rv
ccgccgcguuucg

SEQ ID NO: 1275686 - RNA, 13 nt, Mycobacterium tuberculosis H37Rv
ccgccgcgucgag

SEQ ID NO: 1275687 - RNA, 24 nt, Mycobacterium tuberculosis H37Rv
ccgccgcgucauucaccgcguuga

SEQ ID NO: 1275688 - RNA, 18 nt, Mycobacterium tuberculosis H37Rv
ccgccgcggucagaucca

SEQ ID NO: 1275689 - RNA, 15 nt, Mycobacterium tuberculosis H37Rv
ccgccggccagguga

SEQ ID NO: 1275690 - RNA, 16 nt, Mycobacterium tuberculosis H37Rv
ccgccggccaugugca

SEQ ID NO: 1275691 - RNA, 17 nt, Mycobacterium tuberculosis H37Rv
ccgccggccggaacgcc

SEQ ID NO: 1275692 - RNA, 19 nt, Mycobacterium tuberculosis H37Rv
ccgccggccccgccgcuac

SEQ ID NO: 1275693 - RNA, 19 nt, Mycobacterium tuberculosis H37Rv
ccgccggccccaccgguac

SEQ ID NO: 1275694 - RNA, 22 nt, Mycobacterium tuberculosis H37Rv
ccgccggccccaccggugccgc

SEQ ID NO: 1275695 - RNA, 13 nt, Mycobacterium tuberculosis H37Rv
ccgccggccgcca

SEQ ID NO: 1275696 - RNA, 22 nt, Mycobacterium tuberculosis H37Rv
ccgccggacccgucgagcagca

SEQ ID NO: 1275697 - RNA, 17 nt, Mycobacterium tuberculosis H37Rv
ccgccggacccgucgag

SEQ ID NO: 1275698 - RNA, 23 nt, Mycobacterium tuberculosis H37Rv
ccgccgcuguugaucgacaccga

SEQ ID NO: 1275699 - RNA, 16 nt, Mycobacterium tuberculosis H37Rv
ccgccguucgggaugc

SEQ ID NO: 1275700 - RNA, 20 nt, Mycobacterium tuberculosis H37Rv
ccgccguuaccgccguugcc

SEQ ID NO: 1275701 - RNA, 17 nt, Mycobacterium tuberculosis H37Rv
ccgccguuaccgccguu

SEQ ID NO: 1275702 - RNA, 14 nt, Mycobacterium tuberculosis H37Rv
ccgccgugcugcgg

SEQ ID NO: 1275703 - RNA, 16 nt, Mycobacterium tuberculosis H37Rv
ccgccgugcugcggcg

SEQ ID NO: 1275704 - RNA, 21 nt, Mycobacterium tuberculosis H37Rv
ccgccgugcugcggcgacggu

SEQ ID NO: 1275705 - RNA, 19 nt, Mycobacterium tuberculosis H37Rv
ccgccguggcgucggcguc

SEQ ID NO: 1275706 - RNA, 17 nt, Mycobacterium tuberculosis H37Rv
ccgccgucgccggugcc

SEQ ID NO: 1275707 - RNA, 19 nt, Mycobacterium tuberculosis H37Rv
ccgccgucgccuccgcuac

SEQ ID NO: 1275708 - RNA, 22 nt, Mycobacterium tuberculosis H37Rv
ccgccgucggguugcgacgaac

SEQ ID NO: 1275709 - RNA, 19 nt, Mycobacterium tuberculosis H37Rv
ccgccggugaggaucagcg

SEQ ID NO: 1275710 - RNA, 12 nt, Mycobacterium tuberculosis H37Rv
ccgccuccucga

SEQ ID NO: 1275711 - RNA, 15 nt, Mycobacterium tuberculosis H37Rv
aaaugauagcggcgc

SEQ ID NO: 1275712 - RNA, 23 nt, Mycobacterium tuberculosis H37Rv
ccgccggcgcccaggccgaucag

SEQ ID NO: 1275713 - RNA, 15 nt, Mycobacterium tuberculosis H37Rv
ccgccgucgccacca

SEQ ID NO: 1275714 - RNA, 19 nt, Mycobacterium tuberculosis H37Rv
ccgccgucgccaccgguac

SEQ ID NO: 1275715 - RNA, 21 nt, Mycobacterium tuberculosis H37Rv
ccgccggugccgccgauaccg

SEQ ID NO: 1275716 - RNA, 22 nt, Mycobacterium tuberculosis H37Rv
ccgccggugccgccauugacgc

SEQ ID NO: 1275717 - RNA, 18 nt, Mycobacterium tuberculosis H37Rv
ccgccgucgccgccgcua

SEQ ID NO: 1275718 - RNA, 22 nt, Mycobacterium tuberculosis H37Rv
ccgccgucgccgaucagcugcg

SEQ ID NO: 1275719 - RNA, 13 nt, Mycobacterium tuberculosis H37Rv
ccgccgucgccgg

SEQ ID NO: 1275720 - RNA, 15 nt, Mycobacterium tuberculosis H37Rv
ccgccgucgccggug

SEQ ID NO: 1275721 - RNA, 17 nt, Mycobacterium tuberculosis H37Rv
ccgccggucccgcgugc

SEQ ID NO: 1275722 - RNA, 19 nt, Mycobacterium tuberculosis H37Rv
ccgccgguccccucggugc

SEQ ID NO: 1275723 - RNA, 13 nt, Mycobacterium tuberculosis H37Rv
ccgccggugccgc

SEQ ID NO: 1275724 - RNA, 17 nt, Mycobacterium tuberculosis H37Rv
ccgccggugccgaucag

SEQ ID NO: 1275725 - RNA, 22 nt, Mycobacterium tuberculosis H37Rv
ccgguggcagggaaccauugcc

SEQ ID NO: 1275726 - RNA, 16 nt, Mycobacterium tuberculosis H37Rv
ccgguggccagcacgu

SEQ ID NO: 1275727 - RNA, 20 nt, Mycobacterium tuberculosis H37Rv
ccgguggcccgccggcagug

SEQ ID NO: 1275728 - RNA, 17 nt, Mycobacterium tuberculosis H37Rv
ccgguggcccgccggca

SEQ ID NO: 1275729 - RNA, 15 nt, Mycobacterium tuberculosis H37Rv
ccgguggugccggcg

SEQ ID NO: 1275730 - RNA, 21 nt, Mycobacterium tuberculosis H37Rv
ccgguggugcucgucgguguc

SEQ ID NO: 1275731 - RNA, 22 nt, Mycobacterium tuberculosis H37Rv
ccgguggugggccguggguguc

SEQ ID NO: 1275732 - RNA, 16 nt, Mycobacterium tuberculosis H37Rv
ccgguggugucgguuc

SEQ ID NO: 1275733 - RNA, 21 nt, Mycobacterium tuberculosis H37Rv
ccgguggcugaucaccguugc

SEQ ID NO: 1275734 - RNA, 13 nt, Mycobacterium tuberculosis H37Rv
ccgguggcguuug

SEQ ID NO: 1275735 - RNA, 22 nt, Mycobacterium tuberculosis H37Rv
ccgguggcguggucucggucag

SEQ ID NO: 1275736 - RNA, 19 nt, Mycobacterium tuberculosis H37Rv
ccggugggcggcucgucga

SEQ ID NO: 1275737 - RNA, 19 nt, Mycobacterium tuberculosis H37Rv
ccggugcccaucggcauga

SEQ ID NO: 1275738 - RNA, 15 nt, Mycobacterium tuberculosis H37Rv
ccggugcccgcacca

SEQ ID NO: 1275739 - RNA, 23 nt, Mycobacterium tuberculosis H37Rv
ccggugccaguacucggccagcg

SEQ ID NO: 1275740 - RNA, 20 nt, Mycobacterium tuberculosis H37Rv
ccggugccacugccguugcc

SEQ ID NO: 1275741 - RNA, 12 nt, Mycobacterium tuberculosis H37Rv
ccgguggcagca

SEQ ID NO: 1275742 - RNA, 19 nt, Mycobacterium tuberculosis H37Rv
ccggugccgccauugacgc

SEQ ID NO: 1275743 - RNA, 12 nt, Mycobacterium tuberculosis H37Rv
ccggugccgacg

SEQ ID NO: 1275744 - RNA, 22 nt, Mycobacterium tuberculosis H37Rv
ccgguggaaaagccacggcugc

SEQ ID NO: 1275745 - RNA, 18 nt, Mycobacterium tuberculosis H37Rv
ccgguggacagaugcauc

SEQ ID NO: 1275746 - RNA, 17 nt, Mycobacterium tuberculosis H37Rv
ccgguuauggcauucga

SEQ ID NO: 1275747 - RNA, 13 nt, Mycobacterium tuberculosis H37Rv
ccgguucaccaug

SEQ ID NO: 1275748 - RNA, 24 nt, Mycobacterium tuberculosis H37Rv
ccgguuaauggaaugaucggcguc

SEQ ID NO: 1275749 - RNA, 14 nt, Mycobacterium tuberculosis H37Rv
ccgguguugccguu

SEQ ID NO: 1275750 - RNA, 16 nt, Mycobacterium tuberculosis H37Rv
ccgguguaauugccga

SEQ ID NO: 1275751 - RNA, 19 nt, Mycobacterium tuberculosis H37Rv
ccgguguugccgaagcccg

SEQ ID NO: 1275752 - RNA, 22 nt, Mycobacterium tuberculosis H37Rv
ccgguucgauggcaucggccau

SEQ ID NO: 1275753 - RNA, 20 nt, Mycobacterium tuberculosis H37Rv
ccgguugucgcagcgcacac

SEQ ID NO: 1275754 - RNA, 20 nt, Mycobacterium tuberculosis H37Rv
ccguaacgcggaucgggcac

SEQ ID NO: 1275755 - RNA, 16 nt, Mycobacterium tuberculosis H37Rv
ccguaaagccguugau

SEQ ID NO: 1275756 - RNA, 20 nt, Mycobacterium tuberculosis H37Rv
ccguaacagccggccggauc

SEQ ID NO: 1275757 - RNA, 19 nt, Mycobacterium tuberculosis H37Rv
ccguaaaugguggcguguu

SEQ ID NO: 1275758 - RNA, 19 nt, Mycobacterium tuberculosis H37Rv
ccgguuucuucggccagcu

SEQ ID NO: 1275759 - RNA, 16 nt, Mycobacterium tuberculosis H37Rv
ccgguuuugccgugcc

SEQ ID NO: 1275760 - RNA, 19 nt, Mycobacterium tuberculosis H37Rv
ccggugaaccgggacagca

SEQ ID NO: 1275761 - RNA, 22 nt, Mycobacterium tuberculosis H37Rv
ccggugaaccgggacagcagcc

SEQ ID NO: 1275762 - RNA, 13 nt, Mycobacterium tuberculosis H37Rv
ccggugaccagca

SEQ ID NO: 1275763 - RNA, 15 nt, Mycobacterium tuberculosis H37Rv
ccggugacaaggaug

SEQ ID NO: 1275764 - RNA, 17 nt, Mycobacterium tuberculosis H37Rv
ccggugaccacuugcag

SEQ ID NO: 1275765 - RNA, 20 nt, Mycobacterium tuberculosis H37Rv
ccggugaccacuugcagcac

SEQ ID NO: 1275766 - RNA, 17 nt, Mycobacterium tuberculosis H37Rv
ccggugaccucgguauc

SEQ ID NO: 1275767 - RNA, 21 nt, Mycobacterium tuberculosis H37Rv
ccggugaacaccagcaggaag

SEQ ID NO: 1275768 - RNA, 15 nt, Mycobacterium tuberculosis H37Rv
ccggucuuacggucg

SEQ ID NO: 1275769 - RNA, 23 nt, Mycobacterium tuberculosis H37Rv
ccggucuugcaucgccgaugcgg

SEQ ID NO: 1275770 - RNA, 12 nt, Mycobacterium tuberculosis H37Rv
ccggucucggcc

SEQ ID NO: 1275771 - RNA, 12 nt, Mycobacterium tuberculosis H37Rv
ccggucggcgac

SEQ ID NO: 1275772 - RNA, 18 nt, Mycobacterium tuberculosis H37Rv
ccggucggucucggcgag

SEQ ID NO: 1275773 - RNA, 17 nt, Mycobacterium tuberculosis H37Rv
ccggucuacgacgucgc

SEQ ID NO: 1275774 - RNA, 13 nt, Mycobacterium tuberculosis H37Rv
ccggucguggucc

SEQ ID NO: 1275775 - RNA, 12 nt, Mycobacterium tuberculosis H37Rv
ccggucggccau

SEQ ID NO: 1275776 - RNA, 12 nt, Mycobacterium tuberculosis H37Rv
ccggucggccag

SEQ ID NO: 1275777 - RNA, 19 nt, Mycobacterium tuberculosis H37Rv
ccggucggcgaaaggccag

SEQ ID NO: 1275778 - RNA, 12 nt, Mycobacterium tuberculosis H37Rv
ccggucggcagc

SEQ ID NO: 1275779 - RNA, 14 nt, Mycobacterium tuberculosis H37Rv
ccggucggagcggu

SEQ ID NO: 1275780 - RNA, 20 nt, Mycobacterium tuberculosis H37Rv
ccggucgcuguccacugcca

SEQ ID NO: 1275781 - RNA, 13 nt, Mycobacterium tuberculosis H37Rv
ccgggguucaccg

SEQ ID NO: 1275782 - RNA, 15 nt, Mycobacterium tuberculosis H37Rv
ccggggcugccgaac

SEQ ID NO: 1275783 - RNA, 20 nt, Mycobacterium tuberculosis H37Rv
ccggggcugccgccguugcc

SEQ ID NO: 1275784 - RNA, 14 nt, Mycobacterium tuberculosis H37Rv
ccggguaucgccag

SEQ ID NO: 1275785 - RNA, 15 nt, Mycobacterium tuberculosis H37Rv
ccggguagacaccgc

SEQ ID NO: 1275786 - RNA, 17 nt, Mycobacterium tuberculosis H37Rv
ccggguagacaccgcga

SEQ ID NO: 1275787 - RNA, 23 nt, Mycobacterium tuberculosis H37Rv
ccggguaaagcgaugggaacggg

SEQ ID NO: 1275788 - RNA, 16 nt, Mycobacterium tuberculosis H37Rv
ccggucgccgcgucua

SEQ ID NO: 1275789 - RNA, 11 nt, Mycobacterium tuberculosis H37Rv
ccggucgccgc

SEQ ID NO: 1275790 - RNA, 21 nt, Mycobacterium tuberculosis H37Rv
ccggucgccggucaucgccga

SEQ ID NO: 1275791 - RNA, 19 nt, Mycobacterium tuberculosis H37Rv
ccggucgcauggucgacga

SEQ ID NO: 1275792 - RNA, 20 nt, Mycobacterium tuberculosis H37Rv
ccggucgccaagugcagggc

SEQ ID NO: 1275793 - RNA, 11 nt, Mycobacterium tuberculosis H37Rv
ccggucgaugu

SEQ ID NO: 1275794 - RNA, 19 nt, Mycobacterium tuberculosis H37Rv
ccggucgaugccgaugcga

SEQ ID NO: 1275795 - RNA, 14 nt, Mycobacterium tuberculosis H37Rv
ccggucgcacuugg

SEQ ID NO: 1275796 - RNA, 22 nt, Mycobacterium tuberculosis H37Rv
ccggucgagugccucgaccugg

SEQ ID NO: 1275797 - RNA, 15 nt, Mycobacterium tuberculosis H37Rv
ccggucgaugccgau

SEQ ID NO: 1275798 - RNA, 14 nt, Mycobacterium tuberculosis H37Rv
ccgguccggcgucg

SEQ ID NO: 1275799 - RNA, 16 nt, Mycobacterium tuberculosis H37Rv
ccgggucaccagcgca

SEQ ID NO: 1275800 - RNA, 18 nt, Mycobacterium tuberculosis H37Rv
ccgucgcuaugcgccgca

SEQ ID NO: 1275801 - RNA, 22 nt, Mycobacterium tuberculosis H37Rv
ccgucggauggaaggcggccag

SEQ ID NO: 1275802 - RNA, 17 nt, Mycobacterium tuberculosis H37Rv
ccgucggacauaccgcg

SEQ ID NO: 1275803 - RNA, 23 nt, Mycobacterium tuberculosis H37Rv
ccgucgaucaagugcgguccggc

SEQ ID NO: 1275804 - RNA, 18 nt, Mycobacterium tuberculosis H37Rv
ccgucgaucagcggcagc

SEQ ID NO: 1275805 - RNA, 13 nt, Mycobacterium tuberculosis H37Rv
ccgucgcguccgc

SEQ ID NO: 1275806 - RNA, 14 nt, Mycobacterium tuberculosis H37Rv
ccgucgacgcgguc

SEQ ID NO: 1275807 - RNA, 21 nt, Mycobacterium tuberculosis H37Rv
ccgucgagcacggugagccgg

SEQ ID NO: 1275808 - RNA, 17 nt, Mycobacterium tuberculosis H37Rv
ccgucgauagucgccgu

SEQ ID NO: 1275809 - RNA, 19 nt, Mycobacterium tuberculosis H37Rv
ccgucgauagucgccgucg

SEQ ID NO: 1275810 - RNA, 21 nt, Mycobacterium tuberculosis H37Rv
ccgucgauagucgccgucgcc

SEQ ID NO: 1275811 - RNA, 21 nt, Mycobacterium tuberculosis H37Rv
ccgucgggacggccaacaggg

SEQ ID NO: 1275812 - RNA, 11 nt, Mycobacterium tuberculosis H37Rv
ccgucggcgcu

SEQ ID NO: 1275813 - RNA, 13 nt, Mycobacterium tuberculosis H37Rv
ccgucggcgagca

SEQ ID NO: 1275814 - RNA, 13 nt, Mycobacterium tuberculosis H37Rv
ccgucggcgaagg

SEQ ID NO: 1275815 - RNA, 15 nt, Mycobacterium tuberculosis H37Rv
ccgucggccaggcca

SEQ ID NO: 1275816 - RNA, 21 nt, Mycobacterium tuberculosis H37Rv
ccgugacagcggcauugccag

SEQ ID NO: 1275817 - RNA, 16 nt, Mycobacterium tuberculosis H37Rv
ccgugaaucgagcacc

SEQ ID NO: 1275818 - RNA, 20 nt, Mycobacterium tuberculosis H37Rv
ccgugacccauucucggccg

SEQ ID NO: 1275819 - RNA, 21 nt, Mycobacterium tuberculosis H37Rv
ccgugacccugauggggcguu

SEQ ID NO: 1275820 - RNA, 17 nt, Mycobacterium tuberculosis H37Rv
ccgugcagcucggucag

SEQ ID NO: 1275821 - RNA, 14 nt, Mycobacterium tuberculosis H37Rv
ccgugagcaccagc

SEQ ID NO: 1275822 - RNA, 16 nt, Mycobacterium tuberculosis H37Rv
ccgugcagcucgguca

SEQ ID NO: 1275823 - RNA, 11 nt, Mycobacterium tuberculosis H37Rv
ccgugccagcu

SEQ ID NO: 1275824 - RNA, 19 nt, Mycobacterium tuberculosis H37Rv
ccgucguaugcggugacga

SEQ ID NO: 1275825 - RNA, 19 nt, Mycobacterium tuberculosis H37Rv
ccgucgucgccgucggugc

SEQ ID NO: 1275826 - RNA, 16 nt, Mycobacterium tuberculosis H37Rv
ccgucgucgucgacac

SEQ ID NO: 1275827 - RNA, 15 nt, Mycobacterium tuberculosis H37Rv
ccgucgucguacggc

SEQ ID NO: 1275828 - RNA, 22 nt, Mycobacterium tuberculosis H37Rv
ccgugaacggcgcgggccacca

SEQ ID NO: 1275829 - RNA, 17 nt, Mycobacterium tuberculosis H37Rv
ccgucgucaaguccuuc

SEQ ID NO: 1275830 - RNA, 14 nt, Mycobacterium tuberculosis H37Rv
ccgucgggcccagc

SEQ ID NO: 1275831 - RNA, 19 nt, Mycobacterium tuberculosis H37Rv
ccgucgggcacaccgacgc

SEQ ID NO: 1275832 - RNA, 22 nt, Mycobacterium tuberculosis H37Rv
ccgucguacucggcggccacca

SEQ ID NO: 1275833 - RNA, 22 nt, Mycobacterium tuberculosis H37Rv
ccgucguacucgaccgcgagca

SEQ ID NO: 1275834 - RNA, 17 nt, Mycobacterium tuberculosis H37Rv
ccgucgaaauacccggu

SEQ ID NO: 1275835 - RNA, 16 nt, Mycobacterium tuberculosis H37Rv
ccgucgacgaucagcg

SEQ ID NO: 1275836 - RNA, 17 nt, Mycobacterium tuberculosis H37Rv
ccgucgacgagcgccuc

SEQ ID NO: 1275837 - RNA, 18 nt, Mycobacterium tuberculosis H37Rv
ccgucgacaacaaacccg

SEQ ID NO: 1275838 - RNA, 20 nt, Mycobacterium tuberculosis H37Rv
ccguccccaccgacgccgau

SEQ ID NO: 1275839 - RNA, 12 nt, Mycobacterium tuberculosis H37Rv
ccguccgucggc

SEQ ID NO: 1275840 - RNA, 23 nt, Mycobacterium tuberculosis H37Rv
ccguccugacuuuugucacugcg

SEQ ID NO: 1275841 - RNA, 13 nt, Mycobacterium tuberculosis H37Rv
ccguccucgguca

SEQ ID NO: 1275842 - RNA, 20 nt, Mycobacterium tuberculosis H37Rv
ccguccaggcgcugcagcau

SEQ ID NO: 1275843 - RNA, 15 nt, Mycobacterium tuberculosis H37Rv
ccgucauacucgaca

SEQ ID NO: 1275844 - RNA, 21 nt, Mycobacterium tuberculosis H37Rv
ccgucaguucggugugcggcg

SEQ ID NO: 1275845 - RNA, 23 nt, Mycobacterium tuberculosis H37Rv
ccgucagguacgucuuggaucac

SEQ ID NO: 1275846 - RNA, 21 nt, Mycobacterium tuberculosis H37Rv
ccgucagguucuaccaaaucg

SEQ ID NO: 1275847 - RNA, 21 nt, Mycobacterium tuberculosis H37Rv
ccgucauacucgacaccgacu

SEQ ID NO: 1275848 - RNA, 18 nt, Mycobacterium tuberculosis H37Rv
ccguacaguccacgcgua

SEQ ID NO: 1275849 - RNA, 16 nt, Mycobacterium tuberculosis H37Rv
ccguugaggucgauca

SEQ ID NO: 1275850 - RNA, 20 nt, Mycobacterium tuberculosis H37Rv
ccguugaucgucucggcuag

SEQ ID NO: 1275851 - RNA, 17 nt, Mycobacterium tuberculosis H37Rv
ccguugaucuugacggu

SEQ ID NO: 1275852 - RNA, 21 nt, Mycobacterium tuberculosis H37Rv
ccguugccaccggugccggcg

SEQ ID NO: 1275853 - RNA, 18 nt, Mycobacterium tuberculosis H37Rv
ccguugccaccguagccg

SEQ ID NO: 1275854 - RNA, 14 nt, Mycobacterium tuberculosis H37Rv
ccguugcccacguu

SEQ ID NO: 1275855 - RNA, 19 nt, Mycobacterium tuberculosis H37Rv
ccguugccgccgacgccgc

SEQ ID NO: 1275856 - RNA, 15 nt, Mycobacterium tuberculosis H37Rv
ccguugccgccgacg

SEQ ID NO: 1275857 - RNA, 18 nt, Mycobacterium tuberculosis H37Rv
ccguugccgccgaagccg

SEQ ID NO: 1275858 - RNA, 15 nt, Mycobacterium tuberculosis H37Rv
ccguugccgcccguc

SEQ ID NO: 1275859 - RNA, 21 nt, Mycobacterium tuberculosis H37Rv
ccguugcccccauugccgccg

SEQ ID NO: 1275860 - RNA, 17 nt, Mycobacterium tuberculosis H37Rv
ccguugccgaucagccc

SEQ ID NO: 1275861 - RNA, 23 nt, Mycobacterium tuberculosis H37Rv
ccguugccgaucaguccggcguu

SEQ ID NO: 1275862 - RNA, 21 nt, Mycobacterium tuberculosis H37Rv
ccguugccgccguugccgccg

SEQ ID NO: 1275863 - RNA, 18 nt, Mycobacterium tuberculosis H37Rv
ccguucucgcccacccgc

SEQ ID NO: 1275864 - RNA, 21 nt, Mycobacterium tuberculosis H37Rv
ccguucucggugaaguggcgc

SEQ ID NO: 1275865 - RNA, 13 nt, Mycobacterium tuberculosis H37Rv
ccguugaagccca

SEQ ID NO: 1275866 - RNA, 19 nt, Mycobacterium tuberculosis H37Rv
ccguugaccucuucgggca

SEQ ID NO: 1275867 - RNA, 13 nt, Mycobacterium tuberculosis H37Rv
ccguucgcgucgc

SEQ ID NO: 1275868 - RNA, 20 nt, Mycobacterium tuberculosis H37Rv
ccguucgacccagcgguuga

SEQ ID NO: 1275869 - RNA, 13 nt, Mycobacterium tuberculosis H37Rv
ccguucgaggucg

SEQ ID NO: 1275870 - RNA, 19 nt, Mycobacterium tuberculosis H37Rv
ccguucgaggucggcgauc

SEQ ID NO: 1275871 - RNA, 20 nt, Mycobacterium tuberculosis H37Rv
ccgugucgagaucucacgug

SEQ ID NO: 1275872 - RNA, 15 nt, Mycobacterium tuberculosis H37Rv
ccguguaaccaucgu

SEQ ID NO: 1275873 - RNA, 24 nt, Mycobacterium tuberculosis H37Rv
ccgugucaccgccgggaagccgca

SEQ ID NO: 1275874 - RNA, 17 nt, Mycobacterium tuberculosis H37Rv
ccguguaugcauccacu

SEQ ID NO: 1275875 - RNA, 13 nt, Mycobacterium tuberculosis H37Rv
ccgugucaaccgg

SEQ ID NO: 1275876 - RNA, 20 nt, Mycobacterium tuberculosis H37Rv
ccgugguggucgggcgcaac

SEQ ID NO: 1275877 - RNA, 20 nt, Mycobacterium tuberculosis H37Rv
ccguggugguugaucagcca

SEQ ID NO: 1275878 - RNA, 17 nt, Mycobacterium tuberculosis H37Rv
ccgugccgaaaaucgca

SEQ ID NO: 1275879 - RNA, 18 nt, Mycobacterium tuberculosis H37Rv
ccgugccgaaaaucgcag

SEQ ID NO: 1275880 - RNA, 18 nt, Mycobacterium tuberculosis H37Rv
ccgugccgaugccggcga

SEQ ID NO: 1275881 - RNA, 22 nt, Mycobacterium tuberculosis H37Rv
ccguguugaagaagcccgaguu

SEQ ID NO: 1275882 - RNA, 13 nt, Mycobacterium tuberculosis H37Rv
ccguguuucgaac

SEQ ID NO: 1275883 - RNA, 16 nt, Mycobacterium tuberculosis H37Rv
ccguuauccgacgaac

SEQ ID NO: 1275884 - RNA, 21 nt, Mycobacterium tuberculosis H37Rv
ccguuagcuuagcugccgucg

SEQ ID NO: 1275885 - RNA, 14 nt, Mycobacterium tuberculosis H37Rv
ccguucaugcggcg

SEQ ID NO: 1275886 - RNA, 19 nt, Mycobacterium tuberculosis H37Rv
ccguuguggaccaucuuca

SEQ ID NO: 1275887 - RNA, 21 nt, Mycobacterium tuberculosis H37Rv
ccguuuccggcgcuccgccag

SEQ ID NO: 1275888 - RNA, 17 nt, Mycobacterium tuberculosis H37Rv
ccguugcuauucgccag

SEQ ID NO: 1275889 - RNA, 21 nt, Mycobacterium tuberculosis H37Rv
ccguugcugagcguaggccag

SEQ ID NO: 1275890 - RNA, 21 nt, Mycobacterium tuberculosis H37Rv
ccguugcugcgcagcggcauc

SEQ ID NO: 1275891 - RNA, 20 nt, Mycobacterium tuberculosis H37Rv
ccguuggcggcgguggccag

SEQ ID NO: 1275892 - RNA, 15 nt, Mycobacterium tuberculosis H37Rv
ccguuggcaaugacc

SEQ ID NO: 1275893 - RNA, 22 nt, Mycobacterium tuberculosis H37Rv
ccguuggugccgccugugccac

SEQ ID NO: 1275894 - RNA, 22 nt, Mycobacterium tuberculosis H37Rv
ccuaccgagaucaccgccacca

SEQ ID NO: 1275895 - RNA, 15 nt, Mycobacterium tuberculosis H37Rv
ccuaccgucgaccac

SEQ ID NO: 1275896 - RNA, 17 nt, Mycobacterium tuberculosis H37Rv
ccuagccgcggcaccgc

SEQ ID NO: 1275897 - RNA, 21 nt, Mycobacterium tuberculosis H37Rv
ccuaacccugcccuagcccga

SEQ ID NO: 1275898 - RNA, 17 nt, Mycobacterium tuberculosis H37Rv
ccuccucgagcaggaug

SEQ ID NO: 1275899 - RNA, 17 nt, Mycobacterium tuberculosis H37Rv
ccuccggggugaacgcg

SEQ ID NO: 1275900 - RNA, 17 nt, Mycobacterium tuberculosis H37Rv
ccuccgguaucggcgac

SEQ ID NO: 1275901 - RNA, 21 nt, Mycobacterium tuberculosis H37Rv
ccuccgguaucggcgaccagc

SEQ ID NO: 1275902 - RNA, 21 nt, Mycobacterium tuberculosis H37Rv
ccuccggguauggcggcgacg

SEQ ID NO: 1275903 - RNA, 20 nt, Mycobacterium tuberculosis H37Rv
ccuccggguccaggaacggc

SEQ ID NO: 1275904 - RNA, 22 nt, Mycobacterium tuberculosis H37Rv
ccuccgccaaggaggccaucau

SEQ ID NO: 1275905 - RNA, 18 nt, Mycobacterium tuberculosis H37Rv
ccuccgccggcaccuccg

SEQ ID NO: 1275906 - RNA, 15 nt, Mycobacterium tuberculosis H37Rv
ccuccgccugcccca

SEQ ID NO: 1275907 - RNA, 15 nt, Mycobacterium tuberculosis H37Rv
ccuccgcgaucaccg

SEQ ID NO: 1275908 - RNA, 18 nt, Mycobacterium tuberculosis H37Rv
ccuccgcgaucaccgacg

SEQ ID NO: 1275909 - RNA, 17 nt, Mycobacterium tuberculosis H37Rv
ccuccgcgccgaucagc

SEQ ID NO: 1275910 - RNA, 15 nt, Mycobacterium tuberculosis H37Rv
ccuccggcagcagca

SEQ ID NO: 1275911 - RNA, 17 nt, Mycobacterium tuberculosis H37Rv
ccucauagagcggcacc

SEQ ID NO: 1275912 - RNA, 14 nt, Mycobacterium tuberculosis H37Rv
ccucaucgcagacg

SEQ ID NO: 1275913 - RNA, 19 nt, Mycobacterium tuberculosis H37Rv
ccuagggcggcggcgcgau

SEQ ID NO: 1275914 - RNA, 21 nt, Mycobacterium tuberculosis H37Rv
ccuaggccgucucgacacugc

SEQ ID NO: 1275915 - RNA, 17 nt, Mycobacterium tuberculosis H37Rv
ccuaggugugcgacgac

SEQ ID NO: 1275916 - RNA, 15 nt, Mycobacterium tuberculosis H37Rv
ccuauggucaaccgc

SEQ ID NO: 1275917 - RNA, 19 nt, Mycobacterium tuberculosis H37Rv
ccucgcucuccauggccga

SEQ ID NO: 1275918 - RNA, 22 nt, Mycobacterium tuberculosis H37Rv
ccucggcgaccaucugaucggg

SEQ ID NO: 1275919 - RNA, 19 nt, Mycobacterium tuberculosis H37Rv
ccucggucacgaucacgau

SEQ ID NO: 1275920 - RNA, 17 nt, Mycobacterium tuberculosis H37Rv
ccucgguacuugccacg

SEQ ID NO: 1275921 - RNA, 21 nt, Mycobacterium tuberculosis H37Rv
ccucggugagaaucgacuccg

SEQ ID NO: 1275922 - RNA, 16 nt, Mycobacterium tuberculosis H37Rv
ccucggugacgucgcc

SEQ ID NO: 1275923 - RNA, 15 nt, Mycobacterium tuberculosis H37Rv
ccucggugagcagcu

SEQ ID NO: 1275924 - RNA, 15 nt, Mycobacterium tuberculosis H37Rv
ccucgucgacgucgg

SEQ ID NO: 1275925 - RNA, 19 nt, Mycobacterium tuberculosis H37Rv
ccucgucgacgucggcauc

SEQ ID NO: 1275926 - RNA, 16 nt, Mycobacterium tuberculosis H37Rv
ccucggguacaucgag

SEQ ID NO: 1275927 - RNA, 16 nt, Mycobacterium tuberculosis H37Rv
ccucggcgccgucgga

SEQ ID NO: 1275928 - RNA, 12 nt, Mycobacterium tuberculosis H37Rv
ccucggcgaugu

SEQ ID NO: 1275929 - RNA, 16 nt, Mycobacterium tuberculosis H37Rv
ccucgaguucgaccgg

SEQ ID NO: 1275930 - RNA, 22 nt, Mycobacterium tuberculosis H37Rv
ccucgcggaugagcucggccau

SEQ ID NO: 1275931 - RNA, 22 nt, Mycobacterium tuberculosis H37Rv
ccucgcgggcuuaugcacgacg

SEQ ID NO: 1275932 - RNA, 15 nt, Mycobacterium tuberculosis H37Rv
ccucgccggccaccc

SEQ ID NO: 1275933 - RNA, 18 nt, Mycobacterium tuberculosis H37Rv
ccggcgcuggcguggcca

SEQ ID NO: 1275934 - RNA, 20 nt, Mycobacterium tuberculosis H37Rv
ccggcgcugcugccauugcc

SEQ ID NO: 1275935 - RNA, 18 nt, Mycobacterium tuberculosis H37Rv
ccggcgcuccgccagaau

SEQ ID NO: 1275936 - RNA, 13 nt, Mycobacterium tuberculosis H37Rv
ccggcgcuccgcc

SEQ ID NO: 1275937 - RNA, 15 nt, Mycobacterium tuberculosis H37Rv
ccggcgcuccgccag

SEQ ID NO: 1275938 - RNA, 18 nt, Mycobacterium tuberculosis H37Rv
ccggcgcuccacugacca

SEQ ID NO: 1275939 - RNA, 16 nt, Mycobacterium tuberculosis H37Rv
ccggcgcucaucgcgu

SEQ ID NO: 1275940 - RNA, 21 nt, Mycobacterium tuberculosis H37Rv
ccggcgcucaucgcgugcucg

SEQ ID NO: 1275941 - RNA, 20 nt, Mycobacterium tuberculosis H37Rv
ccggcgcguaguaaugcucg

SEQ ID NO: 1275942 - RNA, 11 nt, Mycobacterium tuberculosis H37Rv
ccggcggccaa

SEQ ID NO: 1275943 - RNA, 12 nt, Mycobacterium tuberculosis H37Rv
ccggcggcaugg

SEQ ID NO: 1275944 - RNA, 20 nt, Mycobacterium tuberculosis H37Rv
ccggcggcaggaaucggguc

SEQ ID NO: 1275945 - RNA, 19 nt, Mycobacterium tuberculosis H37Rv
ccggcggcaaagagcagcc

SEQ ID NO: 1275946 - RNA, 22 nt, Mycobacterium tuberculosis H37Rv
ccggcggcaaagagcagccggc

SEQ ID NO: 1275947 - RNA, 13 nt, Mycobacterium tuberculosis H37Rv
ccggcggaucugg

SEQ ID NO: 1275948 - RNA, 17 nt, Mycobacterium tuberculosis H37Rv
ccggcggaucugaucgg

SEQ ID NO: 1275949 - RNA, 21 nt, Mycobacterium tuberculosis H37Rv
ccggcggacgugaccagaucg

SEQ ID NO: 1275950 - RNA, 22 nt, Mycobacterium tuberculosis H37Rv
ccggcggacgcccggcgcacca

SEQ ID NO: 1275951 - RNA, 18 nt, Mycobacterium tuberculosis H37Rv
ccggcggaccccucgacc

SEQ ID NO: 1275952 - RNA, 14 nt, Mycobacterium tuberculosis H37Rv
ccggcgcggcggac

SEQ ID NO: 1275953 - RNA, 16 nt, Mycobacterium tuberculosis H37Rv
ccggcgcggcggcguc

SEQ ID NO: 1275954 - RNA, 22 nt, Mycobacterium tuberculosis H37Rv
ccggcgcggaacgcgucgccga

SEQ ID NO: 1275955 - RNA, 22 nt, Mycobacterium tuberculosis H37Rv
ccggcgcgccccaccgcgccga

SEQ ID NO: 1275956 - RNA, 20 nt, Mycobacterium tuberculosis H37Rv
ccggcgccugcugcggccag

SEQ ID NO: 1275957 - RNA, 18 nt, Mycobacterium tuberculosis H37Rv
ccggcgcgagcagacgca

SEQ ID NO: 1275958 - RNA, 17 nt, Mycobacterium tuberculosis H37Rv
ccggcgccgccguugcc

SEQ ID NO: 1275959 - RNA, 17 nt, Mycobacterium tuberculosis H37Rv
ccggcgccgccgucgcc

SEQ ID NO: 1275960 - RNA, 17 nt, Mycobacterium tuberculosis H37Rv
ccggcgccgccggugcc

SEQ ID NO: 1275961 - RNA, 20 nt, Mycobacterium tuberculosis H37Rv
ccggcgccgccggcaccggg

SEQ ID NO: 1275962 - RNA, 20 nt, Mycobacterium tuberculosis H37Rv
ccggcgccgaaaacaacccg

SEQ ID NO: 1275963 - RNA, 13 nt, Mycobacterium tuberculosis H37Rv
ccggcgccgccac

SEQ ID NO: 1275964 - RNA, 17 nt, Mycobacterium tuberculosis H37Rv
ccggcgcccagcgccuc

SEQ ID NO: 1275965 - RNA, 17 nt, Mycobacterium tuberculosis H37Rv
ccggcgcccccguuacc

SEQ ID NO: 1275966 - RNA, 16 nt, Mycobacterium tuberculosis H37Rv
ccggcgcccaggccga

SEQ ID NO: 1275967 - RNA, 21 nt, Mycobacterium tuberculosis H37Rv
ccggccuugugcucgaugcga

SEQ ID NO: 1275968 - RNA, 18 nt, Mycobacterium tuberculosis H37Rv
ccggcgaacucgcgccga

SEQ ID NO: 1275969 - RNA, 23 nt, Mycobacterium tuberculosis H37Rv
ccggcgcaccugggcugccggcc

SEQ ID NO: 1275970 - RNA, 16 nt, Mycobacterium tuberculosis H37Rv
ccggcgcacgaaaccg

SEQ ID NO: 1275971 - RNA, 22 nt, Mycobacterium tuberculosis H37Rv
ccggcgcaguagccgaccagga

SEQ ID NO: 1275972 - RNA, 23 nt, Mycobacterium tuberculosis H37Rv
ccggcgcagguucucggugccga

SEQ ID NO: 1275973 - RNA, 24 nt, Mycobacterium tuberculosis H37Rv
ccggcaugcuggcgaucgcgacga

SEQ ID NO: 1275974 - RNA, 13 nt, Mycobacterium tuberculosis H37Rv
ccggcaugcccgc

SEQ ID NO: 1275975 - RNA, 14 nt, Mycobacterium tuberculosis H37Rv
ccggcaugccgcca

SEQ ID NO: 1275976 - RNA, 22 nt, Mycobacterium tuberculosis H37Rv
ccggcaucuccaccgucgccgc

SEQ ID NO: 1275977 - RNA, 21 nt, Mycobacterium tuberculosis H37Rv
ccggaaagccuaguacgccga

SEQ ID NO: 1275978 - RNA, 21 nt, Mycobacterium tuberculosis H37Rv
ccggaaaaauuucuucgccga

SEQ ID NO: 1275979 - RNA, 16 nt, Mycobacterium tuberculosis H37Rv
ccgcuuggccgcugcc

SEQ ID NO: 1275980 - RNA, 16 nt, Mycobacterium tuberculosis H37Rv
ccgcuugggcgguguc

SEQ ID NO: 1275981 - RNA, 15 nt, Mycobacterium tuberculosis H37Rv
ccgcuuguccaccgu

SEQ ID NO: 1275982 - RNA, 19 nt, Mycobacterium tuberculosis H37Rv
ccgcuugcccgcgcagcac

SEQ ID NO: 1275983 - RNA, 16 nt, Mycobacterium tuberculosis H37Rv
ccggccaacagucgca

SEQ ID NO: 1275984 - RNA, 17 nt, Mycobacterium tuberculosis H37Rv
ccggccaccaccgcgcc

SEQ ID NO: 1275985 - RNA, 20 nt, Mycobacterium tuberculosis H37Rv
ccggccagacggugcagcuc

SEQ ID NO: 1275986 - RNA, 19 nt, Mycobacterium tuberculosis H37Rv
ccggccacuccaugagccg

SEQ ID NO: 1275987 - RNA, 22 nt, Mycobacterium tuberculosis H37Rv
ccggccacuccaguacgguccg

SEQ ID NO: 1275988 - RNA, 22 nt, Mycobacterium tuberculosis H37Rv
ccggccacgguccggcccacca

SEQ ID NO: 1275989 - RNA, 18 nt, Mycobacterium tuberculosis H37Rv
ccggccacgaccucggga

SEQ ID NO: 1275990 - RNA, 20 nt, Mycobacterium tuberculosis H37Rv
ccggccacgaccucgggauc

SEQ ID NO: 1275991 - RNA, 16 nt, Mycobacterium tuberculosis H37Rv
ccggccacgagucgca

SEQ ID NO: 1275992 - RNA, 14 nt, Mycobacterium tuberculosis H37Rv
ccggccagcacucc

SEQ ID NO: 1275993 - RNA, 16 nt, Mycobacterium tuberculosis H37Rv
ccggccagcagguccg

SEQ ID NO: 1275994 - RNA, 14 nt, Mycobacterium tuberculosis H37Rv
ccggccucuggauc

SEQ ID NO: 1275995 - RNA, 18 nt, Mycobacterium tuberculosis H37Rv
ccggccuccauaucgcag

SEQ ID NO: 1275996 - RNA, 22 nt, Mycobacterium tuberculosis H37Rv
ccggccucagcccgucagccga

SEQ ID NO: 1275997 - RNA, 13 nt, Mycobacterium tuberculosis H37Rv
ccggccguuggga

SEQ ID NO: 1275998 - RNA, 13 nt, Mycobacterium tuberculosis H37Rv
ccggccggcccau

SEQ ID NO: 1275999 - RNA, 12 nt, Mycobacterium tuberculosis H37Rv
ccggccggcaau

SEQ ID NO: 1276000 - RNA, 17 nt, Mycobacterium tuberculosis H37Rv
ccggccgcuauggcccg

SEQ ID NO: 1276001 - RNA, 14 nt, Mycobacterium tuberculosis H37Rv
ccggccgacccgga

SEQ ID NO: 1276002 - RNA, 14 nt, Mycobacterium tuberculosis H37Rv
ccggccgagcgcac

SEQ ID NO: 1276003 - RNA, 22 nt, Mycobacterium tuberculosis H37Rv
ccggccgcgcacccguccgccg

SEQ ID NO: 1276004 - RNA, 14 nt, Mycobacterium tuberculosis H37Rv
ccggccgcgcagau

SEQ ID NO: 1276005 - RNA, 16 nt, Mycobacterium tuberculosis H37Rv
ccggccgaucucggug

SEQ ID NO: 1276006 - RNA, 15 nt, Mycobacterium tuberculosis H37Rv
ccggccaggugacgu

SEQ ID NO: 1276007 - RNA, 18 nt, Mycobacterium tuberculosis H37Rv
ccggccaggucgacaccg

SEQ ID NO: 1276008 - RNA, 14 nt, Mycobacterium tuberculosis H37Rv
ccggccccgccgau

SEQ ID NO: 1276009 - RNA, 21 nt, Mycobacterium tuberculosis H37Rv
ccggccccgccguuuccgccg

SEQ ID NO: 1276010 - RNA, 19 nt, Mycobacterium tuberculosis H37Rv
ccggccauaccgcucgccg

SEQ ID NO: 1276011 - RNA, 17 nt, Mycobacterium tuberculosis H37Rv
ccggccccgcaagcgga

SEQ ID NO: 1276012 - RNA, 19 nt, Mycobacterium tuberculosis H37Rv
ccggcccgcaacgcgucgg

SEQ ID NO: 1276013 - RNA, 14 nt, Mycobacterium tuberculosis H37Rv
ccggcccucgccag

SEQ ID NO: 1276014 - RNA, 23 nt, Mycobacterium tuberculosis H37Rv
ccggcccgaugccgaggaucgcg

SEQ ID NO: 1276015 - RNA, 17 nt, Mycobacterium tuberculosis H37Rv
ccggccgacgugacaac

SEQ ID NO: 1276016 - RNA, 13 nt, Mycobacterium tuberculosis H37Rv
ccggccgacgaac

SEQ ID NO: 1276017 - RNA, 17 nt, Mycobacterium tuberculosis H37Rv
ccggccgacacgccgau

SEQ ID NO: 1276018 - RNA, 13 nt, Mycobacterium tuberculosis H37Rv
ccggcccgcaucc

SEQ ID NO: 1276019 - RNA, 15 nt, Mycobacterium tuberculosis H37Rv
ccggcgugcucggga

SEQ ID NO: 1276020 - RNA, 16 nt, Mycobacterium tuberculosis H37Rv
ccggcgugcggcgagg

SEQ ID NO: 1276021 - RNA, 17 nt, Mycobacterium tuberculosis H37Rv
ccggcgugcgcaaggca

SEQ ID NO: 1276022 - RNA, 22 nt, Mycobacterium tuberculosis H37Rv
ccggcgugcagcacuuggccag

SEQ ID NO: 1276023 - RNA, 20 nt, Mycobacterium tuberculosis H37Rv
ccggcgucugcccgcccagc

SEQ ID NO: 1276024 - RNA, 14 nt, Mycobacterium tuberculosis H37Rv
ccggcgugucgccg

SEQ ID NO: 1276025 - RNA, 18 nt, Mycobacterium tuberculosis H37Rv
ccggcgugucgccgccac

SEQ ID NO: 1276026 - RNA, 19 nt, Mycobacterium tuberculosis H37Rv
ccggcgugggcaccuugcc

SEQ ID NO: 1276027 - RNA, 15 nt, Mycobacterium tuberculosis H37Rv
ccggcgucggucguc

SEQ ID NO: 1276028 - RNA, 13 nt, Mycobacterium tuberculosis H37Rv
ccggcgucguuga

SEQ ID NO: 1276029 - RNA, 13 nt, Mycobacterium tuberculosis H37Rv
ccggcgucgacga

SEQ ID NO: 1276030 - RNA, 19 nt, Mycobacterium tuberculosis H37Rv
ccggcgucgaaggugacca

SEQ ID NO: 1276031 - RNA, 15 nt, Mycobacterium tuberculosis H37Rv
ccggcgucgagccgg

SEQ ID NO: 1276032 - RNA, 14 nt, Mycobacterium tuberculosis H37Rv
ccggcggucgccag

SEQ ID NO: 1276033 - RNA, 16 nt, Mycobacterium tuberculosis H37Rv
ccggcguuugggcauc

SEQ ID NO: 1276034 - RNA, 18 nt, Mycobacterium tuberculosis H37Rv
ccggcucauccgacggga

SEQ ID NO: 1276035 - RNA, 18 nt, Mycobacterium tuberculosis H37Rv
ccggcuccagcaugggcg

SEQ ID NO: 1276036 - RNA, 19 nt, Mycobacterium tuberculosis H37Rv
ccggcguugccgccguucc

SEQ ID NO: 1276037 - RNA, 19 nt, Mycobacterium tuberculosis H37Rv
ccggcguugccgccguugc

SEQ ID NO: 1276038 - RNA, 22 nt, Mycobacterium tuberculosis H37Rv
ccggcguuguaguugcccacgu

SEQ ID NO: 1276039 - RNA, 14 nt, Mycobacterium tuberculosis H37Rv
ccggcguuggccau

SEQ ID NO: 1276040 - RNA, 23 nt, Mycobacterium tuberculosis H37Rv
ccggcguucccacuggaggucgu

SEQ ID NO: 1276041 - RNA, 17 nt, Mycobacterium tuberculosis H37Rv
ccggcguucccacugga

SEQ ID NO: 1276042 - RNA, 13 nt, Mycobacterium tuberculosis H37Rv
ccggcguugccga

SEQ ID NO: 1276043 - RNA, 20 nt, Mycobacterium tuberculosis H37Rv
ccggcugcaaccagcggcac

SEQ ID NO: 1276044 - RNA, 23 nt, Mycobacterium tuberculosis H37Rv
ccggcugccagcgccgccgccga

SEQ ID NO: 1276045 - RNA, 13 nt, Mycobacterium tuberculosis H37Rv
ccggcugccgcac

SEQ ID NO: 1276046 - RNA, 16 nt, Mycobacterium tuberculosis H37Rv
ccggcugaccgacccg

SEQ ID NO: 1276047 - RNA, 16 nt, Mycobacterium tuberculosis H37Rv
ccggcuccgccguugc

SEQ ID NO: 1276048 - RNA, 12 nt, Mycobacterium tuberculosis H37Rv
ccggcuccgccg

SEQ ID NO: 1276049 - RNA, 20 nt, Mycobacterium tuberculosis H37Rv
ccggcgggugccgagcuggc

SEQ ID NO: 1276050 - RNA, 23 nt, Mycobacterium tuberculosis H37Rv
ccggcgguagucggccagcucgc

SEQ ID NO: 1276051 - RNA, 20 nt, Mycobacterium tuberculosis H37Rv
ccggcgguaccagagcagcu

SEQ ID NO: 1276052 - RNA, 13 nt, Mycobacterium tuberculosis H37Rv
ccggcgguagcca

SEQ ID NO: 1276053 - RNA, 22 nt, Mycobacterium tuberculosis H37Rv
ccggcgguagccauucaguguc

SEQ ID NO: 1276054 - RNA, 20 nt, Mycobacterium tuberculosis H37Rv
ccggcgggcggugggcagca

SEQ ID NO: 1276055 - RNA, 14 nt, Mycobacterium tuberculosis H37Rv
ccggcgggcggugg

SEQ ID NO: 1276056 - RNA, 20 nt, Mycobacterium tuberculosis H37Rv
ccggcgggcgagugucagca

SEQ ID NO: 1276057 - RNA, 20 nt, Mycobacterium tuberculosis H37Rv
ccggcgggcucgcccgcuac

SEQ ID NO: 1276058 - RNA, 15 nt, Mycobacterium tuberculosis H37Rv
ccggcggggauccgg

SEQ ID NO: 1276059 - RNA, 22 nt, Mycobacterium tuberculosis H37Rv
ccggcguauagcccguagccga

SEQ ID NO: 1276060 - RNA, 23 nt, Mycobacterium tuberculosis H37Rv
ccggcguauagcccguagccgau

SEQ ID NO: 1276061 - RNA, 17 nt, Mycobacterium tuberculosis H37Rv
ccggcguaggcaggauc

SEQ ID NO: 1276062 - RNA, 23 nt, Mycobacterium tuberculosis H37Rv
ccggcguaggcaggaucgccuga

SEQ ID NO: 1276063 - RNA, 13 nt, Mycobacterium tuberculosis H37Rv
ccggcguacuucg

SEQ ID NO: 1276064 - RNA, 23 nt, Mycobacterium tuberculosis H37Rv
ccggcguaaccggcagcgguaag

SEQ ID NO: 1276065 - RNA, 15 nt, Mycobacterium tuberculosis H37Rv
ccggcggugccguca

SEQ ID NO: 1276066 - RNA, 23 nt, Mycobacterium tuberculosis H37Rv
ccggcggucgcguaccgguggaa

SEQ ID NO: 1276067 - RNA, 15 nt, Mycobacterium tuberculosis H37Rv
ccggcggccgcccag

SEQ ID NO: 1276068 - RNA, 15 nt, Mycobacterium tuberculosis H37Rv
ccggcggcgcaucac

SEQ ID NO: 1276069 - RNA, 19 nt, Mycobacterium tuberculosis H37Rv
ccggcggcgacgucugcca

SEQ ID NO: 1276070 - RNA, 23 nt, Mycobacterium tuberculosis H37Rv
ccggcgggcacaccgcaccuggg

SEQ ID NO: 1276071 - RNA, 19 nt, Mycobacterium tuberculosis H37Rv
ccggcgggcacaccgcacc

SEQ ID NO: 1276072 - RNA, 20 nt, Mycobacterium tuberculosis H37Rv
ccggcgggacgucgccgcag

SEQ ID NO: 1276073 - RNA, 23 nt, Mycobacterium tuberculosis H37Rv
ccggcgggacgucgccgcaguac

SEQ ID NO: 1276074 - RNA, 23 nt, Mycobacterium tuberculosis H37Rv
ccggcggcggcggcccguuugcc

SEQ ID NO: 1276075 - RNA, 14 nt, Mycobacterium tuberculosis H37Rv
ccggcggcggccag

SEQ ID NO: 1276076 - RNA, 21 nt, Mycobacterium tuberculosis H37Rv
ccggcggcggcgcucggccau

SEQ ID NO: 1276077 - RNA, 14 nt, Mycobacterium tuberculosis H37Rv
ccggcggcgguacc

SEQ ID NO: 1276078 - RNA, 19 nt, Mycobacterium tuberculosis H37Rv
ccggggauaccggucagca

SEQ ID NO: 1276079 - RNA, 14 nt, Mycobacterium tuberculosis H37Rv
ccggggcagauggu

SEQ ID NO: 1276080 - RNA, 17 nt, Mycobacterium tuberculosis H37Rv
ccggggcgcccggccag

SEQ ID NO: 1276081 - RNA, 17 nt, Mycobacterium tuberculosis H37Rv
ccggggccgccgaugcc

SEQ ID NO: 1276082 - RNA, 15 nt, Mycobacterium tuberculosis H37Rv
ccggggccgucggca

SEQ ID NO: 1276083 - RNA, 23 nt, Mycobacterium tuberculosis H37Rv
ccgggcugccgcccaugccggga

SEQ ID NO: 1276084 - RNA, 22 nt, Mycobacterium tuberculosis H37Rv
ccgggcuggguaugcacccagg

SEQ ID NO: 1276085 - RNA, 12 nt, Mycobacterium tuberculosis H37Rv
ccggggaccacg

SEQ ID NO: 1276086 - RNA, 18 nt, Mycobacterium tuberculosis H37Rv
ccggggaccucggcgauc

SEQ ID NO: 1276087 - RNA, 16 nt, Mycobacterium tuberculosis H37Rv
ccggggaacgugaccc

SEQ ID NO: 1276088 - RNA, 18 nt, Mycobacterium tuberculosis H37Rv
ccggggaagaucucggcc

SEQ ID NO: 1276089 - RNA, 20 nt, Mycobacterium tuberculosis H37Rv
ccggggaagaucucggccag

SEQ ID NO: 1276090 - RNA, 22 nt, Mycobacterium tuberculosis H37Rv
ccgggcuuacuugaucucggcg

SEQ ID NO: 1276091 - RNA, 18 nt, Mycobacterium tuberculosis H37Rv
ccgggccuggccugccca

SEQ ID NO: 1276092 - RNA, 18 nt, Mycobacterium tuberculosis H37Rv
ccgggcgaccaccaccgc

SEQ ID NO: 1276093 - RNA, 15 nt, Mycobacterium tuberculosis H37Rv
ccgggccucggcgcc

SEQ ID NO: 1276094 - RNA, 20 nt, Mycobacterium tuberculosis H37Rv
ccgggcgugcggcggcccau

SEQ ID NO: 1276095 - RNA, 22 nt, Mycobacterium tuberculosis H37Rv
ccgggcgugggugucggcgaag

SEQ ID NO: 1276096 - RNA, 19 nt, Mycobacterium tuberculosis H37Rv
ccgggcucggcguugauga

SEQ ID NO: 1276097 - RNA, 21 nt, Mycobacterium tuberculosis H37Rv
ccgggcugaggcggcgacgac

SEQ ID NO: 1276098 - RNA, 14 nt, Mycobacterium tuberculosis H37Rv
ccgggcucggcgaa

SEQ ID NO: 1276099 - RNA, 14 nt, Mycobacterium tuberculosis H37Rv
ccgggcucgcgauc

SEQ ID NO: 1276100 - RNA, 18 nt, Mycobacterium tuberculosis H37Rv
ccgggcaaccagcagcag

SEQ ID NO: 1276101 - RNA, 16 nt, Mycobacterium tuberculosis H37Rv
ccggcuguucucgccg

SEQ ID NO: 1276102 - RNA, 13 nt, Mycobacterium tuberculosis H37Rv
ccggcuguucucg

SEQ ID NO: 1276103 - RNA, 17 nt, Mycobacterium tuberculosis H37Rv
ccggcuguucucgccga

SEQ ID NO: 1276104 - RNA, 19 nt, Mycobacterium tuberculosis H37Rv
ccggcuguucucgccgaag

SEQ ID NO: 1276105 - RNA, 22 nt, Mycobacterium tuberculosis H37Rv
ccgggaggccggcuaccgcgcu

SEQ ID NO: 1276106 - RNA, 20 nt, Mycobacterium tuberculosis H37Rv
ccgggauaacccagcaccac

SEQ ID NO: 1276107 - RNA, 12 nt, Mycobacterium tuberculosis H37Rv
ccggcuucggcg

SEQ ID NO: 1276108 - RNA, 18 nt, Mycobacterium tuberculosis H37Rv
ccggcuucggcgaacccu

SEQ ID NO: 1276109 - RNA, 20 nt, Mycobacterium tuberculosis H37Rv
ccgggccgccucgaucgacu

SEQ ID NO: 1276110 - RNA, 17 nt, Mycobacterium tuberculosis H37Rv
ccgggccgcggccacau

SEQ ID NO: 1276111 - RNA, 20 nt, Mycobacterium tuberculosis H37Rv
ccgggcccgcguucucggca

SEQ ID NO: 1276112 - RNA, 24 nt, Mycobacterium tuberculosis H37Rv
ccgggcauccuucaccagcugcga

SEQ ID NO: 1276113 - RNA, 22 nt, Mycobacterium tuberculosis H37Rv
ccgggcaauacguagucgccga

SEQ ID NO: 1276114 - RNA, 23 nt, Mycobacterium tuberculosis H37Rv
cgacgggaaccucgaccgucacc

SEQ ID NO: 1276115 - RNA, 18 nt, Mycobacterium tuberculosis H37Rv
cgacgggagcgacgucgg

SEQ ID NO: 1276116 - RNA, 15 nt, Mycobacterium tuberculosis H37Rv
cgacgggaaccucga

SEQ ID NO: 1276117 - RNA, 14 nt, Mycobacterium tuberculosis H37Rv
cgacggcgucuucg

SEQ ID NO: 1276118 - RNA, 15 nt, Mycobacterium tuberculosis H37Rv
cgacggcggcgucga

SEQ ID NO: 1276119 - RNA, 14 nt, Mycobacterium tuberculosis H37Rv
cgacggcggcgucg

SEQ ID NO: 1276120 - RNA, 19 nt, Mycobacterium tuberculosis H37Rv
cgacggcggcgucgaugag

SEQ ID NO: 1276121 - RNA, 13 nt, Mycobacterium tuberculosis H37Rv
cgacggcggucag

SEQ ID NO: 1276122 - RNA, 15 nt, Mycobacterium tuberculosis H37Rv
cgacggcggccuucg

SEQ ID NO: 1276123 - RNA, 13 nt, Mycobacterium tuberculosis H37Rv
cgacggcggccaa

SEQ ID NO: 1276124 - RNA, 13 nt, Mycobacterium tuberculosis H37Rv
cgacggugaucag

SEQ ID NO: 1276125 - RNA, 22 nt, Mycobacterium tuberculosis H37Rv
cgacgguggcgccgucggccga

SEQ ID NO: 1276126 - RNA, 13 nt, Mycobacterium tuberculosis H37Rv
cgacgguguagcc

SEQ ID NO: 1276127 - RNA, 15 nt, Mycobacterium tuberculosis H37Rv
cgacgguguagccca

SEQ ID NO: 1276128 - RNA, 12 nt, Mycobacterium tuberculosis H37Rv
cgacggugaacc

SEQ ID NO: 1276129 - RNA, 15 nt, Mycobacterium tuberculosis H37Rv
cgacggucacggugg

SEQ ID NO: 1276130 - RNA, 19 nt, Mycobacterium tuberculosis H37Rv
cgacgguaggcccgcgcga

SEQ ID NO: 1276131 - RNA, 23 nt, Mycobacterium tuberculosis H37Rv
cgacgggguuguggucgaguuga

SEQ ID NO: 1276132 - RNA, 23 nt, Mycobacterium tuberculosis H37Rv
cgacggccagcaagacgaugaca

SEQ ID NO: 1276133 - RNA, 15 nt, Mycobacterium tuberculosis H37Rv
cgacggccagcagga

SEQ ID NO: 1276134 - RNA, 15 nt, Mycobacterium tuberculosis H37Rv
cgacggccagcgcgu

SEQ ID NO: 1276135 - RNA, 19 nt, Mycobacterium tuberculosis H37Rv
cgacggccacgguggagcg

SEQ ID NO: 1276136 - RNA, 18 nt, Mycobacterium tuberculosis H37Rv
cgacggccagcgcgucgg

SEQ ID NO: 1276137 - RNA, 14 nt, Mycobacterium tuberculosis H37Rv
cgacggcccgccgu

SEQ ID NO: 1276138 - RNA, 21 nt, Mycobacterium tuberculosis H37Rv
cgacggccaccccgucggggu

SEQ ID NO: 1276139 - RNA, 18 nt, Mycobacterium tuberculosis H37Rv
cgacggaucgcccugaca

SEQ ID NO: 1276140 - RNA, 17 nt, Mycobacterium tuberculosis H37Rv
cgacggccgcggcgucg

SEQ ID NO: 1276141 - RNA, 13 nt, Mycobacterium tuberculosis H37Rv
cgacggcgcccau

SEQ ID NO: 1276142 - RNA, 14 nt, Mycobacterium tuberculosis H37Rv
cgacggcgcccagc

SEQ ID NO: 1276143 - RNA, 12 nt, Mycobacterium tuberculosis H37Rv
cgacggcgccca

SEQ ID NO: 1276144 - RNA, 15 nt, Mycobacterium tuberculosis H37Rv
cgacgccaacgccag

SEQ ID NO: 1276145 - RNA, 15 nt, Mycobacterium tuberculosis H37Rv
cgacgccaaugccgc

SEQ ID NO: 1276146 - RNA, 15 nt, Mycobacterium tuberculosis H37Rv
cgacgccacgcgucu

SEQ ID NO: 1276147 - RNA, 22 nt, Mycobacterium tuberculosis H37Rv
cgacgauuaccagcggcaccgc

SEQ ID NO: 1276148 - RNA, 20 nt, Mycobacterium tuberculosis H37Rv
cgacgauuaccagcggcacc

SEQ ID NO: 1276149 - RNA, 21 nt, Mycobacterium tuberculosis H37Rv
cgacgcauuccucgacggugu

SEQ ID NO: 1276150 - RNA, 23 nt, Mycobacterium tuberculosis H37Rv
cgacgaugugccaggugcgguga

SEQ ID NO: 1276151 - RNA, 20 nt, Mycobacterium tuberculosis H37Rv
cgacgauguaaacaacgcga

SEQ ID NO: 1276152 - RNA, 16 nt, Mycobacterium tuberculosis H37Rv
cgacgcuguggcucga

SEQ ID NO: 1276153 - RNA, 19 nt, Mycobacterium tuberculosis H37Rv
cgacgcugccgccaggcuc

SEQ ID NO: 1276154 - RNA, 16 nt, Mycobacterium tuberculosis H37Rv
cgacgcugccgccagg

SEQ ID NO: 1276155 - RNA, 18 nt, Mycobacterium tuberculosis H37Rv
cgacgcuuucccgaugac

SEQ ID NO: 1276156 - RNA, 19 nt, Mycobacterium tuberculosis H37Rv
cgacggaaucgucggcgcg

SEQ ID NO: 1276157 - RNA, 22 nt, Mycobacterium tuberculosis H37Rv
cgacggacuccggccggccuag

SEQ ID NO: 1276158 - RNA, 21 nt, Mycobacterium tuberculosis H37Rv
cgacggacucccucgaucacg

SEQ ID NO: 1276159 - RNA, 16 nt, Mycobacterium tuberculosis H37Rv
cgacggaugaucagcg

SEQ ID NO: 1276160 - RNA, 23 nt, Mycobacterium tuberculosis H37Rv
cgacucggcggcgcggucgaagc

SEQ ID NO: 1276161 - RNA, 15 nt, Mycobacterium tuberculosis H37Rv
cgacucggugcggug

SEQ ID NO: 1276162 - RNA, 16 nt, Mycobacterium tuberculosis H37Rv
cgacugauccucgaug

SEQ ID NO: 1276163 - RNA, 12 nt, Mycobacterium tuberculosis H37Rv
cgacugaucgcc

SEQ ID NO: 1276164 - RNA, 13 nt, Mycobacterium tuberculosis H37Rv
cgacugagaucgc

SEQ ID NO: 1276165 - RNA, 20 nt, Mycobacterium tuberculosis H37Rv
cgacugaucaagugccagcg

SEQ ID NO: 1276166 - RNA, 20 nt, Mycobacterium tuberculosis H37Rv
cgacuacacauucauccacc

SEQ ID NO: 1276167 - RNA, 15 nt, Mycobacterium tuberculosis H37Rv
cgacuaccaucgccg

SEQ ID NO: 1276168 - RNA, 13 nt, Mycobacterium tuberculosis H37Rv
cgacuaccaucgc

SEQ ID NO: 1276169 - RNA, 16 nt, Mycobacterium tuberculosis H37Rv
cgacguugaucgccau

SEQ ID NO: 1276170 - RNA, 20 nt, Mycobacterium tuberculosis H37Rv
cgacucgaggaccugcucgg

SEQ ID NO: 1276171 - RNA, 14 nt, Mycobacterium tuberculosis H37Rv
cgacucggcaccgc

SEQ ID NO: 1276172 - RNA, 23 nt, Mycobacterium tuberculosis H37Rv
aacaauaaggccgcacgggcgac

SEQ ID NO: 1276173 - RNA, 23 nt, Mycobacterium tuberculosis H37Rv
cgacguugaagccgccggaguug

SEQ ID NO: 1276174 - RNA, 23 nt, Mycobacterium tuberculosis H37Rv
cgacguaguagcgaugcacccca

SEQ ID NO: 1276175 - RNA, 12 nt, Mycobacterium tuberculosis H37Rv
cgacguccacca

SEQ ID NO: 1276176 - RNA, 16 nt, Mycobacterium tuberculosis H37Rv
cgacguccgaucggug

SEQ ID NO: 1276177 - RNA, 23 nt, Mycobacterium tuberculosis H37Rv
cgacguauuucgcccccuggaug

SEQ ID NO: 1276178 - RNA, 17 nt, Mycobacterium tuberculosis H37Rv
cgacguagacgacgucg

SEQ ID NO: 1276179 - RNA, 15 nt, Mycobacterium tuberculosis H37Rv
cgacguagauggugg

SEQ ID NO: 1276180 - RNA, 20 nt, Mycobacterium tuberculosis H37Rv
cgacguaggccaggucgcca

SEQ ID NO: 1276181 - RNA, 16 nt, Mycobacterium tuberculosis H37Rv
cgacguaggacugcca

SEQ ID NO: 1276182 - RNA, 13 nt, Mycobacterium tuberculosis H37Rv
cgagaaucccggg

SEQ ID NO: 1276183 - RNA, 14 nt, Mycobacterium tuberculosis H37Rv
cgagacuucgacgc

SEQ ID NO: 1276184 - RNA, 15 nt, Mycobacterium tuberculosis H37Rv
cgagacuccgccuug

SEQ ID NO: 1276185 - RNA, 20 nt, Mycobacterium tuberculosis H37Rv
cgagaauuccccagccgcau

SEQ ID NO: 1276186 - RNA, 19 nt, Mycobacterium tuberculosis H37Rv
cgacuggaucgcgauggcc

SEQ ID NO: 1276187 - RNA, 18 nt, Mycobacterium tuberculosis H37Rv
cgacugcgcaccuggguc

SEQ ID NO: 1276188 - RNA, 14 nt, Mycobacterium tuberculosis H37Rv
cgacugggacgacg

SEQ ID NO: 1276189 - RNA, 14 nt, Mycobacterium tuberculosis H37Rv
cgacugggcgccca

SEQ ID NO: 1276190 - RNA, 19 nt, Mycobacterium tuberculosis H37Rv
cgacuggguggugcucacc

SEQ ID NO: 1276191 - RNA, 13 nt, Mycobacterium tuberculosis H37Rv
cgagaucaccgcc

SEQ ID NO: 1276192 - RNA, 15 nt, Mycobacterium tuberculosis H37Rv
cgagaucaccgccac

SEQ ID NO: 1276193 - RNA, 16 nt, Mycobacterium tuberculosis H37Rv
cgagagccucggccau

SEQ ID NO: 1276194 - RNA, 21 nt, Mycobacterium tuberculosis H37Rv
cgagagccgaccggguaaagc

SEQ ID NO: 1276195 - RNA, 15 nt, Mycobacterium tuberculosis H37Rv
cgagagccgaccggg

SEQ ID NO: 1276196 - RNA, 23 nt, Mycobacterium tuberculosis H37Rv
cgagagccccgaccagcagacca

SEQ ID NO: 1276197 - RNA, 20 nt, Mycobacterium tuberculosis H37Rv
cgagagccccgaccagcaga

SEQ ID NO: 1276198 - RNA, 13 nt, Mycobacterium tuberculosis H37Rv
cgagauccagcgc

SEQ ID NO: 1276199 - RNA, 15 nt, Mycobacterium tuberculosis H37Rv
cgagaucgccgagca

SEQ ID NO: 1276200 - RNA, 19 nt, Mycobacterium tuberculosis H37Rv
cgagaucagccggcagcga

SEQ ID NO: 1276201 - RNA, 21 nt, Mycobacterium tuberculosis H37Rv
cgagagcagccagccaccgau

SEQ ID NO: 1276202 - RNA, 22 nt, Mycobacterium tuberculosis H37Rv
cgagcacaugcugccgcugcga

SEQ ID NO: 1276203 - RNA, 21 nt, Mycobacterium tuberculosis H37Rv
cgagcacccgcuggucgagca

SEQ ID NO: 1276204 - RNA, 20 nt, Mycobacterium tuberculosis H37Rv
cgagcaccauccggucccgc

SEQ ID NO: 1276205 - RNA, 16 nt, Mycobacterium tuberculosis H37Rv
cgagcaccgacaccgg

SEQ ID NO: 1276206 - RNA, 20 nt, Mycobacterium tuberculosis H37Rv
cgagcacccguugaucgcgg

SEQ ID NO: 1276207 - RNA, 16 nt, Mycobacterium tuberculosis H37Rv
cgagcacccgcaaugc

SEQ ID NO: 1276208 - RNA, 20 nt, Mycobacterium tuberculosis H37Rv
cgacgaucagcacgucgcgg

SEQ ID NO: 1276209 - RNA, 15 nt, Mycobacterium tuberculosis H37Rv
cgacgaucagcacgu

SEQ ID NO: 1276210 - RNA, 22 nt, Mycobacterium tuberculosis H37Rv
cgacgauagcggcccgaucacc

SEQ ID NO: 1276211 - RNA, 18 nt, Mycobacterium tuberculosis H37Rv
cgacgagaucugcgaugg

SEQ ID NO: 1276212 - RNA, 12 nt, Mycobacterium tuberculosis H37Rv
cgacgagucgcc

SEQ ID NO: 1276213 - RNA, 14 nt, Mycobacterium tuberculosis H37Rv
cgacgagucgccgc

SEQ ID NO: 1276214 - RNA, 16 nt, Mycobacterium tuberculosis H37Rv
cgacgaucaacggaac

SEQ ID NO: 1276215 - RNA, 13 nt, Mycobacterium tuberculosis H37Rv
cgacgagcaacgc

SEQ ID NO: 1276216 - RNA, 23 nt, Mycobacterium tuberculosis H37Rv
cgacgagaucagccucgcgggca

SEQ ID NO: 1276217 - RNA, 14 nt, Mycobacterium tuberculosis H37Rv
cgacgacuucgaau

SEQ ID NO: 1276218 - RNA, 14 nt, Mycobacterium tuberculosis H37Rv
cgacgacgggguug

SEQ ID NO: 1276219 - RNA, 18 nt, Mycobacterium tuberculosis H37Rv
cgacgacuccggcaagca

SEQ ID NO: 1276220 - RNA, 17 nt, Mycobacterium tuberculosis H37Rv
cgacgagaagacaccgc

SEQ ID NO: 1276221 - RNA, 22 nt, Mycobacterium tuberculosis H37Rv
cgacgacacguugacgaugugc

SEQ ID NO: 1276222 - RNA, 15 nt, Mycobacterium tuberculosis H37Rv
cgacgaccagcagau

SEQ ID NO: 1276223 - RNA, 18 nt, Mycobacterium tuberculosis H37Rv
cgacgacguccucgacga

SEQ ID NO: 1276224 - RNA, 17 nt, Mycobacterium tuberculosis H37Rv
cgacgacggcgccgucg

SEQ ID NO: 1276225 - RNA, 12 nt, Mycobacterium tuberculosis H37Rv
cgacgacaccgc

SEQ ID NO: 1276226 - RNA, 16 nt, Mycobacterium tuberculosis H37Rv
cgacgacaccgcgcag

SEQ ID NO: 1276227 - RNA, 21 nt, Mycobacterium tuberculosis H37Rv
cgacgacaccgcgcagcggug

SEQ ID NO: 1276228 - RNA, 21 nt, Mycobacterium tuberculosis H37Rv
cgaccugguaugccgcccgca

SEQ ID NO: 1276229 - RNA, 18 nt, Mycobacterium tuberculosis H37Rv
cgaccuuauugccgagcu

SEQ ID NO: 1276230 - RNA, 15 nt, Mycobacterium tuberculosis H37Rv
cgaccuguaugccgc

SEQ ID NO: 1276231 - RNA, 16 nt, Mycobacterium tuberculosis H37Rv
cgaccuguaugccgcg

SEQ ID NO: 1276232 - RNA, 22 nt, Mycobacterium tuberculosis H37Rv
cgaccuggacgcggccaauggc

SEQ ID NO: 1276233 - RNA, 17 nt, Mycobacterium tuberculosis H37Rv
cgacgaauaccgggaug

SEQ ID NO: 1276234 - RNA, 21 nt, Mycobacterium tuberculosis H37Rv
cgacgaauaacgcggucggca

SEQ ID NO: 1276235 - RNA, 20 nt, Mycobacterium tuberculosis H37Rv
cgacgaauaccgggaugcga

SEQ ID NO: 1276236 - RNA, 13 nt, Mycobacterium tuberculosis H37Rv
cgacgaagucgca

SEQ ID NO: 1276237 - RNA, 17 nt, Mycobacterium tuberculosis H37Rv
cgaccucgacucugguc

SEQ ID NO: 1276238 - RNA, 19 nt, Mycobacterium tuberculosis H37Rv
cgaccuccggaaucgcccg

SEQ ID NO: 1276239 - RNA, 17 nt, Mycobacterium tuberculosis H37Rv
cgaccgucagggucacc

SEQ ID NO: 1276240 - RNA, 20 nt, Mycobacterium tuberculosis H37Rv
cgaccguauugaccagcggg

SEQ ID NO: 1276241 - RNA, 23 nt, Mycobacterium tuberculosis H37Rv
cgaccgucacugaugggccgguu

SEQ ID NO: 1276242 - RNA, 20 nt, Mycobacterium tuberculosis H37Rv
cgaccguccgggucaccagc

SEQ ID NO: 1276243 - RNA, 19 nt, Mycobacterium tuberculosis H37Rv
cgaccguauugaccagcgg

SEQ ID NO: 1276244 - RNA, 23 nt, Mycobacterium tuberculosis H37Rv
cgaccgguuggguagcaccgauu

SEQ ID NO: 1276245 - RNA, 20 nt, Mycobacterium tuberculosis H37Rv
cgaccggucuggcgaugacg

SEQ ID NO: 1276246 - RNA, 23 nt, Mycobacterium tuberculosis H37Rv
cgaccugcgcgagguuggcguug

SEQ ID NO: 1276247 - RNA, 20 nt, Mycobacterium tuberculosis H37Rv
cgaccugcgcgacggcgcug

SEQ ID NO: 1276248 - RNA, 17 nt, Mycobacterium tuberculosis H37Rv
cgaccucgggaucggcg

SEQ ID NO: 1276249 - RNA, 15 nt, Mycobacterium tuberculosis H37Rv
cgaccucgcggcgcu

SEQ ID NO: 1276250 - RNA, 15 nt, Mycobacterium tuberculosis H37Rv
cgaccucgagugcga

SEQ ID NO: 1276251 - RNA, 17 nt, Mycobacterium tuberculosis H37Rv
cgaccucggcgaccgcg

SEQ ID NO: 1276252 - RNA, 14 nt, Mycobacterium tuberculosis H37Rv
cgaccggcacccgc

SEQ ID NO: 1276253 - RNA, 15 nt, Mycobacterium tuberculosis H37Rv
cgaccggcagcgaug

SEQ ID NO: 1276254 - RNA, 14 nt, Mycobacterium tuberculosis H37Rv
cgaccgcuccgacc

SEQ ID NO: 1276255 - RNA, 22 nt, Mycobacterium tuberculosis H37Rv
cgaccgcugguucucgcuguug

SEQ ID NO: 1276256 - RNA, 20 nt, Mycobacterium tuberculosis H37Rv
cgaccggaacguuccugcac

SEQ ID NO: 1276257 - RNA, 19 nt, Mycobacterium tuberculosis H37Rv
cgacccgucccccgcacgc

SEQ ID NO: 1276258 - RNA, 17 nt, Mycobacterium tuberculosis H37Rv
cgaccgcgcacggcugg

SEQ ID NO: 1276259 - RNA, 20 nt, Mycobacterium tuberculosis H37Rv
cgaccgcgaugggauaccgc

SEQ ID NO: 1276260 - RNA, 16 nt, Mycobacterium tuberculosis H37Rv
cgacccgggucggcac

SEQ ID NO: 1276261 - RNA, 17 nt, Mycobacterium tuberculosis H37Rv
cgacccggucgacgggu

SEQ ID NO: 1276262 - RNA, 18 nt, Mycobacterium tuberculosis H37Rv
cgacccguaccagcccgu

SEQ ID NO: 1276263 - RNA, 14 nt, Mycobacterium tuberculosis H37Rv
cgaccgccugcaac

SEQ ID NO: 1276264 - RNA, 13 nt, Mycobacterium tuberculosis H37Rv
cgacccgcccgaa

SEQ ID NO: 1276265 - RNA, 22 nt, Mycobacterium tuberculosis H37Rv
cgacccgccgaugaugcggcgc

SEQ ID NO: 1276266 - RNA, 13 nt, Mycobacterium tuberculosis H37Rv
cgacccgccgaug

SEQ ID NO: 1276267 - RNA, 18 nt, Mycobacterium tuberculosis H37Rv
cgacccgggccggucggu

SEQ ID NO: 1276268 - RNA, 18 nt, Mycobacterium tuberculosis H37Rv
cgacccgggcgucccaau

SEQ ID NO: 1276269 - RNA, 20 nt, Mycobacterium tuberculosis H37Rv
cgacccgggccggucgguga

SEQ ID NO: 1276270 - RNA, 12 nt, Mycobacterium tuberculosis H37Rv
cgacccggucac

SEQ ID NO: 1276271 - RNA, 15 nt, Mycobacterium tuberculosis H37Rv
cgacccggucgacgg

SEQ ID NO: 1276272 - RNA, 20 nt, Mycobacterium tuberculosis H37Rv
cgaccaccaccgccgccgaa

SEQ ID NO: 1276273 - RNA, 14 nt, Mycobacterium tuberculosis H37Rv
cgaccaccaccgcc

SEQ ID NO: 1276274 - RNA, 18 nt, Mycobacterium tuberculosis H37Rv
cgaccaccccgagcggcu

SEQ ID NO: 1276275 - RNA, 20 nt, Mycobacterium tuberculosis H37Rv
cgaccaccgccgggcuguga

SEQ ID NO: 1276276 - RNA, 22 nt, Mycobacterium tuberculosis H37Rv
cgaccacgucggcgaacgcguc

SEQ ID NO: 1276277 - RNA, 21 nt, Mycobacterium tuberculosis H37Rv
cgaccagaacgccagaccgac

SEQ ID NO: 1276278 - RNA, 20 nt, Mycobacterium tuberculosis H37Rv
cgaccacucgagcgcucaca

SEQ ID NO: 1276279 - RNA, 12 nt, Mycobacterium tuberculosis H37Rv
cgaccacggcac

SEQ ID NO: 1276280 - RNA, 14 nt, Mycobacterium tuberculosis H37Rv
cgaccacgacguuc

SEQ ID NO: 1276281 - RNA, 15 nt, Mycobacterium tuberculosis H37Rv
cgaccacaucaugcc

SEQ ID NO: 1276282 - RNA, 18 nt, Mycobacterium tuberculosis H37Rv
cgaccaccggguagccgg

SEQ ID NO: 1276283 - RNA, 18 nt, Mycobacterium tuberculosis H37Rv
cgaccaccguuugagcgg

SEQ ID NO: 1276284 - RNA, 15 nt, Mycobacterium tuberculosis H37Rv
cgacccgaagccgac

SEQ ID NO: 1276285 - RNA, 21 nt, Mycobacterium tuberculosis H37Rv
cgaccccggugagcucuucgg

SEQ ID NO: 1276286 - RNA, 12 nt, Mycobacterium tuberculosis H37Rv
cgacccgcccau

SEQ ID NO: 1276287 - RNA, 13 nt, Mycobacterium tuberculosis H37Rv
cgacccgaucacc

SEQ ID NO: 1276288 - RNA, 14 nt, Mycobacterium tuberculosis H37Rv
cgaccaugagccgg

SEQ ID NO: 1276289 - RNA, 13 nt, Mycobacterium tuberculosis H37Rv
cgacccaacccga

SEQ ID NO: 1276290 - RNA, 23 nt, Mycobacterium tuberculosis H37Rv
cgaccauggucgauucgucgaag

SEQ ID NO: 1276291 - RNA, 14 nt, Mycobacterium tuberculosis H37Rv
cgaccagcgccgca

SEQ ID NO: 1276292 - RNA, 17 nt, Mycobacterium tuberculosis H37Rv
cgaccaucugaucgggc

SEQ ID NO: 1276293 - RNA, 19 nt, Mycobacterium tuberculosis H37Rv
cgacaaagcggcugcccga

SEQ ID NO: 1276294 - RNA, 22 nt, Mycobacterium tuberculosis H37Rv
cgacaaaucggucgacgaucuc

SEQ ID NO: 1276295 - RNA, 19 nt, Mycobacterium tuberculosis H37Rv
cgacaaaucggucgacgau

SEQ ID NO: 1276296 - RNA, 16 nt, Mycobacterium tuberculosis H37Rv
cgacaacaccacggug

SEQ ID NO: 1276297 - RNA, 18 nt, Mycobacterium tuberculosis H37Rv
cgaauuggugcgcaucga

SEQ ID NO: 1276298 - RNA, 16 nt, Mycobacterium tuberculosis H37Rv
cgaaugccaccucgac

SEQ ID NO: 1276299 - RNA, 20 nt, Mycobacterium tuberculosis H37Rv
cgacaucaccaccgaccugg

SEQ ID NO: 1276300 - RNA, 12 nt, Mycobacterium tuberculosis H37Rv
cgacaucaccac

SEQ ID NO: 1276301 - RNA, 15 nt, Mycobacterium tuberculosis H37Rv
cgacaucaccgaacg

SEQ ID NO: 1276302 - RNA, 21 nt, Mycobacterium tuberculosis H37Rv
cgacauuggccgucaucgccg

SEQ ID NO: 1276303 - RNA, 17 nt, Mycobacterium tuberculosis H37Rv
cgacauguguggcagcc

SEQ ID NO: 1276304 - RNA, 16 nt, Mycobacterium tuberculosis H37Rv
cgacaugcccgccaau

SEQ ID NO: 1276305 - RNA, 18 nt, Mycobacterium tuberculosis H37Rv
cgacaugguccgaccagc

SEQ ID NO: 1276306 - RNA, 18 nt, Mycobacterium tuberculosis H37Rv
cgacaugggucggcuguc

SEQ ID NO: 1276307 - RNA, 18 nt, Mycobacterium tuberculosis H37Rv
cgacauuggucaccugcu

SEQ ID NO: 1276308 - RNA, 16 nt, Mycobacterium tuberculosis H37Rv
cgaccaacacgucgag

SEQ ID NO: 1276309 - RNA, 24 nt, Mycobacterium tuberculosis H37Rv
cgaccaagucaugcccacgcugcc

SEQ ID NO: 1276310 - RNA, 19 nt, Mycobacterium tuberculosis H37Rv
cgaccaauucgcaaucggc

SEQ ID NO: 1276311 - RNA, 20 nt, Mycobacterium tuberculosis H37Rv
cgaccaauuggucgagucga

SEQ ID NO: 1276312 - RNA, 18 nt, Mycobacterium tuberculosis H37Rv
cgaccaagguguccagca

SEQ ID NO: 1276313 - RNA, 14 nt, Mycobacterium tuberculosis H37Rv
cgaccaagagacgu

SEQ ID NO: 1276314 - RNA, 16 nt, Mycobacterium tuberculosis H37Rv
cgacaugcgccgagau

SEQ ID NO: 1276315 - RNA, 22 nt, Mycobacterium tuberculosis H37Rv
cgacaucgcugcgacuggccgu

SEQ ID NO: 1276316 - RNA, 17 nt, Mycobacterium tuberculosis H37Rv
cgacaucgucgcgacga

SEQ ID NO: 1276317 - RNA, 17 nt, Mycobacterium tuberculosis H37Rv
cgacaucgucauccagg

SEQ ID NO: 1276318 - RNA, 18 nt, Mycobacterium tuberculosis H37Rv
ccucgucgcgggccaccg

SEQ ID NO: 1276319 - RNA, 16 nt, Mycobacterium tuberculosis H37Rv
ccuguccugcgggagg

SEQ ID NO: 1276320 - RNA, 19 nt, Mycobacterium tuberculosis H37Rv
ccucgucggccgacaccgc

SEQ ID NO: 1276321 - RNA, 21 nt, Mycobacterium tuberculosis H37Rv
ccucgucgagagguucgccgu

SEQ ID NO: 1276322 - RNA, 23 nt, Mycobacterium tuberculosis H37Rv
ccucgucgacgucggcaucggcg

SEQ ID NO: 1276323 - RNA, 18 nt, Mycobacterium tuberculosis H37Rv
ccucgucgaucucgaucg

SEQ ID NO: 1276324 - RNA, 15 nt, Mycobacterium tuberculosis H37Rv
ccucgucgauguucg

SEQ ID NO: 1276325 - RNA, 15 nt, Mycobacterium tuberculosis H37Rv
ccucgucgcugccca

SEQ ID NO: 1276326 - RNA, 16 nt, Mycobacterium tuberculosis H37Rv
ccuucucgucggccag

SEQ ID NO: 1276327 - RNA, 20 nt, Mycobacterium tuberculosis H37Rv
ccuugaggcccugcggccac

SEQ ID NO: 1276328 - RNA, 15 nt, Mycobacterium tuberculosis H37Rv
ccuugacgcggccac

SEQ ID NO: 1276329 - RNA, 22 nt, Mycobacterium tuberculosis H37Rv
ccuucagcacggugaucagcag

SEQ ID NO: 1276330 - RNA, 19 nt, Mycobacterium tuberculosis H37Rv
ccuucaccgggugacccgc

SEQ ID NO: 1276331 - RNA, 22 nt, Mycobacterium tuberculosis H37Rv
ccuuccgacccaacgaccacca

SEQ ID NO: 1276332 - RNA, 22 nt, Mycobacterium tuberculosis H37Rv
ccuucgaguuuggugucgauca

SEQ ID NO: 1276333 - RNA, 23 nt, Mycobacterium tuberculosis H37Rv
ccuucgcgggagaacgugccgag

SEQ ID NO: 1276334 - RNA, 20 nt, Mycobacterium tuberculosis H37Rv
ccuugcagcgcguucggcac

SEQ ID NO: 1276335 - RNA, 23 nt, Mycobacterium tuberculosis H37Rv
ccuugcagcgcccccgcugccau

SEQ ID NO: 1276336 - RNA, 12 nt, Mycobacterium tuberculosis H37Rv
ccuugcccacgg

SEQ ID NO: 1276337 - RNA, 14 nt, Mycobacterium tuberculosis H37Rv
ccuugggcaccacc

SEQ ID NO: 1276338 - RNA, 19 nt, Mycobacterium tuberculosis H37Rv
ccuugcugcgcgauggccg

SEQ ID NO: 1276339 - RNA, 18 nt, Mycobacterium tuberculosis H37Rv
ccuuguuggccugcaacg

SEQ ID NO: 1276340 - RNA, 13 nt, Mycobacterium tuberculosis H37Rv
ccuuguugccgcg

SEQ ID NO: 1276341 - RNA, 20 nt, Mycobacterium tuberculosis H37Rv
ccuuguucccgaaacccgau

SEQ ID NO: 1276342 - RNA, 17 nt, Mycobacterium tuberculosis H37Rv
cgaaacggauuggucga

SEQ ID NO: 1276343 - RNA, 23 nt, Mycobacterium tuberculosis H37Rv
cgaaacggugaaugugcauagca

SEQ ID NO: 1276344 - RNA, 16 nt, Mycobacterium tuberculosis H37Rv
cgaaacucaccagcac

SEQ ID NO: 1276345 - RNA, 22 nt, Mycobacterium tuberculosis H37Rv
cgaaacucagcccgucgggcag

SEQ ID NO: 1276346 - RNA, 19 nt, Mycobacterium tuberculosis H37Rv
cgaaagccaacucgaccga

SEQ ID NO: 1276347 - RNA, 20 nt, Mycobacterium tuberculosis H37Rv
cgaaagccuugccgucgagc

SEQ ID NO: 1276348 - RNA, 19 nt, Mycobacterium tuberculosis H37Rv
cgaaacagcuugcugcgca

SEQ ID NO: 1276349 - RNA, 13 nt, Mycobacterium tuberculosis H37Rv
cgaaacauugccc

SEQ ID NO: 1276350 - RNA, 15 nt, Mycobacterium tuberculosis H37Rv
cgaaacccgauguua

SEQ ID NO: 1276351 - RNA, 19 nt, Mycobacterium tuberculosis H37Rv
cgaaacagcacccagacga

SEQ ID NO: 1276352 - RNA, 14 nt, Mycobacterium tuberculosis H37Rv
cgaaacaugcgcca

SEQ ID NO: 1276353 - RNA, 16 nt, Mycobacterium tuberculosis H37Rv
cgaaacgauggccggg

SEQ ID NO: 1276354 - RNA, 12 nt, Mycobacterium tuberculosis H37Rv
cgaaaccgccgu

SEQ ID NO: 1276355 - RNA, 23 nt, Mycobacterium tuberculosis H37Rv
cgaaacgcgcggaucgucgaggc

SEQ ID NO: 1276356 - RNA, 20 nt, Mycobacterium tuberculosis H37Rv
cgaaacgcccuugugaacgg

SEQ ID NO: 1276357 - RNA, 21 nt, Mycobacterium tuberculosis H37Rv
cgaaacgcccgggcggcgucg

SEQ ID NO: 1276358 - RNA, 22 nt, Mycobacterium tuberculosis H37Rv
cgaaacgccauacgucgccucg

SEQ ID NO: 1276359 - RNA, 14 nt, Mycobacterium tuberculosis H37Rv
cgaaaacagcgauc

SEQ ID NO: 1276360 - RNA, 23 nt, Mycobacterium tuberculosis H37Rv
ccuuugagucgagaaugcugacg

SEQ ID NO: 1276361 - RNA, 20 nt, Mycobacterium tuberculosis H37Rv
cgaagccuguagucccucau

SEQ ID NO: 1276362 - RNA, 16 nt, Mycobacterium tuberculosis H37Rv
cgaagccuugcagcgc

SEQ ID NO: 1276363 - RNA, 22 nt, Mycobacterium tuberculosis H37Rv
cgaagccgggucuguuggugac

SEQ ID NO: 1276364 - RNA, 19 nt, Mycobacterium tuberculosis H37Rv
cgaagccgggucucggugc

SEQ ID NO: 1276365 - RNA, 13 nt, Mycobacterium tuberculosis H37Rv
cgaagcggucgcg

SEQ ID NO: 1276366 - RNA, 12 nt, Mycobacterium tuberculosis H37Rv
cgaagcgaugcc

SEQ ID NO: 1276367 - RNA, 15 nt, Mycobacterium tuberculosis H37Rv
cgaagcgggcggaaa

SEQ ID NO: 1276368 - RNA, 22 nt, Mycobacterium tuberculosis H37Rv
cgaagcgggcuugagcgccgau

SEQ ID NO: 1276369 - RNA, 21 nt, Mycobacterium tuberculosis H37Rv
cgaagcuggcgugcagcagga

SEQ ID NO: 1276370 - RNA, 19 nt, Mycobacterium tuberculosis H37Rv
cgaaggugaacgacauggg

SEQ ID NO: 1276371 - RNA, 17 nt, Mycobacterium tuberculosis H37Rv
cgaagcuugacguugcc

SEQ ID NO: 1276372 - RNA, 18 nt, Mycobacterium tuberculosis H37Rv
cgaauacgaggacgacga

SEQ ID NO: 1276373 - RNA, 22 nt, Mycobacterium tuberculosis H37Rv
cgaagugguaguccagggcgcc

SEQ ID NO: 1276374 - RNA, 19 nt, Mycobacterium tuberculosis H37Rv
cgaaugacgauccagccca

SEQ ID NO: 1276375 - RNA, 17 nt, Mycobacterium tuberculosis H37Rv
cgaaguucucuagcucg

SEQ ID NO: 1276376 - RNA, 21 nt, Mycobacterium tuberculosis H37Rv
cgaaguuggcgaagcccgaca

SEQ ID NO: 1276377 - RNA, 13 nt, Mycobacterium tuberculosis H37Rv
cgaaguucucggu

SEQ ID NO: 1276378 - RNA, 14 nt, Mycobacterium tuberculosis H37Rv
cgaaguucucggug

SEQ ID NO: 1276379 - RNA, 14 nt, Mycobacterium tuberculosis H37Rv
cgaaguagccgacc

SEQ ID NO: 1276380 - RNA, 22 nt, Mycobacterium tuberculosis H37Rv
cgaaguagccgaccggcagcga

SEQ ID NO: 1276381 - RNA, 14 nt, Mycobacterium tuberculosis H37Rv
cgaacuccgcguug

SEQ ID NO: 1276382 - RNA, 13 nt, Mycobacterium tuberculosis H37Rv
cgaacuccgcgga

SEQ ID NO: 1276383 - RNA, 21 nt, Mycobacterium tuberculosis H37Rv
cgaacggcgcaguuggcacca

SEQ ID NO: 1276384 - RNA, 17 nt, Mycobacterium tuberculosis H37Rv
cgaacggaucucggugg

SEQ ID NO: 1276385 - RNA, 18 nt, Mycobacterium tuberculosis H37Rv
cgaacggauaccugggac

SEQ ID NO: 1276386 - RNA, 20 nt, Mycobacterium tuberculosis H37Rv
cgaacgcuucaccucgucga

SEQ ID NO: 1276387 - RNA, 19 nt, Mycobacterium tuberculosis H37Rv
cgaacggccaggacaacgc

SEQ ID NO: 1276388 - RNA, 20 nt, Mycobacterium tuberculosis H37Rv
cgaacgcggcgucgauaacc

SEQ ID NO: 1276389 - RNA, 14 nt, Mycobacterium tuberculosis H37Rv
cgaacgcggcgucg

SEQ ID NO: 1276390 - RNA, 18 nt, Mycobacterium tuberculosis H37Rv
cgaacgccagugaacgcg

SEQ ID NO: 1276391 - RNA, 19 nt, Mycobacterium tuberculosis H37Rv
cgaacgccucugcgaucag

SEQ ID NO: 1276392 - RNA, 16 nt, Mycobacterium tuberculosis H37Rv
cgaacgccgucgacgc

SEQ ID NO: 1276393 - RNA, 15 nt, Mycobacterium tuberculosis H37Rv
cgaacgccgucgacg

SEQ ID NO: 1276394 - RNA, 21 nt, Mycobacterium tuberculosis H37Rv
cgaacgccgucagaacaccgg

SEQ ID NO: 1276395 - RNA, 13 nt, Mycobacterium tuberculosis H37Rv
cgaacucgggcga

SEQ ID NO: 1276396 - RNA, 17 nt, Mycobacterium tuberculosis H37Rv
cgaacucgggcgacugg

SEQ ID NO: 1276397 - RNA, 14 nt, Mycobacterium tuberculosis H37Rv
cgaacucuacggug

SEQ ID NO: 1276398 - RNA, 22 nt, Mycobacterium tuberculosis H37Rv
cgaacucgcgggcgaccaccgc

SEQ ID NO: 1276399 - RNA, 20 nt, Mycobacterium tuberculosis H37Rv
cgaacucgaggucgagcgcc

SEQ ID NO: 1276400 - RNA, 23 nt, Mycobacterium tuberculosis H37Rv
cgaagaaccugagcaccaagacc

SEQ ID NO: 1276401 - RNA, 20 nt, Mycobacterium tuberculosis H37Rv
cgaagaagaacucggcgucg

SEQ ID NO: 1276402 - RNA, 16 nt, Mycobacterium tuberculosis H37Rv
cgaagaaccggucgca

SEQ ID NO: 1276403 - RNA, 20 nt, Mycobacterium tuberculosis H37Rv
cgaagaauaugccgaugacc

SEQ ID NO: 1276404 - RNA, 17 nt, Mycobacterium tuberculosis H37Rv
cgaagaauaugccgaug

SEQ ID NO: 1276405 - RNA, 18 nt, Mycobacterium tuberculosis H37Rv
cgaagaccaggccgguga

SEQ ID NO: 1276406 - RNA, 20 nt, Mycobacterium tuberculosis H37Rv
cgaagccacucaucuucucg

SEQ ID NO: 1276407 - RNA, 15 nt, Mycobacterium tuberculosis H37Rv
cgaagcccgacugua

SEQ ID NO: 1276408 - RNA, 22 nt, Mycobacterium tuberculosis H37Rv
cgaagccgcgcaucugucgcgc

SEQ ID NO: 1276409 - RNA, 23 nt, Mycobacterium tuberculosis H37Rv
cgaagccgccgggugcgccguug

SEQ ID NO: 1276410 - RNA, 19 nt, Mycobacterium tuberculosis H37Rv
cgaagccgaaggggaacgc

SEQ ID NO: 1276411 - RNA, 11 nt, Mycobacterium tuberculosis H37Rv
cgaagccgacc

SEQ ID NO: 1276412 - RNA, 15 nt, Mycobacterium tuberculosis H37Rv
cgaacauugcgccca

SEQ ID NO: 1276413 - RNA, 15 nt, Mycobacterium tuberculosis H37Rv
cgaaccaccgcguug

SEQ ID NO: 1276414 - RNA, 23 nt, Mycobacterium tuberculosis H37Rv
cgaaccacgccaucgagcagcag

SEQ ID NO: 1276415 - RNA, 23 nt, Mycobacterium tuberculosis H37Rv
cgaaccagucgaagaagacccgu

SEQ ID NO: 1276416 - RNA, 19 nt, Mycobacterium tuberculosis H37Rv
cgaaccagcuugcgccgca

SEQ ID NO: 1276417 - RNA, 22 nt, Mycobacterium tuberculosis H37Rv
cgaacccacugcccgccgacgc

SEQ ID NO: 1276418 - RNA, 19 nt, Mycobacterium tuberculosis H37Rv
cgaacccacugcccgccga

SEQ ID NO: 1276419 - RNA, 15 nt, Mycobacterium tuberculosis H37Rv
cgaacccaccgugcc

SEQ ID NO: 1276420 - RNA, 15 nt, Mycobacterium tuberculosis H37Rv
cgaacccaggcacaa

SEQ ID NO: 1276421 - RNA, 20 nt, Mycobacterium tuberculosis H37Rv
cgaacccgccaccgcgacac

SEQ ID NO: 1276422 - RNA, 13 nt, Mycobacterium tuberculosis H37Rv
cgaacccgcguug

SEQ ID NO: 1276423 - RNA, 18 nt, Mycobacterium tuberculosis H37Rv
cgaaccgcuccgagcacc

SEQ ID NO: 1276424 - RNA, 18 nt, Mycobacterium tuberculosis H37Rv
cgaaccgccggcaccgcc

SEQ ID NO: 1276425 - RNA, 16 nt, Mycobacterium tuberculosis H37Rv
cgaaccgccggcaccg

SEQ ID NO: 1276426 - RNA, 13 nt, Mycobacterium tuberculosis H37Rv
cgaaccgccggca

SEQ ID NO: 1276427 - RNA, 21 nt, Mycobacterium tuberculosis H37Rv
cgaacgaguccaacucggcca

SEQ ID NO: 1276428 - RNA, 14 nt, Mycobacterium tuberculosis H37Rv
cgaacgacccuggc

SEQ ID NO: 1276429 - RNA, 17 nt, Mycobacterium tuberculosis H37Rv
cgaacgcccgcugcggg

SEQ ID NO: 1276430 - RNA, 18 nt, Mycobacterium tuberculosis H37Rv
cgaacgccagcagcugug

SEQ ID NO: 1276431 - RNA, 16 nt, Mycobacterium tuberculosis H37Rv
cgaacgcaacgccgau

SEQ ID NO: 1276432 - RNA, 17 nt, Mycobacterium tuberculosis H37Rv
cgaacgcaacgccgaug

SEQ ID NO: 1276433 - RNA, 19 nt, Mycobacterium tuberculosis H37Rv
cgaacgcaacgccgauggc

SEQ ID NO: 1276434 - RNA, 23 nt, Mycobacterium tuberculosis H37Rv
cgaacgcaugcucgaucgcguuc

SEQ ID NO: 1276435 - RNA, 19 nt, Mycobacterium tuberculosis H37Rv
cgaacgcaugcucgaucgc

SEQ ID NO: 1276436 - RNA, 13 nt, Mycobacterium tuberculosis H37Rv
cgaaccguucgcu

SEQ ID NO: 1276437 - RNA, 19 nt, Mycobacterium tuberculosis H37Rv
cgaaccucaccugacacgc

SEQ ID NO: 1276438 - RNA, 17 nt, Mycobacterium tuberculosis H37Rv
cgaaccguucggcgaca

SEQ ID NO: 1276439 - RNA, 20 nt, Mycobacterium tuberculosis H37Rv
cgaaccguucggcgacagcg

SEQ ID NO: 1276440 - RNA, 21 nt, Mycobacterium tuberculosis H37Rv
cgaaccgguguagcagcgcca

SEQ ID NO: 1276441 - RNA, 19 nt, Mycobacterium tuberculosis H37Rv
cgaaccgguguagcagcgc

SEQ ID NO: 1276442 - RNA, 13 nt, Mycobacterium tuberculosis H37Rv
cgaaccgggacaa

SEQ ID NO: 1276443 - RNA, 23 nt, Mycobacterium tuberculosis H37Rv
cgaaccgcagacccucgucgucg

SEQ ID NO: 1276444 - RNA, 12 nt, Mycobacterium tuberculosis H37Rv
cgaaccggauca

SEQ ID NO: 1276445 - RNA, 17 nt, Mycobacterium tuberculosis H37Rv
cgaaccggcaccagcgg

SEQ ID NO: 1276446 - RNA, 18 nt, Mycobacterium tuberculosis H37Rv
cgaaccggcccaccgacg

SEQ ID NO: 1276447 - RNA, 15 nt, Mycobacterium tuberculosis H37Rv
cgaaccggaucaucg

SEQ ID NO: 1276448 - RNA, 18 nt, Mycobacterium tuberculosis H37Rv
cgaaccggaucaucgccg

SEQ ID NO: 1276449 - RNA, 20 nt, Mycobacterium tuberculosis H37Rv
cgaaccgguagucgccgucg

SEQ ID NO: 1276450 - RNA, 20 nt, Mycobacterium tuberculosis H37Rv
cgaacagugccucgcguucg

SEQ ID NO: 1276451 - RNA, 14 nt, Mycobacterium tuberculosis H37Rv
cgaacagucgcagc

SEQ ID NO: 1276452 - RNA, 11 nt, Mycobacterium tuberculosis H37Rv
cgaacagucga

SEQ ID NO: 1276453 - RNA, 20 nt, Mycobacterium tuberculosis H37Rv
cgaacagggaggucgccgca

SEQ ID NO: 1276454 - RNA, 22 nt, Mycobacterium tuberculosis H37Rv
cgaacagcggcacgaucggcag

SEQ ID NO: 1276455 - RNA, 17 nt, Mycobacterium tuberculosis H37Rv
cgaacagcucgaucagc

SEQ ID NO: 1276456 - RNA, 18 nt, Mycobacterium tuberculosis H37Rv
cgaacagcgaagcaacgg

SEQ ID NO: 1276457 - RNA, 17 nt, Mycobacterium tuberculosis H37Rv
cgaacagccccagggug

SEQ ID NO: 1276458 - RNA, 23 nt, Mycobacterium tuberculosis H37Rv
cgaacaccguccaauuggcgucg

SEQ ID NO: 1276459 - RNA, 17 nt, Mycobacterium tuberculosis H37Rv
cgaacaaccccgguuga

SEQ ID NO: 1276460 - RNA, 20 nt, Mycobacterium tuberculosis H37Rv
cgaacaccgccgcgucgagc

SEQ ID NO: 1276461 - RNA, 19 nt, Mycobacterium tuberculosis H37Rv
cgaacaauaaggccgcacg

SEQ ID NO: 1276462 - RNA, 20 nt, Mycobacterium tuberculosis H37Rv
cgaacaccagcgcgccguag

SEQ ID NO: 1276463 - RNA, 14 nt, Mycobacterium tuberculosis H37Rv
cgaaagcgccgaaa

SEQ ID NO: 1276464 - RNA, 15 nt, Mycobacterium tuberculosis H37Rv
cgaaauacccagcgc

SEQ ID NO: 1276465 - RNA, 18 nt, Mycobacterium tuberculosis H37Rv
cgaaaugaagugcaccga

SEQ ID NO: 1276466 - RNA, 20 nt, Mycobacterium tuberculosis H37Rv
cgaaaugccgggcccgacgu

SEQ ID NO: 1276467 - RNA, 18 nt, Mycobacterium tuberculosis H37Rv
cgaaaugcccaucaccag

SEQ ID NO: 1276468 - RNA, 14 nt, Mycobacterium tuberculosis H37Rv
cgaaaucgcacagc

SEQ ID NO: 1276469 - RNA, 20 nt, Mycobacterium tuberculosis H37Rv
cgaaaucgacagcagcgcga

SEQ ID NO: 1276470 - RNA, 18 nt, Mycobacterium tuberculosis H37Rv
cgaaaucgacagcagcgc

SEQ ID NO: 1276471 - RNA, 19 nt, Mycobacterium tuberculosis H37Rv
cgaaaucgcccugacccgg

SEQ ID NO: 1276472 - RNA, 19 nt, Mycobacterium tuberculosis H37Rv
cgauccgguuaugcgguac

SEQ ID NO: 1276473 - RNA, 18 nt, Mycobacterium tuberculosis H37Rv
cgaucgaagaaacggcgu

SEQ ID NO: 1276474 - RNA, 23 nt, Mycobacterium tuberculosis H37Rv
cgauccggggcuggcuguggcgc

SEQ ID NO: 1276475 - RNA, 12 nt, Mycobacterium tuberculosis H37Rv
cgauccgauaca

SEQ ID NO: 1276476 - RNA, 14 nt, Mycobacterium tuberculosis H37Rv
cgaucccggucggu

SEQ ID NO: 1276477 - RNA, 20 nt, Mycobacterium tuberculosis H37Rv
cgaucaucaugucggcgcag

SEQ ID NO: 1276478 - RNA, 19 nt, Mycobacterium tuberculosis H37Rv
cgaucaguucguggcuggc

SEQ ID NO: 1276479 - RNA, 18 nt, Mycobacterium tuberculosis H37Rv
cgaucaguuccuguagcc

SEQ ID NO: 1276480 - RNA, 18 nt, Mycobacterium tuberculosis H37Rv
cgaucaugagcagcacgu

SEQ ID NO: 1276481 - RNA, 21 nt, Mycobacterium tuberculosis H37Rv
cgaucaucgggguggccacca

SEQ ID NO: 1276482 - RNA, 16 nt, Mycobacterium tuberculosis H37Rv
cgaucauggcggcagc

SEQ ID NO: 1276483 - RNA, 15 nt, Mycobacterium tuberculosis H37Rv
cgaucauugcaccca

SEQ ID NO: 1276484 - RNA, 21 nt, Mycobacterium tuberculosis H37Rv
cgauccacaggcugaagacga

SEQ ID NO: 1276485 - RNA, 18 nt, Mycobacterium tuberculosis H37Rv
cgauccacaggcugaaga

SEQ ID NO: 1276486 - RNA, 16 nt, Mycobacterium tuberculosis H37Rv
cgauccccaggccgcu

SEQ ID NO: 1276487 - RNA, 17 nt, Mycobacterium tuberculosis H37Rv
cgauccccagcaccacg

SEQ ID NO: 1276488 - RNA, 13 nt, Mycobacterium tuberculosis H37Rv
cgauccaggagug

SEQ ID NO: 1276489 - RNA, 15 nt, Mycobacterium tuberculosis H37Rv
cgauccaggccaguu

SEQ ID NO: 1276490 - RNA, 17 nt, Mycobacterium tuberculosis H37Rv
cgauccagggccgacgc

SEQ ID NO: 1276491 - RNA, 20 nt, Mycobacterium tuberculosis H37Rv
cgauccagucugggacaccg

SEQ ID NO: 1276492 - RNA, 13 nt, Mycobacterium tuberculosis H37Rv
cgauccaggccag

SEQ ID NO: 1276493 - RNA, 13 nt, Mycobacterium tuberculosis H37Rv
cgaucgauuccgc

SEQ ID NO: 1276494 - RNA, 18 nt, Mycobacterium tuberculosis H37Rv
cgaucgcauccgcgguug

SEQ ID NO: 1276495 - RNA, 13 nt, Mycobacterium tuberculosis H37Rv
cgaucgacacccg

SEQ ID NO: 1276496 - RNA, 20 nt, Mycobacterium tuberculosis H37Rv
cgaucgaauuaaagccacca

SEQ ID NO: 1276497 - RNA, 17 nt, Mycobacterium tuberculosis H37Rv
cgaucgacugcagcccg

SEQ ID NO: 1276498 - RNA, 14 nt, Mycobacterium tuberculosis H37Rv
cgaucgacggucgu

SEQ ID NO: 1276499 - RNA, 22 nt, Mycobacterium tuberculosis H37Rv
cgaucgacgccgccacccggcg

SEQ ID NO: 1276500 - RNA, 16 nt, Mycobacterium tuberculosis H37Rv
cgaucgcgagcgagcc

SEQ ID NO: 1276501 - RNA, 16 nt, Mycobacterium tuberculosis H37Rv
cgaucgcgacacggcc

SEQ ID NO: 1276502 - RNA, 19 nt, Mycobacterium tuberculosis H37Rv
cgaucgccgaguccggcga

SEQ ID NO: 1276503 - RNA, 17 nt, Mycobacterium tuberculosis H37Rv
cgaucgccgcgcugguc

SEQ ID NO: 1276504 - RNA, 17 nt, Mycobacterium tuberculosis H37Rv
cgaucgccgcgccguag

SEQ ID NO: 1276505 - RNA, 16 nt, Mycobacterium tuberculosis H37Rv
cgaucgccgacgccag

SEQ ID NO: 1276506 - RNA, 17 nt, Mycobacterium tuberculosis H37Rv
cgaucgcgccaucgucg

SEQ ID NO: 1276507 - RNA, 22 nt, Mycobacterium tuberculosis H37Rv
cgaucgcgccugugcgcaaggc

SEQ ID NO: 1276508 - RNA, 17 nt, Mycobacterium tuberculosis H37Rv
cgaucgcggcgcccagg

SEQ ID NO: 1276509 - RNA, 15 nt, Mycobacterium tuberculosis H37Rv
cgaucgcggcgccca

SEQ ID NO: 1276510 - RNA, 20 nt, Mycobacterium tuberculosis H37Rv
cgaucgcggucaaauccagc

SEQ ID NO: 1276511 - RNA, 17 nt, Mycobacterium tuberculosis H37Rv
cgaucggaccaccaggg

SEQ ID NO: 1276512 - RNA, 16 nt, Mycobacterium tuberculosis H37Rv
cgaucggaccaccagg

SEQ ID NO: 1276513 - RNA, 15 nt, Mycobacterium tuberculosis H37Rv
cgaucggaucggcac

SEQ ID NO: 1276514 - RNA, 22 nt, Mycobacterium tuberculosis H37Rv
cgaucggccaacagguccaccg

SEQ ID NO: 1276515 - RNA, 13 nt, Mycobacterium tuberculosis H37Rv
cgaucggcccagc

SEQ ID NO: 1276516 - RNA, 22 nt, Mycobacterium tuberculosis H37Rv
cgaucggcgcgccgaucggcac

SEQ ID NO: 1276517 - RNA, 21 nt, Mycobacterium tuberculosis H37Rv
cgaucggcaacccgcaccagg

SEQ ID NO: 1276518 - RNA, 13 nt, Mycobacterium tuberculosis H37Rv
cgaucggcagcca

SEQ ID NO: 1276519 - RNA, 19 nt, Mycobacterium tuberculosis H37Rv
cgaucggcaaucgacucag

SEQ ID NO: 1276520 - RNA, 18 nt, Mycobacterium tuberculosis H37Rv
cgaucgggcgggugaacg

SEQ ID NO: 1276521 - RNA, 21 nt, Mycobacterium tuberculosis H37Rv
cgaucgggcccagcagcgcaa

SEQ ID NO: 1276522 - RNA, 14 nt, Mycobacterium tuberculosis H37Rv
cgaucgggcgucag

SEQ ID NO: 1276523 - RNA, 19 nt, Mycobacterium tuberculosis H37Rv
cgaucgggaguccgguagc

SEQ ID NO: 1276524 - RNA, 22 nt, Mycobacterium tuberculosis H37Rv
cgaucguuccgcuggacggauc

SEQ ID NO: 1276525 - RNA, 13 nt, Mycobacterium tuberculosis H37Rv
cgaucgugcugcc

SEQ ID NO: 1276526 - RNA, 23 nt, Mycobacterium tuberculosis H37Rv
cgaucgugcgacgcaggaucaca

SEQ ID NO: 1276527 - RNA, 21 nt, Mycobacterium tuberculosis H37Rv
cgaucgugccgggaccggugu

SEQ ID NO: 1276528 - RNA, 13 nt, Mycobacterium tuberculosis H37Rv
cgaucgucgacgc

SEQ ID NO: 1276529 - RNA, 18 nt, Mycobacterium tuberculosis H37Rv
cgaucgucaagccgggca

SEQ ID NO: 1276530 - RNA, 19 nt, Mycobacterium tuberculosis H37Rv
cgaucgucaagccgggcac

SEQ ID NO: 1276531 - RNA, 22 nt, Mycobacterium tuberculosis H37Rv
cgaucggugccgaagcugccca

SEQ ID NO: 1276532 - RNA, 16 nt, Mycobacterium tuberculosis H37Rv
cgaucgucacgggguc

SEQ ID NO: 1276533 - RNA, 12 nt, Mycobacterium tuberculosis H37Rv
cgaucucggcgg

SEQ ID NO: 1276534 - RNA, 17 nt, Mycobacterium tuberculosis H37Rv
cgaucucggcgagcacc

SEQ ID NO: 1276535 - RNA, 19 nt, Mycobacterium tuberculosis H37Rv
cgaucucggcgagcaccac

SEQ ID NO: 1276536 - RNA, 22 nt, Mycobacterium tuberculosis H37Rv
cgaucucgccggcgaagaccgc

SEQ ID NO: 1276537 - RNA, 20 nt, Mycobacterium tuberculosis H37Rv
cgaucucgaucgacccgguc

SEQ ID NO: 1276538 - RNA, 23 nt, Mycobacterium tuberculosis H37Rv
cgaucucgaccguauugaccagc

SEQ ID NO: 1276539 - RNA, 21 nt, Mycobacterium tuberculosis H37Rv
cgaucucgagcaggcgcacca

SEQ ID NO: 1276540 - RNA, 15 nt, Mycobacterium tuberculosis H37Rv
cgaucucgaccagcg

SEQ ID NO: 1276541 - RNA, 19 nt, Mycobacterium tuberculosis H37Rv
cgaucucggugaccucacc

SEQ ID NO: 1276542 - RNA, 19 nt, Mycobacterium tuberculosis H37Rv
cgaucucguuuucgcgcuu

SEQ ID NO: 1276543 - RNA, 23 nt, Mycobacterium tuberculosis H37Rv
cgaucucuugguagugacugcga

SEQ ID NO: 1276544 - RNA, 16 nt, Mycobacterium tuberculosis H37Rv
cgaugaagcgucguug

SEQ ID NO: 1276545 - RNA, 15 nt, Mycobacterium tuberculosis H37Rv
cgaucugcaggccca

SEQ ID NO: 1276546 - RNA, 13 nt, Mycobacterium tuberculosis H37Rv
cgaucugcagcgc

SEQ ID NO: 1276547 - RNA, 15 nt, Mycobacterium tuberculosis H37Rv
cgaugacaucgguca

SEQ ID NO: 1276548 - RNA, 22 nt, Mycobacterium tuberculosis H37Rv
cgaugacacaccgcgucggccg

SEQ ID NO: 1276549 - RNA, 16 nt, Mycobacterium tuberculosis H37Rv
cgaugacaucggucag

SEQ ID NO: 1276550 - RNA, 15 nt, Mycobacterium tuberculosis H37Rv
cgaugacgccgugcu

SEQ ID NO: 1276551 - RNA, 20 nt, Mycobacterium tuberculosis H37Rv
cgaugaccagggucugcuca

SEQ ID NO: 1276552 - RNA, 14 nt, Mycobacterium tuberculosis H37Rv
cgaugacgcguuca

SEQ ID NO: 1276553 - RNA, 19 nt, Mycobacterium tuberculosis H37Rv
cgaugcggcgucgaacugc

SEQ ID NO: 1276554 - RNA, 15 nt, Mycobacterium tuberculosis H37Rv
cgaugcgggccauca

SEQ ID NO: 1276555 - RNA, 21 nt, Mycobacterium tuberculosis H37Rv
cgaugcgggccgccaggcggc

SEQ ID NO: 1276556 - RNA, 18 nt, Mycobacterium tuberculosis H37Rv
cgaugcgggccgccaggc

SEQ ID NO: 1276557 - RNA, 14 nt, Mycobacterium tuberculosis H37Rv
cgaugcgugccgac

SEQ ID NO: 1276558 - RNA, 15 nt, Mycobacterium tuberculosis H37Rv
cgaugcguccgccca

SEQ ID NO: 1276559 - RNA, 17 nt, Mycobacterium tuberculosis H37Rv
cgaugcgucacaccacg

SEQ ID NO: 1276560 - RNA, 19 nt, Mycobacterium tuberculosis H37Rv
cgaugcgucacaccacgac

SEQ ID NO: 1276561 - RNA, 22 nt, Mycobacterium tuberculosis H37Rv
cgaugcgucacaccacgacgcg

SEQ ID NO: 1276562 - RNA, 18 nt, Mycobacterium tuberculosis H37Rv
cgaugcgcaccagcggcu

SEQ ID NO: 1276563 - RNA, 14 nt, Mycobacterium tuberculosis H37Rv
cgaugcgcaccagc

SEQ ID NO: 1276564 - RNA, 12 nt, Mycobacterium tuberculosis H37Rv
cgaugcgcacca

SEQ ID NO: 1276565 - RNA, 23 nt, Mycobacterium tuberculosis H37Rv
cgaugcgcaacuucuucagcagc

SEQ ID NO: 1276566 - RNA, 15 nt, Mycobacterium tuberculosis H37Rv
cgaugcgaucgacga

SEQ ID NO: 1276567 - RNA, 14 nt, Mycobacterium tuberculosis H37Rv
cgaugcgauuccgc

SEQ ID NO: 1276568 - RNA, 20 nt, Mycobacterium tuberculosis H37Rv
cgaugccguaggcggccagu

SEQ ID NO: 1276569 - RNA, 14 nt, Mycobacterium tuberculosis H37Rv
cgaugccggcuggc

SEQ ID NO: 1276570 - RNA, 18 nt, Mycobacterium tuberculosis H37Rv
cgaugccggugugcgcca

SEQ ID NO: 1276571 - RNA, 22 nt, Mycobacterium tuberculosis H37Rv
cgaugccagugcaucggucagc

SEQ ID NO: 1276572 - RNA, 18 nt, Mycobacterium tuberculosis H37Rv
cgaugcccacgcacagca

SEQ ID NO: 1276573 - RNA, 21 nt, Mycobacterium tuberculosis H37Rv
cgaugaucucacccagcucgc

SEQ ID NO: 1276574 - RNA, 21 nt, Mycobacterium tuberculosis H37Rv
cgaugaucugcuugccaccgc

SEQ ID NO: 1276575 - RNA, 18 nt, Mycobacterium tuberculosis H37Rv
cgaugaucugugccgcua

SEQ ID NO: 1276576 - RNA, 19 nt, Mycobacterium tuberculosis H37Rv
cgaugagcaugcccagcgc

SEQ ID NO: 1276577 - RNA, 16 nt, Mycobacterium tuberculosis H37Rv
cgaugagcaugcccag

SEQ ID NO: 1276578 - RNA, 20 nt, Mycobacterium tuberculosis H37Rv
cgaugaugaugaccacauug

SEQ ID NO: 1276579 - RNA, 14 nt, Mycobacterium tuberculosis H37Rv
cgaugaugaugacc

SEQ ID NO: 1276580 - RNA, 17 nt, Mycobacterium tuberculosis H37Rv
cgaugaucuugccgcgg

SEQ ID NO: 1276581 - RNA, 15 nt, Mycobacterium tuberculosis H37Rv
cgaugaugggcgguu

SEQ ID NO: 1276582 - RNA, 17 nt, Mycobacterium tuberculosis H37Rv
cgaugaugcucgacaac

SEQ ID NO: 1276583 - RNA, 16 nt, Mycobacterium tuberculosis H37Rv
cgaugauggacaccag

SEQ ID NO: 1276584 - RNA, 22 nt, Mycobacterium tuberculosis H37Rv
cgaugaugccggacagcucgcg

SEQ ID NO: 1276585 - RNA, 22 nt, Mycobacterium tuberculosis H37Rv
cgagcgugaaccuggcgacgcg

SEQ ID NO: 1276586 - RNA, 21 nt, Mycobacterium tuberculosis H37Rv
cgagcguccgggucgacgcga

SEQ ID NO: 1276587 - RNA, 21 nt, Mycobacterium tuberculosis H37Rv
cgagcucggcgaacggcacca

SEQ ID NO: 1276588 - RNA, 12 nt, Mycobacterium tuberculosis H37Rv
cgagcucggcgc

SEQ ID NO: 1276589 - RNA, 15 nt, Mycobacterium tuberculosis H37Rv
cgagcucggucacca

SEQ ID NO: 1276590 - RNA, 18 nt, Mycobacterium tuberculosis H37Rv
cgagcucguugcuggcgg

SEQ ID NO: 1276591 - RNA, 15 nt, Mycobacterium tuberculosis H37Rv
cgagcuguggucacc

SEQ ID NO: 1276592 - RNA, 23 nt, Mycobacterium tuberculosis H37Rv
cgagcugucggcuuccuccucgg

SEQ ID NO: 1276593 - RNA, 17 nt, Mycobacterium tuberculosis H37Rv
cgagcuguaggucagcg

SEQ ID NO: 1276594 - RNA, 17 nt, Mycobacterium tuberculosis H37Rv
cgagcugauccgggugg

SEQ ID NO: 1276595 - RNA, 13 nt, Mycobacterium tuberculosis H37Rv
cgagcugaccacg

SEQ ID NO: 1276596 - RNA, 22 nt, Mycobacterium tuberculosis H37Rv
cgagcucguccucgucuucguc

SEQ ID NO: 1276597 - RNA, 19 nt, Mycobacterium tuberculosis H37Rv
cgagcugauacgcaugcga

SEQ ID NO: 1276598 - RNA, 17 nt, Mycobacterium tuberculosis H37Rv
cgagcugacgccgagcu

SEQ ID NO: 1276599 - RNA, 22 nt, Mycobacterium tuberculosis H37Rv
cgagcgguggugagugcgucuc

SEQ ID NO: 1276600 - RNA, 22 nt, Mycobacterium tuberculosis H37Rv
cgagcggucaacgaguugcgga

SEQ ID NO: 1276601 - RNA, 22 nt, Mycobacterium tuberculosis H37Rv
cgagcgucagauccggccguug

SEQ ID NO: 1276602 - RNA, 18 nt, Mycobacterium tuberculosis H37Rv
cgagcuucagcgcgcugc

SEQ ID NO: 1276603 - RNA, 12 nt, Mycobacterium tuberculosis H37Rv
cgagcuugccgu

SEQ ID NO: 1276604 - RNA, 23 nt, Mycobacterium tuberculosis H37Rv
cgaggaaaucgcccucgucgcgg

SEQ ID NO: 1276605 - RNA, 15 nt, Mycobacterium tuberculosis H37Rv
cgaggaaaccaccag

SEQ ID NO: 1276606 - RNA, 23 nt, Mycobacterium tuberculosis H37Rv
cgagcuuuucgaccuucaccgcg

SEQ ID NO: 1276607 - RNA, 22 nt, Mycobacterium tuberculosis H37Rv
cgaggacuggaaagcagcagcg

SEQ ID NO: 1276608 - RNA, 15 nt, Mycobacterium tuberculosis H37Rv
cgaggagggccgcga

SEQ ID NO: 1276609 - RNA, 24 nt, Mycobacterium tuberculosis H37Rv
cgaggcccgggugcuacugggugg

SEQ ID NO: 1276610 - RNA, 20 nt, Mycobacterium tuberculosis H37Rv
cgaggccgccaucgccgcca

SEQ ID NO: 1276611 - RNA, 14 nt, Mycobacterium tuberculosis H37Rv
cgaggccgccaucg

SEQ ID NO: 1276612 - RNA, 21 nt, Mycobacterium tuberculosis H37Rv
cgaggcccucgcgcgcgucga

SEQ ID NO: 1276613 - RNA, 18 nt, Mycobacterium tuberculosis H37Rv
cgaggaucccgcugcacg

SEQ ID NO: 1276614 - RNA, 24 nt, Mycobacterium tuberculosis H37Rv
cgagggccagcaaguacgcgucgg

SEQ ID NO: 1276615 - RNA, 19 nt, Mycobacterium tuberculosis H37Rv
cgagggccagcagccgcga

SEQ ID NO: 1276616 - RNA, 15 nt, Mycobacterium tuberculosis H37Rv
cgagggcauccgagc

SEQ ID NO: 1276617 - RNA, 17 nt, Mycobacterium tuberculosis H37Rv
cgaggcgucaccccggu

SEQ ID NO: 1276618 - RNA, 18 nt, Mycobacterium tuberculosis H37Rv
cgaggcggcggucgagcu

SEQ ID NO: 1276619 - RNA, 14 nt, Mycobacterium tuberculosis H37Rv
cgaggcggcggucg

SEQ ID NO: 1276620 - RNA, 19 nt, Mycobacterium tuberculosis H37Rv
cgaggccgccguugccguu

SEQ ID NO: 1276621 - RNA, 20 nt, Mycobacterium tuberculosis H37Rv
cgaggccucggccagcguca

SEQ ID NO: 1276622 - RNA, 23 nt, Mycobacterium tuberculosis H37Rv
cgaggcgaagcgggacugcagcg

SEQ ID NO: 1276623 - RNA, 15 nt, Mycobacterium tuberculosis H37Rv
cgaggccuaccaggc

SEQ ID NO: 1276624 - RNA, 23 nt, Mycobacterium tuberculosis H37Rv
cgaggccuaccaggcgcggccca

SEQ ID NO: 1276625 - RNA, 15 nt, Mycobacterium tuberculosis H37Rv
cgaggccucggccag

SEQ ID NO: 1276626 - RNA, 23 nt, Mycobacterium tuberculosis H37Rv
cgaggcgaguucgcgcacgucgg

SEQ ID NO: 1276627 - RNA, 20 nt, Mycobacterium tuberculosis H37Rv
cgaggggcggcaaucggugg

SEQ ID NO: 1276628 - RNA, 15 nt, Mycobacterium tuberculosis H37Rv
cgaggucugguagag

SEQ ID NO: 1276629 - RNA, 21 nt, Mycobacterium tuberculosis H37Rv
cgaguacgggcaggccgcugg

SEQ ID NO: 1276630 - RNA, 19 nt, Mycobacterium tuberculosis H37Rv
cgagucaccaaaggcgucu

SEQ ID NO: 1276631 - RNA, 15 nt, Mycobacterium tuberculosis H37Rv
cgaguaucucggcuc

SEQ ID NO: 1276632 - RNA, 20 nt, Mycobacterium tuberculosis H37Rv
cgaguauuuuucgaccagcc

SEQ ID NO: 1276633 - RNA, 16 nt, Mycobacterium tuberculosis H37Rv
cgaguccaggccggca

SEQ ID NO: 1276634 - RNA, 23 nt, Mycobacterium tuberculosis H37Rv
cgaggugcucggaucggcucgcc

SEQ ID NO: 1276635 - RNA, 17 nt, Mycobacterium tuberculosis H37Rv
cgagguggacaaaucga

SEQ ID NO: 1276636 - RNA, 22 nt, Mycobacterium tuberculosis H37Rv
cgaguacggccugccgcucgcc

SEQ ID NO: 1276637 - RNA, 14 nt, Mycobacterium tuberculosis H37Rv
cgaguaccgauagc

SEQ ID NO: 1276638 - RNA, 23 nt, Mycobacterium tuberculosis H37Rv
cgaggugccgggguggcgcgcca

SEQ ID NO: 1276639 - RNA, 16 nt, Mycobacterium tuberculosis H37Rv
cgaggugagguugacc

SEQ ID NO: 1276640 - RNA, 19 nt, Mycobacterium tuberculosis H37Rv
cgaggugauguuggccgcc

SEQ ID NO: 1276641 - RNA, 16 nt, Mycobacterium tuberculosis H37Rv
cgaucagauaguccgg

SEQ ID NO: 1276642 - RNA, 23 nt, Mycobacterium tuberculosis H37Rv
cgaucacgugguccaaccgggcc

SEQ ID NO: 1276643 - RNA, 23 nt, Mycobacterium tuberculosis H37Rv
cgaucacuguuccgggugccgcg

SEQ ID NO: 1276644 - RNA, 16 nt, Mycobacterium tuberculosis H37Rv
cgaucacgucgucucg

SEQ ID NO: 1276645 - RNA, 13 nt, Mycobacterium tuberculosis H37Rv
cgaucagcagcgu

SEQ ID NO: 1276646 - RNA, 18 nt, Mycobacterium tuberculosis H37Rv
cgaucagcagccgccgau

SEQ ID NO: 1276647 - RNA, 19 nt, Mycobacterium tuberculosis H37Rv
cgaucagcaacucggccac

SEQ ID NO: 1276648 - RNA, 16 nt, Mycobacterium tuberculosis H37Rv
cgaucaccgcaucggu

SEQ ID NO: 1276649 - RNA, 18 nt, Mycobacterium tuberculosis H37Rv
cgaucaccgacaccgugu

SEQ ID NO: 1276650 - RNA, 21 nt, Mycobacterium tuberculosis H37Rv
cgaucaccgagauggcgauca

SEQ ID NO: 1276651 - RNA, 15 nt, Mycobacterium tuberculosis H37Rv
cgaucaccgcuugcu

SEQ ID NO: 1276652 - RNA, 12 nt, Mycobacterium tuberculosis H37Rv
cgaucacgcugc

SEQ ID NO: 1276653 - RNA, 18 nt, Mycobacterium tuberculosis H37Rv
cgaucaccgcuugcuggc

SEQ ID NO: 1276654 - RNA, 21 nt, Mycobacterium tuberculosis H37Rv
cgaucagccgggugcgcaccc

SEQ ID NO: 1276655 - RNA, 23 nt, Mycobacterium tuberculosis H37Rv
cgaucagcgccggauccacaccg

SEQ ID NO: 1276656 - RNA, 21 nt, Mycobacterium tuberculosis H37Rv
cgaucagccguggcagucgca

SEQ ID NO: 1276657 - RNA, 21 nt, Mycobacterium tuberculosis H37Rv
cgaucagcuccuguaacugcu

SEQ ID NO: 1276658 - RNA, 19 nt, Mycobacterium tuberculosis H37Rv
cgaucagcugcgcaucgcc

SEQ ID NO: 1276659 - RNA, 17 nt, Mycobacterium tuberculosis H37Rv
cgaucaggccgacgucg

SEQ ID NO: 1276660 - RNA, 20 nt, Mycobacterium tuberculosis H37Rv
cgaucagguuggugcucagc

SEQ ID NO: 1276661 - RNA, 17 nt, Mycobacterium tuberculosis H37Rv
cgaucaguccggcguuc

SEQ ID NO: 1276662 - RNA, 17 nt, Mycobacterium tuberculosis H37Rv
cgaucagguuggcggcu

SEQ ID NO: 1276663 - RNA, 18 nt, Mycobacterium tuberculosis H37Rv
cgaucaggucgucacgcc

SEQ ID NO: 1276664 - RNA, 16 nt, Mycobacterium tuberculosis H37Rv
cgaucagggugucgaa

SEQ ID NO: 1276665 - RNA, 20 nt, Mycobacterium tuberculosis H37Rv
cgaguccaggcugaucccga

SEQ ID NO: 1276666 - RNA, 15 nt, Mycobacterium tuberculosis H37Rv
cgagucucgucgggu

SEQ ID NO: 1276667 - RNA, 14 nt, Mycobacterium tuberculosis H37Rv
cgagucugcgagca

SEQ ID NO: 1276668 - RNA, 16 nt, Mycobacterium tuberculosis H37Rv
cgagugccgccaccgc

SEQ ID NO: 1276669 - RNA, 15 nt, Mycobacterium tuberculosis H37Rv
cgagugccgccaccg

SEQ ID NO: 1276670 - RNA, 14 nt, Mycobacterium tuberculosis H37Rv
cgauacagaucugg

SEQ ID NO: 1276671 - RNA, 21 nt, Mycobacterium tuberculosis H37Rv
cgauaaugaucucggcaagga

SEQ ID NO: 1276672 - RNA, 18 nt, Mycobacterium tuberculosis H37Rv
cgauacaacgcggcuuug

SEQ ID NO: 1276673 - RNA, 19 nt, Mycobacterium tuberculosis H37Rv
cgauagaacguagcgccca

SEQ ID NO: 1276674 - RNA, 13 nt, Mycobacterium tuberculosis H37Rv
cgaucaacggauc

SEQ ID NO: 1276675 - RNA, 15 nt, Mycobacterium tuberculosis H37Rv
cgaucaauugcccgg

SEQ ID NO: 1276676 - RNA, 20 nt, Mycobacterium tuberculosis H37Rv
cgaucacaacgugcccacca

SEQ ID NO: 1276677 - RNA, 15 nt, Mycobacterium tuberculosis H37Rv
cgauagaucgcgugg

SEQ ID NO: 1276678 - RNA, 15 nt, Mycobacterium tuberculosis H37Rv
cgauagcuggccgau

SEQ ID NO: 1276679 - RNA, 19 nt, Mycobacterium tuberculosis H37Rv
cgcagaccgccaccggcug

SEQ ID NO: 1276680 - RNA, 13 nt, Mycobacterium tuberculosis H37Rv
cgcagaccgccac

SEQ ID NO: 1276681 - RNA, 13 nt, Mycobacterium tuberculosis H37Rv
cgcagacggcugc

SEQ ID NO: 1276682 - RNA, 18 nt, Mycobacterium tuberculosis H37Rv
cgcacucuuuccuuccgc

SEQ ID NO: 1276683 - RNA, 23 nt, Mycobacterium tuberculosis H37Rv
cgcacugaaauggcgugcucgac

SEQ ID NO: 1276684 - RNA, 22 nt, Mycobacterium tuberculosis H37Rv
cgcagacucgccaccgcggcga

SEQ ID NO: 1276685 - RNA, 17 nt, Mycobacterium tuberculosis H37Rv
cgcagacucgccaccgc

SEQ ID NO: 1276686 - RNA, 19 nt, Mycobacterium tuberculosis H37Rv
cgcagacccucgucgucga

SEQ ID NO: 1276687 - RNA, 23 nt, Mycobacterium tuberculosis H37Rv
cgcagacucgauaugcagcucgc

SEQ ID NO: 1276688 - RNA, 16 nt, Mycobacterium tuberculosis H37Rv
cgcagauagcgcucga

SEQ ID NO: 1276689 - RNA, 21 nt, Mycobacterium tuberculosis H37Rv
cgcagauagcgcucgaacucg

SEQ ID NO: 1276690 - RNA, 15 nt, Mycobacterium tuberculosis H37Rv
cgcagaucagggugg

SEQ ID NO: 1276691 - RNA, 22 nt, Mycobacterium tuberculosis H37Rv
cgcagcaacggcggcgucgcgg

SEQ ID NO: 1276692 - RNA, 18 nt, Mycobacterium tuberculosis H37Rv
cgcagaugagcgcggcga

SEQ ID NO: 1276693 - RNA, 23 nt, Mycobacterium tuberculosis H37Rv
cgcagccagcaagucugcccgac

SEQ ID NO: 1276694 - RNA, 12 nt, Mycobacterium tuberculosis H37Rv
cgcagcagcgug

SEQ ID NO: 1276695 - RNA, 20 nt, Mycobacterium tuberculosis H37Rv
cgcagcaggggacgaccaug

SEQ ID NO: 1276696 - RNA, 22 nt, Mycobacterium tuberculosis H37Rv
cgcagcagcaucggcacgucgu

SEQ ID NO: 1276697 - RNA, 13 nt, Mycobacterium tuberculosis H37Rv
cgcagcaacucga

SEQ ID NO: 1276698 - RNA, 22 nt, Mycobacterium tuberculosis H37Rv
cgcagcacucgcccaagcgcag

SEQ ID NO: 1276699 - RNA, 20 nt, Mycobacterium tuberculosis H37Rv
cgcagcacucccugguucgg

SEQ ID NO: 1276700 - RNA, 14 nt, Mycobacterium tuberculosis H37Rv
cgcagcacggguga

SEQ ID NO: 1276701 - RNA, 14 nt, Mycobacterium tuberculosis H37Rv
cgcagcaccgucgg

SEQ ID NO: 1276702 - RNA, 20 nt, Mycobacterium tuberculosis H37Rv
cgcagcaccggcucgacugc

SEQ ID NO: 1276703 - RNA, 14 nt, Mycobacterium tuberculosis H37Rv
cgcaccggcgucgg

SEQ ID NO: 1276704 - RNA, 15 nt, Mycobacterium tuberculosis H37Rv
cgcaccagcugucgg

SEQ ID NO: 1276705 - RNA, 15 nt, Mycobacterium tuberculosis H37Rv
cgcaccagcaccugc

SEQ ID NO: 1276706 - RNA, 16 nt, Mycobacterium tuberculosis H37Rv
cgcaccgugccgacgc

SEQ ID NO: 1276707 - RNA, 22 nt, Mycobacterium tuberculosis H37Rv
cgcaccgugggcccuucacugu

SEQ ID NO: 1276708 - RNA, 23 nt, Mycobacterium tuberculosis H37Rv
cgcaccgugugggccccgccgau

SEQ ID NO: 1276709 - RNA, 18 nt, Mycobacterium tuberculosis H37Rv
cgcaccuauggucaaccg

SEQ ID NO: 1276710 - RNA, 23 nt, Mycobacterium tuberculosis H37Rv
cgcaccggugauggugaccagca

SEQ ID NO: 1276711 - RNA, 14 nt, Mycobacterium tuberculosis H37Rv
cgcaccggugaugg

SEQ ID NO: 1276712 - RNA, 20 nt, Mycobacterium tuberculosis H37Rv
cgcaccggaucggcuaccua

SEQ ID NO: 1276713 - RNA, 17 nt, Mycobacterium tuberculosis H37Rv
cgcaccggcuggcccag

SEQ ID NO: 1276714 - RNA, 21 nt, Mycobacterium tuberculosis H37Rv
cgcacggcgccgacccgauca

SEQ ID NO: 1276715 - RNA, 19 nt, Mycobacterium tuberculosis H37Rv
cgcaccuugaccgucgcgc

SEQ ID NO: 1276716 - RNA, 17 nt, Mycobacterium tuberculosis H37Rv
cgcacuccacgaucggc

SEQ ID NO: 1276717 - RNA, 19 nt, Mycobacterium tuberculosis H37Rv
cgcacucccggcucggcca

SEQ ID NO: 1276718 - RNA, 14 nt, Mycobacterium tuberculosis H37Rv
cgcacucguugccg

SEQ ID NO: 1276719 - RNA, 21 nt, Mycobacterium tuberculosis H37Rv
cgcacucauagaacucgccgc

SEQ ID NO: 1276720 - RNA, 20 nt, Mycobacterium tuberculosis H37Rv
cgcacggugaccacgccgug

SEQ ID NO: 1276721 - RNA, 22 nt, Mycobacterium tuberculosis H37Rv
cgcacucgacggucaucgcugu

SEQ ID NO: 1276722 - RNA, 12 nt, Mycobacterium tuberculosis H37Rv
cgcacggucagc

SEQ ID NO: 1276723 - RNA, 16 nt, Mycobacterium tuberculosis H37Rv
cgcacggucagcgcgc

SEQ ID NO: 1276724 - RNA, 16 nt, Mycobacterium tuberculosis H37Rv
cgcacgguccacggug

SEQ ID NO: 1276725 - RNA, 17 nt, Mycobacterium tuberculosis H37Rv
cgcacgguccacggugg

SEQ ID NO: 1276726 - RNA, 14 nt, Mycobacterium tuberculosis H37Rv
cgcacgggcgaccu

SEQ ID NO: 1276727 - RNA, 15 nt, Mycobacterium tuberculosis H37Rv
cgauuucccaugcaa

SEQ ID NO: 1276728 - RNA, 19 nt, Mycobacterium tuberculosis H37Rv
cgauuuugcgucugcucgc

SEQ ID NO: 1276729 - RNA, 14 nt, Mycobacterium tuberculosis H37Rv
cgaugcucgccguu

SEQ ID NO: 1276730 - RNA, 15 nt, Mycobacterium tuberculosis H37Rv
cgaugcucgccguug

SEQ ID NO: 1276731 - RNA, 16 nt, Mycobacterium tuberculosis H37Rv
cgaugcucagcugguc

SEQ ID NO: 1276732 - RNA, 21 nt, Mycobacterium tuberculosis H37Rv
cgaugcucgucccagaaccgg

SEQ ID NO: 1276733 - RNA, 20 nt, Mycobacterium tuberculosis H37Rv
cgauggccagcacgguguug

SEQ ID NO: 1276734 - RNA, 21 nt, Mycobacterium tuberculosis H37Rv
cgauggcaagggccgacgucg

SEQ ID NO: 1276735 - RNA, 21 nt, Mycobacterium tuberculosis H37Rv
cgauggcaccacuacaucgau

SEQ ID NO: 1276736 - RNA, 16 nt, Mycobacterium tuberculosis H37Rv
cgauggccagcacggu

SEQ ID NO: 1276737 - RNA, 18 nt, Mycobacterium tuberculosis H37Rv
cgcaagcagcccggguga

SEQ ID NO: 1276738 - RNA, 20 nt, Mycobacterium tuberculosis H37Rv
cgcaacguacgcacgcagcc

SEQ ID NO: 1276739 - RNA, 22 nt, Mycobacterium tuberculosis H37Rv
cgcaacuacggcguccccgaca

SEQ ID NO: 1276740 - RNA, 22 nt, Mycobacterium tuberculosis H37Rv
cgcaagaaucagcagcagcgug

SEQ ID NO: 1276741 - RNA, 24 nt, Mycobacterium tuberculosis H37Rv
cgcaacucgacgcguagcucgcgg

SEQ ID NO: 1276742 - RNA, 21 nt, Mycobacterium tuberculosis H37Rv
cgcaacaaccgguuggcgauc

SEQ ID NO: 1276743 - RNA, 23 nt, Mycobacterium tuberculosis H37Rv
cgcaacgcgugcgcaucagcggu

SEQ ID NO: 1276744 - RNA, 16 nt, Mycobacterium tuberculosis H37Rv
cgcaacgcgaucaccu

SEQ ID NO: 1276745 - RNA, 17 nt, Mycobacterium tuberculosis H37Rv
cgcaacaccgugcacca

SEQ ID NO: 1276746 - RNA, 18 nt, Mycobacterium tuberculosis H37Rv
cgcacaaaaucagcgauu

SEQ ID NO: 1276747 - RNA, 18 nt, Mycobacterium tuberculosis H37Rv
cgcacaacccgucgagcc

SEQ ID NO: 1276748 - RNA, 20 nt, Mycobacterium tuberculosis H37Rv
cgcacagcaccacaucgaag

SEQ ID NO: 1276749 - RNA, 13 nt, Mycobacterium tuberculosis H37Rv
cgcacacgaucgc

SEQ ID NO: 1276750 - RNA, 12 nt, Mycobacterium tuberculosis H37Rv
cgcacacgcgug

SEQ ID NO: 1276751 - RNA, 16 nt, Mycobacterium tuberculosis H37Rv
cgcacaguucgccgga

SEQ ID NO: 1276752 - RNA, 20 nt, Mycobacterium tuberculosis H37Rv
cgcacauggugggucgacga

SEQ ID NO: 1276753 - RNA, 18 nt, Mycobacterium tuberculosis H37Rv
cgcacaggcgcgaucgcu

SEQ ID NO: 1276754 - RNA, 14 nt, Mycobacterium tuberculosis H37Rv
cgcacagcgagcac

SEQ ID NO: 1276755 - RNA, 15 nt, Mycobacterium tuberculosis H37Rv
cgcacagcgagcaca

SEQ ID NO: 1276756 - RNA, 20 nt, Mycobacterium tuberculosis H37Rv
cgcaagugucuccggcaaca

SEQ ID NO: 1276757 - RNA, 14 nt, Mycobacterium tuberculosis H37Rv
cgcaagcgcggcga

SEQ ID NO: 1276758 - RNA, 21 nt, Mycobacterium tuberculosis H37Rv
cgcaaugaccugcagcgcauc

SEQ ID NO: 1276759 - RNA, 20 nt, Mycobacterium tuberculosis H37Rv
cgcaaugacgucgucggcca

SEQ ID NO: 1276760 - RNA, 20 nt, Mycobacterium tuberculosis H37Rv
cgcaauuccggugaucgcgg

SEQ ID NO: 1276761 - RNA, 19 nt, Mycobacterium tuberculosis H37Rv
cgcaaugcgcgcgauggcg

SEQ ID NO: 1276762 - RNA, 23 nt, Mycobacterium tuberculosis H37Rv
cgcaaucaggaaccgcucgucac

SEQ ID NO: 1276763 - RNA, 24 nt, Mycobacterium tuberculosis H37Rv
cgcaaucagacggcgaguaggcgu

SEQ ID NO: 1276764 - RNA, 18 nt, Mycobacterium tuberculosis H37Rv
cgcaaucauccgaucgcc

SEQ ID NO: 1276765 - RNA, 15 nt, Mycobacterium tuberculosis H37Rv
cgcaauaugccacag

SEQ ID NO: 1276766 - RNA, 20 nt, Mycobacterium tuberculosis H37Rv
cgccaacaacuucucgucga

SEQ ID NO: 1276767 - RNA, 19 nt, Mycobacterium tuberculosis H37Rv
cgcauguucuccacgccga

SEQ ID NO: 1276768 - RNA, 19 nt, Mycobacterium tuberculosis H37Rv
cgcaugucgggccaggcga

SEQ ID NO: 1276769 - RNA, 20 nt, Mycobacterium tuberculosis H37Rv
cgcaugguggugggugaugg

SEQ ID NO: 1276770 - RNA, 20 nt, Mycobacterium tuberculosis H37Rv
cgccaacaucuccgcgucgg

SEQ ID NO: 1276771 - RNA, 18 nt, Mycobacterium tuberculosis H37Rv
cgccaacaccaaccagug

SEQ ID NO: 1276772 - RNA, 21 nt, Mycobacterium tuberculosis H37Rv
cgccaacgccaaaacggucga

SEQ ID NO: 1276773 - RNA, 19 nt, Mycobacterium tuberculosis H37Rv
cgccaaccuuugcguugcu

SEQ ID NO: 1276774 - RNA, 15 nt, Mycobacterium tuberculosis H37Rv
cgccaacccgguuga

SEQ ID NO: 1276775 - RNA, 21 nt, Mycobacterium tuberculosis H37Rv
cgccaacgccagcaccagcgu

SEQ ID NO: 1276776 - RNA, 13 nt, Mycobacterium tuberculosis H37Rv
cgccacaccauga

SEQ ID NO: 1276777 - RNA, 13 nt, Mycobacterium tuberculosis H37Rv
cgccacaucgugg

SEQ ID NO: 1276778 - RNA, 15 nt, Mycobacterium tuberculosis H37Rv
cgccacagucgucga

SEQ ID NO: 1276779 - RNA, 18 nt, Mycobacterium tuberculosis H37Rv
cgccacagucgucgagcg

SEQ ID NO: 1276780 - RNA, 14 nt, Mycobacterium tuberculosis H37Rv
cgccacccgccaac

SEQ ID NO: 1276781 - RNA, 12 nt, Mycobacterium tuberculosis H37Rv
cgccacccgcga

SEQ ID NO: 1276782 - RNA, 17 nt, Mycobacterium tuberculosis H37Rv
cgccacccgcgucaguc

SEQ ID NO: 1276783 - RNA, 21 nt, Mycobacterium tuberculosis H37Rv
cgccaccgaacgcaccgaaac

SEQ ID NO: 1276784 - RNA, 18 nt, Mycobacterium tuberculosis H37Rv
cgccacccuuggcccggu

SEQ ID NO: 1276785 - RNA, 20 nt, Mycobacterium tuberculosis H37Rv
cgccaccccgcguaugccag

SEQ ID NO: 1276786 - RNA, 22 nt, Mycobacterium tuberculosis H37Rv
cgcaucucgagcaugcccagcg

SEQ ID NO: 1276787 - RNA, 12 nt, Mycobacterium tuberculosis H37Rv
cgcaucgguguc

SEQ ID NO: 1276788 - RNA, 13 nt, Mycobacterium tuberculosis H37Rv
cgcauggacgcga

SEQ ID NO: 1276789 - RNA, 18 nt, Mycobacterium tuberculosis H37Rv
cgcaugcguaugcccacg

SEQ ID NO: 1276790 - RNA, 22 nt, Mycobacterium tuberculosis H37Rv
cgcaugcguaugcccacgaacc

SEQ ID NO: 1276791 - RNA, 18 nt, Mycobacterium tuberculosis H37Rv
cgcaugcucagcaucguc

SEQ ID NO: 1276792 - RNA, 17 nt, Mycobacterium tuberculosis H37Rv
cgcaugcucgaucgcgu

SEQ ID NO: 1276793 - RNA, 19 nt, Mycobacterium tuberculosis H37Rv
cgcaugccggcgcaccaca

SEQ ID NO: 1276794 - RNA, 12 nt, Mycobacterium tuberculosis H37Rv
cgcaugccccga

SEQ ID NO: 1276795 - RNA, 21 nt, Mycobacterium tuberculosis H37Rv
cgcaugcccuggaccagcggg

SEQ ID NO: 1276796 - RNA, 22 nt, Mycobacterium tuberculosis H37Rv
cgcaugcacgucaucggcuggc

SEQ ID NO: 1276797 - RNA, 15 nt, Mycobacterium tuberculosis H37Rv
cgcaucggcccccaa

SEQ ID NO: 1276798 - RNA, 18 nt, Mycobacterium tuberculosis H37Rv
cgcaucgcggcgacgucg

SEQ ID NO: 1276799 - RNA, 20 nt, Mycobacterium tuberculosis H37Rv
cgcaucgcgaagucguccag

SEQ ID NO: 1276800 - RNA, 14 nt, Mycobacterium tuberculosis H37Rv
cgcaucgccgcugg

SEQ ID NO: 1276801 - RNA, 21 nt, Mycobacterium tuberculosis H37Rv
cgcaucgccuccucgacgucg

SEQ ID NO: 1276802 - RNA, 13 nt, Mycobacterium tuberculosis H37Rv
cgcaucgccacca

SEQ ID NO: 1276803 - RNA, 23 nt, Mycobacterium tuberculosis H37Rv
cgcauccgguuuggucgccgcgu

SEQ ID NO: 1276804 - RNA, 18 nt, Mycobacterium tuberculosis H37Rv
cgcauccggucucggccg

SEQ ID NO: 1276805 - RNA, 15 nt, Mycobacterium tuberculosis H37Rv
cgcauccgacacccg

SEQ ID NO: 1276806 - RNA, 16 nt, Mycobacterium tuberculosis H37Rv
cgcauccgcgguuggc

SEQ ID NO: 1276807 - RNA, 14 nt, Mycobacterium tuberculosis H37Rv
cgcauccgcaccga

SEQ ID NO: 1276808 - RNA, 13 nt, Mycobacterium tuberculosis H37Rv
cgcaggcaccccg

SEQ ID NO: 1276809 - RNA, 16 nt, Mycobacterium tuberculosis H37Rv
cgcaggcacaucgcga

SEQ ID NO: 1276810 - RNA, 14 nt, Mycobacterium tuberculosis H37Rv
cgcaggaucggcgg

SEQ ID NO: 1276811 - RNA, 19 nt, Mycobacterium tuberculosis H37Rv
cgcaggauucccagucgcg

SEQ ID NO: 1276812 - RNA, 19 nt, Mycobacterium tuberculosis H37Rv
cgcaggauucugcugacca

SEQ ID NO: 1276813 - RNA, 19 nt, Mycobacterium tuberculosis H37Rv
cgcaggaucacacuggccu

SEQ ID NO: 1276814 - RNA, 12 nt, Mycobacterium tuberculosis H37Rv
cgcagccgguga

SEQ ID NO: 1276815 - RNA, 18 nt, Mycobacterium tuberculosis H37Rv
cgcaggagcgcgaugacc

SEQ ID NO: 1276816 - RNA, 20 nt, Mycobacterium tuberculosis H37Rv
cgcagcgaaaacccggucgg

SEQ ID NO: 1276817 - RNA, 16 nt, Mycobacterium tuberculosis H37Rv
cgcagccugccgauga

SEQ ID NO: 1276818 - RNA, 14 nt, Mycobacterium tuberculosis H37Rv
cgcagccuucucgc

SEQ ID NO: 1276819 - RNA, 20 nt, Mycobacterium tuberculosis H37Rv
cgcaggaagcccacgaucgc

SEQ ID NO: 1276820 - RNA, 14 nt, Mycobacterium tuberculosis H37Rv
cgcagccugcagcg

SEQ ID NO: 1276821 - RNA, 16 nt, Mycobacterium tuberculosis H37Rv
cgcagccgggcaccga

SEQ ID NO: 1276822 - RNA, 20 nt, Mycobacterium tuberculosis H37Rv
cgcagccgggcaccacccuu

SEQ ID NO: 1276823 - RNA, 13 nt, Mycobacterium tuberculosis H37Rv
cgcagccgggcac

SEQ ID NO: 1276824 - RNA, 12 nt, Mycobacterium tuberculosis H37Rv
cgcagcccguga

SEQ ID NO: 1276825 - RNA, 19 nt, Mycobacterium tuberculosis H37Rv
cgcaggugcugggcgaggu

SEQ ID NO: 1276826 - RNA, 17 nt, Mycobacterium tuberculosis H37Rv
cgcaggugccuuucggc

SEQ ID NO: 1276827 - RNA, 19 nt, Mycobacterium tuberculosis H37Rv
cgcagguuggauacggugc

SEQ ID NO: 1276828 - RNA, 15 nt, Mycobacterium tuberculosis H37Rv
cgcagguucucggug

SEQ ID NO: 1276829 - RNA, 15 nt, Mycobacterium tuberculosis H37Rv
cgcaggugggcguug

SEQ ID NO: 1276830 - RNA, 14 nt, Mycobacterium tuberculosis H37Rv
cgcagggaucgcag

SEQ ID NO: 1276831 - RNA, 23 nt, Mycobacterium tuberculosis H37Rv
cgcagucuuguugcuuugcuggc

SEQ ID NO: 1276832 - RNA, 16 nt, Mycobacterium tuberculosis H37Rv
cgcaguccgcacgcgg

SEQ ID NO: 1276833 - RNA, 21 nt, Mycobacterium tuberculosis H37Rv
cgcaguauucacagucgcucg

SEQ ID NO: 1276834 - RNA, 23 nt, Mycobacterium tuberculosis H37Rv
cgcagugacguuuguuggcuguc

SEQ ID NO: 1276835 - RNA, 22 nt, Mycobacterium tuberculosis H37Rv
cgcagugacgggacccgggugg

SEQ ID NO: 1276836 - RNA, 14 nt, Mycobacterium tuberculosis H37Rv
cgcagugagcagcc

SEQ ID NO: 1276837 - RNA, 14 nt, Mycobacterium tuberculosis H37Rv
cgcagugcaccgcg

SEQ ID NO: 1276838 - RNA, 14 nt, Mycobacterium tuberculosis H37Rv
cgcagugcgcgagu

SEQ ID NO: 1276839 - RNA, 21 nt, Mycobacterium tuberculosis H37Rv
cgcauaccuuccagaucgcgg

SEQ ID NO: 1276840 - RNA, 19 nt, Mycobacterium tuberculosis H37Rv
cgcauacgcccacuccagc

SEQ ID NO: 1276841 - RNA, 19 nt, Mycobacterium tuberculosis H37Rv
cgcauaccaguaccgucau

SEQ ID NO: 1276842 - RNA, 21 nt, Mycobacterium tuberculosis H37Rv
cgcauaccuaacgagccgucc

SEQ ID NO: 1276843 - RNA, 14 nt, Mycobacterium tuberculosis H37Rv
cgcaucagcgguac

SEQ ID NO: 1276844 - RNA, 23 nt, Mycobacterium tuberculosis H37Rv
cgcaucacccgggaugaccaccg

SEQ ID NO: 1276845 - RNA, 16 nt, Mycobacterium tuberculosis H37Rv
cgcaucaggucggugg

SEQ ID NO: 1276846 - RNA, 18 nt, Mycobacterium tuberculosis H37Rv
cgccgaggucgguucggc

SEQ ID NO: 1276847 - RNA, 18 nt, Mycobacterium tuberculosis H37Rv
cgccgaggucgaaccgcc

SEQ ID NO: 1276848 - RNA, 20 nt, Mycobacterium tuberculosis H37Rv
cgccgaguauuggucggugg

SEQ ID NO: 1276849 - RNA, 12 nt, Mycobacterium tuberculosis H37Rv
cgccgaguccgg

SEQ ID NO: 1276850 - RNA, 19 nt, Mycobacterium tuberculosis H37Rv
cgccgaucggcaccguguc

SEQ ID NO: 1276851 - RNA, 21 nt, Mycobacterium tuberculosis H37Rv
cgccgaucggcaccgugucga

SEQ ID NO: 1276852 - RNA, 15 nt, Mycobacterium tuberculosis H37Rv
cgccgaugacggugu

SEQ ID NO: 1276853 - RNA, 20 nt, Mycobacterium tuberculosis H37Rv
cgccgaucgaaccgcugcuc

SEQ ID NO: 1276854 - RNA, 20 nt, Mycobacterium tuberculosis H37Rv
cgccgaugccgccggcaccg

SEQ ID NO: 1276855 - RNA, 11 nt, Mycobacterium tuberculosis H37Rv
cgccgaugccg

SEQ ID NO: 1276856 - RNA, 16 nt, Mycobacterium tuberculosis H37Rv
cgccgaugaugcggcg

SEQ ID NO: 1276857 - RNA, 21 nt, Mycobacterium tuberculosis H37Rv
cgccgaugauggacaccagcc

SEQ ID NO: 1276858 - RNA, 16 nt, Mycobacterium tuberculosis H37Rv
cgccgaugacggugua

SEQ ID NO: 1276859 - RNA, 18 nt, Mycobacterium tuberculosis H37Rv
cgccgaucgaaccgcugc

SEQ ID NO: 1276860 - RNA, 17 nt, Mycobacterium tuberculosis H37Rv
cgccgaugccaccgcuu

SEQ ID NO: 1276861 - RNA, 13 nt, Mycobacterium tuberculosis H37Rv
cgccgaugccacc

SEQ ID NO: 1276862 - RNA, 19 nt, Mycobacterium tuberculosis H37Rv
cgccgacgguuacccagcc

SEQ ID NO: 1276863 - RNA, 20 nt, Mycobacterium tuberculosis H37Rv
cgccgacguauagaccaggu

SEQ ID NO: 1276864 - RNA, 14 nt, Mycobacterium tuberculosis H37Rv
cgccgacuacgaag

SEQ ID NO: 1276865 - RNA, 12 nt, Mycobacterium tuberculosis H37Rv
cgccgacgccgu

SEQ ID NO: 1276866 - RNA, 15 nt, Mycobacterium tuberculosis H37Rv
cgccgagcuggcaac

SEQ ID NO: 1276867 - RNA, 17 nt, Mycobacterium tuberculosis H37Rv
cgccgagcggguuagcg

SEQ ID NO: 1276868 - RNA, 20 nt, Mycobacterium tuberculosis H37Rv
cgccgagcgugaagucacgg

SEQ ID NO: 1276869 - RNA, 20 nt, Mycobacterium tuberculosis H37Rv
cgccgagcgccaguucgcgg

SEQ ID NO: 1276870 - RNA, 16 nt, Mycobacterium tuberculosis H37Rv
cgccgagcgcaacucc

SEQ ID NO: 1276871 - RNA, 22 nt, Mycobacterium tuberculosis H37Rv
cgccgagcggaccaccgcucgc

SEQ ID NO: 1276872 - RNA, 17 nt, Mycobacterium tuberculosis H37Rv
cgccgagcggaccaccg

SEQ ID NO: 1276873 - RNA, 23 nt, Mycobacterium tuberculosis H37Rv
cgccgacagccgauccgaucgca

SEQ ID NO: 1276874 - RNA, 22 nt, Mycobacterium tuberculosis H37Rv
cgccgaccagcuugaccgacca

SEQ ID NO: 1276875 - RNA, 13 nt, Mycobacterium tuberculosis H37Rv
cgccgaccaggcc

SEQ ID NO: 1276876 - RNA, 15 nt, Mycobacterium tuberculosis H37Rv
cgccgaccacccgga

SEQ ID NO: 1276877 - RNA, 14 nt, Mycobacterium tuberculosis H37Rv
cgccgaccacucga

SEQ ID NO: 1276878 - RNA, 14 nt, Mycobacterium tuberculosis H37Rv
cgccgaaugccacc

SEQ ID NO: 1276879 - RNA, 17 nt, Mycobacterium tuberculosis H37Rv
cgccgaaucugggguga

SEQ ID NO: 1276880 - RNA, 20 nt, Mycobacterium tuberculosis H37Rv
cgccgaaugccaccucgacg

SEQ ID NO: 1276881 - RNA, 11 nt, Mycobacterium tuberculosis H37Rv
cgccgacacca

SEQ ID NO: 1276882 - RNA, 18 nt, Mycobacterium tuberculosis H37Rv
cgccgacacccucgggca

SEQ ID NO: 1276883 - RNA, 17 nt, Mycobacterium tuberculosis H37Rv
cgccgacaccggcugac

SEQ ID NO: 1276884 - RNA, 16 nt, Mycobacterium tuberculosis H37Rv
cgccgaaucggcaguu

SEQ ID NO: 1276885 - RNA, 14 nt, Mycobacterium tuberculosis H37Rv
cgccgaaucggcag

SEQ ID NO: 1276886 - RNA, 13 nt, Mycobacterium tuberculosis H37Rv
cgccgaaucggca

SEQ ID NO: 1276887 - RNA, 23 nt, Mycobacterium tuberculosis H37Rv
cgccgaaucgcgggcugaccaac

SEQ ID NO: 1276888 - RNA, 22 nt, Mycobacterium tuberculosis H37Rv
cgccgaaucgcgggcugaccaa

SEQ ID NO: 1276889 - RNA, 18 nt, Mycobacterium tuberculosis H37Rv
cgccgaaguagacggugg

SEQ ID NO: 1276890 - RNA, 18 nt, Mycobacterium tuberculosis H37Rv
cgccgacgauuaccagcg

SEQ ID NO: 1276891 - RNA, 19 nt, Mycobacterium tuberculosis H37Rv
cgccgacgacuccggcaag

SEQ ID NO: 1276892 - RNA, 23 nt, Mycobacterium tuberculosis H37Rv
cgccgaccuccuccuugaaccgg

SEQ ID NO: 1276893 - RNA, 19 nt, Mycobacterium tuberculosis H37Rv
cgccgacgccgcggaguag

SEQ ID NO: 1276894 - RNA, 14 nt, Mycobacterium tuberculosis H37Rv
cgccgacggcaagg

SEQ ID NO: 1276895 - RNA, 21 nt, Mycobacterium tuberculosis H37Rv
cgccgacgccagauccuucaa

SEQ ID NO: 1276896 - RNA, 17 nt, Mycobacterium tuberculosis H37Rv
cgccgacgccagaacgu

SEQ ID NO: 1276897 - RNA, 18 nt, Mycobacterium tuberculosis H37Rv
cgccgacgccgccggcac

SEQ ID NO: 1276898 - RNA, 19 nt, Mycobacterium tuberculosis H37Rv
cgccgacccaacccgaucu

SEQ ID NO: 1276899 - RNA, 20 nt, Mycobacterium tuberculosis H37Rv
cgccgaccgacaccaccagg

SEQ ID NO: 1276900 - RNA, 18 nt, Mycobacterium tuberculosis H37Rv
cgccgacccguaccagcc

SEQ ID NO: 1276901 - RNA, 18 nt, Mycobacterium tuberculosis H37Rv
cgccgaccggagccgccg

SEQ ID NO: 1276902 - RNA, 23 nt, Mycobacterium tuberculosis H37Rv
cgccgaccggcccgcauccgcac

SEQ ID NO: 1276903 - RNA, 16 nt, Mycobacterium tuberculosis H37Rv
cgccgaccgcgccgca

SEQ ID NO: 1276904 - RNA, 17 nt, Mycobacterium tuberculosis H37Rv
cgcccggucgagccagc

SEQ ID NO: 1276905 - RNA, 20 nt, Mycobacterium tuberculosis H37Rv
cgcccgguucagcgcuggca

SEQ ID NO: 1276906 - RNA, 15 nt, Mycobacterium tuberculosis H37Rv
cgcccgguugaccgc

SEQ ID NO: 1276907 - RNA, 17 nt, Mycobacterium tuberculosis H37Rv
cgcccguaucggcuucg

SEQ ID NO: 1276908 - RNA, 16 nt, Mycobacterium tuberculosis H37Rv
cgcccgucuuccagcc

SEQ ID NO: 1276909 - RNA, 19 nt, Mycobacterium tuberculosis H37Rv
cgcccuagcuggugcgccc

SEQ ID NO: 1276910 - RNA, 21 nt, Mycobacterium tuberculosis H37Rv
cgcccucaguucacguucggc

SEQ ID NO: 1276911 - RNA, 13 nt, Mycobacterium tuberculosis H37Rv
cgcccgugccgcc

SEQ ID NO: 1276912 - RNA, 15 nt, Mycobacterium tuberculosis H37Rv
cgcccgugaucacca

SEQ ID NO: 1276913 - RNA, 21 nt, Mycobacterium tuberculosis H37Rv
cgcccguggcggugagccgcc

SEQ ID NO: 1276914 - RNA, 16 nt, Mycobacterium tuberculosis H37Rv
cgcccucgaucgccac

SEQ ID NO: 1276915 - RNA, 23 nt, Mycobacterium tuberculosis H37Rv
cgcccugacacccaucgaccgcc

SEQ ID NO: 1276916 - RNA, 18 nt, Mycobacterium tuberculosis H37Rv
cgcccugaccgcccgcac

SEQ ID NO: 1276917 - RNA, 18 nt, Mycobacterium tuberculosis H37Rv
cgcccucucacggcggua

SEQ ID NO: 1276918 - RNA, 16 nt, Mycobacterium tuberculosis H37Rv
cgcccucgucgaucgc

SEQ ID NO: 1276919 - RNA, 12 nt, Mycobacterium tuberculosis H37Rv
cgcccugcggau

SEQ ID NO: 1276920 - RNA, 20 nt, Mycobacterium tuberculosis H37Rv
cgcccugagaacacguucgg

SEQ ID NO: 1276921 - RNA, 20 nt, Mycobacterium tuberculosis H37Rv
cgcccugacgguggugaccg

SEQ ID NO: 1276922 - RNA, 22 nt, Mycobacterium tuberculosis H37Rv
cgccgaagcucaucgccgcuac

SEQ ID NO: 1276923 - RNA, 17 nt, Mycobacterium tuberculosis H37Rv
cgccgaacgcgagguuc

SEQ ID NO: 1276924 - RNA, 17 nt, Mycobacterium tuberculosis H37Rv
cgccgaaaucggccagc

SEQ ID NO: 1276925 - RNA, 16 nt, Mycobacterium tuberculosis H37Rv
cgccgaaaucggccag

SEQ ID NO: 1276926 - RNA, 18 nt, Mycobacterium tuberculosis H37Rv
cgccgaaaucggccagcu

SEQ ID NO: 1276927 - RNA, 18 nt, Mycobacterium tuberculosis H37Rv
cgccgaaacucaccagca

SEQ ID NO: 1276928 - RNA, 13 nt, Mycobacterium tuberculosis H37Rv
cgccgaaaccgcc

SEQ ID NO: 1276929 - RNA, 14 nt, Mycobacterium tuberculosis H37Rv
cgccgaaaccgccg

SEQ ID NO: 1276930 - RNA, 18 nt, Mycobacterium tuberculosis H37Rv
cgccgaaagggucgacgu

SEQ ID NO: 1276931 - RNA, 23 nt, Mycobacterium tuberculosis H37Rv
cgccgaaacagcacccagacgau

SEQ ID NO: 1276932 - RNA, 19 nt, Mycobacterium tuberculosis H37Rv
cgccgaacaccgagugcgg

SEQ ID NO: 1276933 - RNA, 23 nt, Mycobacterium tuberculosis H37Rv
cgcccugggcgccggcguccgga

SEQ ID NO: 1276934 - RNA, 13 nt, Mycobacterium tuberculosis H37Rv
cgcccuguucggc

SEQ ID NO: 1276935 - RNA, 15 nt, Mycobacterium tuberculosis H37Rv
cgcccuggacgucgg

SEQ ID NO: 1276936 - RNA, 13 nt, Mycobacterium tuberculosis H37Rv
cgcccuggcaacg

SEQ ID NO: 1276937 - RNA, 18 nt, Mycobacterium tuberculosis H37Rv
cgcccuuagggucgccgc

SEQ ID NO: 1276938 - RNA, 22 nt, Mycobacterium tuberculosis H37Rv
cgccgaaaaugccgcccagcga

SEQ ID NO: 1276939 - RNA, 19 nt, Mycobacterium tuberculosis H37Rv
cgccgaaaaccucgaaacc

SEQ ID NO: 1276940 - RNA, 16 nt, Mycobacterium tuberculosis H37Rv
cgccgaaaacaacccg

SEQ ID NO: 1276941 - RNA, 16 nt, Mycobacterium tuberculosis H37Rv
cgcccuugccgccagc

SEQ ID NO: 1276942 - RNA, 13 nt, Mycobacterium tuberculosis H37Rv
cgcccuugccgcc

SEQ ID NO: 1276943 - RNA, 14 nt, Mycobacterium tuberculosis H37Rv
cgcccgacacccgu

SEQ ID NO: 1276944 - RNA, 21 nt, Mycobacterium tuberculosis H37Rv
cgcccgaagaaugggauggca

SEQ ID NO: 1276945 - RNA, 20 nt, Mycobacterium tuberculosis H37Rv
cgccccucacguggacugac

SEQ ID NO: 1276946 - RNA, 22 nt, Mycobacterium tuberculosis H37Rv
cgccccguugugucaccggcgu

SEQ ID NO: 1276947 - RNA, 12 nt, Mycobacterium tuberculosis H37Rv
cgccccgguugg

SEQ ID NO: 1276948 - RNA, 12 nt, Mycobacterium tuberculosis H37Rv
cgccccgcguug

SEQ ID NO: 1276949 - RNA, 18 nt, Mycobacterium tuberculosis H37Rv
cgccccgaucggugacgc

SEQ ID NO: 1276950 - RNA, 14 nt, Mycobacterium tuberculosis H37Rv
cgccccgaucggug

SEQ ID NO: 1276951 - RNA, 19 nt, Mycobacterium tuberculosis H37Rv
cgccccgaugaccgccuug

SEQ ID NO: 1276952 - RNA, 16 nt, Mycobacterium tuberculosis H37Rv
cgccccgaugaccgcc

SEQ ID NO: 1276953 - RNA, 15 nt, Mycobacterium tuberculosis H37Rv
cgccccccacggccc

SEQ ID NO: 1276954 - RNA, 13 nt, Mycobacterium tuberculosis H37Rv
cgccccaugauga

SEQ ID NO: 1276955 - RNA, 20 nt, Mycobacterium tuberculosis H37Rv
cgcccccagcagcugcgaua

SEQ ID NO: 1276956 - RNA, 16 nt, Mycobacterium tuberculosis H37Rv
cgccccaguucgacgg

SEQ ID NO: 1276957 - RNA, 20 nt, Mycobacterium tuberculosis H37Rv
cgcccccguuaccgccgucg

SEQ ID NO: 1276958 - RNA, 20 nt, Mycobacterium tuberculosis H37Rv
cgcccaugcugacacgacau

SEQ ID NO: 1276959 - RNA, 20 nt, Mycobacterium tuberculosis H37Rv
cgccccagggggcgugccgc

SEQ ID NO: 1276960 - RNA, 14 nt, Mycobacterium tuberculosis H37Rv
cgccaccgcgguca

SEQ ID NO: 1276961 - RNA, 16 nt, Mycobacterium tuberculosis H37Rv
cgccaccgcugucgau

SEQ ID NO: 1276962 - RNA, 16 nt, Mycobacterium tuberculosis H37Rv
cgccaccgauggcggu

SEQ ID NO: 1276963 - RNA, 17 nt, Mycobacterium tuberculosis H37Rv
cgcccagcgaccgcugc

SEQ ID NO: 1276964 - RNA, 17 nt, Mycobacterium tuberculosis H37Rv
cgcccagccgcagcacc

SEQ ID NO: 1276965 - RNA, 16 nt, Mycobacterium tuberculosis H37Rv
cgccaccggcaccgcc

SEQ ID NO: 1276966 - RNA, 12 nt, Mycobacterium tuberculosis H37Rv
cgccaccggcac

SEQ ID NO: 1276967 - RNA, 21 nt, Mycobacterium tuberculosis H37Rv
cgccacccgaaugccuucgau

SEQ ID NO: 1276968 - RNA, 16 nt, Mycobacterium tuberculosis H37Rv
cgcccagcucgauacc

SEQ ID NO: 1276969 - RNA, 18 nt, Mycobacterium tuberculosis H37Rv
cgcccagugaaucggacc

SEQ ID NO: 1276970 - RNA, 12 nt, Mycobacterium tuberculosis H37Rv
cgcccagcgucu

SEQ ID NO: 1276971 - RNA, 19 nt, Mycobacterium tuberculosis H37Rv
cgcccggacccaaagcacu

SEQ ID NO: 1276972 - RNA, 19 nt, Mycobacterium tuberculosis H37Rv
cgcccggccaggucgacac

SEQ ID NO: 1276973 - RNA, 19 nt, Mycobacterium tuberculosis H37Rv
cgcccggcccgccaccccg

SEQ ID NO: 1276974 - RNA, 20 nt, Mycobacterium tuberculosis H37Rv
cgcccggcccggcucggugc

SEQ ID NO: 1276975 - RNA, 15 nt, Mycobacterium tuberculosis H37Rv
cgcccgcuccgccgu

SEQ ID NO: 1276976 - RNA, 21 nt, Mycobacterium tuberculosis H37Rv
cgcccggaaaggccgcgguga

SEQ ID NO: 1276977 - RNA, 23 nt, Mycobacterium tuberculosis H37Rv
cgcccgcgugacgcuuggccaau

SEQ ID NO: 1276978 - RNA, 20 nt, Mycobacterium tuberculosis H37Rv
cgcccgcuacggcagcccgu

SEQ ID NO: 1276979 - RNA, 17 nt, Mycobacterium tuberculosis H37Rv
cgcccgcuacggcagcc

SEQ ID NO: 1276980 - RNA, 18 nt, Mycobacterium tuberculosis H37Rv
cgcccgcuccuccggcac

SEQ ID NO: 1276981 - RNA, 13 nt, Mycobacterium tuberculosis H37Rv
cgcccggucacgc

SEQ ID NO: 1276982 - RNA, 17 nt, Mycobacterium tuberculosis H37Rv
cgcccgggcggaacgcc

SEQ ID NO: 1276983 - RNA, 21 nt, Mycobacterium tuberculosis H37Rv
cgcccgggcggcgucggugag

SEQ ID NO: 1276984 - RNA, 13 nt, Mycobacterium tuberculosis H37Rv
cgcccgggcggga

SEQ ID NO: 1276985 - RNA, 18 nt, Mycobacterium tuberculosis H37Rv
cgcccggcgcuagcgccg

SEQ ID NO: 1276986 - RNA, 20 nt, Mycobacterium tuberculosis H37Rv
cgcccgcaauuguucgcggc

SEQ ID NO: 1276987 - RNA, 15 nt, Mycobacterium tuberculosis H37Rv
cgcccgcacccauga

SEQ ID NO: 1276988 - RNA, 22 nt, Mycobacterium tuberculosis H37Rv
cgcccgcacccccgacaccgcc

SEQ ID NO: 1276989 - RNA, 23 nt, Mycobacterium tuberculosis H37Rv
cgcccgcaccguggacaccuggc

SEQ ID NO: 1276990 - RNA, 14 nt, Mycobacterium tuberculosis H37Rv
cgcccgcacccaug

SEQ ID NO: 1276991 - RNA, 22 nt, Mycobacterium tuberculosis H37Rv
cgcccgcaccagcugucgggca

SEQ ID NO: 1276992 - RNA, 23 nt, Mycobacterium tuberculosis H37Rv
cgcccgcaucgcggcaucgacgc

SEQ ID NO: 1276993 - RNA, 17 nt, Mycobacterium tuberculosis H37Rv
cgcccgccaggccguug

SEQ ID NO: 1276994 - RNA, 15 nt, Mycobacterium tuberculosis H37Rv
cgcccgauacgccac

SEQ ID NO: 1276995 - RNA, 19 nt, Mycobacterium tuberculosis H37Rv
cgcccgaguuguggacgcc

SEQ ID NO: 1276996 - RNA, 19 nt, Mycobacterium tuberculosis H37Rv
cgcccgagucucgucgggu

SEQ ID NO: 1276997 - RNA, 22 nt, Mycobacterium tuberculosis H37Rv
cgcccgaggcacccgugccgcc

SEQ ID NO: 1276998 - RNA, 18 nt, Mycobacterium tuberculosis H37Rv
cgcccgagaccggcaccg

SEQ ID NO: 1276999 - RNA, 22 nt, Mycobacterium tuberculosis H37Rv
cgcccgacgaggaugucgauga

SEQ ID NO: 1277000 - RNA, 23 nt, Mycobacterium tuberculosis H37Rv
cgcccgacgaugugcacggugug

SEQ ID NO: 1277001 - RNA, 16 nt, Mycobacterium tuberculosis H37Rv
cgcccgcccggacgca

SEQ ID NO: 1277002 - RNA, 18 nt, Mycobacterium tuberculosis H37Rv
cgcccgcccaccucgauc

SEQ ID NO: 1277003 - RNA, 20 nt, Mycobacterium tuberculosis H37Rv
cgcccgccucgaccgccagc

SEQ ID NO: 1277004 - RNA, 19 nt, Mycobacterium tuberculosis H37Rv
cgcccgccucgaccgccag

SEQ ID NO: 1277005 - RNA, 17 nt, Mycobacterium tuberculosis H37Rv
cgcccgccucgaccgcc

SEQ ID NO: 1277006 - RNA, 17 nt, Mycobacterium tuberculosis H37Rv
cgcccgccugcaggaug

SEQ ID NO: 1277007 - RNA, 14 nt, Mycobacterium tuberculosis H37Rv
cgcccgccggcaac

SEQ ID NO: 1277008 - RNA, 17 nt, Mycobacterium tuberculosis H37Rv
cgcccgcgccgccggac

SEQ ID NO: 1277009 - RNA, 22 nt, Mycobacterium tuberculosis H37Rv
cgcccgcgccaccagcaccgcc

SEQ ID NO: 1277010 - RNA, 22 nt, Mycobacterium tuberculosis H37Rv
cgcccgcgagcuguaggucagc

SEQ ID NO: 1277011 - RNA, 21 nt, Mycobacterium tuberculosis H37Rv
cgcccgccuucauuacccguu

SEQ ID NO: 1277012 - RNA, 17 nt, Mycobacterium tuberculosis H37Rv
cgcccgccuucgaucau

SEQ ID NO: 1277013 - RNA, 24 nt, Mycobacterium tuberculosis H37Rv
cgcccgcgagagaguucgcaugcu

SEQ ID NO: 1277014 - RNA, 16 nt, Mycobacterium tuberculosis H37Rv
cgccgcgcguucggcg

SEQ ID NO: 1277015 - RNA, 21 nt, Mycobacterium tuberculosis H37Rv
cgccgcgcguucggcgcugau

SEQ ID NO: 1277016 - RNA, 14 nt, Mycobacterium tuberculosis H37Rv
cgccgcgcucgacg

SEQ ID NO: 1277017 - RNA, 14 nt, Mycobacterium tuberculosis H37Rv
cgccgcgcggcuug

SEQ ID NO: 1277018 - RNA, 13 nt, Mycobacterium tuberculosis H37Rv
cgccgcgcgugac

SEQ ID NO: 1277019 - RNA, 13 nt, Mycobacterium tuberculosis H37Rv
cgccgcgcgucgc

SEQ ID NO: 1277020 - RNA, 12 nt, Mycobacterium tuberculosis H37Rv
cgccgcgcgggu

SEQ ID NO: 1277021 - RNA, 20 nt, Mycobacterium tuberculosis H37Rv
cgccgcgcccggcgcuagcg

SEQ ID NO: 1277022 - RNA, 16 nt, Mycobacterium tuberculosis H37Rv
cgccgcggcggcagcg

SEQ ID NO: 1277023 - RNA, 14 nt, Mycobacterium tuberculosis H37Rv
cgccgcggccaggu

SEQ ID NO: 1277024 - RNA, 21 nt, Mycobacterium tuberculosis H37Rv
cgccgcggcuugucgccccau

SEQ ID NO: 1277025 - RNA, 16 nt, Mycobacterium tuberculosis H37Rv
cgccgcguggcuggcg

SEQ ID NO: 1277026 - RNA, 20 nt, Mycobacterium tuberculosis H37Rv
cgccgcgucauucaccgcgu

SEQ ID NO: 1277027 - RNA, 21 nt, Mycobacterium tuberculosis H37Rv
cgccgcggucgugaucagcag

SEQ ID NO: 1277028 - RNA, 15 nt, Mycobacterium tuberculosis H37Rv
cgccgcggucggacc

SEQ ID NO: 1277029 - RNA, 23 nt, Mycobacterium tuberculosis H37Rv
cgccgaugggaaccgaaucggca

SEQ ID NO: 1277030 - RNA, 18 nt, Mycobacterium tuberculosis H37Rv
cgccgauguagacggugg

SEQ ID NO: 1277031 - RNA, 14 nt, Mycobacterium tuberculosis H37Rv
cgccgauggccgca

SEQ ID NO: 1277032 - RNA, 14 nt, Mycobacterium tuberculosis H37Rv
cgccgccgccgggu

SEQ ID NO: 1277033 - RNA, 15 nt, Mycobacterium tuberculosis H37Rv
cgccgccgccgacga

SEQ ID NO: 1277034 - RNA, 14 nt, Mycobacterium tuberculosis H37Rv
cgccgccgcccgua

SEQ ID NO: 1277035 - RNA, 20 nt, Mycobacterium tuberculosis H37Rv
cgccgccggugccaccgacg

SEQ ID NO: 1277036 - RNA, 20 nt, Mycobacterium tuberculosis H37Rv
cgccgccgguguaacccucg

SEQ ID NO: 1277037 - RNA, 22 nt, Mycobacterium tuberculosis H37Rv
cgccgccggugucgggcuguca

SEQ ID NO: 1277038 - RNA, 22 nt, Mycobacterium tuberculosis H37Rv
cgccgccgggucgaacgcaugc

SEQ ID NO: 1277039 - RNA, 22 nt, Mycobacterium tuberculosis H37Rv
cgccgccggacccaccgucacc

SEQ ID NO: 1277040 - RNA, 21 nt, Mycobacterium tuberculosis H37Rv
cgccgccgcuguugaucgaca

SEQ ID NO: 1277041 - RNA, 16 nt, Mycobacterium tuberculosis H37Rv
cgccgccggaucgccg

SEQ ID NO: 1277042 - RNA, 12 nt, Mycobacterium tuberculosis H37Rv
cgccgccucguc

SEQ ID NO: 1277043 - RNA, 14 nt, Mycobacterium tuberculosis H37Rv
cgccgccucgucgu

SEQ ID NO: 1277044 - RNA, 16 nt, Mycobacterium tuberculosis H37Rv
cgccgccucgucgucg

SEQ ID NO: 1277045 - RNA, 18 nt, Mycobacterium tuberculosis H37Rv
cgccgccucgucgucgga

SEQ ID NO: 1277046 - RNA, 17 nt, Mycobacterium tuberculosis H37Rv
cgccgcgaugacggugc

SEQ ID NO: 1277047 - RNA, 13 nt, Mycobacterium tuberculosis H37Rv
cgccgcgauggcg

SEQ ID NO: 1277048 - RNA, 16 nt, Mycobacterium tuberculosis H37Rv
cgccgccucgggcacc

SEQ ID NO: 1277049 - RNA, 20 nt, Mycobacterium tuberculosis H37Rv
cgccgccguugccgccagcg

SEQ ID NO: 1277050 - RNA, 16 nt, Mycobacterium tuberculosis H37Rv
cgccgccguugccgau

SEQ ID NO: 1277051 - RNA, 14 nt, Mycobacterium tuberculosis H37Rv
cgccgccgucgggu

SEQ ID NO: 1277052 - RNA, 16 nt, Mycobacterium tuberculosis H37Rv
cgccggcuccgccacu

SEQ ID NO: 1277053 - RNA, 15 nt, Mycobacterium tuberculosis H37Rv
cgccggcuccgccag

SEQ ID NO: 1277054 - RNA, 21 nt, Mycobacterium tuberculosis H37Rv
cgccggcuccgccacuggcgc

SEQ ID NO: 1277055 - RNA, 23 nt, Mycobacterium tuberculosis H37Rv
cgccggcuucgcccagagccgcu

SEQ ID NO: 1277056 - RNA, 22 nt, Mycobacterium tuberculosis H37Rv
cgccggcuucggguguucgcgc

SEQ ID NO: 1277057 - RNA, 13 nt, Mycobacterium tuberculosis H37Rv
cgccggcugccac

SEQ ID NO: 1277058 - RNA, 16 nt, Mycobacterium tuberculosis H37Rv
cgccggcugcgccagu

SEQ ID NO: 1277059 - RNA, 15 nt, Mycobacterium tuberculosis H37Rv
cgccggcgucgagcc

SEQ ID NO: 1277060 - RNA, 15 nt, Mycobacterium tuberculosis H37Rv
cgccggcgccgccgu

SEQ ID NO: 1277061 - RNA, 16 nt, Mycobacterium tuberculosis H37Rv
cgccggcgggacgggg

SEQ ID NO: 1277062 - RNA, 13 nt, Mycobacterium tuberculosis H37Rv
aacaccgacgaca

SEQ ID NO: 1277063 - RNA, 18 nt, Mycobacterium tuberculosis H37Rv
cgccggcggccaccagug

SEQ ID NO: 1277064 - RNA, 21 nt, Mycobacterium tuberculosis H37Rv
cgccggcggccaccagugcgg

SEQ ID NO: 1277065 - RNA, 15 nt, Mycobacterium tuberculosis H37Rv
cgccggcgccgccau

SEQ ID NO: 1277066 - RNA, 22 nt, Mycobacterium tuberculosis H37Rv
cgccggcgccagcgccgccacc

SEQ ID NO: 1277067 - RNA, 14 nt, Mycobacterium tuberculosis H37Rv
cgccggcgcccagg

SEQ ID NO: 1277068 - RNA, 13 nt, Mycobacterium tuberculosis H37Rv
cgccggcgccacc

SEQ ID NO: 1277069 - RNA, 14 nt, Mycobacterium tuberculosis H37Rv
cgccggcgccaccg

SEQ ID NO: 1277070 - RNA, 13 nt, Mycobacterium tuberculosis H37Rv
cgccggccgcagu

SEQ ID NO: 1277071 - RNA, 15 nt, Mycobacterium tuberculosis H37Rv
cgccggccaguucgg

SEQ ID NO: 1277072 - RNA, 20 nt, Mycobacterium tuberculosis H37Rv
cgccggccauaccgcucgcc

SEQ ID NO: 1277073 - RNA, 19 nt, Mycobacterium tuberculosis H37Rv
cgccgcuaacgcaccugcg

SEQ ID NO: 1277074 - RNA, 15 nt, Mycobacterium tuberculosis H37Rv
cgccgcuaacgcacc

SEQ ID NO: 1277075 - RNA, 16 nt, Mycobacterium tuberculosis H37Rv
cgccgcuaacgcaccu

SEQ ID NO: 1277076 - RNA, 20 nt, Mycobacterium tuberculosis H37Rv
cgccgcgugguuccggcgug

SEQ ID NO: 1277077 - RNA, 16 nt, Mycobacterium tuberculosis H37Rv
cgccgcgucuaccaac

SEQ ID NO: 1277078 - RNA, 17 nt, Mycobacterium tuberculosis H37Rv
cgccggaccccgagacc

SEQ ID NO: 1277079 - RNA, 14 nt, Mycobacterium tuberculosis H37Rv
cgccggagaugauc

SEQ ID NO: 1277080 - RNA, 16 nt, Mycobacterium tuberculosis H37Rv
cgccggccagcgucgc

SEQ ID NO: 1277081 - RNA, 22 nt, Mycobacterium tuberculosis H37Rv
cgccggccagcggccauccggc

SEQ ID NO: 1277082 - RNA, 20 nt, Mycobacterium tuberculosis H37Rv
cgccggcaacaucgagcgcc

SEQ ID NO: 1277083 - RNA, 18 nt, Mycobacterium tuberculosis H37Rv
cgccggccacccgcgcga

SEQ ID NO: 1277084 - RNA, 22 nt, Mycobacterium tuberculosis H37Rv
cgccggcaucuccaccgucgcc

SEQ ID NO: 1277085 - RNA, 16 nt, Mycobacterium tuberculosis H37Rv
cgccggcaucuccacc

SEQ ID NO: 1277086 - RNA, 16 nt, Mycobacterium tuberculosis H37Rv
cgccggcaugccagcc

SEQ ID NO: 1277087 - RNA, 15 nt, Mycobacterium tuberculosis H37Rv
cgccggcaucgcgca

SEQ ID NO: 1277088 - RNA, 16 nt, Mycobacterium tuberculosis H37Rv
cgccggcaccgccggu

SEQ ID NO: 1277089 - RNA, 14 nt, Mycobacterium tuberculosis H37Rv
cgccggcaccgccg

SEQ ID NO: 1277090 - RNA, 11 nt, Mycobacterium tuberculosis H37Rv
cgccggcaccg

SEQ ID NO: 1277091 - RNA, 23 nt, Mycobacterium tuberculosis H37Rv
cgccggcaauaccgccagcgcca

SEQ ID NO: 1277092 - RNA, 17 nt, Mycobacterium tuberculosis H37Rv
cgccggcaacccagugu

SEQ ID NO: 1277093 - RNA, 17 nt, Mycobacterium tuberculosis H37Rv
cgccggauucgaugaca

SEQ ID NO: 1277094 - RNA, 16 nt, Mycobacterium tuberculosis H37Rv
cgccgggcaucggcgg

SEQ ID NO: 1277095 - RNA, 14 nt, Mycobacterium tuberculosis H37Rv
cgccgggcacgaac

SEQ ID NO: 1277096 - RNA, 16 nt, Mycobacterium tuberculosis H37Rv
cgccgggaacauccca

SEQ ID NO: 1277097 - RNA, 20 nt, Mycobacterium tuberculosis H37Rv
cgccgggaacaucccagcga

SEQ ID NO: 1277098 - RNA, 15 nt, Mycobacterium tuberculosis H37Rv
cgccgggcaacgcga

SEQ ID NO: 1277099 - RNA, 15 nt, Mycobacterium tuberculosis H37Rv
cgccggucggaucgg

SEQ ID NO: 1277100 - RNA, 12 nt, Mycobacterium tuberculosis H37Rv
cgccggugacga

SEQ ID NO: 1277101 - RNA, 13 nt, Mycobacterium tuberculosis H37Rv
cgccggucggugc

SEQ ID NO: 1277102 - RNA, 20 nt, Mycobacterium tuberculosis H37Rv
cgccggugcgcuggaucuuc

SEQ ID NO: 1277103 - RNA, 17 nt, Mycobacterium tuberculosis H37Rv
cgccggugcgcgcugac

SEQ ID NO: 1277104 - RNA, 23 nt, Mycobacterium tuberculosis H37Rv
cgccggugacgggguugaccgcc

SEQ ID NO: 1277105 - RNA, 17 nt, Mycobacterium tuberculosis H37Rv
cgccggugacgacgucg

SEQ ID NO: 1277106 - RNA, 16 nt, Mycobacterium tuberculosis H37Rv
cgccggugccgccugc

SEQ ID NO: 1277107 - RNA, 17 nt, Mycobacterium tuberculosis H37Rv
cgccggugccgccggug

SEQ ID NO: 1277108 - RNA, 18 nt, Mycobacterium tuberculosis H37Rv
cgccgguggggucggucu

SEQ ID NO: 1277109 - RNA, 21 nt, Mycobacterium tuberculosis H37Rv
cgccggugggcgguccgcguc

SEQ ID NO: 1277110 - RNA, 14 nt, Mycobacterium tuberculosis H37Rv
cgccgguggucacg

SEQ ID NO: 1277111 - RNA, 16 nt, Mycobacterium tuberculosis H37Rv
cgccgguggcacggcc

SEQ ID NO: 1277112 - RNA, 17 nt, Mycobacterium tuberculosis H37Rv
cgccgguggcacccgcg

SEQ ID NO: 1277113 - RNA, 21 nt, Mycobacterium tuberculosis H37Rv
cgccgguggcagagccgccgu

SEQ ID NO: 1277114 - RNA, 14 nt, Mycobacterium tuberculosis H37Rv
cgccgguggccgcg

SEQ ID NO: 1277115 - RNA, 14 nt, Mycobacterium tuberculosis H37Rv
cgccgguucagacg

SEQ ID NO: 1277116 - RNA, 18 nt, Mycobacterium tuberculosis H37Rv
cgccggugucguucggcg

SEQ ID NO: 1277117 - RNA, 17 nt, Mycobacterium tuberculosis H37Rv
cgccgucagcccaggug

SEQ ID NO: 1277118 - RNA, 18 nt, Mycobacterium tuberculosis H37Rv
cgccgucagcggccaagu

SEQ ID NO: 1277119 - RNA, 15 nt, Mycobacterium tuberculosis H37Rv
cgccgucagcccagg

SEQ ID NO: 1277120 - RNA, 11 nt, Mycobacterium tuberculosis H37Rv
cgccgucagcc

SEQ ID NO: 1277121 - RNA, 19 nt, Mycobacterium tuberculosis H37Rv
cgccgucaccgaucgaaca

SEQ ID NO: 1277122 - RNA, 15 nt, Mycobacterium tuberculosis H37Rv
cgccgucacggcagu

SEQ ID NO: 1277123 - RNA, 16 nt, Mycobacterium tuberculosis H37Rv
cgccgucaccgccgac

SEQ ID NO: 1277124 - RNA, 15 nt, Mycobacterium tuberculosis H37Rv
cgccgucaccgccgu

SEQ ID NO: 1277125 - RNA, 16 nt, Mycobacterium tuberculosis H37Rv
cgccgucagaacaccg

SEQ ID NO: 1277126 - RNA, 22 nt, Mycobacterium tuberculosis H37Rv
cgccgucaccgccauugccacc

SEQ ID NO: 1277127 - RNA, 13 nt, Mycobacterium tuberculosis H37Rv
cgccgguucccga

SEQ ID NO: 1277128 - RNA, 17 nt, Mycobacterium tuberculosis H37Rv
cgccgugaucagcucgc

SEQ ID NO: 1277129 - RNA, 18 nt, Mycobacterium tuberculosis H37Rv
cgccguggugcgcauggc

SEQ ID NO: 1277130 - RNA, 22 nt, Mycobacterium tuberculosis H37Rv
cgccgugguugcacguucggcg

SEQ ID NO: 1277131 - RNA, 19 nt, Mycobacterium tuberculosis H37Rv
cgccgugguugcacguucg

SEQ ID NO: 1277132 - RNA, 17 nt, Mycobacterium tuberculosis H37Rv
cgccguggugcgcaugg

SEQ ID NO: 1277133 - RNA, 14 nt, Mycobacterium tuberculosis H37Rv
cgccguggccugaa

SEQ ID NO: 1277134 - RNA, 15 nt, Mycobacterium tuberculosis H37Rv
cgccgugcugcggcg

SEQ ID NO: 1277135 - RNA, 23 nt, Mycobacterium tuberculosis H37Rv
cgccgugaccaggugccaggaug

SEQ ID NO: 1277136 - RNA, 15 nt, Mycobacterium tuberculosis H37Rv
cgccgucucgaagcu

SEQ ID NO: 1277137 - RNA, 22 nt, Mycobacterium tuberculosis H37Rv
cgccgucucgcggugcggcaac

SEQ ID NO: 1277138 - RNA, 15 nt, Mycobacterium tuberculosis H37Rv
cgccgucucugccac

SEQ ID NO: 1277139 - RNA, 20 nt, Mycobacterium tuberculosis H37Rv
cgccgucuagcacacgcuug

SEQ ID NO: 1277140 - RNA, 13 nt, Mycobacterium tuberculosis H37Rv
cgccgucggugcc

SEQ ID NO: 1277141 - RNA, 18 nt, Mycobacterium tuberculosis H37Rv
cgccgucgaccggcggga

SEQ ID NO: 1277142 - RNA, 13 nt, Mycobacterium tuberculosis H37Rv
cgccgucggcgcg

SEQ ID NO: 1277143 - RNA, 12 nt, Mycobacterium tuberculosis H37Rv
cgccgucgacgu

SEQ ID NO: 1277144 - RNA, 15 nt, Mycobacterium tuberculosis H37Rv
cgccgucgaccggcg

SEQ ID NO: 1277145 - RNA, 12 nt, Mycobacterium tuberculosis H37Rv
cgccgucgaacc

SEQ ID NO: 1277146 - RNA, 18 nt, Mycobacterium tuberculosis H37Rv
cgccuauccaaagacccc

SEQ ID NO: 1277147 - RNA, 19 nt, Mycobacterium tuberculosis H37Rv
cgccuaggaguuccucgau

SEQ ID NO: 1277148 - RNA, 13 nt, Mycobacterium tuberculosis H37Rv
cgccucgauaucg

SEQ ID NO: 1277149 - RNA, 20 nt, Mycobacterium tuberculosis H37Rv
cgccucgagguauucgcgca

SEQ ID NO: 1277150 - RNA, 22 nt, Mycobacterium tuberculosis H37Rv
cgccugaauaggucgguccgca

SEQ ID NO: 1277151 - RNA, 21 nt, Mycobacterium tuberculosis H37Rv
cgccugaaacgauugcugcgg

SEQ ID NO: 1277152 - RNA, 19 nt, Mycobacterium tuberculosis H37Rv
cgccucggcggccagcucg

SEQ ID NO: 1277153 - RNA, 17 nt, Mycobacterium tuberculosis H37Rv
cgccucggcaucgccgc

SEQ ID NO: 1277154 - RNA, 21 nt, Mycobacterium tuberculosis H37Rv
cgccugacgaaguccaccacg

SEQ ID NO: 1277155 - RNA, 21 nt, Mycobacterium tuberculosis H37Rv
cgccucuuccuggcgugagcc

SEQ ID NO: 1277156 - RNA, 17 nt, Mycobacterium tuberculosis H37Rv
cgccugaccgccaccgu

SEQ ID NO: 1277157 - RNA, 20 nt, Mycobacterium tuberculosis H37Rv
cgccugacgguaaaugucga

SEQ ID NO: 1277158 - RNA, 23 nt, Mycobacterium tuberculosis H37Rv
cgccugacgaaguccaccacgac

SEQ ID NO: 1277159 - RNA, 15 nt, Mycobacterium tuberculosis H37Rv
cgccugccccacccg

SEQ ID NO: 1277160 - RNA, 23 nt, Mycobacterium tuberculosis H37Rv
cgccugcagguuuccggccugca

SEQ ID NO: 1277161 - RNA, 20 nt, Mycobacterium tuberculosis H37Rv
cgccuaccagcaccgggaug

SEQ ID NO: 1277162 - RNA, 22 nt, Mycobacterium tuberculosis H37Rv
aacacgccgucgaccggcggga

SEQ ID NO: 1277163 - RNA, 15 nt, Mycobacterium tuberculosis H37Rv
aacacgcguugguga

SEQ ID NO: 1277164 - RNA, 23 nt, Mycobacterium tuberculosis H37Rv
cgccguuguugaggaugacgacg

SEQ ID NO: 1277165 - RNA, 13 nt, Mycobacterium tuberculosis H37Rv
cgccguugucguc

SEQ ID NO: 1277166 - RNA, 23 nt, Mycobacterium tuberculosis H37Rv
cgccguuuggccucacccgguca

SEQ ID NO: 1277167 - RNA, 20 nt, Mycobacterium tuberculosis H37Rv
cgccguugccgccguuaccg

SEQ ID NO: 1277168 - RNA, 22 nt, Mycobacterium tuberculosis H37Rv
cgccguugccgccguugccacc

SEQ ID NO: 1277169 - RNA, 18 nt, Mycobacterium tuberculosis H37Rv
cgccguuggagacgucgc

SEQ ID NO: 1277170 - RNA, 14 nt, Mycobacterium tuberculosis H37Rv
cgccguuggcaccg

SEQ ID NO: 1277171 - RNA, 23 nt, Mycobacterium tuberculosis H37Rv
cgccguuggggccguucaaccgg

SEQ ID NO: 1277172 - RNA, 21 nt, Mycobacterium tuberculosis H37Rv
cgccguugaacggcaccagcg

SEQ ID NO: 1277173 - RNA, 15 nt, Mycobacterium tuberculosis H37Rv
cgccguugacgccgu

SEQ ID NO: 1277174 - RNA, 15 nt, Mycobacterium tuberculosis H37Rv
cgccguugaacggca

SEQ ID NO: 1277175 - RNA, 18 nt, Mycobacterium tuberculosis H37Rv
cgccguugccgccacgca

SEQ ID NO: 1277176 - RNA, 23 nt, Mycobacterium tuberculosis H37Rv
cgccguugccgccagcgccaccg

SEQ ID NO: 1277177 - RNA, 17 nt, Mycobacterium tuberculosis H37Rv
cgccguugccauugccu

SEQ ID NO: 1277178 - RNA, 15 nt, Mycobacterium tuberculosis H37Rv
cgccguugccaccgu

SEQ ID NO: 1277179 - RNA, 13 nt, Mycobacterium tuberculosis H37Rv
cgccguugccacc

SEQ ID NO: 1277180 - RNA, 15 nt, Mycobacterium tuberculosis H37Rv
cgccguugccgccgu

SEQ ID NO: 1277181 - RNA, 17 nt, Mycobacterium tuberculosis H37Rv
cgccguugccgccgccu

SEQ ID NO: 1277182 - RNA, 18 nt, Mycobacterium tuberculosis H37Rv
cgccguugccgccgucgc

SEQ ID NO: 1277183 - RNA, 17 nt, Mycobacterium tuberculosis H37Rv
cgccguugccgccguca

SEQ ID NO: 1277184 - RNA, 15 nt, Mycobacterium tuberculosis H37Rv
cgccguucucgcgca

SEQ ID NO: 1277185 - RNA, 17 nt, Mycobacterium tuberculosis H37Rv
cgccguucccacccacg

SEQ ID NO: 1277186 - RNA, 20 nt, Mycobacterium tuberculosis H37Rv
cgccguucccacccacgccg

SEQ ID NO: 1277187 - RNA, 21 nt, Mycobacterium tuberculosis H37Rv
cgccguucccacccacgccga

SEQ ID NO: 1277188 - RNA, 23 nt, Mycobacterium tuberculosis H37Rv
cgccguucccacccacgccgacu

SEQ ID NO: 1277189 - RNA, 21 nt, Mycobacterium tuberculosis H37Rv
cgccguucgcucccccgcuac

SEQ ID NO: 1277190 - RNA, 16 nt, Mycobacterium tuberculosis H37Rv
cgccguuaccgccguu

SEQ ID NO: 1277191 - RNA, 15 nt, Mycobacterium tuberculosis H37Rv
cgccguuaccgccgu

SEQ ID NO: 1277192 - RNA, 20 nt, Mycobacterium tuberculosis H37Rv
cgccguucccaccaccaccg

SEQ ID NO: 1277193 - RNA, 15 nt, Mycobacterium tuberculosis H37Rv
cgccguuccacgucg

SEQ ID NO: 1277194 - RNA, 22 nt, Mycobacterium tuberculosis H37Rv
cgccguuacggagggcacgggu

SEQ ID NO: 1277195 - RNA, 18 nt, Mycobacterium tuberculosis H37Rv
cgccguuauccgacgaac

SEQ ID NO: 1277196 - RNA, 21 nt, Mycobacterium tuberculosis H37Rv
cgccguuauccgacgaaccgg

SEQ ID NO: 1277197 - RNA, 18 nt, Mycobacterium tuberculosis H37Rv
cgcucacauacagcaggc

SEQ ID NO: 1277198 - RNA, 11 nt, Mycobacterium tuberculosis H37Rv
cgcucaucgau

SEQ ID NO: 1277199 - RNA, 21 nt, Mycobacterium tuberculosis H37Rv
cgcucaucugcgcgcggaagc

SEQ ID NO: 1277200 - RNA, 20 nt, Mycobacterium tuberculosis H37Rv
cgcuccaaaagccucagccg

SEQ ID NO: 1277201 - RNA, 24 nt, Mycobacterium tuberculosis H37Rv
cgcuccaaaagccucagccgcucg

SEQ ID NO: 1277202 - RNA, 19 nt, Mycobacterium tuberculosis H37Rv
cgcucaacgggccgcaucg

SEQ ID NO: 1277203 - RNA, 20 nt, Mycobacterium tuberculosis H37Rv
cgcuagccagggaucagccg

SEQ ID NO: 1277204 - RNA, 20 nt, Mycobacterium tuberculosis H37Rv
cgcuaggacggcugccguca

SEQ ID NO: 1277205 - RNA, 19 nt, Mycobacterium tuberculosis H37Rv
cgcguugaaggcgccggug

SEQ ID NO: 1277206 - RNA, 22 nt, Mycobacterium tuberculosis H37Rv
cgcguugagcucaauggcuucg

SEQ ID NO: 1277207 - RNA, 17 nt, Mycobacterium tuberculosis H37Rv
cgcguugccaaagccca

SEQ ID NO: 1277208 - RNA, 19 nt, Mycobacterium tuberculosis H37Rv
cgcguugcaccauucgcac

SEQ ID NO: 1277209 - RNA, 14 nt, Mycobacterium tuberculosis H37Rv
cgcgugcugcggac

SEQ ID NO: 1277210 - RNA, 21 nt, Mycobacterium tuberculosis H37Rv
cgcgugcugccguauccaggc

SEQ ID NO: 1277211 - RNA, 15 nt, Mycobacterium tuberculosis H37Rv
cgcguggaucgcgcu

SEQ ID NO: 1277212 - RNA, 12 nt, Mycobacterium tuberculosis H37Rv
cgcgucugggug

SEQ ID NO: 1277213 - RNA, 13 nt, Mycobacterium tuberculosis H37Rv
cgcgucugcucgc

SEQ ID NO: 1277214 - RNA, 14 nt, Mycobacterium tuberculosis H37Rv
cgcgucugcucggc

SEQ ID NO: 1277215 - RNA, 19 nt, Mycobacterium tuberculosis H37Rv
cgcgucucggugcagcagc

SEQ ID NO: 1277216 - RNA, 12 nt, Mycobacterium tuberculosis H37Rv
cgcgucucggug

SEQ ID NO: 1277217 - RNA, 13 nt, Mycobacterium tuberculosis H37Rv
cgcgucucgagcg

SEQ ID NO: 1277218 - RNA, 15 nt, Mycobacterium tuberculosis H37Rv
cgcgugugcgucgca

SEQ ID NO: 1277219 - RNA, 21 nt, Mycobacterium tuberculosis H37Rv
cgcguucaacaccgccgaccu

SEQ ID NO: 1277220 - RNA, 20 nt, Mycobacterium tuberculosis H37Rv
cgcguggugcugaccgcgcc

SEQ ID NO: 1277221 - RNA, 21 nt, Mycobacterium tuberculosis H37Rv
cgcguggugccuacaccggca

SEQ ID NO: 1277222 - RNA, 16 nt, Mycobacterium tuberculosis H37Rv
cgcguggucgccccga

SEQ ID NO: 1277223 - RNA, 20 nt, Mycobacterium tuberculosis H37Rv
cgcgugucugggaccccgcu

SEQ ID NO: 1277224 - RNA, 19 nt, Mycobacterium tuberculosis H37Rv
cgcguguaccgcgacguag

SEQ ID NO: 1277225 - RNA, 19 nt, Mycobacterium tuberculosis H37Rv
cgcgucaaccgaucggucg

SEQ ID NO: 1277226 - RNA, 13 nt, Mycobacterium tuberculosis H37Rv
cgcgucgccgaaa

SEQ ID NO: 1277227 - RNA, 14 nt, Mycobacterium tuberculosis H37Rv
cgcguaucccagau

SEQ ID NO: 1277228 - RNA, 22 nt, Mycobacterium tuberculosis H37Rv
cgcguaguaaugcucgacguag

SEQ ID NO: 1277229 - RNA, 13 nt, Mycobacterium tuberculosis H37Rv
cgcgucgucgaga

SEQ ID NO: 1277230 - RNA, 18 nt, Mycobacterium tuberculosis H37Rv
cgcgucgucgagucgaca

SEQ ID NO: 1277231 - RNA, 20 nt, Mycobacterium tuberculosis H37Rv
cgcgucguagcgcucgugac

SEQ ID NO: 1277232 - RNA, 22 nt, Mycobacterium tuberculosis H37Rv
cgcgucguagcgcucgugaccg

SEQ ID NO: 1277233 - RNA, 15 nt, Mycobacterium tuberculosis H37Rv
cgcgucgucccagug

SEQ ID NO: 1277234 - RNA, 15 nt, Mycobacterium tuberculosis H37Rv
cgcgucggucaccga

SEQ ID NO: 1277235 - RNA, 20 nt, Mycobacterium tuberculosis H37Rv
cgcgucggucgacuguucgg

SEQ ID NO: 1277236 - RNA, 20 nt, Mycobacterium tuberculosis H37Rv
cgcgucgcuguuggcgaagg

SEQ ID NO: 1277237 - RNA, 19 nt, Mycobacterium tuberculosis H37Rv
cgcgucgcgcgcggcaugg

SEQ ID NO: 1277238 - RNA, 22 nt, Mycobacterium tuberculosis H37Rv
cgcgucgcgaaauagcugcgga

SEQ ID NO: 1277239 - RNA, 15 nt, Mycobacterium tuberculosis H37Rv
cgcucgaucugcccg

SEQ ID NO: 1277240 - RNA, 13 nt, Mycobacterium tuberculosis H37Rv
cgcucgcacccgc

SEQ ID NO: 1277241 - RNA, 16 nt, Mycobacterium tuberculosis H37Rv
cgcucgcacagccgcu

SEQ ID NO: 1277242 - RNA, 19 nt, Mycobacterium tuberculosis H37Rv
cgcucgcccgccgccacca

SEQ ID NO: 1277243 - RNA, 22 nt, Mycobacterium tuberculosis H37Rv
cgcucgagcaggcuggcguugg

SEQ ID NO: 1277244 - RNA, 16 nt, Mycobacterium tuberculosis H37Rv
cgcucgagguggucuc

SEQ ID NO: 1277245 - RNA, 17 nt, Mycobacterium tuberculosis H37Rv
cgcucgaggguggcgcg

SEQ ID NO: 1277246 - RNA, 19 nt, Mycobacterium tuberculosis H37Rv
cgcucgaucggcagccagg

SEQ ID NO: 1277247 - RNA, 18 nt, Mycobacterium tuberculosis H37Rv
cgcucgauggauccaacc

SEQ ID NO: 1277248 - RNA, 19 nt, Mycobacterium tuberculosis H37Rv
cgcuccagcucggccagug

SEQ ID NO: 1277249 - RNA, 15 nt, Mycobacterium tuberculosis H37Rv
cgcuccagcacccgc

SEQ ID NO: 1277250 - RNA, 15 nt, Mycobacterium tuberculosis H37Rv
cgcucgcgccagguc

SEQ ID NO: 1277251 - RNA, 17 nt, Mycobacterium tuberculosis H37Rv
cgcucgcgcgcugggcg

SEQ ID NO: 1277252 - RNA, 17 nt, Mycobacterium tuberculosis H37Rv
cgcucgcggcggcgcug

SEQ ID NO: 1277253 - RNA, 15 nt, Mycobacterium tuberculosis H37Rv
cgcucgcggcgacca

SEQ ID NO: 1277254 - RNA, 15 nt, Mycobacterium tuberculosis H37Rv
cgcucgccgagcugu

SEQ ID NO: 1277255 - RNA, 22 nt, Mycobacterium tuberculosis H37Rv
cgcucgcgaaagagagcuaagu

SEQ ID NO: 1277256 - RNA, 13 nt, Mycobacterium tuberculosis H37Rv
cgcucggcagccg

SEQ ID NO: 1277257 - RNA, 17 nt, Mycobacterium tuberculosis H37Rv
cgcucggaucguacggg

SEQ ID NO: 1277258 - RNA, 18 nt, Mycobacterium tuberculosis H37Rv
cgcucggaucguacgggu

SEQ ID NO: 1277259 - RNA, 20 nt, Mycobacterium tuberculosis H37Rv
cgcucggcaaccugcgacca

SEQ ID NO: 1277260 - RNA, 15 nt, Mycobacterium tuberculosis H37Rv
cgcucgcugcagcag

SEQ ID NO: 1277261 - RNA, 15 nt, Mycobacterium tuberculosis H37Rv
cgcucggcagccggc

SEQ ID NO: 1277262 - RNA, 22 nt, Mycobacterium tuberculosis H37Rv
cgcucggcgccacggugucgcg

SEQ ID NO: 1277263 - RNA, 22 nt, Mycobacterium tuberculosis H37Rv
cgcucugugucgccgaucaccg

SEQ ID NO: 1277264 - RNA, 21 nt, Mycobacterium tuberculosis H37Rv
cgcucugugucgccgaucacc

SEQ ID NO: 1277265 - RNA, 14 nt, Mycobacterium tuberculosis H37Rv
cgcucuugcucacc

SEQ ID NO: 1277266 - RNA, 14 nt, Mycobacterium tuberculosis H37Rv
cgcugaacucaacg

SEQ ID NO: 1277267 - RNA, 16 nt, Mycobacterium tuberculosis H37Rv
cgcugaagccgcugga

SEQ ID NO: 1277268 - RNA, 22 nt, Mycobacterium tuberculosis H37Rv
cgcugaccacaaccgugagcac

SEQ ID NO: 1277269 - RNA, 19 nt, Mycobacterium tuberculosis H37Rv
cgcucggugcugcgccgau

SEQ ID NO: 1277270 - RNA, 19 nt, Mycobacterium tuberculosis H37Rv
cgcucggugaaggucaccg

SEQ ID NO: 1277271 - RNA, 22 nt, Mycobacterium tuberculosis H37Rv
cgcucggugaaggucaccgucg

SEQ ID NO: 1277272 - RNA, 14 nt, Mycobacterium tuberculosis H37Rv
cgcucggucgccac

SEQ ID NO: 1277273 - RNA, 22 nt, Mycobacterium tuberculosis H37Rv
cgcucggucuccaccaccgacg

SEQ ID NO: 1277274 - RNA, 14 nt, Mycobacterium tuberculosis H37Rv
cgcucggcggucgg

SEQ ID NO: 1277275 - RNA, 21 nt, Mycobacterium tuberculosis H37Rv
cgcucggcguagcgagcgggu

SEQ ID NO: 1277276 - RNA, 23 nt, Mycobacterium tuberculosis H37Rv
cgcucguggucgacgugaucgcg

SEQ ID NO: 1277277 - RNA, 20 nt, Mycobacterium tuberculosis H37Rv
cgcucguggucgacgugauc

SEQ ID NO: 1277278 - RNA, 14 nt, Mycobacterium tuberculosis H37Rv
cgcucguggucgac

SEQ ID NO: 1277279 - RNA, 18 nt, Mycobacterium tuberculosis H37Rv
cgcucgugacgaucagcg

SEQ ID NO: 1277280 - RNA, 24 nt, Mycobacterium tuberculosis H37Rv
cgcucgugcacgcugagccggucg

SEQ ID NO: 1277281 - RNA, 12 nt, Mycobacterium tuberculosis H37Rv
cgcucgucgaca

SEQ ID NO: 1277282 - RNA, 19 nt, Mycobacterium tuberculosis H37Rv
cgcucguagaaucggcuca

SEQ ID NO: 1277283 - RNA, 16 nt, Mycobacterium tuberculosis H37Rv
cgcucguagaaccggg

SEQ ID NO: 1277284 - RNA, 21 nt, Mycobacterium tuberculosis H37Rv
cgcggcuacaucggcggcguc

SEQ ID NO: 1277285 - RNA, 21 nt, Mycobacterium tuberculosis H37Rv
cgcggcuuggccuagccgcgg

SEQ ID NO: 1277286 - RNA, 19 nt, Mycobacterium tuberculosis H37Rv
cgcggcuugucgcggugcg

SEQ ID NO: 1277287 - RNA, 15 nt, Mycobacterium tuberculosis H37Rv
cgcggcuugucgcgg

SEQ ID NO: 1277288 - RNA, 16 nt, Mycobacterium tuberculosis H37Rv
cgcggcguguacgucg

SEQ ID NO: 1277289 - RNA, 20 nt, Mycobacterium tuberculosis H37Rv
cgcggcgugcuugagcacgu

SEQ ID NO: 1277290 - RNA, 21 nt, Mycobacterium tuberculosis H37Rv
cgcggcguuaagguacccggu

SEQ ID NO: 1277291 - RNA, 20 nt, Mycobacterium tuberculosis H37Rv
cgcggcgugcgcggugaugg

SEQ ID NO: 1277292 - RNA, 19 nt, Mycobacterium tuberculosis H37Rv
cgcggcgucggucgggugg

SEQ ID NO: 1277293 - RNA, 21 nt, Mycobacterium tuberculosis H37Rv
cgcggcguugugaccgccgau

SEQ ID NO: 1277294 - RNA, 15 nt, Mycobacterium tuberculosis H37Rv
cgcgggaacgaugcc

SEQ ID NO: 1277295 - RNA, 23 nt, Mycobacterium tuberculosis H37Rv
cgcgggaaguccgucggucgccg

SEQ ID NO: 1277296 - RNA, 18 nt, Mycobacterium tuberculosis H37Rv
cgcgggagguacccccag

SEQ ID NO: 1277297 - RNA, 15 nt, Mycobacterium tuberculosis H37Rv
cgcggcgggcccgau

SEQ ID NO: 1277298 - RNA, 21 nt, Mycobacterium tuberculosis H37Rv
cgcggcggaacaccgacgaca

SEQ ID NO: 1277299 - RNA, 19 nt, Mycobacterium tuberculosis H37Rv
cgcggcgaguggcuccauc

SEQ ID NO: 1277300 - RNA, 17 nt, Mycobacterium tuberculosis H37Rv
cgcggccguggaugucg

SEQ ID NO: 1277301 - RNA, 14 nt, Mycobacterium tuberculosis H37Rv
cgcggccgucgcgg

SEQ ID NO: 1277302 - RNA, 12 nt, Mycobacterium tuberculosis H37Rv
cgcggccgugaa

SEQ ID NO: 1277303 - RNA, 14 nt, Mycobacterium tuberculosis H37Rv
cgcggccggcgucg

SEQ ID NO: 1277304 - RNA, 14 nt, Mycobacterium tuberculosis H37Rv
cgcggcgaucugcg

SEQ ID NO: 1277305 - RNA, 15 nt, Mycobacterium tuberculosis H37Rv
cgcggccggcgcucg

SEQ ID NO: 1277306 - RNA, 17 nt, Mycobacterium tuberculosis H37Rv
cgcggccgcggugacgg

SEQ ID NO: 1277307 - RNA, 24 nt, Mycobacterium tuberculosis H37Rv
cgcggcccucgaugccgcguagcu

SEQ ID NO: 1277308 - RNA, 20 nt, Mycobacterium tuberculosis H37Rv
cgcggcccucgccuucgccg

SEQ ID NO: 1277309 - RNA, 13 nt, Mycobacterium tuberculosis H37Rv
cgcggcccucgau

SEQ ID NO: 1277310 - RNA, 12 nt, Mycobacterium tuberculosis H37Rv
cgcggcccgaga

SEQ ID NO: 1277311 - RNA, 15 nt, Mycobacterium tuberculosis H37Rv
cgcggcccgaucggc

SEQ ID NO: 1277312 - RNA, 14 nt, Mycobacterium tuberculosis H37Rv
cgcggcccgcgaau

SEQ ID NO: 1277313 - RNA, 20 nt, Mycobacterium tuberculosis H37Rv
cgcggcccgcucgaucggca

SEQ ID NO: 1277314 - RNA, 14 nt, Mycobacterium tuberculosis H37Rv
cgcggcccgcagcg

SEQ ID NO: 1277315 - RNA, 12 nt, Mycobacterium tuberculosis H37Rv
cgcggcccgcau

SEQ ID NO: 1277316 - RNA, 15 nt, Mycobacterium tuberculosis H37Rv
cgcggcccgcaucgu

SEQ ID NO: 1277317 - RNA, 12 nt, Mycobacterium tuberculosis H37Rv
cgcggaccucga

SEQ ID NO: 1277318 - RNA, 15 nt, Mycobacterium tuberculosis H37Rv
cgcggaccucggcga

SEQ ID NO: 1277319 - RNA, 15 nt, Mycobacterium tuberculosis H37Rv
cgcggaccggcgucg

SEQ ID NO: 1277320 - RNA, 18 nt, Mycobacterium tuberculosis H37Rv
cgcggaccggcgucggcu

SEQ ID NO: 1277321 - RNA, 22 nt, Mycobacterium tuberculosis H37Rv
cgcggacccgcagcugcggauc

SEQ ID NO: 1277322 - RNA, 16 nt, Mycobacterium tuberculosis H37Rv
aacagcugcccgccag

SEQ ID NO: 1277323 - RNA, 19 nt, Mycobacterium tuberculosis H37Rv
aacagcgucuggccgucgc

SEQ ID NO: 1277324 - RNA, 13 nt, Mycobacterium tuberculosis H37Rv
aacagcgauccga

SEQ ID NO: 1277325 - RNA, 13 nt, Mycobacterium tuberculosis H37Rv
aacagcgaaccgc

SEQ ID NO: 1277326 - RNA, 13 nt, Mycobacterium tuberculosis H37Rv
aacagcgcgucgg

SEQ ID NO: 1277327 - RNA, 13 nt, Mycobacterium tuberculosis H37Rv
aacagcggcacga

SEQ ID NO: 1277328 - RNA, 13 nt, Mycobacterium tuberculosis H37Rv
aacagcgcggugu

SEQ ID NO: 1277329 - RNA, 23 nt, Mycobacterium tuberculosis H37Rv
cgcgggugcgcugcagcgagacc

SEQ ID NO: 1277330 - RNA, 18 nt, Mycobacterium tuberculosis H37Rv
cgcggguggcgccagguc

SEQ ID NO: 1277331 - RNA, 19 nt, Mycobacterium tuberculosis H37Rv
cgcgguagccgcggccaca

SEQ ID NO: 1277332 - RNA, 15 nt, Mycobacterium tuberculosis H37Rv
cgcgggugaccaggc

SEQ ID NO: 1277333 - RNA, 21 nt, Mycobacterium tuberculosis H37Rv
cgcgggugcgcugcagcgaga

SEQ ID NO: 1277334 - RNA, 15 nt, Mycobacterium tuberculosis H37Rv
cgcgggucuuggcac

SEQ ID NO: 1277335 - RNA, 19 nt, Mycobacterium tuberculosis H37Rv
cgcggggcgcaccgcggac

SEQ ID NO: 1277336 - RNA, 14 nt, Mycobacterium tuberculosis H37Rv
cgcggggcccacac

SEQ ID NO: 1277337 - RNA, 22 nt, Mycobacterium tuberculosis H37Rv
cgcggggcaucggugcgguucg

SEQ ID NO: 1277338 - RNA, 19 nt, Mycobacterium tuberculosis H37Rv
cgcggggaugucgaccgcg

SEQ ID NO: 1277339 - RNA, 21 nt, Mycobacterium tuberculosis H37Rv
cgcggggaugucgaccgcgag

SEQ ID NO: 1277340 - RNA, 22 nt, Mycobacterium tuberculosis H37Rv
cgcgggcgguaaucgcgagacc

SEQ ID NO: 1277341 - RNA, 17 nt, Mycobacterium tuberculosis H37Rv
cgcgggcguuggccagc

SEQ ID NO: 1277342 - RNA, 13 nt, Mycobacterium tuberculosis H37Rv
cgcgggcguugcu

SEQ ID NO: 1277343 - RNA, 13 nt, Mycobacterium tuberculosis H37Rv
cgcgggcucacau

SEQ ID NO: 1277344 - RNA, 22 nt, Mycobacterium tuberculosis H37Rv
cgcgggcgggguaucaaccggc

SEQ ID NO: 1277345 - RNA, 19 nt, Mycobacterium tuberculosis H37Rv
cgcgguaggugcaugucga

SEQ ID NO: 1277346 - RNA, 14 nt, Mycobacterium tuberculosis H37Rv
cgcgguaggcguug

SEQ ID NO: 1277347 - RNA, 16 nt, Mycobacterium tuberculosis H37Rv
cgcggucaccgcguca

SEQ ID NO: 1277348 - RNA, 21 nt, Mycobacterium tuberculosis H37Rv
cgcggucaaauccagcagcca

SEQ ID NO: 1277349 - RNA, 12 nt, Mycobacterium tuberculosis H37Rv
cgcggucggacc

SEQ ID NO: 1277350 - RNA, 16 nt, Mycobacterium tuberculosis H37Rv
cgcggucgcugcgaug

SEQ ID NO: 1277351 - RNA, 14 nt, Mycobacterium tuberculosis H37Rv
cgcggucgcgcgau

SEQ ID NO: 1277352 - RNA, 19 nt, Mycobacterium tuberculosis H37Rv
cgcggucgccaagaucggg

SEQ ID NO: 1277353 - RNA, 14 nt, Mycobacterium tuberculosis H37Rv
cgcggugcgcguga

SEQ ID NO: 1277354 - RNA, 14 nt, Mycobacterium tuberculosis H37Rv
cgcggucggccacc

SEQ ID NO: 1277355 - RNA, 18 nt, Mycobacterium tuberculosis H37Rv
cgcggucggagucgagca

SEQ ID NO: 1277356 - RNA, 14 nt, Mycobacterium tuberculosis H37Rv
cgcggucggcagcg

SEQ ID NO: 1277357 - RNA, 20 nt, Mycobacterium tuberculosis H37Rv
cgcgguggaugcgaugcgcg

SEQ ID NO: 1277358 - RNA, 21 nt, Mycobacterium tuberculosis H37Rv
cgcgguggccaacucgacauc

SEQ ID NO: 1277359 - RNA, 14 nt, Mycobacterium tuberculosis H37Rv
cgcgguggaccggg

SEQ ID NO: 1277360 - RNA, 22 nt, Mycobacterium tuberculosis H37Rv
cgcggugcggcagauacucggc

SEQ ID NO: 1277361 - RNA, 17 nt, Mycobacterium tuberculosis H37Rv
cgcggugcgcgugacga

SEQ ID NO: 1277362 - RNA, 18 nt, Mycobacterium tuberculosis H37Rv
cgcgguuaccucaccgaa

SEQ ID NO: 1277363 - RNA, 17 nt, Mycobacterium tuberculosis H37Rv
cgcgguguuggacgcgg

SEQ ID NO: 1277364 - RNA, 15 nt, Mycobacterium tuberculosis H37Rv
cgcgguucgaugaca

SEQ ID NO: 1277365 - RNA, 18 nt, Mycobacterium tuberculosis H37Rv
cgcgguugugacggugaa

SEQ ID NO: 1277366 - RNA, 17 nt, Mycobacterium tuberculosis H37Rv
cgcgguugugcugggug

SEQ ID NO: 1277367 - RNA, 15 nt, Mycobacterium tuberculosis H37Rv
cgcgguuguuucggc

SEQ ID NO: 1277368 - RNA, 22 nt, Mycobacterium tuberculosis H37Rv
cgcgguuguccuccgacggggg

SEQ ID NO: 1277369 - RNA, 18 nt, Mycobacterium tuberculosis H37Rv
cgcguaaaccggcugacc

SEQ ID NO: 1277370 - RNA, 16 nt, Mycobacterium tuberculosis H37Rv
cgcgguuucggcguca

SEQ ID NO: 1277371 - RNA, 14 nt, Mycobacterium tuberculosis H37Rv
cgcgguuucggcga

SEQ ID NO: 1277372 - RNA, 15 nt, Mycobacterium tuberculosis H37Rv
cgcguaccacggugg

SEQ ID NO: 1277373 - RNA, 16 nt, Mycobacterium tuberculosis H37Rv
cgcgcguaauccgagc

SEQ ID NO: 1277374 - RNA, 16 nt, Mycobacterium tuberculosis H37Rv
cgcgcgguuuucggcu

SEQ ID NO: 1277375 - RNA, 16 nt, Mycobacterium tuberculosis H37Rv
cgcgcgguacugcgca

SEQ ID NO: 1277376 - RNA, 19 nt, Mycobacterium tuberculosis H37Rv
cgcgcggguugucggcgac

SEQ ID NO: 1277377 - RNA, 23 nt, Mycobacterium tuberculosis H37Rv
cgcgcggguugucggcgaccccg

SEQ ID NO: 1277378 - RNA, 17 nt, Mycobacterium tuberculosis H37Rv
cgcgcgguagucgucgc

SEQ ID NO: 1277379 - RNA, 19 nt, Mycobacterium tuberculosis H37Rv
cgcgcggucguacgcaugg

SEQ ID NO: 1277380 - RNA, 19 nt, Mycobacterium tuberculosis H37Rv
cgcgcggugauggucaccg

SEQ ID NO: 1277381 - RNA, 20 nt, Mycobacterium tuberculosis H37Rv
cgcgcgggguggcggcgcug

SEQ ID NO: 1277382 - RNA, 17 nt, Mycobacterium tuberculosis H37Rv
cgcgcgggucacgaccu

SEQ ID NO: 1277383 - RNA, 18 nt, Mycobacterium tuberculosis H37Rv
cgcgcggcucggguaccg

SEQ ID NO: 1277384 - RNA, 21 nt, Mycobacterium tuberculosis H37Rv
cgcgcggcucacgggcgaucg

SEQ ID NO: 1277385 - RNA, 19 nt, Mycobacterium tuberculosis H37Rv
cgcgcuacgcggccgaggu

SEQ ID NO: 1277386 - RNA, 14 nt, Mycobacterium tuberculosis H37Rv
cgcgcguugcgguc

SEQ ID NO: 1277387 - RNA, 14 nt, Mycobacterium tuberculosis H37Rv
cgcgcuaaugucga

SEQ ID NO: 1277388 - RNA, 19 nt, Mycobacterium tuberculosis H37Rv
cgcgcucaccgacgcugac

SEQ ID NO: 1277389 - RNA, 14 nt, Mycobacterium tuberculosis H37Rv
cgcgcucaccgggg

SEQ ID NO: 1277390 - RNA, 13 nt, Mycobacterium tuberculosis H37Rv
cgcgcucaccgac

SEQ ID NO: 1277391 - RNA, 13 nt, Mycobacterium tuberculosis H37Rv
cgcgcucagguca

SEQ ID NO: 1277392 - RNA, 21 nt, Mycobacterium tuberculosis H37Rv
cgcgcuccaacaaugccagcu

SEQ ID NO: 1277393 - RNA, 16 nt, Mycobacterium tuberculosis H37Rv
cgcgcucaucgaccgg

SEQ ID NO: 1277394 - RNA, 17 nt, Mycobacterium tuberculosis H37Rv
cgcgcucaucgaccggg

SEQ ID NO: 1277395 - RNA, 13 nt, Mycobacterium tuberculosis H37Rv
cgcgcgucgaguu

SEQ ID NO: 1277396 - RNA, 20 nt, Mycobacterium tuberculosis H37Rv
cgcgcgucgaguuuugcggc

SEQ ID NO: 1277397 - RNA, 14 nt, Mycobacterium tuberculosis H37Rv
cgcgcguaggccgc

SEQ ID NO: 1277398 - RNA, 21 nt, Mycobacterium tuberculosis H37Rv
cgcgcgucacauccgacagca

SEQ ID NO: 1277399 - RNA, 12 nt, Mycobacterium tuberculosis H37Rv
cgcgcguccgcc

SEQ ID NO: 1277400 - RNA, 21 nt, Mycobacterium tuberculosis H37Rv
cgcgcguggucgccccgauga

SEQ ID NO: 1277401 - RNA, 15 nt, Mycobacterium tuberculosis H37Rv
cgcgcguucggcgcu

SEQ ID NO: 1277402 - RNA, 17 nt, Mycobacterium tuberculosis H37Rv
cgcgcguucggcgagca

SEQ ID NO: 1277403 - RNA, 14 nt, Mycobacterium tuberculosis H37Rv
cgcgcguucggcga

SEQ ID NO: 1277404 - RNA, 23 nt, Mycobacterium tuberculosis H37Rv
cgcgcguugaagucgccggugac

SEQ ID NO: 1277405 - RNA, 22 nt, Mycobacterium tuberculosis H37Rv
cgcgcguucggcgcugaucgcg

SEQ ID NO: 1277406 - RNA, 16 nt, Mycobacterium tuberculosis H37Rv
cgcgcguucggcgcug

SEQ ID NO: 1277407 - RNA, 18 nt, Mycobacterium tuberculosis H37Rv
cgcggaaaccaucgccag

SEQ ID NO: 1277408 - RNA, 16 nt, Mycobacterium tuberculosis H37Rv
cgcggaaaccaucgcc

SEQ ID NO: 1277409 - RNA, 15 nt, Mycobacterium tuberculosis H37Rv
cgcggaacgcgucgc

SEQ ID NO: 1277410 - RNA, 23 nt, Mycobacterium tuberculosis H37Rv
cgcggacagguagucgccgguca

SEQ ID NO: 1277411 - RNA, 19 nt, Mycobacterium tuberculosis H37Rv
cgcgcugcugucgauuucg

SEQ ID NO: 1277412 - RNA, 16 nt, Mycobacterium tuberculosis H37Rv
cgcgcugcgggaaccc

SEQ ID NO: 1277413 - RNA, 20 nt, Mycobacterium tuberculosis H37Rv
cgcgcugcgcgacugauccu

SEQ ID NO: 1277414 - RNA, 16 nt, Mycobacterium tuberculosis H37Rv
cgcgcucccggcgucu

SEQ ID NO: 1277415 - RNA, 17 nt, Mycobacterium tuberculosis H37Rv
cgcgcucgacgagcacg

SEQ ID NO: 1277416 - RNA, 23 nt, Mycobacterium tuberculosis H37Rv
cgcgcucgcacccgcucggcgcg

SEQ ID NO: 1277417 - RNA, 12 nt, Mycobacterium tuberculosis H37Rv
cgcgcucgcgca

SEQ ID NO: 1277418 - RNA, 13 nt, Mycobacterium tuberculosis H37Rv
cgcgcucgccgau

SEQ ID NO: 1277419 - RNA, 14 nt, Mycobacterium tuberculosis H37Rv
cgcgcucgcucacc

SEQ ID NO: 1277420 - RNA, 13 nt, Mycobacterium tuberculosis H37Rv
cgcgcucggccag

SEQ ID NO: 1277421 - RNA, 21 nt, Mycobacterium tuberculosis H37Rv
cgcgcugccaguucuuggcga

SEQ ID NO: 1277422 - RNA, 12 nt, Mycobacterium tuberculosis H37Rv
cgcgcucggugc

SEQ ID NO: 1277423 - RNA, 16 nt, Mycobacterium tuberculosis H37Rv
cgcgcucggugccgcc

SEQ ID NO: 1277424 - RNA, 22 nt, Mycobacterium tuberculosis H37Rv
cgcgcugacccgccgacgaccg

SEQ ID NO: 1277425 - RNA, 19 nt, Mycobacterium tuberculosis H37Rv
cgcgccguagaccagcagg

SEQ ID NO: 1277426 - RNA, 16 nt, Mycobacterium tuberculosis H37Rv
cgcgccguagagccgc

SEQ ID NO: 1277427 - RNA, 17 nt, Mycobacterium tuberculosis H37Rv
cgcgccguagaccagca

SEQ ID NO: 1277428 - RNA, 17 nt, Mycobacterium tuberculosis H37Rv
cgcgccguaguucuccg

SEQ ID NO: 1277429 - RNA, 23 nt, Mycobacterium tuberculosis H37Rv
cgcgccguucacccuggugguca

SEQ ID NO: 1277430 - RNA, 13 nt, Mycobacterium tuberculosis H37Rv
cgcgccguucacc

SEQ ID NO: 1277431 - RNA, 17 nt, Mycobacterium tuberculosis H37Rv
cgcgccgucgucgagca

SEQ ID NO: 1277432 - RNA, 19 nt, Mycobacterium tuberculosis H37Rv
cgcgccgucgucgaccacg

SEQ ID NO: 1277433 - RNA, 16 nt, Mycobacterium tuberculosis H37Rv
cgcgccgucucgaagc

SEQ ID NO: 1277434 - RNA, 22 nt, Mycobacterium tuberculosis H37Rv
cgcgccugccucaccgccgcua

SEQ ID NO: 1277435 - RNA, 18 nt, Mycobacterium tuberculosis H37Rv
cgcgccugccucaccgcc

SEQ ID NO: 1277436 - RNA, 19 nt, Mycobacterium tuberculosis H37Rv
cgcgccugugccaccgcug

SEQ ID NO: 1277437 - RNA, 22 nt, Mycobacterium tuberculosis H37Rv
cgcgcgaaacggugaaugugca

SEQ ID NO: 1277438 - RNA, 13 nt, Mycobacterium tuberculosis H37Rv
cgcgcgacgccgu

SEQ ID NO: 1277439 - RNA, 20 nt, Mycobacterium tuberculosis H37Rv
cgcgcgacggaccaucuccg

SEQ ID NO: 1277440 - RNA, 13 nt, Mycobacterium tuberculosis H37Rv
cgcgcgacgagca

SEQ ID NO: 1277441 - RNA, 14 nt, Mycobacterium tuberculosis H37Rv
cgcgcgacgagcau

SEQ ID NO: 1277442 - RNA, 15 nt, Mycobacterium tuberculosis H37Rv
cgcgcgaaccgcucc

SEQ ID NO: 1277443 - RNA, 23 nt, Mycobacterium tuberculosis H37Rv
cgcgcgacaacccggcgucgacg

SEQ ID NO: 1277444 - RNA, 16 nt, Mycobacterium tuberculosis H37Rv
cgcgcgacaacccggc

SEQ ID NO: 1277445 - RNA, 17 nt, Mycobacterium tuberculosis H37Rv
cgcgcgagaacacccgu

SEQ ID NO: 1277446 - RNA, 21 nt, Mycobacterium tuberculosis H37Rv
cgcgcgacuguacaccgacac

SEQ ID NO: 1277447 - RNA, 22 nt, Mycobacterium tuberculosis H37Rv
cgcgcgacuguacaccgacacg

SEQ ID NO: 1277448 - RNA, 12 nt, Mycobacterium tuberculosis H37Rv
cgcgcgcucgcg

SEQ ID NO: 1277449 - RNA, 18 nt, Mycobacterium tuberculosis H37Rv
cgcgcgcucgcucaccgg

SEQ ID NO: 1277450 - RNA, 13 nt, Mycobacterium tuberculosis H37Rv
cgcgcgcugggcg

SEQ ID NO: 1277451 - RNA, 16 nt, Mycobacterium tuberculosis H37Rv
cgcgcgcugagccgua

SEQ ID NO: 1277452 - RNA, 14 nt, Mycobacterium tuberculosis H37Rv
cgcgcgcugagccg

SEQ ID NO: 1277453 - RNA, 13 nt, Mycobacterium tuberculosis H37Rv
cgcgcgcugcgca

SEQ ID NO: 1277454 - RNA, 16 nt, Mycobacterium tuberculosis H37Rv
cgcgcggagucaagca

SEQ ID NO: 1277455 - RNA, 19 nt, Mycobacterium tuberculosis H37Rv
cgcgcggacacucgcgggu

SEQ ID NO: 1277456 - RNA, 15 nt, Mycobacterium tuberculosis H37Rv
cgcgcggaucgucga

SEQ ID NO: 1277457 - RNA, 20 nt, Mycobacterium tuberculosis H37Rv
cgcgcggauggccucggcga

SEQ ID NO: 1277458 - RNA, 20 nt, Mycobacterium tuberculosis H37Rv
cgcgcggcaccgauggcgca

SEQ ID NO: 1277459 - RNA, 12 nt, Mycobacterium tuberculosis H37Rv
cgcgcggcaccg

SEQ ID NO: 1277460 - RNA, 21 nt, Mycobacterium tuberculosis H37Rv
cgcgcggcgcagcaccgucgg

SEQ ID NO: 1277461 - RNA, 22 nt, Mycobacterium tuberculosis H37Rv
cgcgcggcgacagcuuggccgg

SEQ ID NO: 1277462 - RNA, 16 nt, Mycobacterium tuberculosis H37Rv
cgcgcggcgcagcacc

SEQ ID NO: 1277463 - RNA, 14 nt, Mycobacterium tuberculosis H37Rv
cgcgcggccgcgcu

SEQ ID NO: 1277464 - RNA, 21 nt, Mycobacterium tuberculosis H37Rv
cgcgcgccaucgccuccagcc

SEQ ID NO: 1277465 - RNA, 21 nt, Mycobacterium tuberculosis H37Rv
cgcgcgcaguuguacggcacu

SEQ ID NO: 1277466 - RNA, 16 nt, Mycobacterium tuberculosis H37Rv
cgcgcgcagcugacgu

SEQ ID NO: 1277467 - RNA, 14 nt, Mycobacterium tuberculosis H37Rv
cgcgcgccgcuggg

SEQ ID NO: 1277468 - RNA, 16 nt, Mycobacterium tuberculosis H37Rv
cgcgcgccgcugggug

SEQ ID NO: 1277469 - RNA, 15 nt, Mycobacterium tuberculosis H37Rv
cgcgcgccgcgacga

SEQ ID NO: 1277470 - RNA, 17 nt, Mycobacterium tuberculosis H37Rv
cgcgcgcccgauccggu

SEQ ID NO: 1277471 - RNA, 16 nt, Mycobacterium tuberculosis H37Rv
cgcgcgcccgccucau

SEQ ID NO: 1277472 - RNA, 23 nt, Mycobacterium tuberculosis H37Rv
cgcgcgcccgaaugcgacgucgu

SEQ ID NO: 1277473 - RNA, 14 nt, Mycobacterium tuberculosis H37Rv
cgcgcgcggcguag

SEQ ID NO: 1277474 - RNA, 18 nt, Mycobacterium tuberculosis H37Rv
cgcgcgccgcauccagcc

SEQ ID NO: 1277475 - RNA, 21 nt, Mycobacterium tuberculosis H37Rv
cgcgcccggcgcaagcgccgc

SEQ ID NO: 1277476 - RNA, 17 nt, Mycobacterium tuberculosis H37Rv
cgcgccgaccucaucgg

SEQ ID NO: 1277477 - RNA, 14 nt, Mycobacterium tuberculosis H37Rv
cgcgccgacgccgc

SEQ ID NO: 1277478 - RNA, 13 nt, Mycobacterium tuberculosis H37Rv
cgcgcccggcgca

SEQ ID NO: 1277479 - RNA, 14 nt, Mycobacterium tuberculosis H37Rv
cgcgcccggcgcua

SEQ ID NO: 1277480 - RNA, 17 nt, Mycobacterium tuberculosis H37Rv
cgcgcccggcgcuagcg

SEQ ID NO: 1277481 - RNA, 20 nt, Mycobacterium tuberculosis H37Rv
cgcgcccggaucucggcgua

SEQ ID NO: 1277482 - RNA, 17 nt, Mycobacterium tuberculosis H37Rv
cgcgccccaguucgacg

SEQ ID NO: 1277483 - RNA, 21 nt, Mycobacterium tuberculosis H37Rv
cgcgccccaccgcgccgagca

SEQ ID NO: 1277484 - RNA, 23 nt, Mycobacterium tuberculosis H37Rv
cgcgccgccgcuacccccgaugg

SEQ ID NO: 1277485 - RNA, 13 nt, Mycobacterium tuberculosis H37Rv
cgcgccgccggac

SEQ ID NO: 1277486 - RNA, 14 nt, Mycobacterium tuberculosis H37Rv
cgcgccgccgcuac

SEQ ID NO: 1277487 - RNA, 13 nt, Mycobacterium tuberculosis H37Rv
cgcgccgccgcua

SEQ ID NO: 1277488 - RNA, 16 nt, Mycobacterium tuberculosis H37Rv
cgcgccgccccgcucg

SEQ ID NO: 1277489 - RNA, 21 nt, Mycobacterium tuberculosis H37Rv
cgcgccgcccgcuccuccggc

SEQ ID NO: 1277490 - RNA, 16 nt, Mycobacterium tuberculosis H37Rv
cgcgccggacagcgca

SEQ ID NO: 1277491 - RNA, 16 nt, Mycobacterium tuberculosis H37Rv
cgcgccgcugggugac

SEQ ID NO: 1277492 - RNA, 24 nt, Mycobacterium tuberculosis H37Rv
cgcgccggccccgggggaagcgcc

SEQ ID NO: 1277493 - RNA, 22 nt, Mycobacterium tuberculosis H37Rv
cgcgccaacagaugccacccag

SEQ ID NO: 1277494 - RNA, 22 nt, Mycobacterium tuberculosis H37Rv
cgcgccaccagcaccgccgcug

SEQ ID NO: 1277495 - RNA, 13 nt, Mycobacterium tuberculosis H37Rv
cgcgccaccgaua

SEQ ID NO: 1277496 - RNA, 22 nt, Mycobacterium tuberculosis H37Rv
cgcgcauguuaugagcgcucgg

SEQ ID NO: 1277497 - RNA, 17 nt, Mycobacterium tuberculosis H37Rv
cgcgcauugccgacgcg

SEQ ID NO: 1277498 - RNA, 18 nt, Mycobacterium tuberculosis H37Rv
cgcgcauuuuucgccagc

SEQ ID NO: 1277499 - RNA, 16 nt, Mycobacterium tuberculosis H37Rv
cgcgccagcuugucgg

SEQ ID NO: 1277500 - RNA, 21 nt, Mycobacterium tuberculosis H37Rv
cgcgccaccggcaccgccugc

SEQ ID NO: 1277501 - RNA, 22 nt, Mycobacterium tuberculosis H37Rv
cgcgccaccgugguucggcggc

SEQ ID NO: 1277502 - RNA, 17 nt, Mycobacterium tuberculosis H37Rv
cgcgccaccggcaccgc

SEQ ID NO: 1277503 - RNA, 15 nt, Mycobacterium tuberculosis H37Rv
cgcgccaccggcacc

SEQ ID NO: 1277504 - RNA, 15 nt, Mycobacterium tuberculosis H37Rv
cgcgccacgcacccg

SEQ ID NO: 1277505 - RNA, 21 nt, Mycobacterium tuberculosis H37Rv
cgcgccaccuccgacgggcga

SEQ ID NO: 1277506 - RNA, 17 nt, Mycobacterium tuberculosis H37Rv
cgcgccaggucggugac

SEQ ID NO: 1277507 - RNA, 19 nt, Mycobacterium tuberculosis H37Rv
cgcgccaggucggugacga

SEQ ID NO: 1277508 - RNA, 19 nt, Mycobacterium tuberculosis H37Rv
cgcgccaggcuugcggcac

SEQ ID NO: 1277509 - RNA, 18 nt, Mycobacterium tuberculosis H37Rv
cgcgcagguagucgacga

SEQ ID NO: 1277510 - RNA, 15 nt, Mycobacterium tuberculosis H37Rv
cgcgcagggaucgca

SEQ ID NO: 1277511 - RNA, 18 nt, Mycobacterium tuberculosis H37Rv
cgcgcagcgguccgccgc

SEQ ID NO: 1277512 - RNA, 16 nt, Mycobacterium tuberculosis H37Rv
cgcgcagcgguccgcc

SEQ ID NO: 1277513 - RNA, 14 nt, Mycobacterium tuberculosis H37Rv
cgcgcagcgauucg

SEQ ID NO: 1277514 - RNA, 12 nt, Mycobacterium tuberculosis H37Rv
cgcgcagcgcga

SEQ ID NO: 1277515 - RNA, 17 nt, Mycobacterium tuberculosis H37Rv
cgcgcagccgcucgacg

SEQ ID NO: 1277516 - RNA, 14 nt, Mycobacterium tuberculosis H37Rv
cgcgcagccgcucg

SEQ ID NO: 1277517 - RNA, 21 nt, Mycobacterium tuberculosis H37Rv
cgcgcagccgggucuacagcg

SEQ ID NO: 1277518 - RNA, 16 nt, Mycobacterium tuberculosis H37Rv
cgcgcacuugcguggc

SEQ ID NO: 1277519 - RNA, 14 nt, Mycobacterium tuberculosis H37Rv
cgcgcaacgggucg

SEQ ID NO: 1277520 - RNA, 22 nt, Mycobacterium tuberculosis H37Rv
cgcgauggccaucaucgacggu

SEQ ID NO: 1277521 - RNA, 18 nt, Mycobacterium tuberculosis H37Rv
cgcgauggcgguccaccg

SEQ ID NO: 1277522 - RNA, 19 nt, Mycobacterium tuberculosis H37Rv
cgcgaugcuucccggaugc

SEQ ID NO: 1277523 - RNA, 16 nt, Mycobacterium tuberculosis H37Rv
cgcgaucgacgcucgg

SEQ ID NO: 1277524 - RNA, 14 nt, Mycobacterium tuberculosis H37Rv
cgcgaucgacgcuc

SEQ ID NO: 1277525 - RNA, 15 nt, Mycobacterium tuberculosis H37Rv
cgcgaucgaccuugg

SEQ ID NO: 1277526 - RNA, 22 nt, Mycobacterium tuberculosis H37Rv
cgcgaucgacgcucggcuaugg

SEQ ID NO: 1277527 - RNA, 22 nt, Mycobacterium tuberculosis H37Rv
cgcgaugaccucggcgaugucg

SEQ ID NO: 1277528 - RNA, 20 nt, Mycobacterium tuberculosis H37Rv
cgcgaugacgaguucgcgca

SEQ ID NO: 1277529 - RNA, 20 nt, Mycobacterium tuberculosis H37Rv
cgcgaugaccucggcgaugu

SEQ ID NO: 1277530 - RNA, 20 nt, Mycobacterium tuberculosis H37Rv
cgcgaucgcagugagcagcc

SEQ ID NO: 1277531 - RNA, 17 nt, Mycobacterium tuberculosis H37Rv
cgcgaugaccucggcga

SEQ ID NO: 1277532 - RNA, 19 nt, Mycobacterium tuberculosis H37Rv
cgcgaugauggcgguaccg

SEQ ID NO: 1277533 - RNA, 21 nt, Mycobacterium tuberculosis H37Rv
cgcgcaacguagccagcagcg

SEQ ID NO: 1277534 - RNA, 24 nt, Mycobacterium tuberculosis H37Rv
cgcgcaagcggacccgaccgucgu

SEQ ID NO: 1277535 - RNA, 13 nt, Mycobacterium tuberculosis H37Rv
cgcgcacgacagg

SEQ ID NO: 1277536 - RNA, 17 nt, Mycobacterium tuberculosis H37Rv
cgcgcaccccggcauac

SEQ ID NO: 1277537 - RNA, 12 nt, Mycobacterium tuberculosis H37Rv
cgcgcacgucga

SEQ ID NO: 1277538 - RNA, 20 nt, Mycobacterium tuberculosis H37Rv
cgcgcacucgacggucaucg

SEQ ID NO: 1277539 - RNA, 14 nt, Mycobacterium tuberculosis H37Rv
cgcgcacggcgucg

SEQ ID NO: 1277540 - RNA, 15 nt, Mycobacterium tuberculosis H37Rv
cgcgcacgcccugaa

SEQ ID NO: 1277541 - RNA, 17 nt, Mycobacterium tuberculosis H37Rv
cgcgcacgcgugccgca

SEQ ID NO: 1277542 - RNA, 18 nt, Mycobacterium tuberculosis H37Rv
cgcgauccccgcgcugag

SEQ ID NO: 1277543 - RNA, 16 nt, Mycobacterium tuberculosis H37Rv
cgcgauagauacccgc

SEQ ID NO: 1277544 - RNA, 15 nt, Mycobacterium tuberculosis H37Rv
cgcgauacagacggg

SEQ ID NO: 1277545 - RNA, 17 nt, Mycobacterium tuberculosis H37Rv
cgcgagauccuucgcgu

SEQ ID NO: 1277546 - RNA, 12 nt, Mycobacterium tuberculosis H37Rv
cgcgagaucggg

SEQ ID NO: 1277547 - RNA, 14 nt, Mycobacterium tuberculosis H37Rv
cgcgagaucagccg

SEQ ID NO: 1277548 - RNA, 15 nt, Mycobacterium tuberculosis H37Rv
cgcgagcagacgcgg

SEQ ID NO: 1277549 - RNA, 19 nt, Mycobacterium tuberculosis H37Rv
cgcgacggcacgaucaucg

SEQ ID NO: 1277550 - RNA, 21 nt, Mycobacterium tuberculosis H37Rv
cgccugcucgucggccaccgc

SEQ ID NO: 1277551 - RNA, 15 nt, Mycobacterium tuberculosis H37Rv
cgccugcgggaacgc

SEQ ID NO: 1277552 - RNA, 14 nt, Mycobacterium tuberculosis H37Rv
cgcgacuaccaucg

SEQ ID NO: 1277553 - RNA, 16 nt, Mycobacterium tuberculosis H37Rv
cgcgacugauccucga

SEQ ID NO: 1277554 - RNA, 17 nt, Mycobacterium tuberculosis H37Rv
cgcgacuaccaucgccg

SEQ ID NO: 1277555 - RNA, 18 nt, Mycobacterium tuberculosis H37Rv
cggccgcauccccgguac

SEQ ID NO: 1277556 - RNA, 14 nt, Mycobacterium tuberculosis H37Rv
cggccgcagugcga

SEQ ID NO: 1277557 - RNA, 18 nt, Mycobacterium tuberculosis H37Rv
cggccgcagugcgacucu

SEQ ID NO: 1277558 - RNA, 13 nt, Mycobacterium tuberculosis H37Rv
cggccgcaggcga

SEQ ID NO: 1277559 - RNA, 19 nt, Mycobacterium tuberculosis H37Rv
cggccgcccguaaaccgau

SEQ ID NO: 1277560 - RNA, 14 nt, Mycobacterium tuberculosis H37Rv
cggccgccgacagg

SEQ ID NO: 1277561 - RNA, 19 nt, Mycobacterium tuberculosis H37Rv
cggccgccgacagggaccc

SEQ ID NO: 1277562 - RNA, 18 nt, Mycobacterium tuberculosis H37Rv
cggccgcauucgugacga

SEQ ID NO: 1277563 - RNA, 17 nt, Mycobacterium tuberculosis H37Rv
cggccgauacgaagccg

SEQ ID NO: 1277564 - RNA, 20 nt, Mycobacterium tuberculosis H37Rv
cggccgauacgaagccgccg

SEQ ID NO: 1277565 - RNA, 15 nt, Mycobacterium tuberculosis H37Rv
cggccgagugcacgc

SEQ ID NO: 1277566 - RNA, 15 nt, Mycobacterium tuberculosis H37Rv
cggccgaggucaccc

SEQ ID NO: 1277567 - RNA, 21 nt, Mycobacterium tuberculosis H37Rv
cggccgagggauugccgugcu

SEQ ID NO: 1277568 - RNA, 14 nt, Mycobacterium tuberculosis H37Rv
cggccgagcgcacu

SEQ ID NO: 1277569 - RNA, 15 nt, Mycobacterium tuberculosis H37Rv
cggccgagcgcaccg

SEQ ID NO: 1277570 - RNA, 17 nt, Mycobacterium tuberculosis H37Rv
cggccgagacggcguug

SEQ ID NO: 1277571 - RNA, 14 nt, Mycobacterium tuberculosis H37Rv
cggccgacccggau

SEQ ID NO: 1277572 - RNA, 17 nt, Mycobacterium tuberculosis H37Rv
cggccgacacgccgaug

SEQ ID NO: 1277573 - RNA, 15 nt, Mycobacterium tuberculosis H37Rv
cggcccugcucgccg

SEQ ID NO: 1277574 - RNA, 20 nt, Mycobacterium tuberculosis H37Rv
cggcccugagcugccgagcg

SEQ ID NO: 1277575 - RNA, 13 nt, Mycobacterium tuberculosis H37Rv
cggcccugccgcc

SEQ ID NO: 1277576 - RNA, 17 nt, Mycobacterium tuberculosis H37Rv
cggcccucgaugccgcg

SEQ ID NO: 1277577 - RNA, 15 nt, Mycobacterium tuberculosis H37Rv
cggcccggcucggug

SEQ ID NO: 1277578 - RNA, 16 nt, Mycobacterium tuberculosis H37Rv
cggcccggcacccggu

SEQ ID NO: 1277579 - RNA, 18 nt, Mycobacterium tuberculosis H37Rv
cggccccaccggugccgc

SEQ ID NO: 1277580 - RNA, 14 nt, Mycobacterium tuberculosis H37Rv
cggccccaccggua

SEQ ID NO: 1277581 - RNA, 20 nt, Mycobacterium tuberculosis H37Rv
cggccgcggcgcggcgggca

SEQ ID NO: 1277582 - RNA, 22 nt, Mycobacterium tuberculosis H37Rv
cggccgcgggcguugcugaugg

SEQ ID NO: 1277583 - RNA, 22 nt, Mycobacterium tuberculosis H37Rv
cggccgcggugacggcggcugu

SEQ ID NO: 1277584 - RNA, 12 nt, Mycobacterium tuberculosis H37Rv
cggccgcgguga

SEQ ID NO: 1277585 - RNA, 15 nt, Mycobacterium tuberculosis H37Rv
cggccgcuggcguug

SEQ ID NO: 1277586 - RNA, 18 nt, Mycobacterium tuberculosis H37Rv
cggccgcuucggcgguca

SEQ ID NO: 1277587 - RNA, 20 nt, Mycobacterium tuberculosis H37Rv
cggccgcuucggcggucagc

SEQ ID NO: 1277588 - RNA, 13 nt, Mycobacterium tuberculosis H37Rv
cggccgccgcguu

SEQ ID NO: 1277589 - RNA, 16 nt, Mycobacterium tuberculosis H37Rv
cggccgccgcggcuug

SEQ ID NO: 1277590 - RNA, 15 nt, Mycobacterium tuberculosis H37Rv
cggccgccgagacga

SEQ ID NO: 1277591 - RNA, 19 nt, Mycobacterium tuberculosis H37Rv
cggccggcuccggauugcu

SEQ ID NO: 1277592 - RNA, 15 nt, Mycobacterium tuberculosis H37Rv
cggccggcucguccg

SEQ ID NO: 1277593 - RNA, 13 nt, Mycobacterium tuberculosis H37Rv
cggccggcgucgg

SEQ ID NO: 1277594 - RNA, 21 nt, Mycobacterium tuberculosis H37Rv
cggccggcgucggcgucgaau

SEQ ID NO: 1277595 - RNA, 15 nt, Mycobacterium tuberculosis H37Rv
cggccggcgucagcc

SEQ ID NO: 1277596 - RNA, 15 nt, Mycobacterium tuberculosis H37Rv
cggccggcgcucgcg

SEQ ID NO: 1277597 - RNA, 22 nt, Mycobacterium tuberculosis H37Rv
cggccggaugagcgaacgccag

SEQ ID NO: 1277598 - RNA, 23 nt, Mycobacterium tuberculosis H37Rv
cggccggauguugaccggcucga

SEQ ID NO: 1277599 - RNA, 15 nt, Mycobacterium tuberculosis H37Rv
cggccggacgggugc

SEQ ID NO: 1277600 - RNA, 15 nt, Mycobacterium tuberculosis H37Rv
cggccuucagcgguc

SEQ ID NO: 1277601 - RNA, 21 nt, Mycobacterium tuberculosis H37Rv
cggccuucucgccguguucga

SEQ ID NO: 1277602 - RNA, 21 nt, Mycobacterium tuberculosis H37Rv
cggccuguucggcggcugcca

SEQ ID NO: 1277603 - RNA, 17 nt, Mycobacterium tuberculosis H37Rv
cggccugguacucccgc

SEQ ID NO: 1277604 - RNA, 13 nt, Mycobacterium tuberculosis H37Rv
cggccugccggca

SEQ ID NO: 1277605 - RNA, 12 nt, Mycobacterium tuberculosis H37Rv
cggccugccgcu

SEQ ID NO: 1277606 - RNA, 15 nt, Mycobacterium tuberculosis H37Rv
cggccucugaccagc

SEQ ID NO: 1277607 - RNA, 20 nt, Mycobacterium tuberculosis H37Rv
cggccucgucgauguucgcc

SEQ ID NO: 1277608 - RNA, 19 nt, Mycobacterium tuberculosis H37Rv
cggccugaccggcucgccg

SEQ ID NO: 1277609 - RNA, 13 nt, Mycobacterium tuberculosis H37Rv
cggccugaccggc

SEQ ID NO: 1277610 - RNA, 15 nt, Mycobacterium tuberculosis H37Rv
cggccugcacggcgc

SEQ ID NO: 1277611 - RNA, 21 nt, Mycobacterium tuberculosis H37Rv
cggccucgaguaucucggcuc

SEQ ID NO: 1277612 - RNA, 21 nt, Mycobacterium tuberculosis H37Rv
cggccucgagacggucgauca

SEQ ID NO: 1277613 - RNA, 18 nt, Mycobacterium tuberculosis H37Rv
cggccucgaccucuucgg

SEQ ID NO: 1277614 - RNA, 21 nt, Mycobacterium tuberculosis H37Rv
cggccggguguagcucggacc

SEQ ID NO: 1277615 - RNA, 20 nt, Mycobacterium tuberculosis H37Rv
cggccggguuaucggcagca

SEQ ID NO: 1277616 - RNA, 20 nt, Mycobacterium tuberculosis H37Rv
cggccggguucgcgucugac

SEQ ID NO: 1277617 - RNA, 22 nt, Mycobacterium tuberculosis H37Rv
cggccggguuaucggcagcagg

SEQ ID NO: 1277618 - RNA, 23 nt, Mycobacterium tuberculosis H37Rv
cggccgguagaucuucggccgca

SEQ ID NO: 1277619 - RNA, 14 nt, Mycobacterium tuberculosis H37Rv
cggccggucgagac

SEQ ID NO: 1277620 - RNA, 18 nt, Mycobacterium tuberculosis H37Rv
cggccgugaauucgccga

SEQ ID NO: 1277621 - RNA, 16 nt, Mycobacterium tuberculosis H37Rv
cggccgucauggcccg

SEQ ID NO: 1277622 - RNA, 15 nt, Mycobacterium tuberculosis H37Rv
cggccguagugcacg

SEQ ID NO: 1277623 - RNA, 16 nt, Mycobacterium tuberculosis H37Rv
cggccgugccgccgac

SEQ ID NO: 1277624 - RNA, 19 nt, Mycobacterium tuberculosis H37Rv
cggccgugaccgagccgcg

SEQ ID NO: 1277625 - RNA, 22 nt, Mycobacterium tuberculosis H37Rv
cggccguggaugucgcggucga

SEQ ID NO: 1277626 - RNA, 19 nt, Mycobacterium tuberculosis H37Rv
cggccguggaaagccggcg

SEQ ID NO: 1277627 - RNA, 14 nt, Mycobacterium tuberculosis H37Rv
cggccgugaccgag

SEQ ID NO: 1277628 - RNA, 18 nt, Mycobacterium tuberculosis H37Rv
cggccgugucgggcgcga

SEQ ID NO: 1277629 - RNA, 15 nt, Mycobacterium tuberculosis H37Rv
cggccuccaccacgu

SEQ ID NO: 1277630 - RNA, 18 nt, Mycobacterium tuberculosis H37Rv
cggccuccaccacgucgg

SEQ ID NO: 1277631 - RNA, 21 nt, Mycobacterium tuberculosis H37Rv
cggccucaguacagcgcguug

SEQ ID NO: 1277632 - RNA, 16 nt, Mycobacterium tuberculosis H37Rv
cggccuccaucgcgac

SEQ ID NO: 1277633 - RNA, 15 nt, Mycobacterium tuberculosis H37Rv
cggccuccaucgcga

SEQ ID NO: 1277634 - RNA, 13 nt, Mycobacterium tuberculosis H37Rv
cggccuccaucgc

SEQ ID NO: 1277635 - RNA, 12 nt, Mycobacterium tuberculosis H37Rv
cggccagacggu

SEQ ID NO: 1277636 - RNA, 19 nt, Mycobacterium tuberculosis H37Rv
cggccagacggugcagcuc

SEQ ID NO: 1277637 - RNA, 19 nt, Mycobacterium tuberculosis H37Rv
cggccagaaacccggcgac

SEQ ID NO: 1277638 - RNA, 20 nt, Mycobacterium tuberculosis H37Rv
cggccacugauucgcaggcu

SEQ ID NO: 1277639 - RNA, 13 nt, Mycobacterium tuberculosis H37Rv
cggccacguuguc

SEQ ID NO: 1277640 - RNA, 22 nt, Mycobacterium tuberculosis H37Rv
cggccacuacggccuggccacc

SEQ ID NO: 1277641 - RNA, 17 nt, Mycobacterium tuberculosis H37Rv
cggccacggucagccag

SEQ ID NO: 1277642 - RNA, 14 nt, Mycobacterium tuberculosis H37Rv
cggccacgccgaug

SEQ ID NO: 1277643 - RNA, 13 nt, Mycobacterium tuberculosis H37Rv
cggccacgccgau

SEQ ID NO: 1277644 - RNA, 15 nt, Mycobacterium tuberculosis H37Rv
cggccacgagucgca

SEQ ID NO: 1277645 - RNA, 21 nt, Mycobacterium tuberculosis H37Rv
cggccagcgucagcuguuugc

SEQ ID NO: 1277646 - RNA, 12 nt, Mycobacterium tuberculosis H37Rv
cggccagccgac

SEQ ID NO: 1277647 - RNA, 15 nt, Mycobacterium tuberculosis H37Rv
cggccagcgcgucgg

SEQ ID NO: 1277648 - RNA, 16 nt, Mycobacterium tuberculosis H37Rv
cggccagccgcacggu

SEQ ID NO: 1277649 - RNA, 17 nt, Mycobacterium tuberculosis H37Rv
cggccagccgcuccacg

SEQ ID NO: 1277650 - RNA, 13 nt, Mycobacterium tuberculosis H37Rv
cggccagccgacg

SEQ ID NO: 1277651 - RNA, 18 nt, Mycobacterium tuberculosis H37Rv
cggccagcccagccggga

SEQ ID NO: 1277652 - RNA, 18 nt, Mycobacterium tuberculosis H37Rv
cggccagcaucagcucga

SEQ ID NO: 1277653 - RNA, 22 nt, Mycobacterium tuberculosis H37Rv
cggccagcaggaugaugaccgc

SEQ ID NO: 1277654 - RNA, 12 nt, Mycobacterium tuberculosis H37Rv
cggccagcaggu

SEQ ID NO: 1277655 - RNA, 21 nt, Mycobacterium tuberculosis H37Rv
cggccagcagguauuugccgu

SEQ ID NO: 1277656 - RNA, 14 nt, Mycobacterium tuberculosis H37Rv
cggccagcagcaga

SEQ ID NO: 1277657 - RNA, 23 nt, Mycobacterium tuberculosis H37Rv
cggccagcagcagugccaccggu

SEQ ID NO: 1277658 - RNA, 15 nt, Mycobacterium tuberculosis H37Rv
cggccaggucgacgg

SEQ ID NO: 1277659 - RNA, 15 nt, Mycobacterium tuberculosis H37Rv
cggccauagcgccgc

SEQ ID NO: 1277660 - RNA, 18 nt, Mycobacterium tuberculosis H37Rv
cggccauacgcgcgcggu

SEQ ID NO: 1277661 - RNA, 21 nt, Mycobacterium tuberculosis H37Rv
cggccauaccgcucgccguua

SEQ ID NO: 1277662 - RNA, 19 nt, Mycobacterium tuberculosis H37Rv
cggccaggggaucaccggc

SEQ ID NO: 1277663 - RNA, 14 nt, Mycobacterium tuberculosis H37Rv
cggccaggucgacg

SEQ ID NO: 1277664 - RNA, 15 nt, Mycobacterium tuberculosis H37Rv
cggccagugcucgca

SEQ ID NO: 1277665 - RNA, 17 nt, Mycobacterium tuberculosis H37Rv
cggccaggucgagcacc

SEQ ID NO: 1277666 - RNA, 21 nt, Mycobacterium tuberculosis H37Rv
cggccaggcgcgacguagacg

SEQ ID NO: 1277667 - RNA, 12 nt, Mycobacterium tuberculosis H37Rv
cggccaggcugc

SEQ ID NO: 1277668 - RNA, 15 nt, Mycobacterium tuberculosis H37Rv
cggccaggccgucgg

SEQ ID NO: 1277669 - RNA, 12 nt, Mycobacterium tuberculosis H37Rv
cggccaggccgg

SEQ ID NO: 1277670 - RNA, 14 nt, Mycobacterium tuberculosis H37Rv
cggccaggccgucg

SEQ ID NO: 1277671 - RNA, 21 nt, Mycobacterium tuberculosis H37Rv
cggccaucagaaccuccucgg

SEQ ID NO: 1277672 - RNA, 15 nt, Mycobacterium tuberculosis H37Rv
cggccaucucgucga

SEQ ID NO: 1277673 - RNA, 20 nt, Mycobacterium tuberculosis H37Rv
cggccaugaaaaucggcaag

SEQ ID NO: 1277674 - RNA, 15 nt, Mycobacterium tuberculosis H37Rv
cggccaucugcucgu

SEQ ID NO: 1277675 - RNA, 20 nt, Mycobacterium tuberculosis H37Rv
cggccaucugcucgugggua

SEQ ID NO: 1277676 - RNA, 18 nt, Mycobacterium tuberculosis H37Rv
cggccauggacgccaugg

SEQ ID NO: 1277677 - RNA, 12 nt, Mycobacterium tuberculosis H37Rv
cggcccaucggg

SEQ ID NO: 1277678 - RNA, 17 nt, Mycobacterium tuberculosis H37Rv
cggccccaccgacagcc

SEQ ID NO: 1277679 - RNA, 17 nt, Mycobacterium tuberculosis H37Rv
cggccccaccggcaccc

SEQ ID NO: 1277680 - RNA, 14 nt, Mycobacterium tuberculosis H37Rv
cggcccacgguguc

SEQ ID NO: 1277681 - RNA, 17 nt, Mycobacterium tuberculosis H37Rv
cggcccaccggucgcgc

SEQ ID NO: 1277682 - RNA, 14 nt, Mycobacterium tuberculosis H37Rv
cggcccaccggucg

SEQ ID NO: 1277683 - RNA, 17 nt, Mycobacterium tuberculosis H37Rv
cggcaucgccgagcucg

SEQ ID NO: 1277684 - RNA, 19 nt, Mycobacterium tuberculosis H37Rv
cggcaucgagacgcacggc

SEQ ID NO: 1277685 - RNA, 14 nt, Mycobacterium tuberculosis H37Rv
cggcaucgacugcc

SEQ ID NO: 1277686 - RNA, 21 nt, Mycobacterium tuberculosis H37Rv
cggcaucgacgcggccaacga

SEQ ID NO: 1277687 - RNA, 15 nt, Mycobacterium tuberculosis H37Rv
cggcauguaccgacc

SEQ ID NO: 1277688 - RNA, 22 nt, Mycobacterium tuberculosis H37Rv
cggcauguucagcccgaacucg

SEQ ID NO: 1277689 - RNA, 17 nt, Mycobacterium tuberculosis H37Rv
cggcaugugacaucggg

SEQ ID NO: 1277690 - RNA, 21 nt, Mycobacterium tuberculosis H37Rv
cggcaugggucgugcaggcga

SEQ ID NO: 1277691 - RNA, 13 nt, Mycobacterium tuberculosis H37Rv
cggcaugggccgg

SEQ ID NO: 1277692 - RNA, 19 nt, Mycobacterium tuberculosis H37Rv
cggcauucucgagcacccg

SEQ ID NO: 1277693 - RNA, 17 nt, Mycobacterium tuberculosis H37Rv
cggcauucucgagcacc

SEQ ID NO: 1277694 - RNA, 14 nt, Mycobacterium tuberculosis H37Rv
cggccacaaacccg

SEQ ID NO: 1277695 - RNA, 23 nt, Mycobacterium tuberculosis H37Rv
cggccacaccgucacgccaccgc

SEQ ID NO: 1277696 - RNA, 15 nt, Mycobacterium tuberculosis H37Rv
cggccaccgccugua

SEQ ID NO: 1277697 - RNA, 22 nt, Mycobacterium tuberculosis H37Rv
cggccaccgccuguacgagcag

SEQ ID NO: 1277698 - RNA, 12 nt, Mycobacterium tuberculosis H37Rv
cggccaccgggg

SEQ ID NO: 1277699 - RNA, 15 nt, Mycobacterium tuberculosis H37Rv
cggccaccucggugc

SEQ ID NO: 1277700 - RNA, 15 nt, Mycobacterium tuberculosis H37Rv
cggccaccugcucgu

SEQ ID NO: 1277701 - RNA, 20 nt, Mycobacterium tuberculosis H37Rv
cggccaccugcucgucgguc

SEQ ID NO: 1277702 - RNA, 22 nt, Mycobacterium tuberculosis H37Rv
cggccaccugcucgucggucac

SEQ ID NO: 1277703 - RNA, 15 nt, Mycobacterium tuberculosis H37Rv
cggccaccgcgcaac

SEQ ID NO: 1277704 - RNA, 12 nt, Mycobacterium tuberculosis H37Rv
cggccaccgccg

SEQ ID NO: 1277705 - RNA, 17 nt, Mycobacterium tuberculosis H37Rv
cggccaccggcgucugc

SEQ ID NO: 1277706 - RNA, 19 nt, Mycobacterium tuberculosis H37Rv
cggccacaugaucgagcag

SEQ ID NO: 1277707 - RNA, 15 nt, Mycobacterium tuberculosis H37Rv
cggccacaucgccag

SEQ ID NO: 1277708 - RNA, 14 nt, Mycobacterium tuberculosis H37Rv
cggccaccaccagg

SEQ ID NO: 1277709 - RNA, 19 nt, Mycobacterium tuberculosis H37Rv
cggccaccaccaggcugac

SEQ ID NO: 1277710 - RNA, 14 nt, Mycobacterium tuberculosis H37Rv
cggccaccaccgag

SEQ ID NO: 1277711 - RNA, 18 nt, Mycobacterium tuberculosis H37Rv
cggccaccaaccucaucg

SEQ ID NO: 1277712 - RNA, 14 nt, Mycobacterium tuberculosis H37Rv
cggccaccacaacg

SEQ ID NO: 1277713 - RNA, 20 nt, Mycobacterium tuberculosis H37Rv
cggccacccggacauagccg

SEQ ID NO: 1277714 - RNA, 17 nt, Mycobacterium tuberculosis H37Rv
cggccaccccacagucg

SEQ ID NO: 1277715 - RNA, 16 nt, Mycobacterium tuberculosis H37Rv
cggccaccaguccgau

SEQ ID NO: 1277716 - RNA, 19 nt, Mycobacterium tuberculosis H37Rv
cggccaccagggccaccgc

SEQ ID NO: 1277717 - RNA, 15 nt, Mycobacterium tuberculosis H37Rv
cggccaccagggcca

SEQ ID NO: 1277718 - RNA, 16 nt, Mycobacterium tuberculosis H37Rv
cggcaccucauugccg

SEQ ID NO: 1277719 - RNA, 19 nt, Mycobacterium tuberculosis H37Rv
aacagucgagugaagccga

SEQ ID NO: 1277720 - RNA, 12 nt, Mycobacterium tuberculosis H37Rv
aacagucgcagc

SEQ ID NO: 1277721 - RNA, 18 nt, Mycobacterium tuberculosis H37Rv
cggcacgaucaaccgggu

SEQ ID NO: 1277722 - RNA, 15 nt, Mycobacterium tuberculosis H37Rv
cggcacgaucggcag

SEQ ID NO: 1277723 - RNA, 18 nt, Mycobacterium tuberculosis H37Rv
cggcagcucccgccacgu

SEQ ID NO: 1277724 - RNA, 14 nt, Mycobacterium tuberculosis H37Rv
cggcagcuggcgca

SEQ ID NO: 1277725 - RNA, 20 nt, Mycobacterium tuberculosis H37Rv
cggcagcuuugacgcccucg

SEQ ID NO: 1277726 - RNA, 23 nt, Mycobacterium tuberculosis H37Rv
cggcaggcccggaggguucggac

SEQ ID NO: 1277727 - RNA, 16 nt, Mycobacterium tuberculosis H37Rv
cggcagggcccccagu

SEQ ID NO: 1277728 - RNA, 18 nt, Mycobacterium tuberculosis H37Rv
cggcauagcggcccaucg

SEQ ID NO: 1277729 - RNA, 19 nt, Mycobacterium tuberculosis H37Rv
cggcaggucuucgcugucg

SEQ ID NO: 1277730 - RNA, 22 nt, Mycobacterium tuberculosis H37Rv
cggcauccaggcugucgcgggc

SEQ ID NO: 1277731 - RNA, 22 nt, Mycobacterium tuberculosis H37Rv
cggcauccccaguugugcggcc

SEQ ID NO: 1277732 - RNA, 15 nt, Mycobacterium tuberculosis H37Rv
cggcauccugcacga

SEQ ID NO: 1277733 - RNA, 18 nt, Mycobacterium tuberculosis H37Rv
cggcauccugcacgaccc

SEQ ID NO: 1277734 - RNA, 19 nt, Mycobacterium tuberculosis H37Rv
cggagaugacaaucucggc

SEQ ID NO: 1277735 - RNA, 19 nt, Mycobacterium tuberculosis H37Rv
cggagcaauuccacgaucg

SEQ ID NO: 1277736 - RNA, 23 nt, Mycobacterium tuberculosis H37Rv
cggagcaauuccacgaucggcuc

SEQ ID NO: 1277737 - RNA, 15 nt, Mycobacterium tuberculosis H37Rv
cggagaugaacucgg

SEQ ID NO: 1277738 - RNA, 15 nt, Mycobacterium tuberculosis H37Rv
cggagaucgucgcgu

SEQ ID NO: 1277739 - RNA, 23 nt, Mycobacterium tuberculosis H37Rv
cggagaucuugcgcaaugccgac

SEQ ID NO: 1277740 - RNA, 19 nt, Mycobacterium tuberculosis H37Rv
cggagauacgggccaccgu

SEQ ID NO: 1277741 - RNA, 13 nt, Mycobacterium tuberculosis H37Rv
cggagaucgccac

SEQ ID NO: 1277742 - RNA, 16 nt, Mycobacterium tuberculosis H37Rv
cggagacucucugauc

SEQ ID NO: 1277743 - RNA, 23 nt, Mycobacterium tuberculosis H37Rv
cggagaauuccgcuaggucaggu

SEQ ID NO: 1277744 - RNA, 20 nt, Mycobacterium tuberculosis H37Rv
cggagaauuccgcuagguca

SEQ ID NO: 1277745 - RNA, 15 nt, Mycobacterium tuberculosis H37Rv
cggagaccagcgucu

SEQ ID NO: 1277746 - RNA, 13 nt, Mycobacterium tuberculosis H37Rv
cggagaccagcgu

SEQ ID NO: 1277747 - RNA, 13 nt, Mycobacterium tuberculosis H37Rv
cggagacgucgcc

SEQ ID NO: 1277748 - RNA, 18 nt, Mycobacterium tuberculosis H37Rv
cggagacgucgccgcagu

SEQ ID NO: 1277749 - RNA, 14 nt, Mycobacterium tuberculosis H37Rv
cggagacgaucgcc

SEQ ID NO: 1277750 - RNA, 18 nt, Mycobacterium tuberculosis H37Rv
cggagaccggccggguga

SEQ ID NO: 1277751 - RNA, 13 nt, Mycobacterium tuberculosis H37Rv
cggacuucgccgc

SEQ ID NO: 1277752 - RNA, 23 nt, Mycobacterium tuberculosis H37Rv
cggacuucguuccgugccgagcu

SEQ ID NO: 1277753 - RNA, 19 nt, Mycobacterium tuberculosis H37Rv
cggacuucaugaucggacc

SEQ ID NO: 1277754 - RNA, 23 nt, Mycobacterium tuberculosis H37Rv
cggaggcgaccacgucggcgaac

SEQ ID NO: 1277755 - RNA, 19 nt, Mycobacterium tuberculosis H37Rv
cggaggcgaccacgucggc

SEQ ID NO: 1277756 - RNA, 14 nt, Mycobacterium tuberculosis H37Rv
cggaggcgaccacg

SEQ ID NO: 1277757 - RNA, 17 nt, Mycobacterium tuberculosis H37Rv
cggagccgagccgauau

SEQ ID NO: 1277758 - RNA, 16 nt, Mycobacterium tuberculosis H37Rv
cggagccgaugaucga

SEQ ID NO: 1277759 - RNA, 21 nt, Mycobacterium tuberculosis H37Rv
cggagccgaugaucgaacacg

SEQ ID NO: 1277760 - RNA, 13 nt, Mycobacterium tuberculosis H37Rv
cggagccgccagg

SEQ ID NO: 1277761 - RNA, 17 nt, Mycobacterium tuberculosis H37Rv
cggagccggccaccucg

SEQ ID NO: 1277762 - RNA, 20 nt, Mycobacterium tuberculosis H37Rv
cggagccggugccgacggcg

SEQ ID NO: 1277763 - RNA, 17 nt, Mycobacterium tuberculosis H37Rv
cggagcggucagcggau

SEQ ID NO: 1277764 - RNA, 20 nt, Mycobacterium tuberculosis H37Rv
cggagcggugccgacgguga

SEQ ID NO: 1277765 - RNA, 21 nt, Mycobacterium tuberculosis H37Rv
cggagccgucgcaucaggucg

SEQ ID NO: 1277766 - RNA, 17 nt, Mycobacterium tuberculosis H37Rv
cggagccgccgacucgg

SEQ ID NO: 1277767 - RNA, 16 nt, Mycobacterium tuberculosis H37Rv
cggaggcggaccaggc

SEQ ID NO: 1277768 - RNA, 17 nt, Mycobacterium tuberculosis H37Rv
cggaggcugggcugagg

SEQ ID NO: 1277769 - RNA, 19 nt, Mycobacterium tuberculosis H37Rv
cggagucgcccgguccgcc

SEQ ID NO: 1277770 - RNA, 12 nt, Mycobacterium tuberculosis H37Rv
cggagucgacgg

SEQ ID NO: 1277771 - RNA, 18 nt, Mycobacterium tuberculosis H37Rv
cggagucgagcacaccga

SEQ ID NO: 1277772 - RNA, 19 nt, Mycobacterium tuberculosis H37Rv
cggagucgacggucacggu

SEQ ID NO: 1277773 - RNA, 18 nt, Mycobacterium tuberculosis H37Rv
cggagucacgcagccgcg

SEQ ID NO: 1277774 - RNA, 18 nt, Mycobacterium tuberculosis H37Rv
cggaguugaagaagcccg

SEQ ID NO: 1277775 - RNA, 19 nt, Mycobacterium tuberculosis H37Rv
cggaguugucgacggccac

SEQ ID NO: 1277776 - RNA, 22 nt, Mycobacterium tuberculosis H37Rv
cggaguugaagaagcccgacga

SEQ ID NO: 1277777 - RNA, 20 nt, Mycobacterium tuberculosis H37Rv
cggaguuuaagacgcccgag

SEQ ID NO: 1277778 - RNA, 16 nt, Mycobacterium tuberculosis H37Rv
cggauaaccggcaugc

SEQ ID NO: 1277779 - RNA, 16 nt, Mycobacterium tuberculosis H37Rv
cggaucaccaucgccg

SEQ ID NO: 1277780 - RNA, 18 nt, Mycobacterium tuberculosis H37Rv
cggauagcaccggcaccc

SEQ ID NO: 1277781 - RNA, 16 nt, Mycobacterium tuberculosis H37Rv
cggauacagccacgca

SEQ ID NO: 1277782 - RNA, 23 nt, Mycobacterium tuberculosis H37Rv
cggauacauuucgucgucgcagu

SEQ ID NO: 1277783 - RNA, 20 nt, Mycobacterium tuberculosis H37Rv
cggacgacaacaggccgucg

SEQ ID NO: 1277784 - RNA, 21 nt, Mycobacterium tuberculosis H37Rv
cggacgaacgccgucgacgcg

SEQ ID NO: 1277785 - RNA, 18 nt, Mycobacterium tuberculosis H37Rv
cggaccuccucgcccauu

SEQ ID NO: 1277786 - RNA, 20 nt, Mycobacterium tuberculosis H37Rv
cggaccugggcgacuaccgg

SEQ ID NO: 1277787 - RNA, 19 nt, Mycobacterium tuberculosis H37Rv
cggaccugaccgguggcca

SEQ ID NO: 1277788 - RNA, 17 nt, Mycobacterium tuberculosis H37Rv
cggaccguccgacggcg

SEQ ID NO: 1277789 - RNA, 17 nt, Mycobacterium tuberculosis H37Rv
cggaccgucgccgguga

SEQ ID NO: 1277790 - RNA, 23 nt, Mycobacterium tuberculosis H37Rv
cggaccgucuuuggugccgagca

SEQ ID NO: 1277791 - RNA, 13 nt, Mycobacterium tuberculosis H37Rv
cggaccucggcgg

SEQ ID NO: 1277792 - RNA, 14 nt, Mycobacterium tuberculosis H37Rv
cggaccucgcccau

SEQ ID NO: 1277793 - RNA, 17 nt, Mycobacterium tuberculosis H37Rv
cggaccugcgccgguga

SEQ ID NO: 1277794 - RNA, 16 nt, Mycobacterium tuberculosis H37Rv
cggacgcaacacccgg

SEQ ID NO: 1277795 - RNA, 20 nt, Mycobacterium tuberculosis H37Rv
cggacgcaacacccgggcga

SEQ ID NO: 1277796 - RNA, 19 nt, Mycobacterium tuberculosis H37Rv
cggacgcaacucgacgcgu

SEQ ID NO: 1277797 - RNA, 23 nt, Mycobacterium tuberculosis H37Rv
cggacgccgcgccggcgggcgag

SEQ ID NO: 1277798 - RNA, 19 nt, Mycobacterium tuberculosis H37Rv
cggacgcacgauccgcacc

SEQ ID NO: 1277799 - RNA, 18 nt, Mycobacterium tuberculosis H37Rv
cggacguaggcaccccgg

SEQ ID NO: 1277800 - RNA, 20 nt, Mycobacterium tuberculosis H37Rv
cggacgucgacuuguugggc

SEQ ID NO: 1277801 - RNA, 14 nt, Mycobacterium tuberculosis H37Rv
cggacgugccgguc

SEQ ID NO: 1277802 - RNA, 18 nt, Mycobacterium tuberculosis H37Rv
cggacgggaugcuugguc

SEQ ID NO: 1277803 - RNA, 21 nt, Mycobacterium tuberculosis H37Rv
cggacgcugauugcgaccgcg

SEQ ID NO: 1277804 - RNA, 22 nt, Mycobacterium tuberculosis H37Rv
cggacgcgggugccagaucggc

SEQ ID NO: 1277805 - RNA, 20 nt, Mycobacterium tuberculosis H37Rv
cggacggauucgaaggucgg

SEQ ID NO: 1277806 - RNA, 22 nt, Mycobacterium tuberculosis H37Rv
cggacggcguuuccuucgacga

SEQ ID NO: 1277807 - RNA, 14 nt, Mycobacterium tuberculosis H37Rv
cggacugacgucga

SEQ ID NO: 1277808 - RNA, 21 nt, Mycobacterium tuberculosis H37Rv
cggacugagagauggucgggc

SEQ ID NO: 1277809 - RNA, 12 nt, Mycobacterium tuberculosis H37Rv
cggacugcagcg

SEQ ID NO: 1277810 - RNA, 15 nt, Mycobacterium tuberculosis H37Rv
cggacucccucgauc

SEQ ID NO: 1277811 - RNA, 20 nt, Mycobacterium tuberculosis H37Rv
cggacucggaauucggcguc

SEQ ID NO: 1277812 - RNA, 15 nt, Mycobacterium tuberculosis H37Rv
cggacgugacgucgu

SEQ ID NO: 1277813 - RNA, 16 nt, Mycobacterium tuberculosis H37Rv
cggacucccucgauca

SEQ ID NO: 1277814 - RNA, 15 nt, Mycobacterium tuberculosis H37Rv
cggacccaccgucac

SEQ ID NO: 1277815 - RNA, 18 nt, Mycobacterium tuberculosis H37Rv
cggacccacccgcaccgc

SEQ ID NO: 1277816 - RNA, 20 nt, Mycobacterium tuberculosis H37Rv
cggacccgcagcugcggauc

SEQ ID NO: 1277817 - RNA, 19 nt, Mycobacterium tuberculosis H37Rv
cggacccgaccgucgucgu

SEQ ID NO: 1277818 - RNA, 13 nt, Mycobacterium tuberculosis H37Rv
cggaccagcugcc

SEQ ID NO: 1277819 - RNA, 21 nt, Mycobacterium tuberculosis H37Rv
cggaccacuguuggugccgcc

SEQ ID NO: 1277820 - RNA, 20 nt, Mycobacterium tuberculosis H37Rv
cggaccacuguuggugccgc

SEQ ID NO: 1277821 - RNA, 16 nt, Mycobacterium tuberculosis H37Rv
cggaccaucgacaacg

SEQ ID NO: 1277822 - RNA, 14 nt, Mycobacterium tuberculosis H37Rv
cggaccaucgccag

SEQ ID NO: 1277823 - RNA, 13 nt, Mycobacterium tuberculosis H37Rv
cggacccuuccgc

SEQ ID NO: 1277824 - RNA, 18 nt, Mycobacterium tuberculosis H37Rv
cggaccgaccggcucacg

SEQ ID NO: 1277825 - RNA, 21 nt, Mycobacterium tuberculosis H37Rv
cggacccuaacucccccgcua

SEQ ID NO: 1277826 - RNA, 12 nt, Mycobacterium tuberculosis H37Rv
cggaccgauggu

SEQ ID NO: 1277827 - RNA, 11 nt, Mycobacterium tuberculosis H37Rv
cggaccgcgaa

SEQ ID NO: 1277828 - RNA, 21 nt, Mycobacterium tuberculosis H37Rv
cggaccgggggaagcgguagc

SEQ ID NO: 1277829 - RNA, 20 nt, Mycobacterium tuberculosis H37Rv
cggaccgcacuugaucgacg

SEQ ID NO: 1277830 - RNA, 21 nt, Mycobacterium tuberculosis H37Rv
cggaccgcggccaccgccugu

SEQ ID NO: 1277831 - RNA, 18 nt, Mycobacterium tuberculosis H37Rv
cgcugaccuuuucccgca

SEQ ID NO: 1277832 - RNA, 13 nt, Mycobacterium tuberculosis H37Rv
cgcugagcagcgc

SEQ ID NO: 1277833 - RNA, 19 nt, Mycobacterium tuberculosis H37Rv
cggaccagagugguggcga

SEQ ID NO: 1277834 - RNA, 12 nt, Mycobacterium tuberculosis H37Rv
cggaccacaucu

SEQ ID NO: 1277835 - RNA, 21 nt, Mycobacterium tuberculosis H37Rv
cggaccaccgggccgacagca

SEQ ID NO: 1277836 - RNA, 18 nt, Mycobacterium tuberculosis H37Rv
cggacaucaccggcaugc

SEQ ID NO: 1277837 - RNA, 15 nt, Mycobacterium tuberculosis H37Rv
cggacauccgaugcg

SEQ ID NO: 1277838 - RNA, 23 nt, Mycobacterium tuberculosis H37Rv
cggacauccgaugcgucacacca

SEQ ID NO: 1277839 - RNA, 19 nt, Mycobacterium tuberculosis H37Rv
cggacauccgggccgagcg

SEQ ID NO: 1277840 - RNA, 14 nt, Mycobacterium tuberculosis H37Rv
cggacauaccgcga

SEQ ID NO: 1277841 - RNA, 18 nt, Mycobacterium tuberculosis H37Rv
cgcugagcgggcaacugc

SEQ ID NO: 1277842 - RNA, 14 nt, Mycobacterium tuberculosis H37Rv
cggcaccgccggug

SEQ ID NO: 1277843 - RNA, 21 nt, Mycobacterium tuberculosis H37Rv
cggcaccgccggcaccgccgg

SEQ ID NO: 1277844 - RNA, 21 nt, Mycobacterium tuberculosis H37Rv
cggcaccgcccuugccgccgu

SEQ ID NO: 1277845 - RNA, 14 nt, Mycobacterium tuberculosis H37Rv
cggcacccaccagu

SEQ ID NO: 1277846 - RNA, 21 nt, Mycobacterium tuberculosis H37Rv
cggcacccaguuccacccggu

SEQ ID NO: 1277847 - RNA, 17 nt, Mycobacterium tuberculosis H37Rv
cggcaccccacgccugc

SEQ ID NO: 1277848 - RNA, 21 nt, Mycobacterium tuberculosis H37Rv
cggcacccccgucgccaccga

SEQ ID NO: 1277849 - RNA, 18 nt, Mycobacterium tuberculosis H37Rv
cggcacccccgucgccac

SEQ ID NO: 1277850 - RNA, 15 nt, Mycobacterium tuberculosis H37Rv
cggcacccccgacga

SEQ ID NO: 1277851 - RNA, 20 nt, Mycobacterium tuberculosis H37Rv
cggcaccagguugccgaggu

SEQ ID NO: 1277852 - RNA, 17 nt, Mycobacterium tuberculosis H37Rv
cggcaccagguugccga

SEQ ID NO: 1277853 - RNA, 22 nt, Mycobacterium tuberculosis H37Rv
cggcaccuccgccggcaccucc

SEQ ID NO: 1277854 - RNA, 19 nt, Mycobacterium tuberculosis H37Rv
cggcaccuccggcaccgcc

SEQ ID NO: 1277855 - RNA, 21 nt, Mycobacterium tuberculosis H37Rv
cggcaccgucucgcaccgcgu

SEQ ID NO: 1277856 - RNA, 16 nt, Mycobacterium tuberculosis H37Rv
cggcaccgugucgacg

SEQ ID NO: 1277857 - RNA, 16 nt, Mycobacterium tuberculosis H37Rv
cggcaccgcugccgcu

SEQ ID NO: 1277858 - RNA, 20 nt, Mycobacterium tuberculosis H37Rv
cggcaccguagagcaugccg

SEQ ID NO: 1277859 - RNA, 15 nt, Mycobacterium tuberculosis H37Rv
cggcaccgucucgca

SEQ ID NO: 1277860 - RNA, 14 nt, Mycobacterium tuberculosis H37Rv
cggcaccgcugagg

SEQ ID NO: 1277861 - RNA, 22 nt, Mycobacterium tuberculosis H37Rv
cggcaccacagugaaauccgag

SEQ ID NO: 1277862 - RNA, 14 nt, Mycobacterium tuberculosis H37Rv
cggcaccaccgcga

SEQ ID NO: 1277863 - RNA, 22 nt, Mycobacterium tuberculosis H37Rv
cggcaccaccaagcucggccag

SEQ ID NO: 1277864 - RNA, 12 nt, Mycobacterium tuberculosis H37Rv
cggcaccacgau

SEQ ID NO: 1277865 - RNA, 14 nt, Mycobacterium tuberculosis H37Rv
cggcaccaccguug

SEQ ID NO: 1277866 - RNA, 17 nt, Mycobacterium tuberculosis H37Rv
cggcaccaccguugccg

SEQ ID NO: 1277867 - RNA, 14 nt, Mycobacterium tuberculosis H37Rv
cggcaccacgucga

SEQ ID NO: 1277868 - RNA, 18 nt, Mycobacterium tuberculosis H37Rv
cggcacacccaucaccgc

SEQ ID NO: 1277869 - RNA, 19 nt, Mycobacterium tuberculosis H37Rv
cggcacacccaucaccgcc

SEQ ID NO: 1277870 - RNA, 22 nt, Mycobacterium tuberculosis H37Rv
cggcacacccaucaccgccagc

SEQ ID NO: 1277871 - RNA, 16 nt, Mycobacterium tuberculosis H37Rv
cggcacacccaucagc

SEQ ID NO: 1277872 - RNA, 18 nt, Mycobacterium tuberculosis H37Rv
cggcacaccccgguucga

SEQ ID NO: 1277873 - RNA, 16 nt, Mycobacterium tuberculosis H37Rv
cggcacacccaucacc

SEQ ID NO: 1277874 - RNA, 23 nt, Mycobacterium tuberculosis H37Rv
cggcacaucaugggcgcugccaa

SEQ ID NO: 1277875 - RNA, 20 nt, Mycobacterium tuberculosis H37Rv
cggcaauuacccgacuucaa

SEQ ID NO: 1277876 - RNA, 16 nt, Mycobacterium tuberculosis H37Rv
cggcacaaucggcgcc

SEQ ID NO: 1277877 - RNA, 19 nt, Mycobacterium tuberculosis H37Rv
cggcaauugcgguucgaac

SEQ ID NO: 1277878 - RNA, 18 nt, Mycobacterium tuberculosis H37Rv
cggcaauacuccgcugac

SEQ ID NO: 1277879 - RNA, 15 nt, Mycobacterium tuberculosis H37Rv
cggcaauaccgccag

SEQ ID NO: 1277880 - RNA, 14 nt, Mycobacterium tuberculosis H37Rv
cggcaagucgacgc

SEQ ID NO: 1277881 - RNA, 17 nt, Mycobacterium tuberculosis H37Rv
cggcaaguuccacgggu

SEQ ID NO: 1277882 - RNA, 18 nt, Mycobacterium tuberculosis H37Rv
cggcaaucggcggcaccc

SEQ ID NO: 1277883 - RNA, 12 nt, Mycobacterium tuberculosis H37Rv
cggcaaucucga

SEQ ID NO: 1277884 - RNA, 13 nt, Mycobacterium tuberculosis H37Rv
cggcaagauccgg

SEQ ID NO: 1277885 - RNA, 14 nt, Mycobacterium tuberculosis H37Rv
cggcaagcgcagac

SEQ ID NO: 1277886 - RNA, 21 nt, Mycobacterium tuberculosis H37Rv
cggcaagcgcagacacgaccc

SEQ ID NO: 1277887 - RNA, 16 nt, Mycobacterium tuberculosis H37Rv
cggcaaggucaacggg

SEQ ID NO: 1277888 - RNA, 14 nt, Mycobacterium tuberculosis H37Rv
cggcaagcucgacg

SEQ ID NO: 1277889 - RNA, 17 nt, Mycobacterium tuberculosis H37Rv
cggcaagccaaccagcc

SEQ ID NO: 1277890 - RNA, 14 nt, Mycobacterium tuberculosis H37Rv
cggcaaggcggauc

SEQ ID NO: 1277891 - RNA, 14 nt, Mycobacterium tuberculosis H37Rv
cggcaaccacggag

SEQ ID NO: 1277892 - RNA, 14 nt, Mycobacterium tuberculosis H37Rv
cggcaacccacacg

SEQ ID NO: 1277893 - RNA, 13 nt, Mycobacterium tuberculosis H37Rv
cggcaacaucagc

SEQ ID NO: 1277894 - RNA, 13 nt, Mycobacterium tuberculosis H37Rv
cggcaaccagcga

SEQ ID NO: 1277895 - RNA, 16 nt, Mycobacterium tuberculosis H37Rv
cggcaacagcaccagu

SEQ ID NO: 1277896 - RNA, 16 nt, Mycobacterium tuberculosis H37Rv
cggcaacgcggucugc

SEQ ID NO: 1277897 - RNA, 20 nt, Mycobacterium tuberculosis H37Rv
cggaugagcucggccaucag

SEQ ID NO: 1277898 - RNA, 19 nt, Mycobacterium tuberculosis H37Rv
cggaugacaccgaccgggu

SEQ ID NO: 1277899 - RNA, 17 nt, Mycobacterium tuberculosis H37Rv
cggaucuggugggugcg

SEQ ID NO: 1277900 - RNA, 22 nt, Mycobacterium tuberculosis H37Rv
cggaucgucgaacagcaccgcc

SEQ ID NO: 1277901 - RNA, 19 nt, Mycobacterium tuberculosis H37Rv
cggaucgugcccuguccgg

SEQ ID NO: 1277902 - RNA, 14 nt, Mycobacterium tuberculosis H37Rv
cggaucgucgaggc

SEQ ID NO: 1277903 - RNA, 21 nt, Mycobacterium tuberculosis H37Rv
cggaucguucgcgugccagcg

SEQ ID NO: 1277904 - RNA, 17 nt, Mycobacterium tuberculosis H37Rv
cggaucauucugcggcc

SEQ ID NO: 1277905 - RNA, 23 nt, Mycobacterium tuberculosis H37Rv
cggaucauccuucgccggcgcca

SEQ ID NO: 1277906 - RNA, 19 nt, Mycobacterium tuberculosis H37Rv
cggauccauuagcacaucg

SEQ ID NO: 1277907 - RNA, 19 nt, Mycobacterium tuberculosis H37Rv
cggaucgaccaauucgacc

SEQ ID NO: 1277908 - RNA, 23 nt, Mycobacterium tuberculosis H37Rv
cggaucgaaacucagcccgucgg

SEQ ID NO: 1277909 - RNA, 22 nt, Mycobacterium tuberculosis H37Rv
cggauccucggccgccaucgcc

SEQ ID NO: 1277910 - RNA, 19 nt, Mycobacterium tuberculosis H37Rv
cggaucgccaggccgucgg

SEQ ID NO: 1277911 - RNA, 20 nt, Mycobacterium tuberculosis H37Rv
cggaucgauuccgccgcacu

SEQ ID NO: 1277912 - RNA, 13 nt, Mycobacterium tuberculosis H37Rv
cggaucggcaccc

SEQ ID NO: 1277913 - RNA, 15 nt, Mycobacterium tuberculosis H37Rv
cggaucgcucccguc

SEQ ID NO: 1277914 - RNA, 17 nt, Mycobacterium tuberculosis H37Rv
cggcaaaacacaccgaa

SEQ ID NO: 1277915 - RNA, 18 nt, Mycobacterium tuberculosis H37Rv
cggcaaaccugaguccgg

SEQ ID NO: 1277916 - RNA, 21 nt, Mycobacterium tuberculosis H37Rv
cggcaaaggauucgcgcgaau

SEQ ID NO: 1277917 - RNA, 14 nt, Mycobacterium tuberculosis H37Rv
cggcaaagccgggu

SEQ ID NO: 1277918 - RNA, 14 nt, Mycobacterium tuberculosis H37Rv
cggauuccagcgcg

SEQ ID NO: 1277919 - RNA, 20 nt, Mycobacterium tuberculosis H37Rv
cggauuccggcucgucaggu

SEQ ID NO: 1277920 - RNA, 17 nt, Mycobacterium tuberculosis H37Rv
cggauucggcugccacc

SEQ ID NO: 1277921 - RNA, 24 nt, Mycobacterium tuberculosis H37Rv
cggauugcagcgcgauggccuggc

SEQ ID NO: 1277922 - RNA, 15 nt, Mycobacterium tuberculosis H37Rv
cggauugcagcgcga

SEQ ID NO: 1277923 - RNA, 14 nt, Mycobacterium tuberculosis H37Rv
cggauugacgccga

SEQ ID NO: 1277924 - RNA, 21 nt, Mycobacterium tuberculosis H37Rv
cggaugucgucgaccaggcca

SEQ ID NO: 1277925 - RNA, 17 nt, Mycobacterium tuberculosis H37Rv
cggaugucucggcacca

SEQ ID NO: 1277926 - RNA, 13 nt, Mycobacterium tuberculosis H37Rv
cggauggcgucga

SEQ ID NO: 1277927 - RNA, 18 nt, Mycobacterium tuberculosis H37Rv
cggauggguggccagcaa

SEQ ID NO: 1277928 - RNA, 17 nt, Mycobacterium tuberculosis H37Rv
cggauguccgccgacgu

SEQ ID NO: 1277929 - RNA, 14 nt, Mycobacterium tuberculosis H37Rv
cggauguccgccga

SEQ ID NO: 1277930 - RNA, 17 nt, Mycobacterium tuberculosis H37Rv
cggauggugugucgggu

SEQ ID NO: 1277931 - RNA, 21 nt, Mycobacterium tuberculosis H37Rv
cggaugucgacgagcaccgcg

SEQ ID NO: 1277932 - RNA, 16 nt, Mycobacterium tuberculosis H37Rv
cggaugucgacgagca

SEQ ID NO: 1277933 - RNA, 13 nt, Mycobacterium tuberculosis H37Rv
cggaugucgacga

SEQ ID NO: 1277934 - RNA, 20 nt, Mycobacterium tuberculosis H37Rv
cggaugcucaggucaccggc

SEQ ID NO: 1277935 - RNA, 20 nt, Mycobacterium tuberculosis H37Rv
cggaugcugucagcagccca

SEQ ID NO: 1277936 - RNA, 22 nt, Mycobacterium tuberculosis H37Rv
cggaugcugucagcagcccauu

SEQ ID NO: 1277937 - RNA, 19 nt, Mycobacterium tuberculosis H37Rv
cggaugcguuggccccagg

SEQ ID NO: 1277938 - RNA, 14 nt, Mycobacterium tuberculosis H37Rv
cggauggccucgaa

SEQ ID NO: 1277939 - RNA, 22 nt, Mycobacterium tuberculosis H37Rv
cggauggccucggcgauaccga

SEQ ID NO: 1277940 - RNA, 14 nt, Mycobacterium tuberculosis H37Rv
cggcgaugaacggg

SEQ ID NO: 1277941 - RNA, 16 nt, Mycobacterium tuberculosis H37Rv
cggcgaucucgaccgu

SEQ ID NO: 1277942 - RNA, 15 nt, Mycobacterium tuberculosis H37Rv
cggcgaucugcugug

SEQ ID NO: 1277943 - RNA, 17 nt, Mycobacterium tuberculosis H37Rv
cggcgaucucgucgcgg

SEQ ID NO: 1277944 - RNA, 21 nt, Mycobacterium tuberculosis H37Rv
cggcgaucgcuccgcggcgca

SEQ ID NO: 1277945 - RNA, 19 nt, Mycobacterium tuberculosis H37Rv
cggcgaucuccggcggauc

SEQ ID NO: 1277946 - RNA, 22 nt, Mycobacterium tuberculosis H37Rv
cggcgaucuccggcggaucugg

SEQ ID NO: 1277947 - RNA, 13 nt, Mycobacterium tuberculosis H37Rv
cggcgaucgguga

SEQ ID NO: 1277948 - RNA, 20 nt, Mycobacterium tuberculosis H37Rv
cggccuugugcucgaugcga

SEQ ID NO: 1277949 - RNA, 21 nt, Mycobacterium tuberculosis H37Rv
cggccuuuccagcaccccgau

SEQ ID NO: 1277950 - RNA, 16 nt, Mycobacterium tuberculosis H37Rv
cggcgaaacucgucga

SEQ ID NO: 1277951 - RNA, 20 nt, Mycobacterium tuberculosis H37Rv
cggcgaaaacaacaccaccg

SEQ ID NO: 1277952 - RNA, 19 nt, Mycobacterium tuberculosis H37Rv
cggcgauccggucggccag

SEQ ID NO: 1277953 - RNA, 15 nt, Mycobacterium tuberculosis H37Rv
cggcgaucgcauggu

SEQ ID NO: 1277954 - RNA, 14 nt, Mycobacterium tuberculosis H37Rv
cggcgaucgcaugg

SEQ ID NO: 1277955 - RNA, 22 nt, Mycobacterium tuberculosis H37Rv
cggccuuggcgacgucgcgggu

SEQ ID NO: 1277956 - RNA, 15 nt, Mycobacterium tuberculosis H37Rv
cggccuuuuccgggu

SEQ ID NO: 1277957 - RNA, 17 nt, Mycobacterium tuberculosis H37Rv
cggccuugugcucgaug

SEQ ID NO: 1277958 - RNA, 12 nt, Mycobacterium tuberculosis H37Rv
cggcgaugucga

SEQ ID NO: 1277959 - RNA, 22 nt, Mycobacterium tuberculosis H37Rv
cggcgaugguugaaccagucga

SEQ ID NO: 1277960 - RNA, 16 nt, Mycobacterium tuberculosis H37Rv
cggcgaugguaucgcc

SEQ ID NO: 1277961 - RNA, 21 nt, Mycobacterium tuberculosis H37Rv
cggcgcacaaacauacgccac

SEQ ID NO: 1277962 - RNA, 17 nt, Mycobacterium tuberculosis H37Rv
cggcgcacaacccgucg

SEQ ID NO: 1277963 - RNA, 21 nt, Mycobacterium tuberculosis H37Rv
cggcgaugucgcgcauugccg

SEQ ID NO: 1277964 - RNA, 14 nt, Mycobacterium tuberculosis H37Rv
cggcgaugcagcca

SEQ ID NO: 1277965 - RNA, 14 nt, Mycobacterium tuberculosis H37Rv
cggcgaugggccgg

SEQ ID NO: 1277966 - RNA, 17 nt, Mycobacterium tuberculosis H37Rv
cggcgaugauggcgcga

SEQ ID NO: 1277967 - RNA, 19 nt, Mycobacterium tuberculosis H37Rv
cggcgaugauggcgcgauc

SEQ ID NO: 1277968 - RNA, 18 nt, Mycobacterium tuberculosis H37Rv
cggcgaugaugacggcgg

SEQ ID NO: 1277969 - RNA, 16 nt, Mycobacterium tuberculosis H37Rv
cggcgaugcagccggg

SEQ ID NO: 1277970 - RNA, 17 nt, Mycobacterium tuberculosis H37Rv
cggcgaugcagccggga

SEQ ID NO: 1277971 - RNA, 20 nt, Mycobacterium tuberculosis H37Rv
cggcgaugauguugagcugg

SEQ ID NO: 1277972 - RNA, 15 nt, Mycobacterium tuberculosis H37Rv
cggcgcccaggccga

SEQ ID NO: 1277973 - RNA, 21 nt, Mycobacterium tuberculosis H37Rv
cggcgcccaggccgaucagcg

SEQ ID NO: 1277974 - RNA, 17 nt, Mycobacterium tuberculosis H37Rv
cggcgcccagcucgucg

SEQ ID NO: 1277975 - RNA, 21 nt, Mycobacterium tuberculosis H37Rv
cggcgcccagcucgucgagcu

SEQ ID NO: 1277976 - RNA, 18 nt, Mycobacterium tuberculosis H37Rv
cggcgcccacaucgucgg

SEQ ID NO: 1277977 - RNA, 16 nt, Mycobacterium tuberculosis H37Rv
cggcgcccacaucguc

SEQ ID NO: 1277978 - RNA, 18 nt, Mycobacterium tuberculosis H37Rv
cggcgccauggaucccac

SEQ ID NO: 1277979 - RNA, 22 nt, Mycobacterium tuberculosis H37Rv
cggcgccauuggcgucccgcaa

SEQ ID NO: 1277980 - RNA, 18 nt, Mycobacterium tuberculosis H37Rv
cggcgccggagccgccca

SEQ ID NO: 1277981 - RNA, 14 nt, Mycobacterium tuberculosis H37Rv
cggcgccggaguug

SEQ ID NO: 1277982 - RNA, 14 nt, Mycobacterium tuberculosis H37Rv
cggcgccgccguug

SEQ ID NO: 1277983 - RNA, 17 nt, Mycobacterium tuberculosis H37Rv
cggcgccgccguugccg

SEQ ID NO: 1277984 - RNA, 23 nt, Mycobacterium tuberculosis H37Rv
cggcgccgccggugccaccggcu

SEQ ID NO: 1277985 - RNA, 23 nt, Mycobacterium tuberculosis H37Rv
cggcgccgccgucgccgccguua

SEQ ID NO: 1277986 - RNA, 14 nt, Mycobacterium tuberculosis H37Rv
cggcgccgccggca

SEQ ID NO: 1277987 - RNA, 19 nt, Mycobacterium tuberculosis H37Rv
cggcgcccggucgagccag

SEQ ID NO: 1277988 - RNA, 22 nt, Mycobacterium tuberculosis H37Rv
cggcgccgcccgcgccaccagc

SEQ ID NO: 1277989 - RNA, 15 nt, Mycobacterium tuberculosis H37Rv
cggcgcccaucgcga

SEQ ID NO: 1277990 - RNA, 18 nt, Mycobacterium tuberculosis H37Rv
cggcgcccauagcaccuc

SEQ ID NO: 1277991 - RNA, 21 nt, Mycobacterium tuberculosis H37Rv
cggcgcccauagcaccucgau

SEQ ID NO: 1277992 - RNA, 14 nt, Mycobacterium tuberculosis H37Rv
cggcgcccaucgcg

SEQ ID NO: 1277993 - RNA, 18 nt, Mycobacterium tuberculosis H37Rv
cggcggcacuggugcccg

SEQ ID NO: 1277994 - RNA, 14 nt, Mycobacterium tuberculosis H37Rv
cggcggcagcgauc

SEQ ID NO: 1277995 - RNA, 15 nt, Mycobacterium tuberculosis H37Rv
cggcggcagcggcga

SEQ ID NO: 1277996 - RNA, 19 nt, Mycobacterium tuberculosis H37Rv
cggcggcagcauauccgcc

SEQ ID NO: 1277997 - RNA, 20 nt, Mycobacterium tuberculosis H37Rv
cggcggcagcggcgccgccu

SEQ ID NO: 1277998 - RNA, 14 nt, Mycobacterium tuberculosis H37Rv
cggcggcacgcucg

SEQ ID NO: 1277999 - RNA, 18 nt, Mycobacterium tuberculosis H37Rv
cggcggcacgcucgcgca

SEQ ID NO: 1278000 - RNA, 22 nt, Mycobacterium tuberculosis H37Rv
cggcggcacuacgcagccguag

SEQ ID NO: 1278001 - RNA, 13 nt, Mycobacterium tuberculosis H37Rv
cggcggcacccgg

SEQ ID NO: 1278002 - RNA, 17 nt, Mycobacterium tuberculosis H37Rv
cggcggcacccgggugg

SEQ ID NO: 1278003 - RNA, 21 nt, Mycobacterium tuberculosis H37Rv
cggcggcacccggguggcacg

SEQ ID NO: 1278004 - RNA, 14 nt, Mycobacterium tuberculosis H37Rv
cggcggcacccggg

SEQ ID NO: 1278005 - RNA, 15 nt, Mycobacterium tuberculosis H37Rv
cggcggaaggcgucg

SEQ ID NO: 1278006 - RNA, 20 nt, Mycobacterium tuberculosis H37Rv
cggcggaagaccggaucgcc

SEQ ID NO: 1278007 - RNA, 19 nt, Mycobacterium tuberculosis H37Rv
cggcggaaggacggcagcc

SEQ ID NO: 1278008 - RNA, 21 nt, Mycobacterium tuberculosis H37Rv
cggcggaccguccgacggcgg

SEQ ID NO: 1278009 - RNA, 15 nt, Mycobacterium tuberculosis H37Rv
cggcggacaccucgg

SEQ ID NO: 1278010 - RNA, 14 nt, Mycobacterium tuberculosis H37Rv
cggcggaccguccg

SEQ ID NO: 1278011 - RNA, 21 nt, Mycobacterium tuberculosis H37Rv
cggcgcugcagcugcucgucg

SEQ ID NO: 1278012 - RNA, 14 nt, Mycobacterium tuberculosis H37Rv
cggcgcugaugccg

SEQ ID NO: 1278013 - RNA, 21 nt, Mycobacterium tuberculosis H37Rv
cggcgcugcccgggcugccgc

SEQ ID NO: 1278014 - RNA, 21 nt, Mycobacterium tuberculosis H37Rv
cggcgcguggcaccaccaagg

SEQ ID NO: 1278015 - RNA, 19 nt, Mycobacterium tuberculosis H37Rv
cggcgcguggugccuacac

SEQ ID NO: 1278016 - RNA, 15 nt, Mycobacterium tuberculosis H37Rv
cggcgcgcaccucgg

SEQ ID NO: 1278017 - RNA, 18 nt, Mycobacterium tuberculosis H37Rv
cggcgcgccgaccaccgc

SEQ ID NO: 1278018 - RNA, 23 nt, Mycobacterium tuberculosis H37Rv
cggcgcgccgaucggcaccgugu

SEQ ID NO: 1278019 - RNA, 14 nt, Mycobacterium tuberculosis H37Rv
cggcgcgccgcaca

SEQ ID NO: 1278020 - RNA, 18 nt, Mycobacterium tuberculosis H37Rv
cggcgcgaucgacgcucg

SEQ ID NO: 1278021 - RNA, 12 nt, Mycobacterium tuberculosis H37Rv
cggcgcgagccu

SEQ ID NO: 1278022 - RNA, 18 nt, Mycobacterium tuberculosis H37Rv
cggcgcgauagauacccg

SEQ ID NO: 1278023 - RNA, 16 nt, Mycobacterium tuberculosis H37Rv
cggcgcgagccgcacg

SEQ ID NO: 1278024 - RNA, 21 nt, Mycobacterium tuberculosis H37Rv
cggcgccgucgcccagcguga

SEQ ID NO: 1278025 - RNA, 22 nt, Mycobacterium tuberculosis H37Rv
cggcgccgucguugugccgguc

SEQ ID NO: 1278026 - RNA, 14 nt, Mycobacterium tuberculosis H37Rv
cggcgccgucguug

SEQ ID NO: 1278027 - RNA, 17 nt, Mycobacterium tuberculosis H37Rv
cggcgccgucguugugc

SEQ ID NO: 1278028 - RNA, 21 nt, Mycobacterium tuberculosis H37Rv
cggcgccgugaucagcucgcg

SEQ ID NO: 1278029 - RNA, 13 nt, Mycobacterium tuberculosis H37Rv
cggcgccguugcc

SEQ ID NO: 1278030 - RNA, 21 nt, Mycobacterium tuberculosis H37Rv
cggcgccggcaucuccaccgu

SEQ ID NO: 1278031 - RNA, 21 nt, Mycobacterium tuberculosis H37Rv
cggcgcgguuucggcgucacc

SEQ ID NO: 1278032 - RNA, 22 nt, Mycobacterium tuberculosis H37Rv
cggcgcgguuucggcgucaccg

SEQ ID NO: 1278033 - RNA, 15 nt, Mycobacterium tuberculosis H37Rv
cggcgcgguugggca

SEQ ID NO: 1278034 - RNA, 24 nt, Mycobacterium tuberculosis H37Rv
cggcgcgguggggcgcgccggcua

SEQ ID NO: 1278035 - RNA, 21 nt, Mycobacterium tuberculosis H37Rv
cggcgcgggucacgccgucac

SEQ ID NO: 1278036 - RNA, 20 nt, Mycobacterium tuberculosis H37Rv
cggcgcggccgcagccagca

SEQ ID NO: 1278037 - RNA, 14 nt, Mycobacterium tuberculosis H37Rv
cggcgcggccagcu

SEQ ID NO: 1278038 - RNA, 12 nt, Mycobacterium tuberculosis H37Rv
cggcgcgccgac

SEQ ID NO: 1278039 - RNA, 12 nt, Mycobacterium tuberculosis H37Rv
cggcgcgauggc

SEQ ID NO: 1278040 - RNA, 20 nt, Mycobacterium tuberculosis H37Rv
cggcggccaucccgcguucg

SEQ ID NO: 1278041 - RNA, 13 nt, Mycobacterium tuberculosis H37Rv
cggcggccgagcg

SEQ ID NO: 1278042 - RNA, 19 nt, Mycobacterium tuberculosis H37Rv
cggcggccaguacgaucuc

SEQ ID NO: 1278043 - RNA, 18 nt, Mycobacterium tuberculosis H37Rv
cggcggccagcucggcca

SEQ ID NO: 1278044 - RNA, 12 nt, Mycobacterium tuberculosis H37Rv
cggcggccagcu

SEQ ID NO: 1278045 - RNA, 17 nt, Mycobacterium tuberculosis H37Rv
cggcggccagcuccagc

SEQ ID NO: 1278046 - RNA, 13 nt, Mycobacterium tuberculosis H37Rv
cggcggccagcga

SEQ ID NO: 1278047 - RNA, 21 nt, Mycobacterium tuberculosis H37Rv
cggcggcagguagaucagcau

SEQ ID NO: 1278048 - RNA, 15 nt, Mycobacterium tuberculosis H37Rv
cggcggccgucaccg

SEQ ID NO: 1278049 - RNA, 16 nt, Mycobacterium tuberculosis H37Rv
cggcggccgguagauc

SEQ ID NO: 1278050 - RNA, 14 nt, Mycobacterium tuberculosis H37Rv
cggcggccguggcu

SEQ ID NO: 1278051 - RNA, 18 nt, Mycobacterium tuberculosis H37Rv
cggcggccuccgcggacg

SEQ ID NO: 1278052 - RNA, 14 nt, Mycobacterium tuberculosis H37Rv
cggcggccgcggug

SEQ ID NO: 1278053 - RNA, 19 nt, Mycobacterium tuberculosis H37Rv
cggcggcgacgagcgcagc

SEQ ID NO: 1278054 - RNA, 16 nt, Mycobacterium tuberculosis H37Rv
cggcggcgacgucugc

SEQ ID NO: 1278055 - RNA, 14 nt, Mycobacterium tuberculosis H37Rv
cggcggcgacgugu

SEQ ID NO: 1278056 - RNA, 13 nt, Mycobacterium tuberculosis H37Rv
cggcggcgauguc

SEQ ID NO: 1278057 - RNA, 21 nt, Mycobacterium tuberculosis H37Rv
cggcggcgaacagccccaggg

SEQ ID NO: 1278058 - RNA, 15 nt, Mycobacterium tuberculosis H37Rv
cggcggccuugcggg

SEQ ID NO: 1278059 - RNA, 20 nt, Mycobacterium tuberculosis H37Rv
cggcggccuggcacccgggg

SEQ ID NO: 1278060 - RNA, 17 nt, Mycobacterium tuberculosis H37Rv
cggcggccugagcgucg

SEQ ID NO: 1278061 - RNA, 21 nt, Mycobacterium tuberculosis H37Rv
cggcggccugagcgucgucgc

SEQ ID NO: 1278062 - RNA, 15 nt, Mycobacterium tuberculosis H37Rv
cggcggcgcucuucg

SEQ ID NO: 1278063 - RNA, 18 nt, Mycobacterium tuberculosis H37Rv
cggcggcgcuggucgcgg

SEQ ID NO: 1278064 - RNA, 14 nt, Mycobacterium tuberculosis H37Rv
cggcggcgccguuc

SEQ ID NO: 1278065 - RNA, 15 nt, Mycobacterium tuberculosis H37Rv
cggcggcgccguucg

SEQ ID NO: 1278066 - RNA, 20 nt, Mycobacterium tuberculosis H37Rv
cggcggcgccgaaaccgccg

SEQ ID NO: 1278067 - RNA, 19 nt, Mycobacterium tuberculosis H37Rv
cggcggcuucguggcggcg

SEQ ID NO: 1278068 - RNA, 17 nt, Mycobacterium tuberculosis H37Rv
cggcggcugaaccgcug

SEQ ID NO: 1278069 - RNA, 13 nt, Mycobacterium tuberculosis H37Rv
cggcggcuggucu

SEQ ID NO: 1278070 - RNA, 19 nt, Mycobacterium tuberculosis H37Rv
cggcggcugucggccgggu

SEQ ID NO: 1278071 - RNA, 14 nt, Mycobacterium tuberculosis H37Rv
cggcggcgucuucg

SEQ ID NO: 1278072 - RNA, 15 nt, Mycobacterium tuberculosis H37Rv
cggcggcuaggcacc

SEQ ID NO: 1278073 - RNA, 18 nt, Mycobacterium tuberculosis H37Rv
cggcggcuauuucgcgga

SEQ ID NO: 1278074 - RNA, 16 nt, Mycobacterium tuberculosis H37Rv
cggcggcuacggcugc

SEQ ID NO: 1278075 - RNA, 14 nt, Mycobacterium tuberculosis H37Rv
cggcggcggcgucg

SEQ ID NO: 1278076 - RNA, 17 nt, Mycobacterium tuberculosis H37Rv
cggcggcggcgucggga

SEQ ID NO: 1278077 - RNA, 13 nt, Mycobacterium tuberculosis H37Rv
cggcggcggcacg

SEQ ID NO: 1278078 - RNA, 14 nt, Mycobacterium tuberculosis H37Rv
cggcggcgucgacg

SEQ ID NO: 1278079 - RNA, 18 nt, Mycobacterium tuberculosis H37Rv
cggcggcgucgacggcuc

SEQ ID NO: 1278080 - RNA, 14 nt, Mycobacterium tuberculosis H37Rv
cggcggcgucgcgg

SEQ ID NO: 1278081 - RNA, 15 nt, Mycobacterium tuberculosis H37Rv
cggcggcgucgaggg

SEQ ID NO: 1278082 - RNA, 15 nt, Mycobacterium tuberculosis H37Rv
cggcggcgucgcggu

SEQ ID NO: 1278083 - RNA, 12 nt, Mycobacterium tuberculosis H37Rv
cggcggcgucgg

SEQ ID NO: 1278084 - RNA, 16 nt, Mycobacterium tuberculosis H37Rv
cggcggcgucuucguc

SEQ ID NO: 1278085 - RNA, 14 nt, Mycobacterium tuberculosis H37Rv
cggcggcgucuuuc

SEQ ID NO: 1278086 - RNA, 14 nt, Mycobacterium tuberculosis H37Rv
cggcggcgucggga

SEQ ID NO: 1278087 - RNA, 16 nt, Mycobacterium tuberculosis H37Rv
cggcgggcggcagcga

SEQ ID NO: 1278088 - RNA, 16 nt, Mycobacterium tuberculosis H37Rv
cggcgggcggugggca

SEQ ID NO: 1278089 - RNA, 11 nt, Mycobacterium tuberculosis H37Rv
cggcgggcgau

SEQ ID NO: 1278090 - RNA, 14 nt, Mycobacterium tuberculosis H37Rv
cggcgggcgcgggu

SEQ ID NO: 1278091 - RNA, 23 nt, Mycobacterium tuberculosis H37Rv
cggcgggcgcggguggcgccagu

SEQ ID NO: 1278092 - RNA, 15 nt, Mycobacterium tuberculosis H37Rv
cggcgggcgacccgu

SEQ ID NO: 1278093 - RNA, 20 nt, Mycobacterium tuberculosis H37Rv
cggcgggccgcgcggcgaca

SEQ ID NO: 1278094 - RNA, 14 nt, Mycobacterium tuberculosis H37Rv
cggcgggcagcggg

SEQ ID NO: 1278095 - RNA, 14 nt, Mycobacterium tuberculosis H37Rv
cggcgggauccucg

SEQ ID NO: 1278096 - RNA, 21 nt, Mycobacterium tuberculosis H37Rv
cggcgggcacaccgcaccugg

SEQ ID NO: 1278097 - RNA, 18 nt, Mycobacterium tuberculosis H37Rv
cggcgggacgucgccgca

SEQ ID NO: 1278098 - RNA, 21 nt, Mycobacterium tuberculosis H37Rv
cggcgguaugccacaggcugc

SEQ ID NO: 1278099 - RNA, 14 nt, Mycobacterium tuberculosis H37Rv
cggcgguaccagag

SEQ ID NO: 1278100 - RNA, 13 nt, Mycobacterium tuberculosis H37Rv
cggcgguaccgcc

SEQ ID NO: 1278101 - RNA, 19 nt, Mycobacterium tuberculosis H37Rv
cggcgguagccgaccagcg

SEQ ID NO: 1278102 - RNA, 15 nt, Mycobacterium tuberculosis H37Rv
cggcgguaccgccgc

SEQ ID NO: 1278103 - RNA, 18 nt, Mycobacterium tuberculosis H37Rv
cggcgguaccgccgcggu

SEQ ID NO: 1278104 - RNA, 19 nt, Mycobacterium tuberculosis H37Rv
cggcgguaguacucgcgca

SEQ ID NO: 1278105 - RNA, 19 nt, Mycobacterium tuberculosis H37Rv
cggcggguagcucgcugac

SEQ ID NO: 1278106 - RNA, 20 nt, Mycobacterium tuberculosis H37Rv
cggcgggggaccccgccagc

SEQ ID NO: 1278107 - RNA, 21 nt, Mycobacterium tuberculosis H37Rv
cggcggggucgaacagcucga

SEQ ID NO: 1278108 - RNA, 17 nt, Mycobacterium tuberculosis H37Rv
cggcggguggcgccagu

SEQ ID NO: 1278109 - RNA, 15 nt, Mycobacterium tuberculosis H37Rv
cggcgggucaggcca

SEQ ID NO: 1278110 - RNA, 23 nt, Mycobacterium tuberculosis H37Rv
cggcggggugcgcccaccgaccc

SEQ ID NO: 1278111 - RNA, 21 nt, Mycobacterium tuberculosis H37Rv
cggcggugcccagcagcgcga

SEQ ID NO: 1278112 - RNA, 15 nt, Mycobacterium tuberculosis H37Rv
cggcggugcccagca

SEQ ID NO: 1278113 - RNA, 17 nt, Mycobacterium tuberculosis H37Rv
cggcggugcgcugauga

SEQ ID NO: 1278114 - RNA, 14 nt, Mycobacterium tuberculosis H37Rv
cggcgguggccagc

SEQ ID NO: 1278115 - RNA, 17 nt, Mycobacterium tuberculosis H37Rv
cggcgguggccagcguc

SEQ ID NO: 1278116 - RNA, 16 nt, Mycobacterium tuberculosis H37Rv
cggcgguggcguuacg

SEQ ID NO: 1278117 - RNA, 19 nt, Mycobacterium tuberculosis H37Rv
cggcgguggcguuacgggc

SEQ ID NO: 1278118 - RNA, 15 nt, Mycobacterium tuberculosis H37Rv
cggcggugacggugc

SEQ ID NO: 1278119 - RNA, 15 nt, Mycobacterium tuberculosis H37Rv
cggcgguccgcgcga

SEQ ID NO: 1278120 - RNA, 16 nt, Mycobacterium tuberculosis H37Rv
cggcggucuuggcgcg

SEQ ID NO: 1278121 - RNA, 21 nt, Mycobacterium tuberculosis H37Rv
cggcggucugagacucgucga

SEQ ID NO: 1278122 - RNA, 23 nt, Mycobacterium tuberculosis H37Rv
cggcggucuguaagacagcuauc

SEQ ID NO: 1278123 - RNA, 22 nt, Mycobacterium tuberculosis H37Rv
cggcggucgccuccggggugaa

SEQ ID NO: 1278124 - RNA, 13 nt, Mycobacterium tuberculosis H37Rv
cggcggucgccgc

SEQ ID NO: 1278125 - RNA, 13 nt, Mycobacterium tuberculosis H37Rv
cggcggucgagcu

SEQ ID NO: 1278126 - RNA, 13 nt, Mycobacterium tuberculosis H37Rv
cggcggucgccag

SEQ ID NO: 1278127 - RNA, 21 nt, Mycobacterium tuberculosis H37Rv
cggcggucgccagucgauucg

SEQ ID NO: 1278128 - RNA, 22 nt, Mycobacterium tuberculosis H37Rv
cggcggucguugauuucggcgg

SEQ ID NO: 1278129 - RNA, 23 nt, Mycobacterium tuberculosis H37Rv
cggcggucucacguugugagcca

SEQ ID NO: 1278130 - RNA, 18 nt, Mycobacterium tuberculosis H37Rv
cggcggucggcugggcga

SEQ ID NO: 1278131 - RNA, 21 nt, Mycobacterium tuberculosis H37Rv
cggcgguugccccgaccgccg

SEQ ID NO: 1278132 - RNA, 14 nt, Mycobacterium tuberculosis H37Rv
cggcggugguaccg

SEQ ID NO: 1278133 - RNA, 17 nt, Mycobacterium tuberculosis H37Rv
cggcggugugcgcaugg

SEQ ID NO: 1278134 - RNA, 20 nt, Mycobacterium tuberculosis H37Rv
cggcgguguguuccaacucc

SEQ ID NO: 1278135 - RNA, 18 nt, Mycobacterium tuberculosis H37Rv
cggcgguuaucgucgggu

SEQ ID NO: 1278136 - RNA, 23 nt, Mycobacterium tuberculosis H37Rv
cggcgguuccauacagccgccga

SEQ ID NO: 1278137 - RNA, 23 nt, Mycobacterium tuberculosis H37Rv
cggcgguuaucgucgggucaccc

SEQ ID NO: 1278138 - RNA, 16 nt, Mycobacterium tuberculosis H37Rv
cggcgguucgaucccg

SEQ ID NO: 1278139 - RNA, 21 nt, Mycobacterium tuberculosis H37Rv
cggcguccagggcgccacuga

SEQ ID NO: 1278140 - RNA, 15 nt, Mycobacterium tuberculosis H37Rv
cggcgucccagggca

SEQ ID NO: 1278141 - RNA, 18 nt, Mycobacterium tuberculosis H37Rv
cggcguccccgacaacga

SEQ ID NO: 1278142 - RNA, 19 nt, Mycobacterium tuberculosis H37Rv
cggcguauugcaccgccag

SEQ ID NO: 1278143 - RNA, 22 nt, Mycobacterium tuberculosis H37Rv
cggcgucaaaggccuugacgua

SEQ ID NO: 1278144 - RNA, 20 nt, Mycobacterium tuberculosis H37Rv
cggcguauugcaccgccagg

SEQ ID NO: 1278145 - RNA, 15 nt, Mycobacterium tuberculosis H37Rv
cggcguccagggcgc

SEQ ID NO: 1278146 - RNA, 15 nt, Mycobacterium tuberculosis H37Rv
cggcguaggcgaugg

SEQ ID NO: 1278147 - RNA, 20 nt, Mycobacterium tuberculosis H37Rv
cggcgucggugagcgcgucg

SEQ ID NO: 1278148 - RNA, 16 nt, Mycobacterium tuberculosis H37Rv
cggcgucggugccgcu

SEQ ID NO: 1278149 - RNA, 21 nt, Mycobacterium tuberculosis H37Rv
cggcgucgggaugcucgaucc

SEQ ID NO: 1278150 - RNA, 15 nt, Mycobacterium tuberculosis H37Rv
cggcgucgucgaugg

SEQ ID NO: 1278151 - RNA, 15 nt, Mycobacterium tuberculosis H37Rv
cggcgucgugguggc

SEQ ID NO: 1278152 - RNA, 13 nt, Mycobacterium tuberculosis H37Rv
cggcgucguugac

SEQ ID NO: 1278153 - RNA, 18 nt, Mycobacterium tuberculosis H37Rv
cggcgucgaugacgacgc

SEQ ID NO: 1278154 - RNA, 13 nt, Mycobacterium tuberculosis H37Rv
cggcgucgauguc

SEQ ID NO: 1278155 - RNA, 19 nt, Mycobacterium tuberculosis H37Rv
cggcgucgggaugcucgau

SEQ ID NO: 1278156 - RNA, 13 nt, Mycobacterium tuberculosis H37Rv
cggcgucgaugac

SEQ ID NO: 1278157 - RNA, 16 nt, Mycobacterium tuberculosis H37Rv
cggcgucgaugacgac

SEQ ID NO: 1278158 - RNA, 17 nt, Mycobacterium tuberculosis H37Rv
cggcgucgacuggccgu

SEQ ID NO: 1278159 - RNA, 13 nt, Mycobacterium tuberculosis H37Rv
cggcgucgacugg

SEQ ID NO: 1278160 - RNA, 21 nt, Mycobacterium tuberculosis H37Rv
cggcguccgggaucuccccaa

SEQ ID NO: 1278161 - RNA, 21 nt, Mycobacterium tuberculosis H37Rv
cgggcgcuguagucgcgccuc

SEQ ID NO: 1278162 - RNA, 20 nt, Mycobacterium tuberculosis H37Rv
cgggcggcgcuggcgucguc

SEQ ID NO: 1278163 - RNA, 13 nt, Mycobacterium tuberculosis H37Rv
cgggcggcgaugg

SEQ ID NO: 1278164 - RNA, 18 nt, Mycobacterium tuberculosis H37Rv
cgggcgucgucggugauc

SEQ ID NO: 1278165 - RNA, 12 nt, Mycobacterium tuberculosis H37Rv
cgggcgugccga

SEQ ID NO: 1278166 - RNA, 13 nt, Mycobacterium tuberculosis H37Rv
cgggcgugccgac

SEQ ID NO: 1278167 - RNA, 15 nt, Mycobacterium tuberculosis H37Rv
cgggcgucccaaucg

SEQ ID NO: 1278168 - RNA, 17 nt, Mycobacterium tuberculosis H37Rv
cgggcguccacgcugac

SEQ ID NO: 1278169 - RNA, 22 nt, Mycobacterium tuberculosis H37Rv
cgggcgucaugaugucgacauc

SEQ ID NO: 1278170 - RNA, 12 nt, Mycobacterium tuberculosis H37Rv
cgggcgucgggg

SEQ ID NO: 1278171 - RNA, 14 nt, Mycobacterium tuberculosis H37Rv
cgggcuccaacagg

SEQ ID NO: 1278172 - RNA, 15 nt, Mycobacterium tuberculosis H37Rv
cgggcuccaacaggu

SEQ ID NO: 1278173 - RNA, 20 nt, Mycobacterium tuberculosis H37Rv
cgggcuccagcagcgccauc

SEQ ID NO: 1278174 - RNA, 19 nt, Mycobacterium tuberculosis H37Rv
cgggcugacgaucuccacc

SEQ ID NO: 1278175 - RNA, 19 nt, Mycobacterium tuberculosis H37Rv
cgggcuccccaagucgacg

SEQ ID NO: 1278176 - RNA, 15 nt, Mycobacterium tuberculosis H37Rv
cgggcgugaucccgc

SEQ ID NO: 1278177 - RNA, 17 nt, Mycobacterium tuberculosis H37Rv
cgggcucaacaccagcc

SEQ ID NO: 1278178 - RNA, 22 nt, Mycobacterium tuberculosis H37Rv
cgggcucacaugugcgcgucgc

SEQ ID NO: 1278179 - RNA, 16 nt, Mycobacterium tuberculosis H37Rv
cgggcucagcugggcc

SEQ ID NO: 1278180 - RNA, 17 nt, Mycobacterium tuberculosis H37Rv
cgggcuuggcgucgacg

SEQ ID NO: 1278181 - RNA, 13 nt, Mycobacterium tuberculosis H37Rv
cgggcuucggcca

SEQ ID NO: 1278182 - RNA, 21 nt, Mycobacterium tuberculosis H37Rv
cgggcuugccgucuucgccgc

SEQ ID NO: 1278183 - RNA, 21 nt, Mycobacterium tuberculosis H37Rv
cgggcuguaggcgaucacgau

SEQ ID NO: 1278184 - RNA, 19 nt, Mycobacterium tuberculosis H37Rv
cgggcugugauccgacagu

SEQ ID NO: 1278185 - RNA, 20 nt, Mycobacterium tuberculosis H37Rv
cgggcugugaacagcgcguc

SEQ ID NO: 1278186 - RNA, 17 nt, Mycobacterium tuberculosis H37Rv
cgggcuuaugcacgacg

SEQ ID NO: 1278187 - RNA, 14 nt, Mycobacterium tuberculosis H37Rv
cgggcuggccgacu

SEQ ID NO: 1278188 - RNA, 14 nt, Mycobacterium tuberculosis H37Rv
cgggcuggcguugc

SEQ ID NO: 1278189 - RNA, 12 nt, Mycobacterium tuberculosis H37Rv
cgggcuggcgac

SEQ ID NO: 1278190 - RNA, 23 nt, Mycobacterium tuberculosis H37Rv
cgggcugcagugacucgaucacc

SEQ ID NO: 1278191 - RNA, 20 nt, Mycobacterium tuberculosis H37Rv
cgggcugacgaucuccaccc

SEQ ID NO: 1278192 - RNA, 13 nt, Mycobacterium tuberculosis H37Rv
cgggcgcgucggc

SEQ ID NO: 1278193 - RNA, 21 nt, Mycobacterium tuberculosis H37Rv
cgggcgcgguucgucggcgag

SEQ ID NO: 1278194 - RNA, 22 nt, Mycobacterium tuberculosis H37Rv
cgggcgcgggugaccaggcggc

SEQ ID NO: 1278195 - RNA, 22 nt, Mycobacterium tuberculosis H37Rv
cgggcgcguccucgccgcacgc

SEQ ID NO: 1278196 - RNA, 18 nt, Mycobacterium tuberculosis H37Rv
cgggcgcgggcgccggga

SEQ ID NO: 1278197 - RNA, 13 nt, Mycobacterium tuberculosis H37Rv
cgggcgcuggacg

SEQ ID NO: 1278198 - RNA, 15 nt, Mycobacterium tuberculosis H37Rv
cgggcgcgcugccca

SEQ ID NO: 1278199 - RNA, 22 nt, Mycobacterium tuberculosis H37Rv
cgggcgcgcuuuccucaccagc

SEQ ID NO: 1278200 - RNA, 19 nt, Mycobacterium tuberculosis H37Rv
cgggcgccuuggucgccgc

SEQ ID NO: 1278201 - RNA, 16 nt, Mycobacterium tuberculosis H37Rv
cgggcgaucuuggcga

SEQ ID NO: 1278202 - RNA, 16 nt, Mycobacterium tuberculosis H37Rv
cgggcgaucucggcga

SEQ ID NO: 1278203 - RNA, 17 nt, Mycobacterium tuberculosis H37Rv
cgggcgaucucggcgag

SEQ ID NO: 1278204 - RNA, 12 nt, Mycobacterium tuberculosis H37Rv
cgggcgaugacc

SEQ ID NO: 1278205 - RNA, 16 nt, Mycobacterium tuberculosis H37Rv
cgggcgagugucagca

SEQ ID NO: 1278206 - RNA, 20 nt, Mycobacterium tuberculosis H37Rv
cgggcgagugucagcagaug

SEQ ID NO: 1278207 - RNA, 15 nt, Mycobacterium tuberculosis H37Rv
cgggcgagcucgucg

SEQ ID NO: 1278208 - RNA, 19 nt, Mycobacterium tuberculosis H37Rv
cgggcgagcucgucgagcg

SEQ ID NO: 1278209 - RNA, 14 nt, Mycobacterium tuberculosis H37Rv
cgggcgaaccgcuc

SEQ ID NO: 1278210 - RNA, 21 nt, Mycobacterium tuberculosis H37Rv
cgggccuuguucuuggccacc

SEQ ID NO: 1278211 - RNA, 13 nt, Mycobacterium tuberculosis H37Rv
cgggccccacggc

SEQ ID NO: 1278212 - RNA, 19 nt, Mycobacterium tuberculosis H37Rv
cgggccgaauaccacaccg

SEQ ID NO: 1278213 - RNA, 21 nt, Mycobacterium tuberculosis H37Rv
cgggcccuccggcgcagcgac

SEQ ID NO: 1278214 - RNA, 18 nt, Mycobacterium tuberculosis H37Rv
cgggcccuccacugcgag

SEQ ID NO: 1278215 - RNA, 22 nt, Mycobacterium tuberculosis H37Rv
cgggcccguucucgcggccgau

SEQ ID NO: 1278216 - RNA, 18 nt, Mycobacterium tuberculosis H37Rv
cgggcccuuccuggccga

SEQ ID NO: 1278217 - RNA, 24 nt, Mycobacterium tuberculosis H37Rv
cgggcccucgccauggcguucugc

SEQ ID NO: 1278218 - RNA, 19 nt, Mycobacterium tuberculosis H37Rv
cgggcccccuggaucgcgc

SEQ ID NO: 1278219 - RNA, 22 nt, Mycobacterium tuberculosis H37Rv
cgggcccccgccuacgacgcag

SEQ ID NO: 1278220 - RNA, 14 nt, Mycobacterium tuberculosis H37Rv
cgggguugcucgcg

SEQ ID NO: 1278221 - RNA, 18 nt, Mycobacterium tuberculosis H37Rv
cgggguuguccucggcga

SEQ ID NO: 1278222 - RNA, 17 nt, Mycobacterium tuberculosis H37Rv
cgggguuguggucgagu

SEQ ID NO: 1278223 - RNA, 18 nt, Mycobacterium tuberculosis H37Rv
cgggguugaccgccaccc

SEQ ID NO: 1278224 - RNA, 17 nt, Mycobacterium tuberculosis H37Rv
cggguaaccccaccugg

SEQ ID NO: 1278225 - RNA, 16 nt, Mycobacterium tuberculosis H37Rv
cgggguucaccgucga

SEQ ID NO: 1278226 - RNA, 16 nt, Mycobacterium tuberculosis H37Rv
aaccacccaccggcca

SEQ ID NO: 1278227 - RNA, 16 nt, Mycobacterium tuberculosis H37Rv
cggggugacaucgcga

SEQ ID NO: 1278228 - RNA, 22 nt, Mycobacterium tuberculosis H37Rv
cggggugaacgcggacaccgcg

SEQ ID NO: 1278229 - RNA, 22 nt, Mycobacterium tuberculosis H37Rv
cggggucggccugcggcaccgg

SEQ ID NO: 1278230 - RNA, 21 nt, Mycobacterium tuberculosis H37Rv
cgggguaaggcuugucagccg

SEQ ID NO: 1278231 - RNA, 19 nt, Mycobacterium tuberculosis H37Rv
cgggguacccgguggcacc

SEQ ID NO: 1278232 - RNA, 23 nt, Mycobacterium tuberculosis H37Rv
cggggucggccugcggcaccggc

SEQ ID NO: 1278233 - RNA, 15 nt, Mycobacterium tuberculosis H37Rv
cgggggcagcgccuc

SEQ ID NO: 1278234 - RNA, 19 nt, Mycobacterium tuberculosis H37Rv
cgggggauccggcgcagcg

SEQ ID NO: 1278235 - RNA, 12 nt, Mycobacterium tuberculosis H37Rv
cgggggacgggu

SEQ ID NO: 1278236 - RNA, 20 nt, Mycobacterium tuberculosis H37Rv
cgggggauuucgcgucugcu

SEQ ID NO: 1278237 - RNA, 23 nt, Mycobacterium tuberculosis H37Rv
cgggggcaccguuaccgccgucg

SEQ ID NO: 1278238 - RNA, 21 nt, Mycobacterium tuberculosis H37Rv
cgggggccgaccagucgacgu

SEQ ID NO: 1278239 - RNA, 13 nt, Mycobacterium tuberculosis H37Rv
cgggggcgucgcc

SEQ ID NO: 1278240 - RNA, 20 nt, Mycobacterium tuberculosis H37Rv
cgggggcuuuuacgucugcu

SEQ ID NO: 1278241 - RNA, 15 nt, Mycobacterium tuberculosis H37Rv
cggggggauccagca

SEQ ID NO: 1278242 - RNA, 20 nt, Mycobacterium tuberculosis H37Rv
cgggggcuuaugcgucugcu

SEQ ID NO: 1278243 - RNA, 20 nt, Mycobacterium tuberculosis H37Rv
cgggggcuuaugcgacugcu

SEQ ID NO: 1278244 - RNA, 19 nt, Mycobacterium tuberculosis H37Rv
cgggggcuuaugcgucugc

SEQ ID NO: 1278245 - RNA, 21 nt, Mycobacterium tuberculosis H37Rv
cggggcuucaucuggcgccgu

SEQ ID NO: 1278246 - RNA, 16 nt, Mycobacterium tuberculosis H37Rv
cggggcuuggcgacgu

SEQ ID NO: 1278247 - RNA, 22 nt, Mycobacterium tuberculosis H37Rv
cgggggagcgaacggcgcaguu

SEQ ID NO: 1278248 - RNA, 13 nt, Mycobacterium tuberculosis H37Rv
cggggcugaccgc

SEQ ID NO: 1278249 - RNA, 17 nt, Mycobacterium tuberculosis H37Rv
cggggcugccgccguug

SEQ ID NO: 1278250 - RNA, 16 nt, Mycobacterium tuberculosis H37Rv
cggggcuaugaccugc

SEQ ID NO: 1278251 - RNA, 18 nt, Mycobacterium tuberculosis H37Rv
cggggccgucucgccgug

SEQ ID NO: 1278252 - RNA, 23 nt, Mycobacterium tuberculosis H37Rv
cggggccgucgucggucaccgac

SEQ ID NO: 1278253 - RNA, 14 nt, Mycobacterium tuberculosis H37Rv
cggggccgucucgc

SEQ ID NO: 1278254 - RNA, 21 nt, Mycobacterium tuberculosis H37Rv
cggggccgucgucggucaccg

SEQ ID NO: 1278255 - RNA, 14 nt, Mycobacterium tuberculosis H37Rv
cggggcgcgguacc

SEQ ID NO: 1278256 - RNA, 16 nt, Mycobacterium tuberculosis H37Rv
cggggcgcugcagcuc

SEQ ID NO: 1278257 - RNA, 21 nt, Mycobacterium tuberculosis H37Rv
cggggcgcugcagcucacgac

SEQ ID NO: 1278258 - RNA, 22 nt, Mycobacterium tuberculosis H37Rv
cggggcggcauuggcggugccg

SEQ ID NO: 1278259 - RNA, 18 nt, Mycobacterium tuberculosis H37Rv
cggggccccaugccgacc

SEQ ID NO: 1278260 - RNA, 21 nt, Mycobacterium tuberculosis H37Rv
cggggccgccgaugccaccgc

SEQ ID NO: 1278261 - RNA, 13 nt, Mycobacterium tuberculosis H37Rv
cggggcccacacg

SEQ ID NO: 1278262 - RNA, 15 nt, Mycobacterium tuberculosis H37Rv
cggggccgucgucgg

SEQ ID NO: 1278263 - RNA, 20 nt, Mycobacterium tuberculosis H37Rv
cggggccgucgucggucacc

SEQ ID NO: 1278264 - RNA, 14 nt, Mycobacterium tuberculosis H37Rv
cggggccgccagcu

SEQ ID NO: 1278265 - RNA, 14 nt, Mycobacterium tuberculosis H37Rv
cggggccgccgucg

SEQ ID NO: 1278266 - RNA, 17 nt, Mycobacterium tuberculosis H37Rv
cggggcaaaggagccgu

SEQ ID NO: 1278267 - RNA, 14 nt, Mycobacterium tuberculosis H37Rv
cggggcaacgauca

SEQ ID NO: 1278268 - RNA, 13 nt, Mycobacterium tuberculosis H37Rv
cggggaccgcggu

SEQ ID NO: 1278269 - RNA, 22 nt, Mycobacterium tuberculosis H37Rv
cggggaaaccggccagccgacg

SEQ ID NO: 1278270 - RNA, 18 nt, Mycobacterium tuberculosis H37Rv
cggggaagcccggcagau

SEQ ID NO: 1278271 - RNA, 16 nt, Mycobacterium tuberculosis H37Rv
cggggacucauggccg

SEQ ID NO: 1278272 - RNA, 21 nt, Mycobacterium tuberculosis H37Rv
cggggaggucaaaaucagggu

SEQ ID NO: 1278273 - RNA, 17 nt, Mycobacterium tuberculosis H37Rv
cggggauccgaccugcu

SEQ ID NO: 1278274 - RNA, 21 nt, Mycobacterium tuberculosis H37Rv
cggggaucgcaagccguugca

SEQ ID NO: 1278275 - RNA, 18 nt, Mycobacterium tuberculosis H37Rv
cggcuuugagccgcucga

SEQ ID NO: 1278276 - RNA, 19 nt, Mycobacterium tuberculosis H37Rv
cgggaaaguuguaucgcag

SEQ ID NO: 1278277 - RNA, 15 nt, Mycobacterium tuberculosis H37Rv
cgggaaggaaccggg

SEQ ID NO: 1278278 - RNA, 14 nt, Mycobacterium tuberculosis H37Rv
cgggaaguacggca

SEQ ID NO: 1278279 - RNA, 16 nt, Mycobacterium tuberculosis H37Rv
cgggaaggcauugccc

SEQ ID NO: 1278280 - RNA, 12 nt, Mycobacterium tuberculosis H37Rv
cgggaagucggg

SEQ ID NO: 1278281 - RNA, 17 nt, Mycobacterium tuberculosis H37Rv
cgggaagugcacccggu

SEQ ID NO: 1278282 - RNA, 16 nt, Mycobacterium tuberculosis H37Rv
cgggaacgcucgucga

SEQ ID NO: 1278283 - RNA, 19 nt, Mycobacterium tuberculosis H37Rv
cgggaacggugccgaucgg

SEQ ID NO: 1278284 - RNA, 17 nt, Mycobacterium tuberculosis H37Rv
cgggaacguccagccgu

SEQ ID NO: 1278285 - RNA, 22 nt, Mycobacterium tuberculosis H37Rv
cgggaacuucgccgaagcgccg

SEQ ID NO: 1278286 - RNA, 16 nt, Mycobacterium tuberculosis H37Rv
cggcuguugcguucgg

SEQ ID NO: 1278287 - RNA, 14 nt, Mycobacterium tuberculosis H37Rv
cggcuguucucgcc

SEQ ID NO: 1278288 - RNA, 21 nt, Mycobacterium tuberculosis H37Rv
cggcuguuaggcgauaucgca

SEQ ID NO: 1278289 - RNA, 23 nt, Mycobacterium tuberculosis H37Rv
cggcuguggucgcugcugccgca

SEQ ID NO: 1278290 - RNA, 22 nt, Mycobacterium tuberculosis H37Rv
cggcugugcccgaucagccgug

SEQ ID NO: 1278291 - RNA, 19 nt, Mycobacterium tuberculosis H37Rv
cggcuugcgauuggcuggg

SEQ ID NO: 1278292 - RNA, 15 nt, Mycobacterium tuberculosis H37Rv
cggcuucaguccggc

SEQ ID NO: 1278293 - RNA, 15 nt, Mycobacterium tuberculosis H37Rv
cggcuuugagccgcu

SEQ ID NO: 1278294 - RNA, 17 nt, Mycobacterium tuberculosis H37Rv
cggcuuucccaccgcuu

SEQ ID NO: 1278295 - RNA, 14 nt, Mycobacterium tuberculosis H37Rv
cggcuugucgacca

SEQ ID NO: 1278296 - RNA, 17 nt, Mycobacterium tuberculosis H37Rv
cggcuugggcagaaucg

SEQ ID NO: 1278297 - RNA, 18 nt, Mycobacterium tuberculosis H37Rv
cggcuuggccuagccgcg

SEQ ID NO: 1278298 - RNA, 19 nt, Mycobacterium tuberculosis H37Rv
cggcuugcgguggcggauc

SEQ ID NO: 1278299 - RNA, 19 nt, Mycobacterium tuberculosis H37Rv
cggcugcacgcugcggguc

SEQ ID NO: 1278300 - RNA, 14 nt, Mycobacterium tuberculosis H37Rv
cggcugcaccggcu

SEQ ID NO: 1278301 - RNA, 18 nt, Mycobacterium tuberculosis H37Rv
cggcugcgcgcucggcca

SEQ ID NO: 1278302 - RNA, 15 nt, Mycobacterium tuberculosis H37Rv
cggcugccacacagg

SEQ ID NO: 1278303 - RNA, 17 nt, Mycobacterium tuberculosis H37Rv
cggcugccacgcgucgg

SEQ ID NO: 1278304 - RNA, 20 nt, Mycobacterium tuberculosis H37Rv
cggcugcucgacggcuccga

SEQ ID NO: 1278305 - RNA, 16 nt, Mycobacterium tuberculosis H37Rv
cggcugcucgacggcu

SEQ ID NO: 1278306 - RNA, 22 nt, Mycobacterium tuberculosis H37Rv
cggcugcgguaaucgccaccgc

SEQ ID NO: 1278307 - RNA, 17 nt, Mycobacterium tuberculosis H37Rv
cggcugcguuggcuggu

SEQ ID NO: 1278308 - RNA, 14 nt, Mycobacterium tuberculosis H37Rv
cggcugcggggcga

SEQ ID NO: 1278309 - RNA, 11 nt, Mycobacterium tuberculosis H37Rv
cggcugcggua

SEQ ID NO: 1278310 - RNA, 15 nt, Mycobacterium tuberculosis H37Rv
cggcugcggcgucau

SEQ ID NO: 1278311 - RNA, 16 nt, Mycobacterium tuberculosis H37Rv
cggcugggcgccacca

SEQ ID NO: 1278312 - RNA, 17 nt, Mycobacterium tuberculosis H37Rv
cggcugggcgaagccca

SEQ ID NO: 1278313 - RNA, 16 nt, Mycobacterium tuberculosis H37Rv
cggcugggggauaccg

SEQ ID NO: 1278314 - RNA, 15 nt, Mycobacterium tuberculosis H37Rv
cggcugcugcgcggu

SEQ ID NO: 1278315 - RNA, 16 nt, Mycobacterium tuberculosis H37Rv
cggcugagacgguguu

SEQ ID NO: 1278316 - RNA, 15 nt, Mycobacterium tuberculosis H37Rv
cggcugaacggcagc

SEQ ID NO: 1278317 - RNA, 20 nt, Mycobacterium tuberculosis H37Rv
cggcugaccggggucggccu

SEQ ID NO: 1278318 - RNA, 21 nt, Mycobacterium tuberculosis H37Rv
cggcugaccuucucacgcacc

SEQ ID NO: 1278319 - RNA, 13 nt, Mycobacterium tuberculosis H37Rv
cggcugaccgacc

SEQ ID NO: 1278320 - RNA, 17 nt, Mycobacterium tuberculosis H37Rv
cggcguggccccaccga

SEQ ID NO: 1278321 - RNA, 19 nt, Mycobacterium tuberculosis H37Rv
cggcguggcaguacaccgg

SEQ ID NO: 1278322 - RNA, 18 nt, Mycobacterium tuberculosis H37Rv
cggcguggaugcccgguu

SEQ ID NO: 1278323 - RNA, 22 nt, Mycobacterium tuberculosis H37Rv
cggcguggaucaguuugccauc

SEQ ID NO: 1278324 - RNA, 20 nt, Mycobacterium tuberculosis H37Rv
cggcgugguauccgccguuc

SEQ ID NO: 1278325 - RNA, 20 nt, Mycobacterium tuberculosis H37Rv
cgggagcccgagcucaccgc

SEQ ID NO: 1278326 - RNA, 14 nt, Mycobacterium tuberculosis H37Rv
cgggagacgcugcg

SEQ ID NO: 1278327 - RNA, 23 nt, Mycobacterium tuberculosis H37Rv
cgggauaacccagcaccacaacg

SEQ ID NO: 1278328 - RNA, 14 nt, Mycobacterium tuberculosis H37Rv
cgggagaucgucgc

SEQ ID NO: 1278329 - RNA, 16 nt, Mycobacterium tuberculosis H37Rv
cgggacugcagcgcgg

SEQ ID NO: 1278330 - RNA, 19 nt, Mycobacterium tuberculosis H37Rv
cgggacguuguccaccgcc

SEQ ID NO: 1278331 - RNA, 18 nt, Mycobacterium tuberculosis H37Rv
cgggacguuguccaccgc

SEQ ID NO: 1278332 - RNA, 15 nt, Mycobacterium tuberculosis H37Rv
cgggacgucgccgca

SEQ ID NO: 1278333 - RNA, 13 nt, Mycobacterium tuberculosis H37Rv
cgggacgucaccg

SEQ ID NO: 1278334 - RNA, 14 nt, Mycobacterium tuberculosis H37Rv
cgggaaucgcucgc

SEQ ID NO: 1278335 - RNA, 19 nt, Mycobacterium tuberculosis H37Rv
cgggacaaguucgguagcg

SEQ ID NO: 1278336 - RNA, 18 nt, Mycobacterium tuberculosis H37Rv
cgggacaaagccgaacga

SEQ ID NO: 1278337 - RNA, 22 nt, Mycobacterium tuberculosis H37Rv
cgggacgcaugcgugacccgac

SEQ ID NO: 1278338 - RNA, 13 nt, Mycobacterium tuberculosis H37Rv
cgggacgaagacc

SEQ ID NO: 1278339 - RNA, 20 nt, Mycobacterium tuberculosis H37Rv
cgggaccuucgagccgcaca

SEQ ID NO: 1278340 - RNA, 12 nt, Mycobacterium tuberculosis H37Rv
cgggacgccgug

SEQ ID NO: 1278341 - RNA, 20 nt, Mycobacterium tuberculosis H37Rv
cgggaucaugaccaucgagg

SEQ ID NO: 1278342 - RNA, 21 nt, Mycobacterium tuberculosis H37Rv
aacaugggaugcucaccggga

SEQ ID NO: 1278343 - RNA, 19 nt, Mycobacterium tuberculosis H37Rv
cgggauggacaccaccucg

SEQ ID NO: 1278344 - RNA, 21 nt, Mycobacterium tuberculosis H37Rv
cgggaugcgcguuacccaucg

SEQ ID NO: 1278345 - RNA, 21 nt, Mycobacterium tuberculosis H37Rv
cgggaugugcggcugcaccgg

SEQ ID NO: 1278346 - RNA, 17 nt, Mycobacterium tuberculosis H37Rv
cgggaugguuccguuga

SEQ ID NO: 1278347 - RNA, 22 nt, Mycobacterium tuberculosis H37Rv
cgggauugccgccaccuuggcu

SEQ ID NO: 1278348 - RNA, 13 nt, Mycobacterium tuberculosis H37Rv
cgggauucggcag

SEQ ID NO: 1278349 - RNA, 18 nt, Mycobacterium tuberculosis H37Rv
cgggcaguuuguucgcga

SEQ ID NO: 1278350 - RNA, 19 nt, Mycobacterium tuberculosis H37Rv
cgggcaguuugcgggcgga

SEQ ID NO: 1278351 - RNA, 15 nt, Mycobacterium tuberculosis H37Rv
cgggcaguucacggu

SEQ ID NO: 1278352 - RNA, 14 nt, Mycobacterium tuberculosis H37Rv
cgggcagugugguc

SEQ ID NO: 1278353 - RNA, 15 nt, Mycobacterium tuberculosis H37Rv
cgggcagcgcucuca

SEQ ID NO: 1278354 - RNA, 12 nt, Mycobacterium tuberculosis H37Rv
cgggcagcgcuc

SEQ ID NO: 1278355 - RNA, 22 nt, Mycobacterium tuberculosis H37Rv
cgggccaggccgaugccgaccu

SEQ ID NO: 1278356 - RNA, 19 nt, Mycobacterium tuberculosis H37Rv
cgggccauggguagccgcc

SEQ ID NO: 1278357 - RNA, 18 nt, Mycobacterium tuberculosis H37Rv
cgggccauucaccgcgca

SEQ ID NO: 1278358 - RNA, 20 nt, Mycobacterium tuberculosis H37Rv
cgggcccagcaggucgucgg

SEQ ID NO: 1278359 - RNA, 20 nt, Mycobacterium tuberculosis H37Rv
cgggcccacuugugacccgg

SEQ ID NO: 1278360 - RNA, 16 nt, Mycobacterium tuberculosis H37Rv
cgggccaucaagcgau

SEQ ID NO: 1278361 - RNA, 16 nt, Mycobacterium tuberculosis H37Rv
cgggccaggauccgac

SEQ ID NO: 1278362 - RNA, 20 nt, Mycobacterium tuberculosis H37Rv
cgggccaggccgaugccgac

SEQ ID NO: 1278363 - RNA, 12 nt, Mycobacterium tuberculosis H37Rv
cgggccagcgau

SEQ ID NO: 1278364 - RNA, 21 nt, Mycobacterium tuberculosis H37Rv
cgggcaauacguagucgccga

SEQ ID NO: 1278365 - RNA, 21 nt, Mycobacterium tuberculosis H37Rv
cgggcaagucgcccagccgag

SEQ ID NO: 1278366 - RNA, 19 nt, Mycobacterium tuberculosis H37Rv
cgggcaagccggacagauc

SEQ ID NO: 1278367 - RNA, 22 nt, Mycobacterium tuberculosis H37Rv
cgggcacaccgacgccgccagg

SEQ ID NO: 1278368 - RNA, 15 nt, Mycobacterium tuberculosis H37Rv
cgggcacaccgcacc

SEQ ID NO: 1278369 - RNA, 20 nt, Mycobacterium tuberculosis H37Rv
cgggcagccgcacgguucgg

SEQ ID NO: 1278370 - RNA, 19 nt, Mycobacterium tuberculosis H37Rv
cgggcagcaggcgaugcgc

SEQ ID NO: 1278371 - RNA, 22 nt, Mycobacterium tuberculosis H37Rv
cgggcagcaaaaaccagcgucc

SEQ ID NO: 1278372 - RNA, 16 nt, Mycobacterium tuberculosis H37Rv
cgggcagcacccgcgc

SEQ ID NO: 1278373 - RNA, 23 nt, Mycobacterium tuberculosis H37Rv
cgggcagauacgccaaccgcuuc

SEQ ID NO: 1278374 - RNA, 22 nt, Mycobacterium tuberculosis H37Rv
ggcggcguggcgccggccacga

SEQ ID NO: 1278375 - RNA, 12 nt, Mycobacterium tuberculosis H37Rv
ggcggcuccacc

SEQ ID NO: 1278376 - RNA, 18 nt, Mycobacterium tuberculosis H37Rv
ggcggcucuagaucgccg

SEQ ID NO: 1278377 - RNA, 19 nt, Mycobacterium tuberculosis H37Rv
ggcggcucuagaucgccga

SEQ ID NO: 1278378 - RNA, 18 nt, Mycobacterium tuberculosis H37Rv
ggcgggaacggugccgau

SEQ ID NO: 1278379 - RNA, 16 nt, Mycobacterium tuberculosis H37Rv
ggcgggaacgggcaaa

SEQ ID NO: 1278380 - RNA, 23 nt, Mycobacterium tuberculosis H37Rv
ggcggcggccgcagcggccagcc

SEQ ID NO: 1278381 - RNA, 14 nt, Mycobacterium tuberculosis H37Rv
ggcggcgcugcagc

SEQ ID NO: 1278382 - RNA, 13 nt, Mycobacterium tuberculosis H37Rv
ggcggcgcugcag

SEQ ID NO: 1278383 - RNA, 14 nt, Mycobacterium tuberculosis H37Rv
ggcggcgcgccgau

SEQ ID NO: 1278384 - RNA, 17 nt, Mycobacterium tuberculosis H37Rv
ggcggcgcgaucgacgc

SEQ ID NO: 1278385 - RNA, 20 nt, Mycobacterium tuberculosis H37Rv
ggcggcgacgaccgucggcu

SEQ ID NO: 1278386 - RNA, 22 nt, Mycobacterium tuberculosis H37Rv
ggcggcgaagaagccggcaagc

SEQ ID NO: 1278387 - RNA, 18 nt, Mycobacterium tuberculosis H37Rv
ggcggcgaacagccccag

SEQ ID NO: 1278388 - RNA, 13 nt, Mycobacterium tuberculosis H37Rv
ggcggccuccgcg

SEQ ID NO: 1278389 - RNA, 14 nt, Mycobacterium tuberculosis H37Rv
ggcggccgucaccg

SEQ ID NO: 1278390 - RNA, 15 nt, Mycobacterium tuberculosis H37Rv
ggcggccgucaccgg

SEQ ID NO: 1278391 - RNA, 16 nt, Mycobacterium tuberculosis H37Rv
ggcggccgggcucccc

SEQ ID NO: 1278392 - RNA, 16 nt, Mycobacterium tuberculosis H37Rv
ggcggccagcugcagc

SEQ ID NO: 1278393 - RNA, 13 nt, Mycobacterium tuberculosis H37Rv
ggcggccagcucg

SEQ ID NO: 1278394 - RNA, 18 nt, Mycobacterium tuberculosis H37Rv
ggcggccagcucggccag

SEQ ID NO: 1278395 - RNA, 14 nt, Mycobacterium tuberculosis H37Rv
ggcggaggccgccu

SEQ ID NO: 1278396 - RNA, 14 nt, Mycobacterium tuberculosis H37Rv
ggcggauaaccggc

SEQ ID NO: 1278397 - RNA, 15 nt, Mycobacterium tuberculosis H37Rv
ggcggagccggguga

SEQ ID NO: 1278398 - RNA, 13 nt, Mycobacterium tuberculosis H37Rv
ggcggagacggcg

SEQ ID NO: 1278399 - RNA, 19 nt, Mycobacterium tuberculosis H37Rv
ggcggagaaaagcgcgcua

SEQ ID NO: 1278400 - RNA, 23 nt, Mycobacterium tuberculosis H37Rv
ggcggacgugaccagaucgacgc

SEQ ID NO: 1278401 - RNA, 18 nt, Mycobacterium tuberculosis H37Rv
ggcggacgcgggugccag

SEQ ID NO: 1278402 - RNA, 20 nt, Mycobacterium tuberculosis H37Rv
ggcgcucauaggccggcggu

SEQ ID NO: 1278403 - RNA, 17 nt, Mycobacterium tuberculosis H37Rv
ggcgcucaucacccagc

SEQ ID NO: 1278404 - RNA, 21 nt, Mycobacterium tuberculosis H37Rv
ggcgcucauaggccggcgguc

SEQ ID NO: 1278405 - RNA, 18 nt, Mycobacterium tuberculosis H37Rv
ggcggaaccugucaacau

SEQ ID NO: 1278406 - RNA, 18 nt, Mycobacterium tuberculosis H37Rv
ggcggaagaccggaucgc

SEQ ID NO: 1278407 - RNA, 18 nt, Mycobacterium tuberculosis H37Rv
ggcggaaggcgucgaaca

SEQ ID NO: 1278408 - RNA, 19 nt, Mycobacterium tuberculosis H37Rv
ggcggccacguggucggcg

SEQ ID NO: 1278409 - RNA, 14 nt, Mycobacterium tuberculosis H37Rv
ggcggccagcgcgc

SEQ ID NO: 1278410 - RNA, 15 nt, Mycobacterium tuberculosis H37Rv
ggcggccagcgcacc

SEQ ID NO: 1278411 - RNA, 16 nt, Mycobacterium tuberculosis H37Rv
ggcggccagcgagauc

SEQ ID NO: 1278412 - RNA, 13 nt, Mycobacterium tuberculosis H37Rv
ggcggccaacgac

SEQ ID NO: 1278413 - RNA, 16 nt, Mycobacterium tuberculosis H37Rv
ggcggccaccgucagc

SEQ ID NO: 1278414 - RNA, 21 nt, Mycobacterium tuberculosis H37Rv
ggcggcauuggcggugccggu

SEQ ID NO: 1278415 - RNA, 19 nt, Mycobacterium tuberculosis H37Rv
ggcggcaaagagcagccgg

SEQ ID NO: 1278416 - RNA, 15 nt, Mycobacterium tuberculosis H37Rv
ggcggauaugaugau

SEQ ID NO: 1278417 - RNA, 13 nt, Mycobacterium tuberculosis H37Rv
ggcggagccgggu

SEQ ID NO: 1278418 - RNA, 14 nt, Mycobacterium tuberculosis H37Rv
ggcggcaucggggu

SEQ ID NO: 1278419 - RNA, 15 nt, Mycobacterium tuberculosis H37Rv
ggcggcaugcucacc

SEQ ID NO: 1278420 - RNA, 21 nt, Mycobacterium tuberculosis H37Rv
ggcgggcugauuucgugcgau

SEQ ID NO: 1278421 - RNA, 17 nt, Mycobacterium tuberculosis H37Rv
ggcggguccucgcggag

SEQ ID NO: 1278422 - RNA, 14 nt, Mycobacterium tuberculosis H37Rv
ggcgggacucggcg

SEQ ID NO: 1278423 - RNA, 20 nt, Mycobacterium tuberculosis H37Rv
ggcgggaacccuugccacga

SEQ ID NO: 1278424 - RNA, 13 nt, Mycobacterium tuberculosis H37Rv
ggcgggagcaccg

SEQ ID NO: 1278425 - RNA, 17 nt, Mycobacterium tuberculosis H37Rv
ggcgggagucgucgagc

SEQ ID NO: 1278426 - RNA, 18 nt, Mycobacterium tuberculosis H37Rv
ggcgggagucgucgagcu

SEQ ID NO: 1278427 - RNA, 23 nt, Mycobacterium tuberculosis H37Rv
ggcgggcacucagcaggggaucg

SEQ ID NO: 1278428 - RNA, 13 nt, Mycobacterium tuberculosis H37Rv
ggcgggcggcagc

SEQ ID NO: 1278429 - RNA, 15 nt, Mycobacterium tuberculosis H37Rv
ggcgggcaaucaccg

SEQ ID NO: 1278430 - RNA, 20 nt, Mycobacterium tuberculosis H37Rv
ggcgggcgcggguggcgcca

SEQ ID NO: 1278431 - RNA, 21 nt, Mycobacterium tuberculosis H37Rv
ggcgggcgccuuggucgccgc

SEQ ID NO: 1278432 - RNA, 15 nt, Mycobacterium tuberculosis H37Rv
ggcgguaaucgcgag

SEQ ID NO: 1278433 - RNA, 22 nt, Mycobacterium tuberculosis H37Rv
ggcgguacaccgacacgccguu

SEQ ID NO: 1278434 - RNA, 18 nt, Mycobacterium tuberculosis H37Rv
ggcgguaccucgucgagc

SEQ ID NO: 1278435 - RNA, 14 nt, Mycobacterium tuberculosis H37Rv
ggcggucaccaccg

SEQ ID NO: 1278436 - RNA, 19 nt, Mycobacterium tuberculosis H37Rv
ggcggucagcggcucggcg

SEQ ID NO: 1278437 - RNA, 17 nt, Mycobacterium tuberculosis H37Rv
ggcggucagcggcucgg

SEQ ID NO: 1278438 - RNA, 20 nt, Mycobacterium tuberculosis H37Rv
ggcggucaggucugacagac

SEQ ID NO: 1278439 - RNA, 16 nt, Mycobacterium tuberculosis H37Rv
ggcggucccugaagcc

SEQ ID NO: 1278440 - RNA, 22 nt, Mycobacterium tuberculosis H37Rv
ggcggucgaucauggcggcagc

SEQ ID NO: 1278441 - RNA, 17 nt, Mycobacterium tuberculosis H37Rv
ggcggugagccgccagg

SEQ ID NO: 1278442 - RNA, 21 nt, Mycobacterium tuberculosis H37Rv
ggcggugcacaccgucgcacc

SEQ ID NO: 1278443 - RNA, 12 nt, Mycobacterium tuberculosis H37Rv
ggcggugccacc

SEQ ID NO: 1278444 - RNA, 12 nt, Mycobacterium tuberculosis H37Rv
ggcggugcccag

SEQ ID NO: 1278445 - RNA, 15 nt, Mycobacterium tuberculosis H37Rv
ggcggugccgucagc

SEQ ID NO: 1278446 - RNA, 18 nt, Mycobacterium tuberculosis H37Rv
ggcggugaaaucgcacag

SEQ ID NO: 1278447 - RNA, 22 nt, Mycobacterium tuberculosis H37Rv
ggcggucugcagugcagcgauc

SEQ ID NO: 1278448 - RNA, 15 nt, Mycobacterium tuberculosis H37Rv
ggcggugucgucgag

SEQ ID NO: 1278449 - RNA, 13 nt, Mycobacterium tuberculosis H37Rv
ggcggugucggcg

SEQ ID NO: 1278450 - RNA, 13 nt, Mycobacterium tuberculosis H37Rv
ggcggugucgacc

SEQ ID NO: 1278451 - RNA, 19 nt, Mycobacterium tuberculosis H37Rv
ggcggugggcagcagcugg

SEQ ID NO: 1278452 - RNA, 13 nt, Mycobacterium tuberculosis H37Rv
ggcgguggucccg

SEQ ID NO: 1278453 - RNA, 14 nt, Mycobacterium tuberculosis H37Rv
ggcggugcgucagc

SEQ ID NO: 1278454 - RNA, 20 nt, Mycobacterium tuberculosis H37Rv
ggcggugcugcuucaacgcg

SEQ ID NO: 1278455 - RNA, 22 nt, Mycobacterium tuberculosis H37Rv
ggcggugcugcuucaacgcguc

SEQ ID NO: 1278456 - RNA, 16 nt, Mycobacterium tuberculosis H37Rv
ggcguaccuucgagcg

SEQ ID NO: 1278457 - RNA, 21 nt, Mycobacterium tuberculosis H37Rv
ggcguagcccaugccgaugcc

SEQ ID NO: 1278458 - RNA, 21 nt, Mycobacterium tuberculosis H37Rv
ggcguagacguccgcggucgc

SEQ ID NO: 1278459 - RNA, 22 nt, Mycobacterium tuberculosis H37Rv
ggcguaggcaggaucgccugag

SEQ ID NO: 1278460 - RNA, 18 nt, Mycobacterium tuberculosis H37Rv
ggcgguuuuguucccgag

SEQ ID NO: 1278461 - RNA, 15 nt, Mycobacterium tuberculosis H37Rv
ggcgguugaucgccg

SEQ ID NO: 1278462 - RNA, 16 nt, Mycobacterium tuberculosis H37Rv
ggcgguugaucgccgg

SEQ ID NO: 1278463 - RNA, 19 nt, Mycobacterium tuberculosis H37Rv
ggcgcggcacccggucggc

SEQ ID NO: 1278464 - RNA, 12 nt, Mycobacterium tuberculosis H37Rv
ggcgcgccugug

SEQ ID NO: 1278465 - RNA, 15 nt, Mycobacterium tuberculosis H37Rv
ggcgcgcgacgagca

SEQ ID NO: 1278466 - RNA, 15 nt, Mycobacterium tuberculosis H37Rv
ggcgcggccgcagcc

SEQ ID NO: 1278467 - RNA, 21 nt, Mycobacterium tuberculosis H37Rv
ggcgcggcacccggucggcca

SEQ ID NO: 1278468 - RNA, 20 nt, Mycobacterium tuberculosis H37Rv
ggcgcggcggaccguccgac

SEQ ID NO: 1278469 - RNA, 22 nt, Mycobacterium tuberculosis H37Rv
ggcgcggcggcgucgagggagc

SEQ ID NO: 1278470 - RNA, 14 nt, Mycobacterium tuberculosis H37Rv
ggcgcggcugccgc

SEQ ID NO: 1278471 - RNA, 22 nt, Mycobacterium tuberculosis H37Rv
ggcgcggcgagcacgcgggcac

SEQ ID NO: 1278472 - RNA, 13 nt, Mycobacterium tuberculosis H37Rv
ggcgcggcgagca

SEQ ID NO: 1278473 - RNA, 15 nt, Mycobacterium tuberculosis H37Rv
ggcgcggcgacaagc

SEQ ID NO: 1278474 - RNA, 14 nt, Mycobacterium tuberculosis H37Rv
ggcgcggcggaccg

SEQ ID NO: 1278475 - RNA, 14 nt, Mycobacterium tuberculosis H37Rv
aaggucgcggucga

SEQ ID NO: 1278476 - RNA, 21 nt, Mycobacterium tuberculosis H37Rv
aaggucugccgggcgcgcgua

SEQ ID NO: 1278477 - RNA, 17 nt, Mycobacterium tuberculosis H37Rv
ggcgcuagccagggauc

SEQ ID NO: 1278478 - RNA, 14 nt, Mycobacterium tuberculosis H37Rv
ggcgcgucggcacc

SEQ ID NO: 1278479 - RNA, 18 nt, Mycobacterium tuberculosis H37Rv
ggcgcgucggcaccgauc

SEQ ID NO: 1278480 - RNA, 14 nt, Mycobacterium tuberculosis H37Rv
ggcgcgucauggcg

SEQ ID NO: 1278481 - RNA, 21 nt, Mycobacterium tuberculosis H37Rv
ggcgcgccgaugaacguggcg

SEQ ID NO: 1278482 - RNA, 18 nt, Mycobacterium tuberculosis H37Rv
ggcgcgccgaguugcccg

SEQ ID NO: 1278483 - RNA, 13 nt, Mycobacterium tuberculosis H37Rv
ggcgcgccgcacc

SEQ ID NO: 1278484 - RNA, 21 nt, Mycobacterium tuberculosis H37Rv
ggcgcgcccggaucucggcgu

SEQ ID NO: 1278485 - RNA, 17 nt, Mycobacterium tuberculosis H37Rv
ggcgcgccugugccacc

SEQ ID NO: 1278486 - RNA, 15 nt, Mycobacterium tuberculosis H37Rv
ggcgcgcaucugcuc

SEQ ID NO: 1278487 - RNA, 17 nt, Mycobacterium tuberculosis H37Rv
ggcgcgcaucugcucgg

SEQ ID NO: 1278488 - RNA, 19 nt, Mycobacterium tuberculosis H37Rv
ggcgcgcaucugcucggca

SEQ ID NO: 1278489 - RNA, 23 nt, Mycobacterium tuberculosis H37Rv
ggcgcgcaucugcucggcaucga

SEQ ID NO: 1278490 - RNA, 21 nt, Mycobacterium tuberculosis H37Rv
ggcgcgcagcgauucgccuag

SEQ ID NO: 1278491 - RNA, 17 nt, Mycobacterium tuberculosis H37Rv
ggcgcgcagcucgggcu

SEQ ID NO: 1278492 - RNA, 13 nt, Mycobacterium tuberculosis H37Rv
ggcgcgcagcgac

SEQ ID NO: 1278493 - RNA, 15 nt, Mycobacterium tuberculosis H37Rv
ggcgcgcagcgacgc

SEQ ID NO: 1278494 - RNA, 17 nt, Mycobacterium tuberculosis H37Rv
ggcgcgcaccaccgcgg

SEQ ID NO: 1278495 - RNA, 16 nt, Mycobacterium tuberculosis H37Rv
ggcgcgcaccaccgcg

SEQ ID NO: 1278496 - RNA, 22 nt, Mycobacterium tuberculosis H37Rv
ggcgcgauccccgcgcugagca

SEQ ID NO: 1278497 - RNA, 15 nt, Mycobacterium tuberculosis H37Rv
ggcgcgaggacgcug

SEQ ID NO: 1278498 - RNA, 16 nt, Mycobacterium tuberculosis H37Rv
ggcgcgagccgcacga

SEQ ID NO: 1278499 - RNA, 20 nt, Mycobacterium tuberculosis H37Rv
ggcgcgacguagacgacguc

SEQ ID NO: 1278500 - RNA, 21 nt, Mycobacterium tuberculosis H37Rv
ggcgcgacguaguugccggcu

SEQ ID NO: 1278501 - RNA, 14 nt, Mycobacterium tuberculosis H37Rv
ggcgccucaucgga

SEQ ID NO: 1278502 - RNA, 17 nt, Mycobacterium tuberculosis H37Rv
ggcgccguuagcgucgc

SEQ ID NO: 1278503 - RNA, 21 nt, Mycobacterium tuberculosis H37Rv
ggcgccgucgggccugccgga

SEQ ID NO: 1278504 - RNA, 24 nt, Mycobacterium tuberculosis H37Rv
ggcgccgucguugugccggucgau

SEQ ID NO: 1278505 - RNA, 17 nt, Mycobacterium tuberculosis H37Rv
ggcgcaagaaugccgcc

SEQ ID NO: 1278506 - RNA, 14 nt, Mycobacterium tuberculosis H37Rv
aagggccgccucgc

SEQ ID NO: 1278507 - RNA, 23 nt, Mycobacterium tuberculosis H37Rv
ggcgagcuggcguucccgcucgg

SEQ ID NO: 1278508 - RNA, 24 nt, Mycobacterium tuberculosis H37Rv
ggcgagcagacgcagaaucgcacg

SEQ ID NO: 1278509 - RNA, 15 nt, Mycobacterium tuberculosis H37Rv
ggcgcaguagccgac

SEQ ID NO: 1278510 - RNA, 14 nt, Mycobacterium tuberculosis H37Rv
ggcgcaguagaugc

SEQ ID NO: 1278511 - RNA, 23 nt, Mycobacterium tuberculosis H37Rv
ggcgcagcucaccgacggagauc

SEQ ID NO: 1278512 - RNA, 20 nt, Mycobacterium tuberculosis H37Rv
ggcgcagcugguuugcggug

SEQ ID NO: 1278513 - RNA, 20 nt, Mycobacterium tuberculosis H37Rv
ggcgcagcugguagcgcacc

SEQ ID NO: 1278514 - RNA, 14 nt, Mycobacterium tuberculosis H37Rv
ggcgcacagcgagc

SEQ ID NO: 1278515 - RNA, 20 nt, Mycobacterium tuberculosis H37Rv
ggcgcacaacccgucgagcc

SEQ ID NO: 1278516 - RNA, 19 nt, Mycobacterium tuberculosis H37Rv
ggcgcagcgugagugcagc

SEQ ID NO: 1278517 - RNA, 18 nt, Mycobacterium tuberculosis H37Rv
ggcgccaccguugccgaa

SEQ ID NO: 1278518 - RNA, 17 nt, Mycobacterium tuberculosis H37Rv
ggcgccaccaucgggga

SEQ ID NO: 1278519 - RNA, 20 nt, Mycobacterium tuberculosis H37Rv
ggcgccacgggugacucggg

SEQ ID NO: 1278520 - RNA, 13 nt, Mycobacterium tuberculosis H37Rv
ggcgccacggugu

SEQ ID NO: 1278521 - RNA, 19 nt, Mycobacterium tuberculosis H37Rv
ggcgccacugaccgcgauc

SEQ ID NO: 1278522 - RNA, 15 nt, Mycobacterium tuberculosis H37Rv
ggcgccacugaccgc

SEQ ID NO: 1278523 - RNA, 22 nt, Mycobacterium tuberculosis H37Rv
ggcgccagaugccucggagauc

SEQ ID NO: 1278524 - RNA, 17 nt, Mycobacterium tuberculosis H37Rv
ggcgccagaucgacgcc

SEQ ID NO: 1278525 - RNA, 18 nt, Mycobacterium tuberculosis H37Rv
ggcgccagaucgacgcca

SEQ ID NO: 1278526 - RNA, 23 nt, Mycobacterium tuberculosis H37Rv
ggcgccacugaccgcgaucgccg

SEQ ID NO: 1278527 - RNA, 14 nt, Mycobacterium tuberculosis H37Rv
ggcgcccggcggau

SEQ ID NO: 1278528 - RNA, 16 nt, Mycobacterium tuberculosis H37Rv
ggcgcccggucgagcc

SEQ ID NO: 1278529 - RNA, 13 nt, Mycobacterium tuberculosis H37Rv
ggcgcccgcucgg

SEQ ID NO: 1278530 - RNA, 13 nt, Mycobacterium tuberculosis H37Rv
ggcgcccggccag

SEQ ID NO: 1278531 - RNA, 20 nt, Mycobacterium tuberculosis H37Rv
ggcgcccggccaggucgaca

SEQ ID NO: 1278532 - RNA, 16 nt, Mycobacterium tuberculosis H37Rv
ggcgcccgccggcaac

SEQ ID NO: 1278533 - RNA, 16 nt, Mycobacterium tuberculosis H37Rv
ggcgcccgcgugacgc

SEQ ID NO: 1278534 - RNA, 12 nt, Mycobacterium tuberculosis H37Rv
ggcgccggcguc

SEQ ID NO: 1278535 - RNA, 17 nt, Mycobacterium tuberculosis H37Rv
ggcgccggcgucggcgc

SEQ ID NO: 1278536 - RNA, 19 nt, Mycobacterium tuberculosis H37Rv
ggcgccgccauugucgcca

SEQ ID NO: 1278537 - RNA, 14 nt, Mycobacterium tuberculosis H37Rv
ggcgccgccggcac

SEQ ID NO: 1278538 - RNA, 16 nt, Mycobacterium tuberculosis H37Rv
ggcgccgccgaccaga

SEQ ID NO: 1278539 - RNA, 23 nt, Mycobacterium tuberculosis H37Rv
ggcgccgccgaccagaacgccag

SEQ ID NO: 1278540 - RNA, 21 nt, Mycobacterium tuberculosis H37Rv
ggcgccgccacugccggcagc

SEQ ID NO: 1278541 - RNA, 13 nt, Mycobacterium tuberculosis H37Rv
ggcgccgcaaccg

SEQ ID NO: 1278542 - RNA, 21 nt, Mycobacterium tuberculosis H37Rv
ggcgccgcaaucagacggcga

SEQ ID NO: 1278543 - RNA, 19 nt, Mycobacterium tuberculosis H37Rv
ggcgccgcaaugacgucgu

SEQ ID NO: 1278544 - RNA, 20 nt, Mycobacterium tuberculosis H37Rv
ggcgccgacaccggcugacc

SEQ ID NO: 1278545 - RNA, 24 nt, Mycobacterium tuberculosis H37Rv
ggcgccgcaccaagcagcgaccag

SEQ ID NO: 1278546 - RNA, 17 nt, Mycobacterium tuberculosis H37Rv
ggcgccgaacccggugu

SEQ ID NO: 1278547 - RNA, 13 nt, Mycobacterium tuberculosis H37Rv
ggcgccgaaguag

SEQ ID NO: 1278548 - RNA, 13 nt, Mycobacterium tuberculosis H37Rv
ggcgccgaaccag

SEQ ID NO: 1278549 - RNA, 23 nt, Mycobacterium tuberculosis H37Rv
ggcgccgaacaccggcuccagca

SEQ ID NO: 1278550 - RNA, 15 nt, Mycobacterium tuberculosis H37Rv
ggccggucggugagc

SEQ ID NO: 1278551 - RNA, 20 nt, Mycobacterium tuberculosis H37Rv
ggccggugcgucacagccgg

SEQ ID NO: 1278552 - RNA, 20 nt, Mycobacterium tuberculosis H37Rv
ggccguagugcacgucggcg

SEQ ID NO: 1278553 - RNA, 17 nt, Mycobacterium tuberculosis H37Rv
ggccguagucggcgaug

SEQ ID NO: 1278554 - RNA, 17 nt, Mycobacterium tuberculosis H37Rv
ggccguauagcgugacc

SEQ ID NO: 1278555 - RNA, 20 nt, Mycobacterium tuberculosis H37Rv
ggccggugcgaauggugcaa

SEQ ID NO: 1278556 - RNA, 16 nt, Mycobacterium tuberculosis H37Rv
ggccgugaugccacgg

SEQ ID NO: 1278557 - RNA, 17 nt, Mycobacterium tuberculosis H37Rv
ggccgucuucggugauc

SEQ ID NO: 1278558 - RNA, 16 nt, Mycobacterium tuberculosis H37Rv
ggccgucuucggugau

SEQ ID NO: 1278559 - RNA, 17 nt, Mycobacterium tuberculosis H37Rv
ggccgucuugccggcca

SEQ ID NO: 1278560 - RNA, 22 nt, Mycobacterium tuberculosis H37Rv
ggccgugaagggauccggaagc

SEQ ID NO: 1278561 - RNA, 12 nt, Mycobacterium tuberculosis H37Rv
ggccgugaccga

SEQ ID NO: 1278562 - RNA, 18 nt, Mycobacterium tuberculosis H37Rv
ggccgugaauucgccgaa

SEQ ID NO: 1278563 - RNA, 16 nt, Mycobacterium tuberculosis H37Rv
ggccgucucggcaugc

SEQ ID NO: 1278564 - RNA, 14 nt, Mycobacterium tuberculosis H37Rv
ggccguaggcggcg

SEQ ID NO: 1278565 - RNA, 15 nt, Mycobacterium tuberculosis H37Rv
ggccgucucgccgug

SEQ ID NO: 1278566 - RNA, 14 nt, Mycobacterium tuberculosis H37Rv
ggccgucucgccgu

SEQ ID NO: 1278567 - RNA, 14 nt, Mycobacterium tuberculosis H37Rv
ggccgucucgacac

SEQ ID NO: 1278568 - RNA, 20 nt, Mycobacterium tuberculosis H37Rv
ggccgucagccaggugccca

SEQ ID NO: 1278569 - RNA, 19 nt, Mycobacterium tuberculosis H37Rv
ggccgugagcccggcgauc

SEQ ID NO: 1278570 - RNA, 19 nt, Mycobacterium tuberculosis H37Rv
ggccgugaugccacggcgu

SEQ ID NO: 1278571 - RNA, 16 nt, Mycobacterium tuberculosis H37Rv
ggccuagccgauggcu

SEQ ID NO: 1278572 - RNA, 15 nt, Mycobacterium tuberculosis H37Rv
ggccuagcgcggcga

SEQ ID NO: 1278573 - RNA, 17 nt, Mycobacterium tuberculosis H37Rv
ggccuagccgcggcacc

SEQ ID NO: 1278574 - RNA, 20 nt, Mycobacterium tuberculosis H37Rv
ggccucaguacagcgcguug

SEQ ID NO: 1278575 - RNA, 23 nt, Mycobacterium tuberculosis H37Rv
ggccuccucgucgcucccgguug

SEQ ID NO: 1278576 - RNA, 17 nt, Mycobacterium tuberculosis H37Rv
ggccucgaccgccagcc

SEQ ID NO: 1278577 - RNA, 22 nt, Mycobacterium tuberculosis H37Rv
ggccucagcccggccagccgca

SEQ ID NO: 1278578 - RNA, 20 nt, Mycobacterium tuberculosis H37Rv
ggccucagcccgucagccga

SEQ ID NO: 1278579 - RNA, 16 nt, Mycobacterium tuberculosis H37Rv
ggccucagcccggcca

SEQ ID NO: 1278580 - RNA, 17 nt, Mycobacterium tuberculosis H37Rv
ggccucagccaccgggc

SEQ ID NO: 1278581 - RNA, 16 nt, Mycobacterium tuberculosis H37Rv
ggccucacccggucaa

SEQ ID NO: 1278582 - RNA, 20 nt, Mycobacterium tuberculosis H37Rv
ggccucaaguugguucaccg

SEQ ID NO: 1278583 - RNA, 13 nt, Mycobacterium tuberculosis H37Rv
ggccucgcugcuc

SEQ ID NO: 1278584 - RNA, 20 nt, Mycobacterium tuberculosis H37Rv
ggccucggcgauaccgagga

SEQ ID NO: 1278585 - RNA, 18 nt, Mycobacterium tuberculosis H37Rv
ggccucggccagcgucag

SEQ ID NO: 1278586 - RNA, 19 nt, Mycobacterium tuberculosis H37Rv
ggccucgcugggcucaugg

SEQ ID NO: 1278587 - RNA, 14 nt, Mycobacterium tuberculosis H37Rv
ggccucgaucagcg

SEQ ID NO: 1278588 - RNA, 17 nt, Mycobacterium tuberculosis H37Rv
ggccgguagcgcgggug

SEQ ID NO: 1278589 - RNA, 16 nt, Mycobacterium tuberculosis H37Rv
ggccgguacacgucca

SEQ ID NO: 1278590 - RNA, 20 nt, Mycobacterium tuberculosis H37Rv
ggccgggcucuaucagacga

SEQ ID NO: 1278591 - RNA, 22 nt, Mycobacterium tuberculosis H37Rv
ggccgggcgaucgccugggcuu

SEQ ID NO: 1278592 - RNA, 19 nt, Mycobacterium tuberculosis H37Rv
ggccgggcgggcggccgau

SEQ ID NO: 1278593 - RNA, 20 nt, Mycobacterium tuberculosis H37Rv
ggccgggcgggcggccgauc

SEQ ID NO: 1278594 - RNA, 16 nt, Mycobacterium tuberculosis H37Rv
ggccgggacggcgaua

SEQ ID NO: 1278595 - RNA, 11 nt, Mycobacterium tuberculosis H37Rv
ggccgggaucu

SEQ ID NO: 1278596 - RNA, 11 nt, Mycobacterium tuberculosis H37Rv
ggccggcguug

SEQ ID NO: 1278597 - RNA, 23 nt, Mycobacterium tuberculosis H37Rv
ggccggcuagggcagcagcccgg

SEQ ID NO: 1278598 - RNA, 22 nt, Mycobacterium tuberculosis H37Rv
ggccggcguagcggcgauaccg

SEQ ID NO: 1278599 - RNA, 19 nt, Mycobacterium tuberculosis H37Rv
ggccggcguagcggcgaua

SEQ ID NO: 1278600 - RNA, 18 nt, Mycobacterium tuberculosis H37Rv
ggccggcguagcggcgau

SEQ ID NO: 1278601 - RNA, 13 nt, Mycobacterium tuberculosis H37Rv
ggccggcggucgc

SEQ ID NO: 1278602 - RNA, 17 nt, Mycobacterium tuberculosis H37Rv
ggccggcggcggcgcuc

SEQ ID NO: 1278603 - RNA, 13 nt, Mycobacterium tuberculosis H37Rv
ggccggcgcugcc

SEQ ID NO: 1278604 - RNA, 14 nt, Mycobacterium tuberculosis H37Rv
ggccggcgccgcac

SEQ ID NO: 1278605 - RNA, 13 nt, Mycobacterium tuberculosis H37Rv
ggccggcccgggu

SEQ ID NO: 1278606 - RNA, 20 nt, Mycobacterium tuberculosis H37Rv
ggccgcugggcccaucgcga

SEQ ID NO: 1278607 - RNA, 20 nt, Mycobacterium tuberculosis H37Rv
ggccggcauggcggcauagc

SEQ ID NO: 1278608 - RNA, 15 nt, Mycobacterium tuberculosis H37Rv
ggccggccaccaccg

SEQ ID NO: 1278609 - RNA, 19 nt, Mycobacterium tuberculosis H37Rv
ggccggccaccaguccgau

SEQ ID NO: 1278610 - RNA, 14 nt, Mycobacterium tuberculosis H37Rv
ggccgcugccacua

SEQ ID NO: 1278611 - RNA, 22 nt, Mycobacterium tuberculosis H37Rv
ggccgcugccuuggcgcggcac

SEQ ID NO: 1278612 - RNA, 19 nt, Mycobacterium tuberculosis H37Rv
ggccgcgaucgacgguguc

SEQ ID NO: 1278613 - RNA, 24 nt, Mycobacterium tuberculosis H37Rv
ggccgcgcggucguacgcauggcg

SEQ ID NO: 1278614 - RNA, 21 nt, Mycobacterium tuberculosis H37Rv
ggccgcgcggcgacagcuugg

SEQ ID NO: 1278615 - RNA, 14 nt, Mycobacterium tuberculosis H37Rv
ggccgcgcaugguc

SEQ ID NO: 1278616 - RNA, 12 nt, Mycobacterium tuberculosis H37Rv
ggccgcgcgcac

SEQ ID NO: 1278617 - RNA, 17 nt, Mycobacterium tuberculosis H37Rv
ggccgcgcgcaccggua

SEQ ID NO: 1278618 - RNA, 21 nt, Mycobacterium tuberculosis H37Rv
ggccgcgcgacaacccggcgu

SEQ ID NO: 1278619 - RNA, 23 nt, Mycobacterium tuberculosis H37Rv
ggccgcgaggugaaucgcgucga

SEQ ID NO: 1278620 - RNA, 14 nt, Mycobacterium tuberculosis H37Rv
ggccgcgauccagc

SEQ ID NO: 1278621 - RNA, 23 nt, Mycobacterium tuberculosis H37Rv
ggccgcgagguacccaucgucga

SEQ ID NO: 1278622 - RNA, 21 nt, Mycobacterium tuberculosis H37Rv
ggccgccggacccgucgagca

SEQ ID NO: 1278623 - RNA, 16 nt, Mycobacterium tuberculosis H37Rv
ggccgccgagcucggu

SEQ ID NO: 1278624 - RNA, 14 nt, Mycobacterium tuberculosis H37Rv
ggccgccggccagc

SEQ ID NO: 1278625 - RNA, 15 nt, Mycobacterium tuberculosis H37Rv
ggccgccgagacgac

SEQ ID NO: 1278626 - RNA, 17 nt, Mycobacterium tuberculosis H37Rv
ggccgcucuucgacauc

SEQ ID NO: 1278627 - RNA, 20 nt, Mycobacterium tuberculosis H37Rv
ggccgcgucuuggugcgcgu

SEQ ID NO: 1278628 - RNA, 19 nt, Mycobacterium tuberculosis H37Rv
ggccgcgucucggugcagc

SEQ ID NO: 1278629 - RNA, 16 nt, Mycobacterium tuberculosis H37Rv
ggccgcgucacggacc

SEQ ID NO: 1278630 - RNA, 21 nt, Mycobacterium tuberculosis H37Rv
ggccgcguaaaccggcugacc

SEQ ID NO: 1278631 - RNA, 18 nt, Mycobacterium tuberculosis H37Rv
ggccgcguaaaccggcug

SEQ ID NO: 1278632 - RNA, 24 nt, Mycobacterium tuberculosis H37Rv
ggccgcgguguauccgacgucggu

SEQ ID NO: 1278633 - RNA, 15 nt, Mycobacterium tuberculosis H37Rv
ggccgcggugcccgu

SEQ ID NO: 1278634 - RNA, 15 nt, Mycobacterium tuberculosis H37Rv
ggccgcgcucgucga

SEQ ID NO: 1278635 - RNA, 13 nt, Mycobacterium tuberculosis H37Rv
ggccgcgcugaac

SEQ ID NO: 1278636 - RNA, 18 nt, Mycobacterium tuberculosis H37Rv
ggccgcgcugcagcacgg

SEQ ID NO: 1278637 - RNA, 16 nt, Mycobacterium tuberculosis H37Rv
ggccgcgcugaacgcu

SEQ ID NO: 1278638 - RNA, 23 nt, Mycobacterium tuberculosis H37Rv
ggccgcaucggucaaugccacua

SEQ ID NO: 1278639 - RNA, 20 nt, Mycobacterium tuberculosis H37Rv
ggccgcaucgccucaccacg

SEQ ID NO: 1278640 - RNA, 23 nt, Mycobacterium tuberculosis H37Rv
ggccgcaucgacgcucaucucgg

SEQ ID NO: 1278641 - RNA, 13 nt, Mycobacterium tuberculosis H37Rv
ggccgccaccgcg

SEQ ID NO: 1278642 - RNA, 14 nt, Mycobacterium tuberculosis H37Rv
ggccgccaccgcga

SEQ ID NO: 1278643 - RNA, 12 nt, Mycobacterium tuberculosis H37Rv
ggccgccaccgu

SEQ ID NO: 1278644 - RNA, 17 nt, Mycobacterium tuberculosis H37Rv
ggccgccaccagcgcga

SEQ ID NO: 1278645 - RNA, 17 nt, Mycobacterium tuberculosis H37Rv
ggcccauaccgauggug

SEQ ID NO: 1278646 - RNA, 12 nt, Mycobacterium tuberculosis H37Rv
ggcccaguccgc

SEQ ID NO: 1278647 - RNA, 16 nt, Mycobacterium tuberculosis H37Rv
ggcccauaacagcugg

SEQ ID NO: 1278648 - RNA, 19 nt, Mycobacterium tuberculosis H37Rv
ggccccggugacgccgucg

SEQ ID NO: 1278649 - RNA, 20 nt, Mycobacterium tuberculosis H37Rv
ggccccggugccgaccgguu

SEQ ID NO: 1278650 - RNA, 20 nt, Mycobacterium tuberculosis H37Rv
ggccccgguggugcugccga

SEQ ID NO: 1278651 - RNA, 15 nt, Mycobacterium tuberculosis H37Rv
ggccccgucgccgau

SEQ ID NO: 1278652 - RNA, 15 nt, Mycobacterium tuberculosis H37Rv
ggccgcccggcgagc

SEQ ID NO: 1278653 - RNA, 16 nt, Mycobacterium tuberculosis H37Rv
ggccgcccggcgagca

SEQ ID NO: 1278654 - RNA, 20 nt, Mycobacterium tuberculosis H37Rv
ggccgccccggccgcuggcg

SEQ ID NO: 1278655 - RNA, 21 nt, Mycobacterium tuberculosis H37Rv
ggccgccaugaaaucacccau

SEQ ID NO: 1278656 - RNA, 18 nt, Mycobacterium tuberculosis H37Rv
ggccgccaguucggcguc

SEQ ID NO: 1278657 - RNA, 15 nt, Mycobacterium tuberculosis H37Rv
ggccgccagcugcgc

SEQ ID NO: 1278658 - RNA, 21 nt, Mycobacterium tuberculosis H37Rv
ggccgccagccgguccagcag

SEQ ID NO: 1278659 - RNA, 13 nt, Mycobacterium tuberculosis H37Rv
ggccgccagccgg

SEQ ID NO: 1278660 - RNA, 16 nt, Mycobacterium tuberculosis H37Rv
ggccgccagcgcacga

SEQ ID NO: 1278661 - RNA, 24 nt, Mycobacterium tuberculosis H37Rv
ggccuuggcgaucuuguccagggu

SEQ ID NO: 1278662 - RNA, 15 nt, Mycobacterium tuberculosis H37Rv
ggccuuggcgggauc

SEQ ID NO: 1278663 - RNA, 18 nt, Mycobacterium tuberculosis H37Rv
ggcgaaaauugcuccacc

SEQ ID NO: 1278664 - RNA, 14 nt, Mycobacterium tuberculosis H37Rv
ggcgaaaucgucga

SEQ ID NO: 1278665 - RNA, 16 nt, Mycobacterium tuberculosis H37Rv
ggcgaaauccgcgauc

SEQ ID NO: 1278666 - RNA, 16 nt, Mycobacterium tuberculosis H37Rv
ggcgaacccuccgcag

SEQ ID NO: 1278667 - RNA, 23 nt, Mycobacterium tuberculosis H37Rv
ggcgaaccgcagacccucgucgu

SEQ ID NO: 1278668 - RNA, 18 nt, Mycobacterium tuberculosis H37Rv
ggcgaaaucgucgaaccg

SEQ ID NO: 1278669 - RNA, 11 nt, Mycobacterium tuberculosis H37Rv
ggcgaacacgu

SEQ ID NO: 1278670 - RNA, 17 nt, Mycobacterium tuberculosis H37Rv
ggcgaacugggugcggu

SEQ ID NO: 1278671 - RNA, 22 nt, Mycobacterium tuberculosis H37Rv
ggcgaacgcuucaccucgucga

SEQ ID NO: 1278672 - RNA, 22 nt, Mycobacterium tuberculosis H37Rv
ggcgaagcgucuggucagccgc

SEQ ID NO: 1278673 - RNA, 23 nt, Mycobacterium tuberculosis H37Rv
ggcgaagguccgugccgaugccg

SEQ ID NO: 1278674 - RNA, 15 nt, Mycobacterium tuberculosis H37Rv
ggcgaagcuugacgu

SEQ ID NO: 1278675 - RNA, 21 nt, Mycobacterium tuberculosis H37Rv
ggcgaagccgcugaucgccga

SEQ ID NO: 1278676 - RNA, 16 nt, Mycobacterium tuberculosis H37Rv
aaggcgcgggcgacgu

SEQ ID NO: 1278677 - RNA, 14 nt, Mycobacterium tuberculosis H37Rv
aaggcgacgaaucg

SEQ ID NO: 1278678 - RNA, 17 nt, Mycobacterium tuberculosis H37Rv
ggccucugaccagccgg

SEQ ID NO: 1278679 - RNA, 22 nt, Mycobacterium tuberculosis H37Rv
aaggcgucgaacagugccucgc

SEQ ID NO: 1278680 - RNA, 15 nt, Mycobacterium tuberculosis H37Rv
ggccugggccgcaca

SEQ ID NO: 1278681 - RNA, 16 nt, Mycobacterium tuberculosis H37Rv
ggccugaaacggcugc

SEQ ID NO: 1278682 - RNA, 16 nt, Mycobacterium tuberculosis H37Rv
ggccugaaccacgcgu

SEQ ID NO: 1278683 - RNA, 14 nt, Mycobacterium tuberculosis H37Rv
ggccucgucgaugu

SEQ ID NO: 1278684 - RNA, 17 nt, Mycobacterium tuberculosis H37Rv
ggccucguugaccgggu

SEQ ID NO: 1278685 - RNA, 16 nt, Mycobacterium tuberculosis H37Rv
ggccucguccagcucg

SEQ ID NO: 1278686 - RNA, 13 nt, Mycobacterium tuberculosis H37Rv
ggccucggggauc

SEQ ID NO: 1278687 - RNA, 21 nt, Mycobacterium tuberculosis H37Rv
ggccucggugagcagcucggu

SEQ ID NO: 1278688 - RNA, 19 nt, Mycobacterium tuberculosis H37Rv
ggccuguucgccgucgcua

SEQ ID NO: 1278689 - RNA, 19 nt, Mycobacterium tuberculosis H37Rv
ggccuguucgagaucgccg

SEQ ID NO: 1278690 - RNA, 15 nt, Mycobacterium tuberculosis H37Rv
ggccuguucgagauc

SEQ ID NO: 1278691 - RNA, 17 nt, Mycobacterium tuberculosis H37Rv
ggccuuauucacccggu

SEQ ID NO: 1278692 - RNA, 23 nt, Mycobacterium tuberculosis H37Rv
ggccugguacucccgcgaucgcg

SEQ ID NO: 1278693 - RNA, 12 nt, Mycobacterium tuberculosis H37Rv
ggccuugacagc

SEQ ID NO: 1278694 - RNA, 18 nt, Mycobacterium tuberculosis H37Rv
ggccuugacgcacgacug

SEQ ID NO: 1278695 - RNA, 22 nt, Mycobacterium tuberculosis H37Rv
ggccuugcgcacaggcgcgauc

SEQ ID NO: 1278696 - RNA, 18 nt, Mycobacterium tuberculosis H37Rv
ggccuuggcaguccagcc

SEQ ID NO: 1278697 - RNA, 13 nt, Mycobacterium tuberculosis H37Rv
ggccuugccaccg

SEQ ID NO: 1278698 - RNA, 18 nt, Mycobacterium tuberculosis H37Rv
ggccuucgggccaggauc

SEQ ID NO: 1278699 - RNA, 14 nt, Mycobacterium tuberculosis H37Rv
ggccuugaucaccg

SEQ ID NO: 1278700 - RNA, 18 nt, Mycobacterium tuberculosis H37Rv
ggcgacgacgacaccgcg

SEQ ID NO: 1278701 - RNA, 14 nt, Mycobacterium tuberculosis H37Rv
ggcgacgcacucgg

SEQ ID NO: 1278702 - RNA, 21 nt, Mycobacterium tuberculosis H37Rv
ggcgacgagaucugcgauggg

SEQ ID NO: 1278703 - RNA, 21 nt, Mycobacterium tuberculosis H37Rv
ggcgacgaggcaaugcgagca

SEQ ID NO: 1278704 - RNA, 13 nt, Mycobacterium tuberculosis H37Rv
ggcgacggcgaug

SEQ ID NO: 1278705 - RNA, 20 nt, Mycobacterium tuberculosis H37Rv
ggcgacgcgccgguucagac

SEQ ID NO: 1278706 - RNA, 14 nt, Mycobacterium tuberculosis H37Rv
aaggcucagcagcg

SEQ ID NO: 1278707 - RNA, 18 nt, Mycobacterium tuberculosis H37Rv
ggcgacgggucgggcaac

SEQ ID NO: 1278708 - RNA, 16 nt, Mycobacterium tuberculosis H37Rv
ggcgacgggucgggca

SEQ ID NO: 1278709 - RNA, 15 nt, Mycobacterium tuberculosis H37Rv
ggcgacggcucuacc

SEQ ID NO: 1278710 - RNA, 17 nt, Mycobacterium tuberculosis H37Rv
ggcgacggcgucacccg

SEQ ID NO: 1278711 - RNA, 22 nt, Mycobacterium tuberculosis H37Rv
ggcgagcacccgcuggucgagc

SEQ ID NO: 1278712 - RNA, 18 nt, Mycobacterium tuberculosis H37Rv
ggcgagcaacucguccag

SEQ ID NO: 1278713 - RNA, 19 nt, Mycobacterium tuberculosis H37Rv
ggcgagagcgucaaccacg

SEQ ID NO: 1278714 - RNA, 16 nt, Mycobacterium tuberculosis H37Rv
ggcgagcacgcgggca

SEQ ID NO: 1278715 - RNA, 13 nt, Mycobacterium tuberculosis H37Rv
ggcgacucggugc

SEQ ID NO: 1278716 - RNA, 22 nt, Mycobacterium tuberculosis H37Rv
ggcgacucgaggaccugcucgg

SEQ ID NO: 1278717 - RNA, 15 nt, Mycobacterium tuberculosis H37Rv
ggcgacugucugguc

SEQ ID NO: 1278718 - RNA, 19 nt, Mycobacterium tuberculosis H37Rv
ggcgagaaacacgacagcc

SEQ ID NO: 1278719 - RNA, 15 nt, Mycobacterium tuberculosis H37Rv
ggcgagaacaggauc

SEQ ID NO: 1278720 - RNA, 15 nt, Mycobacterium tuberculosis H37Rv
ggcgacggucgugau

SEQ ID NO: 1278721 - RNA, 20 nt, Mycobacterium tuberculosis H37Rv
ggcgacggugagggcgucgu

SEQ ID NO: 1278722 - RNA, 17 nt, Mycobacterium tuberculosis H37Rv
ggcgacgucaucgccga

SEQ ID NO: 1278723 - RNA, 23 nt, Mycobacterium tuberculosis H37Rv
ggcgacgucucgcaugcucacga

SEQ ID NO: 1278724 - RNA, 21 nt, Mycobacterium tuberculosis H37Rv
ggcgacucgaggaccugcucg

SEQ ID NO: 1278725 - RNA, 12 nt, Mycobacterium tuberculosis H37Rv
ggcgaccagaua

SEQ ID NO: 1278726 - RNA, 23 nt, Mycobacterium tuberculosis H37Rv
ggcgaccauaagcucguagagca

SEQ ID NO: 1278727 - RNA, 20 nt, Mycobacterium tuberculosis H37Rv
ggcgaccauauucagcucgg

SEQ ID NO: 1278728 - RNA, 14 nt, Mycobacterium tuberculosis H37Rv
ggcgaccaggucgg

SEQ ID NO: 1278729 - RNA, 22 nt, Mycobacterium tuberculosis H37Rv
ggcgacaugaucugccaccgcg

SEQ ID NO: 1278730 - RNA, 20 nt, Mycobacterium tuberculosis H37Rv
ggcgaccaacacgucgagca

SEQ ID NO: 1278731 - RNA, 20 nt, Mycobacterium tuberculosis H37Rv
ggcgaccaaggccgaccugu

SEQ ID NO: 1278732 - RNA, 17 nt, Mycobacterium tuberculosis H37Rv
ggcgaaugacggccagu

SEQ ID NO: 1278733 - RNA, 23 nt, Mycobacterium tuberculosis H37Rv
ggcgaauccgcacagguccgggu

SEQ ID NO: 1278734 - RNA, 15 nt, Mycobacterium tuberculosis H37Rv
ggcgacacgccagcc

SEQ ID NO: 1278735 - RNA, 13 nt, Mycobacterium tuberculosis H37Rv
ggcgacacgccag

SEQ ID NO: 1278736 - RNA, 21 nt, Mycobacterium tuberculosis H37Rv
ggcgacaccggaaacggucag

SEQ ID NO: 1278737 - RNA, 21 nt, Mycobacterium tuberculosis H37Rv
ggcgaccgucgauuucgacga

SEQ ID NO: 1278738 - RNA, 22 nt, Mycobacterium tuberculosis H37Rv
ggcgaccgucgauuucgacgac

SEQ ID NO: 1278739 - RNA, 20 nt, Mycobacterium tuberculosis H37Rv
ggcgaccuugacccgcaagu

SEQ ID NO: 1278740 - RNA, 23 nt, Mycobacterium tuberculosis H37Rv
ggcgaccucggguugcagcagca

SEQ ID NO: 1278741 - RNA, 18 nt, Mycobacterium tuberculosis H37Rv
ggcgacgaccgucggcuc

SEQ ID NO: 1278742 - RNA, 16 nt, Mycobacterium tuberculosis H37Rv
ggcgacgacggccugc

SEQ ID NO: 1278743 - RNA, 16 nt, Mycobacterium tuberculosis H37Rv
ggcgacgaaccgccag

SEQ ID NO: 1278744 - RNA, 17 nt, Mycobacterium tuberculosis H37Rv
ggcgacgaaccgccaga

SEQ ID NO: 1278745 - RNA, 14 nt, Mycobacterium tuberculosis H37Rv
ggcgaccgcgcuca

SEQ ID NO: 1278746 - RNA, 12 nt, Mycobacterium tuberculosis H37Rv
ggcgaccggcga

SEQ ID NO: 1278747 - RNA, 13 nt, Mycobacterium tuberculosis H37Rv
ggcgaccgccugc

SEQ ID NO: 1278748 - RNA, 20 nt, Mycobacterium tuberculosis H37Rv
ggcgacccgcugggucgacc

SEQ ID NO: 1278749 - RNA, 20 nt, Mycobacterium tuberculosis H37Rv
ggcgaccagcucagcugcgg

SEQ ID NO: 1278750 - RNA, 15 nt, Mycobacterium tuberculosis H37Rv
ggcgacccggguaga

SEQ ID NO: 1278751 - RNA, 23 nt, Mycobacterium tuberculosis H37Rv
ggcgacccggguagacaccgcga

SEQ ID NO: 1278752 - RNA, 16 nt, Mycobacterium tuberculosis H37Rv
ggccaccggcgaccga

SEQ ID NO: 1278753 - RNA, 21 nt, Mycobacterium tuberculosis H37Rv
ggccacgaugcgcacaccgac

SEQ ID NO: 1278754 - RNA, 16 nt, Mycobacterium tuberculosis H37Rv
ggccaccgcgcaaccc

SEQ ID NO: 1278755 - RNA, 16 nt, Mycobacterium tuberculosis H37Rv
ggccaccgccgccugc

SEQ ID NO: 1278756 - RNA, 22 nt, Mycobacterium tuberculosis H37Rv
ggccacguagcagcagacgacg

SEQ ID NO: 1278757 - RNA, 13 nt, Mycobacterium tuberculosis H37Rv
ggccacgcaccgg

SEQ ID NO: 1278758 - RNA, 16 nt, Mycobacterium tuberculosis H37Rv
ggccacgcaccgggug

SEQ ID NO: 1278759 - RNA, 15 nt, Mycobacterium tuberculosis H37Rv
ggccacgccagcucg

SEQ ID NO: 1278760 - RNA, 14 nt, Mycobacterium tuberculosis H37Rv
ggcaugccggcgaa

SEQ ID NO: 1278761 - RNA, 13 nt, Mycobacterium tuberculosis H37Rv
ggcaugccggcga

SEQ ID NO: 1278762 - RNA, 19 nt, Mycobacterium tuberculosis H37Rv
ggcaugccagccacgaacu

SEQ ID NO: 1278763 - RNA, 16 nt, Mycobacterium tuberculosis H37Rv
ggcaugcggaucggcg

SEQ ID NO: 1278764 - RNA, 17 nt, Mycobacterium tuberculosis H37Rv
ggcaucggccaccuguu

SEQ ID NO: 1278765 - RNA, 20 nt, Mycobacterium tuberculosis H37Rv
ggcaucggccaucucgucga

SEQ ID NO: 1278766 - RNA, 18 nt, Mycobacterium tuberculosis H37Rv
ggcaucggcggccugcuc

SEQ ID NO: 1278767 - RNA, 19 nt, Mycobacterium tuberculosis H37Rv
ggcaucggcggccugcucg

SEQ ID NO: 1278768 - RNA, 15 nt, Mycobacterium tuberculosis H37Rv
ggcaucggcgguucc

SEQ ID NO: 1278769 - RNA, 17 nt, Mycobacterium tuberculosis H37Rv
ggcaucggucagcgcgg

SEQ ID NO: 1278770 - RNA, 18 nt, Mycobacterium tuberculosis H37Rv
ggcaugcuggcgaucgcg

SEQ ID NO: 1278771 - RNA, 19 nt, Mycobacterium tuberculosis H37Rv
ggcauggauacgcagcacc

SEQ ID NO: 1278772 - RNA, 17 nt, Mycobacterium tuberculosis H37Rv
ggcaugcggaucggcgg

SEQ ID NO: 1278773 - RNA, 18 nt, Mycobacterium tuberculosis H37Rv
ggccaccaacucggcgac

SEQ ID NO: 1278774 - RNA, 15 nt, Mycobacterium tuberculosis H37Rv
ggccaccaccgccgc

SEQ ID NO: 1278775 - RNA, 17 nt, Mycobacterium tuberculosis H37Rv
ggccagcgauguggcgu

SEQ ID NO: 1278776 - RNA, 16 nt, Mycobacterium tuberculosis H37Rv
ggccagccuaccggcu

SEQ ID NO: 1278777 - RNA, 19 nt, Mycobacterium tuberculosis H37Rv
ggccagcgcggcgagggcg

SEQ ID NO: 1278778 - RNA, 15 nt, Mycobacterium tuberculosis H37Rv
ggccagcuugcggag

SEQ ID NO: 1278779 - RNA, 14 nt, Mycobacterium tuberculosis H37Rv
ggccagcgcaugga

SEQ ID NO: 1278780 - RNA, 11 nt, Mycobacterium tuberculosis H37Rv
ggccagcggca

SEQ ID NO: 1278781 - RNA, 14 nt, Mycobacterium tuberculosis H37Rv
ggccagcgcggcga

SEQ ID NO: 1278782 - RNA, 23 nt, Mycobacterium tuberculosis H37Rv
ggccagcgcgucgggaugcgcgu

SEQ ID NO: 1278783 - RNA, 16 nt, Mycobacterium tuberculosis H37Rv
ggccagcgcucaccgg

SEQ ID NO: 1278784 - RNA, 16 nt, Mycobacterium tuberculosis H37Rv
ggccagcaucgcggug

SEQ ID NO: 1278785 - RNA, 15 nt, Mycobacterium tuberculosis H37Rv
ggccagcagugcggu

SEQ ID NO: 1278786 - RNA, 13 nt, Mycobacterium tuberculosis H37Rv
ggccagcagcgac

SEQ ID NO: 1278787 - RNA, 21 nt, Mycobacterium tuberculosis H37Rv
ggccagcagaaacaucgacag

SEQ ID NO: 1278788 - RNA, 21 nt, Mycobacterium tuberculosis H37Rv
ggccagcacuccgcgggguug

SEQ ID NO: 1278789 - RNA, 21 nt, Mycobacterium tuberculosis H37Rv
ggccacugcguuccaucgccg

SEQ ID NO: 1278790 - RNA, 14 nt, Mycobacterium tuberculosis H37Rv
ggccagcacaccgu

SEQ ID NO: 1278791 - RNA, 17 nt, Mycobacterium tuberculosis H37Rv
ggccagcaccacggcca

SEQ ID NO: 1278792 - RNA, 22 nt, Mycobacterium tuberculosis H37Rv
ggccagcacccgcuccagcucg

SEQ ID NO: 1278793 - RNA, 19 nt, Mycobacterium tuberculosis H37Rv
ggccagcaccagcucacgu

SEQ ID NO: 1278794 - RNA, 19 nt, Mycobacterium tuberculosis H37Rv
ggccagguggccgcaucgc

SEQ ID NO: 1278795 - RNA, 13 nt, Mycobacterium tuberculosis H37Rv
ggccaguccgggg

SEQ ID NO: 1278796 - RNA, 14 nt, Mycobacterium tuberculosis H37Rv
ggccagugccaccu

SEQ ID NO: 1278797 - RNA, 17 nt, Mycobacterium tuberculosis H37Rv
ggccagugucagcacga

SEQ ID NO: 1278798 - RNA, 22 nt, Mycobacterium tuberculosis H37Rv
ggccagugccgguucgauggca

SEQ ID NO: 1278799 - RNA, 22 nt, Mycobacterium tuberculosis H37Rv
ggccagguuguagacggcaccc

SEQ ID NO: 1278800 - RNA, 16 nt, Mycobacterium tuberculosis H37Rv
ggccagggagcggcuu

SEQ ID NO: 1278801 - RNA, 14 nt, Mycobacterium tuberculosis H37Rv
ggccaucagcucgc

SEQ ID NO: 1278802 - RNA, 14 nt, Mycobacterium tuberculosis H37Rv
ggccauacgcgcgc

SEQ ID NO: 1278803 - RNA, 19 nt, Mycobacterium tuberculosis H37Rv
ggccauaccgcucgccguu

SEQ ID NO: 1278804 - RNA, 23 nt, Mycobacterium tuberculosis H37Rv
ggccauaaaugcgcguucgaccu

SEQ ID NO: 1278805 - RNA, 18 nt, Mycobacterium tuberculosis H37Rv
ggccaguucggugagccg

SEQ ID NO: 1278806 - RNA, 15 nt, Mycobacterium tuberculosis H37Rv
ggccagugaggauca

SEQ ID NO: 1278807 - RNA, 18 nt, Mycobacterium tuberculosis H37Rv
ggccaguuggccggccag

SEQ ID NO: 1278808 - RNA, 16 nt, Mycobacterium tuberculosis H37Rv
ggccaucugcucgugg

SEQ ID NO: 1278809 - RNA, 16 nt, Mycobacterium tuberculosis H37Rv
ggccaucgcgcggacc

SEQ ID NO: 1278810 - RNA, 19 nt, Mycobacterium tuberculosis H37Rv
ggccaucgcgcggaccaga

SEQ ID NO: 1278811 - RNA, 14 nt, Mycobacterium tuberculosis H37Rv
ggccaucguccagc

SEQ ID NO: 1278812 - RNA, 17 nt, Mycobacterium tuberculosis H37Rv
ggccaucgcauccccag

SEQ ID NO: 1278813 - RNA, 17 nt, Mycobacterium tuberculosis H37Rv
ggccaucgaguccacca

SEQ ID NO: 1278814 - RNA, 17 nt, Mycobacterium tuberculosis H37Rv
ggccaucgcccgaugcg

SEQ ID NO: 1278815 - RNA, 20 nt, Mycobacterium tuberculosis H37Rv
ggccaucaucgacggugauc

SEQ ID NO: 1278816 - RNA, 16 nt, Mycobacterium tuberculosis H37Rv
ggcccagauaucguac

SEQ ID NO: 1278817 - RNA, 15 nt, Mycobacterium tuberculosis H37Rv
ggcccacggugcgau

SEQ ID NO: 1278818 - RNA, 22 nt, Mycobacterium tuberculosis H37Rv
ggcccacucacacaaccgacgg

SEQ ID NO: 1278819 - RNA, 18 nt, Mycobacterium tuberculosis H37Rv
ggcccacggcagcgccgg

SEQ ID NO: 1278820 - RNA, 22 nt, Mycobacterium tuberculosis H37Rv
ggcccacgcgcacucgaccagg

SEQ ID NO: 1278821 - RNA, 14 nt, Mycobacterium tuberculosis H37Rv
ggcccagcagcgca

SEQ ID NO: 1278822 - RNA, 23 nt, Mycobacterium tuberculosis H37Rv
ggcccagcaaccgcucggcgaug

SEQ ID NO: 1278823 - RNA, 18 nt, Mycobacterium tuberculosis H37Rv
ggcccagcaaccgcucgg

SEQ ID NO: 1278824 - RNA, 12 nt, Mycobacterium tuberculosis H37Rv
ggcccagcacgg

SEQ ID NO: 1278825 - RNA, 21 nt, Mycobacterium tuberculosis H37Rv
ggcccagcgcccccagcagcu

SEQ ID NO: 1278826 - RNA, 17 nt, Mycobacterium tuberculosis H37Rv
ggcccaggcuguccgac

SEQ ID NO: 1278827 - RNA, 15 nt, Mycobacterium tuberculosis H37Rv
ggcccagcgaccagu

SEQ ID NO: 1278828 - RNA, 19 nt, Mycobacterium tuberculosis H37Rv
ggcccagcgguaguccggc

SEQ ID NO: 1278829 - RNA, 23 nt, Mycobacterium tuberculosis H37Rv
ggcccagcgugucuugucgcgca

SEQ ID NO: 1278830 - RNA, 17 nt, Mycobacterium tuberculosis H37Rv
ggccaugugcacggcgu

SEQ ID NO: 1278831 - RNA, 17 nt, Mycobacterium tuberculosis H37Rv
ggccauucaccgcgcac

SEQ ID NO: 1278832 - RNA, 15 nt, Mycobacterium tuberculosis H37Rv
ggcccaccgccguug

SEQ ID NO: 1278833 - RNA, 18 nt, Mycobacterium tuberculosis H37Rv
ggcccaaggaacggcguc

SEQ ID NO: 1278834 - RNA, 13 nt, Mycobacterium tuberculosis H37Rv
ggccaucugcucg

SEQ ID NO: 1278835 - RNA, 17 nt, Mycobacterium tuberculosis H37Rv
ggccaugaaaaucggca

SEQ ID NO: 1278836 - RNA, 16 nt, Mycobacterium tuberculosis H37Rv
ggcagcauccucgacu

SEQ ID NO: 1278837 - RNA, 16 nt, Mycobacterium tuberculosis H37Rv
ggcagcaucggucaca

SEQ ID NO: 1278838 - RNA, 21 nt, Mycobacterium tuberculosis H37Rv
ggcagcauauccgccggcgac

SEQ ID NO: 1278839 - RNA, 16 nt, Mycobacterium tuberculosis H37Rv
ggcagcaggcgaugcg

SEQ ID NO: 1278840 - RNA, 19 nt, Mycobacterium tuberculosis H37Rv
ggcagcagcgggcgcgcua

SEQ ID NO: 1278841 - RNA, 14 nt, Mycobacterium tuberculosis H37Rv
ggcagcagcccggg

SEQ ID NO: 1278842 - RNA, 20 nt, Mycobacterium tuberculosis H37Rv
ggcagcagcaaaacccgagc

SEQ ID NO: 1278843 - RNA, 15 nt, Mycobacterium tuberculosis H37Rv
ggcagcacuuggacc

SEQ ID NO: 1278844 - RNA, 19 nt, Mycobacterium tuberculosis H37Rv
ggcagcacucuucgaugaa

SEQ ID NO: 1278845 - RNA, 22 nt, Mycobacterium tuberculosis H37Rv
ggcagaccaagcccgucgucgu

SEQ ID NO: 1278846 - RNA, 22 nt, Mycobacterium tuberculosis H37Rv
ggcagaagucguugcgcggucu

SEQ ID NO: 1278847 - RNA, 23 nt, Mycobacterium tuberculosis H37Rv
ggcagaacuggacaagcuccucg

SEQ ID NO: 1278848 - RNA, 15 nt, Mycobacterium tuberculosis H37Rv
ggcagcaacgacguc

SEQ ID NO: 1278849 - RNA, 14 nt, Mycobacterium tuberculosis H37Rv
ggcagaccggcauc

SEQ ID NO: 1278850 - RNA, 12 nt, Mycobacterium tuberculosis H37Rv
ggcagacauggc

SEQ ID NO: 1278851 - RNA, 17 nt, Mycobacterium tuberculosis H37Rv
ggcagcacggucugggu

SEQ ID NO: 1278852 - RNA, 21 nt, Mycobacterium tuberculosis H37Rv
ggcagcaccggugaccucggu

SEQ ID NO: 1278853 - RNA, 22 nt, Mycobacterium tuberculosis H37Rv
ggcagcaccggugaccucggua

SEQ ID NO: 1278854 - RNA, 16 nt, Mycobacterium tuberculosis H37Rv
ggcagcacccgcgcca

SEQ ID NO: 1278855 - RNA, 21 nt, Mycobacterium tuberculosis H37Rv
ggcagcacccacaucagccgc

SEQ ID NO: 1278856 - RNA, 14 nt, Mycobacterium tuberculosis H37Rv
ggcagcaccagcgc

SEQ ID NO: 1278857 - RNA, 14 nt, Mycobacterium tuberculosis H37Rv
ggcagccagcggcg

SEQ ID NO: 1278858 - RNA, 22 nt, Mycobacterium tuberculosis H37Rv
ggcagccaagcgagcggcgaac

SEQ ID NO: 1278859 - RNA, 14 nt, Mycobacterium tuberculosis H37Rv
ggcagcaucgguca

SEQ ID NO: 1278860 - RNA, 13 nt, Mycobacterium tuberculosis H37Rv
ggcagccagaucu

SEQ ID NO: 1278861 - RNA, 23 nt, Mycobacterium tuberculosis H37Rv
ggcagccaccgucaugccgacga

SEQ ID NO: 1278862 - RNA, 14 nt, Mycobacterium tuberculosis H37Rv
ggcagcccggcgau

SEQ ID NO: 1278863 - RNA, 19 nt, Mycobacterium tuberculosis H37Rv
ggcagccgaagcgcccguu

SEQ ID NO: 1278864 - RNA, 13 nt, Mycobacterium tuberculosis H37Rv
ggcagcccguucg

SEQ ID NO: 1278865 - RNA, 23 nt, Mycobacterium tuberculosis H37Rv
ggcagcgccggucggaucgguga

SEQ ID NO: 1278866 - RNA, 17 nt, Mycobacterium tuberculosis H37Rv
ggcagcggcgucgucgu

SEQ ID NO: 1278867 - RNA, 16 nt, Mycobacterium tuberculosis H37Rv
ggcagcgccaggccgu

SEQ ID NO: 1278868 - RNA, 16 nt, Mycobacterium tuberculosis H37Rv
ggcagcgagucgacgu

SEQ ID NO: 1278869 - RNA, 14 nt, Mycobacterium tuberculosis H37Rv
ggcagcgaggcucg

SEQ ID NO: 1278870 - RNA, 23 nt, Mycobacterium tuberculosis H37Rv
ggcagcgacgccggcccgacggg

SEQ ID NO: 1278871 - RNA, 15 nt, Mycobacterium tuberculosis H37Rv
ggcagcgacgccggc

SEQ ID NO: 1278872 - RNA, 14 nt, Mycobacterium tuberculosis H37Rv
ggcagccggguugg

SEQ ID NO: 1278873 - RNA, 19 nt, Mycobacterium tuberculosis H37Rv
ggcauccacaccgaccgcg

SEQ ID NO: 1278874 - RNA, 20 nt, Mycobacterium tuberculosis H37Rv
ggcauccaaaaucgccugau

SEQ ID NO: 1278875 - RNA, 14 nt, Mycobacterium tuberculosis H37Rv
ggcaucaccggaac

SEQ ID NO: 1278876 - RNA, 19 nt, Mycobacterium tuberculosis H37Rv
ggcaucaacgcgggcgcuu

SEQ ID NO: 1278877 - RNA, 22 nt, Mycobacterium tuberculosis H37Rv
ggcauaucgauucgggcgucgg

SEQ ID NO: 1278878 - RNA, 18 nt, Mycobacterium tuberculosis H37Rv
ggcaguggcagcccgucg

SEQ ID NO: 1278879 - RNA, 21 nt, Mycobacterium tuberculosis H37Rv
ggcaucgcgcgcggcuccguu

SEQ ID NO: 1278880 - RNA, 17 nt, Mycobacterium tuberculosis H37Rv
ggcaucgacugccagcg

SEQ ID NO: 1278881 - RNA, 13 nt, Mycobacterium tuberculosis H37Rv
ggcaucgacgcgg

SEQ ID NO: 1278882 - RNA, 14 nt, Mycobacterium tuberculosis H37Rv
ggcaucgaggccag

SEQ ID NO: 1278883 - RNA, 17 nt, Mycobacterium tuberculosis H37Rv
ggcauccaggcugucgc

SEQ ID NO: 1278884 - RNA, 15 nt, Mycobacterium tuberculosis H37Rv
ggcauccagcuucgc

SEQ ID NO: 1278885 - RNA, 16 nt, Mycobacterium tuberculosis H37Rv
ggcagggcagcccggc

SEQ ID NO: 1278886 - RNA, 23 nt, Mycobacterium tuberculosis H37Rv
ggcagcguaagaccugaguuggu

SEQ ID NO: 1278887 - RNA, 15 nt, Mycobacterium tuberculosis H37Rv
ggcagcucaucgcgc

SEQ ID NO: 1278888 - RNA, 18 nt, Mycobacterium tuberculosis H37Rv
ggcagcgugggcgacgga

SEQ ID NO: 1278889 - RNA, 23 nt, Mycobacterium tuberculosis H37Rv
ggcagcguugacggucagccgcg

SEQ ID NO: 1278890 - RNA, 19 nt, Mycobacterium tuberculosis H37Rv
ggcagcgucacccugucgc

SEQ ID NO: 1278891 - RNA, 17 nt, Mycobacterium tuberculosis H37Rv
ggcagcgucgucgacga

SEQ ID NO: 1278892 - RNA, 23 nt, Mycobacterium tuberculosis H37Rv
ggcagcggguuugccgggcgcug

SEQ ID NO: 1278893 - RNA, 22 nt, Mycobacterium tuberculosis H37Rv
ggcagcgguggcccgccggcaa

SEQ ID NO: 1278894 - RNA, 16 nt, Mycobacterium tuberculosis H37Rv
ggcaguggcgcggcga

SEQ ID NO: 1278895 - RNA, 16 nt, Mycobacterium tuberculosis H37Rv
ggcagucccagcgccg

SEQ ID NO: 1278896 - RNA, 22 nt, Mycobacterium tuberculosis H37Rv
ggcaccgaaaaacaccagcgag

SEQ ID NO: 1278897 - RNA, 14 nt, Mycobacterium tuberculosis H37Rv
ggcacccucggcgu

SEQ ID NO: 1278898 - RNA, 13 nt, Mycobacterium tuberculosis H37Rv
ggcacccuugccg

SEQ ID NO: 1278899 - RNA, 15 nt, Mycobacterium tuberculosis H37Rv
ggcacccuugccgau

SEQ ID NO: 1278900 - RNA, 22 nt, Mycobacterium tuberculosis H37Rv
ggcacccgugccgccgaugccg

SEQ ID NO: 1278901 - RNA, 20 nt, Mycobacterium tuberculosis H37Rv
ggcaccgaaaaacaccagcg

SEQ ID NO: 1278902 - RNA, 12 nt, Mycobacterium tuberculosis H37Rv
ggcaccggcgau

SEQ ID NO: 1278903 - RNA, 13 nt, Mycobacterium tuberculosis H37Rv
ggcaccggcgauc

SEQ ID NO: 1278904 - RNA, 21 nt, Mycobacterium tuberculosis H37Rv
ggcaccguagagcaugccgcc

SEQ ID NO: 1278905 - RNA, 16 nt, Mycobacterium tuberculosis H37Rv
ggcaccggauccggag

SEQ ID NO: 1278906 - RNA, 14 nt, Mycobacterium tuberculosis H37Rv
ggcaccacgcugug

SEQ ID NO: 1278907 - RNA, 21 nt, Mycobacterium tuberculosis H37Rv
ggcaccacccgauuggccaac

SEQ ID NO: 1278908 - RNA, 15 nt, Mycobacterium tuberculosis H37Rv
ggcaccacgcugugc

SEQ ID NO: 1278909 - RNA, 16 nt, Mycobacterium tuberculosis H37Rv
ggcaccacccuugccg

SEQ ID NO: 1278910 - RNA, 12 nt, Mycobacterium tuberculosis H37Rv
ggcacacagguc

SEQ ID NO: 1278911 - RNA, 22 nt, Mycobacterium tuberculosis H37Rv
ggcacaccgguggcgcccuugg

SEQ ID NO: 1278912 - RNA, 13 nt, Mycobacterium tuberculosis H37Rv
ggcaccacgucga

SEQ ID NO: 1278913 - RNA, 15 nt, Mycobacterium tuberculosis H37Rv
ggcacccggcagagc

SEQ ID NO: 1278914 - RNA, 14 nt, Mycobacterium tuberculosis H37Rv
ggcacccgcgucga

SEQ ID NO: 1278915 - RNA, 12 nt, Mycobacterium tuberculosis H37Rv
ggcaccacgauc

SEQ ID NO: 1278916 - RNA, 13 nt, Mycobacterium tuberculosis H37Rv
ggcaccagcggca

SEQ ID NO: 1278917 - RNA, 20 nt, Mycobacterium tuberculosis H37Rv
ggcacuuccagcccggcaau

SEQ ID NO: 1278918 - RNA, 20 nt, Mycobacterium tuberculosis H37Rv
ggcacuuuguagcccgcgau

SEQ ID NO: 1278919 - RNA, 19 nt, Mycobacterium tuberculosis H37Rv
ggcacuuagcccgauggug

SEQ ID NO: 1278920 - RNA, 16 nt, Mycobacterium tuberculosis H37Rv
ggcacuuccagcccgg

SEQ ID NO: 1278921 - RNA, 18 nt, Mycobacterium tuberculosis H37Rv
ggcacguggcgaccggcg

SEQ ID NO: 1278922 - RNA, 15 nt, Mycobacterium tuberculosis H37Rv
ggcacguucggcgca

SEQ ID NO: 1278923 - RNA, 22 nt, Mycobacterium tuberculosis H37Rv
ggcacgugaaagccgaccagcg

SEQ ID NO: 1278924 - RNA, 17 nt, Mycobacterium tuberculosis H37Rv
ggcacgucggcgccgac

SEQ ID NO: 1278925 - RNA, 21 nt, Mycobacterium tuberculosis H37Rv
ggcacgucgaaaucggugcac

SEQ ID NO: 1278926 - RNA, 22 nt, Mycobacterium tuberculosis H37Rv
ggcacgggucgucaugccaguc

SEQ ID NO: 1278927 - RNA, 15 nt, Mycobacterium tuberculosis H37Rv
ggcacgggucgucau

SEQ ID NO: 1278928 - RNA, 16 nt, Mycobacterium tuberculosis H37Rv
ggcacgggcgucgucg

SEQ ID NO: 1278929 - RNA, 16 nt, Mycobacterium tuberculosis H37Rv
ggcacgccgccgacgu

SEQ ID NO: 1278930 - RNA, 17 nt, Mycobacterium tuberculosis H37Rv
ggcacgaucaucggggu

SEQ ID NO: 1278931 - RNA, 20 nt, Mycobacterium tuberculosis H37Rv
ggcacgcccucgucgaucgc

SEQ ID NO: 1278932 - RNA, 13 nt, Mycobacterium tuberculosis H37Rv
ggcacgaucggca

SEQ ID NO: 1278933 - RNA, 18 nt, Mycobacterium tuberculosis H37Rv
ggcaccgucucgcaccgc

SEQ ID NO: 1278934 - RNA, 17 nt, Mycobacterium tuberculosis H37Rv
ggcacgaucaaccgggu

SEQ ID NO: 1278935 - RNA, 22 nt, Mycobacterium tuberculosis H37Rv
ggcaccggcccagaucgguuga

SEQ ID NO: 1278936 - RNA, 16 nt, Mycobacterium tuberculosis H37Rv
ggcaccgucggaacug

SEQ ID NO: 1278937 - RNA, 14 nt, Mycobacterium tuberculosis H37Rv
ggcaccggucgguu

SEQ ID NO: 1278938 - RNA, 18 nt, Mycobacterium tuberculosis H37Rv
ggcaacgguacgcgcuga

SEQ ID NO: 1278939 - RNA, 20 nt, Mycobacterium tuberculosis H37Rv
ggcaacggacgggaucgccc

SEQ ID NO: 1278940 - RNA, 22 nt, Mycobacterium tuberculosis H37Rv
ggcaacgcgaaccggccaucga

SEQ ID NO: 1278941 - RNA, 18 nt, Mycobacterium tuberculosis H37Rv
ggcaaccacaucaccggc

SEQ ID NO: 1278942 - RNA, 18 nt, Mycobacterium tuberculosis H37Rv
ggcaacugcagcauggcc

SEQ ID NO: 1278943 - RNA, 18 nt, Mycobacterium tuberculosis H37Rv
ggcaagcugucgucgccc

SEQ ID NO: 1278944 - RNA, 19 nt, Mycobacterium tuberculosis H37Rv
ggcaacaccaccucgacga

SEQ ID NO: 1278945 - RNA, 16 nt, Mycobacterium tuberculosis H37Rv
ggcaacgcgaaccggc

SEQ ID NO: 1278946 - RNA, 13 nt, Mycobacterium tuberculosis H37Rv
ggcaacagcgcca

SEQ ID NO: 1278947 - RNA, 21 nt, Mycobacterium tuberculosis H37Rv
ggcaacagcggggugugcggu

SEQ ID NO: 1278948 - RNA, 18 nt, Mycobacterium tuberculosis H37Rv
ggcaaaucggugcgaucc

SEQ ID NO: 1278949 - RNA, 17 nt, Mycobacterium tuberculosis H37Rv
ggcaaucccgcggucga

SEQ ID NO: 1278950 - RNA, 22 nt, Mycobacterium tuberculosis H37Rv
ggcaaucgaggaaggugugcgu

SEQ ID NO: 1278951 - RNA, 14 nt, Mycobacterium tuberculosis H37Rv
ggcaauuacccgac

SEQ ID NO: 1278952 - RNA, 15 nt, Mycobacterium tuberculosis H37Rv
ggcacaacaucgccg

SEQ ID NO: 1278953 - RNA, 16 nt, Mycobacterium tuberculosis H37Rv
ggcacaaccggauuga

SEQ ID NO: 1278954 - RNA, 13 nt, Mycobacterium tuberculosis H37Rv
ggcacaaucggcg

SEQ ID NO: 1278955 - RNA, 13 nt, Mycobacterium tuberculosis H37Rv
ggcacaaucaccg

SEQ ID NO: 1278956 - RNA, 20 nt, Mycobacterium tuberculosis H37Rv
ggcacaccccgguucgacgu

SEQ ID NO: 1278957 - RNA, 18 nt, Mycobacterium tuberculosis H37Rv
ggcaagucgacgccgcag

SEQ ID NO: 1278958 - RNA, 19 nt, Mycobacterium tuberculosis H37Rv
ggcaauaccgccagcgcca

SEQ ID NO: 1278959 - RNA, 20 nt, Mycobacterium tuberculosis H37Rv
ggcaauaccgccagcgccac

SEQ ID NO: 1278960 - RNA, 21 nt, Mycobacterium tuberculosis H37Rv
ggcaaucaucucccgaccgcc

SEQ ID NO: 1278961 - RNA, 19 nt, Mycobacterium tuberculosis H37Rv
ggaucccccgcgcgaaccg

SEQ ID NO: 1278962 - RNA, 23 nt, Mycobacterium tuberculosis H37Rv
ggaucccagugccagugccagcg

SEQ ID NO: 1278963 - RNA, 21 nt, Mycobacterium tuberculosis H37Rv
ggaucccacgaguuggccaag

SEQ ID NO: 1278964 - RNA, 16 nt, Mycobacterium tuberculosis H37Rv
ggaucaugaccaucga

SEQ ID NO: 1278965 - RNA, 22 nt, Mycobacterium tuberculosis H37Rv
ggauccggacggugucagccgu

SEQ ID NO: 1278966 - RNA, 11 nt, Mycobacterium tuberculosis H37Rv
ggaucccggug

SEQ ID NO: 1278967 - RNA, 18 nt, Mycobacterium tuberculosis H37Rv
ggaucccgguggcagcac

SEQ ID NO: 1278968 - RNA, 22 nt, Mycobacterium tuberculosis H37Rv
ggauccgcaccacgcccgacga

SEQ ID NO: 1278969 - RNA, 22 nt, Mycobacterium tuberculosis H37Rv
ggauccuccggguuggcgacga

SEQ ID NO: 1278970 - RNA, 14 nt, Mycobacterium tuberculosis H37Rv
ggaucagaacgcgg

SEQ ID NO: 1278971 - RNA, 20 nt, Mycobacterium tuberculosis H37Rv
ggaucaggcccgggcggaug

SEQ ID NO: 1278972 - RNA, 15 nt, Mycobacterium tuberculosis H37Rv
ggaucagcgugucgc

SEQ ID NO: 1278973 - RNA, 13 nt, Mycobacterium tuberculosis H37Rv
ggaucauguucgg

SEQ ID NO: 1278974 - RNA, 20 nt, Mycobacterium tuberculosis H37Rv
ggaucaguuugccaucggga

SEQ ID NO: 1278975 - RNA, 16 nt, Mycobacterium tuberculosis H37Rv
ggaucagggcuuucgc

SEQ ID NO: 1278976 - RNA, 12 nt, Mycobacterium tuberculosis H37Rv
ggaucagcgacu

SEQ ID NO: 1278977 - RNA, 14 nt, Mycobacterium tuberculosis H37Rv
ggauagacggcgac

SEQ ID NO: 1278978 - RNA, 18 nt, Mycobacterium tuberculosis H37Rv
ggauaccggucagcaccu

SEQ ID NO: 1278979 - RNA, 17 nt, Mycobacterium tuberculosis H37Rv
ggauagcgcagcucgcu

SEQ ID NO: 1278980 - RNA, 23 nt, Mycobacterium tuberculosis H37Rv
ggauacaacacagaacucaccga

SEQ ID NO: 1278981 - RNA, 15 nt, Mycobacterium tuberculosis H37Rv
ggauacccagcgccc

SEQ ID NO: 1278982 - RNA, 21 nt, Mycobacterium tuberculosis H37Rv
ggauacccagcgcccggccac

SEQ ID NO: 1278983 - RNA, 13 nt, Mycobacterium tuberculosis H37Rv
ggauaucacgacg

SEQ ID NO: 1278984 - RNA, 21 nt, Mycobacterium tuberculosis H37Rv
ggauaggacgaacaacgcgac

SEQ ID NO: 1278985 - RNA, 21 nt, Mycobacterium tuberculosis H37Rv
ggaucaaaaaccacgcgucgc

SEQ ID NO: 1278986 - RNA, 14 nt, Mycobacterium tuberculosis H37Rv
ggaucacgaccgcg

SEQ ID NO: 1278987 - RNA, 12 nt, Mycobacterium tuberculosis H37Rv
ggaucacgccac

SEQ ID NO: 1278988 - RNA, 18 nt, Mycobacterium tuberculosis H37Rv
ggaucacaccccaggcac

SEQ ID NO: 1278989 - RNA, 20 nt, Mycobacterium tuberculosis H37Rv
ggaguugagcugucgcaacg

SEQ ID NO: 1278990 - RNA, 22 nt, Mycobacterium tuberculosis H37Rv
ggaguggcuguacccgaccagc

SEQ ID NO: 1278991 - RNA, 21 nt, Mycobacterium tuberculosis H37Rv
ggagguacccccagcacccgg

SEQ ID NO: 1278992 - RNA, 22 nt, Mycobacterium tuberculosis H37Rv
ggagucgucgagcugaccacgg

SEQ ID NO: 1278993 - RNA, 22 nt, Mycobacterium tuberculosis H37Rv
ggagucuucgucgucggaaucg

SEQ ID NO: 1278994 - RNA, 19 nt, Mycobacterium tuberculosis H37Rv
ggagucgacggugccgucg

SEQ ID NO: 1278995 - RNA, 17 nt, Mycobacterium tuberculosis H37Rv
ggagucaagcagcagca

SEQ ID NO: 1278996 - RNA, 15 nt, Mycobacterium tuberculosis H37Rv
ggaggcggcgccagu

SEQ ID NO: 1278997 - RNA, 19 nt, Mycobacterium tuberculosis H37Rv
ggagcgccgagcucggcgc

SEQ ID NO: 1278998 - RNA, 23 nt, Mycobacterium tuberculosis H37Rv
ggagcgcaccugaaggcggcgau

SEQ ID NO: 1278999 - RNA, 18 nt, Mycobacterium tuberculosis H37Rv
ggagcgccgagcucggcg

SEQ ID NO: 1279000 - RNA, 20 nt, Mycobacterium tuberculosis H37Rv
ggagcggauagcggcaaagc

SEQ ID NO: 1279001 - RNA, 16 nt, Mycobacterium tuberculosis H37Rv
ggagcggcuugcggug

SEQ ID NO: 1279002 - RNA, 14 nt, Mycobacterium tuberculosis H37Rv
ggagcggcugcacg

SEQ ID NO: 1279003 - RNA, 14 nt, Mycobacterium tuberculosis H37Rv
aaggccgucgaccc

SEQ ID NO: 1279004 - RNA, 18 nt, Mycobacterium tuberculosis H37Rv
ggagcucacgugcugccg

SEQ ID NO: 1279005 - RNA, 21 nt, Mycobacterium tuberculosis H37Rv
ggagcgguguggucgcaggau

SEQ ID NO: 1279006 - RNA, 15 nt, Mycobacterium tuberculosis H37Rv
ggagcucaucgacga

SEQ ID NO: 1279007 - RNA, 18 nt, Mycobacterium tuberculosis H37Rv
ggagcucaucuucgguca

SEQ ID NO: 1279008 - RNA, 15 nt, Mycobacterium tuberculosis H37Rv
ggagcuggcugacga

SEQ ID NO: 1279009 - RNA, 16 nt, Mycobacterium tuberculosis H37Rv
aaggauucgaagccga

SEQ ID NO: 1279010 - RNA, 16 nt, Mycobacterium tuberculosis H37Rv
ggagcgaugcgggcaa

SEQ ID NO: 1279011 - RNA, 15 nt, Mycobacterium tuberculosis H37Rv
ggagccgucgcauca

SEQ ID NO: 1279012 - RNA, 18 nt, Mycobacterium tuberculosis H37Rv
ggagccgucgcaucaggu

SEQ ID NO: 1279013 - RNA, 13 nt, Mycobacterium tuberculosis H37Rv
ggagccgugcggu

SEQ ID NO: 1279014 - RNA, 15 nt, Mycobacterium tuberculosis H37Rv
ggagaacaucccccg

SEQ ID NO: 1279015 - RNA, 20 nt, Mycobacterium tuberculosis H37Rv
ggagaagauuuucucggugc

SEQ ID NO: 1279016 - RNA, 17 nt, Mycobacterium tuberculosis H37Rv
ggagauaccgaccaucg

SEQ ID NO: 1279017 - RNA, 23 nt, Mycobacterium tuberculosis H37Rv
ggagagccgguagaucagcgccu

SEQ ID NO: 1279018 - RNA, 17 nt, Mycobacterium tuberculosis H37Rv
ggagaacgggucgacgu

SEQ ID NO: 1279019 - RNA, 20 nt, Mycobacterium tuberculosis H37Rv
ggagacuccagcaaggccag

SEQ ID NO: 1279020 - RNA, 20 nt, Mycobacterium tuberculosis H37Rv
ggagagguagggcuccaccg

SEQ ID NO: 1279021 - RNA, 16 nt, Mycobacterium tuberculosis H37Rv
ggagaucucguccaga

SEQ ID NO: 1279022 - RNA, 12 nt, Mycobacterium tuberculosis H37Rv
ggagcagccgaa

SEQ ID NO: 1279023 - RNA, 21 nt, Mycobacterium tuberculosis H37Rv
ggagccccagguagucgacca

SEQ ID NO: 1279024 - RNA, 16 nt, Mycobacterium tuberculosis H37Rv
ggagcccgagcucacc

SEQ ID NO: 1279025 - RNA, 13 nt, Mycobacterium tuberculosis H37Rv
ggagccagaaugc

SEQ ID NO: 1279026 - RNA, 14 nt, Mycobacterium tuberculosis H37Rv
ggagccgccaccga

SEQ ID NO: 1279027 - RNA, 15 nt, Mycobacterium tuberculosis H37Rv
ggacgcugccgguca

SEQ ID NO: 1279028 - RNA, 21 nt, Mycobacterium tuberculosis H37Rv
ggacgcgcggauuucgccgug

SEQ ID NO: 1279029 - RNA, 17 nt, Mycobacterium tuberculosis H37Rv
ggacgcgaugaucauga

SEQ ID NO: 1279030 - RNA, 23 nt, Mycobacterium tuberculosis H37Rv
ggacgcgaugaucaugaacgcca

SEQ ID NO: 1279031 - RNA, 14 nt, Mycobacterium tuberculosis H37Rv
ggacgcgaucggcg

SEQ ID NO: 1279032 - RNA, 21 nt, Mycobacterium tuberculosis H37Rv
ggacgcgcagcaucggcgaca

SEQ ID NO: 1279033 - RNA, 20 nt, Mycobacterium tuberculosis H37Rv
ggacgcgaaauccccugcgc

SEQ ID NO: 1279034 - RNA, 15 nt, Mycobacterium tuberculosis H37Rv
ggacgccuugcacaa

SEQ ID NO: 1279035 - RNA, 20 nt, Mycobacterium tuberculosis H37Rv
ggacggcugccgucagccgu

SEQ ID NO: 1279036 - RNA, 20 nt, Mycobacterium tuberculosis H37Rv
ggacggccuccaucgcgaca

SEQ ID NO: 1279037 - RNA, 21 nt, Mycobacterium tuberculosis H37Rv
ggacggcguuuccuucgacga

SEQ ID NO: 1279038 - RNA, 18 nt, Mycobacterium tuberculosis H37Rv
ggacgggucucgcgagcg

SEQ ID NO: 1279039 - RNA, 16 nt, Mycobacterium tuberculosis H37Rv
ggacgggucucgcgag

SEQ ID NO: 1279040 - RNA, 14 nt, Mycobacterium tuberculosis H37Rv
ggacgggucgccgc

SEQ ID NO: 1279041 - RNA, 21 nt, Mycobacterium tuberculosis H37Rv
ggacggccaacagggcgccga

SEQ ID NO: 1279042 - RNA, 20 nt, Mycobacterium tuberculosis H37Rv
ggacggcgcgagccgcacga

SEQ ID NO: 1279043 - RNA, 22 nt, Mycobacterium tuberculosis H37Rv
ggacggcauagcagccagcguc

SEQ ID NO: 1279044 - RNA, 18 nt, Mycobacterium tuberculosis H37Rv
ggacggcaggcuggcgag

SEQ ID NO: 1279045 - RNA, 21 nt, Mycobacterium tuberculosis H37Rv
ggacggcagccaccagcgacg

SEQ ID NO: 1279046 - RNA, 14 nt, Mycobacterium tuberculosis H37Rv
ggacgugacgucgu

SEQ ID NO: 1279047 - RNA, 18 nt, Mycobacterium tuberculosis H37Rv
ggacgugacgucguggcg

SEQ ID NO: 1279048 - RNA, 21 nt, Mycobacterium tuberculosis H37Rv
ggacguggacuuuggugucgc

SEQ ID NO: 1279049 - RNA, 17 nt, Mycobacterium tuberculosis H37Rv
ggacgucuccaccgcga

SEQ ID NO: 1279050 - RNA, 23 nt, Mycobacterium tuberculosis H37Rv
ggacgucaccgucaguucggugu

SEQ ID NO: 1279051 - RNA, 14 nt, Mycobacterium tuberculosis H37Rv
ggacgucaccguca

SEQ ID NO: 1279052 - RNA, 14 nt, Mycobacterium tuberculosis H37Rv
ggacgucggcgaua

SEQ ID NO: 1279053 - RNA, 14 nt, Mycobacterium tuberculosis H37Rv
ggacgucgccgcag

SEQ ID NO: 1279054 - RNA, 21 nt, Mycobacterium tuberculosis H37Rv
ggacgguugguccgccgucga

SEQ ID NO: 1279055 - RNA, 17 nt, Mycobacterium tuberculosis H37Rv
ggacgguugagaugguc

SEQ ID NO: 1279056 - RNA, 16 nt, Mycobacterium tuberculosis H37Rv
ggacggugcggucaga

SEQ ID NO: 1279057 - RNA, 13 nt, Mycobacterium tuberculosis H37Rv
ggacggugucagc

SEQ ID NO: 1279058 - RNA, 19 nt, Mycobacterium tuberculosis H37Rv
ggacggugucagccgucgc

SEQ ID NO: 1279059 - RNA, 18 nt, Mycobacterium tuberculosis H37Rv
ggacugugggggcgcacc

SEQ ID NO: 1279060 - RNA, 20 nt, Mycobacterium tuberculosis H37Rv
ggacuucaugaucggacccg

SEQ ID NO: 1279061 - RNA, 12 nt, Mycobacterium tuberculosis H37Rv
ggacucgccgac

SEQ ID NO: 1279062 - RNA, 22 nt, Mycobacterium tuberculosis H37Rv
ggacucggcggaagaccggauc

SEQ ID NO: 1279063 - RNA, 19 nt, Mycobacterium tuberculosis H37Rv
ggacucggaauucggcguc

SEQ ID NO: 1279064 - RNA, 18 nt, Mycobacterium tuberculosis H37Rv
ggacugcagcgccucgac

SEQ ID NO: 1279065 - RNA, 18 nt, Mycobacterium tuberculosis H37Rv
ggacugcggacacguugc

SEQ ID NO: 1279066 - RNA, 13 nt, Mycobacterium tuberculosis H37Rv
ggaagcgugcggu

SEQ ID NO: 1279067 - RNA, 20 nt, Mycobacterium tuberculosis H37Rv
ggaagccugcgggccggcau

SEQ ID NO: 1279068 - RNA, 15 nt, Mycobacterium tuberculosis H37Rv
ggaagcccgucgcgg

SEQ ID NO: 1279069 - RNA, 21 nt, Mycobacterium tuberculosis H37Rv
ggaagcccggcagaugcagcg

SEQ ID NO: 1279070 - RNA, 17 nt, Mycobacterium tuberculosis H37Rv
ggaagccgacgaccagc

SEQ ID NO: 1279071 - RNA, 17 nt, Mycobacterium tuberculosis H37Rv
ggaacugaccacgucgg

SEQ ID NO: 1279072 - RNA, 19 nt, Mycobacterium tuberculosis H37Rv
ggaacugaugaaccacggc

SEQ ID NO: 1279073 - RNA, 20 nt, Mycobacterium tuberculosis H37Rv
ggaagaccggaucgccuugg

SEQ ID NO: 1279074 - RNA, 16 nt, Mycobacterium tuberculosis H37Rv
ggaagacgccggcgau

SEQ ID NO: 1279075 - RNA, 14 nt, Mycobacterium tuberculosis H37Rv
ggaauggaccagcg

SEQ ID NO: 1279076 - RNA, 20 nt, Mycobacterium tuberculosis H37Rv
ggaaugggucguugccggac

SEQ ID NO: 1279077 - RNA, 13 nt, Mycobacterium tuberculosis H37Rv
ggaaucguucggg

SEQ ID NO: 1279078 - RNA, 18 nt, Mycobacterium tuberculosis H37Rv
ggaaugcccgagcaggac

SEQ ID NO: 1279079 - RNA, 20 nt, Mycobacterium tuberculosis H37Rv
ggaaucgucgcggccgucgc

SEQ ID NO: 1279080 - RNA, 19 nt, Mycobacterium tuberculosis H37Rv
ggaauagcaacgcugcagc

SEQ ID NO: 1279081 - RNA, 13 nt, Mycobacterium tuberculosis H37Rv
ggaauacgcgguu

SEQ ID NO: 1279082 - RNA, 14 nt, Mycobacterium tuberculosis H37Rv
ggaauacgcgguua

SEQ ID NO: 1279083 - RNA, 13 nt, Mycobacterium tuberculosis H37Rv
ggaaucgcaccgu

SEQ ID NO: 1279084 - RNA, 17 nt, Mycobacterium tuberculosis H37Rv
ggaauccccccugucgc

SEQ ID NO: 1279085 - RNA, 22 nt, Mycobacterium tuberculosis H37Rv
ggaagugcaccuggaucagggc

SEQ ID NO: 1279086 - RNA, 14 nt, Mycobacterium tuberculosis H37Rv
ggaaguucgucggu

SEQ ID NO: 1279087 - RNA, 18 nt, Mycobacterium tuberculosis H37Rv
ggaagggcuaucguggcg

SEQ ID NO: 1279088 - RNA, 22 nt, Mycobacterium tuberculosis H37Rv
ggaaggucgacaugggucggcu

SEQ ID NO: 1279089 - RNA, 21 nt, Mycobacterium tuberculosis H37Rv
ggaacuacccgccagcaaacc

SEQ ID NO: 1279090 - RNA, 17 nt, Mycobacterium tuberculosis H37Rv
ggaacguuucgcugucc

SEQ ID NO: 1279091 - RNA, 16 nt, Mycobacterium tuberculosis H37Rv
ggaacguccgcgccga

SEQ ID NO: 1279092 - RNA, 15 nt, Mycobacterium tuberculosis H37Rv
ggaacgcgcccacgg

SEQ ID NO: 1279093 - RNA, 21 nt, Mycobacterium tuberculosis H37Rv
ggaacgcuaggcgauccagac

SEQ ID NO: 1279094 - RNA, 18 nt, Mycobacterium tuberculosis H37Rv
ggaacgcgucgccgacgc

SEQ ID NO: 1279095 - RNA, 13 nt, Mycobacterium tuberculosis H37Rv
ggaacgccggcau

SEQ ID NO: 1279096 - RNA, 18 nt, Mycobacterium tuberculosis H37Rv
ggaacgaugccggcaagc

SEQ ID NO: 1279097 - RNA, 12 nt, Mycobacterium tuberculosis H37Rv
ggaacgagccac

SEQ ID NO: 1279098 - RNA, 15 nt, Mycobacterium tuberculosis H37Rv
ggaacgaucgaugac

SEQ ID NO: 1279099 - RNA, 20 nt, Mycobacterium tuberculosis H37Rv
ggaaccguccaagccggcug

SEQ ID NO: 1279100 - RNA, 12 nt, Mycobacterium tuberculosis H37Rv
ggaacaggccgu

SEQ ID NO: 1279101 - RNA, 15 nt, Mycobacterium tuberculosis H37Rv
ggaacacgaugccca

SEQ ID NO: 1279102 - RNA, 14 nt, Mycobacterium tuberculosis H37Rv
ggaacaccgaggcg

SEQ ID NO: 1279103 - RNA, 18 nt, Mycobacterium tuberculosis H37Rv
ggaacaaugagaucggga

SEQ ID NO: 1279104 - RNA, 22 nt, Mycobacterium tuberculosis H37Rv
ggaacacccauaccuucggcga

SEQ ID NO: 1279105 - RNA, 13 nt, Mycobacterium tuberculosis H37Rv
ggaacacgaugcg

SEQ ID NO: 1279106 - RNA, 23 nt, Mycobacterium tuberculosis H37Rv
gcuggcgccgccggugccaccga

SEQ ID NO: 1279107 - RNA, 19 nt, Mycobacterium tuberculosis H37Rv
ggacccggcgcgauggcga

SEQ ID NO: 1279108 - RNA, 19 nt, Mycobacterium tuberculosis H37Rv
ggacccgugagcucgucga

SEQ ID NO: 1279109 - RNA, 18 nt, Mycobacterium tuberculosis H37Rv
ggacccgcugaucucggu

SEQ ID NO: 1279110 - RNA, 19 nt, Mycobacterium tuberculosis H37Rv
ggacccgcagcugcggauc

SEQ ID NO: 1279111 - RNA, 19 nt, Mycobacterium tuberculosis H37Rv
ggacccgcgcgucgcccag

SEQ ID NO: 1279112 - RNA, 18 nt, Mycobacterium tuberculosis H37Rv
ggacccgcuacgacgguc

SEQ ID NO: 1279113 - RNA, 13 nt, Mycobacterium tuberculosis H37Rv
ggacccaccguca

SEQ ID NO: 1279114 - RNA, 17 nt, Mycobacterium tuberculosis H37Rv
ggaccgccgaucggcca

SEQ ID NO: 1279115 - RNA, 21 nt, Mycobacterium tuberculosis H37Rv
ggaccgcggucauggcgacgg

SEQ ID NO: 1279116 - RNA, 21 nt, Mycobacterium tuberculosis H37Rv
ggaccgcccgagucucgucgg

SEQ ID NO: 1279117 - RNA, 23 nt, Mycobacterium tuberculosis H37Rv
ggaccgcagcgugaucuggccac

SEQ ID NO: 1279118 - RNA, 21 nt, Mycobacterium tuberculosis H37Rv
ggaccgaugguugagcaucga

SEQ ID NO: 1279119 - RNA, 21 nt, Mycobacterium tuberculosis H37Rv
ggaccgcgacggcgccggcau

SEQ ID NO: 1279120 - RNA, 15 nt, Mycobacterium tuberculosis H37Rv
ggaccggucgacagc

SEQ ID NO: 1279121 - RNA, 17 nt, Mycobacterium tuberculosis H37Rv
ggaccgcucgucgccgg

SEQ ID NO: 1279122 - RNA, 13 nt, Mycobacterium tuberculosis H37Rv
ggaccucgcccau

SEQ ID NO: 1279123 - RNA, 19 nt, Mycobacterium tuberculosis H37Rv
ggaccugcgagaucggaug

SEQ ID NO: 1279124 - RNA, 14 nt, Mycobacterium tuberculosis H37Rv
ggaccucggcgauc

SEQ ID NO: 1279125 - RNA, 12 nt, Mycobacterium tuberculosis H37Rv
ggaccgucgugg

SEQ ID NO: 1279126 - RNA, 20 nt, Mycobacterium tuberculosis H37Rv
ggaccgucuuuggugccgag

SEQ ID NO: 1279127 - RNA, 21 nt, Mycobacterium tuberculosis H37Rv
ggaccuauuggucgcucgcgg

SEQ ID NO: 1279128 - RNA, 13 nt, Mycobacterium tuberculosis H37Rv
ggacgaucagggu

SEQ ID NO: 1279129 - RNA, 20 nt, Mycobacterium tuberculosis H37Rv
ggacgacaacaggccgucga

SEQ ID NO: 1279130 - RNA, 14 nt, Mycobacterium tuberculosis H37Rv
ggacgaaucccgcg

SEQ ID NO: 1279131 - RNA, 16 nt, Mycobacterium tuberculosis H37Rv
ggacgcaacucgacgc

SEQ ID NO: 1279132 - RNA, 19 nt, Mycobacterium tuberculosis H37Rv
ggacgcagagucaacgaac

SEQ ID NO: 1279133 - RNA, 22 nt, Mycobacterium tuberculosis H37Rv
ggacgauggcaagggccgacgu

SEQ ID NO: 1279134 - RNA, 21 nt, Mycobacterium tuberculosis H37Rv
ggacgaugaugaucaccguca

SEQ ID NO: 1279135 - RNA, 11 nt, Mycobacterium tuberculosis H37Rv
ggacgacgauc

SEQ ID NO: 1279136 - RNA, 15 nt, Mycobacterium tuberculosis H37Rv
ggacgcccucggggu

SEQ ID NO: 1279137 - RNA, 22 nt, Mycobacterium tuberculosis H37Rv
ggacgcccacaugcucagggca

SEQ ID NO: 1279138 - RNA, 20 nt, Mycobacterium tuberculosis H37Rv
ggacagcgcgagaucagccg

SEQ ID NO: 1279139 - RNA, 23 nt, Mycobacterium tuberculosis H37Rv
ggacaguuuuuccgugccgacca

SEQ ID NO: 1279140 - RNA, 14 nt, Mycobacterium tuberculosis H37Rv
ggacaucaccggca

SEQ ID NO: 1279141 - RNA, 14 nt, Mycobacterium tuberculosis H37Rv
ggacauccgaugcg

SEQ ID NO: 1279142 - RNA, 15 nt, Mycobacterium tuberculosis H37Rv
ggaccacgccgacgu

SEQ ID NO: 1279143 - RNA, 17 nt, Mycobacterium tuberculosis H37Rv
ggaccaccgcucgccac

SEQ ID NO: 1279144 - RNA, 13 nt, Mycobacterium tuberculosis H37Rv
ggaccacgaaccg

SEQ ID NO: 1279145 - RNA, 18 nt, Mycobacterium tuberculosis H37Rv
ggaccacagccgcgccga

SEQ ID NO: 1279146 - RNA, 19 nt, Mycobacterium tuberculosis H37Rv
ggaccacagccgcgccgac

SEQ ID NO: 1279147 - RNA, 21 nt, Mycobacterium tuberculosis H37Rv
ggaccaccacuaggucgccgg

SEQ ID NO: 1279148 - RNA, 21 nt, Mycobacterium tuberculosis H37Rv
ggacauccgggccgagcgcac

SEQ ID NO: 1279149 - RNA, 21 nt, Mycobacterium tuberculosis H37Rv
ggacauccgcuuacggguguc

SEQ ID NO: 1279150 - RNA, 21 nt, Mycobacterium tuberculosis H37Rv
ggaccagaggcgcuucgccac

SEQ ID NO: 1279151 - RNA, 16 nt, Mycobacterium tuberculosis H37Rv
ggaccagauacgucgu

SEQ ID NO: 1279152 - RNA, 18 nt, Mycobacterium tuberculosis H37Rv
ggaccagcugccggcgac

SEQ ID NO: 1279153 - RNA, 14 nt, Mycobacterium tuberculosis H37Rv
ggaccaacgccaac

SEQ ID NO: 1279154 - RNA, 20 nt, Mycobacterium tuberculosis H37Rv
ggaccauagccugcgccgac

SEQ ID NO: 1279155 - RNA, 17 nt, Mycobacterium tuberculosis H37Rv
ggaccaucccgccgauc

SEQ ID NO: 1279156 - RNA, 15 nt, Mycobacterium tuberculosis H37Rv
ggacagcagccggau

SEQ ID NO: 1279157 - RNA, 14 nt, Mycobacterium tuberculosis H37Rv
ggacagcgcaucca

SEQ ID NO: 1279158 - RNA, 11 nt, Mycobacterium tuberculosis H37Rv
ggacagcgccg

SEQ ID NO: 1279159 - RNA, 21 nt, Mycobacterium tuberculosis H37Rv
ggacaccuguaguucgaugac

SEQ ID NO: 1279160 - RNA, 15 nt, Mycobacterium tuberculosis H37Rv
ggacaccgcggcgau

SEQ ID NO: 1279161 - RNA, 18 nt, Mycobacterium tuberculosis H37Rv
ggacaccguggaucggca

SEQ ID NO: 1279162 - RNA, 23 nt, Mycobacterium tuberculosis H37Rv
ggacaaccgggcgggacucggcg

SEQ ID NO: 1279163 - RNA, 18 nt, Mycobacterium tuberculosis H37Rv
ggacaaccgggcgggacu

SEQ ID NO: 1279164 - RNA, 21 nt, Mycobacterium tuberculosis H37Rv
ggacaacagcuuggagaucgc

SEQ ID NO: 1279165 - RNA, 13 nt, Mycobacterium tuberculosis H37Rv
ggacaacagcaug

SEQ ID NO: 1279166 - RNA, 14 nt, Mycobacterium tuberculosis H37Rv
ggacaacacggcga

SEQ ID NO: 1279167 - RNA, 18 nt, Mycobacterium tuberculosis H37Rv
ggacaaacaucgcaccca

SEQ ID NO: 1279168 - RNA, 15 nt, Mycobacterium tuberculosis H37Rv
ggaauucagcgacgc

SEQ ID NO: 1279169 - RNA, 18 nt, Mycobacterium tuberculosis H37Rv
ggacacagcguccgucgu

SEQ ID NO: 1279170 - RNA, 17 nt, Mycobacterium tuberculosis H37Rv
ggacaagcuccucgcga

SEQ ID NO: 1279171 - RNA, 15 nt, Mycobacterium tuberculosis H37Rv
ggacaaccucgucga

SEQ ID NO: 1279172 - RNA, 21 nt, Mycobacterium tuberculosis H37Rv
ggacaaccuggggccaccaga

SEQ ID NO: 1279173 - RNA, 15 nt, Mycobacterium tuberculosis H37Rv
gggccgacagcacgc

SEQ ID NO: 1279174 - RNA, 13 nt, Mycobacterium tuberculosis H37Rv
gggccgagccgac

SEQ ID NO: 1279175 - RNA, 18 nt, Mycobacterium tuberculosis H37Rv
gggccgagccgacaucga

SEQ ID NO: 1279176 - RNA, 23 nt, Mycobacterium tuberculosis H37Rv
gggccgcacguauccacggucga

SEQ ID NO: 1279177 - RNA, 19 nt, Mycobacterium tuberculosis H37Rv
gggccgcacggucagcgcg

SEQ ID NO: 1279178 - RNA, 22 nt, Mycobacterium tuberculosis H37Rv
gggccgaucucuccggcggcga

SEQ ID NO: 1279179 - RNA, 21 nt, Mycobacterium tuberculosis H37Rv
gggcccgucggacauaccgcg

SEQ ID NO: 1279180 - RNA, 18 nt, Mycobacterium tuberculosis H37Rv
gggcccgccgucaccgcc

SEQ ID NO: 1279181 - RNA, 21 nt, Mycobacterium tuberculosis H37Rv
gggccauguggacggcauagc

SEQ ID NO: 1279182 - RNA, 14 nt, Mycobacterium tuberculosis H37Rv
gggcccagccggac

SEQ ID NO: 1279183 - RNA, 17 nt, Mycobacterium tuberculosis H37Rv
gggccggugcagcacgu

SEQ ID NO: 1279184 - RNA, 16 nt, Mycobacterium tuberculosis H37Rv
gggccggugaacacgu

SEQ ID NO: 1279185 - RNA, 22 nt, Mycobacterium tuberculosis H37Rv
gggccgggcggugucugaaccg

SEQ ID NO: 1279186 - RNA, 15 nt, Mycobacterium tuberculosis H37Rv
gggccggcagcggcu

SEQ ID NO: 1279187 - RNA, 19 nt, Mycobacterium tuberculosis H37Rv
gggccggaugucgacgagc

SEQ ID NO: 1279188 - RNA, 19 nt, Mycobacterium tuberculosis H37Rv
gggccggcguagcggcgau

SEQ ID NO: 1279189 - RNA, 21 nt, Mycobacterium tuberculosis H37Rv
gggccggacugaagccgcgag

SEQ ID NO: 1279190 - RNA, 17 nt, Mycobacterium tuberculosis H37Rv
gggccgcggcggccagc

SEQ ID NO: 1279191 - RNA, 17 nt, Mycobacterium tuberculosis H37Rv
gggccgcucgccucgau

SEQ ID NO: 1279192 - RNA, 19 nt, Mycobacterium tuberculosis H37Rv
gggccgccucgaucgacuc

SEQ ID NO: 1279193 - RNA, 16 nt, Mycobacterium tuberculosis H37Rv
gggccgccgagcggac

SEQ ID NO: 1279194 - RNA, 23 nt, Mycobacterium tuberculosis H37Rv
gggccgccgaagcucaucgccgc

SEQ ID NO: 1279195 - RNA, 15 nt, Mycobacterium tuberculosis H37Rv
gggccgccaucucgu

SEQ ID NO: 1279196 - RNA, 22 nt, Mycobacterium tuberculosis H37Rv
gggccgccagcugcgcagcgca

SEQ ID NO: 1279197 - RNA, 14 nt, Mycobacterium tuberculosis H37Rv
gggcagcgcucuca

SEQ ID NO: 1279198 - RNA, 22 nt, Mycobacterium tuberculosis H37Rv
gggcagccgcccgcccaccucg

SEQ ID NO: 1279199 - RNA, 23 nt, Mycobacterium tuberculosis H37Rv
gggcaggaucuccgggucgaugu

SEQ ID NO: 1279200 - RNA, 12 nt, Mycobacterium tuberculosis H37Rv
gggcaucgucgc

SEQ ID NO: 1279201 - RNA, 21 nt, Mycobacterium tuberculosis H37Rv
gggcaugccggcgaagccggc

SEQ ID NO: 1279202 - RNA, 13 nt, Mycobacterium tuberculosis H37Rv
gggcagugaacau

SEQ ID NO: 1279203 - RNA, 17 nt, Mycobacterium tuberculosis H37Rv
gggcaggccauccgggc

SEQ ID NO: 1279204 - RNA, 13 nt, Mycobacterium tuberculosis H37Rv
gggcaucaccgcc

SEQ ID NO: 1279205 - RNA, 15 nt, Mycobacterium tuberculosis H37Rv
gggcaucaccgccgc

SEQ ID NO: 1279206 - RNA, 15 nt, Mycobacterium tuberculosis H37Rv
gggccacagcaacgu

SEQ ID NO: 1279207 - RNA, 16 nt, Mycobacterium tuberculosis H37Rv
gggccacuggccgguu

SEQ ID NO: 1279208 - RNA, 21 nt, Mycobacterium tuberculosis H37Rv
gggccaccaguuguccggcua

SEQ ID NO: 1279209 - RNA, 13 nt, Mycobacterium tuberculosis H37Rv
gggccagcgccuc

SEQ ID NO: 1279210 - RNA, 14 nt, Mycobacterium tuberculosis H37Rv
gggccagccgcuca

SEQ ID NO: 1279211 - RNA, 14 nt, Mycobacterium tuberculosis H37Rv
gggccagcgcgcca

SEQ ID NO: 1279212 - RNA, 16 nt, Mycobacterium tuberculosis H37Rv
gggccaggucagccgc

SEQ ID NO: 1279213 - RNA, 15 nt, Mycobacterium tuberculosis H37Rv
gggacgugcccggug

SEQ ID NO: 1279214 - RNA, 22 nt, Mycobacterium tuberculosis H37Rv
gggacucauggccggucugcug

SEQ ID NO: 1279215 - RNA, 19 nt, Mycobacterium tuberculosis H37Rv
gggaccucggcgcgcucgg

SEQ ID NO: 1279216 - RNA, 17 nt, Mycobacterium tuberculosis H37Rv
gggaccgccccggccag

SEQ ID NO: 1279217 - RNA, 13 nt, Mycobacterium tuberculosis H37Rv
gggaccgcgguca

SEQ ID NO: 1279218 - RNA, 18 nt, Mycobacterium tuberculosis H37Rv
ggcgucaugaacgaucgg

SEQ ID NO: 1279219 - RNA, 15 nt, Mycobacterium tuberculosis H37Rv
ggcgucauccgcggc

SEQ ID NO: 1279220 - RNA, 19 nt, Mycobacterium tuberculosis H37Rv
ggcgucaagcaaguccacc

SEQ ID NO: 1279221 - RNA, 16 nt, Mycobacterium tuberculosis H37Rv
ggcgucaaauccagcg

SEQ ID NO: 1279222 - RNA, 14 nt, Mycobacterium tuberculosis H37Rv
ggcgucaccccggu

SEQ ID NO: 1279223 - RNA, 22 nt, Mycobacterium tuberculosis H37Rv
ggcgucaggccagagucgcccg

SEQ ID NO: 1279224 - RNA, 19 nt, Mycobacterium tuberculosis H37Rv
ggcgucaggcacaacgcga

SEQ ID NO: 1279225 - RNA, 22 nt, Mycobacterium tuberculosis H37Rv
ggcgucaggcacaacgcgacgc

SEQ ID NO: 1279226 - RNA, 15 nt, Mycobacterium tuberculosis H37Rv
ggcgucaccgccggu

SEQ ID NO: 1279227 - RNA, 14 nt, Mycobacterium tuberculosis H37Rv
ggcgucagcagcaa

SEQ ID NO: 1279228 - RNA, 21 nt, Mycobacterium tuberculosis H37Rv
ggcgucagcaguucggcgaug

SEQ ID NO: 1279229 - RNA, 14 nt, Mycobacterium tuberculosis H37Rv
gggagcagccgaac

SEQ ID NO: 1279230 - RNA, 20 nt, Mycobacterium tuberculosis H37Rv
gggagcccgagcucaccgca

SEQ ID NO: 1279231 - RNA, 18 nt, Mycobacterium tuberculosis H37Rv
gggagcggcugcggcaac

SEQ ID NO: 1279232 - RNA, 23 nt, Mycobacterium tuberculosis H37Rv
gggagcggcuugcgguggcggau

SEQ ID NO: 1279233 - RNA, 18 nt, Mycobacterium tuberculosis H37Rv
gggagcgaacggcgcagu

SEQ ID NO: 1279234 - RNA, 21 nt, Mycobacterium tuberculosis H37Rv
gggagucaucgcggcggcgac

SEQ ID NO: 1279235 - RNA, 16 nt, Mycobacterium tuberculosis H37Rv
gggauaucgucgacgc

SEQ ID NO: 1279236 - RNA, 17 nt, Mycobacterium tuberculosis H37Rv
gggauccgaagagccag

SEQ ID NO: 1279237 - RNA, 16 nt, Mycobacterium tuberculosis H37Rv
gggaucgagagccgac

SEQ ID NO: 1279238 - RNA, 17 nt, Mycobacterium tuberculosis H37Rv
gggcacgccgccgacgu

SEQ ID NO: 1279239 - RNA, 13 nt, Mycobacterium tuberculosis H37Rv
gggcacgcccucg

SEQ ID NO: 1279240 - RNA, 20 nt, Mycobacterium tuberculosis H37Rv
gggcacguugugaucgucag

SEQ ID NO: 1279241 - RNA, 20 nt, Mycobacterium tuberculosis H37Rv
gggcacuccgggcucggcgu

SEQ ID NO: 1279242 - RNA, 20 nt, Mycobacterium tuberculosis H37Rv
gggcacaaccagaucuguac

SEQ ID NO: 1279243 - RNA, 19 nt, Mycobacterium tuberculosis H37Rv
gggcacaccgacgccgcca

SEQ ID NO: 1279244 - RNA, 23 nt, Mycobacterium tuberculosis H37Rv
gggcacaccgacgccgccagguc

SEQ ID NO: 1279245 - RNA, 21 nt, Mycobacterium tuberculosis H37Rv
gggcaaggacaagccgcugau

SEQ ID NO: 1279246 - RNA, 17 nt, Mycobacterium tuberculosis H37Rv
gggcaacucggugacgu

SEQ ID NO: 1279247 - RNA, 13 nt, Mycobacterium tuberculosis H37Rv
gggcaccauaucg

SEQ ID NO: 1279248 - RNA, 17 nt, Mycobacterium tuberculosis H37Rv
gggaucgccguccagca

SEQ ID NO: 1279249 - RNA, 19 nt, Mycobacterium tuberculosis H37Rv
gggaucuuaggcacucccg

SEQ ID NO: 1279250 - RNA, 15 nt, Mycobacterium tuberculosis H37Rv
gggaugccggcgaag

SEQ ID NO: 1279251 - RNA, 15 nt, Mycobacterium tuberculosis H37Rv
gggaugcggccggau

SEQ ID NO: 1279252 - RNA, 18 nt, Mycobacterium tuberculosis H37Rv
gggauuuugcgucugcuc

SEQ ID NO: 1279253 - RNA, 19 nt, Mycobacterium tuberculosis H37Rv
gggauuuugcgucugcuca

SEQ ID NO: 1279254 - RNA, 20 nt, Mycobacterium tuberculosis H37Rv
gggauuuugcgucugcucac

SEQ ID NO: 1279255 - RNA, 19 nt, Mycobacterium tuberculosis H37Rv
gggauuucgcgucugcucg

SEQ ID NO: 1279256 - RNA, 14 nt, Mycobacterium tuberculosis H37Rv
gggauucggccaga

SEQ ID NO: 1279257 - RNA, 17 nt, Mycobacterium tuberculosis H37Rv
gggauguagugcugcuc

SEQ ID NO: 1279258 - RNA, 18 nt, Mycobacterium tuberculosis H37Rv
gggauguagugcugcucg

SEQ ID NO: 1279259 - RNA, 18 nt, Mycobacterium tuberculosis H37Rv
gggcaaccacaucaccgg

SEQ ID NO: 1279260 - RNA, 19 nt, Mycobacterium tuberculosis H37Rv
gggauuuugcgucugcucg

SEQ ID NO: 1279261 - RNA, 18 nt, Mycobacterium tuberculosis H37Rv
gggcuccucgugcacgca

SEQ ID NO: 1279262 - RNA, 14 nt, Mycobacterium tuberculosis H37Rv
gggcuccacgucau

SEQ ID NO: 1279263 - RNA, 16 nt, Mycobacterium tuberculosis H37Rv
gggcuccccaagucga

SEQ ID NO: 1279264 - RNA, 23 nt, Mycobacterium tuberculosis H37Rv
gggcucaacaccagccggucguc

SEQ ID NO: 1279265 - RNA, 16 nt, Mycobacterium tuberculosis H37Rv
gggcuaugaccugcga

SEQ ID NO: 1279266 - RNA, 21 nt, Mycobacterium tuberculosis H37Rv
gggcuaucguggcggcgucga

SEQ ID NO: 1279267 - RNA, 13 nt, Mycobacterium tuberculosis H37Rv
gggcuggcaaccg

SEQ ID NO: 1279268 - RNA, 14 nt, Mycobacterium tuberculosis H37Rv
gggcucguccagca

SEQ ID NO: 1279269 - RNA, 15 nt, Mycobacterium tuberculosis H37Rv
gggcgguccgcgucu

SEQ ID NO: 1279270 - RNA, 18 nt, Mycobacterium tuberculosis H37Rv
gggcgucgcaacgcgauc

SEQ ID NO: 1279271 - RNA, 18 nt, Mycobacterium tuberculosis H37Rv
gggcgugaucccgcccaa

SEQ ID NO: 1279272 - RNA, 21 nt, Mycobacterium tuberculosis H37Rv
ggggaccucggcgaucaagcc

SEQ ID NO: 1279273 - RNA, 21 nt, Mycobacterium tuberculosis H37Rv
ggggaccuauuggucgcucgc

SEQ ID NO: 1279274 - RNA, 18 nt, Mycobacterium tuberculosis H37Rv
ggggacccggggccguug

SEQ ID NO: 1279275 - RNA, 23 nt, Mycobacterium tuberculosis H37Rv
ggggacucauggccggucugcug

SEQ ID NO: 1279276 - RNA, 17 nt, Mycobacterium tuberculosis H37Rv
ggggacgugcccggugu

SEQ ID NO: 1279277 - RNA, 19 nt, Mycobacterium tuberculosis H37Rv
ggggaaaccggccagccga

SEQ ID NO: 1279278 - RNA, 20 nt, Mycobacterium tuberculosis H37Rv
gggcuuuugcgucugcugac

SEQ ID NO: 1279279 - RNA, 15 nt, Mycobacterium tuberculosis H37Rv
gggcuuugccgucga

SEQ ID NO: 1279280 - RNA, 19 nt, Mycobacterium tuberculosis H37Rv
gggcuuuuacgucugcucg

SEQ ID NO: 1279281 - RNA, 19 nt, Mycobacterium tuberculosis H37Rv
gggcuuuugcgucugcucg

SEQ ID NO: 1279282 - RNA, 16 nt, Mycobacterium tuberculosis H37Rv
gggcuggccgacucga

SEQ ID NO: 1279283 - RNA, 23 nt, Mycobacterium tuberculosis H37Rv
gggcuggcgacgacgacaccgcg

SEQ ID NO: 1279284 - RNA, 16 nt, Mycobacterium tuberculosis H37Rv
gggcugguaucgagca

SEQ ID NO: 1279285 - RNA, 21 nt, Mycobacterium tuberculosis H37Rv
gggcuguugacgccacgacgc

SEQ ID NO: 1279286 - RNA, 16 nt, Mycobacterium tuberculosis H37Rv
gggcuguccgaccucg

SEQ ID NO: 1279287 - RNA, 21 nt, Mycobacterium tuberculosis H37Rv
gggcuguccgaccucgccgcg

SEQ ID NO: 1279288 - RNA, 21 nt, Mycobacterium tuberculosis H37Rv
gggcuuacuuaaccaggcgag

SEQ ID NO: 1279289 - RNA, 17 nt, Mycobacterium tuberculosis H37Rv
gggcuuaugcgucugcu

SEQ ID NO: 1279290 - RNA, 19 nt, Mycobacterium tuberculosis H37Rv
gggcuuaugcgucugcucg

SEQ ID NO: 1279291 - RNA, 19 nt, Mycobacterium tuberculosis H37Rv
gggcuucugcgucugcucg

SEQ ID NO: 1279292 - RNA, 15 nt, Mycobacterium tuberculosis H37Rv
gggcuucgagugcga

SEQ ID NO: 1279293 - RNA, 16 nt, Mycobacterium tuberculosis H37Rv
gggcuuggcgacgaug

SEQ ID NO: 1279294 - RNA, 19 nt, Mycobacterium tuberculosis H37Rv
gggggauuucgcgucugcu

SEQ ID NO: 1279295 - RNA, 21 nt, Mycobacterium tuberculosis H37Rv
gggggauuucgcgucugcucg

SEQ ID NO: 1279296 - RNA, 23 nt, Mycobacterium tuberculosis H37Rv
gggggauccagcaggccgggaca

SEQ ID NO: 1279297 - RNA, 20 nt, Mycobacterium tuberculosis H37Rv
gggggauccggcgcagcgaa

SEQ ID NO: 1279298 - RNA, 12 nt, Mycobacterium tuberculosis H37Rv
gggggacgcuga

SEQ ID NO: 1279299 - RNA, 19 nt, Mycobacterium tuberculosis H37Rv
ggggcuuuugcgucugcuc

SEQ ID NO: 1279300 - RNA, 20 nt, Mycobacterium tuberculosis H37Rv
ggggcuuuugcgucugcucg

SEQ ID NO: 1279301 - RNA, 20 nt, Mycobacterium tuberculosis H37Rv
ggggcuuuugcgucugcuga

SEQ ID NO: 1279302 - RNA, 23 nt, Mycobacterium tuberculosis H37Rv
ggggcgaugagccugcaggccgc

SEQ ID NO: 1279303 - RNA, 20 nt, Mycobacterium tuberculosis H37Rv
ggggcuucugcgucugcucg

SEQ ID NO: 1279304 - RNA, 20 nt, Mycobacterium tuberculosis H37Rv
ggggcuuuuacgucugcucg

SEQ ID NO: 1279305 - RNA, 18 nt, Mycobacterium tuberculosis H37Rv
ggggcuuggcgacgucgc

SEQ ID NO: 1279306 - RNA, 21 nt, Mycobacterium tuberculosis H37Rv
gggggcuuuuacgucugcucg

SEQ ID NO: 1279307 - RNA, 15 nt, Mycobacterium tuberculosis H37Rv
gggggcugcugcucg

SEQ ID NO: 1279308 - RNA, 20 nt, Mycobacterium tuberculosis H37Rv
gggggcuuaugcgacugcuc

SEQ ID NO: 1279309 - RNA, 21 nt, Mycobacterium tuberculosis H37Rv
gggggcuuaugcgacugcucg

SEQ ID NO: 1279310 - RNA, 21 nt, Mycobacterium tuberculosis H37Rv
gggggcuuaugcgucugcucg

SEQ ID NO: 1279311 - RNA, 12 nt, Mycobacterium tuberculosis H37Rv
aaguaagccgcg

SEQ ID NO: 1279312 - RNA, 20 nt, Mycobacterium tuberculosis H37Rv
ggggcuuauguguccgcucg

SEQ ID NO: 1279313 - RNA, 13 nt, Mycobacterium tuberculosis H37Rv
ggggccgucggca

SEQ ID NO: 1279314 - RNA, 17 nt, Mycobacterium tuberculosis H37Rv
ggggauuuugcgucugc

SEQ ID NO: 1279315 - RNA, 20 nt, Mycobacterium tuberculosis H37Rv
ggggauuucgcgucugcucg

SEQ ID NO: 1279316 - RNA, 20 nt, Mycobacterium tuberculosis H37Rv
ggggaguucgcgcagcaccg

SEQ ID NO: 1279317 - RNA, 17 nt, Mycobacterium tuberculosis H37Rv
ggggaucaccggcugcu

SEQ ID NO: 1279318 - RNA, 19 nt, Mycobacterium tuberculosis H37Rv
ggggauuucgcgucugcuc

SEQ ID NO: 1279319 - RNA, 18 nt, Mycobacterium tuberculosis H37Rv
gggcgcugccaauccgau

SEQ ID NO: 1279320 - RNA, 18 nt, Mycobacterium tuberculosis H37Rv
gggcgcuuaugcgucugc

SEQ ID NO: 1279321 - RNA, 20 nt, Mycobacterium tuberculosis H37Rv
gggcgcuuaugcgucugcuc

SEQ ID NO: 1279322 - RNA, 21 nt, Mycobacterium tuberculosis H37Rv
gggcgcuuaugcgucugcucg

SEQ ID NO: 1279323 - RNA, 13 nt, Mycobacterium tuberculosis H37Rv
gggcgcucgcauc

SEQ ID NO: 1279324 - RNA, 13 nt, Mycobacterium tuberculosis H37Rv
gggcgcucggucu

SEQ ID NO: 1279325 - RNA, 21 nt, Mycobacterium tuberculosis H37Rv
gggcggacaaaagaacgccag

SEQ ID NO: 1279326 - RNA, 13 nt, Mycobacterium tuberculosis H37Rv
gggcggaggccgc

SEQ ID NO: 1279327 - RNA, 17 nt, Mycobacterium tuberculosis H37Rv
gggcggcccaccggcca

SEQ ID NO: 1279328 - RNA, 18 nt, Mycobacterium tuberculosis H37Rv
gggcgggcaaucaccgcc

SEQ ID NO: 1279329 - RNA, 14 nt, Mycobacterium tuberculosis H37Rv
gggcggcggugcgu

SEQ ID NO: 1279330 - RNA, 17 nt, Mycobacterium tuberculosis H37Rv
gggcggcgaccucgggu

SEQ ID NO: 1279331 - RNA, 18 nt, Mycobacterium tuberculosis H37Rv
gggcgcggguggcgccag

SEQ ID NO: 1279332 - RNA, 12 nt, Mycobacterium tuberculosis H37Rv
gggcgcgggugc

SEQ ID NO: 1279333 - RNA, 17 nt, Mycobacterium tuberculosis H37Rv
gggcgcgcucaucgacc

SEQ ID NO: 1279334 - RNA, 16 nt, Mycobacterium tuberculosis H37Rv
gggcgcgcaucugcuc

SEQ ID NO: 1279335 - RNA, 20 nt, Mycobacterium tuberculosis H37Rv
gggcgccuuugccccgugga

SEQ ID NO: 1279336 - RNA, 19 nt, Mycobacterium tuberculosis H37Rv
gggcgccuucaccuggugu

SEQ ID NO: 1279337 - RNA, 15 nt, Mycobacterium tuberculosis H37Rv
gggcgccuuagccau

SEQ ID NO: 1279338 - RNA, 14 nt, Mycobacterium tuberculosis H37Rv
gggcgccucgguga

SEQ ID NO: 1279339 - RNA, 17 nt, Mycobacterium tuberculosis H37Rv
gggcgccgcuaggugac

SEQ ID NO: 1279340 - RNA, 21 nt, Mycobacterium tuberculosis H37Rv
gggcgccgaauuggcccgggu

SEQ ID NO: 1279341 - RNA, 18 nt, Mycobacterium tuberculosis H37Rv
gggcgccacugaccgcga

SEQ ID NO: 1279342 - RNA, 23 nt, Mycobacterium tuberculosis H37Rv
gggcgccacgggugacucgggca

SEQ ID NO: 1279343 - RNA, 22 nt, Mycobacterium tuberculosis H37Rv
gggcgauuuugcgucugcucgc

SEQ ID NO: 1279344 - RNA, 21 nt, Mycobacterium tuberculosis H37Rv
gggcgauuuugcgucugcucg

SEQ ID NO: 1279345 - RNA, 19 nt, Mycobacterium tuberculosis H37Rv
gggcgauuuugcgucugcu

SEQ ID NO: 1279346 - RNA, 18 nt, Mycobacterium tuberculosis H37Rv
gggcgauuuugcgucugc

SEQ ID NO: 1279347 - RNA, 17 nt, Mycobacterium tuberculosis H37Rv
gggcgagugucagcaga

SEQ ID NO: 1279348 - RNA, 18 nt, Mycobacterium tuberculosis H37Rv
gggcgacacccgaugugc

SEQ ID NO: 1279349 - RNA, 22 nt, Mycobacterium tuberculosis H37Rv
gggcgaccaccaccgccgccga

SEQ ID NO: 1279350 - RNA, 17 nt, Mycobacterium tuberculosis H37Rv
gggcgagaccgcgagca

SEQ ID NO: 1279351 - RNA, 15 nt, Mycobacterium tuberculosis H37Rv
gggcgagaccgcgag

SEQ ID NO: 1279352 - RNA, 18 nt, Mycobacterium tuberculosis H37Rv
gggcgacgucaucgccga

SEQ ID NO: 1279353 - RNA, 19 nt, Mycobacterium tuberculosis H37Rv
gggccucguugaccagaac

SEQ ID NO: 1279354 - RNA, 20 nt, Mycobacterium tuberculosis H37Rv
gggccucggcgccgucggag

SEQ ID NO: 1279355 - RNA, 17 nt, Mycobacterium tuberculosis H37Rv
gggccucggcgaccauc

SEQ ID NO: 1279356 - RNA, 17 nt, Mycobacterium tuberculosis H37Rv
gggccucagacaacggg

SEQ ID NO: 1279357 - RNA, 19 nt, Mycobacterium tuberculosis H37Rv
gggccucaaggcggccauu

SEQ ID NO: 1279358 - RNA, 14 nt, Mycobacterium tuberculosis H37Rv
gggccugggccgca

SEQ ID NO: 1279359 - RNA, 21 nt, Mycobacterium tuberculosis H37Rv
ggucaucauggccggauccca

SEQ ID NO: 1279360 - RNA, 22 nt, Mycobacterium tuberculosis H37Rv
gguccaaccccagcgacaugcc

SEQ ID NO: 1279361 - RNA, 15 nt, Mycobacterium tuberculosis H37Rv
gguccaccccgccga

SEQ ID NO: 1279362 - RNA, 17 nt, Mycobacterium tuberculosis H37Rv
gguccaccccgccgauc

SEQ ID NO: 1279363 - RNA, 20 nt, Mycobacterium tuberculosis H37Rv
gguccaagugggccggcggu

SEQ ID NO: 1279364 - RNA, 21 nt, Mycobacterium tuberculosis H37Rv
gguccaccgaccuaccgucga

SEQ ID NO: 1279365 - RNA, 13 nt, Mycobacterium tuberculosis H37Rv
gguccacgacguc

SEQ ID NO: 1279366 - RNA, 21 nt, Mycobacterium tuberculosis H37Rv
ggucagcgaguuucugcucga

SEQ ID NO: 1279367 - RNA, 11 nt, Mycobacterium tuberculosis H37Rv
ggucagcgacu

SEQ ID NO: 1279368 - RNA, 21 nt, Mycobacterium tuberculosis H37Rv
ggucagccgcgcgggucacga

SEQ ID NO: 1279369 - RNA, 18 nt, Mycobacterium tuberculosis H37Rv
ggucagguugucggcgau

SEQ ID NO: 1279370 - RNA, 23 nt, Mycobacterium tuberculosis H37Rv
ggucaguccgacaccggcggcau

SEQ ID NO: 1279371 - RNA, 16 nt, Mycobacterium tuberculosis H37Rv
ggucagcgccggccau

SEQ ID NO: 1279372 - RNA, 17 nt, Mycobacterium tuberculosis H37Rv
ggucagcaccaccagca

SEQ ID NO: 1279373 - RNA, 19 nt, Mycobacterium tuberculosis H37Rv
ggucacugguccaacgauc

SEQ ID NO: 1279374 - RNA, 17 nt, Mycobacterium tuberculosis H37Rv
ggucacgccgucaccgc

SEQ ID NO: 1279375 - RNA, 14 nt, Mycobacterium tuberculosis H37Rv
ggucacgcagucgg

SEQ ID NO: 1279376 - RNA, 23 nt, Mycobacterium tuberculosis H37Rv
ggucacgcagucgggcagcgcuc

SEQ ID NO: 1279377 - RNA, 17 nt, Mycobacterium tuberculosis H37Rv
ggucaccggccgccgac

SEQ ID NO: 1279378 - RNA, 12 nt, Mycobacterium tuberculosis H37Rv
ggucaccugcgg

SEQ ID NO: 1279379 - RNA, 17 nt, Mycobacterium tuberculosis H37Rv
ggucacccgguagacgu

SEQ ID NO: 1279380 - RNA, 18 nt, Mycobacterium tuberculosis H37Rv
ggucaccgaacgacccug

SEQ ID NO: 1279381 - RNA, 13 nt, Mycobacterium tuberculosis H37Rv
ggucaccagcugg

SEQ ID NO: 1279382 - RNA, 20 nt, Mycobacterium tuberculosis H37Rv
gguccccgcagcucgaccag

SEQ ID NO: 1279383 - RNA, 21 nt, Mycobacterium tuberculosis H37Rv
ggucccgccggucacgacguc

SEQ ID NO: 1279384 - RNA, 19 nt, Mycobacterium tuberculosis H37Rv
ggucccgcuacaccugcgg

SEQ ID NO: 1279385 - RNA, 16 nt, Mycobacterium tuberculosis H37Rv
gguccgaccagcggcc

SEQ ID NO: 1279386 - RNA, 12 nt, Mycobacterium tuberculosis H37Rv
gguccgaccagc

SEQ ID NO: 1279387 - RNA, 22 nt, Mycobacterium tuberculosis H37Rv
gguccggcccaccagcgcagcc

SEQ ID NO: 1279388 - RNA, 22 nt, Mycobacterium tuberculosis H37Rv
gguccggcggccgccaucagcc

SEQ ID NO: 1279389 - RNA, 18 nt, Mycobacterium tuberculosis H37Rv
gguccggcggccgguaga

SEQ ID NO: 1279390 - RNA, 17 nt, Mycobacterium tuberculosis H37Rv
gguccggggcaacgauc

SEQ ID NO: 1279391 - RNA, 13 nt, Mycobacterium tuberculosis H37Rv
gguccgugccgau

SEQ ID NO: 1279392 - RNA, 14 nt, Mycobacterium tuberculosis H37Rv
gguccuccuucggu

SEQ ID NO: 1279393 - RNA, 20 nt, Mycobacterium tuberculosis H37Rv
gguccuaggugugcgacgac

SEQ ID NO: 1279394 - RNA, 14 nt, Mycobacterium tuberculosis H37Rv
gguccucagcgaug

SEQ ID NO: 1279395 - RNA, 20 nt, Mycobacterium tuberculosis H37Rv
ggucgacaugggucggcugu

SEQ ID NO: 1279396 - RNA, 23 nt, Mycobacterium tuberculosis H37Rv
ggucgaagagguggggcaggauc

SEQ ID NO: 1279397 - RNA, 12 nt, Mycobacterium tuberculosis H37Rv
gguccugcgguc

SEQ ID NO: 1279398 - RNA, 21 nt, Mycobacterium tuberculosis H37Rv
ggucgacagcgaaggcgccga

SEQ ID NO: 1279399 - RNA, 20 nt, Mycobacterium tuberculosis H37Rv
ggucgacgagauccagcgcc

SEQ ID NO: 1279400 - RNA, 21 nt, Mycobacterium tuberculosis H37Rv
ggucgagcgcuucgucgccga

SEQ ID NO: 1279401 - RNA, 13 nt, Mycobacterium tuberculosis H37Rv
ggucgaugccgau

SEQ ID NO: 1279402 - RNA, 19 nt, Mycobacterium tuberculosis H37Rv
ggucgagguggcgggcgau

SEQ ID NO: 1279403 - RNA, 20 nt, Mycobacterium tuberculosis H37Rv
ggucgcaccacagugccaau

SEQ ID NO: 1279404 - RNA, 15 nt, Mycobacterium tuberculosis H37Rv
ggucgcagaccagac

SEQ ID NO: 1279405 - RNA, 16 nt, Mycobacterium tuberculosis H37Rv
ggucgaugcugccagc

SEQ ID NO: 1279406 - RNA, 17 nt, Mycobacterium tuberculosis H37Rv
ggucgaugucgucgaca

SEQ ID NO: 1279407 - RNA, 12 nt, Mycobacterium tuberculosis H37Rv
ggucgccggcgu

SEQ ID NO: 1279408 - RNA, 16 nt, Mycobacterium tuberculosis H37Rv
ggucgccggacugcgg

SEQ ID NO: 1279409 - RNA, 17 nt, Mycobacterium tuberculosis H37Rv
ggucgccgccgccacgg

SEQ ID NO: 1279410 - RNA, 21 nt, Mycobacterium tuberculosis H37Rv
ggucgccgcauugcagaaccg

SEQ ID NO: 1279411 - RNA, 14 nt, Mycobacterium tuberculosis H37Rv
ggucgcauggucga

SEQ ID NO: 1279412 - RNA, 20 nt, Mycobacterium tuberculosis H37Rv
ggucgcauucugcugccagc

SEQ ID NO: 1279413 - RNA, 18 nt, Mycobacterium tuberculosis H37Rv
gguagcugcccagcguca

SEQ ID NO: 1279414 - RNA, 13 nt, Mycobacterium tuberculosis H37Rv
gguaggccggcaa

SEQ ID NO: 1279415 - RNA, 15 nt, Mycobacterium tuberculosis H37Rv
gguaggagaucaccu

SEQ ID NO: 1279416 - RNA, 17 nt, Mycobacterium tuberculosis H37Rv
gguaccggaaucggcgg

SEQ ID NO: 1279417 - RNA, 17 nt, Mycobacterium tuberculosis H37Rv
gguaccggcggcaaagc

SEQ ID NO: 1279418 - RNA, 17 nt, Mycobacterium tuberculosis H37Rv
gguagcacugucgaggu

SEQ ID NO: 1279419 - RNA, 16 nt, Mycobacterium tuberculosis H37Rv
gguagccauucggugu

SEQ ID NO: 1279420 - RNA, 13 nt, Mycobacterium tuberculosis H37Rv
gguagccgacgac

SEQ ID NO: 1279421 - RNA, 17 nt, Mycobacterium tuberculosis H37Rv
gguaucgucccggcgac

SEQ ID NO: 1279422 - RNA, 21 nt, Mycobacterium tuberculosis H37Rv
gguaucccggucuacgacguc

SEQ ID NO: 1279423 - RNA, 17 nt, Mycobacterium tuberculosis H37Rv
gguaucggcagaugguc

SEQ ID NO: 1279424 - RNA, 19 nt, Mycobacterium tuberculosis H37Rv
gguaucgagaugccaucgg

SEQ ID NO: 1279425 - RNA, 22 nt, Mycobacterium tuberculosis H37Rv
gguaucgacccuccagcacgcc

SEQ ID NO: 1279426 - RNA, 21 nt, Mycobacterium tuberculosis H37Rv
ggucaacgugaugcguucggc

SEQ ID NO: 1279427 - RNA, 21 nt, Mycobacterium tuberculosis H37Rv
ggucaacgggaugccggcgaa

SEQ ID NO: 1279428 - RNA, 19 nt, Mycobacterium tuberculosis H37Rv
ggucaacgaguugcggaua

SEQ ID NO: 1279429 - RNA, 14 nt, Mycobacterium tuberculosis H37Rv
ggucaaggucgucg

SEQ ID NO: 1279430 - RNA, 17 nt, Mycobacterium tuberculosis H37Rv
ggucacacgccagccgg

SEQ ID NO: 1279431 - RNA, 18 nt, Mycobacterium tuberculosis H37Rv
gguaccaucaccgcgcca

SEQ ID NO: 1279432 - RNA, 20 nt, Mycobacterium tuberculosis H37Rv
gguaccgccacuggcgcuga

SEQ ID NO: 1279433 - RNA, 19 nt, Mycobacterium tuberculosis H37Rv
gguaccgagcacaucgcca

SEQ ID NO: 1279434 - RNA, 13 nt, Mycobacterium tuberculosis H37Rv
gguaaucgcgaga

SEQ ID NO: 1279435 - RNA, 13 nt, Mycobacterium tuberculosis H37Rv
gguaagccggcgu

SEQ ID NO: 1279436 - RNA, 15 nt, Mycobacterium tuberculosis H37Rv
gguaaccggcggauu

SEQ ID NO: 1279437 - RNA, 15 nt, Mycobacterium tuberculosis H37Rv
ggguugccagcgacg

SEQ ID NO: 1279438 - RNA, 19 nt, Mycobacterium tuberculosis H37Rv
ggguucuuccacagcgcgu

SEQ ID NO: 1279439 - RNA, 19 nt, Mycobacterium tuberculosis H37Rv
ggguucgccgaagccggac

SEQ ID NO: 1279440 - RNA, 20 nt, Mycobacterium tuberculosis H37Rv
ggguguagcaagucgccgag

SEQ ID NO: 1279441 - RNA, 19 nt, Mycobacterium tuberculosis H37Rv
ggguguagcaagucgccga

SEQ ID NO: 1279442 - RNA, 14 nt, Mycobacterium tuberculosis H37Rv
ggguggcugcuggc

SEQ ID NO: 1279443 - RNA, 12 nt, Mycobacterium tuberculosis H37Rv
ggguggcgucgc

SEQ ID NO: 1279444 - RNA, 20 nt, Mycobacterium tuberculosis H37Rv
gggugggucggcuuccggug

SEQ ID NO: 1279445 - RNA, 14 nt, Mycobacterium tuberculosis H37Rv
ggguggcggcguca

SEQ ID NO: 1279446 - RNA, 16 nt, Mycobacterium tuberculosis H37Rv
ggguggcgucaccgcc

SEQ ID NO: 1279447 - RNA, 22 nt, Mycobacterium tuberculosis H37Rv
aaguacgcccuggaaugccgcc

SEQ ID NO: 1279448 - RNA, 14 nt, Mycobacterium tuberculosis H37Rv
ggugcccaucggca

SEQ ID NO: 1279449 - RNA, 17 nt, Mycobacterium tuberculosis H37Rv
ggugccagccggucgau

SEQ ID NO: 1279450 - RNA, 17 nt, Mycobacterium tuberculosis H37Rv
ggugcaguacgcgcuga

SEQ ID NO: 1279451 - RNA, 16 nt, Mycobacterium tuberculosis H37Rv
ggugccagcaggccga

SEQ ID NO: 1279452 - RNA, 12 nt, Mycobacterium tuberculosis H37Rv
ggugcagcgacu

SEQ ID NO: 1279453 - RNA, 19 nt, Mycobacterium tuberculosis H37Rv
ggugcaggugaugcaugcu

SEQ ID NO: 1279454 - RNA, 16 nt, Mycobacterium tuberculosis H37Rv
ggugcaggugacgauc

SEQ ID NO: 1279455 - RNA, 16 nt, Mycobacterium tuberculosis H37Rv
ggugcagucgauuucg

SEQ ID NO: 1279456 - RNA, 17 nt, Mycobacterium tuberculosis H37Rv
ggugccgccaccggcgu

SEQ ID NO: 1279457 - RNA, 20 nt, Mycobacterium tuberculosis H37Rv
ggugccgaagaugaccgcuc

SEQ ID NO: 1279458 - RNA, 17 nt, Mycobacterium tuberculosis H37Rv
ggugccgagcuggcgac

SEQ ID NO: 1279459 - RNA, 15 nt, Mycobacterium tuberculosis H37Rv
ggugccgccgucgau

SEQ ID NO: 1279460 - RNA, 23 nt, Mycobacterium tuberculosis H37Rv
ggugccggugcuccucggcaggc

SEQ ID NO: 1279461 - RNA, 13 nt, Mycobacterium tuberculosis H37Rv
ggugccgucgagu

SEQ ID NO: 1279462 - RNA, 19 nt, Mycobacterium tuberculosis H37Rv
ggugccggugauggccgac

SEQ ID NO: 1279463 - RNA, 19 nt, Mycobacterium tuberculosis H37Rv
ggugccuacaccggcaagc

SEQ ID NO: 1279464 - RNA, 14 nt, Mycobacterium tuberculosis H37Rv
ggugccgucgggua

SEQ ID NO: 1279465 - RNA, 12 nt, Mycobacterium tuberculosis H37Rv
ggugccggcgac

SEQ ID NO: 1279466 - RNA, 17 nt, Mycobacterium tuberculosis H37Rv
ggugccggcauagaucg

SEQ ID NO: 1279467 - RNA, 16 nt, Mycobacterium tuberculosis H37Rv
ggugccggcagcggcg

SEQ ID NO: 1279468 - RNA, 14 nt, Mycobacterium tuberculosis H37Rv
ggugccgcgcagcu

SEQ ID NO: 1279469 - RNA, 15 nt, Mycobacterium tuberculosis H37Rv
ggugcguccaggcca

SEQ ID NO: 1279470 - RNA, 12 nt, Mycobacterium tuberculosis H37Rv
ggugcgcgguug

SEQ ID NO: 1279471 - RNA, 17 nt, Mycobacterium tuberculosis H37Rv
ggugcggcgggcucgcu

SEQ ID NO: 1279472 - RNA, 16 nt, Mycobacterium tuberculosis H37Rv
ggugcgggacgccgaa

SEQ ID NO: 1279473 - RNA, 19 nt, Mycobacterium tuberculosis H37Rv
ggugcgggugggacaccau

SEQ ID NO: 1279474 - RNA, 15 nt, Mycobacterium tuberculosis H37Rv
ggugcgggucggcgc

SEQ ID NO: 1279475 - RNA, 16 nt, Mycobacterium tuberculosis H37Rv
gguggcagccugcugc

SEQ ID NO: 1279476 - RNA, 12 nt, Mycobacterium tuberculosis H37Rv
gguggcagcgca

SEQ ID NO: 1279477 - RNA, 15 nt, Mycobacterium tuberculosis H37Rv
gguggccaccagcgg

SEQ ID NO: 1279478 - RNA, 18 nt, Mycobacterium tuberculosis H37Rv
gguggcauucgucgagua

SEQ ID NO: 1279479 - RNA, 16 nt, Mycobacterium tuberculosis H37Rv
gguggccaacucgaca

SEQ ID NO: 1279480 - RNA, 15 nt, Mycobacterium tuberculosis H37Rv
gguggcacccgcguc

SEQ ID NO: 1279481 - RNA, 21 nt, Mycobacterium tuberculosis H37Rv
gguggauguuugcucggccua

SEQ ID NO: 1279482 - RNA, 22 nt, Mycobacterium tuberculosis H37Rv
gguggaugugugagucccacgc

SEQ ID NO: 1279483 - RNA, 14 nt, Mycobacterium tuberculosis H37Rv
ggugcgggccacga

SEQ ID NO: 1279484 - RNA, 21 nt, Mycobacterium tuberculosis H37Rv
ggugcuacuggugugacgauc

SEQ ID NO: 1279485 - RNA, 18 nt, Mycobacterium tuberculosis H37Rv
ggugcuagcgccgccagu

SEQ ID NO: 1279486 - RNA, 17 nt, Mycobacterium tuberculosis H37Rv
ggugcuaaccgacgcug

SEQ ID NO: 1279487 - RNA, 18 nt, Mycobacterium tuberculosis H37Rv
ggugcuaaccgacgcuga

SEQ ID NO: 1279488 - RNA, 20 nt, Mycobacterium tuberculosis H37Rv
ggugccuacaccggcaagcc

SEQ ID NO: 1279489 - RNA, 19 nt, Mycobacterium tuberculosis H37Rv
ggugcgaucccacccucgg

SEQ ID NO: 1279490 - RNA, 19 nt, Mycobacterium tuberculosis H37Rv
ggugcgccauugcgggaac

SEQ ID NO: 1279491 - RNA, 16 nt, Mycobacterium tuberculosis H37Rv
ggugcgcccaccgacc

SEQ ID NO: 1279492 - RNA, 12 nt, Mycobacterium tuberculosis H37Rv
ggugcgacgauc

SEQ ID NO: 1279493 - RNA, 18 nt, Mycobacterium tuberculosis H37Rv
ggugcggccgcggcgauc

SEQ ID NO: 1279494 - RNA, 21 nt, Mycobacterium tuberculosis H37Rv
ggugcggauguccuugcgguc

SEQ ID NO: 1279495 - RNA, 17 nt, Mycobacterium tuberculosis H37Rv
ggugcggcaacagcgcc

SEQ ID NO: 1279496 - RNA, 19 nt, Mycobacterium tuberculosis H37Rv
ggugcgcgugacgaccagc

SEQ ID NO: 1279497 - RNA, 14 nt, Mycobacterium tuberculosis H37Rv
ggugcgcgaccagg

SEQ ID NO: 1279498 - RNA, 14 nt, Mycobacterium tuberculosis H37Rv
ggugcgcgaggucg

SEQ ID NO: 1279499 - RNA, 13 nt, Mycobacterium tuberculosis H37Rv
ggugcgccggcgu

SEQ ID NO: 1279500 - RNA, 13 nt, Mycobacterium tuberculosis H37Rv
ggucguucgccga

SEQ ID NO: 1279501 - RNA, 22 nt, Mycobacterium tuberculosis H37Rv
ggucguucuccgcgccgccgau

SEQ ID NO: 1279502 - RNA, 22 nt, Mycobacterium tuberculosis H37Rv
ggucggcuuccggugccgggau

SEQ ID NO: 1279503 - RNA, 14 nt, Mycobacterium tuberculosis H37Rv
ggucgggacgcugc

SEQ ID NO: 1279504 - RNA, 16 nt, Mycobacterium tuberculosis H37Rv
ggucggggagcugcgg

SEQ ID NO: 1279505 - RNA, 17 nt, Mycobacterium tuberculosis H37Rv
ggucggccuucagcguc

SEQ ID NO: 1279506 - RNA, 13 nt, Mycobacterium tuberculosis H37Rv
ggucggccugcgg

SEQ ID NO: 1279507 - RNA, 21 nt, Mycobacterium tuberculosis H37Rv
ggucggccucgagacggucga

SEQ ID NO: 1279508 - RNA, 14 nt, Mycobacterium tuberculosis H37Rv
ggucggccucgaga

SEQ ID NO: 1279509 - RNA, 15 nt, Mycobacterium tuberculosis H37Rv
ggucggccggcucgu

SEQ ID NO: 1279510 - RNA, 15 nt, Mycobacterium tuberculosis H37Rv
ggucggcccuccacc

SEQ ID NO: 1279511 - RNA, 18 nt, Mycobacterium tuberculosis H37Rv
ggucggccaggucgagca

SEQ ID NO: 1279512 - RNA, 21 nt, Mycobacterium tuberculosis H37Rv
ggucggccaggucgagcaccg

SEQ ID NO: 1279513 - RNA, 16 nt, Mycobacterium tuberculosis H37Rv
ggucgccucaccggcg

SEQ ID NO: 1279514 - RNA, 17 nt, Mycobacterium tuberculosis H37Rv
ggucgccuccucgugca

SEQ ID NO: 1279515 - RNA, 17 nt, Mycobacterium tuberculosis H37Rv
ggucguuuacggcaagu

SEQ ID NO: 1279516 - RNA, 17 nt, Mycobacterium tuberculosis H37Rv
ggucguuggcggcgguc

SEQ ID NO: 1279517 - RNA, 14 nt, Mycobacterium tuberculosis H37Rv
ggucugccagcacc

SEQ ID NO: 1279518 - RNA, 20 nt, Mycobacterium tuberculosis H37Rv
ggucucccagaggucgagcg

SEQ ID NO: 1279519 - RNA, 16 nt, Mycobacterium tuberculosis H37Rv
ggucugcggccgauac

SEQ ID NO: 1279520 - RNA, 16 nt, Mycobacterium tuberculosis H37Rv
ggucuggacugcagcc

SEQ ID NO: 1279521 - RNA, 18 nt, Mycobacterium tuberculosis H37Rv
ggucugccgggcgcgcgu

SEQ ID NO: 1279522 - RNA, 20 nt, Mycobacterium tuberculosis H37Rv
ggucuuccggugcgccgauc

SEQ ID NO: 1279523 - RNA, 20 nt, Mycobacterium tuberculosis H37Rv
ggucuucaggccgcgcaugg

SEQ ID NO: 1279524 - RNA, 14 nt, Mycobacterium tuberculosis H37Rv
ggucuucaggccgc

SEQ ID NO: 1279525 - RNA, 17 nt, Mycobacterium tuberculosis H37Rv
ggucuguaagacagcua

SEQ ID NO: 1279526 - RNA, 20 nt, Mycobacterium tuberculosis H37Rv
ggugaaggcaaacaccagcc

SEQ ID NO: 1279527 - RNA, 14 nt, Mycobacterium tuberculosis H37Rv
ggucuugccgagca

SEQ ID NO: 1279528 - RNA, 21 nt, Mycobacterium tuberculosis H37Rv
ggucuuggauccggccgccaa

SEQ ID NO: 1279529 - RNA, 22 nt, Mycobacterium tuberculosis H37Rv
ggugauguuggccgccacaccg

SEQ ID NO: 1279530 - RNA, 16 nt, Mycobacterium tuberculosis H37Rv
ggugauguucagcgcc

SEQ ID NO: 1279531 - RNA, 14 nt, Mycobacterium tuberculosis H37Rv
ggugaucagcagca

SEQ ID NO: 1279532 - RNA, 15 nt, Mycobacterium tuberculosis H37Rv
ggugaucagcagcag

SEQ ID NO: 1279533 - RNA, 19 nt, Mycobacterium tuberculosis H37Rv
ggugcaccgaagauggcca

SEQ ID NO: 1279534 - RNA, 22 nt, Mycobacterium tuberculosis H37Rv
ggugcagcaccagccacgccag

SEQ ID NO: 1279535 - RNA, 18 nt, Mycobacterium tuberculosis H37Rv
ggugcagaucggcucacc

SEQ ID NO: 1279536 - RNA, 15 nt, Mycobacterium tuberculosis H37Rv
ggugcaccgauucca

SEQ ID NO: 1279537 - RNA, 20 nt, Mycobacterium tuberculosis H37Rv
ggugcaccgaagauggccag

SEQ ID NO: 1279538 - RNA, 23 nt, Mycobacterium tuberculosis H37Rv
ggugagccgugccgccagcaacc

SEQ ID NO: 1279539 - RNA, 17 nt, Mycobacterium tuberculosis H37Rv
ggugagcgagcgcgcgu

SEQ ID NO: 1279540 - RNA, 17 nt, Mycobacterium tuberculosis H37Rv
ggugaccaacgucgacu

SEQ ID NO: 1279541 - RNA, 13 nt, Mycobacterium tuberculosis H37Rv
ggugacaucgcga

SEQ ID NO: 1279542 - RNA, 22 nt, Mycobacterium tuberculosis H37Rv
ggugacagagcggguucgacgu

SEQ ID NO: 1279543 - RNA, 14 nt, Mycobacterium tuberculosis H37Rv
ggugaccaggccgg

SEQ ID NO: 1279544 - RNA, 17 nt, Mycobacterium tuberculosis H37Rv
ggugaccaggaucgaca

SEQ ID NO: 1279545 - RNA, 15 nt, Mycobacterium tuberculosis H37Rv
ggugaccaggcggcg

SEQ ID NO: 1279546 - RNA, 19 nt, Mycobacterium tuberculosis H37Rv
ggugaaucgucugacgaaa

SEQ ID NO: 1279547 - RNA, 16 nt, Mycobacterium tuberculosis H37Rv
ggugaaucgacaccgc

SEQ ID NO: 1279548 - RNA, 21 nt, Mycobacterium tuberculosis H37Rv
gucgcguaccaacaggauggu

SEQ ID NO: 1279549 - RNA, 23 nt, Mycobacterium tuberculosis H37Rv
gucgcgguagccuggcuguccgc

SEQ ID NO: 1279550 - RNA, 21 nt, Mycobacterium tuberculosis H37Rv
gucgcgguaccaucaccgcgc

SEQ ID NO: 1279551 - RNA, 15 nt, Mycobacterium tuberculosis H37Rv
gucgcggguguucca

SEQ ID NO: 1279552 - RNA, 15 nt, Mycobacterium tuberculosis H37Rv
gucgcggguccaggc

SEQ ID NO: 1279553 - RNA, 12 nt, Mycobacterium tuberculosis H37Rv
gucgcggccaag

SEQ ID NO: 1279554 - RNA, 14 nt, Mycobacterium tuberculosis H37Rv
gucgcggcccgcga

SEQ ID NO: 1279555 - RNA, 22 nt, Mycobacterium tuberculosis H37Rv
gucgcggccgucgcgggacaac

SEQ ID NO: 1279556 - RNA, 14 nt, Mycobacterium tuberculosis H37Rv
gucgcggacggugc

SEQ ID NO: 1279557 - RNA, 19 nt, Mycobacterium tuberculosis H37Rv
gucgcggacggugcgguca

SEQ ID NO: 1279558 - RNA, 19 nt, Mycobacterium tuberculosis H37Rv
gucgcggagaacgcgucgc

SEQ ID NO: 1279559 - RNA, 14 nt, Mycobacterium tuberculosis H37Rv
gucgcgauugccgc

SEQ ID NO: 1279560 - RNA, 22 nt, Mycobacterium tuberculosis H37Rv
gucgcgaugcucaaugugccgc

SEQ ID NO: 1279561 - RNA, 20 nt, Mycobacterium tuberculosis H37Rv
gucgcgacgacguagauggu

SEQ ID NO: 1279562 - RNA, 21 nt, Mycobacterium tuberculosis H37Rv
gucgccuuugagggcgacgac

SEQ ID NO: 1279563 - RNA, 13 nt, Mycobacterium tuberculosis H37Rv
gucgcgacgucgg

SEQ ID NO: 1279564 - RNA, 22 nt, Mycobacterium tuberculosis H37Rv
gucgcgaguagcugacccgcgg

SEQ ID NO: 1279565 - RNA, 15 nt, Mycobacterium tuberculosis H37Rv
gucgcgaguagcuga

SEQ ID NO: 1279566 - RNA, 14 nt, Mycobacterium tuberculosis H37Rv
gucgccgcggcagc

SEQ ID NO: 1279567 - RNA, 21 nt, Mycobacterium tuberculosis H37Rv
gucgccgcgcguuccagcaca

SEQ ID NO: 1279568 - RNA, 21 nt, Mycobacterium tuberculosis H37Rv
gucgccgcggcggcagcggcg

SEQ ID NO: 1279569 - RNA, 17 nt, Mycobacterium tuberculosis H37Rv
gucgccgcggcggcagc

SEQ ID NO: 1279570 - RNA, 23 nt, Mycobacterium tuberculosis H37Rv
gucgccgcggcggcagcggcgau

SEQ ID NO: 1279571 - RNA, 18 nt, Mycobacterium tuberculosis H37Rv
gucgcgaaauagcugcgg

SEQ ID NO: 1279572 - RNA, 17 nt, Mycobacterium tuberculosis H37Rv
gucgaguuucucggcgu

SEQ ID NO: 1279573 - RNA, 20 nt, Mycobacterium tuberculosis H37Rv
gucgaucagcgcgacggucc

SEQ ID NO: 1279574 - RNA, 12 nt, Mycobacterium tuberculosis H37Rv
gucgaucaccga

SEQ ID NO: 1279575 - RNA, 18 nt, Mycobacterium tuberculosis H37Rv
gucgaucacggccgucga

SEQ ID NO: 1279576 - RNA, 17 nt, Mycobacterium tuberculosis H37Rv
gucgaucagcggcgaaa

SEQ ID NO: 1279577 - RNA, 16 nt, Mycobacterium tuberculosis H37Rv
gucgcaggaucggcgg

SEQ ID NO: 1279578 - RNA, 14 nt, Mycobacterium tuberculosis H37Rv
gucgaucauggcgg

SEQ ID NO: 1279579 - RNA, 15 nt, Mycobacterium tuberculosis H37Rv
gucgcagccagcuga

SEQ ID NO: 1279580 - RNA, 19 nt, Mycobacterium tuberculosis H37Rv
gucgcaguauucacagucg

SEQ ID NO: 1279581 - RNA, 20 nt, Mycobacterium tuberculosis H37Rv
gucgcaguauucacagucgc

SEQ ID NO: 1279582 - RNA, 14 nt, Mycobacterium tuberculosis H37Rv
gucgcagcucgucg

SEQ ID NO: 1279583 - RNA, 22 nt, Mycobacterium tuberculosis H37Rv
gucgccaacgccagcaccagcg

SEQ ID NO: 1279584 - RNA, 15 nt, Mycobacterium tuberculosis H37Rv
gucgcauucugcugc

SEQ ID NO: 1279585 - RNA, 19 nt, Mycobacterium tuberculosis H37Rv
gucgccaagcccaggcgau

SEQ ID NO: 1279586 - RNA, 15 nt, Mycobacterium tuberculosis H37Rv
gucgccaggucaucg

SEQ ID NO: 1279587 - RNA, 23 nt, Mycobacterium tuberculosis H37Rv
gucgccagguuaggcaauagccg

SEQ ID NO: 1279588 - RNA, 17 nt, Mycobacterium tuberculosis H37Rv
gucgccauccucgagcu

SEQ ID NO: 1279589 - RNA, 19 nt, Mycobacterium tuberculosis H37Rv
gucgccauaccugccggac

SEQ ID NO: 1279590 - RNA, 18 nt, Mycobacterium tuberculosis H37Rv
gucgcccggucucgacgg

SEQ ID NO: 1279591 - RNA, 17 nt, Mycobacterium tuberculosis H37Rv
gucgcccucgaucgcca

SEQ ID NO: 1279592 - RNA, 15 nt, Mycobacterium tuberculosis H37Rv
gucgccgaucaccgc

SEQ ID NO: 1279593 - RNA, 13 nt, Mycobacterium tuberculosis H37Rv
gucgccgcgcguu

SEQ ID NO: 1279594 - RNA, 13 nt, Mycobacterium tuberculosis H37Rv
gucgccgccguug

SEQ ID NO: 1279595 - RNA, 21 nt, Mycobacterium tuberculosis H37Rv
gucgccgccuuacgcaccgau

SEQ ID NO: 1279596 - RNA, 14 nt, Mycobacterium tuberculosis H37Rv
gucgccgccaccag

SEQ ID NO: 1279597 - RNA, 15 nt, Mycobacterium tuberculosis H37Rv
gucgccgccaccagc

SEQ ID NO: 1279598 - RNA, 17 nt, Mycobacterium tuberculosis H37Rv
gucgccgccaccagcgc

SEQ ID NO: 1279599 - RNA, 17 nt, Mycobacterium tuberculosis H37Rv
gucgccgauaucgguga

SEQ ID NO: 1279600 - RNA, 14 nt, Mycobacterium tuberculosis H37Rv
gucggcgaucaacg

SEQ ID NO: 1279601 - RNA, 17 nt, Mycobacterium tuberculosis H37Rv
gucggcgaugcguccgc

SEQ ID NO: 1279602 - RNA, 22 nt, Mycobacterium tuberculosis H37Rv
gucggcgaugcguccgcccagc

SEQ ID NO: 1279603 - RNA, 20 nt, Mycobacterium tuberculosis H37Rv
gucggcgacguagacggucc

SEQ ID NO: 1279604 - RNA, 16 nt, Mycobacterium tuberculosis H37Rv
gucggcgacggccagc

SEQ ID NO: 1279605 - RNA, 12 nt, Mycobacterium tuberculosis H37Rv
gucggcgagcgc

SEQ ID NO: 1279606 - RNA, 21 nt, Mycobacterium tuberculosis H37Rv
gucggccggaugagcgaacgc

SEQ ID NO: 1279607 - RNA, 16 nt, Mycobacterium tuberculosis H37Rv
gucggccggcggucgc

SEQ ID NO: 1279608 - RNA, 17 nt, Mycobacterium tuberculosis H37Rv
gucggccaaagacccgg

SEQ ID NO: 1279609 - RNA, 21 nt, Mycobacterium tuberculosis H37Rv
gucggcauccucugaaccugc

SEQ ID NO: 1279610 - RNA, 18 nt, Mycobacterium tuberculosis H37Rv
gucggccacauccagcgc

SEQ ID NO: 1279611 - RNA, 15 nt, Mycobacterium tuberculosis H37Rv
gucggccaccggcgu

SEQ ID NO: 1279612 - RNA, 16 nt, Mycobacterium tuberculosis H37Rv
gucggccgcaucgccc

SEQ ID NO: 1279613 - RNA, 21 nt, Mycobacterium tuberculosis H37Rv
gucggcccggugcucaagcgc

SEQ ID NO: 1279614 - RNA, 21 nt, Mycobacterium tuberculosis H37Rv
gucggccgaacaaccuucggg

SEQ ID NO: 1279615 - RNA, 17 nt, Mycobacterium tuberculosis H37Rv
gucggcccacggugucc

SEQ ID NO: 1279616 - RNA, 17 nt, Mycobacterium tuberculosis H37Rv
gucggccaggucgagca

SEQ ID NO: 1279617 - RNA, 17 nt, Mycobacterium tuberculosis H37Rv
gucggccccggccgcgu

SEQ ID NO: 1279618 - RNA, 21 nt, Mycobacterium tuberculosis H37Rv
gucggccauccaccgcagauc

SEQ ID NO: 1279619 - RNA, 19 nt, Mycobacterium tuberculosis H37Rv
gucgcugugcagcggguug

SEQ ID NO: 1279620 - RNA, 21 nt, Mycobacterium tuberculosis H37Rv
gucgcugccgccgccggcggu

SEQ ID NO: 1279621 - RNA, 19 nt, Mycobacterium tuberculosis H37Rv
gucgcugcccgcggugugc

SEQ ID NO: 1279622 - RNA, 20 nt, Mycobacterium tuberculosis H37Rv
gucgcucacggcccgagccg

SEQ ID NO: 1279623 - RNA, 14 nt, Mycobacterium tuberculosis H37Rv
gucgcucgucguca

SEQ ID NO: 1279624 - RNA, 15 nt, Mycobacterium tuberculosis H37Rv
gucggcaacgacccg

SEQ ID NO: 1279625 - RNA, 22 nt, Mycobacterium tuberculosis H37Rv
gucggcaauacuccgcugacga

SEQ ID NO: 1279626 - RNA, 20 nt, Mycobacterium tuberculosis H37Rv
gucggcagcuucucgccgac

SEQ ID NO: 1279627 - RNA, 14 nt, Mycobacterium tuberculosis H37Rv
gucggcagcgacgc

SEQ ID NO: 1279628 - RNA, 13 nt, Mycobacterium tuberculosis H37Rv
gucggcagcagcg

SEQ ID NO: 1279629 - RNA, 17 nt, Mycobacterium tuberculosis H37Rv
gucggcagcagcggugc

SEQ ID NO: 1279630 - RNA, 15 nt, Mycobacterium tuberculosis H37Rv
gucggcacgacccgg

SEQ ID NO: 1279631 - RNA, 14 nt, Mycobacterium tuberculosis H37Rv
gucggcacgacccg

SEQ ID NO: 1279632 - RNA, 15 nt, Mycobacterium tuberculosis H37Rv
gucggcagaccgacc

SEQ ID NO: 1279633 - RNA, 22 nt, Mycobacterium tuberculosis H37Rv
gucggcaaugucuucgauaccg

SEQ ID NO: 1279634 - RNA, 18 nt, Mycobacterium tuberculosis H37Rv
gucggaccucgcccauga

SEQ ID NO: 1279635 - RNA, 17 nt, Mycobacterium tuberculosis H37Rv
gucggagcggugccgac

SEQ ID NO: 1279636 - RNA, 15 nt, Mycobacterium tuberculosis H37Rv
gucgcuucagcgcca

SEQ ID NO: 1279637 - RNA, 17 nt, Mycobacterium tuberculosis H37Rv
gucgcuucugauuacgg

SEQ ID NO: 1279638 - RNA, 18 nt, Mycobacterium tuberculosis H37Rv
guccuccagcugcgcggg

SEQ ID NO: 1279639 - RNA, 23 nt, Mycobacterium tuberculosis H37Rv
guccucaucguuccacgagucgu

SEQ ID NO: 1279640 - RNA, 18 nt, Mycobacterium tuberculosis H37Rv
guccuauuugcagccuuc

SEQ ID NO: 1279641 - RNA, 19 nt, Mycobacterium tuberculosis H37Rv
guccucgcggagccgucgc

SEQ ID NO: 1279642 - RNA, 21 nt, Mycobacterium tuberculosis H37Rv
guccucgagugccgccgucgc

SEQ ID NO: 1279643 - RNA, 20 nt, Mycobacterium tuberculosis H37Rv
guccucgacgaucagcacgu

SEQ ID NO: 1279644 - RNA, 16 nt, Mycobacterium tuberculosis H37Rv
guccugcagcuggcga

SEQ ID NO: 1279645 - RNA, 21 nt, Mycobacterium tuberculosis H37Rv
guccugccaguccgcagcguc

SEQ ID NO: 1279646 - RNA, 23 nt, Mycobacterium tuberculosis H37Rv
guccugcgagaggugcugcaccu

SEQ ID NO: 1279647 - RNA, 13 nt, Mycobacterium tuberculosis H37Rv
guccugcggucgc

SEQ ID NO: 1279648 - RNA, 22 nt, Mycobacterium tuberculosis H37Rv
gucgaaguuggcgaagcccgac

SEQ ID NO: 1279649 - RNA, 21 nt, Mycobacterium tuberculosis H37Rv
gucgaaguuggcgaagcccga

SEQ ID NO: 1279650 - RNA, 22 nt, Mycobacterium tuberculosis H37Rv
gucgaauaguugaccaggccga

SEQ ID NO: 1279651 - RNA, 19 nt, Mycobacterium tuberculosis H37Rv
gucgaauaguugaccaggc

SEQ ID NO: 1279652 - RNA, 21 nt, Mycobacterium tuberculosis H37Rv
gucgaaucgcugccgccgauc

SEQ ID NO: 1279653 - RNA, 17 nt, Mycobacterium tuberculosis H37Rv
gucgacaagccgucggc

SEQ ID NO: 1279654 - RNA, 20 nt, Mycobacterium tuberculosis H37Rv
gucgacaagccgucggcgau

SEQ ID NO: 1279655 - RNA, 11 nt, Mycobacterium tuberculosis H37Rv
gucgacaaacc

SEQ ID NO: 1279656 - RNA, 19 nt, Mycobacterium tuberculosis H37Rv
gucgacaccgaggaccucg

SEQ ID NO: 1279657 - RNA, 15 nt, Mycobacterium tuberculosis H37Rv
gucgacacccgcacg

SEQ ID NO: 1279658 - RNA, 17 nt, Mycobacterium tuberculosis H37Rv
gucgacacgccgaacgu

SEQ ID NO: 1279659 - RNA, 17 nt, Mycobacterium tuberculosis H37Rv
gucgacaccgcggugcc

SEQ ID NO: 1279660 - RNA, 14 nt, Mycobacterium tuberculosis H37Rv
gucgacacggugau

SEQ ID NO: 1279661 - RNA, 21 nt, Mycobacterium tuberculosis H37Rv
gucgaacuuugucgcgcugcu

SEQ ID NO: 1279662 - RNA, 19 nt, Mycobacterium tuberculosis H37Rv
gucgaagcacaugccgaac

SEQ ID NO: 1279663 - RNA, 21 nt, Mycobacterium tuberculosis H37Rv
guccugggcccgaaucgccug

SEQ ID NO: 1279664 - RNA, 18 nt, Mycobacterium tuberculosis H37Rv
gucgaacuucagcggcgg

SEQ ID NO: 1279665 - RNA, 22 nt, Mycobacterium tuberculosis H37Rv
gucgacgugaucgcgguccaac

SEQ ID NO: 1279666 - RNA, 13 nt, Mycobacterium tuberculosis H37Rv
gucgacuccgauc

SEQ ID NO: 1279667 - RNA, 23 nt, Mycobacterium tuberculosis H37Rv
gucgacgugaucgcgguccaaca

SEQ ID NO: 1279668 - RNA, 23 nt, Mycobacterium tuberculosis H37Rv
gucgacuacacauucauccaccc

SEQ ID NO: 1279669 - RNA, 20 nt, Mycobacterium tuberculosis H37Rv
gucgacucguggcgccacgg

SEQ ID NO: 1279670 - RNA, 16 nt, Mycobacterium tuberculosis H37Rv
gucgacuugcaggcgu

SEQ ID NO: 1279671 - RNA, 14 nt, Mycobacterium tuberculosis H37Rv
gucgacuugccgac

SEQ ID NO: 1279672 - RNA, 19 nt, Mycobacterium tuberculosis H37Rv
gucgagcgaccccacacgc

SEQ ID NO: 1279673 - RNA, 16 nt, Mycobacterium tuberculosis H37Rv
gucgagcgccuugucg

SEQ ID NO: 1279674 - RNA, 14 nt, Mycobacterium tuberculosis H37Rv
gucgagccggugcc

SEQ ID NO: 1279675 - RNA, 22 nt, Mycobacterium tuberculosis H37Rv
gucgagccgugccucgaggacg

SEQ ID NO: 1279676 - RNA, 14 nt, Mycobacterium tuberculosis H37Rv
gucgagucgccgag

SEQ ID NO: 1279677 - RNA, 15 nt, Mycobacterium tuberculosis H37Rv
gucgagucgaugacc

SEQ ID NO: 1279678 - RNA, 13 nt, Mycobacterium tuberculosis H37Rv
gucgagugcggac

SEQ ID NO: 1279679 - RNA, 14 nt, Mycobacterium tuberculosis H37Rv
gucgaguccaggcc

SEQ ID NO: 1279680 - RNA, 16 nt, Mycobacterium tuberculosis H37Rv
gucgagucgacaagcc

SEQ ID NO: 1279681 - RNA, 21 nt, Mycobacterium tuberculosis H37Rv
gucgagucgacggcaucgggg

SEQ ID NO: 1279682 - RNA, 19 nt, Mycobacterium tuberculosis H37Rv
gucgagcguggcgacggga

SEQ ID NO: 1279683 - RNA, 21 nt, Mycobacterium tuberculosis H37Rv
gucgagcguuuuggugcggac

SEQ ID NO: 1279684 - RNA, 21 nt, Mycobacterium tuberculosis H37Rv
gucgagcucccacaggaccga

SEQ ID NO: 1279685 - RNA, 19 nt, Mycobacterium tuberculosis H37Rv
gucgagcgcgucggucacc

SEQ ID NO: 1279686 - RNA, 17 nt, Mycobacterium tuberculosis H37Rv
gucgagcgccgcaguga

SEQ ID NO: 1279687 - RNA, 20 nt, Mycobacterium tuberculosis H37Rv
gucgagcgucugcgaucccg

SEQ ID NO: 1279688 - RNA, 15 nt, Mycobacterium tuberculosis H37Rv
gucgagcgcgucggu

SEQ ID NO: 1279689 - RNA, 13 nt, Mycobacterium tuberculosis H37Rv
gucgacgucgauc

SEQ ID NO: 1279690 - RNA, 22 nt, Mycobacterium tuberculosis H37Rv
gucgacgggucggcgccgagca

SEQ ID NO: 1279691 - RNA, 22 nt, Mycobacterium tuberculosis H37Rv
gucgacggccuggggcagccgg

SEQ ID NO: 1279692 - RNA, 20 nt, Mycobacterium tuberculosis H37Rv
gucgacggccagugcgcaga

SEQ ID NO: 1279693 - RNA, 23 nt, Mycobacterium tuberculosis H37Rv
gucgacaggugccagaccagggc

SEQ ID NO: 1279694 - RNA, 22 nt, Mycobacterium tuberculosis H37Rv
gucgacagcgaaggcgccgaac

SEQ ID NO: 1279695 - RNA, 20 nt, Mycobacterium tuberculosis H37Rv
gucgacagcgaaggcgccga

SEQ ID NO: 1279696 - RNA, 20 nt, Mycobacterium tuberculosis H37Rv
gucgacaguucaacgggccu

SEQ ID NO: 1279697 - RNA, 22 nt, Mycobacterium tuberculosis H37Rv
gucgacaucaaagucgaggucg

SEQ ID NO: 1279698 - RNA, 15 nt, Mycobacterium tuberculosis H37Rv
gucgaccacgaccgu

SEQ ID NO: 1279699 - RNA, 17 nt, Mycobacterium tuberculosis H37Rv
gucgaccacgaccgucu

SEQ ID NO: 1279700 - RNA, 22 nt, Mycobacterium tuberculosis H37Rv
gucgaccacgacguucgacgac

SEQ ID NO: 1279701 - RNA, 14 nt, Mycobacterium tuberculosis H37Rv
guccguggacaagc

SEQ ID NO: 1279702 - RNA, 22 nt, Mycobacterium tuberculosis H37Rv
guccguucgaugccagugcauc

SEQ ID NO: 1279703 - RNA, 15 nt, Mycobacterium tuberculosis H37Rv
guccguggacaagca

SEQ ID NO: 1279704 - RNA, 19 nt, Mycobacterium tuberculosis H37Rv
guccgucgcguccgcgauc

SEQ ID NO: 1279705 - RNA, 20 nt, Mycobacterium tuberculosis H37Rv
guccgucggguagugcccac

SEQ ID NO: 1279706 - RNA, 18 nt, Mycobacterium tuberculosis H37Rv
guccgugccgaugccggc

SEQ ID NO: 1279707 - RNA, 18 nt, Mycobacterium tuberculosis H37Rv
guccguagcgcggccgau

SEQ ID NO: 1279708 - RNA, 23 nt, Mycobacterium tuberculosis H37Rv
guccgguguggcgcugaucggca

SEQ ID NO: 1279709 - RNA, 23 nt, Mycobacterium tuberculosis H37Rv
guccgguuacuuuuccaguguga

SEQ ID NO: 1279710 - RNA, 23 nt, Mycobacterium tuberculosis H37Rv
guccgguggaccgccgaucggcc

SEQ ID NO: 1279711 - RNA, 16 nt, Mycobacterium tuberculosis H37Rv
guccgguggacgcaga

SEQ ID NO: 1279712 - RNA, 16 nt, Mycobacterium tuberculosis H37Rv
guccggaucggucggc

SEQ ID NO: 1279713 - RNA, 17 nt, Mycobacterium tuberculosis H37Rv
guccggaagcggcguuc

SEQ ID NO: 1279714 - RNA, 19 nt, Mycobacterium tuberculosis H37Rv
guccggcauaccgaacagc

SEQ ID NO: 1279715 - RNA, 19 nt, Mycobacterium tuberculosis H37Rv
guccggcccaccagcgcag

SEQ ID NO: 1279716 - RNA, 15 nt, Mycobacterium tuberculosis H37Rv
guccggcccaccagc

SEQ ID NO: 1279717 - RNA, 19 nt, Mycobacterium tuberculosis H37Rv
guccgcggucgcagcagac

SEQ ID NO: 1279718 - RNA, 15 nt, Mycobacterium tuberculosis H37Rv
guccgcuacggcguc

SEQ ID NO: 1279719 - RNA, 14 nt, Mycobacterium tuberculosis H37Rv
guccgccggugccg

SEQ ID NO: 1279720 - RNA, 16 nt, Mycobacterium tuberculosis H37Rv
guccgccguugccgau

SEQ ID NO: 1279721 - RNA, 18 nt, Mycobacterium tuberculosis H37Rv
guccgccgucgaccacga

SEQ ID NO: 1279722 - RNA, 15 nt, Mycobacterium tuberculosis H37Rv
guccgcggaucacca

SEQ ID NO: 1279723 - RNA, 12 nt, Mycobacterium tuberculosis H37Rv
guccgccgcaga

SEQ ID NO: 1279724 - RNA, 14 nt, Mycobacterium tuberculosis H37Rv
guccgccgcagcgc

SEQ ID NO: 1279725 - RNA, 21 nt, Mycobacterium tuberculosis H37Rv
guccgacgcaccaacgcgauc

SEQ ID NO: 1279726 - RNA, 20 nt, Mycobacterium tuberculosis H37Rv
guccgacaccacggaccagc

SEQ ID NO: 1279727 - RNA, 16 nt, Mycobacterium tuberculosis H37Rv
gucccgggcaccgucg

SEQ ID NO: 1279728 - RNA, 19 nt, Mycobacterium tuberculosis H37Rv
guccgacaccggcggcauc

SEQ ID NO: 1279729 - RNA, 20 nt, Mycobacterium tuberculosis H37Rv
gucauccgacaagcugucgg

SEQ ID NO: 1279730 - RNA, 14 nt, Mycobacterium tuberculosis H37Rv
gucauccggccguc

SEQ ID NO: 1279731 - RNA, 16 nt, Mycobacterium tuberculosis H37Rv
gucaucgccagcggca

SEQ ID NO: 1279732 - RNA, 13 nt, Mycobacterium tuberculosis H37Rv
gucaucgccagcg

SEQ ID NO: 1279733 - RNA, 21 nt, Mycobacterium tuberculosis H37Rv
gucaucgcggugugccggucu

SEQ ID NO: 1279734 - RNA, 21 nt, Mycobacterium tuberculosis H37Rv
guccagugcauucccgccuuc

SEQ ID NO: 1279735 - RNA, 15 nt, Mycobacterium tuberculosis H37Rv
gucccgccgcaccgc

SEQ ID NO: 1279736 - RNA, 16 nt, Mycobacterium tuberculosis H37Rv
gucccgccgccuggaa

SEQ ID NO: 1279737 - RNA, 19 nt, Mycobacterium tuberculosis H37Rv
gucccgcaaaaucgucagc

SEQ ID NO: 1279738 - RNA, 21 nt, Mycobacterium tuberculosis H37Rv
gucccgccguugccgccguca

SEQ ID NO: 1279739 - RNA, 18 nt, Mycobacterium tuberculosis H37Rv
gucccggcucgagcucgg

SEQ ID NO: 1279740 - RNA, 12 nt, Mycobacterium tuberculosis H37Rv
gucccaucgcgu

SEQ ID NO: 1279741 - RNA, 17 nt, Mycobacterium tuberculosis H37Rv
guccccagcgccaccgu

SEQ ID NO: 1279742 - RNA, 18 nt, Mycobacterium tuberculosis H37Rv
guaucaaccggccgguga

SEQ ID NO: 1279743 - RNA, 21 nt, Mycobacterium tuberculosis H37Rv
guaucacgguugccgcgaucg

SEQ ID NO: 1279744 - RNA, 19 nt, Mycobacterium tuberculosis H37Rv
guaucacgguugccgcgau

SEQ ID NO: 1279745 - RNA, 15 nt, Mycobacterium tuberculosis H37Rv
guaguggccggcuuc

SEQ ID NO: 1279746 - RNA, 18 nt, Mycobacterium tuberculosis H37Rv
guaguggaagccgaccac

SEQ ID NO: 1279747 - RNA, 18 nt, Mycobacterium tuberculosis H37Rv
guagucggcgccgagauc

SEQ ID NO: 1279748 - RNA, 14 nt, Mycobacterium tuberculosis H37Rv
guagucggcgcguc

SEQ ID NO: 1279749 - RNA, 16 nt, Mycobacterium tuberculosis H37Rv
aagucguaaucggcaa

SEQ ID NO: 1279750 - RNA, 15 nt, Mycobacterium tuberculosis H37Rv
guagguugccaugcc

SEQ ID NO: 1279751 - RNA, 21 nt, Mycobacterium tuberculosis H37Rv
guagucgauuggcugcgccga

SEQ ID NO: 1279752 - RNA, 13 nt, Mycobacterium tuberculosis H37Rv
guaguccgcaucc

SEQ ID NO: 1279753 - RNA, 14 nt, Mycobacterium tuberculosis H37Rv
guaguccugcgggc

SEQ ID NO: 1279754 - RNA, 19 nt, Mycobacterium tuberculosis H37Rv
guagcuucgaugggcauca

SEQ ID NO: 1279755 - RNA, 12 nt, Mycobacterium tuberculosis H37Rv
guagcugcgcag

SEQ ID NO: 1279756 - RNA, 20 nt, Mycobacterium tuberculosis H37Rv
guagcuccuugagcaaugac

SEQ ID NO: 1279757 - RNA, 13 nt, Mycobacterium tuberculosis H37Rv
aaguaucgcagca

SEQ ID NO: 1279758 - RNA, 19 nt, Mycobacterium tuberculosis H37Rv
guaggaacuacccgccagc

SEQ ID NO: 1279759 - RNA, 20 nt, Mycobacterium tuberculosis H37Rv
guaggaacuacccgccagca

SEQ ID NO: 1279760 - RNA, 22 nt, Mycobacterium tuberculosis H37Rv
aagucaaucgcgucaucaacgu

SEQ ID NO: 1279761 - RNA, 12 nt, Mycobacterium tuberculosis H37Rv
aagucagcucga

SEQ ID NO: 1279762 - RNA, 14 nt, Mycobacterium tuberculosis H37Rv
aagucgaucgccga

SEQ ID NO: 1279763 - RNA, 19 nt, Mycobacterium tuberculosis H37Rv
aagucgcggacgucgcccc

SEQ ID NO: 1279764 - RNA, 14 nt, Mycobacterium tuberculosis H37Rv
guagcgccucguga

SEQ ID NO: 1279765 - RNA, 13 nt, Mycobacterium tuberculosis H37Rv
guagcgccccgau

SEQ ID NO: 1279766 - RNA, 20 nt, Mycobacterium tuberculosis H37Rv
guagcgauuccaggauggcc

SEQ ID NO: 1279767 - RNA, 23 nt, Mycobacterium tuberculosis H37Rv
guagcgaccgcggucgcugcgau

SEQ ID NO: 1279768 - RNA, 15 nt, Mycobacterium tuberculosis H37Rv
guagccugaccagcc

SEQ ID NO: 1279769 - RNA, 16 nt, Mycobacterium tuberculosis H37Rv
guagccgucgucgucg

SEQ ID NO: 1279770 - RNA, 14 nt, Mycobacterium tuberculosis H37Rv
guagccggugaccg

SEQ ID NO: 1279771 - RNA, 13 nt, Mycobacterium tuberculosis H37Rv
guagccaaccgug

SEQ ID NO: 1279772 - RNA, 19 nt, Mycobacterium tuberculosis H37Rv
guagcacuucagcuucggu

SEQ ID NO: 1279773 - RNA, 14 nt, Mycobacterium tuberculosis H37Rv
guagcagcgccagc

SEQ ID NO: 1279774 - RNA, 13 nt, Mycobacterium tuberculosis H37Rv
guagcagcgcggc

SEQ ID NO: 1279775 - RNA, 13 nt, Mycobacterium tuberculosis H37Rv
guacuugccaccc

SEQ ID NO: 1279776 - RNA, 18 nt, Mycobacterium tuberculosis H37Rv
guacuucgcuggaaaccu

SEQ ID NO: 1279777 - RNA, 15 nt, Mycobacterium tuberculosis H37Rv
guacugagccgcgaa

SEQ ID NO: 1279778 - RNA, 23 nt, Mycobacterium tuberculosis H37Rv
guacggugggugguuguccacgg

SEQ ID NO: 1279779 - RNA, 15 nt, Mycobacterium tuberculosis H37Rv
guagcaccacaucgg

SEQ ID NO: 1279780 - RNA, 17 nt, Mycobacterium tuberculosis H37Rv
guagacggcacccccga

SEQ ID NO: 1279781 - RNA, 17 nt, Mycobacterium tuberculosis H37Rv
guagacgguuaccgcga

SEQ ID NO: 1279782 - RNA, 21 nt, Mycobacterium tuberculosis H37Rv
guagaccuucucgccgccgcu

SEQ ID NO: 1279783 - RNA, 20 nt, Mycobacterium tuberculosis H37Rv
guagacgacgucggccgcau

SEQ ID NO: 1279784 - RNA, 22 nt, Mycobacterium tuberculosis H37Rv
guagaccuccagugcggccuug

SEQ ID NO: 1279785 - RNA, 23 nt, Mycobacterium tuberculosis H37Rv
guagacccacaucaggucggcga

SEQ ID NO: 1279786 - RNA, 19 nt, Mycobacterium tuberculosis H37Rv
guagacccacaucaggucg

SEQ ID NO: 1279787 - RNA, 22 nt, Mycobacterium tuberculosis H37Rv
guaccgucaucgcggugugccg

SEQ ID NO: 1279788 - RNA, 15 nt, Mycobacterium tuberculosis H37Rv
guaccucaucgcaga

SEQ ID NO: 1279789 - RNA, 16 nt, Mycobacterium tuberculosis H37Rv
guaccuagccgcagau

SEQ ID NO: 1279790 - RNA, 16 nt, Mycobacterium tuberculosis H37Rv
guaccuaggaguggua

SEQ ID NO: 1279791 - RNA, 17 nt, Mycobacterium tuberculosis H37Rv
guaccccaacgaccggc

SEQ ID NO: 1279792 - RNA, 13 nt, Mycobacterium tuberculosis H37Rv
guaccaucaccgc

SEQ ID NO: 1279793 - RNA, 16 nt, Mycobacterium tuberculosis H37Rv
guacccgaucacucgg

SEQ ID NO: 1279794 - RNA, 13 nt, Mycobacterium tuberculosis H37Rv
guacccgaucagc

SEQ ID NO: 1279795 - RNA, 18 nt, Mycobacterium tuberculosis H37Rv
guacccgaucagcgacgc

SEQ ID NO: 1279796 - RNA, 15 nt, Mycobacterium tuberculosis H37Rv
guacccggcgacguu

SEQ ID NO: 1279797 - RNA, 16 nt, Mycobacterium tuberculosis H37Rv
guacccggcgacguuc

SEQ ID NO: 1279798 - RNA, 21 nt, Mycobacterium tuberculosis H37Rv
guacccgccucgggccggcgu

SEQ ID NO: 1279799 - RNA, 14 nt, Mycobacterium tuberculosis H37Rv
guaccuuggcgucg

SEQ ID NO: 1279800 - RNA, 16 nt, Mycobacterium tuberculosis H37Rv
guacggcgguccggau

SEQ ID NO: 1279801 - RNA, 12 nt, Mycobacterium tuberculosis H37Rv
guacgggugauc

SEQ ID NO: 1279802 - RNA, 23 nt, Mycobacterium tuberculosis H37Rv
guacggggucgccggcaccggau

SEQ ID NO: 1279803 - RNA, 15 nt, Mycobacterium tuberculosis H37Rv
guacaagucgaccau

SEQ ID NO: 1279804 - RNA, 22 nt, Mycobacterium tuberculosis H37Rv
guacaagucgaccaugagccgg

SEQ ID NO: 1279805 - RNA, 22 nt, Mycobacterium tuberculosis H37Rv
guacaaccacccacccgcacca

SEQ ID NO: 1279806 - RNA, 18 nt, Mycobacterium tuberculosis H37Rv
guacaccgcgcccgccga

SEQ ID NO: 1279807 - RNA, 14 nt, Mycobacterium tuberculosis H37Rv
gguggccaccacgg

SEQ ID NO: 1279808 - RNA, 14 nt, Mycobacterium tuberculosis H37Rv
gguggccaucgcgc

SEQ ID NO: 1279809 - RNA, 13 nt, Mycobacterium tuberculosis H37Rv
gguggccaucgcg

SEQ ID NO: 1279810 - RNA, 14 nt, Mycobacterium tuberculosis H37Rv
gguggccaucaccg

SEQ ID NO: 1279811 - RNA, 21 nt, Mycobacterium tuberculosis H37Rv
gguggcccgccggcagugagu

SEQ ID NO: 1279812 - RNA, 15 nt, Mycobacterium tuberculosis H37Rv
gguggccaucgcgcg

SEQ ID NO: 1279813 - RNA, 19 nt, Mycobacterium tuberculosis H37Rv
gguggcccgccggcaacau

SEQ ID NO: 1279814 - RNA, 13 nt, Mycobacterium tuberculosis H37Rv
gguggcccgggga

SEQ ID NO: 1279815 - RNA, 12 nt, Mycobacterium tuberculosis H37Rv
gguggccgacga

SEQ ID NO: 1279816 - RNA, 13 nt, Mycobacterium tuberculosis H37Rv
guaaagccgcgga

SEQ ID NO: 1279817 - RNA, 21 nt, Mycobacterium tuberculosis H37Rv
guaaaagccgaugacgguccc

SEQ ID NO: 1279818 - RNA, 21 nt, Mycobacterium tuberculosis H37Rv
guaaggcuugucagccgcgac

SEQ ID NO: 1279819 - RNA, 18 nt, Mycobacterium tuberculosis H37Rv
guaagcgguuguccgguc

SEQ ID NO: 1279820 - RNA, 17 nt, Mycobacterium tuberculosis H37Rv
guaagcgaacagcggca

SEQ ID NO: 1279821 - RNA, 17 nt, Mycobacterium tuberculosis H37Rv
gucagcaguucggcgau

SEQ ID NO: 1279822 - RNA, 13 nt, Mycobacterium tuberculosis H37Rv
gucagcagcgccg

SEQ ID NO: 1279823 - RNA, 21 nt, Mycobacterium tuberculosis H37Rv
gucagcagaauccugcgcugc

SEQ ID NO: 1279824 - RNA, 20 nt, Mycobacterium tuberculosis H37Rv
gucagcgacuugcggugcuc

SEQ ID NO: 1279825 - RNA, 15 nt, Mycobacterium tuberculosis H37Rv
gucagcgaacggcca

SEQ ID NO: 1279826 - RNA, 13 nt, Mycobacterium tuberculosis H37Rv
gucagccggugac

SEQ ID NO: 1279827 - RNA, 19 nt, Mycobacterium tuberculosis H37Rv
gucagccggaccaccaggu

SEQ ID NO: 1279828 - RNA, 16 nt, Mycobacterium tuberculosis H37Rv
gucagcucccggcuuc

SEQ ID NO: 1279829 - RNA, 19 nt, Mycobacterium tuberculosis H37Rv
gucagcgcgcggcucgggu

SEQ ID NO: 1279830 - RNA, 14 nt, Mycobacterium tuberculosis H37Rv
gucagcgcgcacga

SEQ ID NO: 1279831 - RNA, 15 nt, Mycobacterium tuberculosis H37Rv
gucagcgcggcgacc

SEQ ID NO: 1279832 - RNA, 17 nt, Mycobacterium tuberculosis H37Rv
gucaggccagggugacc

SEQ ID NO: 1279833 - RNA, 16 nt, Mycobacterium tuberculosis H37Rv
gucauaucucgagccc

SEQ ID NO: 1279834 - RNA, 16 nt, Mycobacterium tuberculosis H37Rv
gucauaucgacgggcc

SEQ ID NO: 1279835 - RNA, 21 nt, Mycobacterium tuberculosis H37Rv
gucaggcggcggacccgcucg

SEQ ID NO: 1279836 - RNA, 17 nt, Mycobacterium tuberculosis H37Rv
gucauacucgacaccga

SEQ ID NO: 1279837 - RNA, 16 nt, Mycobacterium tuberculosis H37Rv
gucaccuugaccgggu

SEQ ID NO: 1279838 - RNA, 19 nt, Mycobacterium tuberculosis H37Rv
gucacgaagaccaggccgg

SEQ ID NO: 1279839 - RNA, 13 nt, Mycobacterium tuberculosis H37Rv
gucacgaucacga

SEQ ID NO: 1279840 - RNA, 13 nt, Mycobacterium tuberculosis H37Rv
gucaccugcgggc

SEQ ID NO: 1279841 - RNA, 14 nt, Mycobacterium tuberculosis H37Rv
gucaccggucggcc

SEQ ID NO: 1279842 - RNA, 20 nt, Mycobacterium tuberculosis H37Rv
gucaccgucuugcacgucca

SEQ ID NO: 1279843 - RNA, 23 nt, Mycobacterium tuberculosis H37Rv
gucaccgucuugcacguccaagc

SEQ ID NO: 1279844 - RNA, 15 nt, Mycobacterium tuberculosis H37Rv
gucaccguuggccgc

SEQ ID NO: 1279845 - RNA, 13 nt, Mycobacterium tuberculosis H37Rv
gucaccucaccga

SEQ ID NO: 1279846 - RNA, 20 nt, Mycobacterium tuberculosis H37Rv
gucacgcagccgcgcgguga

SEQ ID NO: 1279847 - RNA, 20 nt, Mycobacterium tuberculosis H37Rv
gucacgcacucccgagccac

SEQ ID NO: 1279848 - RNA, 22 nt, Mycobacterium tuberculosis H37Rv
gucacgaucgugccgggaccgg

SEQ ID NO: 1279849 - RNA, 13 nt, Mycobacterium tuberculosis H37Rv
gucacgcgaggcg

SEQ ID NO: 1279850 - RNA, 17 nt, Mycobacterium tuberculosis H37Rv
gucacguggucggccac

SEQ ID NO: 1279851 - RNA, 20 nt, Mycobacterium tuberculosis H37Rv
gucacucccuggccgcuucg

SEQ ID NO: 1279852 - RNA, 17 nt, Mycobacterium tuberculosis H37Rv
gucacgguggugucagc

SEQ ID NO: 1279853 - RNA, 18 nt, Mycobacterium tuberculosis H37Rv
gucacggugcguucgugc

SEQ ID NO: 1279854 - RNA, 13 nt, Mycobacterium tuberculosis H37Rv
gucacggacccuu

SEQ ID NO: 1279855 - RNA, 19 nt, Mycobacterium tuberculosis H37Rv
gucacggucguggugcaac

SEQ ID NO: 1279856 - RNA, 18 nt, Mycobacterium tuberculosis H37Rv
gucacgggguccgaugcg

SEQ ID NO: 1279857 - RNA, 16 nt, Mycobacterium tuberculosis H37Rv
gucagauguuguacgg

SEQ ID NO: 1279858 - RNA, 14 nt, Mycobacterium tuberculosis H37Rv
gucacucuggcgag

SEQ ID NO: 1279859 - RNA, 18 nt, Mycobacterium tuberculosis H37Rv
gucagaaaaagccgcgua

SEQ ID NO: 1279860 - RNA, 14 nt, Mycobacterium tuberculosis H37Rv
guauucguggucgg

SEQ ID NO: 1279861 - RNA, 23 nt, Mycobacterium tuberculosis H37Rv
guauugcaccgcggccagcacca

SEQ ID NO: 1279862 - RNA, 14 nt, Mycobacterium tuberculosis H37Rv
guauucggcaucgc

SEQ ID NO: 1279863 - RNA, 13 nt, Mycobacterium tuberculosis H37Rv
gucaaaauccgcg

SEQ ID NO: 1279864 - RNA, 14 nt, Mycobacterium tuberculosis H37Rv
gucaaacgcaaaga

SEQ ID NO: 1279865 - RNA, 23 nt, Mycobacterium tuberculosis H37Rv
gucaaagaauucguucagcgcca

SEQ ID NO: 1279866 - RNA, 19 nt, Mycobacterium tuberculosis H37Rv
guauccacggucgaccagg

SEQ ID NO: 1279867 - RNA, 13 nt, Mycobacterium tuberculosis H37Rv
guaucgucccggc

SEQ ID NO: 1279868 - RNA, 23 nt, Mycobacterium tuberculosis H37Rv
guaucggggggucuugccgagca

SEQ ID NO: 1279869 - RNA, 19 nt, Mycobacterium tuberculosis H37Rv
guaucggcgugucucgucg

SEQ ID NO: 1279870 - RNA, 24 nt, Mycobacterium tuberculosis H37Rv
guaucggggggucuugccgagcaa

SEQ ID NO: 1279871 - RNA, 20 nt, Mycobacterium tuberculosis H37Rv
guaucggugcuggucgccgc

SEQ ID NO: 1279872 - RNA, 15 nt, Mycobacterium tuberculosis H37Rv
guaucggucagccac

SEQ ID NO: 1279873 - RNA, 19 nt, Mycobacterium tuberculosis H37Rv
guaugcguuacgccgcgag

SEQ ID NO: 1279874 - RNA, 13 nt, Mycobacterium tuberculosis H37Rv
guaugcggugacg

SEQ ID NO: 1279875 - RNA, 23 nt, Mycobacterium tuberculosis H37Rv
guaucuguuccuugugaccccgg

SEQ ID NO: 1279876 - RNA, 20 nt, Mycobacterium tuberculosis H37Rv
guaugcacaugaucccauga

SEQ ID NO: 1279877 - RNA, 16 nt, Mycobacterium tuberculosis H37Rv
guaugcccacgaaccg

SEQ ID NO: 1279878 - RNA, 19 nt, Mycobacterium tuberculosis H37Rv
guaugcgccaucucgacgg

SEQ ID NO: 1279879 - RNA, 17 nt, Mycobacterium tuberculosis H37Rv
guaugcccggauuggcg

SEQ ID NO: 1279880 - RNA, 21 nt, Mycobacterium tuberculosis H37Rv
gucaagaacgccacgacgucg

SEQ ID NO: 1279881 - RNA, 17 nt, Mycobacterium tuberculosis H37Rv
gucaagcaaguccaccg

SEQ ID NO: 1279882 - RNA, 14 nt, Mycobacterium tuberculosis H37Rv
gucaagaucagcgg

SEQ ID NO: 1279883 - RNA, 12 nt, Mycobacterium tuberculosis H37Rv
gucaacgacgac

SEQ ID NO: 1279884 - RNA, 12 nt, Mycobacterium tuberculosis H37Rv
gucaacgauggu

SEQ ID NO: 1279885 - RNA, 15 nt, Mycobacterium tuberculosis H37Rv
gucaacgcaaucgac

SEQ ID NO: 1279886 - RNA, 16 nt, Mycobacterium tuberculosis H37Rv
gucaacgcaaucgacu

SEQ ID NO: 1279887 - RNA, 17 nt, Mycobacterium tuberculosis H37Rv
gucaacgccacgccgau

SEQ ID NO: 1279888 - RNA, 16 nt, Mycobacterium tuberculosis H37Rv
gucaacgacgacgaca

SEQ ID NO: 1279889 - RNA, 14 nt, Mycobacterium tuberculosis H37Rv
gucaacgcugacgu

SEQ ID NO: 1279890 - RNA, 14 nt, Mycobacterium tuberculosis H37Rv
gucaacagcggcaa

SEQ ID NO: 1279891 - RNA, 21 nt, Mycobacterium tuberculosis H37Rv
gucaacauuucugagacacga

SEQ ID NO: 1279892 - RNA, 12 nt, Mycobacterium tuberculosis H37Rv
gucaaccgaucg

SEQ ID NO: 1279893 - RNA, 19 nt, Mycobacterium tuberculosis H37Rv
gucaaccugcgcaucacca

SEQ ID NO: 1279894 - RNA, 20 nt, Mycobacterium tuberculosis H37Rv
gucaaguggcaaccgcaccg

SEQ ID NO: 1279895 - RNA, 18 nt, Mycobacterium tuberculosis H37Rv
gucaagucuggcugagca

SEQ ID NO: 1279896 - RNA, 17 nt, Mycobacterium tuberculosis H37Rv
gucaaggucgucgugga

SEQ ID NO: 1279897 - RNA, 19 nt, Mycobacterium tuberculosis H37Rv
gucaaucacccagccggaa

SEQ ID NO: 1279898 - RNA, 17 nt, Mycobacterium tuberculosis H37Rv
gucacaagcugacacga

SEQ ID NO: 1279899 - RNA, 20 nt, Mycobacterium tuberculosis H37Rv
gucacaagucgacacgccga

SEQ ID NO: 1279900 - RNA, 17 nt, Mycobacterium tuberculosis H37Rv
gucacaagccugccggc

SEQ ID NO: 1279901 - RNA, 22 nt, Mycobacterium tuberculosis H37Rv
gucacaccagcgggcaucgcga

SEQ ID NO: 1279902 - RNA, 18 nt, Mycobacterium tuberculosis H37Rv
gucacaccagcgggcauc

SEQ ID NO: 1279903 - RNA, 14 nt, Mycobacterium tuberculosis H37Rv
gucacaccgaugcg

SEQ ID NO: 1279904 - RNA, 17 nt, Mycobacterium tuberculosis H37Rv
gucaccgcgacggaacc

SEQ ID NO: 1279905 - RNA, 15 nt, Mycobacterium tuberculosis H37Rv
gucaccgcgcagcga

SEQ ID NO: 1279906 - RNA, 15 nt, Mycobacterium tuberculosis H37Rv
gucaccgcgaccagc

SEQ ID NO: 1279907 - RNA, 18 nt, Mycobacterium tuberculosis H37Rv
gucaccgccguugccgau

SEQ ID NO: 1279908 - RNA, 20 nt, Mycobacterium tuberculosis H37Rv
gucaccgccguugccaagca

SEQ ID NO: 1279909 - RNA, 14 nt, Mycobacterium tuberculosis H37Rv
gucaccgccggcac

SEQ ID NO: 1279910 - RNA, 18 nt, Mycobacterium tuberculosis H37Rv
gucaccgcgucaccggag

SEQ ID NO: 1279911 - RNA, 18 nt, Mycobacterium tuberculosis H37Rv
gucaccgaugcgccggac

SEQ ID NO: 1279912 - RNA, 15 nt, Mycobacterium tuberculosis H37Rv
gucaccgcaaccgag

SEQ ID NO: 1279913 - RNA, 23 nt, Mycobacterium tuberculosis H37Rv
gucaccgccgggaagccgcaucu

SEQ ID NO: 1279914 - RNA, 11 nt, Mycobacterium tuberculosis H37Rv
gucaccgccgg

SEQ ID NO: 1279915 - RNA, 21 nt, Mycobacterium tuberculosis H37Rv
gucaccagccaccgcgcguca

SEQ ID NO: 1279916 - RNA, 12 nt, Mycobacterium tuberculosis H37Rv
gucaccacgauc

SEQ ID NO: 1279917 - RNA, 18 nt, Mycobacterium tuberculosis H37Rv
gucaccaccuggugcaac

SEQ ID NO: 1279918 - RNA, 13 nt, Mycobacterium tuberculosis H37Rv
gucacccguaucg

SEQ ID NO: 1279919 - RNA, 13 nt, Mycobacterium tuberculosis H37Rv
gucacccgcccga

SEQ ID NO: 1279920 - RNA, 18 nt, Mycobacterium tuberculosis H37Rv
gucaccaggccgaaaucc

SEQ ID NO: 1279921 - RNA, 18 nt, Mycobacterium tuberculosis H37Rv
gcgcccugagccaccccg

SEQ ID NO: 1279922 - RNA, 15 nt, Mycobacterium tuberculosis H37Rv
gcgccgaacgccagc

SEQ ID NO: 1279923 - RNA, 13 nt, Mycobacterium tuberculosis H37Rv
gcgcccggcgugg

SEQ ID NO: 1279924 - RNA, 19 nt, Mycobacterium tuberculosis H37Rv
gcgcccgcgguccggcgaa

SEQ ID NO: 1279925 - RNA, 18 nt, Mycobacterium tuberculosis H37Rv
gcgccgaaguagccgacc

SEQ ID NO: 1279926 - RNA, 13 nt, Mycobacterium tuberculosis H37Rv
gcgccgaccaccg

SEQ ID NO: 1279927 - RNA, 22 nt, Mycobacterium tuberculosis H37Rv
gcgccgaaugccaccucgacgc

SEQ ID NO: 1279928 - RNA, 20 nt, Mycobacterium tuberculosis H37Rv
gcgccgagagcaccgcucgg

SEQ ID NO: 1279929 - RNA, 15 nt, Mycobacterium tuberculosis H37Rv
gcgccgacuccaguu

SEQ ID NO: 1279930 - RNA, 15 nt, Mycobacterium tuberculosis H37Rv
gcgccgcaaccgccg

SEQ ID NO: 1279931 - RNA, 17 nt, Mycobacterium tuberculosis H37Rv
gcgccgcaaugacgucg

SEQ ID NO: 1279932 - RNA, 20 nt, Mycobacterium tuberculosis H37Rv
gcgccgcaaucagacggcga

SEQ ID NO: 1279933 - RNA, 21 nt, Mycobacterium tuberculosis H37Rv
gcgccgcacacucucggugaa

SEQ ID NO: 1279934 - RNA, 16 nt, Mycobacterium tuberculosis H37Rv
gcgccgcaucggcgaa

SEQ ID NO: 1279935 - RNA, 14 nt, Mycobacterium tuberculosis H37Rv
gcgccgauggccgc

SEQ ID NO: 1279936 - RNA, 16 nt, Mycobacterium tuberculosis H37Rv
gcgccgaugccggcca

SEQ ID NO: 1279937 - RNA, 15 nt, Mycobacterium tuberculosis H37Rv
gcgccaugaagccgg

SEQ ID NO: 1279938 - RNA, 18 nt, Mycobacterium tuberculosis H37Rv
gcgccaggucggcggacg

SEQ ID NO: 1279939 - RNA, 22 nt, Mycobacterium tuberculosis H37Rv
gcgccaggucggugacgaagag

SEQ ID NO: 1279940 - RNA, 21 nt, Mycobacterium tuberculosis H37Rv
gcgccauggaucccacgaguu

SEQ ID NO: 1279941 - RNA, 18 nt, Mycobacterium tuberculosis H37Rv
gcgccaggcgcgaucgcg

SEQ ID NO: 1279942 - RNA, 17 nt, Mycobacterium tuberculosis H37Rv
gcgccaggggugugccg

SEQ ID NO: 1279943 - RNA, 12 nt, Mycobacterium tuberculosis H37Rv
gcgccaggccgc

SEQ ID NO: 1279944 - RNA, 17 nt, Mycobacterium tuberculosis H37Rv
gcgccaggccacguagc

SEQ ID NO: 1279945 - RNA, 13 nt, Mycobacterium tuberculosis H37Rv
gcgcccgccggca

SEQ ID NO: 1279946 - RNA, 12 nt, Mycobacterium tuberculosis H37Rv
gcgcccgccuca

SEQ ID NO: 1279947 - RNA, 17 nt, Mycobacterium tuberculosis H37Rv
gcgcccauggccaccag

SEQ ID NO: 1279948 - RNA, 13 nt, Mycobacterium tuberculosis H37Rv
gcgccccaccgcg

SEQ ID NO: 1279949 - RNA, 22 nt, Mycobacterium tuberculosis H37Rv
gcgccccaugcaacacaccgcg

SEQ ID NO: 1279950 - RNA, 22 nt, Mycobacterium tuberculosis H37Rv
gcgccccaguucgacggcguca

SEQ ID NO: 1279951 - RNA, 15 nt, Mycobacterium tuberculosis H37Rv
gcgcccagaucgccg

SEQ ID NO: 1279952 - RNA, 18 nt, Mycobacterium tuberculosis H37Rv
gcgccaauucagcggcaa

SEQ ID NO: 1279953 - RNA, 14 nt, Mycobacterium tuberculosis H37Rv
gcgccacgaugacc

SEQ ID NO: 1279954 - RNA, 20 nt, Mycobacterium tuberculosis H37Rv
gcgccacgcacccggcaauc

SEQ ID NO: 1279955 - RNA, 15 nt, Mycobacterium tuberculosis H37Rv
gcgccacggcagcgc

SEQ ID NO: 1279956 - RNA, 15 nt, Mycobacterium tuberculosis H37Rv
gcgccagcaacagcg

SEQ ID NO: 1279957 - RNA, 18 nt, Mycobacterium tuberculosis H37Rv
gcgccagcgauaucggcg

SEQ ID NO: 1279958 - RNA, 22 nt, Mycobacterium tuberculosis H37Rv
gcgccagcgauaucggcggcuu

SEQ ID NO: 1279959 - RNA, 16 nt, Mycobacterium tuberculosis H37Rv
gcgccagcgccugcgc

SEQ ID NO: 1279960 - RNA, 17 nt, Mycobacterium tuberculosis H37Rv
gcgccagcgccgccacc

SEQ ID NO: 1279961 - RNA, 13 nt, Mycobacterium tuberculosis H37Rv
gcgccagcgagca

SEQ ID NO: 1279962 - RNA, 15 nt, Mycobacterium tuberculosis H37Rv
gcgccagccuccacc

SEQ ID NO: 1279963 - RNA, 15 nt, Mycobacterium tuberculosis H37Rv
gcgccaacgggcugc

SEQ ID NO: 1279964 - RNA, 14 nt, Mycobacterium tuberculosis H37Rv
gcgcaucgagcacc

SEQ ID NO: 1279965 - RNA, 18 nt, Mycobacterium tuberculosis H37Rv
gcgcaugcaagucaaacg

SEQ ID NO: 1279966 - RNA, 18 nt, Mycobacterium tuberculosis H37Rv
gcgcaugccccgaccgcg

SEQ ID NO: 1279967 - RNA, 13 nt, Mycobacterium tuberculosis H37Rv
gcgcaucccgaag

SEQ ID NO: 1279968 - RNA, 12 nt, Mycobacterium tuberculosis H37Rv
gcgcaucgccaa

SEQ ID NO: 1279969 - RNA, 20 nt, Mycobacterium tuberculosis H37Rv
gcgcaucgccaccaucaccg

SEQ ID NO: 1279970 - RNA, 18 nt, Mycobacterium tuberculosis H37Rv
gcgcagguucucggugcc

SEQ ID NO: 1279971 - RNA, 18 nt, Mycobacterium tuberculosis H37Rv
gcgcaggugccuuucggc

SEQ ID NO: 1279972 - RNA, 16 nt, Mycobacterium tuberculosis H37Rv
gcgcagaacaccaccg

SEQ ID NO: 1279973 - RNA, 21 nt, Mycobacterium tuberculosis H37Rv
gcgcacucccggcucggccag

SEQ ID NO: 1279974 - RNA, 14 nt, Mycobacterium tuberculosis H37Rv
gcgcacucaccuug

SEQ ID NO: 1279975 - RNA, 17 nt, Mycobacterium tuberculosis H37Rv
gcgcacuugcguggcgu

SEQ ID NO: 1279976 - RNA, 22 nt, Mycobacterium tuberculosis H37Rv
gcgcagaaacgccgagcgccag

SEQ ID NO: 1279977 - RNA, 22 nt, Mycobacterium tuberculosis H37Rv
gcgcaguacuugaccguccacc

SEQ ID NO: 1279978 - RNA, 21 nt, Mycobacterium tuberculosis H37Rv
gcgcauaccuacccgagaacg

SEQ ID NO: 1279979 - RNA, 21 nt, Mycobacterium tuberculosis H37Rv
gcgcauccaauccacgguugc

SEQ ID NO: 1279980 - RNA, 18 nt, Mycobacterium tuberculosis H37Rv
gcgccucaucggacagcg

SEQ ID NO: 1279981 - RNA, 22 nt, Mycobacterium tuberculosis H37Rv
gcgccuaaccccggcucgacgc

SEQ ID NO: 1279982 - RNA, 16 nt, Mycobacterium tuberculosis H37Rv
gcgccguucgcucccc

SEQ ID NO: 1279983 - RNA, 15 nt, Mycobacterium tuberculosis H37Rv
gcgccguucgucgug

SEQ ID NO: 1279984 - RNA, 18 nt, Mycobacterium tuberculosis H37Rv
gcgccguucgucguggau

SEQ ID NO: 1279985 - RNA, 20 nt, Mycobacterium tuberculosis H37Rv
gcgccguggaucaucccgac

SEQ ID NO: 1279986 - RNA, 19 nt, Mycobacterium tuberculosis H37Rv
gcgccgucggagccggcca

SEQ ID NO: 1279987 - RNA, 19 nt, Mycobacterium tuberculosis H37Rv
gcgccgucggccgagucga

SEQ ID NO: 1279988 - RNA, 13 nt, Mycobacterium tuberculosis H37Rv
gcgccgucggcga

SEQ ID NO: 1279989 - RNA, 15 nt, Mycobacterium tuberculosis H37Rv
gcgccgucgcccagc

SEQ ID NO: 1279990 - RNA, 18 nt, Mycobacterium tuberculosis H37Rv
gcgccggucggaucggug

SEQ ID NO: 1279991 - RNA, 20 nt, Mycobacterium tuberculosis H37Rv
gcgccggucggaucggugau

SEQ ID NO: 1279992 - RNA, 14 nt, Mycobacterium tuberculosis H37Rv
gcgccggucgccug

SEQ ID NO: 1279993 - RNA, 21 nt, Mycobacterium tuberculosis H37Rv
gcgccgguccucgucggcgaa

SEQ ID NO: 1279994 - RNA, 14 nt, Mycobacterium tuberculosis H37Rv
gcgccggcugccac

SEQ ID NO: 1279995 - RNA, 23 nt, Mycobacterium tuberculosis H37Rv
gcgccggacaaaccgggcggcca

SEQ ID NO: 1279996 - RNA, 19 nt, Mycobacterium tuberculosis H37Rv
gcgccggcgacaccgcacc

SEQ ID NO: 1279997 - RNA, 23 nt, Mycobacterium tuberculosis H37Rv
gcgccggccauaccgcucgccgu

SEQ ID NO: 1279998 - RNA, 14 nt, Mycobacterium tuberculosis H37Rv
gcgccggacagcgc

SEQ ID NO: 1279999 - RNA, 17 nt, Mycobacterium tuberculosis H37Rv
gcgccggcaucuccacc

SEQ ID NO: 1280000 - RNA, 15 nt, Mycobacterium tuberculosis H37Rv
gcgccggcaucgcgc

SEQ ID NO: 1280001 - RNA, 13 nt, Mycobacterium tuberculosis H37Rv
gcgccggacagcg

SEQ ID NO: 1280002 - RNA, 19 nt, Mycobacterium tuberculosis H37Rv
gcgccgcugggugaccagg

SEQ ID NO: 1280003 - RNA, 23 nt, Mycobacterium tuberculosis H37Rv
gcgccgcggugacgggaucgucg

SEQ ID NO: 1280004 - RNA, 21 nt, Mycobacterium tuberculosis H37Rv
gcgccgcuaggugacgccgcc

SEQ ID NO: 1280005 - RNA, 12 nt, Mycobacterium tuberculosis H37Rv
gcgccgccagcg

SEQ ID NO: 1280006 - RNA, 17 nt, Mycobacterium tuberculosis H37Rv
gcgccgccagcaccacc

SEQ ID NO: 1280007 - RNA, 22 nt, Mycobacterium tuberculosis H37Rv
gcgccgccaacuccucagccgc

SEQ ID NO: 1280008 - RNA, 20 nt, Mycobacterium tuberculosis H37Rv
gcgcgaagccaccaggucga

SEQ ID NO: 1280009 - RNA, 14 nt, Mycobacterium tuberculosis H37Rv
gcgcgaaagcgccg

SEQ ID NO: 1280010 - RNA, 18 nt, Mycobacterium tuberculosis H37Rv
gcgcgaaacgccgcaaug

SEQ ID NO: 1280011 - RNA, 20 nt, Mycobacterium tuberculosis H37Rv
gcgcgaaccggcccggucca

SEQ ID NO: 1280012 - RNA, 22 nt, Mycobacterium tuberculosis H37Rv
gcgcgaaccggcccgguccagc

SEQ ID NO: 1280013 - RNA, 15 nt, Mycobacterium tuberculosis H37Rv
gcgcgaaagcgccga

SEQ ID NO: 1280014 - RNA, 16 nt, Mycobacterium tuberculosis H37Rv
gcgccuuggucgccgg

SEQ ID NO: 1280015 - RNA, 14 nt, Mycobacterium tuberculosis H37Rv
gcgcgaaacgccgc

SEQ ID NO: 1280016 - RNA, 20 nt, Mycobacterium tuberculosis H37Rv
gcgcgaaaccaguccaucga

SEQ ID NO: 1280017 - RNA, 22 nt, Mycobacterium tuberculosis H37Rv
gcgccuuggucgccgccuucuu

SEQ ID NO: 1280018 - RNA, 22 nt, Mycobacterium tuberculosis H37Rv
gcgccuuggucgccgcuuucuu

SEQ ID NO: 1280019 - RNA, 18 nt, Mycobacterium tuberculosis H37Rv
gcgccuuggccagcgcgu

SEQ ID NO: 1280020 - RNA, 13 nt, Mycobacterium tuberculosis H37Rv
gcgcgaucaacgc

SEQ ID NO: 1280021 - RNA, 18 nt, Mycobacterium tuberculosis H37Rv
gcgcgaugaccucggcga

SEQ ID NO: 1280022 - RNA, 12 nt, Mycobacterium tuberculosis H37Rv
gcgcgaugccca

SEQ ID NO: 1280023 - RNA, 13 nt, Mycobacterium tuberculosis H37Rv
gcgcgcaccgggu

SEQ ID NO: 1280024 - RNA, 20 nt, Mycobacterium tuberculosis H37Rv
gcgcgaugucguucgcguca

SEQ ID NO: 1280025 - RNA, 18 nt, Mycobacterium tuberculosis H37Rv
gcgcgauggcagcgccga

SEQ ID NO: 1280026 - RNA, 16 nt, Mycobacterium tuberculosis H37Rv
gcgcgaugcuggcgaa

SEQ ID NO: 1280027 - RNA, 16 nt, Mycobacterium tuberculosis H37Rv
gcgcgauggacccaag

SEQ ID NO: 1280028 - RNA, 14 nt, Mycobacterium tuberculosis H37Rv
gcgcgaggucggcg

SEQ ID NO: 1280029 - RNA, 18 nt, Mycobacterium tuberculosis H37Rv
gcgcgaggggccggcuca

SEQ ID NO: 1280030 - RNA, 19 nt, Mycobacterium tuberculosis H37Rv
gcgcgaccuccgcgaucac

SEQ ID NO: 1280031 - RNA, 22 nt, Mycobacterium tuberculosis H37Rv
gcgcgaccuccgcgaucaccga

SEQ ID NO: 1280032 - RNA, 12 nt, Mycobacterium tuberculosis H37Rv
gcgcgaccauga

SEQ ID NO: 1280033 - RNA, 18 nt, Mycobacterium tuberculosis H37Rv
gcgcgaccaaugcguuga

SEQ ID NO: 1280034 - RNA, 16 nt, Mycobacterium tuberculosis H37Rv
gcgcgacaggcccugg

SEQ ID NO: 1280035 - RNA, 20 nt, Mycobacterium tuberculosis H37Rv
gcgccugugccaccgcugga

SEQ ID NO: 1280036 - RNA, 16 nt, Mycobacterium tuberculosis H37Rv
gcgccuucgccagcgg

SEQ ID NO: 1280037 - RNA, 23 nt, Mycobacterium tuberculosis H37Rv
gcgccuucacgcuggccuccagc

SEQ ID NO: 1280038 - RNA, 17 nt, Mycobacterium tuberculosis H37Rv
gcgccuugaccagcagc

SEQ ID NO: 1280039 - RNA, 13 nt, Mycobacterium tuberculosis H37Rv
gcgccuugaccac

SEQ ID NO: 1280040 - RNA, 19 nt, Mycobacterium tuberculosis H37Rv
gcgccugacucaucaccga

SEQ ID NO: 1280041 - RNA, 16 nt, Mycobacterium tuberculosis H37Rv
gcgccugaauaggucg

SEQ ID NO: 1280042 - RNA, 15 nt, Mycobacterium tuberculosis H37Rv
gcgccucgugcgugg

SEQ ID NO: 1280043 - RNA, 13 nt, Mycobacterium tuberculosis H37Rv
gcgccucggugag

SEQ ID NO: 1280044 - RNA, 22 nt, Mycobacterium tuberculosis H37Rv
gcgccucggaccagacccacga

SEQ ID NO: 1280045 - RNA, 16 nt, Mycobacterium tuberculosis H37Rv
gcgacauacccgauca

SEQ ID NO: 1280046 - RNA, 20 nt, Mycobacterium tuberculosis H37Rv
gcgaccaccaccgccgccga

SEQ ID NO: 1280047 - RNA, 21 nt, Mycobacterium tuberculosis H37Rv
gcgacaucaccaccgaccugg

SEQ ID NO: 1280048 - RNA, 12 nt, Mycobacterium tuberculosis H37Rv
gcgacaucaccg

SEQ ID NO: 1280049 - RNA, 13 nt, Mycobacterium tuberculosis H37Rv
gcgaccaccaccg

SEQ ID NO: 1280050 - RNA, 14 nt, Mycobacterium tuberculosis H37Rv
gcgaccaccaccgc

SEQ ID NO: 1280051 - RNA, 22 nt, Mycobacterium tuberculosis H37Rv
gcgaccaaugcguugacgucga

SEQ ID NO: 1280052 - RNA, 17 nt, Mycobacterium tuberculosis H37Rv
gcgaccacgucggcgaa

SEQ ID NO: 1280053 - RNA, 23 nt, Mycobacterium tuberculosis H37Rv
gcgaccacggcaccgaucaacgg

SEQ ID NO: 1280054 - RNA, 16 nt, Mycobacterium tuberculosis H37Rv
gcgacaucaccaccga

SEQ ID NO: 1280055 - RNA, 20 nt, Mycobacterium tuberculosis H37Rv
aagccgaccguaccgaucca

SEQ ID NO: 1280056 - RNA, 17 nt, Mycobacterium tuberculosis H37Rv
aagccgaccuucucggc

SEQ ID NO: 1280057 - RNA, 16 nt, Mycobacterium tuberculosis H37Rv
gcgaccacggcaccga

SEQ ID NO: 1280058 - RNA, 11 nt, Mycobacterium tuberculosis H37Rv
gcgaccagcgc

SEQ ID NO: 1280059 - RNA, 21 nt, Mycobacterium tuberculosis H37Rv
gcgacacauagugcggcaccg

SEQ ID NO: 1280060 - RNA, 12 nt, Mycobacterium tuberculosis H37Rv
gcgacacaucgc

SEQ ID NO: 1280061 - RNA, 14 nt, Mycobacterium tuberculosis H37Rv
gcgacacaucgccc

SEQ ID NO: 1280062 - RNA, 20 nt, Mycobacterium tuberculosis H37Rv
gcgacacaacgggugucggc

SEQ ID NO: 1280063 - RNA, 21 nt, Mycobacterium tuberculosis H37Rv
gcgacacacgccgccgguguc

SEQ ID NO: 1280064 - RNA, 15 nt, Mycobacterium tuberculosis H37Rv
gcgacaccgcaccga

SEQ ID NO: 1280065 - RNA, 12 nt, Mycobacterium tuberculosis H37Rv
gcgacaggccga

SEQ ID NO: 1280066 - RNA, 13 nt, Mycobacterium tuberculosis H37Rv
gcgacaggccgag

SEQ ID NO: 1280067 - RNA, 18 nt, Mycobacterium tuberculosis H37Rv
gcgacaggacgucggcga

SEQ ID NO: 1280068 - RNA, 18 nt, Mycobacterium tuberculosis H37Rv
gcgacaaggucgucgacu

SEQ ID NO: 1280069 - RNA, 14 nt, Mycobacterium tuberculosis H37Rv
gcgaccgaugaucg

SEQ ID NO: 1280070 - RNA, 18 nt, Mycobacterium tuberculosis H37Rv
gcgaccgaugaucucacc

SEQ ID NO: 1280071 - RNA, 17 nt, Mycobacterium tuberculosis H37Rv
gcgacccgaucgcgcca

SEQ ID NO: 1280072 - RNA, 12 nt, Mycobacterium tuberculosis H37Rv
gcgaccgcaucu

SEQ ID NO: 1280073 - RNA, 23 nt, Mycobacterium tuberculosis H37Rv
gcgacccccagcgcccgccggca

SEQ ID NO: 1280074 - RNA, 23 nt, Mycobacterium tuberculosis H37Rv
gcgaccccgccgagcgguugccu

SEQ ID NO: 1280075 - RNA, 20 nt, Mycobacterium tuberculosis H37Rv
gcgaccccugguagcaccca

SEQ ID NO: 1280076 - RNA, 16 nt, Mycobacterium tuberculosis H37Rv
gcgaccgccucgccgu

SEQ ID NO: 1280077 - RNA, 12 nt, Mycobacterium tuberculosis H37Rv
gcgaccgucugg

SEQ ID NO: 1280078 - RNA, 13 nt, Mycobacterium tuberculosis H37Rv
gcgaccugcgcga

SEQ ID NO: 1280079 - RNA, 18 nt, Mycobacterium tuberculosis H37Rv
gcgaccugccggaccgcg

SEQ ID NO: 1280080 - RNA, 17 nt, Mycobacterium tuberculosis H37Rv
gcgaccuccggaaucgc

SEQ ID NO: 1280081 - RNA, 20 nt, Mycobacterium tuberculosis H37Rv
gcgaccucggcggcggcacg

SEQ ID NO: 1280082 - RNA, 22 nt, Mycobacterium tuberculosis H37Rv
gcgacgaaccucggcgggaucc

SEQ ID NO: 1280083 - RNA, 20 nt, Mycobacterium tuberculosis H37Rv
gcgaccucgccgcggcggaa

SEQ ID NO: 1280084 - RNA, 13 nt, Mycobacterium tuberculosis H37Rv
gcgacggccagcg

SEQ ID NO: 1280085 - RNA, 23 nt, Mycobacterium tuberculosis H37Rv
gcgacggacucccucgaucacgg

SEQ ID NO: 1280086 - RNA, 17 nt, Mycobacterium tuberculosis H37Rv
gcgacggacucccucga

SEQ ID NO: 1280087 - RNA, 18 nt, Mycobacterium tuberculosis H37Rv
gcgacggaccaucuccgg

SEQ ID NO: 1280088 - RNA, 15 nt, Mycobacterium tuberculosis H37Rv
gcgacgcauaaccgg

SEQ ID NO: 1280089 - RNA, 14 nt, Mycobacterium tuberculosis H37Rv
gcgacgccaugguc

SEQ ID NO: 1280090 - RNA, 20 nt, Mycobacterium tuberculosis H37Rv
gcgacgcagaccguccagca

SEQ ID NO: 1280091 - RNA, 14 nt, Mycobacterium tuberculosis H37Rv
gcgacgcagaccgu

SEQ ID NO: 1280092 - RNA, 12 nt, Mycobacterium tuberculosis H37Rv
gcgacgcagacc

SEQ ID NO: 1280093 - RNA, 15 nt, Mycobacterium tuberculosis H37Rv
gcgacgcacugcccc

SEQ ID NO: 1280094 - RNA, 19 nt, Mycobacterium tuberculosis H37Rv
gcgacgcacugccccgcau

SEQ ID NO: 1280095 - RNA, 14 nt, Mycobacterium tuberculosis H37Rv
gcgacgaugccucg

SEQ ID NO: 1280096 - RNA, 20 nt, Mycobacterium tuberculosis H37Rv
gcgacgacccgggucggcac

SEQ ID NO: 1280097 - RNA, 21 nt, Mycobacterium tuberculosis H37Rv
gcgacgacacgccugggcgac

SEQ ID NO: 1280098 - RNA, 21 nt, Mycobacterium tuberculosis H37Rv
gcgacgaagaagaacucggcg

SEQ ID NO: 1280099 - RNA, 13 nt, Mycobacterium tuberculosis H37Rv
gcgaccugcggac

SEQ ID NO: 1280100 - RNA, 16 nt, Mycobacterium tuberculosis H37Rv
gcgacgaacgccguca

SEQ ID NO: 1280101 - RNA, 17 nt, Mycobacterium tuberculosis H37Rv
gcgauaucgcacaugga

SEQ ID NO: 1280102 - RNA, 16 nt, Mycobacterium tuberculosis H37Rv
gcgauaucgcacaugg

SEQ ID NO: 1280103 - RNA, 13 nt, Mycobacterium tuberculosis H37Rv
gcgauaucggcgg

SEQ ID NO: 1280104 - RNA, 21 nt, Mycobacterium tuberculosis H37Rv
gcgaucaaccgcugucaccgu

SEQ ID NO: 1280105 - RNA, 20 nt, Mycobacterium tuberculosis H37Rv
gcgaucaaugcgaugcgguc

SEQ ID NO: 1280106 - RNA, 14 nt, Mycobacterium tuberculosis H37Rv
gcgauacccaccgu

SEQ ID NO: 1280107 - RNA, 19 nt, Mycobacterium tuberculosis H37Rv
gcgauacccaucgaucgaa

SEQ ID NO: 1280108 - RNA, 15 nt, Mycobacterium tuberculosis H37Rv
gcgagguugcgccga

SEQ ID NO: 1280109 - RNA, 20 nt, Mycobacterium tuberculosis H37Rv
gcgaggugcucggaucggcu

SEQ ID NO: 1280110 - RNA, 19 nt, Mycobacterium tuberculosis H37Rv
gcgagguacccaucgucga

SEQ ID NO: 1280111 - RNA, 21 nt, Mycobacterium tuberculosis H37Rv
gcgagguaagcgagucgacga

SEQ ID NO: 1280112 - RNA, 19 nt, Mycobacterium tuberculosis H37Rv
gcgagcccagcugcgccga

SEQ ID NO: 1280113 - RNA, 14 nt, Mycobacterium tuberculosis H37Rv
gcgagccgccaccg

SEQ ID NO: 1280114 - RNA, 20 nt, Mycobacterium tuberculosis H37Rv
gcgagcccggccucggcgag

SEQ ID NO: 1280115 - RNA, 19 nt, Mycobacterium tuberculosis H37Rv
gcgagccucuuggucaacg

SEQ ID NO: 1280116 - RNA, 14 nt, Mycobacterium tuberculosis H37Rv
gcgagccggugauc

SEQ ID NO: 1280117 - RNA, 19 nt, Mycobacterium tuberculosis H37Rv
gcgaggacgcugauccacg

SEQ ID NO: 1280118 - RNA, 21 nt, Mycobacterium tuberculosis H37Rv
gcgaggaacuggaccggugcc

SEQ ID NO: 1280119 - RNA, 16 nt, Mycobacterium tuberculosis H37Rv
gcgacuucaucuucga

SEQ ID NO: 1280120 - RNA, 22 nt, Mycobacterium tuberculosis H37Rv
gcgagacuucgacgcggcgacc

SEQ ID NO: 1280121 - RNA, 23 nt, Mycobacterium tuberculosis H37Rv
gcgagacuucgacgcggcgaccg

SEQ ID NO: 1280122 - RNA, 16 nt, Mycobacterium tuberculosis H37Rv
gcgagaccucucugcg

SEQ ID NO: 1280123 - RNA, 14 nt, Mycobacterium tuberculosis H37Rv
gcgagacgucgaac

SEQ ID NO: 1280124 - RNA, 21 nt, Mycobacterium tuberculosis H37Rv
gcgagacgucgaacuucagcg

SEQ ID NO: 1280125 - RNA, 12 nt, Mycobacterium tuberculosis H37Rv
gcgagcagcagg

SEQ ID NO: 1280126 - RNA, 22 nt, Mycobacterium tuberculosis H37Rv
gcgagcagacgcagagucgcac

SEQ ID NO: 1280127 - RNA, 20 nt, Mycobacterium tuberculosis H37Rv
gcgagcagacgcagagucgc

SEQ ID NO: 1280128 - RNA, 16 nt, Mycobacterium tuberculosis H37Rv
gcgagaucgcggcgac

SEQ ID NO: 1280129 - RNA, 21 nt, Mycobacterium tuberculosis H37Rv
gcgagcagacgcagaaucgcc

SEQ ID NO: 1280130 - RNA, 15 nt, Mycobacterium tuberculosis H37Rv
gcgacguuccgcucg

SEQ ID NO: 1280131 - RNA, 14 nt, Mycobacterium tuberculosis H37Rv
gcgacuaccaucgc

SEQ ID NO: 1280132 - RNA, 15 nt, Mycobacterium tuberculosis H37Rv
gcgacuaagggcacu

SEQ ID NO: 1280133 - RNA, 13 nt, Mycobacterium tuberculosis H37Rv
gcgacugcgcacc

SEQ ID NO: 1280134 - RNA, 15 nt, Mycobacterium tuberculosis H37Rv
gcgacugucuggucg

SEQ ID NO: 1280135 - RNA, 21 nt, Mycobacterium tuberculosis H37Rv
gcgacgucugccaggcgcagc

SEQ ID NO: 1280136 - RNA, 16 nt, Mycobacterium tuberculosis H37Rv
gcgacgucucgcaugc

SEQ ID NO: 1280137 - RNA, 16 nt, Mycobacterium tuberculosis H37Rv
gcgacggcgcucggcg

SEQ ID NO: 1280138 - RNA, 20 nt, Mycobacterium tuberculosis H37Rv
gcgacggcgcccauagcacc

SEQ ID NO: 1280139 - RNA, 20 nt, Mycobacterium tuberculosis H37Rv
gcgacggccagcgcgucggg

SEQ ID NO: 1280140 - RNA, 18 nt, Mycobacterium tuberculosis H37Rv
gcgacggcccgaucccga

SEQ ID NO: 1280141 - RNA, 22 nt, Mycobacterium tuberculosis H37Rv
gcgacggcccgaucccgaucga

SEQ ID NO: 1280142 - RNA, 12 nt, Mycobacterium tuberculosis H37Rv
gcgacggccaag

SEQ ID NO: 1280143 - RNA, 16 nt, Mycobacterium tuberculosis H37Rv
gcgacggccggcaagc

SEQ ID NO: 1280144 - RNA, 19 nt, Mycobacterium tuberculosis H37Rv
gcgauuccgcgucugcucg

SEQ ID NO: 1280145 - RNA, 23 nt, Mycobacterium tuberculosis H37Rv
gcgauuccgcgucugcucggcgg

SEQ ID NO: 1280146 - RNA, 17 nt, Mycobacterium tuberculosis H37Rv
gcgauucgcaaucagcu

SEQ ID NO: 1280147 - RNA, 21 nt, Mycobacterium tuberculosis H37Rv
gcgauuuccaucgcgaccucg

SEQ ID NO: 1280148 - RNA, 20 nt, Mycobacterium tuberculosis H37Rv
gcgauuuugugucugcucgc

SEQ ID NO: 1280149 - RNA, 13 nt, Mycobacterium tuberculosis H37Rv
gcgauuucggcgc

SEQ ID NO: 1280150 - RNA, 19 nt, Mycobacterium tuberculosis H37Rv
gcgcaacccagccgcgcca

SEQ ID NO: 1280151 - RNA, 13 nt, Mycobacterium tuberculosis H37Rv
gcgcaacaccucg

SEQ ID NO: 1280152 - RNA, 14 nt, Mycobacterium tuberculosis H37Rv
gcgcaacaccauca

SEQ ID NO: 1280153 - RNA, 17 nt, Mycobacterium tuberculosis H37Rv
gcgcaaccagauccggu

SEQ ID NO: 1280154 - RNA, 19 nt, Mycobacterium tuberculosis H37Rv
gcgauuagcaaaccgaccg

SEQ ID NO: 1280155 - RNA, 16 nt, Mycobacterium tuberculosis H37Rv
gcgauguggguuaccu

SEQ ID NO: 1280156 - RNA, 13 nt, Mycobacterium tuberculosis H37Rv
gcgaugucguucg

SEQ ID NO: 1280157 - RNA, 16 nt, Mycobacterium tuberculosis H37Rv
gcgaugguaucgccgc

SEQ ID NO: 1280158 - RNA, 15 nt, Mycobacterium tuberculosis H37Rv
gcgaugguaucgccg

SEQ ID NO: 1280159 - RNA, 17 nt, Mycobacterium tuberculosis H37Rv
gcgaugguagucgcgac

SEQ ID NO: 1280160 - RNA, 15 nt, Mycobacterium tuberculosis H37Rv
gcgauggcagcgccg

SEQ ID NO: 1280161 - RNA, 23 nt, Mycobacterium tuberculosis H37Rv
gcgauggcaccacuacaucgauc

SEQ ID NO: 1280162 - RNA, 16 nt, Mycobacterium tuberculosis H37Rv
gcgauggcaccgugga

SEQ ID NO: 1280163 - RNA, 14 nt, Mycobacterium tuberculosis H37Rv
gcgcaccgccgaug

SEQ ID NO: 1280164 - RNA, 19 nt, Mycobacterium tuberculosis H37Rv
gcgcaccgcauaacgcgaa

SEQ ID NO: 1280165 - RNA, 17 nt, Mycobacterium tuberculosis H37Rv
gcgcaccaggcggccgu

SEQ ID NO: 1280166 - RNA, 15 nt, Mycobacterium tuberculosis H37Rv
gcgcaccacaccacg

SEQ ID NO: 1280167 - RNA, 13 nt, Mycobacterium tuberculosis H37Rv
gcgcacgaaaccg

SEQ ID NO: 1280168 - RNA, 14 nt, Mycobacterium tuberculosis H37Rv
gcgcacgcccgcac

SEQ ID NO: 1280169 - RNA, 23 nt, Mycobacterium tuberculosis H37Rv
gcgcaaugcaucgcggcggcgcu

SEQ ID NO: 1280170 - RNA, 16 nt, Mycobacterium tuberculosis H37Rv
gcgcaaugcaucgcgg

SEQ ID NO: 1280171 - RNA, 18 nt, Mycobacterium tuberculosis H37Rv
gcgcaaucgugguucggc

SEQ ID NO: 1280172 - RNA, 15 nt, Mycobacterium tuberculosis H37Rv
gcgcaaucgaccacg

SEQ ID NO: 1280173 - RNA, 19 nt, Mycobacterium tuberculosis H37Rv
gcgcaaucgacaccagcgu

SEQ ID NO: 1280174 - RNA, 18 nt, Mycobacterium tuberculosis H37Rv
gcgcaccaagacgccacc

SEQ ID NO: 1280175 - RNA, 18 nt, Mycobacterium tuberculosis H37Rv
gcgcaacguacgcacgca

SEQ ID NO: 1280176 - RNA, 20 nt, Mycobacterium tuberculosis H37Rv
gcgcaagugauuucggugac

SEQ ID NO: 1280177 - RNA, 20 nt, Mycobacterium tuberculosis H37Rv
gcgcaaguugagcagcuugg

SEQ ID NO: 1280178 - RNA, 22 nt, Mycobacterium tuberculosis H37Rv
gcgcaaggcaaaucggugcgau

SEQ ID NO: 1280179 - RNA, 18 nt, Mycobacterium tuberculosis H37Rv
gcgcaacucccagcacgg

SEQ ID NO: 1280180 - RNA, 18 nt, Mycobacterium tuberculosis H37Rv
gcgcaacguagccagcag

SEQ ID NO: 1280181 - RNA, 16 nt, Mycobacterium tuberculosis H37Rv
gcgcaacggccagcgc

SEQ ID NO: 1280182 - RNA, 20 nt, Mycobacterium tuberculosis H37Rv
gcgcaacgccauaccagcgu

SEQ ID NO: 1280183 - RNA, 14 nt, Mycobacterium tuberculosis H37Rv
gcgcaaccggccgu

SEQ ID NO: 1280184 - RNA, 12 nt, Mycobacterium tuberculosis H37Rv
gcgaucggcaug

SEQ ID NO: 1280185 - RNA, 16 nt, Mycobacterium tuberculosis H37Rv
gcgaucgggcccagca

SEQ ID NO: 1280186 - RNA, 15 nt, Mycobacterium tuberculosis H37Rv
gcgaucgugccgggc

SEQ ID NO: 1280187 - RNA, 17 nt, Mycobacterium tuberculosis H37Rv
gcgaucgucacggaggc

SEQ ID NO: 1280188 - RNA, 18 nt, Mycobacterium tuberculosis H37Rv
gcgaucugcgacaagacc

SEQ ID NO: 1280189 - RNA, 17 nt, Mycobacterium tuberculosis H37Rv
gcgaucucggcgagcac

SEQ ID NO: 1280190 - RNA, 16 nt, Mycobacterium tuberculosis H37Rv
gcgaucuccggcggau

SEQ ID NO: 1280191 - RNA, 16 nt, Mycobacterium tuberculosis H37Rv
gcgaugacgaucgcgu

SEQ ID NO: 1280192 - RNA, 17 nt, Mycobacterium tuberculosis H37Rv
gcgaugaccgggcgauu

SEQ ID NO: 1280193 - RNA, 16 nt, Mycobacterium tuberculosis H37Rv
gcgaugacacaccgcg

SEQ ID NO: 1280194 - RNA, 22 nt, Mycobacterium tuberculosis H37Rv
gcgaugaggaacguuucgcugu

SEQ ID NO: 1280195 - RNA, 23 nt, Mycobacterium tuberculosis H37Rv
gcgaucuugcgacgcccgccuuc

SEQ ID NO: 1280196 - RNA, 22 nt, Mycobacterium tuberculosis H37Rv
gcgaucuuggcgacaugcagcg

SEQ ID NO: 1280197 - RNA, 14 nt, Mycobacterium tuberculosis H37Rv
gcgaucuuggaucg

SEQ ID NO: 1280198 - RNA, 16 nt, Mycobacterium tuberculosis H37Rv
gcgaugaacgggaucg

SEQ ID NO: 1280199 - RNA, 13 nt, Mycobacterium tuberculosis H37Rv
gcgaugaacagcg

SEQ ID NO: 1280200 - RNA, 15 nt, Mycobacterium tuberculosis H37Rv
gcgaugcgcgccgau

SEQ ID NO: 1280201 - RNA, 16 nt, Mycobacterium tuberculosis H37Rv
gcgaugcggcccucga

SEQ ID NO: 1280202 - RNA, 16 nt, Mycobacterium tuberculosis H37Rv
gcgaugcgcaccagcg

SEQ ID NO: 1280203 - RNA, 16 nt, Mycobacterium tuberculosis H37Rv
gcgaugcaccccauga

SEQ ID NO: 1280204 - RNA, 22 nt, Mycobacterium tuberculosis H37Rv
gcgaugauuucgucgaucggcu

SEQ ID NO: 1280205 - RNA, 19 nt, Mycobacterium tuberculosis H37Rv
gcgaugaucgcaucgacgu

SEQ ID NO: 1280206 - RNA, 17 nt, Mycobacterium tuberculosis H37Rv
gcgaugaugcucgacaa

SEQ ID NO: 1280207 - RNA, 15 nt, Mycobacterium tuberculosis H37Rv
gcgaugauguucauc

SEQ ID NO: 1280208 - RNA, 14 nt, Mycobacterium tuberculosis H37Rv
gcgaugcccgucga

SEQ ID NO: 1280209 - RNA, 19 nt, Mycobacterium tuberculosis H37Rv
gcgaucagcagccgccgau

SEQ ID NO: 1280210 - RNA, 16 nt, Mycobacterium tuberculosis H37Rv
gcgaucaggcgcucga

SEQ ID NO: 1280211 - RNA, 22 nt, Mycobacterium tuberculosis H37Rv
gcgaucaccgcgccggagaucg

SEQ ID NO: 1280212 - RNA, 14 nt, Mycobacterium tuberculosis H37Rv
gcgaucaccgacga

SEQ ID NO: 1280213 - RNA, 13 nt, Mycobacterium tuberculosis H37Rv
gcgaucaccaccg

SEQ ID NO: 1280214 - RNA, 19 nt, Mycobacterium tuberculosis H37Rv
gcgauccacuccggcgauc

SEQ ID NO: 1280215 - RNA, 18 nt, Mycobacterium tuberculosis H37Rv
gcgauccccagcaccacg

SEQ ID NO: 1280216 - RNA, 14 nt, Mycobacterium tuberculosis H37Rv
gcgauccccgacgu

SEQ ID NO: 1280217 - RNA, 16 nt, Mycobacterium tuberculosis H37Rv
gcgaucaucaggugcg

SEQ ID NO: 1280218 - RNA, 20 nt, Mycobacterium tuberculosis H37Rv
gcgaucaguucgugacgugc

SEQ ID NO: 1280219 - RNA, 20 nt, Mycobacterium tuberculosis H37Rv
gcgaucaggcggacgggacg

SEQ ID NO: 1280220 - RNA, 21 nt, Mycobacterium tuberculosis H37Rv
gcgaucaugguggggaccgcg

SEQ ID NO: 1280221 - RNA, 16 nt, Mycobacterium tuberculosis H37Rv
gcgauccgcggcguuc

SEQ ID NO: 1280222 - RNA, 13 nt, Mycobacterium tuberculosis H37Rv
gcgaucccgaucg

SEQ ID NO: 1280223 - RNA, 15 nt, Mycobacterium tuberculosis H37Rv
gcgaucccggcaaca

SEQ ID NO: 1280224 - RNA, 16 nt, Mycobacterium tuberculosis H37Rv
gcgauccgagaccgcg

SEQ ID NO: 1280225 - RNA, 17 nt, Mycobacterium tuberculosis H37Rv
gcgaucgacgcucggcu

SEQ ID NO: 1280226 - RNA, 16 nt, Mycobacterium tuberculosis H37Rv
gcgauccggucggcca

SEQ ID NO: 1280227 - RNA, 20 nt, Mycobacterium tuberculosis H37Rv
gcgaucggcacuuagcccga

SEQ ID NO: 1280228 - RNA, 13 nt, Mycobacterium tuberculosis H37Rv
gcgaucggcguca

SEQ ID NO: 1280229 - RNA, 21 nt, Mycobacterium tuberculosis H37Rv
gcgaucgcgacacggccaucc

SEQ ID NO: 1280230 - RNA, 16 nt, Mycobacterium tuberculosis H37Rv
gcgaucgcauccgcgg

SEQ ID NO: 1280231 - RNA, 16 nt, Mycobacterium tuberculosis H37Rv
gcgaucgccgacgcca

SEQ ID NO: 1280232 - RNA, 20 nt, Mycobacterium tuberculosis H37Rv
gccggugauggccgaccagc

SEQ ID NO: 1280233 - RNA, 14 nt, Mycobacterium tuberculosis H37Rv
gccggugcagcacg

SEQ ID NO: 1280234 - RNA, 20 nt, Mycobacterium tuberculosis H37Rv
gccggugcacucgguaaccg

SEQ ID NO: 1280235 - RNA, 15 nt, Mycobacterium tuberculosis H37Rv
gccggugcugcggga

SEQ ID NO: 1280236 - RNA, 19 nt, Mycobacterium tuberculosis H37Rv
gccggugcgcugguuucgc

SEQ ID NO: 1280237 - RNA, 13 nt, Mycobacterium tuberculosis H37Rv
gccggugccaccg

SEQ ID NO: 1280238 - RNA, 17 nt, Mycobacterium tuberculosis H37Rv
gccggugccacugccgu

SEQ ID NO: 1280239 - RNA, 13 nt, Mycobacterium tuberculosis H37Rv
gccggugacggug

SEQ ID NO: 1280240 - RNA, 17 nt, Mycobacterium tuberculosis H37Rv
gccggugagcgagcgcg

SEQ ID NO: 1280241 - RNA, 17 nt, Mycobacterium tuberculosis H37Rv
gccggugaggaucagcg

SEQ ID NO: 1280242 - RNA, 17 nt, Mycobacterium tuberculosis H37Rv
gccggugacggggcuga

SEQ ID NO: 1280243 - RNA, 18 nt, Mycobacterium tuberculosis H37Rv
gccggugacaaguggugc

SEQ ID NO: 1280244 - RNA, 16 nt, Mycobacterium tuberculosis H37Rv
gccggucuugcaucgc

SEQ ID NO: 1280245 - RNA, 21 nt, Mycobacterium tuberculosis H37Rv
gccggucuugcaucgccgaug

SEQ ID NO: 1280246 - RNA, 15 nt, Mycobacterium tuberculosis H37Rv
gccggucgagacgcu

SEQ ID NO: 1280247 - RNA, 19 nt, Mycobacterium tuberculosis H37Rv
gccgguccucgucggcgaa

SEQ ID NO: 1280248 - RNA, 18 nt, Mycobacterium tuberculosis H37Rv
gccgggauugccgccacc

SEQ ID NO: 1280249 - RNA, 17 nt, Mycobacterium tuberculosis H37Rv
gccgggcaaccagcagc

SEQ ID NO: 1280250 - RNA, 18 nt, Mycobacterium tuberculosis H37Rv
gccgggcaaccagcagca

SEQ ID NO: 1280251 - RNA, 20 nt, Mycobacterium tuberculosis H37Rv
gccggguggugauugcggaa

SEQ ID NO: 1280252 - RNA, 16 nt, Mycobacterium tuberculosis H37Rv
gccgggcaacgcgaac

SEQ ID NO: 1280253 - RNA, 21 nt, Mycobacterium tuberculosis H37Rv
gccgggcaaggccaccgucgc

SEQ ID NO: 1280254 - RNA, 17 nt, Mycobacterium tuberculosis H37Rv
gccgguaacuguccgcc

SEQ ID NO: 1280255 - RNA, 17 nt, Mycobacterium tuberculosis H37Rv
gccggguuuauccaguc

SEQ ID NO: 1280256 - RNA, 16 nt, Mycobacterium tuberculosis H37Rv
gccggguuugaucagc

SEQ ID NO: 1280257 - RNA, 21 nt, Mycobacterium tuberculosis H37Rv
gccggguuugaucagcucggu

SEQ ID NO: 1280258 - RNA, 16 nt, Mycobacterium tuberculosis H37Rv
gccggguuuggugcag

SEQ ID NO: 1280259 - RNA, 14 nt, Mycobacterium tuberculosis H37Rv
gccggguuggccgg

SEQ ID NO: 1280260 - RNA, 16 nt, Mycobacterium tuberculosis H37Rv
gccggguucgcgucug

SEQ ID NO: 1280261 - RNA, 14 nt, Mycobacterium tuberculosis H37Rv
gccgguccucgucg

SEQ ID NO: 1280262 - RNA, 14 nt, Mycobacterium tuberculosis H37Rv
gccggucacgucga

SEQ ID NO: 1280263 - RNA, 19 nt, Mycobacterium tuberculosis H37Rv
gccggugucgacggggaac

SEQ ID NO: 1280264 - RNA, 20 nt, Mycobacterium tuberculosis H37Rv
gccggugucgggcugucagg

SEQ ID NO: 1280265 - RNA, 20 nt, Mycobacterium tuberculosis H37Rv
gccgguggucugcgcggugc

SEQ ID NO: 1280266 - RNA, 17 nt, Mycobacterium tuberculosis H37Rv
gccgguguaacccucga

SEQ ID NO: 1280267 - RNA, 17 nt, Mycobacterium tuberculosis H37Rv
gccggugggcgguccgc

SEQ ID NO: 1280268 - RNA, 18 nt, Mycobacterium tuberculosis H37Rv
gccgguggggucggucug

SEQ ID NO: 1280269 - RNA, 13 nt, Mycobacterium tuberculosis H37Rv
gccguaucggugu

SEQ ID NO: 1280270 - RNA, 17 nt, Mycobacterium tuberculosis H37Rv
gccguagugucggcguc

SEQ ID NO: 1280271 - RNA, 18 nt, Mycobacterium tuberculosis H37Rv
gccguagagccgcucggc

SEQ ID NO: 1280272 - RNA, 17 nt, Mycobacterium tuberculosis H37Rv
gccguaguaguggccgc

SEQ ID NO: 1280273 - RNA, 18 nt, Mycobacterium tuberculosis H37Rv
gccguaguggccggcuuc

SEQ ID NO: 1280274 - RNA, 23 nt, Mycobacterium tuberculosis H37Rv
gccguagaccagccgucguccgc

SEQ ID NO: 1280275 - RNA, 14 nt, Mycobacterium tuberculosis H37Rv
gccguagaccagcc

SEQ ID NO: 1280276 - RNA, 12 nt, Mycobacterium tuberculosis H37Rv
gccguaccgaag

SEQ ID NO: 1280277 - RNA, 21 nt, Mycobacterium tuberculosis H37Rv
gccgucagaacaccggccagg

SEQ ID NO: 1280278 - RNA, 15 nt, Mycobacterium tuberculosis H37Rv
gccgucagaacaccg

SEQ ID NO: 1280279 - RNA, 21 nt, Mycobacterium tuberculosis H37Rv
gccgucaacgaugguggcgau

SEQ ID NO: 1280280 - RNA, 17 nt, Mycobacterium tuberculosis H37Rv
gccgucagccguucggc

SEQ ID NO: 1280281 - RNA, 14 nt, Mycobacterium tuberculosis H37Rv
gccgucagcggcgg

SEQ ID NO: 1280282 - RNA, 21 nt, Mycobacterium tuberculosis H37Rv
gccguccaauuccgcagagac

SEQ ID NO: 1280283 - RNA, 14 nt, Mycobacterium tuberculosis H37Rv
gccgucauggcccg

SEQ ID NO: 1280284 - RNA, 13 nt, Mycobacterium tuberculosis H37Rv
gccgucaugccca

SEQ ID NO: 1280285 - RNA, 23 nt, Mycobacterium tuberculosis H37Rv
gccguccaagaugucguguucgc

SEQ ID NO: 1280286 - RNA, 21 nt, Mycobacterium tuberculosis H37Rv
gccguggauggcccguucgac

SEQ ID NO: 1280287 - RNA, 21 nt, Mycobacterium tuberculosis H37Rv
gccgugcuacccauucggcgg

SEQ ID NO: 1280288 - RNA, 22 nt, Mycobacterium tuberculosis H37Rv
gccgugcuguuccagcgucugc

SEQ ID NO: 1280289 - RNA, 19 nt, Mycobacterium tuberculosis H37Rv
gccgugcuacccauucggc

SEQ ID NO: 1280290 - RNA, 15 nt, Mycobacterium tuberculosis H37Rv
gccgugcggucgcgc

SEQ ID NO: 1280291 - RNA, 22 nt, Mycobacterium tuberculosis H37Rv
gccgugcugaauugccaagcgc

SEQ ID NO: 1280292 - RNA, 14 nt, Mycobacterium tuberculosis H37Rv
gccgugagcccggc

SEQ ID NO: 1280293 - RNA, 18 nt, Mycobacterium tuberculosis H37Rv
gccgugagcccggcgauc

SEQ ID NO: 1280294 - RNA, 19 nt, Mycobacterium tuberculosis H37Rv
gccgugccgguuuggccga

SEQ ID NO: 1280295 - RNA, 13 nt, Mycobacterium tuberculosis H37Rv
gccgucuuggccc

SEQ ID NO: 1280296 - RNA, 19 nt, Mycobacterium tuberculosis H37Rv
gccguggugaaaugccgag

SEQ ID NO: 1280297 - RNA, 19 nt, Mycobacterium tuberculosis H37Rv
gccgugggugucgguggcc

SEQ ID NO: 1280298 - RNA, 12 nt, Mycobacterium tuberculosis H37Rv
gccguggucgaa

SEQ ID NO: 1280299 - RNA, 14 nt, Mycobacterium tuberculosis H37Rv
gccguugacaacua

SEQ ID NO: 1280300 - RNA, 16 nt, Mycobacterium tuberculosis H37Rv
gccguugcgaucgcgu

SEQ ID NO: 1280301 - RNA, 16 nt, Mycobacterium tuberculosis H37Rv
gccguugcgucugcuc

SEQ ID NO: 1280302 - RNA, 20 nt, Mycobacterium tuberculosis H37Rv
gccguugccgccggugccac

SEQ ID NO: 1280303 - RNA, 20 nt, Mycobacterium tuberculosis H37Rv
gccguugccggcguugccgc

SEQ ID NO: 1280304 - RNA, 17 nt, Mycobacterium tuberculosis H37Rv
gccguugccaagcagcu

SEQ ID NO: 1280305 - RNA, 12 nt, Mycobacterium tuberculosis H37Rv
gccguugccaac

SEQ ID NO: 1280306 - RNA, 21 nt, Mycobacterium tuberculosis H37Rv
gccguugcccccguugccgcc

SEQ ID NO: 1280307 - RNA, 14 nt, Mycobacterium tuberculosis H37Rv
gccguugccgccga

SEQ ID NO: 1280308 - RNA, 14 nt, Mycobacterium tuberculosis H37Rv
gccgucgaccggcg

SEQ ID NO: 1280309 - RNA, 11 nt, Mycobacterium tuberculosis H37Rv
gccgucgacgc

SEQ ID NO: 1280310 - RNA, 21 nt, Mycobacterium tuberculosis H37Rv
gccgucgccaccgguaccgau

SEQ ID NO: 1280311 - RNA, 11 nt, Mycobacterium tuberculosis H37Rv
gccgucgccac

SEQ ID NO: 1280312 - RNA, 14 nt, Mycobacterium tuberculosis H37Rv
gccgucgcaucagg

SEQ ID NO: 1280313 - RNA, 20 nt, Mycobacterium tuberculosis H37Rv
gccgucgacaacaaacccgg

SEQ ID NO: 1280314 - RNA, 13 nt, Mycobacterium tuberculosis H37Rv
gccgucgaccacg

SEQ ID NO: 1280315 - RNA, 17 nt, Mycobacterium tuberculosis H37Rv
gccgucgaaauacccgg

SEQ ID NO: 1280316 - RNA, 21 nt, Mycobacterium tuberculosis H37Rv
gccgucccggcucgagcucgg

SEQ ID NO: 1280317 - RNA, 14 nt, Mycobacterium tuberculosis H37Rv
gccguccgcaccgg

SEQ ID NO: 1280318 - RNA, 16 nt, Mycobacterium tuberculosis H37Rv
gccguccgggcggccu

SEQ ID NO: 1280319 - RNA, 17 nt, Mycobacterium tuberculosis H37Rv
gccgucucugccacgcg

SEQ ID NO: 1280320 - RNA, 18 nt, Mycobacterium tuberculosis H37Rv
gccgucgugaucggcgaa

SEQ ID NO: 1280321 - RNA, 21 nt, Mycobacterium tuberculosis H37Rv
gccgucgucgucggcagcguc

SEQ ID NO: 1280322 - RNA, 19 nt, Mycobacterium tuberculosis H37Rv
gccgucgugaucggcgaac

SEQ ID NO: 1280323 - RNA, 15 nt, Mycobacterium tuberculosis H37Rv
gccgucgucgucgag

SEQ ID NO: 1280324 - RNA, 13 nt, Mycobacterium tuberculosis H37Rv
gccgucgugaucg

SEQ ID NO: 1280325 - RNA, 16 nt, Mycobacterium tuberculosis H37Rv
gccgucgucggcguac

SEQ ID NO: 1280326 - RNA, 14 nt, Mycobacterium tuberculosis H37Rv
gccgucgucggcgu

SEQ ID NO: 1280327 - RNA, 12 nt, Mycobacterium tuberculosis H37Rv
gccgucgucggc

SEQ ID NO: 1280328 - RNA, 21 nt, Mycobacterium tuberculosis H37Rv
gccgucgucgccgucggugcc

SEQ ID NO: 1280329 - RNA, 13 nt, Mycobacterium tuberculosis H37Rv
gccgucgucgauc

SEQ ID NO: 1280330 - RNA, 16 nt, Mycobacterium tuberculosis H37Rv
gccgucgucgaccacg

SEQ ID NO: 1280331 - RNA, 20 nt, Mycobacterium tuberculosis H37Rv
gccgucggugaugacguagu

SEQ ID NO: 1280332 - RNA, 14 nt, Mycobacterium tuberculosis H37Rv
gccgucggugccgc

SEQ ID NO: 1280333 - RNA, 16 nt, Mycobacterium tuberculosis H37Rv
gccgucgccgccguua

SEQ ID NO: 1280334 - RNA, 13 nt, Mycobacterium tuberculosis H37Rv
gccgucgccgauc

SEQ ID NO: 1280335 - RNA, 20 nt, Mycobacterium tuberculosis H37Rv
gccgucgcccagcgugaacu

SEQ ID NO: 1280336 - RNA, 18 nt, Mycobacterium tuberculosis H37Rv
gccugcuggccgcggccu

SEQ ID NO: 1280337 - RNA, 13 nt, Mycobacterium tuberculosis H37Rv
gccugcugcggcc

SEQ ID NO: 1280338 - RNA, 15 nt, Mycobacterium tuberculosis H37Rv
gccugcucgucggcc

SEQ ID NO: 1280339 - RNA, 14 nt, Mycobacterium tuberculosis H37Rv
gccugcucgaccau

SEQ ID NO: 1280340 - RNA, 18 nt, Mycobacterium tuberculosis H37Rv
gccuggaucagcgcguug

SEQ ID NO: 1280341 - RNA, 16 nt, Mycobacterium tuberculosis H37Rv
gccugcuucaggaucg

SEQ ID NO: 1280342 - RNA, 14 nt, Mycobacterium tuberculosis H37Rv
gccugcuagcagca

SEQ ID NO: 1280343 - RNA, 17 nt, Mycobacterium tuberculosis H37Rv
gccugcuccaccgucga

SEQ ID NO: 1280344 - RNA, 15 nt, Mycobacterium tuberculosis H37Rv
gccugcgggccggca

SEQ ID NO: 1280345 - RNA, 20 nt, Mycobacterium tuberculosis H37Rv
gccugcgggggacacgucgu

SEQ ID NO: 1280346 - RNA, 15 nt, Mycobacterium tuberculosis H37Rv
gccugcgucucgaug

SEQ ID NO: 1280347 - RNA, 20 nt, Mycobacterium tuberculosis H37Rv
gccugcggcgguuacgguca

SEQ ID NO: 1280348 - RNA, 20 nt, Mycobacterium tuberculosis H37Rv
gccugcggcaggugcgguca

SEQ ID NO: 1280349 - RNA, 17 nt, Mycobacterium tuberculosis H37Rv
gccugcgccuuggucgc

SEQ ID NO: 1280350 - RNA, 16 nt, Mycobacterium tuberculosis H37Rv
gccugcgccgacccgc

SEQ ID NO: 1280351 - RNA, 15 nt, Mycobacterium tuberculosis H37Rv
gccugggacggcggc

SEQ ID NO: 1280352 - RNA, 16 nt, Mycobacterium tuberculosis H37Rv
gccuggcuggccagcu

SEQ ID NO: 1280353 - RNA, 13 nt, Mycobacterium tuberculosis H37Rv
gccuggucgcgca

SEQ ID NO: 1280354 - RNA, 12 nt, Mycobacterium tuberculosis H37Rv
gccuguccacgu

SEQ ID NO: 1280355 - RNA, 20 nt, Mycobacterium tuberculosis H37Rv
gccuguuuguuugcugcggc

SEQ ID NO: 1280356 - RNA, 21 nt, Mycobacterium tuberculosis H37Rv
gccuguuuguuugcugcggcg

SEQ ID NO: 1280357 - RNA, 23 nt, Mycobacterium tuberculosis H37Rv
gccuguuuguuugcugcggcgau

SEQ ID NO: 1280358 - RNA, 18 nt, Mycobacterium tuberculosis H37Rv
gccugcgacgagcccacc

SEQ ID NO: 1280359 - RNA, 16 nt, Mycobacterium tuberculosis H37Rv
gccugcgacagcacgu

SEQ ID NO: 1280360 - RNA, 13 nt, Mycobacterium tuberculosis H37Rv
gccugcgcagacu

SEQ ID NO: 1280361 - RNA, 17 nt, Mycobacterium tuberculosis H37Rv
gccugccgacggcauca

SEQ ID NO: 1280362 - RNA, 16 nt, Mycobacterium tuberculosis H37Rv
gccugccccacccgcg

SEQ ID NO: 1280363 - RNA, 17 nt, Mycobacterium tuberculosis H37Rv
gccugccaguccugaug

SEQ ID NO: 1280364 - RNA, 15 nt, Mycobacterium tuberculosis H37Rv
gccugcccaccuucg

SEQ ID NO: 1280365 - RNA, 18 nt, Mycobacterium tuberculosis H37Rv
gccugcccaccuucgagu

SEQ ID NO: 1280366 - RNA, 19 nt, Mycobacterium tuberculosis H37Rv
gccugccaucacgcgcuca

SEQ ID NO: 1280367 - RNA, 22 nt, Mycobacterium tuberculosis H37Rv
gccugcaagacaaagccgucga

SEQ ID NO: 1280368 - RNA, 14 nt, Mycobacterium tuberculosis H37Rv
gccugccaccggcg

SEQ ID NO: 1280369 - RNA, 17 nt, Mycobacterium tuberculosis H37Rv
gccugaccggcucgccg

SEQ ID NO: 1280370 - RNA, 15 nt, Mycobacterium tuberculosis H37Rv
gccugaccggcucgc

SEQ ID NO: 1280371 - RNA, 18 nt, Mycobacterium tuberculosis H37Rv
gccugaccgccaccguca

SEQ ID NO: 1280372 - RNA, 17 nt, Mycobacterium tuberculosis H37Rv
gccugacucaucaccga

SEQ ID NO: 1280373 - RNA, 15 nt, Mycobacterium tuberculosis H37Rv
gccugacgcgucagc

SEQ ID NO: 1280374 - RNA, 18 nt, Mycobacterium tuberculosis H37Rv
gccucggcgaccaucuga

SEQ ID NO: 1280375 - RNA, 15 nt, Mycobacterium tuberculosis H37Rv
gccucggcgauaccg

SEQ ID NO: 1280376 - RNA, 12 nt, Mycobacterium tuberculosis H37Rv
gccucggcgaug

SEQ ID NO: 1280377 - RNA, 17 nt, Mycobacterium tuberculosis H37Rv
aagccagcaucggcagc

SEQ ID NO: 1280378 - RNA, 23 nt, Mycobacterium tuberculosis H37Rv
gccguugcgucugcucggcguac

SEQ ID NO: 1280379 - RNA, 19 nt, Mycobacterium tuberculosis H37Rv
gccguuggagccgccaccg

SEQ ID NO: 1280380 - RNA, 20 nt, Mycobacterium tuberculosis H37Rv
gccguuggagccgccaccga

SEQ ID NO: 1280381 - RNA, 23 nt, Mycobacterium tuberculosis H37Rv
gccguugggcaccguguagcugc

SEQ ID NO: 1280382 - RNA, 15 nt, Mycobacterium tuberculosis H37Rv
gccucgaggaccacc

SEQ ID NO: 1280383 - RNA, 18 nt, Mycobacterium tuberculosis H37Rv
gccucgaguaucucggcu

SEQ ID NO: 1280384 - RNA, 18 nt, Mycobacterium tuberculosis H37Rv
gccucgacagcggcaauc

SEQ ID NO: 1280385 - RNA, 15 nt, Mycobacterium tuberculosis H37Rv
gccucgaccgccagc

SEQ ID NO: 1280386 - RNA, 18 nt, Mycobacterium tuberculosis H37Rv
gccucggccagcgucagc

SEQ ID NO: 1280387 - RNA, 20 nt, Mycobacterium tuberculosis H37Rv
gccucggacaaagccgucgc

SEQ ID NO: 1280388 - RNA, 19 nt, Mycobacterium tuberculosis H37Rv
gccucgcugggcucauggc

SEQ ID NO: 1280389 - RNA, 18 nt, Mycobacterium tuberculosis H37Rv
gccgcugggugaccagga

SEQ ID NO: 1280390 - RNA, 19 nt, Mycobacterium tuberculosis H37Rv
gccgcuggggcgcccgaga

SEQ ID NO: 1280391 - RNA, 17 nt, Mycobacterium tuberculosis H37Rv
gccgcuggcaaucccgc

SEQ ID NO: 1280392 - RNA, 20 nt, Mycobacterium tuberculosis H37Rv
gccgcugugcggucgucacc

SEQ ID NO: 1280393 - RNA, 14 nt, Mycobacterium tuberculosis H37Rv
gccgcuguggccgc

SEQ ID NO: 1280394 - RNA, 17 nt, Mycobacterium tuberculosis H37Rv
gccgcuucggcggucag

SEQ ID NO: 1280395 - RNA, 15 nt, Mycobacterium tuberculosis H37Rv
gccgcugccagccgu

SEQ ID NO: 1280396 - RNA, 14 nt, Mycobacterium tuberculosis H37Rv
gccgcugcauccgc

SEQ ID NO: 1280397 - RNA, 15 nt, Mycobacterium tuberculosis H37Rv
gccgccgcgccggca

SEQ ID NO: 1280398 - RNA, 16 nt, Mycobacterium tuberculosis H37Rv
gccgccgcgaggaugc

SEQ ID NO: 1280399 - RNA, 14 nt, Mycobacterium tuberculosis H37Rv
gccgcugccuucuu

SEQ ID NO: 1280400 - RNA, 20 nt, Mycobacterium tuberculosis H37Rv
gccgcugccgaagcggccac

SEQ ID NO: 1280401 - RNA, 20 nt, Mycobacterium tuberculosis H37Rv
gccggacgacaacaggccgu

SEQ ID NO: 1280402 - RNA, 15 nt, Mycobacterium tuberculosis H37Rv
gccggaccgcacuug

SEQ ID NO: 1280403 - RNA, 17 nt, Mycobacterium tuberculosis H37Rv
gccggaccgcgacggcg

SEQ ID NO: 1280404 - RNA, 14 nt, Mycobacterium tuberculosis H37Rv
gccggacccgucga

SEQ ID NO: 1280405 - RNA, 20 nt, Mycobacterium tuberculosis H37Rv
gccggacccgccggguccgc

SEQ ID NO: 1280406 - RNA, 17 nt, Mycobacterium tuberculosis H37Rv
gccggacccggugcacg

SEQ ID NO: 1280407 - RNA, 16 nt, Mycobacterium tuberculosis H37Rv
gccggacccaccguca

SEQ ID NO: 1280408 - RNA, 19 nt, Mycobacterium tuberculosis H37Rv
gccggagaguaggaccucg

SEQ ID NO: 1280409 - RNA, 16 nt, Mycobacterium tuberculosis H37Rv
gccggagacacccgcc

SEQ ID NO: 1280410 - RNA, 23 nt, Mycobacterium tuberculosis H37Rv
gccggacugaagccgcgagcgcg

SEQ ID NO: 1280411 - RNA, 14 nt, Mycobacterium tuberculosis H37Rv
gccggacugcggcc

SEQ ID NO: 1280412 - RNA, 15 nt, Mycobacterium tuberculosis H37Rv
gccggagccggugcc

SEQ ID NO: 1280413 - RNA, 23 nt, Mycobacterium tuberculosis H37Rv
gccggaggcaagcaaccggugcg

SEQ ID NO: 1280414 - RNA, 18 nt, Mycobacterium tuberculosis H37Rv
gccggaggcaagcaaccg

SEQ ID NO: 1280415 - RNA, 24 nt, Mycobacterium tuberculosis H37Rv
gccggacaggcuugacugcacacc

SEQ ID NO: 1280416 - RNA, 23 nt, Mycobacterium tuberculosis H37Rv
gccggaaggugaggucgaucagc

SEQ ID NO: 1280417 - RNA, 24 nt, Mycobacterium tuberculosis H37Rv
gccggaagcgccggccgaucggcc

SEQ ID NO: 1280418 - RNA, 20 nt, Mycobacterium tuberculosis H37Rv
gccggaauacaccagcgacg

SEQ ID NO: 1280419 - RNA, 22 nt, Mycobacterium tuberculosis H37Rv
gccggacaaaccgggcggccaa

SEQ ID NO: 1280420 - RNA, 13 nt, Mycobacterium tuberculosis H37Rv
gccgcuuggccgc

SEQ ID NO: 1280421 - RNA, 19 nt, Mycobacterium tuberculosis H37Rv
gccgcuucgggcgucaucc

SEQ ID NO: 1280422 - RNA, 18 nt, Mycobacterium tuberculosis H37Rv
gccggcacauugaucgac

SEQ ID NO: 1280423 - RNA, 13 nt, Mycobacterium tuberculosis H37Rv
gccggcaccaccg

SEQ ID NO: 1280424 - RNA, 20 nt, Mycobacterium tuberculosis H37Rv
gccggcaccaccguugccgc

SEQ ID NO: 1280425 - RNA, 23 nt, Mycobacterium tuberculosis H37Rv
gccggcaauaccgccagcgccac

SEQ ID NO: 1280426 - RNA, 23 nt, Mycobacterium tuberculosis H37Rv
gccggcaacaucgagcgccagcc

SEQ ID NO: 1280427 - RNA, 16 nt, Mycobacterium tuberculosis H37Rv
gccggcaagaccgaac

SEQ ID NO: 1280428 - RNA, 20 nt, Mycobacterium tuberculosis H37Rv
gccggauggguggccagcaa

SEQ ID NO: 1280429 - RNA, 20 nt, Mycobacterium tuberculosis H37Rv
gccggaugucgacgagcacc

SEQ ID NO: 1280430 - RNA, 23 nt, Mycobacterium tuberculosis H37Rv
gccggcaaaggacgucgaccugu

SEQ ID NO: 1280431 - RNA, 19 nt, Mycobacterium tuberculosis H37Rv
gccggauucggcugccacc

SEQ ID NO: 1280432 - RNA, 17 nt, Mycobacterium tuberculosis H37Rv
gccggauggguggccag

SEQ ID NO: 1280433 - RNA, 16 nt, Mycobacterium tuberculosis H37Rv
gccggaugagcgaacg

SEQ ID NO: 1280434 - RNA, 14 nt, Mycobacterium tuberculosis H37Rv
gccggaugacaccg

SEQ ID NO: 1280435 - RNA, 18 nt, Mycobacterium tuberculosis H37Rv
gccggaucgccggugaac

SEQ ID NO: 1280436 - RNA, 18 nt, Mycobacterium tuberculosis H37Rv
gccggaucgacguucggg

SEQ ID NO: 1280437 - RNA, 16 nt, Mycobacterium tuberculosis H37Rv
gccggauccgauccgc

SEQ ID NO: 1280438 - RNA, 14 nt, Mycobacterium tuberculosis H37Rv
gccggaucccgguc

SEQ ID NO: 1280439 - RNA, 17 nt, Mycobacterium tuberculosis H37Rv
gccggaucgacguucgg

SEQ ID NO: 1280440 - RNA, 20 nt, Mycobacterium tuberculosis H37Rv
gccggagucggggggccgga

SEQ ID NO: 1280441 - RNA, 19 nt, Mycobacterium tuberculosis H37Rv
gccggaguccgucggggac

SEQ ID NO: 1280442 - RNA, 13 nt, Mycobacterium tuberculosis H37Rv
gccggagucaccg

SEQ ID NO: 1280443 - RNA, 21 nt, Mycobacterium tuberculosis H37Rv
gccggaguugaagaagcccga

SEQ ID NO: 1280444 - RNA, 24 nt, Mycobacterium tuberculosis H37Rv
gccggaguugaagaagcccgacga

SEQ ID NO: 1280445 - RNA, 15 nt, Mycobacterium tuberculosis H37Rv
gccggagucgacgac

SEQ ID NO: 1280446 - RNA, 15 nt, Mycobacterium tuberculosis H37Rv
gccggaggucgggcg

SEQ ID NO: 1280447 - RNA, 19 nt, Mycobacterium tuberculosis H37Rv
gccggauaggucgggcaug

SEQ ID NO: 1280448 - RNA, 14 nt, Mycobacterium tuberculosis H37Rv
gccggauaggucgg

SEQ ID NO: 1280449 - RNA, 15 nt, Mycobacterium tuberculosis H37Rv
gccggauacgucagc

SEQ ID NO: 1280450 - RNA, 15 nt, Mycobacterium tuberculosis H37Rv
gccggccagcgucgc

SEQ ID NO: 1280451 - RNA, 17 nt, Mycobacterium tuberculosis H37Rv
gccggccacgaccucuu

SEQ ID NO: 1280452 - RNA, 17 nt, Mycobacterium tuberculosis H37Rv
gccggccacgcauucca

SEQ ID NO: 1280453 - RNA, 22 nt, Mycobacterium tuberculosis H37Rv
gccggccacccgcgcgaugcug

SEQ ID NO: 1280454 - RNA, 18 nt, Mycobacterium tuberculosis H37Rv
gccggccacccgcgcgau

SEQ ID NO: 1280455 - RNA, 24 nt, Mycobacterium tuberculosis H37Rv
gccggccacuacggccuggccacc

SEQ ID NO: 1280456 - RNA, 16 nt, Mycobacterium tuberculosis H37Rv
gccggccacgaccucu

SEQ ID NO: 1280457 - RNA, 16 nt, Mycobacterium tuberculosis H37Rv
gccggccacgucgaug

SEQ ID NO: 1280458 - RNA, 14 nt, Mycobacterium tuberculosis H37Rv
gccggccaccucgg

SEQ ID NO: 1280459 - RNA, 22 nt, Mycobacterium tuberculosis H37Rv
gccggccaauggccugcagcgc

SEQ ID NO: 1280460 - RNA, 20 nt, Mycobacterium tuberculosis H37Rv
gccggcaucuccaccgucgc

SEQ ID NO: 1280461 - RNA, 23 nt, Mycobacterium tuberculosis H37Rv
gccggcaucuccaccgucgccgc

SEQ ID NO: 1280462 - RNA, 15 nt, Mycobacterium tuberculosis H37Rv
gccggcaucuccacc

SEQ ID NO: 1280463 - RNA, 14 nt, Mycobacterium tuberculosis H37Rv
gccggcaucgucga

SEQ ID NO: 1280464 - RNA, 18 nt, Mycobacterium tuberculosis H37Rv
gccggcaucgcgcaaccg

SEQ ID NO: 1280465 - RNA, 20 nt, Mycobacterium tuberculosis H37Rv
gccggcaucggucagcgcgg

SEQ ID NO: 1280466 - RNA, 15 nt, Mycobacterium tuberculosis H37Rv
gccggcagcgucggc

SEQ ID NO: 1280467 - RNA, 13 nt, Mycobacterium tuberculosis H37Rv
gccggcagcagcg

SEQ ID NO: 1280468 - RNA, 15 nt, Mycobacterium tuberculosis H37Rv
gccggcacggugaac

SEQ ID NO: 1280469 - RNA, 14 nt, Mycobacterium tuberculosis H37Rv
gccggcaccguaga

SEQ ID NO: 1280470 - RNA, 21 nt, Mycobacterium tuberculosis H37Rv
gccggcaccgccagugcccgc

SEQ ID NO: 1280471 - RNA, 16 nt, Mycobacterium tuberculosis H37Rv
gccggcaccgccggug

SEQ ID NO: 1280472 - RNA, 20 nt, Mycobacterium tuberculosis H37Rv
gccggcaccgccagugcccg

SEQ ID NO: 1280473 - RNA, 14 nt, Mycobacterium tuberculosis H37Rv
gccggcaccuccgg

SEQ ID NO: 1280474 - RNA, 14 nt, Mycobacterium tuberculosis H37Rv
gccggccgccagcc

SEQ ID NO: 1280475 - RNA, 13 nt, Mycobacterium tuberculosis H37Rv
gccggccgccagc

SEQ ID NO: 1280476 - RNA, 19 nt, Mycobacterium tuberculosis H37Rv
gccggccgcacgccggcca

SEQ ID NO: 1280477 - RNA, 18 nt, Mycobacterium tuberculosis H37Rv
gccggccgcacaugagcu

SEQ ID NO: 1280478 - RNA, 14 nt, Mycobacterium tuberculosis H37Rv
gccggccgccgacc

SEQ ID NO: 1280479 - RNA, 22 nt, Mycobacterium tuberculosis H37Rv
gccggcccugcucggccaacgu

SEQ ID NO: 1280480 - RNA, 18 nt, Mycobacterium tuberculosis H37Rv
gccggccccaccggugcc

SEQ ID NO: 1280481 - RNA, 17 nt, Mycobacterium tuberculosis H37Rv
gccggccccaccggugc

SEQ ID NO: 1280482 - RNA, 14 nt, Mycobacterium tuberculosis H37Rv
gccggccccaccgg

SEQ ID NO: 1280483 - RNA, 16 nt, Mycobacterium tuberculosis H37Rv
gccggccccgccgaug

SEQ ID NO: 1280484 - RNA, 23 nt, Mycobacterium tuberculosis H37Rv
gccggcccauucaucuugcggca

SEQ ID NO: 1280485 - RNA, 15 nt, Mycobacterium tuberculosis H37Rv
gccggccaguucggc

SEQ ID NO: 1280486 - RNA, 17 nt, Mycobacterium tuberculosis H37Rv
gccggccaucgcccgau

SEQ ID NO: 1280487 - RNA, 18 nt, Mycobacterium tuberculosis H37Rv
gccggccaugccuucggu

SEQ ID NO: 1280488 - RNA, 16 nt, Mycobacterium tuberculosis H37Rv
gccggcccaccgccga

SEQ ID NO: 1280489 - RNA, 17 nt, Mycobacterium tuberculosis H37Rv
gccggccagcggccauc

SEQ ID NO: 1280490 - RNA, 14 nt, Mycobacterium tuberculosis H37Rv
gccggccaguucgg

SEQ ID NO: 1280491 - RNA, 15 nt, Mycobacterium tuberculosis H37Rv
aagcagcugggcauc

SEQ ID NO: 1280492 - RNA, 12 nt, Mycobacterium tuberculosis H37Rv
aagcagcagcgg

SEQ ID NO: 1280493 - RNA, 17 nt, Mycobacterium tuberculosis H37Rv
gccggccugcucggcga

SEQ ID NO: 1280494 - RNA, 15 nt, Mycobacterium tuberculosis H37Rv
gccggccucgccgaa

SEQ ID NO: 1280495 - RNA, 22 nt, Mycobacterium tuberculosis H37Rv
gccggccucuggaucacgucga

SEQ ID NO: 1280496 - RNA, 18 nt, Mycobacterium tuberculosis H37Rv
gccggccucuggaucacg

SEQ ID NO: 1280497 - RNA, 13 nt, Mycobacterium tuberculosis H37Rv
gccggccgucggc

SEQ ID NO: 1280498 - RNA, 14 nt, Mycobacterium tuberculosis H37Rv
gccggccgguggcc

SEQ ID NO: 1280499 - RNA, 15 nt, Mycobacterium tuberculosis H37Rv
gccggcgaaggccag

SEQ ID NO: 1280500 - RNA, 19 nt, Mycobacterium tuberculosis H37Rv
gccggcgaagugcuccacc

SEQ ID NO: 1280501 - RNA, 19 nt, Mycobacterium tuberculosis H37Rv
gccggcgaacucgcgccga

SEQ ID NO: 1280502 - RNA, 15 nt, Mycobacterium tuberculosis H37Rv
aagcauucaggccga

SEQ ID NO: 1280503 - RNA, 19 nt, Mycobacterium tuberculosis H37Rv
gccggcgagcagacgcaaa

SEQ ID NO: 1280504 - RNA, 15 nt, Mycobacterium tuberculosis H37Rv
gccggcgacgggucg

SEQ ID NO: 1280505 - RNA, 15 nt, Mycobacterium tuberculosis H37Rv
gccggcgacggcguc

SEQ ID NO: 1280506 - RNA, 20 nt, Mycobacterium tuberculosis H37Rv
gccggcgacgcuaccgccgg

SEQ ID NO: 1280507 - RNA, 13 nt, Mycobacterium tuberculosis H37Rv
gccggcgacaccg

SEQ ID NO: 1280508 - RNA, 13 nt, Mycobacterium tuberculosis H37Rv
gccgggaucaccg

SEQ ID NO: 1280509 - RNA, 19 nt, Mycobacterium tuberculosis H37Rv
gccgggauaucgucgacgc

SEQ ID NO: 1280510 - RNA, 14 nt, Mycobacterium tuberculosis H37Rv
gccggcgugcgcga

SEQ ID NO: 1280511 - RNA, 19 nt, Mycobacterium tuberculosis H37Rv
gccggcgucggcgcccagc

SEQ ID NO: 1280512 - RNA, 11 nt, Mycobacterium tuberculosis H37Rv
gccggcggugg

SEQ ID NO: 1280513 - RNA, 17 nt, Mycobacterium tuberculosis H37Rv
gccggcgucggcgccca

SEQ ID NO: 1280514 - RNA, 18 nt, Mycobacterium tuberculosis H37Rv
gccggcggucagcagcgc

SEQ ID NO: 1280515 - RNA, 22 nt, Mycobacterium tuberculosis H37Rv
gccggcggucccaugugcccgc

SEQ ID NO: 1280516 - RNA, 14 nt, Mycobacterium tuberculosis H37Rv
gccggcggucagca

SEQ ID NO: 1280517 - RNA, 21 nt, Mycobacterium tuberculosis H37Rv
gccggcgguagucggccagcu

SEQ ID NO: 1280518 - RNA, 18 nt, Mycobacterium tuberculosis H37Rv
gccggcgguaagcccaga

SEQ ID NO: 1280519 - RNA, 20 nt, Mycobacterium tuberculosis H37Rv
gccggcgggcucgcccgcua

SEQ ID NO: 1280520 - RNA, 15 nt, Mycobacterium tuberculosis H37Rv
gccggcgggcucggu

SEQ ID NO: 1280521 - RNA, 20 nt, Mycobacterium tuberculosis H37Rv
gccggcgggcguaccuucga

SEQ ID NO: 1280522 - RNA, 18 nt, Mycobacterium tuberculosis H37Rv
gccggcggcuguggucgc

SEQ ID NO: 1280523 - RNA, 22 nt, Mycobacterium tuberculosis H37Rv
gccggcggcgguaccggaaucg

SEQ ID NO: 1280524 - RNA, 15 nt, Mycobacterium tuberculosis H37Rv
gccggcggcgguacc

SEQ ID NO: 1280525 - RNA, 15 nt, Mycobacterium tuberculosis H37Rv
gccggcggcggcgcu

SEQ ID NO: 1280526 - RNA, 21 nt, Mycobacterium tuberculosis H37Rv
gccggcggcgcccaucgcgac

SEQ ID NO: 1280527 - RNA, 17 nt, Mycobacterium tuberculosis H37Rv
gccggcggccgcggugc

SEQ ID NO: 1280528 - RNA, 23 nt, Mycobacterium tuberculosis H37Rv
gccggcgcguaguaaugcucgac

SEQ ID NO: 1280529 - RNA, 14 nt, Mycobacterium tuberculosis H37Rv
gccggcgcgccgau

SEQ ID NO: 1280530 - RNA, 15 nt, Mycobacterium tuberculosis H37Rv
gccggcgcgccgaug

SEQ ID NO: 1280531 - RNA, 20 nt, Mycobacterium tuberculosis H37Rv
gccggcgccuuggucgccgc

SEQ ID NO: 1280532 - RNA, 17 nt, Mycobacterium tuberculosis H37Rv
gccggcgccuuggucgc

SEQ ID NO: 1280533 - RNA, 14 nt, Mycobacterium tuberculosis H37Rv
gccggcgccggcuu

SEQ ID NO: 1280534 - RNA, 17 nt, Mycobacterium tuberculosis H37Rv
gccggcgccggugccgc

SEQ ID NO: 1280535 - RNA, 22 nt, Mycobacterium tuberculosis H37Rv
gccggcgccgccagcaccaccg

SEQ ID NO: 1280536 - RNA, 19 nt, Mycobacterium tuberculosis H37Rv
gccggcgccgccauugcca

SEQ ID NO: 1280537 - RNA, 23 nt, Mycobacterium tuberculosis H37Rv
gccggcgccgccauugucgccaa

SEQ ID NO: 1280538 - RNA, 15 nt, Mycobacterium tuberculosis H37Rv
gccggcgccgcccuu

SEQ ID NO: 1280539 - RNA, 16 nt, Mycobacterium tuberculosis H37Rv
gccggcgccgccggca

SEQ ID NO: 1280540 - RNA, 23 nt, Mycobacterium tuberculosis H37Rv
gccggcgccgccggugccaccgg

SEQ ID NO: 1280541 - RNA, 18 nt, Mycobacterium tuberculosis H37Rv
gccggcgcccaggccgau

SEQ ID NO: 1280542 - RNA, 22 nt, Mycobacterium tuberculosis H37Rv
gccggcgcccaggccgaucagc

SEQ ID NO: 1280543 - RNA, 22 nt, Mycobacterium tuberculosis H37Rv
gccggcgcccgccgcgaacucc

SEQ ID NO: 1280544 - RNA, 17 nt, Mycobacterium tuberculosis H37Rv
gccggcgccagcgccgc

SEQ ID NO: 1280545 - RNA, 17 nt, Mycobacterium tuberculosis H37Rv
gccggcgcccaggccga

SEQ ID NO: 1280546 - RNA, 14 nt, Mycobacterium tuberculosis H37Rv
gccggcgauuaccg

SEQ ID NO: 1280547 - RNA, 22 nt, Mycobacterium tuberculosis H37Rv
gccggcgccaccguugccgaac

SEQ ID NO: 1280548 - RNA, 12 nt, Mycobacterium tuberculosis H37Rv
gccggcgccagc

SEQ ID NO: 1280549 - RNA, 19 nt, Mycobacterium tuberculosis H37Rv
gccggcgauuaccggcacg

SEQ ID NO: 1280550 - RNA, 16 nt, Mycobacterium tuberculosis H37Rv
gcguuccaucgccgac

SEQ ID NO: 1280551 - RNA, 20 nt, Mycobacterium tuberculosis H37Rv
gcguuccgaucggcaaucga

SEQ ID NO: 1280552 - RNA, 24 nt, Mycobacterium tuberculosis H37Rv
gcguuccgaucggcaaucgacuca

SEQ ID NO: 1280553 - RNA, 21 nt, Mycobacterium tuberculosis H37Rv
gcgugucgggggauuucgcgu

SEQ ID NO: 1280554 - RNA, 17 nt, Mycobacterium tuberculosis H37Rv
gcguguccgccgaacug

SEQ ID NO: 1280555 - RNA, 23 nt, Mycobacterium tuberculosis H37Rv
gcgugucugggaccccgcugcga

SEQ ID NO: 1280556 - RNA, 17 nt, Mycobacterium tuberculosis H37Rv
gcguuccuccagcagcg

SEQ ID NO: 1280557 - RNA, 22 nt, Mycobacterium tuberculosis H37Rv
gcguucggccgacucggucuca

SEQ ID NO: 1280558 - RNA, 14 nt, Mycobacterium tuberculosis H37Rv
gcguugacggcggg

SEQ ID NO: 1280559 - RNA, 23 nt, Mycobacterium tuberculosis H37Rv
gcguugacgaucuccgccaaccg

SEQ ID NO: 1280560 - RNA, 20 nt, Mycobacterium tuberculosis H37Rv
gcguucgucguaguccaggc

SEQ ID NO: 1280561 - RNA, 22 nt, Mycobacterium tuberculosis H37Rv
gcguugagcucaauggcuucga

SEQ ID NO: 1280562 - RNA, 15 nt, Mycobacterium tuberculosis H37Rv
gcguugcacagcagc

SEQ ID NO: 1280563 - RNA, 19 nt, Mycobacterium tuberculosis H37Rv
gcguugcagaccaccagug

SEQ ID NO: 1280564 - RNA, 22 nt, Mycobacterium tuberculosis H37Rv
gcguugaucgacaucaccaccg

SEQ ID NO: 1280565 - RNA, 17 nt, Mycobacterium tuberculosis H37Rv
gcguuucgucgaccgcg

SEQ ID NO: 1280566 - RNA, 12 nt, Mycobacterium tuberculosis H37Rv
gcguuguccacc

SEQ ID NO: 1280567 - RNA, 19 nt, Mycobacterium tuberculosis H37Rv
gcguuguuaucgaagcccg

SEQ ID NO: 1280568 - RNA, 20 nt, Mycobacterium tuberculosis H37Rv
gcguuguugcggaucgagca

SEQ ID NO: 1280569 - RNA, 18 nt, Mycobacterium tuberculosis H37Rv
gcguuguagcgguccagc

SEQ ID NO: 1280570 - RNA, 22 nt, Mycobacterium tuberculosis H37Rv
gcguuguaguccugcgggccgu

SEQ ID NO: 1280571 - RNA, 14 nt, Mycobacterium tuberculosis H37Rv
gcguuggggcucgu

SEQ ID NO: 1280572 - RNA, 18 nt, Mycobacterium tuberculosis H37Rv
gcguuggccccaggaucg

SEQ ID NO: 1280573 - RNA, 16 nt, Mycobacterium tuberculosis H37Rv
gcucaccgcacaccug

SEQ ID NO: 1280574 - RNA, 15 nt, Mycobacterium tuberculosis H37Rv
gcucacccugcucga

SEQ ID NO: 1280575 - RNA, 18 nt, Mycobacterium tuberculosis H37Rv
gcucacccgucgucaagu

SEQ ID NO: 1280576 - RNA, 17 nt, Mycobacterium tuberculosis H37Rv
gcucaccgacaugacgc

SEQ ID NO: 1280577 - RNA, 16 nt, Mycobacterium tuberculosis H37Rv
gcucaccgacgcugac

SEQ ID NO: 1280578 - RNA, 20 nt, Mycobacterium tuberculosis H37Rv
gcucacccuuggaauugaag

SEQ ID NO: 1280579 - RNA, 17 nt, Mycobacterium tuberculosis H37Rv
gcucacauacagcaggc

SEQ ID NO: 1280580 - RNA, 19 nt, Mycobacterium tuberculosis H37Rv
gcucaccaaggucggcgau

SEQ ID NO: 1280581 - RNA, 20 nt, Mycobacterium tuberculosis H37Rv
gcucaccaaggucggcgauc

SEQ ID NO: 1280582 - RNA, 12 nt, Mycobacterium tuberculosis H37Rv
gcucaccagcgg

SEQ ID NO: 1280583 - RNA, 15 nt, Mycobacterium tuberculosis H37Rv
gcucacaagccgugc

SEQ ID NO: 1280584 - RNA, 22 nt, Mycobacterium tuberculosis H37Rv
gcucaacaccagccggucgucg

SEQ ID NO: 1280585 - RNA, 18 nt, Mycobacterium tuberculosis H37Rv
gcucaaggacgcaccgcc

SEQ ID NO: 1280586 - RNA, 22 nt, Mycobacterium tuberculosis H37Rv
gcucaacggaaccgauaccucg

SEQ ID NO: 1280587 - RNA, 23 nt, Mycobacterium tuberculosis H37Rv
gcucaaccagcagacgccguagc

SEQ ID NO: 1280588 - RNA, 15 nt, Mycobacterium tuberculosis H37Rv
gcuaucaugaccacc

SEQ ID NO: 1280589 - RNA, 16 nt, Mycobacterium tuberculosis H37Rv
gcuauccgagugaucg

SEQ ID NO: 1280590 - RNA, 15 nt, Mycobacterium tuberculosis H37Rv
gcuaugaccugcgaa

SEQ ID NO: 1280591 - RNA, 14 nt, Mycobacterium tuberculosis H37Rv
gcuacgcggccgag

SEQ ID NO: 1280592 - RNA, 18 nt, Mycobacterium tuberculosis H37Rv
gcuaccgcaggugccacc

SEQ ID NO: 1280593 - RNA, 19 nt, Mycobacterium tuberculosis H37Rv
gcuaccgcaggugccaccu

SEQ ID NO: 1280594 - RNA, 22 nt, Mycobacterium tuberculosis H37Rv
gcuaccaaaaaaggucagcgug

SEQ ID NO: 1280595 - RNA, 16 nt, Mycobacterium tuberculosis H37Rv
gcuaccccagccggca

SEQ ID NO: 1280596 - RNA, 15 nt, Mycobacterium tuberculosis H37Rv
gcuaccccgcagaau

SEQ ID NO: 1280597 - RNA, 23 nt, Mycobacterium tuberculosis H37Rv
gcuacccauucggcggcgguggc

SEQ ID NO: 1280598 - RNA, 17 nt, Mycobacterium tuberculosis H37Rv
gcuacagcuugcguagc

SEQ ID NO: 1280599 - RNA, 19 nt, Mycobacterium tuberculosis H37Rv
gcuagugcgggccgugacc

SEQ ID NO: 1280600 - RNA, 16 nt, Mycobacterium tuberculosis H37Rv
gcuagcggauucagcg

SEQ ID NO: 1280601 - RNA, 22 nt, Mycobacterium tuberculosis H37Rv
gcuagcgcuauaggccgcaugc

SEQ ID NO: 1280602 - RNA, 18 nt, Mycobacterium tuberculosis H37Rv
gcuaggccaccggcgacc

SEQ ID NO: 1280603 - RNA, 16 nt, Mycobacterium tuberculosis H37Rv
gcuaggaccaccagcg

SEQ ID NO: 1280604 - RNA, 23 nt, Mycobacterium tuberculosis H37Rv
gcuaggacggcugccgucagccg

SEQ ID NO: 1280605 - RNA, 17 nt, Mycobacterium tuberculosis H37Rv
gcuacucacggugaucg

SEQ ID NO: 1280606 - RNA, 13 nt, Mycobacterium tuberculosis H37Rv
gcuacugcgacca

SEQ ID NO: 1280607 - RNA, 21 nt, Mycobacterium tuberculosis H37Rv
gcuagccgggcgcgccggcca

SEQ ID NO: 1280608 - RNA, 19 nt, Mycobacterium tuberculosis H37Rv
gcuagccgacagcucaucg

SEQ ID NO: 1280609 - RNA, 20 nt, Mycobacterium tuberculosis H37Rv
gcuagccaccaggcggucag

SEQ ID NO: 1280610 - RNA, 20 nt, Mycobacterium tuberculosis H37Rv
gcuacggcgacacgccagcc

SEQ ID NO: 1280611 - RNA, 22 nt, Mycobacterium tuberculosis H37Rv
gcuacggccagugccaucgcca

SEQ ID NO: 1280612 - RNA, 17 nt, Mycobacterium tuberculosis H37Rv
gcuacguuacgccgaga

SEQ ID NO: 1280613 - RNA, 22 nt, Mycobacterium tuberculosis H37Rv
gcgguccugguguagccgagca

SEQ ID NO: 1280614 - RNA, 18 nt, Mycobacterium tuberculosis H37Rv
gcggucgagaugucgaag

SEQ ID NO: 1280615 - RNA, 19 nt, Mycobacterium tuberculosis H37Rv
gcgguccggcuucggcgaa

SEQ ID NO: 1280616 - RNA, 15 nt, Mycobacterium tuberculosis H37Rv
gcgguccucgagccg

SEQ ID NO: 1280617 - RNA, 14 nt, Mycobacterium tuberculosis H37Rv
gcggucgacguguu

SEQ ID NO: 1280618 - RNA, 14 nt, Mycobacterium tuberculosis H37Rv
gcguagcggcgaua

SEQ ID NO: 1280619 - RNA, 13 nt, Mycobacterium tuberculosis H37Rv
gcggucgaucaca

SEQ ID NO: 1280620 - RNA, 15 nt, Mycobacterium tuberculosis H37Rv
gcguaggcgauggcg

SEQ ID NO: 1280621 - RNA, 14 nt, Mycobacterium tuberculosis H37Rv
gcguaggccagcga

SEQ ID NO: 1280622 - RNA, 15 nt, Mycobacterium tuberculosis H37Rv
gcguaucgacccgcg

SEQ ID NO: 1280623 - RNA, 17 nt, Mycobacterium tuberculosis H37Rv
gcgucaaccacggccgc

SEQ ID NO: 1280624 - RNA, 22 nt, Mycobacterium tuberculosis H37Rv
gcgucaccucaccgaacggcag

SEQ ID NO: 1280625 - RNA, 22 nt, Mycobacterium tuberculosis H37Rv
gcgucaccguguugcacgcggg

SEQ ID NO: 1280626 - RNA, 20 nt, Mycobacterium tuberculosis H37Rv
gcgucacggugcguucgugc

SEQ ID NO: 1280627 - RNA, 13 nt, Mycobacterium tuberculosis H37Rv
gcgucaucaccgg

SEQ ID NO: 1280628 - RNA, 21 nt, Mycobacterium tuberculosis H37Rv
gcgucaucaccgguacugcga

SEQ ID NO: 1280629 - RNA, 15 nt, Mycobacterium tuberculosis H37Rv
gcgucaucaggucgu

SEQ ID NO: 1280630 - RNA, 17 nt, Mycobacterium tuberculosis H37Rv
gcgucaucaggucgucg

SEQ ID NO: 1280631 - RNA, 21 nt, Mycobacterium tuberculosis H37Rv
gcgucaugaugucgacaucga

SEQ ID NO: 1280632 - RNA, 16 nt, Mycobacterium tuberculosis H37Rv
gcguccaccacgcaaa

SEQ ID NO: 1280633 - RNA, 23 nt, Mycobacterium tuberculosis H37Rv
gcguccacccacgaucagcagcg

SEQ ID NO: 1280634 - RNA, 12 nt, Mycobacterium tuberculosis H37Rv
gcguccaccacg

SEQ ID NO: 1280635 - RNA, 13 nt, Mycobacterium tuberculosis H37Rv
gcgucgccgucga

SEQ ID NO: 1280636 - RNA, 15 nt, Mycobacterium tuberculosis H37Rv
gcgucggaaauucca

SEQ ID NO: 1280637 - RNA, 20 nt, Mycobacterium tuberculosis H37Rv
gcgucggccaggaucaaccg

SEQ ID NO: 1280638 - RNA, 21 nt, Mycobacterium tuberculosis H37Rv
gcgucggccacccgguccacc

SEQ ID NO: 1280639 - RNA, 23 nt, Mycobacterium tuberculosis H37Rv
gcgucgcuggugggaucgcagcg

SEQ ID NO: 1280640 - RNA, 16 nt, Mycobacterium tuberculosis H37Rv
gcgucgaucguuccgc

SEQ ID NO: 1280641 - RNA, 19 nt, Mycobacterium tuberculosis H37Rv
gcgucgaaggugaccaggc

SEQ ID NO: 1280642 - RNA, 17 nt, Mycobacterium tuberculosis H37Rv
gcgucgagugccgccac

SEQ ID NO: 1280643 - RNA, 13 nt, Mycobacterium tuberculosis H37Rv
gcguccagcagcg

SEQ ID NO: 1280644 - RNA, 17 nt, Mycobacterium tuberculosis H37Rv
gcguccgcccagccgca

SEQ ID NO: 1280645 - RNA, 16 nt, Mycobacterium tuberculosis H37Rv
gcgucgaacacgucgg

SEQ ID NO: 1280646 - RNA, 13 nt, Mycobacterium tuberculosis H37Rv
gcguccggaacca

SEQ ID NO: 1280647 - RNA, 20 nt, Mycobacterium tuberculosis H37Rv
gcguccgggcucgcgcucga

SEQ ID NO: 1280648 - RNA, 14 nt, Mycobacterium tuberculosis H37Rv
gcgucgaagccggg

SEQ ID NO: 1280649 - RNA, 16 nt, Mycobacterium tuberculosis H37Rv
gcgucgaaccagucga

SEQ ID NO: 1280650 - RNA, 20 nt, Mycobacterium tuberculosis H37Rv
gcgucgaacacgucgggaug

SEQ ID NO: 1280651 - RNA, 17 nt, Mycobacterium tuberculosis H37Rv
gcgucgaagacggcaag

SEQ ID NO: 1280652 - RNA, 20 nt, Mycobacterium tuberculosis H37Rv
gcgucucggaggcgaccacg

SEQ ID NO: 1280653 - RNA, 16 nt, Mycobacterium tuberculosis H37Rv
gcgugaaccuggcgac

SEQ ID NO: 1280654 - RNA, 17 nt, Mycobacterium tuberculosis H37Rv
gcgucugcucgccagcc

SEQ ID NO: 1280655 - RNA, 17 nt, Mycobacterium tuberculosis H37Rv
gcgucugcucaccagcg

SEQ ID NO: 1280656 - RNA, 22 nt, Mycobacterium tuberculosis H37Rv
gcgugaccacugaaccguucga

SEQ ID NO: 1280657 - RNA, 23 nt, Mycobacterium tuberculosis H37Rv
gcgugaccagucgcggcguucgg

SEQ ID NO: 1280658 - RNA, 14 nt, Mycobacterium tuberculosis H37Rv
gcgugacagggcgg

SEQ ID NO: 1280659 - RNA, 16 nt, Mycobacterium tuberculosis H37Rv
gcgugaccaccgccga

SEQ ID NO: 1280660 - RNA, 16 nt, Mycobacterium tuberculosis H37Rv
aagcuugggcgaucgu

SEQ ID NO: 1280661 - RNA, 22 nt, Mycobacterium tuberculosis H37Rv
aagcuuaggcgugguucccggc

SEQ ID NO: 1280662 - RNA, 21 nt, Mycobacterium tuberculosis H37Rv
aagcugugccuucgccucguu

SEQ ID NO: 1280663 - RNA, 15 nt, Mycobacterium tuberculosis H37Rv
gcgucgucgucgaga

SEQ ID NO: 1280664 - RNA, 19 nt, Mycobacterium tuberculosis H37Rv
gcgucgugucggguccaac

SEQ ID NO: 1280665 - RNA, 20 nt, Mycobacterium tuberculosis H37Rv
gcgucgugcgauucacacuc

SEQ ID NO: 1280666 - RNA, 17 nt, Mycobacterium tuberculosis H37Rv
gcgucguuugggugcgc

SEQ ID NO: 1280667 - RNA, 20 nt, Mycobacterium tuberculosis H37Rv
gcgucguugcucggucucgu

SEQ ID NO: 1280668 - RNA, 17 nt, Mycobacterium tuberculosis H37Rv
gcgucguugcucggucu

SEQ ID NO: 1280669 - RNA, 23 nt, Mycobacterium tuberculosis H37Rv
gcgucguugaggaagcccgaugc

SEQ ID NO: 1280670 - RNA, 14 nt, Mycobacterium tuberculosis H37Rv
gcgucguucgcggg

SEQ ID NO: 1280671 - RNA, 14 nt, Mycobacterium tuberculosis H37Rv
gcgucguugaggaa

SEQ ID NO: 1280672 - RNA, 17 nt, Mycobacterium tuberculosis H37Rv
gcgucguugaggaagcc

SEQ ID NO: 1280673 - RNA, 18 nt, Mycobacterium tuberculosis H37Rv
gcgucgucgagucgacaa

SEQ ID NO: 1280674 - RNA, 19 nt, Mycobacterium tuberculosis H37Rv
gcgucgucgaguuggccau

SEQ ID NO: 1280675 - RNA, 22 nt, Mycobacterium tuberculosis H37Rv
gcgucgucgaugaugccggaca

SEQ ID NO: 1280676 - RNA, 22 nt, Mycobacterium tuberculosis H37Rv
gcgucgucgauggcugcgccga

SEQ ID NO: 1280677 - RNA, 23 nt, Mycobacterium tuberculosis H37Rv
gcgucggcgaugaacagcgacgc

SEQ ID NO: 1280678 - RNA, 18 nt, Mycobacterium tuberculosis H37Rv
gcgucggcccgcggucgc

SEQ ID NO: 1280679 - RNA, 21 nt, Mycobacterium tuberculosis H37Rv
gcgucggcgaacagacgcaaa

SEQ ID NO: 1280680 - RNA, 12 nt, Mycobacterium tuberculosis H37Rv
gcgucggcgaau

SEQ ID NO: 1280681 - RNA, 17 nt, Mycobacterium tuberculosis H37Rv
gcgucggcgacguccag

SEQ ID NO: 1280682 - RNA, 21 nt, Mycobacterium tuberculosis H37Rv
gcgugccggggauaucacgac

SEQ ID NO: 1280683 - RNA, 22 nt, Mycobacterium tuberculosis H37Rv
gcgugcgacgauaucgggagcg

SEQ ID NO: 1280684 - RNA, 19 nt, Mycobacterium tuberculosis H37Rv
gcgugccgacccgcuucgc

SEQ ID NO: 1280685 - RNA, 14 nt, Mycobacterium tuberculosis H37Rv
gcgugccgaccagc

SEQ ID NO: 1280686 - RNA, 12 nt, Mycobacterium tuberculosis H37Rv
gcgugccagcgc

SEQ ID NO: 1280687 - RNA, 12 nt, Mycobacterium tuberculosis H37Rv
gcgugcaucgcg

SEQ ID NO: 1280688 - RNA, 17 nt, Mycobacterium tuberculosis H37Rv
gcgugcaucgccugcgc

SEQ ID NO: 1280689 - RNA, 20 nt, Mycobacterium tuberculosis H37Rv
gcgugcaggcugucaauccg

SEQ ID NO: 1280690 - RNA, 16 nt, Mycobacterium tuberculosis H37Rv
gcguggcgcaccaccg

SEQ ID NO: 1280691 - RNA, 15 nt, Mycobacterium tuberculosis H37Rv
gcguggcgcaccacc

SEQ ID NO: 1280692 - RNA, 17 nt, Mycobacterium tuberculosis H37Rv
gcguguagguccacaac

SEQ ID NO: 1280693 - RNA, 21 nt, Mycobacterium tuberculosis H37Rv
gcguguaguggcccgcgggca

SEQ ID NO: 1280694 - RNA, 15 nt, Mycobacterium tuberculosis H37Rv
gcgugguguccaccg

SEQ ID NO: 1280695 - RNA, 12 nt, Mycobacterium tuberculosis H37Rv
gcguggugcuga

SEQ ID NO: 1280696 - RNA, 18 nt, Mycobacterium tuberculosis H37Rv
gcguggucgggaacccgg

SEQ ID NO: 1280697 - RNA, 23 nt, Mycobacterium tuberculosis H37Rv
gcguggucaccccuucgccagcg

SEQ ID NO: 1280698 - RNA, 22 nt, Mycobacterium tuberculosis H37Rv
gcguggcgggcugcagccgaca

SEQ ID NO: 1280699 - RNA, 18 nt, Mycobacterium tuberculosis H37Rv
gcugcggcgaucuggucg

SEQ ID NO: 1280700 - RNA, 13 nt, Mycobacterium tuberculosis H37Rv
gcugcggcccaca

SEQ ID NO: 1280701 - RNA, 12 nt, Mycobacterium tuberculosis H37Rv
gcugcggccagg

SEQ ID NO: 1280702 - RNA, 14 nt, Mycobacterium tuberculosis H37Rv
gcugcggccagcgc

SEQ ID NO: 1280703 - RNA, 12 nt, Mycobacterium tuberculosis H37Rv
gcugcggcagcg

SEQ ID NO: 1280704 - RNA, 19 nt, Mycobacterium tuberculosis H37Rv
gcugcggauuaagucggcg

SEQ ID NO: 1280705 - RNA, 18 nt, Mycobacterium tuberculosis H37Rv
gcugcggauccaccacgc

SEQ ID NO: 1280706 - RNA, 18 nt, Mycobacterium tuberculosis H37Rv
gcugcggauacagccgcc

SEQ ID NO: 1280707 - RNA, 14 nt, Mycobacterium tuberculosis H37Rv
gcugcgcgucgagc

SEQ ID NO: 1280708 - RNA, 19 nt, Mycobacterium tuberculosis H37Rv
gcugcgagaucgcggcgac

SEQ ID NO: 1280709 - RNA, 14 nt, Mycobacterium tuberculosis H37Rv
gcugcgauaugguc

SEQ ID NO: 1280710 - RNA, 14 nt, Mycobacterium tuberculosis H37Rv
gcugcgcagcggca

SEQ ID NO: 1280711 - RNA, 17 nt, Mycobacterium tuberculosis H37Rv
gcugcgccagaaucccg

SEQ ID NO: 1280712 - RNA, 17 nt, Mycobacterium tuberculosis H37Rv
gcugccuuggcgcggca

SEQ ID NO: 1280713 - RNA, 22 nt, Mycobacterium tuberculosis H37Rv
gcugcgaaagccacucgcgcac

SEQ ID NO: 1280714 - RNA, 13 nt, Mycobacterium tuberculosis H37Rv
gcugccugccgcg

SEQ ID NO: 1280715 - RNA, 16 nt, Mycobacterium tuberculosis H37Rv
gcugccgucggugccg

SEQ ID NO: 1280716 - RNA, 22 nt, Mycobacterium tuberculosis H37Rv
gcugccguauccaggcgugcau

SEQ ID NO: 1280717 - RNA, 18 nt, Mycobacterium tuberculosis H37Rv
gcugccgucagcugaccg

SEQ ID NO: 1280718 - RNA, 14 nt, Mycobacterium tuberculosis H37Rv
gcugcccgcggugu

SEQ ID NO: 1280719 - RNA, 20 nt, Mycobacterium tuberculosis H37Rv
gcugccggugugcggcguac

SEQ ID NO: 1280720 - RNA, 15 nt, Mycobacterium tuberculosis H37Rv
gcugcccgccagcgc

SEQ ID NO: 1280721 - RNA, 13 nt, Mycobacterium tuberculosis H37Rv
gcugcccgccagc

SEQ ID NO: 1280722 - RNA, 18 nt, Mycobacterium tuberculosis H37Rv
gcugcccgcgcggccaau

SEQ ID NO: 1280723 - RNA, 13 nt, Mycobacterium tuberculosis H37Rv
gcugcacgcucgu

SEQ ID NO: 1280724 - RNA, 18 nt, Mycobacterium tuberculosis H37Rv
gcugcagugacucgauca

SEQ ID NO: 1280725 - RNA, 15 nt, Mycobacterium tuberculosis H37Rv
gcugcagugccgcac

SEQ ID NO: 1280726 - RNA, 16 nt, Mycobacterium tuberculosis H37Rv
gcugccagccgaagcc

SEQ ID NO: 1280727 - RNA, 16 nt, Mycobacterium tuberculosis H37Rv
gcugccacgcgucggu

SEQ ID NO: 1280728 - RNA, 18 nt, Mycobacterium tuberculosis H37Rv
gcugccaucccgaucccg

SEQ ID NO: 1280729 - RNA, 19 nt, Mycobacterium tuberculosis H37Rv
gcugacgguuugcggagca

SEQ ID NO: 1280730 - RNA, 16 nt, Mycobacterium tuberculosis H37Rv
gcugacggccugcaac

SEQ ID NO: 1280731 - RNA, 18 nt, Mycobacterium tuberculosis H37Rv
gcugacuagggucaccga

SEQ ID NO: 1280732 - RNA, 17 nt, Mycobacterium tuberculosis H37Rv
gcugacuagggucaccg

SEQ ID NO: 1280733 - RNA, 20 nt, Mycobacterium tuberculosis H37Rv
gcugacgucuuggaacacgg

SEQ ID NO: 1280734 - RNA, 21 nt, Mycobacterium tuberculosis H37Rv
gcugaugccgucuuugucacg

SEQ ID NO: 1280735 - RNA, 12 nt, Mycobacterium tuberculosis H37Rv
gcuggccaccgc

SEQ ID NO: 1280736 - RNA, 13 nt, Mycobacterium tuberculosis H37Rv
gcuggccagcaca

SEQ ID NO: 1280737 - RNA, 20 nt, Mycobacterium tuberculosis H37Rv
gcuggccacgauccgcggua

SEQ ID NO: 1280738 - RNA, 23 nt, Mycobacterium tuberculosis H37Rv
gcuggcaaguccggucgcggaga

SEQ ID NO: 1280739 - RNA, 13 nt, Mycobacterium tuberculosis H37Rv
gcuggcaaccgcg

SEQ ID NO: 1280740 - RNA, 20 nt, Mycobacterium tuberculosis H37Rv
gcuggcaaucccgcggucga

SEQ ID NO: 1280741 - RNA, 13 nt, Mycobacterium tuberculosis H37Rv
gcuggcagcucgg

SEQ ID NO: 1280742 - RNA, 17 nt, Mycobacterium tuberculosis H37Rv
gcuggcgaccuggucgc

SEQ ID NO: 1280743 - RNA, 15 nt, Mycobacterium tuberculosis H37Rv
gcuggcgacgacgac

SEQ ID NO: 1280744 - RNA, 17 nt, Mycobacterium tuberculosis H37Rv
gcuggcgagggcugacg

SEQ ID NO: 1280745 - RNA, 14 nt, Mycobacterium tuberculosis H37Rv
gcuggccgucgaag

SEQ ID NO: 1280746 - RNA, 22 nt, Mycobacterium tuberculosis H37Rv
gcuggccggguuccagcggcac

SEQ ID NO: 1280747 - RNA, 18 nt, Mycobacterium tuberculosis H37Rv
gcuggcccgcaugccggc

SEQ ID NO: 1280748 - RNA, 19 nt, Mycobacterium tuberculosis H37Rv
gcugcuuggcggucugcgc

SEQ ID NO: 1280749 - RNA, 16 nt, Mycobacterium tuberculosis H37Rv
gcugcggcuuucagcg

SEQ ID NO: 1280750 - RNA, 20 nt, Mycobacterium tuberculosis H37Rv
gcugcggcgcuggccagcag

SEQ ID NO: 1280751 - RNA, 20 nt, Mycobacterium tuberculosis H37Rv
gcugcugaugcgguagucgc

SEQ ID NO: 1280752 - RNA, 15 nt, Mycobacterium tuberculosis H37Rv
gcugcugcgcggugc

SEQ ID NO: 1280753 - RNA, 16 nt, Mycobacterium tuberculosis H37Rv
gcuggagcagcuaccg

SEQ ID NO: 1280754 - RNA, 15 nt, Mycobacterium tuberculosis H37Rv
gcuggacuccgguca

SEQ ID NO: 1280755 - RNA, 21 nt, Mycobacterium tuberculosis H37Rv
gcuggaucgagcuaguucggc

SEQ ID NO: 1280756 - RNA, 22 nt, Mycobacterium tuberculosis H37Rv
gcuggaaucgaaaaggugcacc

SEQ ID NO: 1280757 - RNA, 16 nt, Mycobacterium tuberculosis H37Rv
gcuggaagucggucug

SEQ ID NO: 1280758 - RNA, 21 nt, Mycobacterium tuberculosis H37Rv
gcucacgacuggcgcccagcc

SEQ ID NO: 1280759 - RNA, 12 nt, Mycobacterium tuberculosis H37Rv
gcucacgaucac

SEQ ID NO: 1280760 - RNA, 17 nt, Mycobacterium tuberculosis H37Rv
gcucacgcugaagccgc

SEQ ID NO: 1280761 - RNA, 14 nt, Mycobacterium tuberculosis H37Rv
gcucacgcggucaa

SEQ ID NO: 1280762 - RNA, 17 nt, Mycobacterium tuberculosis H37Rv
gcucacgcggucaacgc

SEQ ID NO: 1280763 - RNA, 14 nt, Mycobacterium tuberculosis H37Rv
gcucacggcccgag

SEQ ID NO: 1280764 - RNA, 22 nt, Mycobacterium tuberculosis H37Rv
gcucacggcccgagccgcgugg

SEQ ID NO: 1280765 - RNA, 20 nt, Mycobacterium tuberculosis H37Rv
gcucacgguggccgcaucga

SEQ ID NO: 1280766 - RNA, 21 nt, Mycobacterium tuberculosis H37Rv
gcucacgguggccgcaucgac

SEQ ID NO: 1280767 - RNA, 14 nt, Mycobacterium tuberculosis H37Rv
gcucacuggugacc

SEQ ID NO: 1280768 - RNA, 13 nt, Mycobacterium tuberculosis H37Rv
gcucacuacccgc

SEQ ID NO: 1280769 - RNA, 19 nt, Mycobacterium tuberculosis H37Rv
gcucacgggcgaucgugcg

SEQ ID NO: 1280770 - RNA, 20 nt, Mycobacterium tuberculosis H37Rv
gcuccgggugcagaucgccc

SEQ ID NO: 1280771 - RNA, 23 nt, Mycobacterium tuberculosis H37Rv
gcuccgccugccgcuggucgucg

SEQ ID NO: 1280772 - RNA, 13 nt, Mycobacterium tuberculosis H37Rv
gcuccgccgccga

SEQ ID NO: 1280773 - RNA, 18 nt, Mycobacterium tuberculosis H37Rv
gcuccgccgccgacggau

SEQ ID NO: 1280774 - RNA, 16 nt, Mycobacterium tuberculosis H37Rv
gcuccgccgucgccgc

SEQ ID NO: 1280775 - RNA, 21 nt, Mycobacterium tuberculosis H37Rv
gcuccgcagcgaagaccagcg

SEQ ID NO: 1280776 - RNA, 18 nt, Mycobacterium tuberculosis H37Rv
gcuccgaugccgacggcg

SEQ ID NO: 1280777 - RNA, 14 nt, Mycobacterium tuberculosis H37Rv
gcuccgaugccgac

SEQ ID NO: 1280778 - RNA, 21 nt, Mycobacterium tuberculosis H37Rv
gcuccgaugcaucggugcagc

SEQ ID NO: 1280779 - RNA, 15 nt, Mycobacterium tuberculosis H37Rv
gcucgauaucguugg

SEQ ID NO: 1280780 - RNA, 15 nt, Mycobacterium tuberculosis H37Rv
gcucgagcaccucgg

SEQ ID NO: 1280781 - RNA, 21 nt, Mycobacterium tuberculosis H37Rv
gcucgaccugaggcaccucgg

SEQ ID NO: 1280782 - RNA, 15 nt, Mycobacterium tuberculosis H37Rv
gcuccguuguccagc

SEQ ID NO: 1280783 - RNA, 19 nt, Mycobacterium tuberculosis H37Rv
gcuccucauagagcggcac

SEQ ID NO: 1280784 - RNA, 20 nt, Mycobacterium tuberculosis H37Rv
gcuccgugguugccgaagcc

SEQ ID NO: 1280785 - RNA, 19 nt, Mycobacterium tuberculosis H37Rv
gcuccgugucggacaagga

SEQ ID NO: 1280786 - RNA, 15 nt, Mycobacterium tuberculosis H37Rv
gcuccucggccagcg

SEQ ID NO: 1280787 - RNA, 20 nt, Mycobacterium tuberculosis H37Rv
gcuccuccccggcccgcuca

SEQ ID NO: 1280788 - RNA, 14 nt, Mycobacterium tuberculosis H37Rv
gcucgccggccaac

SEQ ID NO: 1280789 - RNA, 12 nt, Mycobacterium tuberculosis H37Rv
gcucgccggcac

SEQ ID NO: 1280790 - RNA, 16 nt, Mycobacterium tuberculosis H37Rv
gcucgccggcaccgac

SEQ ID NO: 1280791 - RNA, 21 nt, Mycobacterium tuberculosis H37Rv
gcucgccgguaggcggccagc

SEQ ID NO: 1280792 - RNA, 22 nt, Mycobacterium tuberculosis H37Rv
gcucgccgguaggcggccagcg

SEQ ID NO: 1280793 - RNA, 19 nt, Mycobacterium tuberculosis H37Rv
gcucgccgguaggcggcca

SEQ ID NO: 1280794 - RNA, 18 nt, Mycobacterium tuberculosis H37Rv
gcucgccguaagcaccag

SEQ ID NO: 1280795 - RNA, 20 nt, Mycobacterium tuberculosis H37Rv
gcucgccggcucggcgguac

SEQ ID NO: 1280796 - RNA, 19 nt, Mycobacterium tuberculosis H37Rv
gcucgccgauaucugccac

SEQ ID NO: 1280797 - RNA, 20 nt, Mycobacterium tuberculosis H37Rv
gcucgaucggcagccagggc

SEQ ID NO: 1280798 - RNA, 16 nt, Mycobacterium tuberculosis H37Rv
gcucgaucagccgggu

SEQ ID NO: 1280799 - RNA, 16 nt, Mycobacterium tuberculosis H37Rv
gcucgcucugcgcggc

SEQ ID NO: 1280800 - RNA, 20 nt, Mycobacterium tuberculosis H37Rv
gcucgcugaugcaucccaac

SEQ ID NO: 1280801 - RNA, 21 nt, Mycobacterium tuberculosis H37Rv
gcucgcuguagagggugucgc

SEQ ID NO: 1280802 - RNA, 21 nt, Mycobacterium tuberculosis H37Rv
gcucgcguggccgccggcgcu

SEQ ID NO: 1280803 - RNA, 15 nt, Mycobacterium tuberculosis H37Rv
gcucgcucaccggcu

SEQ ID NO: 1280804 - RNA, 19 nt, Mycobacterium tuberculosis H37Rv
gcucguccagcgagcgcag

SEQ ID NO: 1280805 - RNA, 18 nt, Mycobacterium tuberculosis H37Rv
gcucgguggcaucggcgg

SEQ ID NO: 1280806 - RNA, 12 nt, Mycobacterium tuberculosis H37Rv
gcucgucaaacg

SEQ ID NO: 1280807 - RNA, 11 nt, Mycobacterium tuberculosis H37Rv
gcucggugcgc

SEQ ID NO: 1280808 - RNA, 16 nt, Mycobacterium tuberculosis H37Rv
gcucggugcacggcgc

SEQ ID NO: 1280809 - RNA, 18 nt, Mycobacterium tuberculosis H37Rv
gcucgguggcggacggcg

SEQ ID NO: 1280810 - RNA, 22 nt, Mycobacterium tuberculosis H37Rv
gcucguccucgucuucgucggu

SEQ ID NO: 1280811 - RNA, 14 nt, Mycobacterium tuberculosis H37Rv
gcucgucgagcaug

SEQ ID NO: 1280812 - RNA, 12 nt, Mycobacterium tuberculosis H37Rv
gcucgucgacgu

SEQ ID NO: 1280813 - RNA, 23 nt, Mycobacterium tuberculosis H37Rv
gcucgucgaugucgacgucgcgu

SEQ ID NO: 1280814 - RNA, 19 nt, Mycobacterium tuberculosis H37Rv
gcucgucgagcgcgucggu

SEQ ID NO: 1280815 - RNA, 22 nt, Mycobacterium tuberculosis H37Rv
gcucgucgagcgcgucggucac

SEQ ID NO: 1280816 - RNA, 17 nt, Mycobacterium tuberculosis H37Rv
gcucgucgccugcgacu

SEQ ID NO: 1280817 - RNA, 13 nt, Mycobacterium tuberculosis H37Rv
gcucgucggcgcc

SEQ ID NO: 1280818 - RNA, 14 nt, Mycobacterium tuberculosis H37Rv
gcucgucggcgaug

SEQ ID NO: 1280819 - RNA, 20 nt, Mycobacterium tuberculosis H37Rv
gcucgucggucaccgaaugc

SEQ ID NO: 1280820 - RNA, 18 nt, Mycobacterium tuberculosis H37Rv
gcucgucgucgauccagc

SEQ ID NO: 1280821 - RNA, 20 nt, Mycobacterium tuberculosis H37Rv
gcucgucuugggccgggaug

SEQ ID NO: 1280822 - RNA, 15 nt, Mycobacterium tuberculosis H37Rv
gcucgggucaucuug

SEQ ID NO: 1280823 - RNA, 20 nt, Mycobacterium tuberculosis H37Rv
gcucgggguugcucgcgauc

SEQ ID NO: 1280824 - RNA, 18 nt, Mycobacterium tuberculosis H37Rv
gcucgggguugcucgcga

SEQ ID NO: 1280825 - RNA, 17 nt, Mycobacterium tuberculosis H37Rv
gcucgggggauccggcg

SEQ ID NO: 1280826 - RNA, 22 nt, Mycobacterium tuberculosis H37Rv
gcucggucuuguauaggccguu

SEQ ID NO: 1280827 - RNA, 14 nt, Mycobacterium tuberculosis H37Rv
gcucggucuccacc

SEQ ID NO: 1280828 - RNA, 22 nt, Mycobacterium tuberculosis H37Rv
gcucgguccagccgguccagac

SEQ ID NO: 1280829 - RNA, 16 nt, Mycobacterium tuberculosis H37Rv
gcucggucagcgucag

SEQ ID NO: 1280830 - RNA, 23 nt, Mycobacterium tuberculosis H37Rv
gcucggucagcgucaggugcgcg

SEQ ID NO: 1280831 - RNA, 21 nt, Mycobacterium tuberculosis H37Rv
gcucgggcgcgaggacgcuga

SEQ ID NO: 1280832 - RNA, 18 nt, Mycobacterium tuberculosis H37Rv
gcucgggcgcgcggcgag

SEQ ID NO: 1280833 - RNA, 16 nt, Mycobacterium tuberculosis H37Rv
gcucggcgaguucggc

SEQ ID NO: 1280834 - RNA, 17 nt, Mycobacterium tuberculosis H37Rv
gcucggcgccguuuggc

SEQ ID NO: 1280835 - RNA, 15 nt, Mycobacterium tuberculosis H37Rv
gcucggccauagcgc

SEQ ID NO: 1280836 - RNA, 19 nt, Mycobacterium tuberculosis H37Rv
gcugaagccgacgauccac

SEQ ID NO: 1280837 - RNA, 17 nt, Mycobacterium tuberculosis H37Rv
gcugaccgaauggccgc

SEQ ID NO: 1280838 - RNA, 24 nt, Mycobacterium tuberculosis H37Rv
gcugaccgcuaccagcugggcgac

SEQ ID NO: 1280839 - RNA, 15 nt, Mycobacterium tuberculosis H37Rv
gcugaagcccauggc

SEQ ID NO: 1280840 - RNA, 18 nt, Mycobacterium tuberculosis H37Rv
gcugaagcuguaggcgac

SEQ ID NO: 1280841 - RNA, 21 nt, Mycobacterium tuberculosis H37Rv
gcugaagacgaauaacgccgc

SEQ ID NO: 1280842 - RNA, 19 nt, Mycobacterium tuberculosis H37Rv
gcugacgacugggcgccca

SEQ ID NO: 1280843 - RNA, 16 nt, Mycobacterium tuberculosis H37Rv
gcugaccuucucacgc

SEQ ID NO: 1280844 - RNA, 19 nt, Mycobacterium tuberculosis H37Rv
gcugaccuuguugaccacc

SEQ ID NO: 1280845 - RNA, 22 nt, Mycobacterium tuberculosis H37Rv
gcugaccuucucacgcaccaug

SEQ ID NO: 1280846 - RNA, 22 nt, Mycobacterium tuberculosis H37Rv
gcugaccguuucgaucucgagc

SEQ ID NO: 1280847 - RNA, 19 nt, Mycobacterium tuberculosis H37Rv
gcucugcgccacagcagcg

SEQ ID NO: 1280848 - RNA, 20 nt, Mycobacterium tuberculosis H37Rv
gcucgugaucuucggcgauc

SEQ ID NO: 1280849 - RNA, 14 nt, Mycobacterium tuberculosis H37Rv
gcucuggacgguca

SEQ ID NO: 1280850 - RNA, 13 nt, Mycobacterium tuberculosis H37Rv
gcucugcggccac

SEQ ID NO: 1280851 - RNA, 13 nt, Mycobacterium tuberculosis H37Rv
gcucuggcuccga

SEQ ID NO: 1280852 - RNA, 15 nt, Mycobacterium tuberculosis H37Rv
gcucugcugccagcc

SEQ ID NO: 1280853 - RNA, 23 nt, Mycobacterium tuberculosis H37Rv
gcucugguuuuacacaccagcgg

SEQ ID NO: 1280854 - RNA, 17 nt, Mycobacterium tuberculosis H37Rv
gcucugugucgccgauc

SEQ ID NO: 1280855 - RNA, 15 nt, Mycobacterium tuberculosis H37Rv
gcugaacggcagccg

SEQ ID NO: 1280856 - RNA, 21 nt, Mycobacterium tuberculosis H37Rv
gcggaaaagaacccgggaucg

SEQ ID NO: 1280857 - RNA, 22 nt, Mycobacterium tuberculosis H37Rv
gcggaaaacccagaucggcgac

SEQ ID NO: 1280858 - RNA, 23 nt, Mycobacterium tuberculosis H37Rv
gcgcuugcgaucggcacuuagcc

SEQ ID NO: 1280859 - RNA, 15 nt, Mycobacterium tuberculosis H37Rv
gcgcuugcgaucggc

SEQ ID NO: 1280860 - RNA, 16 nt, Mycobacterium tuberculosis H37Rv
gcgcuugcgaucgccg

SEQ ID NO: 1280861 - RNA, 17 nt, Mycobacterium tuberculosis H37Rv
gcggaagcggcggcccu

SEQ ID NO: 1280862 - RNA, 16 nt, Mycobacterium tuberculosis H37Rv
gcggaaggcgucgaac

SEQ ID NO: 1280863 - RNA, 14 nt, Mycobacterium tuberculosis H37Rv
gcggaaggcgucga

SEQ ID NO: 1280864 - RNA, 13 nt, Mycobacterium tuberculosis H37Rv
gcggaaucaccga

SEQ ID NO: 1280865 - RNA, 17 nt, Mycobacterium tuberculosis H37Rv
gcggaauccgcggcgau

SEQ ID NO: 1280866 - RNA, 18 nt, Mycobacterium tuberculosis H37Rv
gcggaauccgcggcgauc

SEQ ID NO: 1280867 - RNA, 13 nt, Mycobacterium tuberculosis H37Rv
gcggaaucgcgac

SEQ ID NO: 1280868 - RNA, 16 nt, Mycobacterium tuberculosis H37Rv
gcggaauuagucgccg

SEQ ID NO: 1280869 - RNA, 17 nt, Mycobacterium tuberculosis H37Rv
gcggaauuagucgccgc

SEQ ID NO: 1280870 - RNA, 19 nt, Mycobacterium tuberculosis H37Rv
gcggaacaccaccaggcug

SEQ ID NO: 1280871 - RNA, 19 nt, Mycobacterium tuberculosis H37Rv
gcggaaccugcucggccgu

SEQ ID NO: 1280872 - RNA, 17 nt, Mycobacterium tuberculosis H37Rv
gcggaacgccgagcacg

SEQ ID NO: 1280873 - RNA, 17 nt, Mycobacterium tuberculosis H37Rv
gcggaacgcgucgccga

SEQ ID NO: 1280874 - RNA, 15 nt, Mycobacterium tuberculosis H37Rv
gcggaacaccaccag

SEQ ID NO: 1280875 - RNA, 18 nt, Mycobacterium tuberculosis H37Rv
gcggaacgcgucgccgac

SEQ ID NO: 1280876 - RNA, 16 nt, Mycobacterium tuberculosis H37Rv
gcgcuguugccaucga

SEQ ID NO: 1280877 - RNA, 19 nt, Mycobacterium tuberculosis H37Rv
gcgcuguugccaucgacgc

SEQ ID NO: 1280878 - RNA, 16 nt, Mycobacterium tuberculosis H37Rv
gcgcuguugcuggcgc

SEQ ID NO: 1280879 - RNA, 16 nt, Mycobacterium tuberculosis H37Rv
gcgcuuccaucgccac

SEQ ID NO: 1280880 - RNA, 20 nt, Mycobacterium tuberculosis H37Rv
gcgcuucacagccaccagcc

SEQ ID NO: 1280881 - RNA, 21 nt, Mycobacterium tuberculosis H37Rv
gcgcuucgucgccgaacagcg

SEQ ID NO: 1280882 - RNA, 22 nt, Mycobacterium tuberculosis H37Rv
gcgcuugaaacugauccacguc

SEQ ID NO: 1280883 - RNA, 20 nt, Mycobacterium tuberculosis H37Rv
gcgcugguaguguucagcuu

SEQ ID NO: 1280884 - RNA, 20 nt, Mycobacterium tuberculosis H37Rv
gcgcuggucggagaccagcg

SEQ ID NO: 1280885 - RNA, 16 nt, Mycobacterium tuberculosis H37Rv
gcgcugggcgcgcuca

SEQ ID NO: 1280886 - RNA, 15 nt, Mycobacterium tuberculosis H37Rv
gcgcuggcgucgucu

SEQ ID NO: 1280887 - RNA, 21 nt, Mycobacterium tuberculosis H37Rv
gcgcugggcgcgcucaucgac

SEQ ID NO: 1280888 - RNA, 22 nt, Mycobacterium tuberculosis H37Rv
gcgcugggauguucgaucagcg

SEQ ID NO: 1280889 - RNA, 15 nt, Mycobacterium tuberculosis H37Rv
gcgcgcagcugacgu

SEQ ID NO: 1280890 - RNA, 13 nt, Mycobacterium tuberculosis H37Rv
gcgcgcagcucgg

SEQ ID NO: 1280891 - RNA, 15 nt, Mycobacterium tuberculosis H37Rv
gcgcgcagcgauucg

SEQ ID NO: 1280892 - RNA, 12 nt, Mycobacterium tuberculosis H37Rv
gcgcgcagcgau

SEQ ID NO: 1280893 - RNA, 19 nt, Mycobacterium tuberculosis H37Rv
gcgcgcagaucguccaccg

SEQ ID NO: 1280894 - RNA, 18 nt, Mycobacterium tuberculosis H37Rv
gcgcgcacgacaggaucg

SEQ ID NO: 1280895 - RNA, 15 nt, Mycobacterium tuberculosis H37Rv
gcgcucgcgcaccgu

SEQ ID NO: 1280896 - RNA, 18 nt, Mycobacterium tuberculosis H37Rv
gcgcucgcgguagcgccg

SEQ ID NO: 1280897 - RNA, 17 nt, Mycobacterium tuberculosis H37Rv
gcgcucgcgcgguaguc

SEQ ID NO: 1280898 - RNA, 20 nt, Mycobacterium tuberculosis H37Rv
gcgcucggucuccaccaccg

SEQ ID NO: 1280899 - RNA, 13 nt, Mycobacterium tuberculosis H37Rv
gcgcucucgguca

SEQ ID NO: 1280900 - RNA, 17 nt, Mycobacterium tuberculosis H37Rv
gcgcucggcgaucugcg

SEQ ID NO: 1280901 - RNA, 18 nt, Mycobacterium tuberculosis H37Rv
gcgcucggucuccaccac

SEQ ID NO: 1280902 - RNA, 16 nt, Mycobacterium tuberculosis H37Rv
gcgcugaagccgacga

SEQ ID NO: 1280903 - RNA, 18 nt, Mycobacterium tuberculosis H37Rv
gcgcugaacuagggucgg

SEQ ID NO: 1280904 - RNA, 21 nt, Mycobacterium tuberculosis H37Rv
gcgcugaagccgacgauccac

SEQ ID NO: 1280905 - RNA, 18 nt, Mycobacterium tuberculosis H37Rv
gcgcugaaggccgguagc

SEQ ID NO: 1280906 - RNA, 21 nt, Mycobacterium tuberculosis H37Rv
gcgcugagcacgcggaucgcg

SEQ ID NO: 1280907 - RNA, 15 nt, Mycobacterium tuberculosis H37Rv
gcgcugacccgccga

SEQ ID NO: 1280908 - RNA, 18 nt, Mycobacterium tuberculosis H37Rv
gcgcugacccgccgacga

SEQ ID NO: 1280909 - RNA, 21 nt, Mycobacterium tuberculosis H37Rv
gcgcugauccggucggccagc

SEQ ID NO: 1280910 - RNA, 20 nt, Mycobacterium tuberculosis H37Rv
gcgcugcagcacggcuucgc

SEQ ID NO: 1280911 - RNA, 23 nt, Mycobacterium tuberculosis H37Rv
gcgcugccaaacuaacggcagcc

SEQ ID NO: 1280912 - RNA, 19 nt, Mycobacterium tuberculosis H37Rv
gcgcugccaauccgaucga

SEQ ID NO: 1280913 - RNA, 14 nt, Mycobacterium tuberculosis H37Rv
gcgcugccaccgcg

SEQ ID NO: 1280914 - RNA, 13 nt, Mycobacterium tuberculosis H37Rv
gcgcugcagcgag

SEQ ID NO: 1280915 - RNA, 21 nt, Mycobacterium tuberculosis H37Rv
gcgcugcgcaccgccgcgcga

SEQ ID NO: 1280916 - RNA, 21 nt, Mycobacterium tuberculosis H37Rv
gcgcugccaguucuuggcgac

SEQ ID NO: 1280917 - RNA, 23 nt, Mycobacterium tuberculosis H37Rv
gcgcugccgccguuuccugcguc

SEQ ID NO: 1280918 - RNA, 21 nt, Mycobacterium tuberculosis H37Rv
gcgcuggaggacccgcuacga

SEQ ID NO: 1280919 - RNA, 13 nt, Mycobacterium tuberculosis H37Rv
gcgcuggacggcg

SEQ ID NO: 1280920 - RNA, 15 nt, Mycobacterium tuberculosis H37Rv
gcgcugcuggcagac

SEQ ID NO: 1280921 - RNA, 18 nt, Mycobacterium tuberculosis H37Rv
gcgcugcuggcagaccaa

SEQ ID NO: 1280922 - RNA, 21 nt, Mycobacterium tuberculosis H37Rv
gcgcugcggcccacaccagcg

SEQ ID NO: 1280923 - RNA, 20 nt, Mycobacterium tuberculosis H37Rv
gcgcugcucacgcagcagug

SEQ ID NO: 1280924 - RNA, 22 nt, Mycobacterium tuberculosis H37Rv
gcgcugcucugagcuuggucgc

SEQ ID NO: 1280925 - RNA, 17 nt, Mycobacterium tuberculosis H37Rv
gcgcuggaugugggcgc

SEQ ID NO: 1280926 - RNA, 16 nt, Mycobacterium tuberculosis H37Rv
gcgcuggccagcaggg

SEQ ID NO: 1280927 - RNA, 14 nt, Mycobacterium tuberculosis H37Rv
gcgcuggccagcag

SEQ ID NO: 1280928 - RNA, 19 nt, Mycobacterium tuberculosis H37Rv
gcgcuggccaugguggcgc

SEQ ID NO: 1280929 - RNA, 14 nt, Mycobacterium tuberculosis H37Rv
gcggacuucgccgc

SEQ ID NO: 1280930 - RNA, 19 nt, Mycobacterium tuberculosis H37Rv
gcggacucgagucugcgca

SEQ ID NO: 1280931 - RNA, 22 nt, Mycobacterium tuberculosis H37Rv
gcggacucagcggcguggucuc

SEQ ID NO: 1280932 - RNA, 23 nt, Mycobacterium tuberculosis H37Rv
gcggacggcguuuccuucgacga

SEQ ID NO: 1280933 - RNA, 21 nt, Mycobacterium tuberculosis H37Rv
gcggacuucguuccgugccga

SEQ ID NO: 1280934 - RNA, 19 nt, Mycobacterium tuberculosis H37Rv
gcggagcacuucgucgaac

SEQ ID NO: 1280935 - RNA, 19 nt, Mycobacterium tuberculosis H37Rv
gcggaguccgucgacaccg

SEQ ID NO: 1280936 - RNA, 21 nt, Mycobacterium tuberculosis H37Rv
gcggaguccgucgacaccgcg

SEQ ID NO: 1280937 - RNA, 14 nt, Mycobacterium tuberculosis H37Rv
gcggaggcgggugc

SEQ ID NO: 1280938 - RNA, 18 nt, Mycobacterium tuberculosis H37Rv
gcggacauccgggccgag

SEQ ID NO: 1280939 - RNA, 17 nt, Mycobacterium tuberculosis H37Rv
gcggacagcucgcggua

SEQ ID NO: 1280940 - RNA, 18 nt, Mycobacterium tuberculosis H37Rv
gcggacccgcagcugcgg

SEQ ID NO: 1280941 - RNA, 16 nt, Mycobacterium tuberculosis H37Rv
gcggaccaccgcucgc

SEQ ID NO: 1280942 - RNA, 13 nt, Mycobacterium tuberculosis H37Rv
gcggacacugcga

SEQ ID NO: 1280943 - RNA, 23 nt, Mycobacterium tuberculosis H37Rv
gcggacacugcgaaggaccagag

SEQ ID NO: 1280944 - RNA, 16 nt, Mycobacterium tuberculosis H37Rv
gcggacagcccggacg

SEQ ID NO: 1280945 - RNA, 13 nt, Mycobacterium tuberculosis H37Rv
gcggacagcucgc

SEQ ID NO: 1280946 - RNA, 15 nt, Mycobacterium tuberculosis H37Rv
gcggacagcucgcgg

SEQ ID NO: 1280947 - RNA, 18 nt, Mycobacterium tuberculosis H37Rv
gcggacaccgcggcgauc

SEQ ID NO: 1280948 - RNA, 16 nt, Mycobacterium tuberculosis H37Rv
gcggacaagucggcac

SEQ ID NO: 1280949 - RNA, 15 nt, Mycobacterium tuberculosis H37Rv
gcggacaagucggca

SEQ ID NO: 1280950 - RNA, 23 nt, Mycobacterium tuberculosis H37Rv
gcggacacgaucgcgucggcuac

SEQ ID NO: 1280951 - RNA, 20 nt, Mycobacterium tuberculosis H37Rv
gcggacacgaucgcgucggc

SEQ ID NO: 1280952 - RNA, 20 nt, Mycobacterium tuberculosis H37Rv
gcggacccgcgcgucgccca

SEQ ID NO: 1280953 - RNA, 20 nt, Mycobacterium tuberculosis H37Rv
gcggacccgcagcugcggau

SEQ ID NO: 1280954 - RNA, 16 nt, Mycobacterium tuberculosis H37Rv
gcggacccgaccgucg

SEQ ID NO: 1280955 - RNA, 20 nt, Mycobacterium tuberculosis H37Rv
gcggaccgauugucggcaac

SEQ ID NO: 1280956 - RNA, 14 nt, Mycobacterium tuberculosis H37Rv
gcggacccgcucgc

SEQ ID NO: 1280957 - RNA, 17 nt, Mycobacterium tuberculosis H37Rv
gcggaccgcaacgacgg

SEQ ID NO: 1280958 - RNA, 13 nt, Mycobacterium tuberculosis H37Rv
gcggacgaccuug

SEQ ID NO: 1280959 - RNA, 13 nt, Mycobacterium tuberculosis H37Rv
gcggaccugcgag

SEQ ID NO: 1280960 - RNA, 12 nt, Mycobacterium tuberculosis H37Rv
gcggaccguccg

SEQ ID NO: 1280961 - RNA, 17 nt, Mycobacterium tuberculosis H37Rv
gcggaucgcggucagcg

SEQ ID NO: 1280962 - RNA, 18 nt, Mycobacterium tuberculosis H37Rv
gcggaucugaucggcgcg

SEQ ID NO: 1280963 - RNA, 13 nt, Mycobacterium tuberculosis H37Rv
gcggaucugaucg

SEQ ID NO: 1280964 - RNA, 23 nt, Mycobacterium tuberculosis H37Rv
gcggaucuucucgguaccaccgg

SEQ ID NO: 1280965 - RNA, 16 nt, Mycobacterium tuberculosis H37Rv
gcggaucgucguuguc

SEQ ID NO: 1280966 - RNA, 21 nt, Mycobacterium tuberculosis H37Rv
gcggaucgucguugucagcga

SEQ ID NO: 1280967 - RNA, 20 nt, Mycobacterium tuberculosis H37Rv
gcggaugaacugggcaacau

SEQ ID NO: 1280968 - RNA, 18 nt, Mycobacterium tuberculosis H37Rv
gcggauuaagucggcggc

SEQ ID NO: 1280969 - RNA, 18 nt, Mycobacterium tuberculosis H37Rv
gcggaugucgucgaccag

SEQ ID NO: 1280970 - RNA, 19 nt, Mycobacterium tuberculosis H37Rv
gcggaugcuguugacccgu

SEQ ID NO: 1280971 - RNA, 20 nt, Mycobacterium tuberculosis H37Rv
gcggaucuggcuccggccag

SEQ ID NO: 1280972 - RNA, 14 nt, Mycobacterium tuberculosis H37Rv
gcggauggcgucga

SEQ ID NO: 1280973 - RNA, 16 nt, Mycobacterium tuberculosis H37Rv
gcggaucccgccggug

SEQ ID NO: 1280974 - RNA, 21 nt, Mycobacterium tuberculosis H37Rv
gcggauccagaaacugcucgg

SEQ ID NO: 1280975 - RNA, 18 nt, Mycobacterium tuberculosis H37Rv
gcggaucagaggacccgu

SEQ ID NO: 1280976 - RNA, 21 nt, Mycobacterium tuberculosis H37Rv
gcggaguucgcugacggccau

SEQ ID NO: 1280977 - RNA, 16 nt, Mycobacterium tuberculosis H37Rv
gcggaguuuuucgggg

SEQ ID NO: 1280978 - RNA, 21 nt, Mycobacterium tuberculosis H37Rv
gcggauagcggcaaagccggg

SEQ ID NO: 1280979 - RNA, 21 nt, Mycobacterium tuberculosis H37Rv
aagccgggauugccgccaccu

SEQ ID NO: 1280980 - RNA, 21 nt, Mycobacterium tuberculosis H37Rv
aagccggcugcauccuccucg

SEQ ID NO: 1280981 - RNA, 13 nt, Mycobacterium tuberculosis H37Rv
aagccgcgagcgc

SEQ ID NO: 1280982 - RNA, 23 nt, Mycobacterium tuberculosis H37Rv
aagccgcggcuaggccagcacgg

SEQ ID NO: 1280983 - RNA, 18 nt, Mycobacterium tuberculosis H37Rv
aagccgacguugaagccg

SEQ ID NO: 1280984 - RNA, 16 nt, Mycobacterium tuberculosis H37Rv
aagccgcaccagaucg

SEQ ID NO: 1280985 - RNA, 17 nt, Mycobacterium tuberculosis H37Rv
aagccguuggcgacguu

SEQ ID NO: 1280986 - RNA, 23 nt, Mycobacterium tuberculosis H37Rv
aagccucgauaggugagcgcggg

SEQ ID NO: 1280987 - RNA, 14 nt, Mycobacterium tuberculosis H37Rv
gcggcaauggccag

SEQ ID NO: 1280988 - RNA, 14 nt, Mycobacterium tuberculosis H37Rv
gcggcaaccgucga

SEQ ID NO: 1280989 - RNA, 20 nt, Mycobacterium tuberculosis H37Rv
gcggcaacgcggucugcucc

SEQ ID NO: 1280990 - RNA, 14 nt, Mycobacterium tuberculosis H37Rv
gcggcaacgagguc

SEQ ID NO: 1280991 - RNA, 19 nt, Mycobacterium tuberculosis H37Rv
gcggcaacgcggucugcuc

SEQ ID NO: 1280992 - RNA, 21 nt, Mycobacterium tuberculosis H37Rv
gcggcaagcucguccggugcg

SEQ ID NO: 1280993 - RNA, 15 nt, Mycobacterium tuberculosis H37Rv
gcggcaaggucaacg

SEQ ID NO: 1280994 - RNA, 22 nt, Mycobacterium tuberculosis H37Rv
aagccgacgauccacggcgaug

SEQ ID NO: 1280995 - RNA, 23 nt, Mycobacterium tuberculosis H37Rv
gcggaugcguuggccccaggauc

SEQ ID NO: 1280996 - RNA, 21 nt, Mycobacterium tuberculosis H37Rv
gcggauuccggcaucgguucg

SEQ ID NO: 1280997 - RNA, 14 nt, Mycobacterium tuberculosis H37Rv
gcggauuucgccgu

SEQ ID NO: 1280998 - RNA, 23 nt, Mycobacterium tuberculosis H37Rv
gcggcagccuggccucgccauug

SEQ ID NO: 1280999 - RNA, 22 nt, Mycobacterium tuberculosis H37Rv
gcggcagcggaccgcugccugc

SEQ ID NO: 1281000 - RNA, 21 nt, Mycobacterium tuberculosis H37Rv
gcggcagcguugacggucagc

SEQ ID NO: 1281001 - RNA, 14 nt, Mycobacterium tuberculosis H37Rv
gcggcagcggcgau

SEQ ID NO: 1281002 - RNA, 21 nt, Mycobacterium tuberculosis H37Rv
gcggcagcgguuuuaggcagc

SEQ ID NO: 1281003 - RNA, 16 nt, Mycobacterium tuberculosis H37Rv
gcggcagcggugcugg

SEQ ID NO: 1281004 - RNA, 13 nt, Mycobacterium tuberculosis H37Rv
gcggcaucggcca

SEQ ID NO: 1281005 - RNA, 13 nt, Mycobacterium tuberculosis H37Rv
gcggcaucggugg

SEQ ID NO: 1281006 - RNA, 22 nt, Mycobacterium tuberculosis H37Rv
gcggcaucggugguaacaccgg

SEQ ID NO: 1281007 - RNA, 12 nt, Mycobacterium tuberculosis H37Rv
gcggcaucgcgg

SEQ ID NO: 1281008 - RNA, 17 nt, Mycobacterium tuberculosis H37Rv
gcggcagguucggcgac

SEQ ID NO: 1281009 - RNA, 19 nt, Mycobacterium tuberculosis H37Rv
gcggcaggugcggcggcau

SEQ ID NO: 1281010 - RNA, 14 nt, Mycobacterium tuberculosis H37Rv
gcggcaggugcggc

SEQ ID NO: 1281011 - RNA, 17 nt, Mycobacterium tuberculosis H37Rv
gcggcacgcacgcgguu

SEQ ID NO: 1281012 - RNA, 21 nt, Mycobacterium tuberculosis H37Rv
gcggcacaucaugggcgcugc

SEQ ID NO: 1281013 - RNA, 19 nt, Mycobacterium tuberculosis H37Rv
gcggcaccagcaccgucgg

SEQ ID NO: 1281014 - RNA, 24 nt, Mycobacterium tuberculosis H37Rv
gcggcacccaaccaggccgcgaca

SEQ ID NO: 1281015 - RNA, 16 nt, Mycobacterium tuberculosis H37Rv
gcggcacccggucggc

SEQ ID NO: 1281016 - RNA, 13 nt, Mycobacterium tuberculosis H37Rv
gcggcaccgcuga

SEQ ID NO: 1281017 - RNA, 20 nt, Mycobacterium tuberculosis H37Rv
gcggcaccgauggcgcaccg

SEQ ID NO: 1281018 - RNA, 17 nt, Mycobacterium tuberculosis H37Rv
gcggcaccgauggcgca

SEQ ID NO: 1281019 - RNA, 13 nt, Mycobacterium tuberculosis H37Rv
gcggcaccgccga

SEQ ID NO: 1281020 - RNA, 13 nt, Mycobacterium tuberculosis H37Rv
gcggcuaggccag

SEQ ID NO: 1281021 - RNA, 16 nt, Mycobacterium tuberculosis H37Rv
gcggcuacccauggcc

SEQ ID NO: 1281022 - RNA, 22 nt, Mycobacterium tuberculosis H37Rv
gcggcuaggccagcacggcgac

SEQ ID NO: 1281023 - RNA, 19 nt, Mycobacterium tuberculosis H37Rv
gcggcguugugaccgccga

SEQ ID NO: 1281024 - RNA, 16 nt, Mycobacterium tuberculosis H37Rv
aagcuguaggcgacca

SEQ ID NO: 1281025 - RNA, 18 nt, Mycobacterium tuberculosis H37Rv
gcggcuugaacagcugau

SEQ ID NO: 1281026 - RNA, 21 nt, Mycobacterium tuberculosis H37Rv
gcggcuucgucgacaucgcca

SEQ ID NO: 1281027 - RNA, 15 nt, Mycobacterium tuberculosis H37Rv
gcggcuuucagcgcu

SEQ ID NO: 1281028 - RNA, 20 nt, Mycobacterium tuberculosis H37Rv
gcggcuuucagcgcuucaaa

SEQ ID NO: 1281029 - RNA, 13 nt, Mycobacterium tuberculosis H37Rv
gcgggaauccggu

SEQ ID NO: 1281030 - RNA, 17 nt, Mycobacterium tuberculosis H37Rv
gcgggacgucgucguug

SEQ ID NO: 1281031 - RNA, 21 nt, Mycobacterium tuberculosis H37Rv
gcgggacgggggcuguccacc

SEQ ID NO: 1281032 - RNA, 12 nt, Mycobacterium tuberculosis H37Rv
gcgggacgucgc

SEQ ID NO: 1281033 - RNA, 17 nt, Mycobacterium tuberculosis H37Rv
gcgggacugcagcgcgg

SEQ ID NO: 1281034 - RNA, 15 nt, Mycobacterium tuberculosis H37Rv
gcgggacucggcgag

SEQ ID NO: 1281035 - RNA, 19 nt, Mycobacterium tuberculosis H37Rv
gcgggagguacccccagca

SEQ ID NO: 1281036 - RNA, 14 nt, Mycobacterium tuberculosis H37Rv
gcgggagaucgucg

SEQ ID NO: 1281037 - RNA, 20 nt, Mycobacterium tuberculosis H37Rv
gcgggacagauggcggccga

SEQ ID NO: 1281038 - RNA, 21 nt, Mycobacterium tuberculosis H37Rv
gcgggacagauggcggccgag

SEQ ID NO: 1281039 - RNA, 18 nt, Mycobacterium tuberculosis H37Rv
gcgggacaacagcauggg

SEQ ID NO: 1281040 - RNA, 15 nt, Mycobacterium tuberculosis H37Rv
gcgggacaccaccgc

SEQ ID NO: 1281041 - RNA, 14 nt, Mycobacterium tuberculosis H37Rv
gcgggacacgucgc

SEQ ID NO: 1281042 - RNA, 14 nt, Mycobacterium tuberculosis H37Rv
gcgggacaucaccg

SEQ ID NO: 1281043 - RNA, 21 nt, Mycobacterium tuberculosis H37Rv
gcgggaccuucgagccgcaca

SEQ ID NO: 1281044 - RNA, 15 nt, Mycobacterium tuberculosis H37Rv
gcgggcagcaggcga

SEQ ID NO: 1281045 - RNA, 17 nt, Mycobacterium tuberculosis H37Rv
gcgggcagcuguucggc

SEQ ID NO: 1281046 - RNA, 14 nt, Mycobacterium tuberculosis H37Rv
gcgggcgaucggca

SEQ ID NO: 1281047 - RNA, 16 nt, Mycobacterium tuberculosis H37Rv
gcgggcgaugagcgcg

SEQ ID NO: 1281048 - RNA, 16 nt, Mycobacterium tuberculosis H37Rv
gcgggcgaccaccgcg

SEQ ID NO: 1281049 - RNA, 21 nt, Mycobacterium tuberculosis H37Rv
gcgggcgagaacccacgcaug

SEQ ID NO: 1281050 - RNA, 12 nt, Mycobacterium tuberculosis H37Rv
gcgggcccacgc

SEQ ID NO: 1281051 - RNA, 14 nt, Mycobacterium tuberculosis H37Rv
gcgggcgcaccagg

SEQ ID NO: 1281052 - RNA, 13 nt, Mycobacterium tuberculosis H37Rv
gcgggcgauggcg

SEQ ID NO: 1281053 - RNA, 15 nt, Mycobacterium tuberculosis H37Rv
gcgggcgauggccag

SEQ ID NO: 1281054 - RNA, 14 nt, Mycobacterium tuberculosis H37Rv
gcgggcgccccacc

SEQ ID NO: 1281055 - RNA, 13 nt, Mycobacterium tuberculosis H37Rv
gcgggcggcaccg

SEQ ID NO: 1281056 - RNA, 19 nt, Mycobacterium tuberculosis H37Rv
gcgggcggcagcgagucga

SEQ ID NO: 1281057 - RNA, 13 nt, Mycobacterium tuberculosis H37Rv
gcgggcggccgau

SEQ ID NO: 1281058 - RNA, 16 nt, Mycobacterium tuberculosis H37Rv
gcgggcgggcguccac

SEQ ID NO: 1281059 - RNA, 22 nt, Mycobacterium tuberculosis H37Rv
gcgggcuugccgucuucgccgc

SEQ ID NO: 1281060 - RNA, 19 nt, Mycobacterium tuberculosis H37Rv
gcgggcuuaugcacgacgg

SEQ ID NO: 1281061 - RNA, 20 nt, Mycobacterium tuberculosis H37Rv
gcgggcugugaacagcgcgu

SEQ ID NO: 1281062 - RNA, 15 nt, Mycobacterium tuberculosis H37Rv
gcgggcuugccguug

SEQ ID NO: 1281063 - RNA, 13 nt, Mycobacterium tuberculosis H37Rv
gcggggaucagcg

SEQ ID NO: 1281064 - RNA, 21 nt, Mycobacterium tuberculosis H37Rv
gcgggcucgcuucaggcaccg

SEQ ID NO: 1281065 - RNA, 19 nt, Mycobacterium tuberculosis H37Rv
gcgggcucucggcgucgag

SEQ ID NO: 1281066 - RNA, 22 nt, Mycobacterium tuberculosis H37Rv
gcgggcucggucccgcuacacc

SEQ ID NO: 1281067 - RNA, 18 nt, Mycobacterium tuberculosis H37Rv
gcgggcugauuucgugcg

SEQ ID NO: 1281068 - RNA, 16 nt, Mycobacterium tuberculosis H37Rv
gcgggcgugcuacacc

SEQ ID NO: 1281069 - RNA, 18 nt, Mycobacterium tuberculosis H37Rv
gcgggcgugccgaccagc

SEQ ID NO: 1281070 - RNA, 14 nt, Mycobacterium tuberculosis H37Rv
gcggguaggugacg

SEQ ID NO: 1281071 - RNA, 19 nt, Mycobacterium tuberculosis H37Rv
gcggguacuuacgggucgc

SEQ ID NO: 1281072 - RNA, 12 nt, Mycobacterium tuberculosis H37Rv
gcgggguccagc

SEQ ID NO: 1281073 - RNA, 19 nt, Mycobacterium tuberculosis H37Rv
gcggggaugucgaccgcga

SEQ ID NO: 1281074 - RNA, 22 nt, Mycobacterium tuberculosis H37Rv
gcggggcgaaguggaucuggcg

SEQ ID NO: 1281075 - RNA, 18 nt, Mycobacterium tuberculosis H37Rv
gcgggggagcgaacggcg

SEQ ID NO: 1281076 - RNA, 15 nt, Mycobacterium tuberculosis H37Rv
gcgggggagcgaacg

SEQ ID NO: 1281077 - RNA, 16 nt, Mycobacterium tuberculosis H37Rv
gcgggggacacgucgu

SEQ ID NO: 1281078 - RNA, 16 nt, Mycobacterium tuberculosis H37Rv
gcgggggaccgcccga

SEQ ID NO: 1281079 - RNA, 16 nt, Mycobacterium tuberculosis H37Rv
gcggggcgauccccag

SEQ ID NO: 1281080 - RNA, 18 nt, Mycobacterium tuberculosis H37Rv
gcgggugccagaucggcg

SEQ ID NO: 1281081 - RNA, 15 nt, Mycobacterium tuberculosis H37Rv
gcgggugauguucgu

SEQ ID NO: 1281082 - RNA, 23 nt, Mycobacterium tuberculosis H37Rv
gcgggugaugacgccgucggcgc

SEQ ID NO: 1281083 - RNA, 23 nt, Mycobacterium tuberculosis H37Rv
gcgggugauggaugggucgaccg

SEQ ID NO: 1281084 - RNA, 14 nt, Mycobacterium tuberculosis H37Rv
gcgggugaugcagu

SEQ ID NO: 1281085 - RNA, 18 nt, Mycobacterium tuberculosis H37Rv
gcgggucucgccgaccuu

SEQ ID NO: 1281086 - RNA, 11 nt, Mycobacterium tuberculosis H37Rv
gcgggugacuu

SEQ ID NO: 1281087 - RNA, 15 nt, Mycobacterium tuberculosis H37Rv
gcgggucgugccccg

SEQ ID NO: 1281088 - RNA, 17 nt, Mycobacterium tuberculosis H37Rv
gcgggucguuaccaggc

SEQ ID NO: 1281089 - RNA, 22 nt, Mycobacterium tuberculosis H37Rv
gcgggucguuaccaggcgugga

SEQ ID NO: 1281090 - RNA, 20 nt, Mycobacterium tuberculosis H37Rv
gcgggucguccgccugcacc

SEQ ID NO: 1281091 - RNA, 17 nt, Mycobacterium tuberculosis H37Rv
gcgggucggcggugccg

SEQ ID NO: 1281092 - RNA, 16 nt, Mycobacterium tuberculosis H37Rv
gcgggucgcguuucgc

SEQ ID NO: 1281093 - RNA, 13 nt, Mycobacterium tuberculosis H37Rv
gcgggucggcgac

SEQ ID NO: 1281094 - RNA, 17 nt, Mycobacterium tuberculosis H37Rv
gcgggucgcgggugccg

SEQ ID NO: 1281095 - RNA, 14 nt, Mycobacterium tuberculosis H37Rv
gcggguccgucagc

SEQ ID NO: 1281096 - RNA, 14 nt, Mycobacterium tuberculosis H37Rv
gcgggucaggccag

SEQ ID NO: 1281097 - RNA, 15 nt, Mycobacterium tuberculosis H37Rv
gcgggucagcgccga

SEQ ID NO: 1281098 - RNA, 22 nt, Mycobacterium tuberculosis H37Rv
gcgggucagcgcguauggcuca

SEQ ID NO: 1281099 - RNA, 12 nt, Mycobacterium tuberculosis H37Rv
gcgggucagccu

SEQ ID NO: 1281100 - RNA, 15 nt, Mycobacterium tuberculosis H37Rv
gcgguaucggucagc

SEQ ID NO: 1281101 - RNA, 16 nt, Mycobacterium tuberculosis H37Rv
gcgguagccgagcucg

SEQ ID NO: 1281102 - RNA, 13 nt, Mycobacterium tuberculosis H37Rv
gcgguaucggucg

SEQ ID NO: 1281103 - RNA, 17 nt, Mycobacterium tuberculosis H37Rv
gcgguaucggucagcca

SEQ ID NO: 1281104 - RNA, 15 nt, Mycobacterium tuberculosis H37Rv
gcgguaucggucgac

SEQ ID NO: 1281105 - RNA, 20 nt, Mycobacterium tuberculosis H37Rv
gcgguacgccggucggugcg

SEQ ID NO: 1281106 - RNA, 14 nt, Mycobacterium tuberculosis H37Rv
gcgguacugcgcag

SEQ ID NO: 1281107 - RNA, 18 nt, Mycobacterium tuberculosis H37Rv
gcgguagccgacgacacg

SEQ ID NO: 1281108 - RNA, 17 nt, Mycobacterium tuberculosis H37Rv
gcgguagccgaccagcg

SEQ ID NO: 1281109 - RNA, 17 nt, Mycobacterium tuberculosis H37Rv
gcggucaucggcgccaa

SEQ ID NO: 1281110 - RNA, 15 nt, Mycobacterium tuberculosis H37Rv
gcggucaucgccucg

SEQ ID NO: 1281111 - RNA, 23 nt, Mycobacterium tuberculosis H37Rv
gcggucaacuucuuggugcccau

SEQ ID NO: 1281112 - RNA, 22 nt, Mycobacterium tuberculosis H37Rv
gcggucaacgcuagcgucgugu

SEQ ID NO: 1281113 - RNA, 17 nt, Mycobacterium tuberculosis H37Rv
gcgguauuuugccggau

SEQ ID NO: 1281114 - RNA, 21 nt, Mycobacterium tuberculosis H37Rv
gcgguauuuugccggauucuc

SEQ ID NO: 1281115 - RNA, 21 nt, Mycobacterium tuberculosis H37Rv
gcgguccacaaaccgugcacg

SEQ ID NO: 1281116 - RNA, 13 nt, Mycobacterium tuberculosis H37Rv
gcggucaugggcg

SEQ ID NO: 1281117 - RNA, 14 nt, Mycobacterium tuberculosis H37Rv
gcgguccagccacc

SEQ ID NO: 1281118 - RNA, 18 nt, Mycobacterium tuberculosis H37Rv
gcgguacgcccgaaucgc

SEQ ID NO: 1281119 - RNA, 17 nt, Mycobacterium tuberculosis H37Rv
gcgguaccgcucgggcg

SEQ ID NO: 1281120 - RNA, 17 nt, Mycobacterium tuberculosis H37Rv
gcggguuugcgguaguc

SEQ ID NO: 1281121 - RNA, 18 nt, Mycobacterium tuberculosis H37Rv
gcggguuugaucuccacc

SEQ ID NO: 1281122 - RNA, 18 nt, Mycobacterium tuberculosis H37Rv
gcggguuggguggcaccg

SEQ ID NO: 1281123 - RNA, 17 nt, Mycobacterium tuberculosis H37Rv
gcggguugcggucaccg

SEQ ID NO: 1281124 - RNA, 18 nt, Mycobacterium tuberculosis H37Rv
gcggguugccucggcgag

SEQ ID NO: 1281125 - RNA, 21 nt, Mycobacterium tuberculosis H37Rv
gcggguucgacguugaucgcc

SEQ ID NO: 1281126 - RNA, 20 nt, Mycobacterium tuberculosis H37Rv
gcggguucgacguugaucgc

SEQ ID NO: 1281127 - RNA, 15 nt, Mycobacterium tuberculosis H37Rv
gcggguucgacguug

SEQ ID NO: 1281128 - RNA, 21 nt, Mycobacterium tuberculosis H37Rv
gcggguucacugccggccaac

SEQ ID NO: 1281129 - RNA, 20 nt, Mycobacterium tuberculosis H37Rv
gcggguucaacgcgcgcacg

SEQ ID NO: 1281130 - RNA, 23 nt, Mycobacterium tuberculosis H37Rv
gcggguguuccacaccaggccga

SEQ ID NO: 1281131 - RNA, 17 nt, Mycobacterium tuberculosis H37Rv
gcggguguggcuacgac

SEQ ID NO: 1281132 - RNA, 22 nt, Mycobacterium tuberculosis H37Rv
gcgggugauggaugggucgacc

SEQ ID NO: 1281133 - RNA, 22 nt, Mycobacterium tuberculosis H37Rv
gcggguggugaaguagucggcg

SEQ ID NO: 1281134 - RNA, 14 nt, Mycobacterium tuberculosis H37Rv
gcggguggugccag

SEQ ID NO: 1281135 - RNA, 18 nt, Mycobacterium tuberculosis H37Rv
gcgggugcuggucaacag

SEQ ID NO: 1281136 - RNA, 22 nt, Mycobacterium tuberculosis H37Rv
gcggguggauuggugccgguca

SEQ ID NO: 1281137 - RNA, 14 nt, Mycobacterium tuberculosis H37Rv
gcggccgcagcggc

SEQ ID NO: 1281138 - RNA, 21 nt, Mycobacterium tuberculosis H37Rv
gcggccgcaggcgaacaccag

SEQ ID NO: 1281139 - RNA, 15 nt, Mycobacterium tuberculosis H37Rv
gcggccgccaucagc

SEQ ID NO: 1281140 - RNA, 13 nt, Mycobacterium tuberculosis H37Rv
gcggccgauuccg

SEQ ID NO: 1281141 - RNA, 19 nt, Mycobacterium tuberculosis H37Rv
gcggccgcagccagcaagu

SEQ ID NO: 1281142 - RNA, 14 nt, Mycobacterium tuberculosis H37Rv
gcggccaacggacc

SEQ ID NO: 1281143 - RNA, 12 nt, Mycobacterium tuberculosis H37Rv
gcggccgagguc

SEQ ID NO: 1281144 - RNA, 22 nt, Mycobacterium tuberculosis H37Rv
gcggcaugggucgugcaggcga

SEQ ID NO: 1281145 - RNA, 18 nt, Mycobacterium tuberculosis H37Rv
gcggcauguagaguaucg

SEQ ID NO: 1281146 - RNA, 17 nt, Mycobacterium tuberculosis H37Rv
gcggcaugugacaucgg

SEQ ID NO: 1281147 - RNA, 22 nt, Mycobacterium tuberculosis H37Rv
gcggcauugguaccggcuucgu

SEQ ID NO: 1281148 - RNA, 16 nt, Mycobacterium tuberculosis H37Rv
gcggcauucucgagca

SEQ ID NO: 1281149 - RNA, 17 nt, Mycobacterium tuberculosis H37Rv
gcggccaacgacgaccc

SEQ ID NO: 1281150 - RNA, 13 nt, Mycobacterium tuberculosis H37Rv
gcggccaacgaac

SEQ ID NO: 1281151 - RNA, 20 nt, Mycobacterium tuberculosis H37Rv
gcggcaugauuuuucgcagu

SEQ ID NO: 1281152 - RNA, 22 nt, Mycobacterium tuberculosis H37Rv
gcggcauggcauggcgaacacg

SEQ ID NO: 1281153 - RNA, 17 nt, Mycobacterium tuberculosis H37Rv
gcggccgcuccaccucg

SEQ ID NO: 1281154 - RNA, 18 nt, Mycobacterium tuberculosis H37Rv
gcggccgcugaucaacag

SEQ ID NO: 1281155 - RNA, 17 nt, Mycobacterium tuberculosis H37Rv
gcggccggguucgcguc

SEQ ID NO: 1281156 - RNA, 20 nt, Mycobacterium tuberculosis H37Rv
gcggccgguacacguccagu

SEQ ID NO: 1281157 - RNA, 14 nt, Mycobacterium tuberculosis H37Rv
gcggccguaacggc

SEQ ID NO: 1281158 - RNA, 20 nt, Mycobacterium tuberculosis H37Rv
gcggccgggucucuugcggg

SEQ ID NO: 1281159 - RNA, 16 nt, Mycobacterium tuberculosis H37Rv
gcggcgauccggucgg

SEQ ID NO: 1281160 - RNA, 16 nt, Mycobacterium tuberculosis H37Rv
gcggcgaucuggucga

SEQ ID NO: 1281161 - RNA, 15 nt, Mycobacterium tuberculosis H37Rv
gcggcgaugauggcg

SEQ ID NO: 1281162 - RNA, 21 nt, Mycobacterium tuberculosis H37Rv
gcggcgaugguugaaccaguc

SEQ ID NO: 1281163 - RNA, 23 nt, Mycobacterium tuberculosis H37Rv
gcggcgaugguugaaccagucga

SEQ ID NO: 1281164 - RNA, 18 nt, Mycobacterium tuberculosis H37Rv
gcggcgagcuccgaugcc

SEQ ID NO: 1281165 - RNA, 15 nt, Mycobacterium tuberculosis H37Rv
gcggcgagaaucccg

SEQ ID NO: 1281166 - RNA, 15 nt, Mycobacterium tuberculosis H37Rv
gcggcgagagccucg

SEQ ID NO: 1281167 - RNA, 22 nt, Mycobacterium tuberculosis H37Rv
gcggcgaccgcauccggucucg

SEQ ID NO: 1281168 - RNA, 18 nt, Mycobacterium tuberculosis H37Rv
gcggcgacuacggccucg

SEQ ID NO: 1281169 - RNA, 14 nt, Mycobacterium tuberculosis H37Rv
gcggcgaccagauu

SEQ ID NO: 1281170 - RNA, 16 nt, Mycobacterium tuberculosis H37Rv
gcggccugagcgucgu

SEQ ID NO: 1281171 - RNA, 18 nt, Mycobacterium tuberculosis H37Rv
gcggccugagcgucgucg

SEQ ID NO: 1281172 - RNA, 12 nt, Mycobacterium tuberculosis H37Rv
gcggcgaacucu

SEQ ID NO: 1281173 - RNA, 18 nt, Mycobacterium tuberculosis H37Rv
gcggcgaagaagccggca

SEQ ID NO: 1281174 - RNA, 16 nt, Mycobacterium tuberculosis H37Rv
gcggcgaacaucaccg

SEQ ID NO: 1281175 - RNA, 14 nt, Mycobacterium tuberculosis H37Rv
gcggcgaaccagcg

SEQ ID NO: 1281176 - RNA, 18 nt, Mycobacterium tuberculosis H37Rv
gcggcggccugagcgucg

SEQ ID NO: 1281177 - RNA, 14 nt, Mycobacterium tuberculosis H37Rv
gcggcgggcccgau

SEQ ID NO: 1281178 - RNA, 13 nt, Mycobacterium tuberculosis H37Rv
gcggcggucacca

SEQ ID NO: 1281179 - RNA, 21 nt, Mycobacterium tuberculosis H37Rv
gcggcggugccacgaucggcg

SEQ ID NO: 1281180 - RNA, 22 nt, Mycobacterium tuberculosis H37Rv
gcggcggcccuaaacaccgcga

SEQ ID NO: 1281181 - RNA, 14 nt, Mycobacterium tuberculosis H37Rv
gcggcggcccgcag

SEQ ID NO: 1281182 - RNA, 15 nt, Mycobacterium tuberculosis H37Rv
gcggcggcgucgacg

SEQ ID NO: 1281183 - RNA, 14 nt, Mycobacterium tuberculosis H37Rv
gcggcggccagcgc

SEQ ID NO: 1281184 - RNA, 21 nt, Mycobacterium tuberculosis H37Rv
gcggcggcccuaaacaccgcg

SEQ ID NO: 1281185 - RNA, 21 nt, Mycobacterium tuberculosis H37Rv
gcggcggaccguccgacggcg

SEQ ID NO: 1281186 - RNA, 16 nt, Mycobacterium tuberculosis H37Rv
gcggcggaccguccga

SEQ ID NO: 1281187 - RNA, 14 nt, Mycobacterium tuberculosis H37Rv
gcggcggacccgcu

SEQ ID NO: 1281188 - RNA, 14 nt, Mycobacterium tuberculosis H37Rv
gcggcggaccgucc

SEQ ID NO: 1281189 - RNA, 21 nt, Mycobacterium tuberculosis H37Rv
aagcucgacaacugcccgaug

SEQ ID NO: 1281190 - RNA, 14 nt, Mycobacterium tuberculosis H37Rv
aagcugaccgccag

SEQ ID NO: 1281191 - RNA, 22 nt, Mycobacterium tuberculosis H37Rv
gcggcgucgaugagguucaucg

SEQ ID NO: 1281192 - RNA, 21 nt, Mycobacterium tuberculosis H37Rv
gcggcgcacaacccgucgagc

SEQ ID NO: 1281193 - RNA, 15 nt, Mycobacterium tuberculosis H37Rv
gcggcgcagcgacgc

SEQ ID NO: 1281194 - RNA, 18 nt, Mycobacterium tuberculosis H37Rv
gcggcgcagcaccgucgg

SEQ ID NO: 1281195 - RNA, 21 nt, Mycobacterium tuberculosis H37Rv
gcggcgcaggucgcgcaguug

SEQ ID NO: 1281196 - RNA, 12 nt, Mycobacterium tuberculosis H37Rv
gcggcgccgcca

SEQ ID NO: 1281197 - RNA, 20 nt, Mycobacterium tuberculosis H37Rv
gcggcgcauuccggcgccag

SEQ ID NO: 1281198 - RNA, 19 nt, Mycobacterium tuberculosis H37Rv
gcggcgccgcagaucaccg

SEQ ID NO: 1281199 - RNA, 17 nt, Mycobacterium tuberculosis H37Rv
gcggcggacccgcucgc

SEQ ID NO: 1281200 - RNA, 19 nt, Mycobacterium tuberculosis H37Rv
gcggcggaaggcgucgaac

SEQ ID NO: 1281201 - RNA, 14 nt, Mycobacterium tuberculosis H37Rv
gcggcgcuggcguc

SEQ ID NO: 1281202 - RNA, 13 nt, Mycobacterium tuberculosis H37Rv
gcggcgcugggac

SEQ ID NO: 1281203 - RNA, 13 nt, Mycobacterium tuberculosis H37Rv
gcggcgcgggugc

SEQ ID NO: 1281204 - RNA, 14 nt, Mycobacterium tuberculosis H37Rv
gccaacaccgccag

SEQ ID NO: 1281205 - RNA, 12 nt, Mycobacterium tuberculosis H37Rv
gccaacaccuca

SEQ ID NO: 1281206 - RNA, 14 nt, Mycobacterium tuberculosis H37Rv
gccaacacgcguug

SEQ ID NO: 1281207 - RNA, 14 nt, Mycobacterium tuberculosis H37Rv
gccaacagucgcag

SEQ ID NO: 1281208 - RNA, 16 nt, Mycobacterium tuberculosis H37Rv
gccaacaccggcgauc

SEQ ID NO: 1281209 - RNA, 17 nt, Mycobacterium tuberculosis H37Rv
gccaacaccgccagcau

SEQ ID NO: 1281210 - RNA, 15 nt, Mycobacterium tuberculosis H37Rv
gccaacaacaucagc

SEQ ID NO: 1281211 - RNA, 15 nt, Mycobacterium tuberculosis H37Rv
gccaaaacggucgac

SEQ ID NO: 1281212 - RNA, 14 nt, Mycobacterium tuberculosis H37Rv
gccaaagacccggc

SEQ ID NO: 1281213 - RNA, 23 nt, Mycobacterium tuberculosis H37Rv
gcauuucguggcgcgccgcaucg

SEQ ID NO: 1281214 - RNA, 21 nt, Mycobacterium tuberculosis H37Rv
gcauugagcuggcgcccgggu

SEQ ID NO: 1281215 - RNA, 14 nt, Mycobacterium tuberculosis H37Rv
gcauucucccggua

SEQ ID NO: 1281216 - RNA, 20 nt, Mycobacterium tuberculosis H37Rv
gcauucguugaugaugccca

SEQ ID NO: 1281217 - RNA, 15 nt, Mycobacterium tuberculosis H37Rv
gcauucgggauucgg

SEQ ID NO: 1281218 - RNA, 15 nt, Mycobacterium tuberculosis H37Rv
gccaacccaucccga

SEQ ID NO: 1281219 - RNA, 18 nt, Mycobacterium tuberculosis H37Rv
gccaacccaucccgaucc

SEQ ID NO: 1281220 - RNA, 17 nt, Mycobacterium tuberculosis H37Rv
gccaaccccauggccag

SEQ ID NO: 1281221 - RNA, 19 nt, Mycobacterium tuberculosis H37Rv
gccaaccccauggccagcg

SEQ ID NO: 1281222 - RNA, 21 nt, Mycobacterium tuberculosis H37Rv
gccaaccgguucgucgaacgg

SEQ ID NO: 1281223 - RNA, 19 nt, Mycobacterium tuberculosis H37Rv
gccaaccgguucgucgaac

SEQ ID NO: 1281224 - RNA, 19 nt, Mycobacterium tuberculosis H37Rv
gccaaccgggucguucggg

SEQ ID NO: 1281225 - RNA, 19 nt, Mycobacterium tuberculosis H37Rv
gccaaccgcgugcgucagc

SEQ ID NO: 1281226 - RNA, 14 nt, Mycobacterium tuberculosis H37Rv
gccaacgacggccg

SEQ ID NO: 1281227 - RNA, 17 nt, Mycobacterium tuberculosis H37Rv
gccaacgacggccgaca

SEQ ID NO: 1281228 - RNA, 18 nt, Mycobacterium tuberculosis H37Rv
gccaacgacaggcgccca

SEQ ID NO: 1281229 - RNA, 20 nt, Mycobacterium tuberculosis H37Rv
gccaacgaaccgcucagcgc

SEQ ID NO: 1281230 - RNA, 18 nt, Mycobacterium tuberculosis H37Rv
gccaacgaaccgcucagc

SEQ ID NO: 1281231 - RNA, 19 nt, Mycobacterium tuberculosis H37Rv
gccaaccugaagccagcgc

SEQ ID NO: 1281232 - RNA, 19 nt, Mycobacterium tuberculosis H37Rv
gccaacgccagcaccagcg

SEQ ID NO: 1281233 - RNA, 18 nt, Mycobacterium tuberculosis H37Rv
gccaacgccagcaccagc

SEQ ID NO: 1281234 - RNA, 14 nt, Mycobacterium tuberculosis H37Rv
gccaacgccagcac

SEQ ID NO: 1281235 - RNA, 20 nt, Mycobacterium tuberculosis H37Rv
gccaagccgugccgcacagc

SEQ ID NO: 1281236 - RNA, 22 nt, Mycobacterium tuberculosis H37Rv
gccaagcgacucgccggcgaau

SEQ ID NO: 1281237 - RNA, 19 nt, Mycobacterium tuberculosis H37Rv
gccaagcccaggcgaucgc

SEQ ID NO: 1281238 - RNA, 20 nt, Mycobacterium tuberculosis H37Rv
gccaagcagcugggcaucac

SEQ ID NO: 1281239 - RNA, 15 nt, Mycobacterium tuberculosis H37Rv
gccaacgcgucccgc

SEQ ID NO: 1281240 - RNA, 21 nt, Mycobacterium tuberculosis H37Rv
gccaacgcgcagagcguuccg

SEQ ID NO: 1281241 - RNA, 22 nt, Mycobacterium tuberculosis H37Rv
gccaacggcacccugcggcacc

SEQ ID NO: 1281242 - RNA, 16 nt, Mycobacterium tuberculosis H37Rv
gccaacggcaccucga

SEQ ID NO: 1281243 - RNA, 22 nt, Mycobacterium tuberculosis H37Rv
gccaacggcuccgggcgcucgg

SEQ ID NO: 1281244 - RNA, 22 nt, Mycobacterium tuberculosis H37Rv
gccaacgcgucccgccgcaccg

SEQ ID NO: 1281245 - RNA, 22 nt, Mycobacterium tuberculosis H37Rv
gccaacgggaacaacggcguaa

SEQ ID NO: 1281246 - RNA, 19 nt, Mycobacterium tuberculosis H37Rv
gccaaucugcacgcgcucg

SEQ ID NO: 1281247 - RNA, 21 nt, Mycobacterium tuberculosis H37Rv
gccaaugacgucggaccagcu

SEQ ID NO: 1281248 - RNA, 17 nt, Mycobacterium tuberculosis H37Rv
gccaauccggcggcgac

SEQ ID NO: 1281249 - RNA, 18 nt, Mycobacterium tuberculosis H37Rv
gccaaucagcccgccgga

SEQ ID NO: 1281250 - RNA, 19 nt, Mycobacterium tuberculosis H37Rv
gccaauacgugauguagcu

SEQ ID NO: 1281251 - RNA, 12 nt, Mycobacterium tuberculosis H37Rv
gccaaggccguc

SEQ ID NO: 1281252 - RNA, 13 nt, Mycobacterium tuberculosis H37Rv
gccaaggccgucg

SEQ ID NO: 1281253 - RNA, 15 nt, Mycobacterium tuberculosis H37Rv
gccaaggccgucgac

SEQ ID NO: 1281254 - RNA, 17 nt, Mycobacterium tuberculosis H37Rv
gccacacacugccggac

SEQ ID NO: 1281255 - RNA, 15 nt, Mycobacterium tuberculosis H37Rv
gccaaugccguugau

SEQ ID NO: 1281256 - RNA, 18 nt, Mycobacterium tuberculosis H37Rv
gccacaccgucacgccac

SEQ ID NO: 1281257 - RNA, 13 nt, Mycobacterium tuberculosis H37Rv
gccacacaggcgu

SEQ ID NO: 1281258 - RNA, 21 nt, Mycobacterium tuberculosis H37Rv
gcaucugugagauaccgacgc

SEQ ID NO: 1281259 - RNA, 18 nt, Mycobacterium tuberculosis H37Rv
gcaucugcgggucggcau

SEQ ID NO: 1281260 - RNA, 14 nt, Mycobacterium tuberculosis H37Rv
gcaugaagucccgg

SEQ ID NO: 1281261 - RNA, 15 nt, Mycobacterium tuberculosis H37Rv
gcaugauccgcucgu

SEQ ID NO: 1281262 - RNA, 15 nt, Mycobacterium tuberculosis H37Rv
gcaugagggcaucga

SEQ ID NO: 1281263 - RNA, 22 nt, Mycobacterium tuberculosis H37Rv
gcaugcgugccggcagcggugg

SEQ ID NO: 1281264 - RNA, 19 nt, Mycobacterium tuberculosis H37Rv
gcaugcgacagaugccggg

SEQ ID NO: 1281265 - RNA, 13 nt, Mycobacterium tuberculosis H37Rv
gcaugccuucggc

SEQ ID NO: 1281266 - RNA, 17 nt, Mycobacterium tuberculosis H37Rv
gcaugcccuggaccagc

SEQ ID NO: 1281267 - RNA, 22 nt, Mycobacterium tuberculosis H37Rv
gcaugcguaugcccacgaaccg

SEQ ID NO: 1281268 - RNA, 17 nt, Mycobacterium tuberculosis H37Rv
gcaugcguuggggcacg

SEQ ID NO: 1281269 - RNA, 13 nt, Mycobacterium tuberculosis H37Rv
gcaugcuggaccu

SEQ ID NO: 1281270 - RNA, 18 nt, Mycobacterium tuberculosis H37Rv
gcaugcuggaccucgcga

SEQ ID NO: 1281271 - RNA, 23 nt, Mycobacterium tuberculosis H37Rv
gcaugggccggcgccgcaccaag

SEQ ID NO: 1281272 - RNA, 23 nt, Mycobacterium tuberculosis H37Rv
gcauggucgacgaacaccccggg

SEQ ID NO: 1281273 - RNA, 16 nt, Mycobacterium tuberculosis H37Rv
gcauggucuucgcgga

SEQ ID NO: 1281274 - RNA, 22 nt, Mycobacterium tuberculosis H37Rv
gcaugguccacagccggcggcu

SEQ ID NO: 1281275 - RNA, 20 nt, Mycobacterium tuberculosis H37Rv
gcauguucagcccgaacucg

SEQ ID NO: 1281276 - RNA, 20 nt, Mycobacterium tuberculosis H37Rv
gcaugguggcgccgaccugg

SEQ ID NO: 1281277 - RNA, 22 nt, Mycobacterium tuberculosis H37Rv
gcauguucuccacgccgaucug

SEQ ID NO: 1281278 - RNA, 15 nt, Mycobacterium tuberculosis H37Rv
gcagcgcgaacacca

SEQ ID NO: 1281279 - RNA, 18 nt, Mycobacterium tuberculosis H37Rv
gcagcgcgaaggucagcg

SEQ ID NO: 1281280 - RNA, 15 nt, Mycobacterium tuberculosis H37Rv
gcagugacucgauca

SEQ ID NO: 1281281 - RNA, 16 nt, Mycobacterium tuberculosis H37Rv
gcagugcagcgauccc

SEQ ID NO: 1281282 - RNA, 17 nt, Mycobacterium tuberculosis H37Rv
gcagcgccucgauccgc

SEQ ID NO: 1281283 - RNA, 21 nt, Mycobacterium tuberculosis H37Rv
gcagcgccucgauccgcauca

SEQ ID NO: 1281284 - RNA, 23 nt, Mycobacterium tuberculosis H37Rv
gcagcgccuaccagcaccgggau

SEQ ID NO: 1281285 - RNA, 20 nt, Mycobacterium tuberculosis H37Rv
gcaguggugucggaaugggc

SEQ ID NO: 1281286 - RNA, 16 nt, Mycobacterium tuberculosis H37Rv
gcagugccucggcgau

SEQ ID NO: 1281287 - RNA, 15 nt, Mycobacterium tuberculosis H37Rv
gcaguuggccgagcg

SEQ ID NO: 1281288 - RNA, 15 nt, Mycobacterium tuberculosis H37Rv
gcaguucggucgucu

SEQ ID NO: 1281289 - RNA, 21 nt, Mycobacterium tuberculosis H37Rv
gcaguugaacucgaccaccgc

SEQ ID NO: 1281290 - RNA, 13 nt, Mycobacterium tuberculosis H37Rv
gcaguucggcgau

SEQ ID NO: 1281291 - RNA, 23 nt, Mycobacterium tuberculosis H37Rv
gcaguuccuugccgaucgccgag

SEQ ID NO: 1281292 - RNA, 21 nt, Mycobacterium tuberculosis H37Rv
gcaguucgcggccaucgccga

SEQ ID NO: 1281293 - RNA, 16 nt, Mycobacterium tuberculosis H37Rv
gcaguuggcaccagcc

SEQ ID NO: 1281294 - RNA, 24 nt, Mycobacterium tuberculosis H37Rv
gcauaagcccccgacacgccgugc

SEQ ID NO: 1281295 - RNA, 15 nt, Mycobacterium tuberculosis H37Rv
gcaucacgccgucgc

SEQ ID NO: 1281296 - RNA, 20 nt, Mycobacterium tuberculosis H37Rv
gcaucagauucgcgcuggcc

SEQ ID NO: 1281297 - RNA, 13 nt, Mycobacterium tuberculosis H37Rv
gcauaugacgucg

SEQ ID NO: 1281298 - RNA, 21 nt, Mycobacterium tuberculosis H37Rv
gcaucaccaccgcaccggaau

SEQ ID NO: 1281299 - RNA, 17 nt, Mycobacterium tuberculosis H37Rv
gcauacauccaggcugu

SEQ ID NO: 1281300 - RNA, 18 nt, Mycobacterium tuberculosis H37Rv
gcauacaccgugacguug

SEQ ID NO: 1281301 - RNA, 21 nt, Mycobacterium tuberculosis H37Rv
gcauaggcggccaucgacgac

SEQ ID NO: 1281302 - RNA, 20 nt, Mycobacterium tuberculosis H37Rv
gcauagguaguugcucggcu

SEQ ID NO: 1281303 - RNA, 14 nt, Mycobacterium tuberculosis H37Rv
gcauagugcggcug

SEQ ID NO: 1281304 - RNA, 19 nt, Mycobacterium tuberculosis H37Rv
gcaucaguuugacgccgau

SEQ ID NO: 1281305 - RNA, 15 nt, Mycobacterium tuberculosis H37Rv
gcauccacugcggcg

SEQ ID NO: 1281306 - RNA, 15 nt, Mycobacterium tuberculosis H37Rv
gcaucauggccguga

SEQ ID NO: 1281307 - RNA, 13 nt, Mycobacterium tuberculosis H37Rv
gcauccacaccga

SEQ ID NO: 1281308 - RNA, 20 nt, Mycobacterium tuberculosis H37Rv
gcaucaugggagucgucgug

SEQ ID NO: 1281309 - RNA, 16 nt, Mycobacterium tuberculosis H37Rv
gcauccauccugccuu

SEQ ID NO: 1281310 - RNA, 16 nt, Mycobacterium tuberculosis H37Rv
gcaucccgguccagcc

SEQ ID NO: 1281311 - RNA, 13 nt, Mycobacterium tuberculosis H37Rv
gcaucccgggcag

SEQ ID NO: 1281312 - RNA, 17 nt, Mycobacterium tuberculosis H37Rv
gcauccuccucgucgac

SEQ ID NO: 1281313 - RNA, 16 nt, Mycobacterium tuberculosis H37Rv
gcauccuccucgucga

SEQ ID NO: 1281314 - RNA, 15 nt, Mycobacterium tuberculosis H37Rv
gcaucgacgcggcca

SEQ ID NO: 1281315 - RNA, 22 nt, Mycobacterium tuberculosis H37Rv
gcaucgacgcguuccucgacgu

SEQ ID NO: 1281316 - RNA, 15 nt, Mycobacterium tuberculosis H37Rv
gcaucgagcgucggg

SEQ ID NO: 1281317 - RNA, 17 nt, Mycobacterium tuberculosis H37Rv
gcaucgagcccggacga

SEQ ID NO: 1281318 - RNA, 21 nt, Mycobacterium tuberculosis H37Rv
gcaucgacgugcgcggcauuc

SEQ ID NO: 1281319 - RNA, 15 nt, Mycobacterium tuberculosis H37Rv
gcaucgagacgagcc

SEQ ID NO: 1281320 - RNA, 19 nt, Mycobacterium tuberculosis H37Rv
gcaucgagacgcacggcca

SEQ ID NO: 1281321 - RNA, 13 nt, Mycobacterium tuberculosis H37Rv
gcaucgaucaccg

SEQ ID NO: 1281322 - RNA, 14 nt, Mycobacterium tuberculosis H37Rv
gcaucgcacagcgc

SEQ ID NO: 1281323 - RNA, 22 nt, Mycobacterium tuberculosis H37Rv
gcaucgauucgauguccucgac

SEQ ID NO: 1281324 - RNA, 18 nt, Mycobacterium tuberculosis H37Rv
gcaucggagauacgggcc

SEQ ID NO: 1281325 - RNA, 12 nt, Mycobacterium tuberculosis H37Rv
gcaucggcgaac

SEQ ID NO: 1281326 - RNA, 22 nt, Mycobacterium tuberculosis H37Rv
gcaucgccugcgccuuggucgc

SEQ ID NO: 1281327 - RNA, 22 nt, Mycobacterium tuberculosis H37Rv
gcaucgccuccucgacgucggc

SEQ ID NO: 1281328 - RNA, 13 nt, Mycobacterium tuberculosis H37Rv
gcaucgccgucaa

SEQ ID NO: 1281329 - RNA, 18 nt, Mycobacterium tuberculosis H37Rv
gcaucgccuccucgacgu

SEQ ID NO: 1281330 - RNA, 20 nt, Mycobacterium tuberculosis H37Rv
gcaucgccaccaucaccgcc

SEQ ID NO: 1281331 - RNA, 23 nt, Mycobacterium tuberculosis H37Rv
gcaucgcccaacaacgcuucggc

SEQ ID NO: 1281332 - RNA, 13 nt, Mycobacterium tuberculosis H37Rv
gcaucgccgagcu

SEQ ID NO: 1281333 - RNA, 22 nt, Mycobacterium tuberculosis H37Rv
gcaucgccgagguggacaaauc

SEQ ID NO: 1281334 - RNA, 23 nt, Mycobacterium tuberculosis H37Rv
gcaucguuuucgccgaucccggc

SEQ ID NO: 1281335 - RNA, 19 nt, Mycobacterium tuberculosis H37Rv
gcaucguugccgaccguca

SEQ ID NO: 1281336 - RNA, 19 nt, Mycobacterium tuberculosis H37Rv
gcaucgucgccgaccguca

SEQ ID NO: 1281337 - RNA, 22 nt, Mycobacterium tuberculosis H37Rv
gcaucgucgggucaaugcuggc

SEQ ID NO: 1281338 - RNA, 19 nt, Mycobacterium tuberculosis H37Rv
gcaucucgggcgaagccgc

SEQ ID NO: 1281339 - RNA, 17 nt, Mycobacterium tuberculosis H37Rv
gcaucuccaccgucgcc

SEQ ID NO: 1281340 - RNA, 21 nt, Mycobacterium tuberculosis H37Rv
gcaucgggcuugcgcagcagc

SEQ ID NO: 1281341 - RNA, 18 nt, Mycobacterium tuberculosis H37Rv
gcaucggugcagcccgcc

SEQ ID NO: 1281342 - RNA, 22 nt, Mycobacterium tuberculosis H37Rv
gcaucggugguaacaccggcga

SEQ ID NO: 1281343 - RNA, 20 nt, Mycobacterium tuberculosis H37Rv
gcaucgggcgagcucgucga

SEQ ID NO: 1281344 - RNA, 15 nt, Mycobacterium tuberculosis H37Rv
gcaucggcggugaac

SEQ ID NO: 1281345 - RNA, 23 nt, Mycobacterium tuberculosis H37Rv
gccagccacgaacugaucgaccg

SEQ ID NO: 1281346 - RNA, 22 nt, Mycobacterium tuberculosis H37Rv
gccagcauugaagaagcccgaa

SEQ ID NO: 1281347 - RNA, 15 nt, Mycobacterium tuberculosis H37Rv
gccagccaccacauc

SEQ ID NO: 1281348 - RNA, 21 nt, Mycobacterium tuberculosis H37Rv
gccagcauugaagaagcccga

SEQ ID NO: 1281349 - RNA, 19 nt, Mycobacterium tuberculosis H37Rv
gccagcccacucgucgaac

SEQ ID NO: 1281350 - RNA, 23 nt, Mycobacterium tuberculosis H37Rv
gccagcccacucgucgaacaccg

SEQ ID NO: 1281351 - RNA, 22 nt, Mycobacterium tuberculosis H37Rv
gccagcccggucauggucagca

SEQ ID NO: 1281352 - RNA, 19 nt, Mycobacterium tuberculosis H37Rv
gccagcgauaucggcggcu

SEQ ID NO: 1281353 - RNA, 14 nt, Mycobacterium tuberculosis H37Rv
gccagcgauucacg

SEQ ID NO: 1281354 - RNA, 21 nt, Mycobacterium tuberculosis H37Rv
gccagcgagaucagcaugccc

SEQ ID NO: 1281355 - RNA, 15 nt, Mycobacterium tuberculosis H37Rv
gccagccgguccagc

SEQ ID NO: 1281356 - RNA, 20 nt, Mycobacterium tuberculosis H37Rv
gccagccggucgaugccgau

SEQ ID NO: 1281357 - RNA, 23 nt, Mycobacterium tuberculosis H37Rv
gccagcgcagccaggcugcggau

SEQ ID NO: 1281358 - RNA, 16 nt, Mycobacterium tuberculosis H37Rv
gccagcgccaacucga

SEQ ID NO: 1281359 - RNA, 12 nt, Mycobacterium tuberculosis H37Rv
gccagcggcaca

SEQ ID NO: 1281360 - RNA, 16 nt, Mycobacterium tuberculosis H37Rv
gccagcgcgucgccgu

SEQ ID NO: 1281361 - RNA, 20 nt, Mycobacterium tuberculosis H37Rv
gccagauagguccgaucaug

SEQ ID NO: 1281362 - RNA, 22 nt, Mycobacterium tuberculosis H37Rv
gccagaucaccgucgacagcgu

SEQ ID NO: 1281363 - RNA, 13 nt, Mycobacterium tuberculosis H37Rv
gccagaucggcgg

SEQ ID NO: 1281364 - RNA, 22 nt, Mycobacterium tuberculosis H37Rv
gccagaucucgcgcgcggcgac

SEQ ID NO: 1281365 - RNA, 16 nt, Mycobacterium tuberculosis H37Rv
gccagauccgucagcu

SEQ ID NO: 1281366 - RNA, 15 nt, Mycobacterium tuberculosis H37Rv
gccagaucgacgcca

SEQ ID NO: 1281367 - RNA, 19 nt, Mycobacterium tuberculosis H37Rv
gccagcaccacgucgacga

SEQ ID NO: 1281368 - RNA, 16 nt, Mycobacterium tuberculosis H37Rv
gccagcaccacgucga

SEQ ID NO: 1281369 - RNA, 19 nt, Mycobacterium tuberculosis H37Rv
gccagcacaccgucgacga

SEQ ID NO: 1281370 - RNA, 14 nt, Mycobacterium tuberculosis H37Rv
gccagcaccacggc

SEQ ID NO: 1281371 - RNA, 20 nt, Mycobacterium tuberculosis H37Rv
gccagcaccacggccagcgg

SEQ ID NO: 1281372 - RNA, 14 nt, Mycobacterium tuberculosis H37Rv
gccagcaccacguc

SEQ ID NO: 1281373 - RNA, 21 nt, Mycobacterium tuberculosis H37Rv
gccagcagccacccgacaacg

SEQ ID NO: 1281374 - RNA, 15 nt, Mycobacterium tuberculosis H37Rv
gccagcagccguuca

SEQ ID NO: 1281375 - RNA, 14 nt, Mycobacterium tuberculosis H37Rv
gccagcaccagcgu

SEQ ID NO: 1281376 - RNA, 16 nt, Mycobacterium tuberculosis H37Rv
gccagcacgaccucgc

SEQ ID NO: 1281377 - RNA, 18 nt, Mycobacterium tuberculosis H37Rv
gccagcagguuggucacc

SEQ ID NO: 1281378 - RNA, 19 nt, Mycobacterium tuberculosis H37Rv
gccagcagcggcgagccaa

SEQ ID NO: 1281379 - RNA, 15 nt, Mycobacterium tuberculosis H37Rv
gccagagguggauca

SEQ ID NO: 1281380 - RNA, 23 nt, Mycobacterium tuberculosis H37Rv
gccagaguuaccaggucggaacu

SEQ ID NO: 1281381 - RNA, 13 nt, Mycobacterium tuberculosis H37Rv
gccagaaucccgc

SEQ ID NO: 1281382 - RNA, 22 nt, Mycobacterium tuberculosis H37Rv
gccagaccagggcagcggccag

SEQ ID NO: 1281383 - RNA, 13 nt, Mycobacterium tuberculosis H37Rv
gccagaccagggc

SEQ ID NO: 1281384 - RNA, 21 nt, Mycobacterium tuberculosis H37Rv
gccagaagaccuggcggugcc

SEQ ID NO: 1281385 - RNA, 16 nt, Mycobacterium tuberculosis H37Rv
gccagaacggcgucga

SEQ ID NO: 1281386 - RNA, 14 nt, Mycobacterium tuberculosis H37Rv
gccacugaccgcga

SEQ ID NO: 1281387 - RNA, 13 nt, Mycobacterium tuberculosis H37Rv
gccacugccggca

SEQ ID NO: 1281388 - RNA, 14 nt, Mycobacterium tuberculosis H37Rv
gccacugccgacca

SEQ ID NO: 1281389 - RNA, 13 nt, Mycobacterium tuberculosis H37Rv
gccacugaccgcg

SEQ ID NO: 1281390 - RNA, 17 nt, Mycobacterium tuberculosis H37Rv
gccagaaacccggcgac

SEQ ID NO: 1281391 - RNA, 14 nt, Mycobacterium tuberculosis H37Rv
gccacugcguucca

SEQ ID NO: 1281392 - RNA, 18 nt, Mycobacterium tuberculosis H37Rv
gccacugccggugggcgu

SEQ ID NO: 1281393 - RNA, 22 nt, Mycobacterium tuberculosis H37Rv
gccacucgcccgauccggaucc

SEQ ID NO: 1281394 - RNA, 21 nt, Mycobacterium tuberculosis H37Rv
gccacgggugacucgggcacg

SEQ ID NO: 1281395 - RNA, 18 nt, Mycobacterium tuberculosis H37Rv
gccacggcugaccggggu

SEQ ID NO: 1281396 - RNA, 15 nt, Mycobacterium tuberculosis H37Rv
gccacggcggcuucc

SEQ ID NO: 1281397 - RNA, 16 nt, Mycobacterium tuberculosis H37Rv
gccacggcgucggcca

SEQ ID NO: 1281398 - RNA, 17 nt, Mycobacterium tuberculosis H37Rv
gccacgccagcucgccg

SEQ ID NO: 1281399 - RNA, 16 nt, Mycobacterium tuberculosis H37Rv
gccacgccagcgucga

SEQ ID NO: 1281400 - RNA, 13 nt, Mycobacterium tuberculosis H37Rv
gccacgccagcgu

SEQ ID NO: 1281401 - RNA, 17 nt, Mycobacterium tuberculosis H37Rv
gccacgcaugggccagg

SEQ ID NO: 1281402 - RNA, 17 nt, Mycobacterium tuberculosis H37Rv
gccacgcccgacgccag

SEQ ID NO: 1281403 - RNA, 16 nt, Mycobacterium tuberculosis H37Rv
gccacggcccgguugg

SEQ ID NO: 1281404 - RNA, 18 nt, Mycobacterium tuberculosis H37Rv
gccacggcacugggucca

SEQ ID NO: 1281405 - RNA, 13 nt, Mycobacterium tuberculosis H37Rv
gccacgccgauca

SEQ ID NO: 1281406 - RNA, 14 nt, Mycobacterium tuberculosis H37Rv
gccacgccgaggcg

SEQ ID NO: 1281407 - RNA, 18 nt, Mycobacterium tuberculosis H37Rv
gccacgccgaugcggugc

SEQ ID NO: 1281408 - RNA, 17 nt, Mycobacterium tuberculosis H37Rv
gccacgccgaugcggug

SEQ ID NO: 1281409 - RNA, 18 nt, Mycobacterium tuberculosis H37Rv
gccacgagcaacgggcga

SEQ ID NO: 1281410 - RNA, 19 nt, Mycobacterium tuberculosis H37Rv
gccacgacgaacaccagcg

SEQ ID NO: 1281411 - RNA, 14 nt, Mycobacterium tuberculosis H37Rv
gccacgaucggcgg

SEQ ID NO: 1281412 - RNA, 17 nt, Mycobacterium tuberculosis H37Rv
gccacgccacguccaac

SEQ ID NO: 1281413 - RNA, 18 nt, Mycobacterium tuberculosis H37Rv
gccacgcagcacggcacc

SEQ ID NO: 1281414 - RNA, 15 nt, Mycobacterium tuberculosis H37Rv
gccacgcaccgggug

SEQ ID NO: 1281415 - RNA, 16 nt, Mycobacterium tuberculosis H37Rv
gccacaucgccagcag

SEQ ID NO: 1281416 - RNA, 15 nt, Mycobacterium tuberculosis H37Rv
gccacaucguggcgu

SEQ ID NO: 1281417 - RNA, 20 nt, Mycobacterium tuberculosis H37Rv
gccacaucguucaugaucgg

SEQ ID NO: 1281418 - RNA, 16 nt, Mycobacterium tuberculosis H37Rv
gccacagucgucgagc

SEQ ID NO: 1281419 - RNA, 15 nt, Mycobacterium tuberculosis H37Rv
gccaccgucauggcg

SEQ ID NO: 1281420 - RNA, 13 nt, Mycobacterium tuberculosis H37Rv
gccaccgucaugg

SEQ ID NO: 1281421 - RNA, 12 nt, Mycobacterium tuberculosis H37Rv
gccaccaaacgc

SEQ ID NO: 1281422 - RNA, 14 nt, Mycobacterium tuberculosis H37Rv
gccacaugccacag

SEQ ID NO: 1281423 - RNA, 22 nt, Mycobacterium tuberculosis H37Rv
gccacaucguucaugaucggca

SEQ ID NO: 1281424 - RNA, 22 nt, Mycobacterium tuberculosis H37Rv
gccacaugaucgagcaguucca

SEQ ID NO: 1281425 - RNA, 20 nt, Mycobacterium tuberculosis H37Rv
gccaccuugugcaggcccaa

SEQ ID NO: 1281426 - RNA, 22 nt, Mycobacterium tuberculosis H37Rv
gccaccuuggcguugaccagca

SEQ ID NO: 1281427 - RNA, 23 nt, Mycobacterium tuberculosis H37Rv
gccaccgugucacgcgaccaccg

SEQ ID NO: 1281428 - RNA, 19 nt, Mycobacterium tuberculosis H37Rv
gccaccguggccgcagggc

SEQ ID NO: 1281429 - RNA, 16 nt, Mycobacterium tuberculosis H37Rv
gccaccgugguucggc

SEQ ID NO: 1281430 - RNA, 16 nt, Mycobacterium tuberculosis H37Rv
gccaccgugucacgcg

SEQ ID NO: 1281431 - RNA, 22 nt, Mycobacterium tuberculosis H37Rv
gccaccguuugcgcaccgguca

SEQ ID NO: 1281432 - RNA, 15 nt, Mycobacterium tuberculosis H37Rv
gccaccucgacgcac

SEQ ID NO: 1281433 - RNA, 22 nt, Mycobacterium tuberculosis H37Rv
gccacgaccucgggaucggcgg

SEQ ID NO: 1281434 - RNA, 18 nt, Mycobacterium tuberculosis H37Rv
gccacgaccucgggaucg

SEQ ID NO: 1281435 - RNA, 15 nt, Mycobacterium tuberculosis H37Rv
gccacgaccgccgau

SEQ ID NO: 1281436 - RNA, 13 nt, Mycobacterium tuberculosis H37Rv
gccacgacagguc

SEQ ID NO: 1281437 - RNA, 18 nt, Mycobacterium tuberculosis H37Rv
gccaggcgaagucgacuc

SEQ ID NO: 1281438 - RNA, 15 nt, Mycobacterium tuberculosis H37Rv
gccaggccgucggcg

SEQ ID NO: 1281439 - RNA, 21 nt, Mycobacterium tuberculosis H37Rv
gccaggccgucggcgucgaag

SEQ ID NO: 1281440 - RNA, 15 nt, Mycobacterium tuberculosis H37Rv
gccagcgucgacaca

SEQ ID NO: 1281441 - RNA, 19 nt, Mycobacterium tuberculosis H37Rv
gccagcguccauggucgcg

SEQ ID NO: 1281442 - RNA, 22 nt, Mycobacterium tuberculosis H37Rv
gccagcggccgcuccaccucgg

SEQ ID NO: 1281443 - RNA, 16 nt, Mycobacterium tuberculosis H37Rv
gccagcgguggaccac

SEQ ID NO: 1281444 - RNA, 17 nt, Mycobacterium tuberculosis H37Rv
gccagcgguggaccacc

SEQ ID NO: 1281445 - RNA, 18 nt, Mycobacterium tuberculosis H37Rv
gccagcgguggaccaccg

SEQ ID NO: 1281446 - RNA, 17 nt, Mycobacterium tuberculosis H37Rv
gccagcggcccgucacc

SEQ ID NO: 1281447 - RNA, 17 nt, Mycobacterium tuberculosis H37Rv
gccaggaagcgguggcc

SEQ ID NO: 1281448 - RNA, 14 nt, Mycobacterium tuberculosis H37Rv
gccaggacauuccc

SEQ ID NO: 1281449 - RNA, 17 nt, Mycobacterium tuberculosis H37Rv
gccaggacaacgcaccg

SEQ ID NO: 1281450 - RNA, 16 nt, Mycobacterium tuberculosis H37Rv
gccaggacgacgccga

SEQ ID NO: 1281451 - RNA, 15 nt, Mycobacterium tuberculosis H37Rv
gccaggcaugccgcc

SEQ ID NO: 1281452 - RNA, 17 nt, Mycobacterium tuberculosis H37Rv
gccaggucggcguugau

SEQ ID NO: 1281453 - RNA, 15 nt, Mycobacterium tuberculosis H37Rv
gccaggucuccuugg

SEQ ID NO: 1281454 - RNA, 18 nt, Mycobacterium tuberculosis H37Rv
gccagguggccgcaucgc

SEQ ID NO: 1281455 - RNA, 13 nt, Mycobacterium tuberculosis H37Rv
gccagguggccgc

SEQ ID NO: 1281456 - RNA, 21 nt, Mycobacterium tuberculosis H37Rv
gccaggugcagggugagcacg

SEQ ID NO: 1281457 - RNA, 16 nt, Mycobacterium tuberculosis H37Rv
gccaguaugcggugcc

SEQ ID NO: 1281458 - RNA, 19 nt, Mycobacterium tuberculosis H37Rv
gccaguacucggccagcgc

SEQ ID NO: 1281459 - RNA, 22 nt, Mycobacterium tuberculosis H37Rv
gccagggugaccaggccgagcu

SEQ ID NO: 1281460 - RNA, 18 nt, Mycobacterium tuberculosis H37Rv
gccagguacucggugcac

SEQ ID NO: 1281461 - RNA, 15 nt, Mycobacterium tuberculosis H37Rv
gccaguuccggugac

SEQ ID NO: 1281462 - RNA, 14 nt, Mycobacterium tuberculosis H37Rv
gccaguucgucggc

SEQ ID NO: 1281463 - RNA, 20 nt, Mycobacterium tuberculosis H37Rv
gccaguucuucauucguggg

SEQ ID NO: 1281464 - RNA, 20 nt, Mycobacterium tuberculosis H37Rv
gccaguucggcgucguccgc

SEQ ID NO: 1281465 - RNA, 14 nt, Mycobacterium tuberculosis H37Rv
gccaguucggcggg

SEQ ID NO: 1281466 - RNA, 21 nt, Mycobacterium tuberculosis H37Rv
gccaguucggcgggcgcgggu

SEQ ID NO: 1281467 - RNA, 16 nt, Mycobacterium tuberculosis H37Rv
gccagucccccgcucg

SEQ ID NO: 1281468 - RNA, 21 nt, Mycobacterium tuberculosis H37Rv
gccagucccccgcucgaccag

SEQ ID NO: 1281469 - RNA, 18 nt, Mycobacterium tuberculosis H37Rv
gccagucccggcgcacaa

SEQ ID NO: 1281470 - RNA, 16 nt, Mycobacterium tuberculosis H37Rv
gccagugaacgcgcgu

SEQ ID NO: 1281471 - RNA, 14 nt, Mycobacterium tuberculosis H37Rv
gccaguagucgccg

SEQ ID NO: 1281472 - RNA, 17 nt, Mycobacterium tuberculosis H37Rv
gccaguggccaccauca

SEQ ID NO: 1281473 - RNA, 15 nt, Mycobacterium tuberculosis H37Rv
gccagugucagcacg

SEQ ID NO: 1281474 - RNA, 18 nt, Mycobacterium tuberculosis H37Rv
gccagugccagcguccgu

SEQ ID NO: 1281475 - RNA, 15 nt, Mycobacterium tuberculosis H37Rv
gccagugauggcgcg

SEQ ID NO: 1281476 - RNA, 17 nt, Mycobacterium tuberculosis H37Rv
gccagugauggcgcggu

SEQ ID NO: 1281477 - RNA, 23 nt, Mycobacterium tuberculosis H37Rv
gccauaggcccacggcagcgccg

SEQ ID NO: 1281478 - RNA, 22 nt, Mycobacterium tuberculosis H37Rv
gccauagugaggccgaccagca

SEQ ID NO: 1281479 - RNA, 19 nt, Mycobacterium tuberculosis H37Rv
gccauagugaggccgacca

SEQ ID NO: 1281480 - RNA, 17 nt, Mycobacterium tuberculosis H37Rv
gccauaccgcaauuggc

SEQ ID NO: 1281481 - RNA, 14 nt, Mycobacterium tuberculosis H37Rv
gccauacgucgccu

SEQ ID NO: 1281482 - RNA, 12 nt, Mycobacterium tuberculosis H37Rv
gccauagaugcc

SEQ ID NO: 1281483 - RNA, 17 nt, Mycobacterium tuberculosis H37Rv
gccauagaugcccgcga

SEQ ID NO: 1281484 - RNA, 14 nt, Mycobacterium tuberculosis H37Rv
gccaucaucgacgg

SEQ ID NO: 1281485 - RNA, 21 nt, Mycobacterium tuberculosis H37Rv
gccaucccgccgcccgcaucg

SEQ ID NO: 1281486 - RNA, 13 nt, Mycobacterium tuberculosis H37Rv
gccaucccgaucc

SEQ ID NO: 1281487 - RNA, 19 nt, Mycobacterium tuberculosis H37Rv
gccaucacggucagcucgc

SEQ ID NO: 1281488 - RNA, 20 nt, Mycobacterium tuberculosis H37Rv
gccaucgaguccaccaccug

SEQ ID NO: 1281489 - RNA, 22 nt, Mycobacterium tuberculosis H37Rv
gccauccucgagcugcuggcgc

SEQ ID NO: 1281490 - RNA, 18 nt, Mycobacterium tuberculosis H37Rv
gccauccggcggcggcca

SEQ ID NO: 1281491 - RNA, 15 nt, Mycobacterium tuberculosis H37Rv
gccauccgugaaucg

SEQ ID NO: 1281492 - RNA, 16 nt, Mycobacterium tuberculosis H37Rv
gccauccgugaaucga

SEQ ID NO: 1281493 - RNA, 17 nt, Mycobacterium tuberculosis H37Rv
gccaucguccagcagga

SEQ ID NO: 1281494 - RNA, 21 nt, Mycobacterium tuberculosis H37Rv
gccaucgggaccggggacgcg

SEQ ID NO: 1281495 - RNA, 19 nt, Mycobacterium tuberculosis H37Rv
gccaucgaugcggugaauc

SEQ ID NO: 1281496 - RNA, 19 nt, Mycobacterium tuberculosis H37Rv
gccaucgcgcggaccagag

SEQ ID NO: 1281497 - RNA, 13 nt, Mycobacterium tuberculosis H37Rv
aagaauaugccga

SEQ ID NO: 1281498 - RNA, 16 nt, Mycobacterium tuberculosis H37Rv
aagaaugugggcgacg

SEQ ID NO: 1281499 - RNA, 18 nt, Mycobacterium tuberculosis H37Rv
gccaugccgcucggcaac

SEQ ID NO: 1281500 - RNA, 22 nt, Mycobacterium tuberculosis H37Rv
gccaucguccagcaggacggug

SEQ ID NO: 1281501 - RNA, 13 nt, Mycobacterium tuberculosis H37Rv
gccaucgucgugg

SEQ ID NO: 1281502 - RNA, 18 nt, Mycobacterium tuberculosis H37Rv
gccaucugauccgguguc

SEQ ID NO: 1281503 - RNA, 12 nt, Mycobacterium tuberculosis H37Rv
gccaucugcucg

SEQ ID NO: 1281504 - RNA, 13 nt, Mycobacterium tuberculosis H37Rv
gccaucugccugc

SEQ ID NO: 1281505 - RNA, 23 nt, Mycobacterium tuberculosis H37Rv
gccaucucgacggugaccggauc

SEQ ID NO: 1281506 - RNA, 18 nt, Mycobacterium tuberculosis H37Rv
gccgaucgggguggucgc

SEQ ID NO: 1281507 - RNA, 20 nt, Mycobacterium tuberculosis H37Rv
gccgaucgggcuucggccag

SEQ ID NO: 1281508 - RNA, 22 nt, Mycobacterium tuberculosis H37Rv
gccgaucgggcuucggccagau

SEQ ID NO: 1281509 - RNA, 22 nt, Mycobacterium tuberculosis H37Rv
gccgaucgggcucacucgccga

SEQ ID NO: 1281510 - RNA, 19 nt, Mycobacterium tuberculosis H37Rv
gccgaucccggcgagcacc

SEQ ID NO: 1281511 - RNA, 18 nt, Mycobacterium tuberculosis H37Rv
gccgaucgucucggccac

SEQ ID NO: 1281512 - RNA, 16 nt, Mycobacterium tuberculosis H37Rv
gccgaucucggugacc

SEQ ID NO: 1281513 - RNA, 20 nt, Mycobacterium tuberculosis H37Rv
gccgaucucuccggcggcga

SEQ ID NO: 1281514 - RNA, 17 nt, Mycobacterium tuberculosis H37Rv
gccgaucugcugcagcg

SEQ ID NO: 1281515 - RNA, 17 nt, Mycobacterium tuberculosis H37Rv
gccgcacaaguggucga

SEQ ID NO: 1281516 - RNA, 20 nt, Mycobacterium tuberculosis H37Rv
gccgcaaugcguugaccgau

SEQ ID NO: 1281517 - RNA, 17 nt, Mycobacterium tuberculosis H37Rv
gccgcaaacgcggcguc

SEQ ID NO: 1281518 - RNA, 19 nt, Mycobacterium tuberculosis H37Rv
gccgcagcaggugcaucgc

SEQ ID NO: 1281519 - RNA, 21 nt, Mycobacterium tuberculosis H37Rv
gccgcagcaggugcaucgcca

SEQ ID NO: 1281520 - RNA, 20 nt, Mycobacterium tuberculosis H37Rv
gccgcagcaggggacgacca

SEQ ID NO: 1281521 - RNA, 20 nt, Mycobacterium tuberculosis H37Rv
gccgcagcaccucgucgauc

SEQ ID NO: 1281522 - RNA, 15 nt, Mycobacterium tuberculosis H37Rv
gccgcagcaccucgg

SEQ ID NO: 1281523 - RNA, 14 nt, Mycobacterium tuberculosis H37Rv
gccgcacccguugc

SEQ ID NO: 1281524 - RNA, 22 nt, Mycobacterium tuberculosis H37Rv
gccgcaccgauuuccucugggc

SEQ ID NO: 1281525 - RNA, 22 nt, Mycobacterium tuberculosis H37Rv
gccgcagaucaccgccagcugg

SEQ ID NO: 1281526 - RNA, 22 nt, Mycobacterium tuberculosis H37Rv
gccgcaccaagcagcgaccagc

SEQ ID NO: 1281527 - RNA, 17 nt, Mycobacterium tuberculosis H37Rv
gccgcaccagcauucuc

SEQ ID NO: 1281528 - RNA, 19 nt, Mycobacterium tuberculosis H37Rv
gccgcacccagaccgccga

SEQ ID NO: 1281529 - RNA, 18 nt, Mycobacterium tuberculosis H37Rv
gccgcaccagaucgucgg

SEQ ID NO: 1281530 - RNA, 18 nt, Mycobacterium tuberculosis H37Rv
gccgcacccgaucgacgg

SEQ ID NO: 1281531 - RNA, 20 nt, Mycobacterium tuberculosis H37Rv
gccgcaccaagcagcgacca

SEQ ID NO: 1281532 - RNA, 17 nt, Mycobacterium tuberculosis H37Rv
gccgcacaugagcugga

SEQ ID NO: 1281533 - RNA, 22 nt, Mycobacterium tuberculosis H37Rv
gccgcacagcggauucggcguc

SEQ ID NO: 1281534 - RNA, 14 nt, Mycobacterium tuberculosis H37Rv
gccgcacacgcgug

SEQ ID NO: 1281535 - RNA, 20 nt, Mycobacterium tuberculosis H37Rv
gccgcacacucucggugaac

SEQ ID NO: 1281536 - RNA, 19 nt, Mycobacterium tuberculosis H37Rv
gccgccagcugcgcagcgc

SEQ ID NO: 1281537 - RNA, 13 nt, Mycobacterium tuberculosis H37Rv
gccgccagcccgu

SEQ ID NO: 1281538 - RNA, 17 nt, Mycobacterium tuberculosis H37Rv
gccgccagccccagcgu

SEQ ID NO: 1281539 - RNA, 14 nt, Mycobacterium tuberculosis H37Rv
gccgccagccggcg

SEQ ID NO: 1281540 - RNA, 14 nt, Mycobacterium tuberculosis H37Rv
gccgccaccaccgg

SEQ ID NO: 1281541 - RNA, 22 nt, Mycobacterium tuberculosis H37Rv
gccgcaugcgcuccggcgcgac

SEQ ID NO: 1281542 - RNA, 15 nt, Mycobacterium tuberculosis H37Rv
gccgcauccagccgu

SEQ ID NO: 1281543 - RNA, 20 nt, Mycobacterium tuberculosis H37Rv
gccgcauaggccccgccagc

SEQ ID NO: 1281544 - RNA, 15 nt, Mycobacterium tuberculosis H37Rv
gccgcauucggcgau

SEQ ID NO: 1281545 - RNA, 16 nt, Mycobacterium tuberculosis H37Rv
gccgcagccagcggua

SEQ ID NO: 1281546 - RNA, 13 nt, Mycobacterium tuberculosis H37Rv
gccgcagccaggu

SEQ ID NO: 1281547 - RNA, 14 nt, Mycobacterium tuberculosis H37Rv
gccgcagccagcaa

SEQ ID NO: 1281548 - RNA, 20 nt, Mycobacterium tuberculosis H37Rv
gccgcaggugggcguuggcg

SEQ ID NO: 1281549 - RNA, 22 nt, Mycobacterium tuberculosis H37Rv
gccgcaguccgcacgcggcaau

SEQ ID NO: 1281550 - RNA, 19 nt, Mycobacterium tuberculosis H37Rv
gccgcagguucaacgcggg

SEQ ID NO: 1281551 - RNA, 15 nt, Mycobacterium tuberculosis H37Rv
gccgccgaauccgac

SEQ ID NO: 1281552 - RNA, 17 nt, Mycobacterium tuberculosis H37Rv
gccgccgaccagaacgc

SEQ ID NO: 1281553 - RNA, 16 nt, Mycobacterium tuberculosis H37Rv
gccgccgaccggagcc

SEQ ID NO: 1281554 - RNA, 13 nt, Mycobacterium tuberculosis H37Rv
gccgccgccaccu

SEQ ID NO: 1281555 - RNA, 13 nt, Mycobacterium tuberculosis H37Rv
gccgccgagcucg

SEQ ID NO: 1281556 - RNA, 16 nt, Mycobacterium tuberculosis H37Rv
gccgcccucgggauug

SEQ ID NO: 1281557 - RNA, 20 nt, Mycobacterium tuberculosis H37Rv
gccgcccguaucggcuucgu

SEQ ID NO: 1281558 - RNA, 21 nt, Mycobacterium tuberculosis H37Rv
gccgcccggcgagcagggcgu

SEQ ID NO: 1281559 - RNA, 17 nt, Mycobacterium tuberculosis H37Rv
gccgcccucaccgccug

SEQ ID NO: 1281560 - RNA, 14 nt, Mycobacterium tuberculosis H37Rv
gccgcccuugccgc

SEQ ID NO: 1281561 - RNA, 21 nt, Mycobacterium tuberculosis H37Rv
gccgcccggcguauugcaccg

SEQ ID NO: 1281562 - RNA, 13 nt, Mycobacterium tuberculosis H37Rv
gccgcccggucgg

SEQ ID NO: 1281563 - RNA, 20 nt, Mycobacterium tuberculosis H37Rv
gccgcccgcugcggcggcuu

SEQ ID NO: 1281564 - RNA, 20 nt, Mycobacterium tuberculosis H37Rv
gccgccaucagccgcugcgu

SEQ ID NO: 1281565 - RNA, 17 nt, Mycobacterium tuberculosis H37Rv
gccgccaucagccgcug

SEQ ID NO: 1281566 - RNA, 20 nt, Mycobacterium tuberculosis H37Rv
gccgccaggcgcuuggccgg

SEQ ID NO: 1281567 - RNA, 22 nt, Mycobacterium tuberculosis H37Rv
gccgccagggcccuagccggcg

SEQ ID NO: 1281568 - RNA, 23 nt, Mycobacterium tuberculosis H37Rv
gccgccaugcgcaccaguccagc

SEQ ID NO: 1281569 - RNA, 15 nt, Mycobacterium tuberculosis H37Rv
gccgccaucgccgau

SEQ ID NO: 1281570 - RNA, 17 nt, Mycobacterium tuberculosis H37Rv
gccgcccagaccgccga

SEQ ID NO: 1281571 - RNA, 21 nt, Mycobacterium tuberculosis H37Rv
gccgcccagcggaaucaccga

SEQ ID NO: 1281572 - RNA, 18 nt, Mycobacterium tuberculosis H37Rv
gccgcccagugcggccac

SEQ ID NO: 1281573 - RNA, 15 nt, Mycobacterium tuberculosis H37Rv
gccgcccgcgccacc

SEQ ID NO: 1281574 - RNA, 17 nt, Mycobacterium tuberculosis H37Rv
gccgcccgcgccaccag

SEQ ID NO: 1281575 - RNA, 14 nt, Mycobacterium tuberculosis H37Rv
gccgcccgcaucgc

SEQ ID NO: 1281576 - RNA, 15 nt, Mycobacterium tuberculosis H37Rv
gccgcccgagccggu

SEQ ID NO: 1281577 - RNA, 21 nt, Mycobacterium tuberculosis H37Rv
gccgcccccguuuacggcccg

SEQ ID NO: 1281578 - RNA, 14 nt, Mycobacterium tuberculosis H37Rv
gccgccccgcucgg

SEQ ID NO: 1281579 - RNA, 22 nt, Mycobacterium tuberculosis H37Rv
gccgagugcccagcgaugcgcu

SEQ ID NO: 1281580 - RNA, 15 nt, Mycobacterium tuberculosis H37Rv
gccgaggucguaugc

SEQ ID NO: 1281581 - RNA, 15 nt, Mycobacterium tuberculosis H37Rv
gccgaguucgucagc

SEQ ID NO: 1281582 - RNA, 17 nt, Mycobacterium tuberculosis H37Rv
gccgauacaggccacgc

SEQ ID NO: 1281583 - RNA, 21 nt, Mycobacterium tuberculosis H37Rv
gccgauacagcacauccagcc

SEQ ID NO: 1281584 - RNA, 22 nt, Mycobacterium tuberculosis H37Rv
gccgagcugguugacggcgaag

SEQ ID NO: 1281585 - RNA, 16 nt, Mycobacterium tuberculosis H37Rv
gccgagcucggucacc

SEQ ID NO: 1281586 - RNA, 21 nt, Mycobacterium tuberculosis H37Rv
gccgagcugguugacggcgaa

SEQ ID NO: 1281587 - RNA, 20 nt, Mycobacterium tuberculosis H37Rv
gccgagcuagaucacggagc

SEQ ID NO: 1281588 - RNA, 13 nt, Mycobacterium tuberculosis H37Rv
gccgagcucggcu

SEQ ID NO: 1281589 - RNA, 20 nt, Mycobacterium tuberculosis H37Rv
gccgagcugugcgcagacau

SEQ ID NO: 1281590 - RNA, 21 nt, Mycobacterium tuberculosis H37Rv
gccgagcugguuggcgccgaa

SEQ ID NO: 1281591 - RNA, 19 nt, Mycobacterium tuberculosis H37Rv
gccgagguagauggcgaac

SEQ ID NO: 1281592 - RNA, 15 nt, Mycobacterium tuberculosis H37Rv
gccgaggucgaaccg

SEQ ID NO: 1281593 - RNA, 18 nt, Mycobacterium tuberculosis H37Rv
gccgauccagcaggccgu

SEQ ID NO: 1281594 - RNA, 14 nt, Mycobacterium tuberculosis H37Rv
gccgauccagcagg

SEQ ID NO: 1281595 - RNA, 14 nt, Mycobacterium tuberculosis H37Rv
gccgaucaucaccg

SEQ ID NO: 1281596 - RNA, 15 nt, Mycobacterium tuberculosis H37Rv
gccgaucaucaccgg

SEQ ID NO: 1281597 - RNA, 13 nt, Mycobacterium tuberculosis H37Rv
gccgaucagcugg

SEQ ID NO: 1281598 - RNA, 19 nt, Mycobacterium tuberculosis H37Rv
gccgaucagcgaaccaccg

SEQ ID NO: 1281599 - RNA, 22 nt, Mycobacterium tuberculosis H37Rv
gccgauacagaucuggguuccc

SEQ ID NO: 1281600 - RNA, 23 nt, Mycobacterium tuberculosis H37Rv
gccgauauccaaugccagaucgg

SEQ ID NO: 1281601 - RNA, 21 nt, Mycobacterium tuberculosis H37Rv
gccgauaucggugaccguggc

SEQ ID NO: 1281602 - RNA, 15 nt, Mycobacterium tuberculosis H37Rv
gccgauaucggugac

SEQ ID NO: 1281603 - RNA, 17 nt, Mycobacterium tuberculosis H37Rv
gccgauauuggcaucgu

SEQ ID NO: 1281604 - RNA, 13 nt, Mycobacterium tuberculosis H37Rv
gccgaucacggca

SEQ ID NO: 1281605 - RNA, 19 nt, Mycobacterium tuberculosis H37Rv
gccgauaccggcggcgagc

SEQ ID NO: 1281606 - RNA, 19 nt, Mycobacterium tuberculosis H37Rv
gccgauacuucaucggcac

SEQ ID NO: 1281607 - RNA, 14 nt, Mycobacterium tuberculosis H37Rv
gccgauagcaccgg

SEQ ID NO: 1281608 - RNA, 17 nt, Mycobacterium tuberculosis H37Rv
gccgagcgcaccacggc

SEQ ID NO: 1281609 - RNA, 12 nt, Mycobacterium tuberculosis H37Rv
gccgagcgcacu

SEQ ID NO: 1281610 - RNA, 23 nt, Mycobacterium tuberculosis H37Rv
gccgagcguggccaauccggcgg

SEQ ID NO: 1281611 - RNA, 22 nt, Mycobacterium tuberculosis H37Rv
gccgagcgugaagucacggcgg

SEQ ID NO: 1281612 - RNA, 16 nt, Mycobacterium tuberculosis H37Rv
gccgagcuagaucacg

SEQ ID NO: 1281613 - RNA, 15 nt, Mycobacterium tuberculosis H37Rv
gccgagcgaccgucc

SEQ ID NO: 1281614 - RNA, 19 nt, Mycobacterium tuberculosis H37Rv
gccgagcgaccgucccagc

SEQ ID NO: 1281615 - RNA, 13 nt, Mycobacterium tuberculosis H37Rv
gccgagccgacau

SEQ ID NO: 1281616 - RNA, 15 nt, Mycobacterium tuberculosis H37Rv
gccgagccagcuccg

SEQ ID NO: 1281617 - RNA, 22 nt, Mycobacterium tuberculosis H37Rv
gccgagcagguuccgcacgauc

SEQ ID NO: 1281618 - RNA, 14 nt, Mycobacterium tuberculosis H37Rv
gccgagcauccgac

SEQ ID NO: 1281619 - RNA, 22 nt, Mycobacterium tuberculosis H37Rv
gccgagaugcuggucggcgaug

SEQ ID NO: 1281620 - RNA, 18 nt, Mycobacterium tuberculosis H37Rv
gccgagcaggucggcaau

SEQ ID NO: 1281621 - RNA, 18 nt, Mycobacterium tuberculosis H37Rv
gccgagcagggccggcac

SEQ ID NO: 1281622 - RNA, 16 nt, Mycobacterium tuberculosis H37Rv
gccgacucaucggccg

SEQ ID NO: 1281623 - RNA, 15 nt, Mycobacterium tuberculosis H37Rv
gccgacucaggucgg

SEQ ID NO: 1281624 - RNA, 22 nt, Mycobacterium tuberculosis H37Rv
gccgacuacgaagacguucgga

SEQ ID NO: 1281625 - RNA, 23 nt, Mycobacterium tuberculosis H37Rv
gccgacugugaaucugacgacgc

SEQ ID NO: 1281626 - RNA, 17 nt, Mycobacterium tuberculosis H37Rv
gccgacucaucggccgc

SEQ ID NO: 1281627 - RNA, 21 nt, Mycobacterium tuberculosis H37Rv
gccgacgucgacgccggccag

SEQ ID NO: 1281628 - RNA, 22 nt, Mycobacterium tuberculosis H37Rv
gccgacgucgacgccggccagc

SEQ ID NO: 1281629 - RNA, 15 nt, Mycobacterium tuberculosis H37Rv
gccgacgucguuggc

SEQ ID NO: 1281630 - RNA, 18 nt, Mycobacterium tuberculosis H37Rv
gccgagagcaccgcucgg

SEQ ID NO: 1281631 - RNA, 24 nt, Mycobacterium tuberculosis H37Rv
gccgagaacgauguccgcgcgaac

SEQ ID NO: 1281632 - RNA, 20 nt, Mycobacterium tuberculosis H37Rv
gccgagaccgccgcugccgc

SEQ ID NO: 1281633 - RNA, 13 nt, Mycobacterium tuberculosis H37Rv
gccgagaucacgc

SEQ ID NO: 1281634 - RNA, 21 nt, Mycobacterium tuberculosis H37Rv
gccgagaucgacaucguuggc

SEQ ID NO: 1281635 - RNA, 15 nt, Mycobacterium tuberculosis H37Rv
gccgagaucgacauc

SEQ ID NO: 1281636 - RNA, 13 nt, Mycobacterium tuberculosis H37Rv
gccgagagcagcc

SEQ ID NO: 1281637 - RNA, 18 nt, Mycobacterium tuberculosis H37Rv
gccgagaacgauguccgc

SEQ ID NO: 1281638 - RNA, 13 nt, Mycobacterium tuberculosis H37Rv
gccgagaacaccg

SEQ ID NO: 1281639 - RNA, 20 nt, Mycobacterium tuberculosis H37Rv
gccgagaagugggcgguacc

SEQ ID NO: 1281640 - RNA, 20 nt, Mycobacterium tuberculosis H37Rv
gccgacuuccgcgucgccgg

SEQ ID NO: 1281641 - RNA, 15 nt, Mycobacterium tuberculosis H37Rv
gccgaaaucggccag

SEQ ID NO: 1281642 - RNA, 22 nt, Mycobacterium tuberculosis H37Rv
gccgaacaguucggcgagcaca

SEQ ID NO: 1281643 - RNA, 19 nt, Mycobacterium tuberculosis H37Rv
gccgaacaguucggcgagc

SEQ ID NO: 1281644 - RNA, 14 nt, Mycobacterium tuberculosis H37Rv
gccgaaccacgcgc

SEQ ID NO: 1281645 - RNA, 19 nt, Mycobacterium tuberculosis H37Rv
gccgaacccgccgucaccg

SEQ ID NO: 1281646 - RNA, 20 nt, Mycobacterium tuberculosis H37Rv
gccgaacgaggaaccgucga

SEQ ID NO: 1281647 - RNA, 18 nt, Mycobacterium tuberculosis H37Rv
gccgaaccguucggcgac

SEQ ID NO: 1281648 - RNA, 19 nt, Mycobacterium tuberculosis H37Rv
gccgaaccgguagucgccg

SEQ ID NO: 1281649 - RNA, 22 nt, Mycobacterium tuberculosis H37Rv
gccgaaccgguagucgccgucg

SEQ ID NO: 1281650 - RNA, 15 nt, Mycobacterium tuberculosis H37Rv
gccgaaacucaccag

SEQ ID NO: 1281651 - RNA, 20 nt, Mycobacterium tuberculosis H37Rv
gccgaaagccuugccgucga

SEQ ID NO: 1281652 - RNA, 23 nt, Mycobacterium tuberculosis H37Rv
gccgaaaucacugaggcugcggg

SEQ ID NO: 1281653 - RNA, 21 nt, Mycobacterium tuberculosis H37Rv
gccgaaagagccagcggcacu

SEQ ID NO: 1281654 - RNA, 18 nt, Mycobacterium tuberculosis H37Rv
gccgaaacauugcccgug

SEQ ID NO: 1281655 - RNA, 20 nt, Mycobacterium tuberculosis H37Rv
gcccucaguucacgcucgac

SEQ ID NO: 1281656 - RNA, 16 nt, Mycobacterium tuberculosis H37Rv
gcccucagcuagcgcg

SEQ ID NO: 1281657 - RNA, 23 nt, Mycobacterium tuberculosis H37Rv
gcccucaguucacguucggcgac

SEQ ID NO: 1281658 - RNA, 20 nt, Mycobacterium tuberculosis H37Rv
gcccucaguucacguucggc

SEQ ID NO: 1281659 - RNA, 14 nt, Mycobacterium tuberculosis H37Rv
gcccuccgagcaca

SEQ ID NO: 1281660 - RNA, 18 nt, Mycobacterium tuberculosis H37Rv
gccgaacgggucggcgac

SEQ ID NO: 1281661 - RNA, 21 nt, Mycobacterium tuberculosis H37Rv
gccgaacgccucugcgaucag

SEQ ID NO: 1281662 - RNA, 20 nt, Mycobacterium tuberculosis H37Rv
gccgaacgccagaccgccga

SEQ ID NO: 1281663 - RNA, 12 nt, Mycobacterium tuberculosis H37Rv
gccgaacgccag

SEQ ID NO: 1281664 - RNA, 19 nt, Mycobacterium tuberculosis H37Rv
gccgaagcccccgacguug

SEQ ID NO: 1281665 - RNA, 19 nt, Mycobacterium tuberculosis H37Rv
gccgaagcccgaucggcgg

SEQ ID NO: 1281666 - RNA, 16 nt, Mycobacterium tuberculosis H37Rv
gccgaagccgacgaac

SEQ ID NO: 1281667 - RNA, 20 nt, Mycobacterium tuberculosis H37Rv
gccgaacgugcaaccauggc

SEQ ID NO: 1281668 - RNA, 19 nt, Mycobacterium tuberculosis H37Rv
gccgaacgucgcggccagc

SEQ ID NO: 1281669 - RNA, 22 nt, Mycobacterium tuberculosis H37Rv
gccgaacuaucguugugcggac

SEQ ID NO: 1281670 - RNA, 16 nt, Mycobacterium tuberculosis H37Rv
gccgaagcgcccguug

SEQ ID NO: 1281671 - RNA, 19 nt, Mycobacterium tuberculosis H37Rv
gccgaagcgcccguuggcc

SEQ ID NO: 1281672 - RNA, 13 nt, Mycobacterium tuberculosis H37Rv
gccgaagccggac

SEQ ID NO: 1281673 - RNA, 14 nt, Mycobacterium tuberculosis H37Rv
gccgaccucacggc

SEQ ID NO: 1281674 - RNA, 16 nt, Mycobacterium tuberculosis H37Rv
gccgaccguaccgauc

SEQ ID NO: 1281675 - RNA, 20 nt, Mycobacterium tuberculosis H37Rv
gccgaccgacaccaccaggu

SEQ ID NO: 1281676 - RNA, 19 nt, Mycobacterium tuberculosis H37Rv
gccgaccgaaucagcacgg

SEQ ID NO: 1281677 - RNA, 15 nt, Mycobacterium tuberculosis H37Rv
gccgaccgacgucgc

SEQ ID NO: 1281678 - RNA, 18 nt, Mycobacterium tuberculosis H37Rv
gccgaccgacgucgccca

SEQ ID NO: 1281679 - RNA, 22 nt, Mycobacterium tuberculosis H37Rv
gccgaccgguuggguagcaccg

SEQ ID NO: 1281680 - RNA, 17 nt, Mycobacterium tuberculosis H37Rv
gccgaccagcaucucgg

SEQ ID NO: 1281681 - RNA, 19 nt, Mycobacterium tuberculosis H37Rv
gccgaccagcaucucggcc

SEQ ID NO: 1281682 - RNA, 22 nt, Mycobacterium tuberculosis H37Rv
gccgacccgcgcgccggcgacc

SEQ ID NO: 1281683 - RNA, 20 nt, Mycobacterium tuberculosis H37Rv
gccgaccacucgagcgcuca

SEQ ID NO: 1281684 - RNA, 16 nt, Mycobacterium tuberculosis H37Rv
gccgaccagcacaccg

SEQ ID NO: 1281685 - RNA, 14 nt, Mycobacterium tuberculosis H37Rv
aagaugaccugauc

SEQ ID NO: 1281686 - RNA, 16 nt, Mycobacterium tuberculosis H37Rv
aagaugaccucggcga

SEQ ID NO: 1281687 - RNA, 20 nt, Mycobacterium tuberculosis H37Rv
gccgacgccuuccagcccga

SEQ ID NO: 1281688 - RNA, 17 nt, Mycobacterium tuberculosis H37Rv
gccgacgcgcggccagc

SEQ ID NO: 1281689 - RNA, 16 nt, Mycobacterium tuberculosis H37Rv
gccgacgcgcggccag

SEQ ID NO: 1281690 - RNA, 18 nt, Mycobacterium tuberculosis H37Rv
gccgacgccaacgccagc

SEQ ID NO: 1281691 - RNA, 20 nt, Mycobacterium tuberculosis H37Rv
gccgacgccccgaucggcca

SEQ ID NO: 1281692 - RNA, 22 nt, Mycobacterium tuberculosis H37Rv
gccgacgauuaccagcggcacc

SEQ ID NO: 1281693 - RNA, 13 nt, Mycobacterium tuberculosis H37Rv
gccgacgaugacg

SEQ ID NO: 1281694 - RNA, 23 nt, Mycobacterium tuberculosis H37Rv
gccgaccugcuggaucucggugg

SEQ ID NO: 1281695 - RNA, 13 nt, Mycobacterium tuberculosis H37Rv
gcccgucaucgcg

SEQ ID NO: 1281696 - RNA, 18 nt, Mycobacterium tuberculosis H37Rv
gcccguauaaccggccau

SEQ ID NO: 1281697 - RNA, 20 nt, Mycobacterium tuberculosis H37Rv
gcccgucagcggacaguucg

SEQ ID NO: 1281698 - RNA, 22 nt, Mycobacterium tuberculosis H37Rv
gcccguccucgucggugugcca

SEQ ID NO: 1281699 - RNA, 22 nt, Mycobacterium tuberculosis H37Rv
gcccgucgcugggaggcgcggu

SEQ ID NO: 1281700 - RNA, 20 nt, Mycobacterium tuberculosis H37Rv
gcccgucggacauaccgcga

SEQ ID NO: 1281701 - RNA, 23 nt, Mycobacterium tuberculosis H37Rv
gcccgucggauggaaggcggcca

SEQ ID NO: 1281702 - RNA, 15 nt, Mycobacterium tuberculosis H37Rv
gcccgucucguugac

SEQ ID NO: 1281703 - RNA, 17 nt, Mycobacterium tuberculosis H37Rv
gcccgucgucgugcacg

SEQ ID NO: 1281704 - RNA, 19 nt, Mycobacterium tuberculosis H37Rv
gcccgucgucgugcacgac

SEQ ID NO: 1281705 - RNA, 18 nt, Mycobacterium tuberculosis H37Rv
gcccgucggcgccgaaca

SEQ ID NO: 1281706 - RNA, 16 nt, Mycobacterium tuberculosis H37Rv
gcccucaccgccugug

SEQ ID NO: 1281707 - RNA, 14 nt, Mycobacterium tuberculosis H37Rv
gcccuaucagccga

SEQ ID NO: 1281708 - RNA, 23 nt, Mycobacterium tuberculosis H37Rv
gcccguuguccagaacggcgauc

SEQ ID NO: 1281709 - RNA, 23 nt, Mycobacterium tuberculosis H37Rv
gcccguuugccgguucggcgauc

SEQ ID NO: 1281710 - RNA, 20 nt, Mycobacterium tuberculosis H37Rv
gcccguuugccgguucggcg

SEQ ID NO: 1281711 - RNA, 23 nt, Mycobacterium tuberculosis H37Rv
gcccguucgaaguucucggugcg

SEQ ID NO: 1281712 - RNA, 23 nt, Mycobacterium tuberculosis H37Rv
gcccguguugaagaagcccgagu

SEQ ID NO: 1281713 - RNA, 21 nt, Mycobacterium tuberculosis H37Rv
gcccguggugauggucgugau

SEQ ID NO: 1281714 - RNA, 16 nt, Mycobacterium tuberculosis H37Rv
gcccguggcggugagc

SEQ ID NO: 1281715 - RNA, 22 nt, Mycobacterium tuberculosis H37Rv
gcccguucaugcggcggcgcuc

SEQ ID NO: 1281716 - RNA, 20 nt, Mycobacterium tuberculosis H37Rv
gcccguggucgaucaugacg

SEQ ID NO: 1281717 - RNA, 16 nt, Mycobacterium tuberculosis H37Rv
gcccgugaucaccacg

SEQ ID NO: 1281718 - RNA, 22 nt, Mycobacterium tuberculosis H37Rv
gcccgucuuccagccaggccuu

SEQ ID NO: 1281719 - RNA, 14 nt, Mycobacterium tuberculosis H37Rv
gcccgugaucacca

SEQ ID NO: 1281720 - RNA, 21 nt, Mycobacterium tuberculosis H37Rv
gcccgggacaaguucgguagc

SEQ ID NO: 1281721 - RNA, 22 nt, Mycobacterium tuberculosis H37Rv
gcccgggaaauagauucccggc

SEQ ID NO: 1281722 - RNA, 22 nt, Mycobacterium tuberculosis H37Rv
gcccgggauaguuuucggccgc

SEQ ID NO: 1281723 - RNA, 14 nt, Mycobacterium tuberculosis H37Rv
gcccgggcucggcg

SEQ ID NO: 1281724 - RNA, 16 nt, Mycobacterium tuberculosis H37Rv
gcccgggcgucaagcc

SEQ ID NO: 1281725 - RNA, 22 nt, Mycobacterium tuberculosis H37Rv
gcccgggcgggagucgucgagc

SEQ ID NO: 1281726 - RNA, 18 nt, Mycobacterium tuberculosis H37Rv
gcccgggcggaacgccgg

SEQ ID NO: 1281727 - RNA, 18 nt, Mycobacterium tuberculosis H37Rv
gcccgggacaaguucggu

SEQ ID NO: 1281728 - RNA, 18 nt, Mycobacterium tuberculosis H37Rv
gcccggguuggccgaaca

SEQ ID NO: 1281729 - RNA, 15 nt, Mycobacterium tuberculosis H37Rv
gcccggguuggccga

SEQ ID NO: 1281730 - RNA, 21 nt, Mycobacterium tuberculosis H37Rv
gcccggguggcccggaacacc

SEQ ID NO: 1281731 - RNA, 20 nt, Mycobacterium tuberculosis H37Rv
gcccgggugaaacgauggcg

SEQ ID NO: 1281732 - RNA, 14 nt, Mycobacterium tuberculosis H37Rv
gcccgggguccauc

SEQ ID NO: 1281733 - RNA, 20 nt, Mycobacterium tuberculosis H37Rv
gcccggggaaccguccaagc

SEQ ID NO: 1281734 - RNA, 16 nt, Mycobacterium tuberculosis H37Rv
gcccggggcgcacagc

SEQ ID NO: 1281735 - RNA, 20 nt, Mycobacterium tuberculosis H37Rv
gcccgggggguugaucggca

SEQ ID NO: 1281736 - RNA, 21 nt, Mycobacterium tuberculosis H37Rv
gcccgguaucgucccggcgac

SEQ ID NO: 1281737 - RNA, 22 nt, Mycobacterium tuberculosis H37Rv
gcccgguaucgucccggcgacc

SEQ ID NO: 1281738 - RNA, 16 nt, Mycobacterium tuberculosis H37Rv
gcccggucuugggcgc

SEQ ID NO: 1281739 - RNA, 16 nt, Mycobacterium tuberculosis H37Rv
gcccggugcggugcac

SEQ ID NO: 1281740 - RNA, 17 nt, Mycobacterium tuberculosis H37Rv
gcccggugcggugcaca

SEQ ID NO: 1281741 - RNA, 22 nt, Mycobacterium tuberculosis H37Rv
gcccggucgagccagcggagca

SEQ ID NO: 1281742 - RNA, 19 nt, Mycobacterium tuberculosis H37Rv
gcccggucgcucgacgacc

SEQ ID NO: 1281743 - RNA, 15 nt, Mycobacterium tuberculosis H37Rv
gcccguagcguccgc

SEQ ID NO: 1281744 - RNA, 18 nt, Mycobacterium tuberculosis H37Rv
gcccguagcgucgaucac

SEQ ID NO: 1281745 - RNA, 19 nt, Mycobacterium tuberculosis H37Rv
gcccguagcgucgaucacg

SEQ ID NO: 1281746 - RNA, 20 nt, Mycobacterium tuberculosis H37Rv
gcccguagcgucgaucacgu

SEQ ID NO: 1281747 - RNA, 15 nt, Mycobacterium tuberculosis H37Rv
gcccgguugaccgcc

SEQ ID NO: 1281748 - RNA, 21 nt, Mycobacterium tuberculosis H37Rv
gcccgguugcggucagacgcc

SEQ ID NO: 1281749 - RNA, 15 nt, Mycobacterium tuberculosis H37Rv
gcccggaugaucccg

SEQ ID NO: 1281750 - RNA, 14 nt, Mycobacterium tuberculosis H37Rv
gcccggaugcgaug

SEQ ID NO: 1281751 - RNA, 15 nt, Mycobacterium tuberculosis H37Rv
gcccggacgucggcg

SEQ ID NO: 1281752 - RNA, 12 nt, Mycobacterium tuberculosis H37Rv
gcccggacgucg

SEQ ID NO: 1281753 - RNA, 18 nt, Mycobacterium tuberculosis H37Rv
gcccggacgauggcgucg

SEQ ID NO: 1281754 - RNA, 15 nt, Mycobacterium tuberculosis H37Rv
gcccggacgauggcg

SEQ ID NO: 1281755 - RNA, 19 nt, Mycobacterium tuberculosis H37Rv
gcccggacaugcgggcagc

SEQ ID NO: 1281756 - RNA, 13 nt, Mycobacterium tuberculosis H37Rv
gcccggcagcacg

SEQ ID NO: 1281757 - RNA, 22 nt, Mycobacterium tuberculosis H37Rv
gcccggcaguucgcggccaucg

SEQ ID NO: 1281758 - RNA, 21 nt, Mycobacterium tuberculosis H37Rv
gcccggcacugaccgcgauga

SEQ ID NO: 1281759 - RNA, 13 nt, Mycobacterium tuberculosis H37Rv
gcccggcaucgcg

SEQ ID NO: 1281760 - RNA, 20 nt, Mycobacterium tuberculosis H37Rv
gcccggccacaggaagcgac

SEQ ID NO: 1281761 - RNA, 20 nt, Mycobacterium tuberculosis H37Rv
gcccggccaggucgacaccg

SEQ ID NO: 1281762 - RNA, 12 nt, Mycobacterium tuberculosis H37Rv
gcccggccaggu

SEQ ID NO: 1281763 - RNA, 17 nt, Mycobacterium tuberculosis H37Rv
gcccggaauguagucca

SEQ ID NO: 1281764 - RNA, 14 nt, Mycobacterium tuberculosis H37Rv
gcccggacgauggc

SEQ ID NO: 1281765 - RNA, 23 nt, Mycobacterium tuberculosis H37Rv
gcccggaaaaauuucuucgccga

SEQ ID NO: 1281766 - RNA, 20 nt, Mycobacterium tuberculosis H37Rv
gcccgcgcccccggugccgu

SEQ ID NO: 1281767 - RNA, 14 nt, Mycobacterium tuberculosis H37Rv
gcccgcgcagcggu

SEQ ID NO: 1281768 - RNA, 20 nt, Mycobacterium tuberculosis H37Rv
gcccgccugaccgccaccgu

SEQ ID NO: 1281769 - RNA, 24 nt, Mycobacterium tuberculosis H37Rv
gcccgccucugucuucagcugcgg

SEQ ID NO: 1281770 - RNA, 23 nt, Mycobacterium tuberculosis H37Rv
gcccggcgaaagcuugggcgauc

SEQ ID NO: 1281771 - RNA, 14 nt, Mycobacterium tuberculosis H37Rv
gcccggccgccagc

SEQ ID NO: 1281772 - RNA, 20 nt, Mycobacterium tuberculosis H37Rv
gcccggcccgggucagcgac

SEQ ID NO: 1281773 - RNA, 23 nt, Mycobacterium tuberculosis H37Rv
gcccggcccugagcugccgagcg

SEQ ID NO: 1281774 - RNA, 16 nt, Mycobacterium tuberculosis H37Rv
gcccggcccggcucgg

SEQ ID NO: 1281775 - RNA, 12 nt, Mycobacterium tuberculosis H37Rv
gcccggcgcgaa

SEQ ID NO: 1281776 - RNA, 16 nt, Mycobacterium tuberculosis H37Rv
gcccggcgcaccaucg

SEQ ID NO: 1281777 - RNA, 18 nt, Mycobacterium tuberculosis H37Rv
gcccggcgaucagcagcg

SEQ ID NO: 1281778 - RNA, 15 nt, Mycobacterium tuberculosis H37Rv
gcccggcgagcaggg

SEQ ID NO: 1281779 - RNA, 13 nt, Mycobacterium tuberculosis H37Rv
gcccggcgcaagc

SEQ ID NO: 1281780 - RNA, 22 nt, Mycobacterium tuberculosis H37Rv
gcccggcgaauacgaccgucgc

SEQ ID NO: 1281781 - RNA, 23 nt, Mycobacterium tuberculosis H37Rv
gcccggcgagcagacgcauaagc

SEQ ID NO: 1281782 - RNA, 23 nt, Mycobacterium tuberculosis H37Rv
gcccggcguuguugaccagcacg

SEQ ID NO: 1281783 - RNA, 19 nt, Mycobacterium tuberculosis H37Rv
gcccggcuaggagaucagc

SEQ ID NO: 1281784 - RNA, 12 nt, Mycobacterium tuberculosis H37Rv
gcccggcucggu

SEQ ID NO: 1281785 - RNA, 13 nt, Mycobacterium tuberculosis H37Rv
gcccggcggcggu

SEQ ID NO: 1281786 - RNA, 12 nt, Mycobacterium tuberculosis H37Rv
gcccggcggcga

SEQ ID NO: 1281787 - RNA, 13 nt, Mycobacterium tuberculosis H37Rv
gcccggcggccaa

SEQ ID NO: 1281788 - RNA, 21 nt, Mycobacterium tuberculosis H37Rv
gcccggcggccaacgacgacc

SEQ ID NO: 1281789 - RNA, 21 nt, Mycobacterium tuberculosis H37Rv
gcccgaaugcggugaguccgc

SEQ ID NO: 1281790 - RNA, 17 nt, Mycobacterium tuberculosis H37Rv
gcccgaaugcgacgucg

SEQ ID NO: 1281791 - RNA, 17 nt, Mycobacterium tuberculosis H37Rv
gcccgacaccguccagc

SEQ ID NO: 1281792 - RNA, 17 nt, Mycobacterium tuberculosis H37Rv
gcccgacagauggucac

SEQ ID NO: 1281793 - RNA, 17 nt, Mycobacterium tuberculosis H37Rv
gcccgacacgaaaucga

SEQ ID NO: 1281794 - RNA, 19 nt, Mycobacterium tuberculosis H37Rv
gcccgacccaucaccagcg

SEQ ID NO: 1281795 - RNA, 14 nt, Mycobacterium tuberculosis H37Rv
gcccgaccgggaac

SEQ ID NO: 1281796 - RNA, 23 nt, Mycobacterium tuberculosis H37Rv
gcccgaccgggaaccacggucag

SEQ ID NO: 1281797 - RNA, 14 nt, Mycobacterium tuberculosis H37Rv
gcccgacgagucgc

SEQ ID NO: 1281798 - RNA, 20 nt, Mycobacterium tuberculosis H37Rv
gcccgacgaugcgggcgauc

SEQ ID NO: 1281799 - RNA, 21 nt, Mycobacterium tuberculosis H37Rv
gcccgacuggucacugcccug

SEQ ID NO: 1281800 - RNA, 14 nt, Mycobacterium tuberculosis H37Rv
gcccgacuggucac

SEQ ID NO: 1281801 - RNA, 19 nt, Mycobacterium tuberculosis H37Rv
gcccgacugaacgucaccg

SEQ ID NO: 1281802 - RNA, 16 nt, Mycobacterium tuberculosis H37Rv
gcccgacugccguuca

SEQ ID NO: 1281803 - RNA, 18 nt, Mycobacterium tuberculosis H37Rv
gcccgacugccguucagc

SEQ ID NO: 1281804 - RNA, 17 nt, Mycobacterium tuberculosis H37Rv
gcccgacgcguggcauc

SEQ ID NO: 1281805 - RNA, 21 nt, Mycobacterium tuberculosis H37Rv
gcccgacggaguucgacgucg

SEQ ID NO: 1281806 - RNA, 22 nt, Mycobacterium tuberculosis H37Rv
gccccggauagcgucuggcgac

SEQ ID NO: 1281807 - RNA, 22 nt, Mycobacterium tuberculosis H37Rv
gccccggcaagcgcagacacga

SEQ ID NO: 1281808 - RNA, 15 nt, Mycobacterium tuberculosis H37Rv
gccccgcuggucgac

SEQ ID NO: 1281809 - RNA, 16 nt, Mycobacterium tuberculosis H37Rv
gccccgcuggucgacc

SEQ ID NO: 1281810 - RNA, 23 nt, Mycobacterium tuberculosis H37Rv
gccccuucgcagcauguggccgc

SEQ ID NO: 1281811 - RNA, 13 nt, Mycobacterium tuberculosis H37Rv
gccccggccgcug

SEQ ID NO: 1281812 - RNA, 22 nt, Mycobacterium tuberculosis H37Rv
gcccgaacgaggcgcccagcga

SEQ ID NO: 1281813 - RNA, 21 nt, Mycobacterium tuberculosis H37Rv
gcccgaacgaggcgcccagcg

SEQ ID NO: 1281814 - RNA, 16 nt, Mycobacterium tuberculosis H37Rv
gcccgaacucguuggc

SEQ ID NO: 1281815 - RNA, 21 nt, Mycobacterium tuberculosis H37Rv
gcccgaaccaccaccggcaac

SEQ ID NO: 1281816 - RNA, 15 nt, Mycobacterium tuberculosis H37Rv
gcccgaaccaccgcg

SEQ ID NO: 1281817 - RNA, 14 nt, Mycobacterium tuberculosis H37Rv
gcccgagcccagcg

SEQ ID NO: 1281818 - RNA, 19 nt, Mycobacterium tuberculosis H37Rv
gcccgagcccagccgggca

SEQ ID NO: 1281819 - RNA, 19 nt, Mycobacterium tuberculosis H37Rv
gcccgagacgguguugccu

SEQ ID NO: 1281820 - RNA, 14 nt, Mycobacterium tuberculosis H37Rv
gcccgagcaggacg

SEQ ID NO: 1281821 - RNA, 19 nt, Mycobacterium tuberculosis H37Rv
gcccgcacgaaccggucga

SEQ ID NO: 1281822 - RNA, 18 nt, Mycobacterium tuberculosis H37Rv
gcccgcaccguggacacc

SEQ ID NO: 1281823 - RNA, 15 nt, Mycobacterium tuberculosis H37Rv
gcccgaggcgagacg

SEQ ID NO: 1281824 - RNA, 18 nt, Mycobacterium tuberculosis H37Rv
gcccgcacccccgacacc

SEQ ID NO: 1281825 - RNA, 19 nt, Mycobacterium tuberculosis H37Rv
gcccgcacccccgacaccg

SEQ ID NO: 1281826 - RNA, 13 nt, Mycobacterium tuberculosis H37Rv
gcccgcaccagcu

SEQ ID NO: 1281827 - RNA, 18 nt, Mycobacterium tuberculosis H37Rv
gcccgccagcagggccag

SEQ ID NO: 1281828 - RNA, 18 nt, Mycobacterium tuberculosis H37Rv
gcccgccagcccagcacg

SEQ ID NO: 1281829 - RNA, 20 nt, Mycobacterium tuberculosis H37Rv
gcccgccaccggguucaccg

SEQ ID NO: 1281830 - RNA, 14 nt, Mycobacterium tuberculosis H37Rv
gcccgccaccggcg

SEQ ID NO: 1281831 - RNA, 13 nt, Mycobacterium tuberculosis H37Rv
gcccgcacuugcc

SEQ ID NO: 1281832 - RNA, 19 nt, Mycobacterium tuberculosis H37Rv
gcccgcagccaaguccgcc

SEQ ID NO: 1281833 - RNA, 15 nt, Mycobacterium tuberculosis H37Rv
gcccgcccgcacgac

SEQ ID NO: 1281834 - RNA, 14 nt, Mycobacterium tuberculosis H37Rv
gcccgccgaucggg

SEQ ID NO: 1281835 - RNA, 21 nt, Mycobacterium tuberculosis H37Rv
gcccgccgaucgggcuucggc

SEQ ID NO: 1281836 - RNA, 14 nt, Mycobacterium tuberculosis H37Rv
gcccgccgacgauc

SEQ ID NO: 1281837 - RNA, 15 nt, Mycobacterium tuberculosis H37Rv
gcccgccgacgccag

SEQ ID NO: 1281838 - RNA, 22 nt, Mycobacterium tuberculosis H37Rv
gcccgcccuggcaacgacacgc

SEQ ID NO: 1281839 - RNA, 16 nt, Mycobacterium tuberculosis H37Rv
gcccgcccugaccgcc

SEQ ID NO: 1281840 - RNA, 18 nt, Mycobacterium tuberculosis H37Rv
gcccgcccuggcaacgac

SEQ ID NO: 1281841 - RNA, 14 nt, Mycobacterium tuberculosis H37Rv
gcccgccgaacgug

SEQ ID NO: 1281842 - RNA, 15 nt, Mycobacterium tuberculosis H37Rv
gcccgccucgaccgc

SEQ ID NO: 1281843 - RNA, 20 nt, Mycobacterium tuberculosis H37Rv
gcccgccucgaccgccagcc

SEQ ID NO: 1281844 - RNA, 17 nt, Mycobacterium tuberculosis H37Rv
gcccgccucgcagcgac

SEQ ID NO: 1281845 - RNA, 14 nt, Mycobacterium tuberculosis H37Rv
gcccgccguccggc

SEQ ID NO: 1281846 - RNA, 16 nt, Mycobacterium tuberculosis H37Rv
gcccgccggacccgcc

SEQ ID NO: 1281847 - RNA, 23 nt, Mycobacterium tuberculosis H37Rv
gccccgccgagcggugccggcgu

SEQ ID NO: 1281848 - RNA, 20 nt, Mycobacterium tuberculosis H37Rv
aagagcacgucaacagccag

SEQ ID NO: 1281849 - RNA, 15 nt, Mycobacterium tuberculosis H37Rv
gccccgccgagcacc

SEQ ID NO: 1281850 - RNA, 13 nt, Mycobacterium tuberculosis H37Rv
gccccgccagcgg

SEQ ID NO: 1281851 - RNA, 22 nt, Mycobacterium tuberculosis H37Rv
gccccgcagcugcgucccggaa

SEQ ID NO: 1281852 - RNA, 12 nt, Mycobacterium tuberculosis H37Rv
gccccgcagcac

SEQ ID NO: 1281853 - RNA, 13 nt, Mycobacterium tuberculosis H37Rv
gccccgccagcgc

SEQ ID NO: 1281854 - RNA, 16 nt, Mycobacterium tuberculosis H37Rv
gccccgaucggugacg

SEQ ID NO: 1281855 - RNA, 17 nt, Mycobacterium tuberculosis H37Rv
gccccgaucaucgacga

SEQ ID NO: 1281856 - RNA, 17 nt, Mycobacterium tuberculosis H37Rv
gcccccgccacgccgaa

SEQ ID NO: 1281857 - RNA, 22 nt, Mycobacterium tuberculosis H37Rv
gccccgaccagcagaccaagcc

SEQ ID NO: 1281858 - RNA, 13 nt, Mycobacterium tuberculosis H37Rv
aagacggccaccg

SEQ ID NO: 1281859 - RNA, 19 nt, Mycobacterium tuberculosis H37Rv
aagacggauuguccgggac

SEQ ID NO: 1281860 - RNA, 18 nt, Mycobacterium tuberculosis H37Rv
gcccccagcagcugcgau

SEQ ID NO: 1281861 - RNA, 17 nt, Mycobacterium tuberculosis H37Rv
gccccaugcgccagcga

SEQ ID NO: 1281862 - RNA, 21 nt, Mycobacterium tuberculosis H37Rv
gccccaugaucuggugcgcgg

SEQ ID NO: 1281863 - RNA, 17 nt, Mycobacterium tuberculosis H37Rv
gccccaguucgacggcg

SEQ ID NO: 1281864 - RNA, 23 nt, Mycobacterium tuberculosis H37Rv
gccccaguucgacggcgucaaag

SEQ ID NO: 1281865 - RNA, 19 nt, Mycobacterium tuberculosis H37Rv
gcccauuggguaaccagcg

SEQ ID NO: 1281866 - RNA, 16 nt, Mycobacterium tuberculosis H37Rv
gcccauuucgagcucg

SEQ ID NO: 1281867 - RNA, 15 nt, Mycobacterium tuberculosis H37Rv
gcccauuucggcacg

SEQ ID NO: 1281868 - RNA, 15 nt, Mycobacterium tuberculosis H37Rv
gcccauggcgucgaa

SEQ ID NO: 1281869 - RNA, 16 nt, Mycobacterium tuberculosis H37Rv
gcccauggcagcccgu

SEQ ID NO: 1281870 - RNA, 15 nt, Mycobacterium tuberculosis H37Rv
gcccaugcgccacgc

SEQ ID NO: 1281871 - RNA, 17 nt, Mycobacterium tuberculosis H37Rv
gcccaugucgagcacgc

SEQ ID NO: 1281872 - RNA, 18 nt, Mycobacterium tuberculosis H37Rv
gcccaugucgagcacgcc

SEQ ID NO: 1281873 - RNA, 16 nt, Mycobacterium tuberculosis H37Rv
gccaugguggcgccga

SEQ ID NO: 1281874 - RNA, 16 nt, Mycobacterium tuberculosis H37Rv
gccauguccaccagcg

SEQ ID NO: 1281875 - RNA, 15 nt, Mycobacterium tuberculosis H37Rv
gcccaggccgaucag

SEQ ID NO: 1281876 - RNA, 19 nt, Mycobacterium tuberculosis H37Rv
gcccaggcguccaucagag

SEQ ID NO: 1281877 - RNA, 14 nt, Mycobacterium tuberculosis H37Rv
gcccauggacccau

SEQ ID NO: 1281878 - RNA, 19 nt, Mycobacterium tuberculosis H37Rv
gcccaugaugcucgaugau

SEQ ID NO: 1281879 - RNA, 15 nt, Mycobacterium tuberculosis H37Rv
gcccaguagaucgcg

SEQ ID NO: 1281880 - RNA, 15 nt, Mycobacterium tuberculosis H37Rv
gcccagguugccaac

SEQ ID NO: 1281881 - RNA, 15 nt, Mycobacterium tuberculosis H37Rv
gcccaggugggccga

SEQ ID NO: 1281882 - RNA, 17 nt, Mycobacterium tuberculosis H37Rv
gcccaggugcguccagg

SEQ ID NO: 1281883 - RNA, 18 nt, Mycobacterium tuberculosis H37Rv
gcccaggucaacgacguu

SEQ ID NO: 1281884 - RNA, 21 nt, Mycobacterium tuberculosis H37Rv
gcccaggguguccgucgaacc

SEQ ID NO: 1281885 - RNA, 17 nt, Mycobacterium tuberculosis H37Rv
gcccagggcgaucugcg

SEQ ID NO: 1281886 - RNA, 19 nt, Mycobacterium tuberculosis H37Rv
gagaugucggugaucacgg

SEQ ID NO: 1281887 - RNA, 16 nt, Mycobacterium tuberculosis H37Rv
gagauuggguccagcg

SEQ ID NO: 1281888 - RNA, 15 nt, Mycobacterium tuberculosis H37Rv
gagcaaaauggccac

SEQ ID NO: 1281889 - RNA, 15 nt, Mycobacterium tuberculosis H37Rv
gagcaacacgagcgc

SEQ ID NO: 1281890 - RNA, 13 nt, Mycobacterium tuberculosis H37Rv
gagaucgucgcga

SEQ ID NO: 1281891 - RNA, 13 nt, Mycobacterium tuberculosis H37Rv
gagcacacguccg

SEQ ID NO: 1281892 - RNA, 13 nt, Mycobacterium tuberculosis H37Rv
gagcacacgucgg

SEQ ID NO: 1281893 - RNA, 14 nt, Mycobacterium tuberculosis H37Rv
gagcaagaucaccu

SEQ ID NO: 1281894 - RNA, 21 nt, Mycobacterium tuberculosis H37Rv
gagcaacugcucgacgaggcc

SEQ ID NO: 1281895 - RNA, 24 nt, Mycobacterium tuberculosis H37Rv
gagcaacgcgaccaucucgacguc

SEQ ID NO: 1281896 - RNA, 17 nt, Mycobacterium tuberculosis H37Rv
gagcaacgccacgccga

SEQ ID NO: 1281897 - RNA, 14 nt, Mycobacterium tuberculosis H37Rv
gagcaccacgugcg

SEQ ID NO: 1281898 - RNA, 14 nt, Mycobacterium tuberculosis H37Rv
gagcaccccgacgu

SEQ ID NO: 1281899 - RNA, 22 nt, Mycobacterium tuberculosis H37Rv
gagcagaaacaacgucgccgcg

SEQ ID NO: 1281900 - RNA, 16 nt, Mycobacterium tuberculosis H37Rv
gagcagacccaguccg

SEQ ID NO: 1281901 - RNA, 18 nt, Mycobacterium tuberculosis H37Rv
gagcagacacagaaucgc

SEQ ID NO: 1281902 - RNA, 20 nt, Mycobacterium tuberculosis H37Rv
gagcagaucuuccgagcacu

SEQ ID NO: 1281903 - RNA, 16 nt, Mycobacterium tuberculosis H37Rv
gagcagacugcccucg

SEQ ID NO: 1281904 - RNA, 18 nt, Mycobacterium tuberculosis H37Rv
gagcagacgcagaaucgc

SEQ ID NO: 1281905 - RNA, 24 nt, Mycobacterium tuberculosis H37Rv
gagcaccucggccucgucgugcac

SEQ ID NO: 1281906 - RNA, 18 nt, Mycobacterium tuberculosis H37Rv
gagcaccucuaccguggc

SEQ ID NO: 1281907 - RNA, 14 nt, Mycobacterium tuberculosis H37Rv
gagcaccgacaccg

SEQ ID NO: 1281908 - RNA, 21 nt, Mycobacterium tuberculosis H37Rv
gagcacggugagccgguggcc

SEQ ID NO: 1281909 - RNA, 18 nt, Mycobacterium tuberculosis H37Rv
gagcacguccucgacccg

SEQ ID NO: 1281910 - RNA, 17 nt, Mycobacterium tuberculosis H37Rv
gagcaccugaccguuga

SEQ ID NO: 1281911 - RNA, 21 nt, Mycobacterium tuberculosis H37Rv
gagaucagcaccgugacagcg

SEQ ID NO: 1281912 - RNA, 22 nt, Mycobacterium tuberculosis H37Rv
gagaucagcaccgugacagcgg

SEQ ID NO: 1281913 - RNA, 11 nt, Mycobacterium tuberculosis H37Rv
gagaucagcgg

SEQ ID NO: 1281914 - RNA, 17 nt, Mycobacterium tuberculosis H37Rv
gagauacggccaccagg

SEQ ID NO: 1281915 - RNA, 14 nt, Mycobacterium tuberculosis H37Rv
gagauacgggccac

SEQ ID NO: 1281916 - RNA, 20 nt, Mycobacterium tuberculosis H37Rv
gagauaccgaccaucgggac

SEQ ID NO: 1281917 - RNA, 22 nt, Mycobacterium tuberculosis H37Rv
gagauaccgacgcgcucggcga

SEQ ID NO: 1281918 - RNA, 17 nt, Mycobacterium tuberculosis H37Rv
gagauccacgccagagc

SEQ ID NO: 1281919 - RNA, 11 nt, Mycobacterium tuberculosis H37Rv
gagaucgcccg

SEQ ID NO: 1281920 - RNA, 17 nt, Mycobacterium tuberculosis H37Rv
gagaucgcccgaguuga

SEQ ID NO: 1281921 - RNA, 14 nt, Mycobacterium tuberculosis H37Rv
gagaguucgcaugc

SEQ ID NO: 1281922 - RNA, 16 nt, Mycobacterium tuberculosis H37Rv
gagagccccgaccagc

SEQ ID NO: 1281923 - RNA, 17 nt, Mycobacterium tuberculosis H37Rv
gagagccccgaccagca

SEQ ID NO: 1281924 - RNA, 18 nt, Mycobacterium tuberculosis H37Rv
gagacuucgacgcggcga

SEQ ID NO: 1281925 - RNA, 22 nt, Mycobacterium tuberculosis H37Rv
gagacgcuuuccgccgcaccgg

SEQ ID NO: 1281926 - RNA, 13 nt, Mycobacterium tuberculosis H37Rv
gagacgucgccgc

SEQ ID NO: 1281927 - RNA, 15 nt, Mycobacterium tuberculosis H37Rv
gagacugccgccgcu

SEQ ID NO: 1281928 - RNA, 21 nt, Mycobacterium tuberculosis H37Rv
gagacgaucaucucgucgucg

SEQ ID NO: 1281929 - RNA, 14 nt, Mycobacterium tuberculosis H37Rv
gagacgaugccgua

SEQ ID NO: 1281930 - RNA, 19 nt, Mycobacterium tuberculosis H37Rv
gagacgaucaucucgucgu

SEQ ID NO: 1281931 - RNA, 19 nt, Mycobacterium tuberculosis H37Rv
gagacaugucgcugccgcc

SEQ ID NO: 1281932 - RNA, 23 nt, Mycobacterium tuberculosis H37Rv
gagaccagguucucggucgguac

SEQ ID NO: 1281933 - RNA, 16 nt, Mycobacterium tuberculosis H37Rv
gagacaaaggugccga

SEQ ID NO: 1281934 - RNA, 23 nt, Mycobacterium tuberculosis H37Rv
gagacacccgccaggccgcgcga

SEQ ID NO: 1281935 - RNA, 15 nt, Mycobacterium tuberculosis H37Rv
gagaagucucgcggc

SEQ ID NO: 1281936 - RNA, 18 nt, Mycobacterium tuberculosis H37Rv
gagaaggugcugcgcggg

SEQ ID NO: 1281937 - RNA, 17 nt, Mycobacterium tuberculosis H37Rv
gagaagcgucacagucc

SEQ ID NO: 1281938 - RNA, 20 nt, Mycobacterium tuberculosis H37Rv
gagccgccaggugcucgucg

SEQ ID NO: 1281939 - RNA, 17 nt, Mycobacterium tuberculosis H37Rv
gagccgguagaucagcg

SEQ ID NO: 1281940 - RNA, 13 nt, Mycobacterium tuberculosis H37Rv
gagcgaacggcgc

SEQ ID NO: 1281941 - RNA, 13 nt, Mycobacterium tuberculosis H37Rv
gagccggugccga

SEQ ID NO: 1281942 - RNA, 15 nt, Mycobacterium tuberculosis H37Rv
gagccggugggugac

SEQ ID NO: 1281943 - RNA, 19 nt, Mycobacterium tuberculosis H37Rv
gagcgaccgcgagggccag

SEQ ID NO: 1281944 - RNA, 19 nt, Mycobacterium tuberculosis H37Rv
gagcgaccccacacgccga

SEQ ID NO: 1281945 - RNA, 16 nt, Mycobacterium tuberculosis H37Rv
gagcgauacgucguca

SEQ ID NO: 1281946 - RNA, 19 nt, Mycobacterium tuberculosis H37Rv
gagcgauacgucgucagcc

SEQ ID NO: 1281947 - RNA, 20 nt, Mycobacterium tuberculosis H37Rv
gagcgauacgucgucagcca

SEQ ID NO: 1281948 - RNA, 16 nt, Mycobacterium tuberculosis H37Rv
gagcgagaaucacggu

SEQ ID NO: 1281949 - RNA, 19 nt, Mycobacterium tuberculosis H37Rv
gagcgacugcagcggcgca

SEQ ID NO: 1281950 - RNA, 19 nt, Mycobacterium tuberculosis H37Rv
gagcgacccccagcgcccg

SEQ ID NO: 1281951 - RNA, 15 nt, Mycobacterium tuberculosis H37Rv
gagcgccgcggcgac

SEQ ID NO: 1281952 - RNA, 14 nt, Mycobacterium tuberculosis H37Rv
gagcccgccgcgac

SEQ ID NO: 1281953 - RNA, 17 nt, Mycobacterium tuberculosis H37Rv
gagcccgccgcgaccac

SEQ ID NO: 1281954 - RNA, 14 nt, Mycobacterium tuberculosis H37Rv
gagccccgaccagc

SEQ ID NO: 1281955 - RNA, 16 nt, Mycobacterium tuberculosis H37Rv
gagccaucgucgagcg

SEQ ID NO: 1281956 - RNA, 13 nt, Mycobacterium tuberculosis H37Rv
gagcccagcgccu

SEQ ID NO: 1281957 - RNA, 16 nt, Mycobacterium tuberculosis H37Rv
gagccacggcuucgcc

SEQ ID NO: 1281958 - RNA, 19 nt, Mycobacterium tuberculosis H37Rv
gagccgacaacgacgucgc

SEQ ID NO: 1281959 - RNA, 16 nt, Mycobacterium tuberculosis H37Rv
gagccgacaacgacgu

SEQ ID NO: 1281960 - RNA, 20 nt, Mycobacterium tuberculosis H37Rv
gagcccucguuaucgaccgc

SEQ ID NO: 1281961 - RNA, 14 nt, Mycobacterium tuberculosis H37Rv
gagcccguccaggc

SEQ ID NO: 1281962 - RNA, 21 nt, Mycobacterium tuberculosis H37Rv
gagcccgucagcuccccgucg

SEQ ID NO: 1281963 - RNA, 13 nt, Mycobacterium tuberculosis H37Rv
gagcccgucagcu

SEQ ID NO: 1281964 - RNA, 15 nt, Mycobacterium tuberculosis H37Rv
gagcccggucgcucg

SEQ ID NO: 1281965 - RNA, 19 nt, Mycobacterium tuberculosis H37Rv
gagcccggugcuaccggcu

SEQ ID NO: 1281966 - RNA, 16 nt, Mycobacterium tuberculosis H37Rv
gagcccgcgaucacca

SEQ ID NO: 1281967 - RNA, 22 nt, Mycobacterium tuberculosis H37Rv
gagcccggcggcccgauagauc

SEQ ID NO: 1281968 - RNA, 14 nt, Mycobacterium tuberculosis H37Rv
gagccgaucacgcu

SEQ ID NO: 1281969 - RNA, 16 nt, Mycobacterium tuberculosis H37Rv
gagccgagccucgcuc

SEQ ID NO: 1281970 - RNA, 14 nt, Mycobacterium tuberculosis H37Rv
gagccgaucgcccg

SEQ ID NO: 1281971 - RNA, 18 nt, Mycobacterium tuberculosis H37Rv
gagccgagccagcuccgg

SEQ ID NO: 1281972 - RNA, 19 nt, Mycobacterium tuberculosis H37Rv
gagccgcagcaccucgucg

SEQ ID NO: 1281973 - RNA, 16 nt, Mycobacterium tuberculosis H37Rv
gagcaucucgucgucg

SEQ ID NO: 1281974 - RNA, 16 nt, Mycobacterium tuberculosis H37Rv
aacucgacgugaagau

SEQ ID NO: 1281975 - RNA, 17 nt, Mycobacterium tuberculosis H37Rv
aacuccgcguugggcac

SEQ ID NO: 1281976 - RNA, 15 nt, Mycobacterium tuberculosis H37Rv
gagccaacgcgcaga

SEQ ID NO: 1281977 - RNA, 15 nt, Mycobacterium tuberculosis H37Rv
gagccaacgcgcgac

SEQ ID NO: 1281978 - RNA, 15 nt, Mycobacterium tuberculosis H37Rv
gagccacgacccagc

SEQ ID NO: 1281979 - RNA, 14 nt, Mycobacterium tuberculosis H37Rv
gagcaugcccagcg

SEQ ID NO: 1281980 - RNA, 17 nt, Mycobacterium tuberculosis H37Rv
gagcaugcuggaccucg

SEQ ID NO: 1281981 - RNA, 18 nt, Mycobacterium tuberculosis H37Rv
gagcagcucacuggugac

SEQ ID NO: 1281982 - RNA, 23 nt, Mycobacterium tuberculosis H37Rv
gagcagccgaaccggcaccagcg

SEQ ID NO: 1281983 - RNA, 20 nt, Mycobacterium tuberculosis H37Rv
gagcagcucggugacaagcg

SEQ ID NO: 1281984 - RNA, 18 nt, Mycobacterium tuberculosis H37Rv
gagcagccgaaccggcac

SEQ ID NO: 1281985 - RNA, 20 nt, Mycobacterium tuberculosis H37Rv
gagcagcgccacccgcguca

SEQ ID NO: 1281986 - RNA, 19 nt, Mycobacterium tuberculosis H37Rv
gagcagcaccacccgcacc

SEQ ID NO: 1281987 - RNA, 20 nt, Mycobacterium tuberculosis H37Rv
gagcagcagaaacggcgacu

SEQ ID NO: 1281988 - RNA, 22 nt, Mycobacterium tuberculosis H37Rv
gagcagcagguacaucaccacg

SEQ ID NO: 1281989 - RNA, 14 nt, Mycobacterium tuberculosis H37Rv
gagcauaccgccgc

SEQ ID NO: 1281990 - RNA, 22 nt, Mycobacterium tuberculosis H37Rv
gagcaguuccagcucgcggugg

SEQ ID NO: 1281991 - RNA, 17 nt, Mycobacterium tuberculosis H37Rv
gagcagggccggcaccg

SEQ ID NO: 1281992 - RNA, 18 nt, Mycobacterium tuberculosis H37Rv
gagcagggcgucgaccgc

SEQ ID NO: 1281993 - RNA, 21 nt, Mycobacterium tuberculosis H37Rv
gacguaguugccggcuucggc

SEQ ID NO: 1281994 - RNA, 15 nt, Mycobacterium tuberculosis H37Rv
gacgucaccguucuu

SEQ ID NO: 1281995 - RNA, 15 nt, Mycobacterium tuberculosis H37Rv
gacguaccacggcga

SEQ ID NO: 1281996 - RNA, 18 nt, Mycobacterium tuberculosis H37Rv
gacguagggcagcgccag

SEQ ID NO: 1281997 - RNA, 14 nt, Mycobacterium tuberculosis H37Rv
gacguccucgacga

SEQ ID NO: 1281998 - RNA, 19 nt, Mycobacterium tuberculosis H37Rv
gacguccgcggucgcagca

SEQ ID NO: 1281999 - RNA, 20 nt, Mycobacterium tuberculosis H37Rv
gacguccagggccacgaucu

SEQ ID NO: 1282000 - RNA, 22 nt, Mycobacterium tuberculosis H37Rv
gacgaccgucacaagucgacac

SEQ ID NO: 1282001 - RNA, 17 nt, Mycobacterium tuberculosis H37Rv
gacguagacgacgucgg

SEQ ID NO: 1282002 - RNA, 18 nt, Mycobacterium tuberculosis H37Rv
gacguagaaugcgccguc

SEQ ID NO: 1282003 - RNA, 20 nt, Mycobacterium tuberculosis H37Rv
gacgaccggcuaccggcgug

SEQ ID NO: 1282004 - RNA, 20 nt, Mycobacterium tuberculosis H37Rv
gacgaccccggugagcucuu

SEQ ID NO: 1282005 - RNA, 22 nt, Mycobacterium tuberculosis H37Rv
gacgaccauacuaauggcgcca

SEQ ID NO: 1282006 - RNA, 13 nt, Mycobacterium tuberculosis H37Rv
gacgacaccgcga

SEQ ID NO: 1282007 - RNA, 22 nt, Mycobacterium tuberculosis H37Rv
gacgaccagcagauccaggcgu

SEQ ID NO: 1282008 - RNA, 20 nt, Mycobacterium tuberculosis H37Rv
gacgaccacaccacgauggc

SEQ ID NO: 1282009 - RNA, 21 nt, Mycobacterium tuberculosis H37Rv
gacgucggugaccucggcgac

SEQ ID NO: 1282010 - RNA, 23 nt, Mycobacterium tuberculosis H37Rv
gacgucgguaagcgccaaggcga

SEQ ID NO: 1282011 - RNA, 17 nt, Mycobacterium tuberculosis H37Rv
gacgucggcguggucgc

SEQ ID NO: 1282012 - RNA, 23 nt, Mycobacterium tuberculosis H37Rv
gacgucguagacaccuucgacgu

SEQ ID NO: 1282013 - RNA, 17 nt, Mycobacterium tuberculosis H37Rv
gacgucgucgucgacgg

SEQ ID NO: 1282014 - RNA, 22 nt, Mycobacterium tuberculosis H37Rv
gacgucguucuuugucgggauc

SEQ ID NO: 1282015 - RNA, 22 nt, Mycobacterium tuberculosis H37Rv
gacgucguuggaaaucccuggc

SEQ ID NO: 1282016 - RNA, 16 nt, Mycobacterium tuberculosis H37Rv
gacgucuccaccgcga

SEQ ID NO: 1282017 - RNA, 23 nt, Mycobacterium tuberculosis H37Rv
gacgucuucgggcucguccagca

SEQ ID NO: 1282018 - RNA, 20 nt, Mycobacterium tuberculosis H37Rv
gacgucucgcaugcucacga

SEQ ID NO: 1282019 - RNA, 16 nt, Mycobacterium tuberculosis H37Rv
gacgucggcgaccagg

SEQ ID NO: 1282020 - RNA, 18 nt, Mycobacterium tuberculosis H37Rv
gacgucgcaauaugccac

SEQ ID NO: 1282021 - RNA, 16 nt, Mycobacterium tuberculosis H37Rv
gacguccucgacgauc

SEQ ID NO: 1282022 - RNA, 20 nt, Mycobacterium tuberculosis H37Rv
gacgucgaacuucagcggcg

SEQ ID NO: 1282023 - RNA, 18 nt, Mycobacterium tuberculosis H37Rv
gacgugguugccccgcag

SEQ ID NO: 1282024 - RNA, 19 nt, Mycobacterium tuberculosis H37Rv
gacguuaucgguucgcucg

SEQ ID NO: 1282025 - RNA, 16 nt, Mycobacterium tuberculosis H37Rv
gacguuaucgguucgc

SEQ ID NO: 1282026 - RNA, 20 nt, Mycobacterium tuberculosis H37Rv
gacguuggcgugcaccgcau

SEQ ID NO: 1282027 - RNA, 23 nt, Mycobacterium tuberculosis H37Rv
gacguugcgaggccgcacgucga

SEQ ID NO: 1282028 - RNA, 17 nt, Mycobacterium tuberculosis H37Rv
gacguugccgggcuugu

SEQ ID NO: 1282029 - RNA, 15 nt, Mycobacterium tuberculosis H37Rv
gacguugaagccgcc

SEQ ID NO: 1282030 - RNA, 14 nt, Mycobacterium tuberculosis H37Rv
gacgugcgcggcau

SEQ ID NO: 1282031 - RNA, 14 nt, Mycobacterium tuberculosis H37Rv
gacgugcaaccucg

SEQ ID NO: 1282032 - RNA, 17 nt, Mycobacterium tuberculosis H37Rv
gacgugcaaccucggcu

SEQ ID NO: 1282033 - RNA, 17 nt, Mycobacterium tuberculosis H37Rv
gacguggcugcguucgc

SEQ ID NO: 1282034 - RNA, 13 nt, Mycobacterium tuberculosis H37Rv
gacguggccgacg

SEQ ID NO: 1282035 - RNA, 22 nt, Mycobacterium tuberculosis H37Rv
gacgugguguaucgacggcggc

SEQ ID NO: 1282036 - RNA, 19 nt, Mycobacterium tuberculosis H37Rv
gacuacccagccagccgcg

SEQ ID NO: 1282037 - RNA, 18 nt, Mycobacterium tuberculosis H37Rv
gacuaucggccgccggau

SEQ ID NO: 1282038 - RNA, 20 nt, Mycobacterium tuberculosis H37Rv
gacguuucccaggcccgaca

SEQ ID NO: 1282039 - RNA, 17 nt, Mycobacterium tuberculosis H37Rv
gacucaucccgagauca

SEQ ID NO: 1282040 - RNA, 23 nt, Mycobacterium tuberculosis H37Rv
gacucacgaggcacaaucaccgc

SEQ ID NO: 1282041 - RNA, 16 nt, Mycobacterium tuberculosis H37Rv
gacuccagcaccagca

SEQ ID NO: 1282042 - RNA, 21 nt, Mycobacterium tuberculosis H37Rv
gacucaucggccgcggucggc

SEQ ID NO: 1282043 - RNA, 13 nt, Mycobacterium tuberculosis H37Rv
gacucaucggccg

SEQ ID NO: 1282044 - RNA, 19 nt, Mycobacterium tuberculosis H37Rv
gacuccagcaccagcacgg

SEQ ID NO: 1282045 - RNA, 16 nt, Mycobacterium tuberculosis H37Rv
gacuccgcgcgcggac

SEQ ID NO: 1282046 - RNA, 21 nt, Mycobacterium tuberculosis H37Rv
gacucccucgaucacggcggc

SEQ ID NO: 1282047 - RNA, 20 nt, Mycobacterium tuberculosis H37Rv
gacucccucgaucacggcgg

SEQ ID NO: 1282048 - RNA, 22 nt, Mycobacterium tuberculosis H37Rv
gacuccggccggccuagccgau

SEQ ID NO: 1282049 - RNA, 20 nt, Mycobacterium tuberculosis H37Rv
gacuccggccgcacgccgac

SEQ ID NO: 1282050 - RNA, 14 nt, Mycobacterium tuberculosis H37Rv
gacuccgcgcgcug

SEQ ID NO: 1282051 - RNA, 22 nt, Mycobacterium tuberculosis H37Rv
gacuccggcuggaagcggcgac

SEQ ID NO: 1282052 - RNA, 20 nt, Mycobacterium tuberculosis H37Rv
gacugcagaaacagccgcag

SEQ ID NO: 1282053 - RNA, 16 nt, Mycobacterium tuberculosis H37Rv
gacucugccgauguca

SEQ ID NO: 1282054 - RNA, 18 nt, Mycobacterium tuberculosis H37Rv
gacucugcgucugcucac

SEQ ID NO: 1282055 - RNA, 17 nt, Mycobacterium tuberculosis H37Rv
gacucugguccggucuu

SEQ ID NO: 1282056 - RNA, 19 nt, Mycobacterium tuberculosis H37Rv
gacucggcggaagaccgga

SEQ ID NO: 1282057 - RNA, 14 nt, Mycobacterium tuberculosis H37Rv
gacucgagagcgau

SEQ ID NO: 1282058 - RNA, 17 nt, Mycobacterium tuberculosis H37Rv
gacuccugcggcaccgc

SEQ ID NO: 1282059 - RNA, 20 nt, Mycobacterium tuberculosis H37Rv
gacucgaccgcgacggcaaa

SEQ ID NO: 1282060 - RNA, 13 nt, Mycobacterium tuberculosis H37Rv
gacuccugcggca

SEQ ID NO: 1282061 - RNA, 22 nt, Mycobacterium tuberculosis H37Rv
aacgugguauugacguggccgu

SEQ ID NO: 1282062 - RNA, 12 nt, Mycobacterium tuberculosis H37Rv
gacugguggucg

SEQ ID NO: 1282063 - RNA, 18 nt, Mycobacterium tuberculosis H37Rv
gacuguacaccgacacgc

SEQ ID NO: 1282064 - RNA, 15 nt, Mycobacterium tuberculosis H37Rv
gacuggcaccgccag

SEQ ID NO: 1282065 - RNA, 17 nt, Mycobacterium tuberculosis H37Rv
gacugggcaaacccgga

SEQ ID NO: 1282066 - RNA, 18 nt, Mycobacterium tuberculosis H37Rv
gacugcgaaaauccgugc

SEQ ID NO: 1282067 - RNA, 22 nt, Mycobacterium tuberculosis H37Rv
gacugcgaaaauccgugccgaa

SEQ ID NO: 1282068 - RNA, 16 nt, Mycobacterium tuberculosis H37Rv
gacugcgucggcggcu

SEQ ID NO: 1282069 - RNA, 15 nt, Mycobacterium tuberculosis H37Rv
gacugcccgauggcu

SEQ ID NO: 1282070 - RNA, 17 nt, Mycobacterium tuberculosis H37Rv
gacuugcacgucggcug

SEQ ID NO: 1282071 - RNA, 17 nt, Mycobacterium tuberculosis H37Rv
gacuugcgacccgucga

SEQ ID NO: 1282072 - RNA, 16 nt, Mycobacterium tuberculosis H37Rv
gacuuggcaucgcgag

SEQ ID NO: 1282073 - RNA, 15 nt, Mycobacterium tuberculosis H37Rv
gacuuggcaucgcga

SEQ ID NO: 1282074 - RNA, 21 nt, Mycobacterium tuberculosis H37Rv
gacuugcugcuccuucucgcg

SEQ ID NO: 1282075 - RNA, 20 nt, Mycobacterium tuberculosis H37Rv
gacuuggccagcagccgcga

SEQ ID NO: 1282076 - RNA, 13 nt, Mycobacterium tuberculosis H37Rv
gacuucagcggcc

SEQ ID NO: 1282077 - RNA, 18 nt, Mycobacterium tuberculosis H37Rv
gacuucagcaggcccagc

SEQ ID NO: 1282078 - RNA, 21 nt, Mycobacterium tuberculosis H37Rv
gacuucccgcgcgagccgcuc

SEQ ID NO: 1282079 - RNA, 22 nt, Mycobacterium tuberculosis H37Rv
gacuucgucaaccaccaggagc

SEQ ID NO: 1282080 - RNA, 19 nt, Mycobacterium tuberculosis H37Rv
gacuucgguguagcccagc

SEQ ID NO: 1282081 - RNA, 19 nt, Mycobacterium tuberculosis H37Rv
gacuucgcugcggugggcc

SEQ ID NO: 1282082 - RNA, 19 nt, Mycobacterium tuberculosis H37Rv
gagaacuccgggaccaggc

SEQ ID NO: 1282083 - RNA, 17 nt, Mycobacterium tuberculosis H37Rv
gagaacguaggguggcc

SEQ ID NO: 1282084 - RNA, 22 nt, Mycobacterium tuberculosis H37Rv
gacugugaaucugacgacgcga

SEQ ID NO: 1282085 - RNA, 20 nt, Mycobacterium tuberculosis H37Rv
gacugugaaucucacgacgc

SEQ ID NO: 1282086 - RNA, 21 nt, Mycobacterium tuberculosis H37Rv
aacuacucccccgcgaaguug

SEQ ID NO: 1282087 - RNA, 21 nt, Mycobacterium tuberculosis H37Rv
aacuacucauccagaagccgg

SEQ ID NO: 1282088 - RNA, 18 nt, Mycobacterium tuberculosis H37Rv
aacuacggcguccccgac

SEQ ID NO: 1282089 - RNA, 16 nt, Mycobacterium tuberculosis H37Rv
gagcgcgcucagguca

SEQ ID NO: 1282090 - RNA, 22 nt, Mycobacterium tuberculosis H37Rv
gagcgcgccgcgcucgccgaua

SEQ ID NO: 1282091 - RNA, 22 nt, Mycobacterium tuberculosis H37Rv
gagcgcgcgcaacccugccgcg

SEQ ID NO: 1282092 - RNA, 16 nt, Mycobacterium tuberculosis H37Rv
gaggcaagcaaccggu

SEQ ID NO: 1282093 - RNA, 20 nt, Mycobacterium tuberculosis H37Rv
gaggaugucgagcccgucga

SEQ ID NO: 1282094 - RNA, 15 nt, Mycobacterium tuberculosis H37Rv
gaggcaccgacaucg

SEQ ID NO: 1282095 - RNA, 19 nt, Mycobacterium tuberculosis H37Rv
gaggcacccgugccgccga

SEQ ID NO: 1282096 - RNA, 20 nt, Mycobacterium tuberculosis H37Rv
gaggaccaccuggucgcguc

SEQ ID NO: 1282097 - RNA, 17 nt, Mycobacterium tuberculosis H37Rv
gaggccgccaucgccgc

SEQ ID NO: 1282098 - RNA, 13 nt, Mycobacterium tuberculosis H37Rv
gaggcgaucaccg

SEQ ID NO: 1282099 - RNA, 21 nt, Mycobacterium tuberculosis H37Rv
gaggcgcaagaaugccgccga

SEQ ID NO: 1282100 - RNA, 16 nt, Mycobacterium tuberculosis H37Rv
gaggcgcagcgccagc

SEQ ID NO: 1282101 - RNA, 15 nt, Mycobacterium tuberculosis H37Rv
gaggcgggucgccgc

SEQ ID NO: 1282102 - RNA, 13 nt, Mycobacterium tuberculosis H37Rv
gaggcgucggcaa

SEQ ID NO: 1282103 - RNA, 12 nt, Mycobacterium tuberculosis H37Rv
gagguucccgaa

SEQ ID NO: 1282104 - RNA, 15 nt, Mycobacterium tuberculosis H37Rv
gaggugagcugcggg

SEQ ID NO: 1282105 - RNA, 22 nt, Mycobacterium tuberculosis H37Rv
gaggugguucacggggaccaga

SEQ ID NO: 1282106 - RNA, 15 nt, Mycobacterium tuberculosis H37Rv
gagggcggccgcggu

SEQ ID NO: 1282107 - RNA, 13 nt, Mycobacterium tuberculosis H37Rv
gagucggcgucga

SEQ ID NO: 1282108 - RNA, 14 nt, Mycobacterium tuberculosis H37Rv
gagucggcuggucc

SEQ ID NO: 1282109 - RNA, 18 nt, Mycobacterium tuberculosis H37Rv
gagucggggggccggacu

SEQ ID NO: 1282110 - RNA, 19 nt, Mycobacterium tuberculosis H37Rv
gagucggugaaaugacggc

SEQ ID NO: 1282111 - RNA, 20 nt, Mycobacterium tuberculosis H37Rv
gagucgguggucucggcauc

SEQ ID NO: 1282112 - RNA, 23 nt, Mycobacterium tuberculosis H37Rv
gaguccagcgcaucguugccgca

SEQ ID NO: 1282113 - RNA, 14 nt, Mycobacterium tuberculosis H37Rv
gaguccaggccggc

SEQ ID NO: 1282114 - RNA, 21 nt, Mycobacterium tuberculosis H37Rv
gagucguaguaggcgccgcga

SEQ ID NO: 1282115 - RNA, 15 nt, Mycobacterium tuberculosis H37Rv
gagugccucgaccug

SEQ ID NO: 1282116 - RNA, 21 nt, Mycobacterium tuberculosis H37Rv
gagugaccacgcugcugguga

SEQ ID NO: 1282117 - RNA, 18 nt, Mycobacterium tuberculosis H37Rv
gagugcacagacacggca

SEQ ID NO: 1282118 - RNA, 17 nt, Mycobacterium tuberculosis H37Rv
gagugcggcacgaucgc

SEQ ID NO: 1282119 - RNA, 14 nt, Mycobacterium tuberculosis H37Rv
gagugcgccggcug

SEQ ID NO: 1282120 - RNA, 20 nt, Mycobacterium tuberculosis H37Rv
gagugcguugacucugcguc

SEQ ID NO: 1282121 - RNA, 22 nt, Mycobacterium tuberculosis H37Rv
gaguggaugcgccgcacggcga

SEQ ID NO: 1282122 - RNA, 15 nt, Mycobacterium tuberculosis H37Rv
gagugucagcgccac

SEQ ID NO: 1282123 - RNA, 17 nt, Mycobacterium tuberculosis H37Rv
gauagucauucgcuccg

SEQ ID NO: 1282124 - RNA, 15 nt, Mycobacterium tuberculosis H37Rv
gauaggccguggucg

SEQ ID NO: 1282125 - RNA, 15 nt, Mycobacterium tuberculosis H37Rv
gaucaccgcgccgga

SEQ ID NO: 1282126 - RNA, 21 nt, Mycobacterium tuberculosis H37Rv
gaucaaggaccgcucugcggc

SEQ ID NO: 1282127 - RNA, 22 nt, Mycobacterium tuberculosis H37Rv
gaucaaccgggucagcccagcc

SEQ ID NO: 1282128 - RNA, 19 nt, Mycobacterium tuberculosis H37Rv
gaucaacggaacaucguca

SEQ ID NO: 1282129 - RNA, 15 nt, Mycobacterium tuberculosis H37Rv
gaucaacaugccggu

SEQ ID NO: 1282130 - RNA, 16 nt, Mycobacterium tuberculosis H37Rv
gaucaaacuaccgaac

SEQ ID NO: 1282131 - RNA, 15 nt, Mycobacterium tuberculosis H37Rv
gauaucguacuggcu

SEQ ID NO: 1282132 - RNA, 14 nt, Mycobacterium tuberculosis H37Rv
gaguugagcgccaa

SEQ ID NO: 1282133 - RNA, 12 nt, Mycobacterium tuberculosis H37Rv
gaguuccggucg

SEQ ID NO: 1282134 - RNA, 11 nt, Mycobacterium tuberculosis H37Rv
gaguucccgaa

SEQ ID NO: 1282135 - RNA, 19 nt, Mycobacterium tuberculosis H37Rv
gaguucgaccggcgggacg

SEQ ID NO: 1282136 - RNA, 19 nt, Mycobacterium tuberculosis H37Rv
gaguugcccgggucggccg

SEQ ID NO: 1282137 - RNA, 14 nt, Mycobacterium tuberculosis H37Rv
gaguugcccguuca

SEQ ID NO: 1282138 - RNA, 15 nt, Mycobacterium tuberculosis H37Rv
gaguuggcccgacgc

SEQ ID NO: 1282139 - RNA, 19 nt, Mycobacterium tuberculosis H37Rv
gaguuggcgaagcccgaga

SEQ ID NO: 1282140 - RNA, 15 nt, Mycobacterium tuberculosis H37Rv
gauaaagccgcugaa

SEQ ID NO: 1282141 - RNA, 16 nt, Mycobacterium tuberculosis H37Rv
gauaacuccgcggcga

SEQ ID NO: 1282142 - RNA, 17 nt, Mycobacterium tuberculosis H37Rv
gauaacgucacaccgau

SEQ ID NO: 1282143 - RNA, 20 nt, Mycobacterium tuberculosis H37Rv
gauaccgacgcgcucggcga

SEQ ID NO: 1282144 - RNA, 21 nt, Mycobacterium tuberculosis H37Rv
gauacagacggggaucggucu

SEQ ID NO: 1282145 - RNA, 13 nt, Mycobacterium tuberculosis H37Rv
gauaccgcgauga

SEQ ID NO: 1282146 - RNA, 17 nt, Mycobacterium tuberculosis H37Rv
gauacgcacccgcugaa

SEQ ID NO: 1282147 - RNA, 19 nt, Mycobacterium tuberculosis H37Rv
gauaaugaucucggcaagg

SEQ ID NO: 1282148 - RNA, 17 nt, Mycobacterium tuberculosis H37Rv
gaucgcaagcgcggcga

SEQ ID NO: 1282149 - RNA, 17 nt, Mycobacterium tuberculosis H37Rv
gaucgcagugagcagcc

SEQ ID NO: 1282150 - RNA, 14 nt, Mycobacterium tuberculosis H37Rv
gaucgcaucgacgu

SEQ ID NO: 1282151 - RNA, 19 nt, Mycobacterium tuberculosis H37Rv
gaucgauucgucgcggauc

SEQ ID NO: 1282152 - RNA, 14 nt, Mycobacterium tuberculosis H37Rv
gaucgagacuucuu

SEQ ID NO: 1282153 - RNA, 15 nt, Mycobacterium tuberculosis H37Rv
gaucgacuucggugg

SEQ ID NO: 1282154 - RNA, 16 nt, Mycobacterium tuberculosis H37Rv
gauccggcgcagcgaa

SEQ ID NO: 1282155 - RNA, 15 nt, Mycobacterium tuberculosis H37Rv
gaucccgucgggcac

SEQ ID NO: 1282156 - RNA, 15 nt, Mycobacterium tuberculosis H37Rv
gaucccguagccgug

SEQ ID NO: 1282157 - RNA, 17 nt, Mycobacterium tuberculosis H37Rv
gaucgcgaacaucgcca

SEQ ID NO: 1282158 - RNA, 17 nt, Mycobacterium tuberculosis H37Rv
gaucgcgcccugcggau

SEQ ID NO: 1282159 - RNA, 15 nt, Mycobacterium tuberculosis H37Rv
gaucgcgacccgauc

SEQ ID NO: 1282160 - RNA, 21 nt, Mycobacterium tuberculosis H37Rv
gaucgcaucgacgugcgcggc

SEQ ID NO: 1282161 - RNA, 18 nt, Mycobacterium tuberculosis H37Rv
gaucgcaucgacgugcgc

SEQ ID NO: 1282162 - RNA, 17 nt, Mycobacterium tuberculosis H37Rv
gaucagcaccgacagcc

SEQ ID NO: 1282163 - RNA, 17 nt, Mycobacterium tuberculosis H37Rv
gaucagcaacucggcca

SEQ ID NO: 1282164 - RNA, 22 nt, Mycobacterium tuberculosis H37Rv
gaucagguuggcggcugcacgc

SEQ ID NO: 1282165 - RNA, 12 nt, Mycobacterium tuberculosis H37Rv
gaucacgccgac

SEQ ID NO: 1282166 - RNA, 16 nt, Mycobacterium tuberculosis H37Rv
gaucacggccgucgau

SEQ ID NO: 1282167 - RNA, 12 nt, Mycobacterium tuberculosis H37Rv
gaucacugucgg

SEQ ID NO: 1282168 - RNA, 14 nt, Mycobacterium tuberculosis H37Rv
gaucacuguuccgg

SEQ ID NO: 1282169 - RNA, 13 nt, Mycobacterium tuberculosis H37Rv
gaucccacccucg

SEQ ID NO: 1282170 - RNA, 23 nt, Mycobacterium tuberculosis H37Rv
gaucccaacgcccgggcgaaucc

SEQ ID NO: 1282171 - RNA, 16 nt, Mycobacterium tuberculosis H37Rv
gaucccaagcgucgca

SEQ ID NO: 1282172 - RNA, 13 nt, Mycobacterium tuberculosis H37Rv
gauccccacgaua

SEQ ID NO: 1282173 - RNA, 22 nt, Mycobacterium tuberculosis H37Rv
gaucccgccgaucgaaccgcug

SEQ ID NO: 1282174 - RNA, 15 nt, Mycobacterium tuberculosis H37Rv
gaucccgaaccguuc

SEQ ID NO: 1282175 - RNA, 14 nt, Mycobacterium tuberculosis H37Rv
gaucaguccggcgu

SEQ ID NO: 1282176 - RNA, 15 nt, Mycobacterium tuberculosis H37Rv
gaucaugccggcgaa

SEQ ID NO: 1282177 - RNA, 15 nt, Mycobacterium tuberculosis H37Rv
gaucauucugcggcc

SEQ ID NO: 1282178 - RNA, 22 nt, Mycobacterium tuberculosis H37Rv
gaucgggccggccgccgcggga

SEQ ID NO: 1282179 - RNA, 13 nt, Mycobacterium tuberculosis H37Rv
gaucgggccgauc

SEQ ID NO: 1282180 - RNA, 17 nt, Mycobacterium tuberculosis H37Rv
gaucgggcuucggccag

SEQ ID NO: 1282181 - RNA, 18 nt, Mycobacterium tuberculosis H37Rv
gaucggggcgcugcagcu

SEQ ID NO: 1282182 - RNA, 19 nt, Mycobacterium tuberculosis H37Rv
gaucggcggcgcgccgauc

SEQ ID NO: 1282183 - RNA, 18 nt, Mycobacterium tuberculosis H37Rv
gaucggcuugggaaaccc

SEQ ID NO: 1282184 - RNA, 20 nt, Mycobacterium tuberculosis H37Rv
gaucggcuugggaaacccgg

SEQ ID NO: 1282185 - RNA, 23 nt, Mycobacterium tuberculosis H37Rv
gaucggugcgggcgccgcuaggu

SEQ ID NO: 1282186 - RNA, 17 nt, Mycobacterium tuberculosis H37Rv
gaucgguugaucggcca

SEQ ID NO: 1282187 - RNA, 16 nt, Mycobacterium tuberculosis H37Rv
gaucggugucgggcug

SEQ ID NO: 1282188 - RNA, 22 nt, Mycobacterium tuberculosis H37Rv
gaucgguaccgacggcaccaug

SEQ ID NO: 1282189 - RNA, 21 nt, Mycobacterium tuberculosis H37Rv
gaucggugaugaacgacaucc

SEQ ID NO: 1282190 - RNA, 18 nt, Mycobacterium tuberculosis H37Rv
gaucggucggcaccaggu

SEQ ID NO: 1282191 - RNA, 14 nt, Mycobacterium tuberculosis H37Rv
gaucggucggccaa

SEQ ID NO: 1282192 - RNA, 15 nt, Mycobacterium tuberculosis H37Rv
gaucgucaagccggg

SEQ ID NO: 1282193 - RNA, 19 nt, Mycobacterium tuberculosis H37Rv
gaucgucaagccgggcacg

SEQ ID NO: 1282194 - RNA, 19 nt, Mycobacterium tuberculosis H37Rv
gaucgucgaacagcaccgc

SEQ ID NO: 1282195 - RNA, 18 nt, Mycobacterium tuberculosis H37Rv
gaucgucgaggcacgagc

SEQ ID NO: 1282196 - RNA, 19 nt, Mycobacterium tuberculosis H37Rv
gaucgugaacacgucgcgg

SEQ ID NO: 1282197 - RNA, 17 nt, Mycobacterium tuberculosis H37Rv
gaucgugagacgccguc

SEQ ID NO: 1282198 - RNA, 15 nt, Mycobacterium tuberculosis H37Rv
gaucgugccggcgaa

SEQ ID NO: 1282199 - RNA, 15 nt, Mycobacterium tuberculosis H37Rv
gaucgugcggaaccu

SEQ ID NO: 1282200 - RNA, 18 nt, Mycobacterium tuberculosis H37Rv
gaucgucgugcacggcgg

SEQ ID NO: 1282201 - RNA, 14 nt, Mycobacterium tuberculosis H37Rv
gaucgucguuguca

SEQ ID NO: 1282202 - RNA, 17 nt, Mycobacterium tuberculosis H37Rv
gaucgucucgcgcaccu

SEQ ID NO: 1282203 - RNA, 11 nt, Mycobacterium tuberculosis H37Rv
gaucgucgggu

SEQ ID NO: 1282204 - RNA, 14 nt, Mycobacterium tuberculosis H37Rv
gaucgucggcaacc

SEQ ID NO: 1282205 - RNA, 15 nt, Mycobacterium tuberculosis H37Rv
gaucgucggcaacca

SEQ ID NO: 1282206 - RNA, 22 nt, Mycobacterium tuberculosis H37Rv
gaucucgagcaggcgcaccagg

SEQ ID NO: 1282207 - RNA, 18 nt, Mycobacterium tuberculosis H37Rv
gaucguugccucgucgcc

SEQ ID NO: 1282208 - RNA, 23 nt, Mycobacterium tuberculosis H37Rv
gaucguguccaccggaccgacca

SEQ ID NO: 1282209 - RNA, 15 nt, Mycobacterium tuberculosis H37Rv
gaucggccaccaucg

SEQ ID NO: 1282210 - RNA, 19 nt, Mycobacterium tuberculosis H37Rv
gaucggcacuuagcccgau

SEQ ID NO: 1282211 - RNA, 19 nt, Mycobacterium tuberculosis H37Rv
gaucggauggugugucggg

SEQ ID NO: 1282212 - RNA, 13 nt, Mycobacterium tuberculosis H37Rv
gaucggaucggca

SEQ ID NO: 1282213 - RNA, 17 nt, Mycobacterium tuberculosis H37Rv
gaucggaaagauccgcu

SEQ ID NO: 1282214 - RNA, 15 nt, Mycobacterium tuberculosis H37Rv
gaucggaacccgaau

SEQ ID NO: 1282215 - RNA, 22 nt, Mycobacterium tuberculosis H37Rv
gaucggcaacccgcaccagggu

SEQ ID NO: 1282216 - RNA, 16 nt, Mycobacterium tuberculosis H37Rv
gaucggcaacggcggc

SEQ ID NO: 1282217 - RNA, 19 nt, Mycobacterium tuberculosis H37Rv
gaucggcaacggcggcgug

SEQ ID NO: 1282218 - RNA, 17 nt, Mycobacterium tuberculosis H37Rv
gaucggcaacccgcacc

SEQ ID NO: 1282219 - RNA, 16 nt, Mycobacterium tuberculosis H37Rv
gaucggacccgcggga

SEQ ID NO: 1282220 - RNA, 16 nt, Mycobacterium tuberculosis H37Rv
gaucggcgcgccgauc

SEQ ID NO: 1282221 - RNA, 15 nt, Mycobacterium tuberculosis H37Rv
gaucggcgcgccgau

SEQ ID NO: 1282222 - RNA, 21 nt, Mycobacterium tuberculosis H37Rv
gaucgcuccgcggcgcagcac

SEQ ID NO: 1282223 - RNA, 20 nt, Mycobacterium tuberculosis H37Rv
gaucgcguuagccaggucga

SEQ ID NO: 1282224 - RNA, 17 nt, Mycobacterium tuberculosis H37Rv
gaucgcgugcgacgaua

SEQ ID NO: 1282225 - RNA, 19 nt, Mycobacterium tuberculosis H37Rv
gaucgcuggccgcgaggua

SEQ ID NO: 1282226 - RNA, 20 nt, Mycobacterium tuberculosis H37Rv
gaucgcgguccgagcggcau

SEQ ID NO: 1282227 - RNA, 21 nt, Mycobacterium tuberculosis H37Rv
gaucgcgguccgagcggcauc

SEQ ID NO: 1282228 - RNA, 19 nt, Mycobacterium tuberculosis H37Rv
gaucgcggugggccccgau

SEQ ID NO: 1282229 - RNA, 14 nt, Mycobacterium tuberculosis H37Rv
gaucgcgcugcggg

SEQ ID NO: 1282230 - RNA, 19 nt, Mycobacterium tuberculosis H37Rv
gaucgcgcugaucagccca

SEQ ID NO: 1282231 - RNA, 13 nt, Mycobacterium tuberculosis H37Rv
gaucgcgcugauc

SEQ ID NO: 1282232 - RNA, 18 nt, Mycobacterium tuberculosis H37Rv
gaucgcgccgucggcgau

SEQ ID NO: 1282233 - RNA, 23 nt, Mycobacterium tuberculosis H37Rv
gaucgcgccgucgucgaccacga

SEQ ID NO: 1282234 - RNA, 17 nt, Mycobacterium tuberculosis H37Rv
gaucgcgccgggcucgg

SEQ ID NO: 1282235 - RNA, 15 nt, Mycobacterium tuberculosis H37Rv
gaucgcggcggcgug

SEQ ID NO: 1282236 - RNA, 16 nt, Mycobacterium tuberculosis H37Rv
gaucgcggcggccucc

SEQ ID NO: 1282237 - RNA, 13 nt, Mycobacterium tuberculosis H37Rv
gcacggcgucggc

SEQ ID NO: 1282238 - RNA, 12 nt, Mycobacterium tuberculosis H37Rv
gcacggcggugu

SEQ ID NO: 1282239 - RNA, 19 nt, Mycobacterium tuberculosis H37Rv
gcacggcguggaugcccgg

SEQ ID NO: 1282240 - RNA, 13 nt, Mycobacterium tuberculosis H37Rv
gcacggcuucggc

SEQ ID NO: 1282241 - RNA, 22 nt, Mycobacterium tuberculosis H37Rv
gcacggcuuuucgacgcugugg

SEQ ID NO: 1282242 - RNA, 14 nt, Mycobacterium tuberculosis H37Rv
gcacggugaucagc

SEQ ID NO: 1282243 - RNA, 16 nt, Mycobacterium tuberculosis H37Rv
gcacggugaccacgcc

SEQ ID NO: 1282244 - RNA, 14 nt, Mycobacterium tuberculosis H37Rv
gcacgucgaacucg

SEQ ID NO: 1282245 - RNA, 13 nt, Mycobacterium tuberculosis H37Rv
gcacgucgaggcg

SEQ ID NO: 1282246 - RNA, 20 nt, Mycobacterium tuberculosis H37Rv
gcacgucgaccucggcaacc

SEQ ID NO: 1282247 - RNA, 13 nt, Mycobacterium tuberculosis H37Rv
gcacgucgagcag

SEQ ID NO: 1282248 - RNA, 22 nt, Mycobacterium tuberculosis H37Rv
gcacguccgaucggcgcgccga

SEQ ID NO: 1282249 - RNA, 14 nt, Mycobacterium tuberculosis H37Rv
gcacgguguauccg

SEQ ID NO: 1282250 - RNA, 16 nt, Mycobacterium tuberculosis H37Rv
gcacggugucgcgcga

SEQ ID NO: 1282251 - RNA, 13 nt, Mycobacterium tuberculosis H37Rv
gcacgguguacgc

SEQ ID NO: 1282252 - RNA, 20 nt, Mycobacterium tuberculosis H37Rv
gcacgguggcuucgacggcg

SEQ ID NO: 1282253 - RNA, 22 nt, Mycobacterium tuberculosis H37Rv
gcacgguggcuucgacggcggc

SEQ ID NO: 1282254 - RNA, 19 nt, Mycobacterium tuberculosis H37Rv
gcacggaugcgauggccga

SEQ ID NO: 1282255 - RNA, 15 nt, Mycobacterium tuberculosis H37Rv
gcacggaaucgcauc

SEQ ID NO: 1282256 - RNA, 15 nt, Mycobacterium tuberculosis H37Rv
gcacggaaggucgac

SEQ ID NO: 1282257 - RNA, 23 nt, Mycobacterium tuberculosis H37Rv
gcacgcgguucaccacgucgucg

SEQ ID NO: 1282258 - RNA, 16 nt, Mycobacterium tuberculosis H37Rv
gcacgcgguucaccac

SEQ ID NO: 1282259 - RNA, 21 nt, Mycobacterium tuberculosis H37Rv
gcacgcgguucaccacgucgu

SEQ ID NO: 1282260 - RNA, 22 nt, Mycobacterium tuberculosis H37Rv
gcacgcgggcguuggccagcag

SEQ ID NO: 1282261 - RNA, 15 nt, Mycobacterium tuberculosis H37Rv
gcacgccgccgacgu

SEQ ID NO: 1282262 - RNA, 14 nt, Mycobacterium tuberculosis H37Rv
gcacgccgauaccg

SEQ ID NO: 1282263 - RNA, 14 nt, Mycobacterium tuberculosis H37Rv
gcacgccggcaugc

SEQ ID NO: 1282264 - RNA, 16 nt, Mycobacterium tuberculosis H37Rv
gcacgauggccgucga

SEQ ID NO: 1282265 - RNA, 16 nt, Mycobacterium tuberculosis H37Rv
gcacgaugucgaugcc

SEQ ID NO: 1282266 - RNA, 15 nt, Mycobacterium tuberculosis H37Rv
gcacgccgaccagca

SEQ ID NO: 1282267 - RNA, 14 nt, Mycobacterium tuberculosis H37Rv
gcacgccgaccagc

SEQ ID NO: 1282268 - RNA, 14 nt, Mycobacterium tuberculosis H37Rv
gcacgcaguucggu

SEQ ID NO: 1282269 - RNA, 15 nt, Mycobacterium tuberculosis H37Rv
gcacgcaccacaauc

SEQ ID NO: 1282270 - RNA, 18 nt, Mycobacterium tuberculosis H37Rv
gcacgacggcaucgucga

SEQ ID NO: 1282271 - RNA, 15 nt, Mycobacterium tuberculosis H37Rv
gcacgacgacaucga

SEQ ID NO: 1282272 - RNA, 20 nt, Mycobacterium tuberculosis H37Rv
gcacgacgacaaccggccag

SEQ ID NO: 1282273 - RNA, 15 nt, Mycobacterium tuberculosis H37Rv
gcacgacgacaaccg

SEQ ID NO: 1282274 - RNA, 18 nt, Mycobacterium tuberculosis H37Rv
gcacgaaaucagcccgcc

SEQ ID NO: 1282275 - RNA, 21 nt, Mycobacterium tuberculosis H37Rv
gcaccuccagguagucgcggu

SEQ ID NO: 1282276 - RNA, 13 nt, Mycobacterium tuberculosis H37Rv
gcaccucggccuu

SEQ ID NO: 1282277 - RNA, 19 nt, Mycobacterium tuberculosis H37Rv
gcaccucgacgucgagcac

SEQ ID NO: 1282278 - RNA, 21 nt, Mycobacterium tuberculosis H37Rv
gcaccucgacgucgagcacgu

SEQ ID NO: 1282279 - RNA, 15 nt, Mycobacterium tuberculosis H37Rv
gcaccucggccagcg

SEQ ID NO: 1282280 - RNA, 16 nt, Mycobacterium tuberculosis H37Rv
gcaccugccgaucggg

SEQ ID NO: 1282281 - RNA, 19 nt, Mycobacterium tuberculosis H37Rv
gcaccgguuugacguccag

SEQ ID NO: 1282282 - RNA, 20 nt, Mycobacterium tuberculosis H37Rv
gcaccgguuugacguccagg

SEQ ID NO: 1282283 - RNA, 21 nt, Mycobacterium tuberculosis H37Rv
gcaccguaguaguucagccag

SEQ ID NO: 1282284 - RNA, 21 nt, Mycobacterium tuberculosis H37Rv
gcaccggugauggugaccagc

SEQ ID NO: 1282285 - RNA, 18 nt, Mycobacterium tuberculosis H37Rv
gcaccgguuugacgucca

SEQ ID NO: 1282286 - RNA, 20 nt, Mycobacterium tuberculosis H37Rv
gcaccggugcucgucgagca

SEQ ID NO: 1282287 - RNA, 18 nt, Mycobacterium tuberculosis H37Rv
gcaccggguugagccgcc

SEQ ID NO: 1282288 - RNA, 23 nt, Mycobacterium tuberculosis H37Rv
gcaccggggugugcgggcggugc

SEQ ID NO: 1282289 - RNA, 15 nt, Mycobacterium tuberculosis H37Rv
gcaccgggucaacgc

SEQ ID NO: 1282290 - RNA, 17 nt, Mycobacterium tuberculosis H37Rv
gcaccuauggucaaccg

SEQ ID NO: 1282291 - RNA, 22 nt, Mycobacterium tuberculosis H37Rv
gcaccguuaccgccgucgccac

SEQ ID NO: 1282292 - RNA, 21 nt, Mycobacterium tuberculosis H37Rv
gcaccguuaccgccgucgcca

SEQ ID NO: 1282293 - RNA, 20 nt, Mycobacterium tuberculosis H37Rv
gcaccguuaccgccgucgcc

SEQ ID NO: 1282294 - RNA, 21 nt, Mycobacterium tuberculosis H37Rv
gcaccguuuccggcgcuccgc

SEQ ID NO: 1282295 - RNA, 17 nt, Mycobacterium tuberculosis H37Rv
gcaccgugucuacgccg

SEQ ID NO: 1282296 - RNA, 20 nt, Mycobacterium tuberculosis H37Rv
gcaccgugaguacucgguca

SEQ ID NO: 1282297 - RNA, 15 nt, Mycobacterium tuberculosis H37Rv
gcaccguccucgguc

SEQ ID NO: 1282298 - RNA, 18 nt, Mycobacterium tuberculosis H37Rv
gcaccgugacagcggcau

SEQ ID NO: 1282299 - RNA, 13 nt, Mycobacterium tuberculosis H37Rv
gcaccgucgucac

SEQ ID NO: 1282300 - RNA, 14 nt, Mycobacterium tuberculosis H37Rv
gcaccgucgucacc

SEQ ID NO: 1282301 - RNA, 15 nt, Mycobacterium tuberculosis H37Rv
gcaccgccaggucga

SEQ ID NO: 1282302 - RNA, 16 nt, Mycobacterium tuberculosis H37Rv
gcaccgccaguuccgg

SEQ ID NO: 1282303 - RNA, 15 nt, Mycobacterium tuberculosis H37Rv
gcaccgccagccacc

SEQ ID NO: 1282304 - RNA, 17 nt, Mycobacterium tuberculosis H37Rv
gcaccgcggccagcggg

SEQ ID NO: 1282305 - RNA, 17 nt, Mycobacterium tuberculosis H37Rv
gcaccgcgccggcggaa

SEQ ID NO: 1282306 - RNA, 18 nt, Mycobacterium tuberculosis H37Rv
gcaccgcccccgucggcc

SEQ ID NO: 1282307 - RNA, 20 nt, Mycobacterium tuberculosis H37Rv
gcaccgcccccgucggccuu

SEQ ID NO: 1282308 - RNA, 23 nt, Mycobacterium tuberculosis H37Rv
gcaccggcggcgccgaaaccgcc

SEQ ID NO: 1282309 - RNA, 17 nt, Mycobacterium tuberculosis H37Rv
gcaccggcgcaacucga

SEQ ID NO: 1282310 - RNA, 19 nt, Mycobacterium tuberculosis H37Rv
gcaccggccgugccgccga

SEQ ID NO: 1282311 - RNA, 20 nt, Mycobacterium tuberculosis H37Rv
gcaccgcgggaucgguggcg

SEQ ID NO: 1282312 - RNA, 19 nt, Mycobacterium tuberculosis H37Rv
gcaccgcggccagcgggaa

SEQ ID NO: 1282313 - RNA, 18 nt, Mycobacterium tuberculosis H37Rv
gcacccguugcgacaccu

SEQ ID NO: 1282314 - RNA, 14 nt, Mycobacterium tuberculosis H37Rv
gcacccugcggcac

SEQ ID NO: 1282315 - RNA, 19 nt, Mycobacterium tuberculosis H37Rv
gcacccuugccgauuccgg

SEQ ID NO: 1282316 - RNA, 17 nt, Mycobacterium tuberculosis H37Rv
gcacccuugccgauucc

SEQ ID NO: 1282317 - RNA, 22 nt, Mycobacterium tuberculosis H37Rv
gcaccgaaaaacaccagcgagg

SEQ ID NO: 1282318 - RNA, 23 nt, Mycobacterium tuberculosis H37Rv
gcacccgugccgccgaugccgcc

SEQ ID NO: 1282319 - RNA, 20 nt, Mycobacterium tuberculosis H37Rv
gcacccguugcgacaccucc

SEQ ID NO: 1282320 - RNA, 16 nt, Mycobacterium tuberculosis H37Rv
gcacccguugaucgcg

SEQ ID NO: 1282321 - RNA, 20 nt, Mycobacterium tuberculosis H37Rv
gcacccgccagggcggcauc

SEQ ID NO: 1282322 - RNA, 18 nt, Mycobacterium tuberculosis H37Rv
gcacccgcuccagcucgg

SEQ ID NO: 1282323 - RNA, 20 nt, Mycobacterium tuberculosis H37Rv
gcacccgcuccagcucggcg

SEQ ID NO: 1282324 - RNA, 19 nt, Mycobacterium tuberculosis H37Rv
gcaccgacugcugucaccg

SEQ ID NO: 1282325 - RNA, 15 nt, Mycobacterium tuberculosis H37Rv
gcaccgacagcccga

SEQ ID NO: 1282326 - RNA, 20 nt, Mycobacterium tuberculosis H37Rv
gcaccgaccugagucggcau

SEQ ID NO: 1282327 - RNA, 21 nt, Mycobacterium tuberculosis H37Rv
gcaccgaccgcaccgugccga

SEQ ID NO: 1282328 - RNA, 19 nt, Mycobacterium tuberculosis H37Rv
gcaccgacaccggccgcga

SEQ ID NO: 1282329 - RNA, 16 nt, Mycobacterium tuberculosis H37Rv
gcaccgaagcggucgc

SEQ ID NO: 1282330 - RNA, 16 nt, Mycobacterium tuberculosis H37Rv
gcaccgaagauggcca

SEQ ID NO: 1282331 - RNA, 21 nt, Mycobacterium tuberculosis H37Rv
gcaccgaaaccaugccgccga

SEQ ID NO: 1282332 - RNA, 19 nt, Mycobacterium tuberculosis H37Rv
gcaccgaaaccaugccgcc

SEQ ID NO: 1282333 - RNA, 22 nt, Mycobacterium tuberculosis H37Rv
gcaccgaacguguucuggucgc

SEQ ID NO: 1282334 - RNA, 17 nt, Mycobacterium tuberculosis H37Rv
gcacagcaccacaucga

SEQ ID NO: 1282335 - RNA, 13 nt, Mycobacterium tuberculosis H37Rv
gcaccagucgccc

SEQ ID NO: 1282336 - RNA, 13 nt, Mycobacterium tuberculosis H37Rv
gcaccaguccagc

SEQ ID NO: 1282337 - RNA, 21 nt, Mycobacterium tuberculosis H37Rv
gcaccaguggcgcccauggcc

SEQ ID NO: 1282338 - RNA, 17 nt, Mycobacterium tuberculosis H37Rv
gcacccgcacggccucc

SEQ ID NO: 1282339 - RNA, 14 nt, Mycobacterium tuberculosis H37Rv
gcacccgcacggug

SEQ ID NO: 1282340 - RNA, 22 nt, Mycobacterium tuberculosis H37Rv
gcacccaggugucgcugcugaa

SEQ ID NO: 1282341 - RNA, 13 nt, Mycobacterium tuberculosis H37Rv
gcacccagccgug

SEQ ID NO: 1282342 - RNA, 13 nt, Mycobacterium tuberculosis H37Rv
gcacccagcggcg

SEQ ID NO: 1282343 - RNA, 22 nt, Mycobacterium tuberculosis H37Rv
gcaccaguguggcgaugaccac

SEQ ID NO: 1282344 - RNA, 19 nt, Mycobacterium tuberculosis H37Rv
gcagcgccacccgcgucag

SEQ ID NO: 1282345 - RNA, 18 nt, Mycobacterium tuberculosis H37Rv
gcagcgccaccgaccgag

SEQ ID NO: 1282346 - RNA, 14 nt, Mycobacterium tuberculosis H37Rv
gcagcgccagcagc

SEQ ID NO: 1282347 - RNA, 22 nt, Mycobacterium tuberculosis H37Rv
gcagcgcccagaucgccgagau

SEQ ID NO: 1282348 - RNA, 21 nt, Mycobacterium tuberculosis H37Rv
gcagcgccaucaucuuggcgc

SEQ ID NO: 1282349 - RNA, 16 nt, Mycobacterium tuberculosis H37Rv
gcagccggugccgguc

SEQ ID NO: 1282350 - RNA, 22 nt, Mycobacterium tuberculosis H37Rv
gcagcgagaccucucugcgcca

SEQ ID NO: 1282351 - RNA, 15 nt, Mycobacterium tuberculosis H37Rv
gcagccugcagcgaa

SEQ ID NO: 1282352 - RNA, 13 nt, Mycobacterium tuberculosis H37Rv
gcagccuucgacg

SEQ ID NO: 1282353 - RNA, 20 nt, Mycobacterium tuberculosis H37Rv
gcagccgcgacacgugcauc

SEQ ID NO: 1282354 - RNA, 17 nt, Mycobacterium tuberculosis H37Rv
gcagccgcgacauccgc

SEQ ID NO: 1282355 - RNA, 18 nt, Mycobacterium tuberculosis H37Rv
gcagccgcagccgguuaa

SEQ ID NO: 1282356 - RNA, 23 nt, Mycobacterium tuberculosis H37Rv
gcagccgcccgcccaccucgauc

SEQ ID NO: 1282357 - RNA, 23 nt, Mycobacterium tuberculosis H37Rv
gcagcccgguggugcugucgugg

SEQ ID NO: 1282358 - RNA, 12 nt, Mycobacterium tuberculosis H37Rv
gcagccgaaccg

SEQ ID NO: 1282359 - RNA, 20 nt, Mycobacterium tuberculosis H37Rv
gcagccgaaccggcaccagc

SEQ ID NO: 1282360 - RNA, 14 nt, Mycobacterium tuberculosis H37Rv
gcagccgaaccggc

SEQ ID NO: 1282361 - RNA, 21 nt, Mycobacterium tuberculosis H37Rv
gcagccgaaccggcaccagcg

SEQ ID NO: 1282362 - RNA, 13 nt, Mycobacterium tuberculosis H37Rv
gcagcccggggau

SEQ ID NO: 1282363 - RNA, 20 nt, Mycobacterium tuberculosis H37Rv
gcagcccaaggcgacgaauc

SEQ ID NO: 1282364 - RNA, 15 nt, Mycobacterium tuberculosis H37Rv
gcagcaucacguccg

SEQ ID NO: 1282365 - RNA, 20 nt, Mycobacterium tuberculosis H37Rv
gcagcaucggcacgucguug

SEQ ID NO: 1282366 - RNA, 13 nt, Mycobacterium tuberculosis H37Rv
gcagcaucggcga

SEQ ID NO: 1282367 - RNA, 15 nt, Mycobacterium tuberculosis H37Rv
gcagcaucgucgcca

SEQ ID NO: 1282368 - RNA, 17 nt, Mycobacterium tuberculosis H37Rv
gcagcaucuccgucggc

SEQ ID NO: 1282369 - RNA, 15 nt, Mycobacterium tuberculosis H37Rv
gcagcaguuggucgc

SEQ ID NO: 1282370 - RNA, 13 nt, Mycobacterium tuberculosis H37Rv
gcagcagugccgu

SEQ ID NO: 1282371 - RNA, 17 nt, Mycobacterium tuberculosis H37Rv
gcagcagcgugaccacc

SEQ ID NO: 1282372 - RNA, 23 nt, Mycobacterium tuberculosis H37Rv
gcagcagcgugaccaccgccgac

SEQ ID NO: 1282373 - RNA, 24 nt, Mycobacterium tuberculosis H37Rv
gcagcaggggacgaccaugccgau

SEQ ID NO: 1282374 - RNA, 22 nt, Mycobacterium tuberculosis H37Rv
gcagcauguccgcagcggugcg

SEQ ID NO: 1282375 - RNA, 19 nt, Mycobacterium tuberculosis H37Rv
gcagccaagcgagcggcga

SEQ ID NO: 1282376 - RNA, 15 nt, Mycobacterium tuberculosis H37Rv
gcagccaaugccgga

SEQ ID NO: 1282377 - RNA, 16 nt, Mycobacterium tuberculosis H37Rv
gcagccaaugccggau

SEQ ID NO: 1282378 - RNA, 19 nt, Mycobacterium tuberculosis H37Rv
gcagccacguuacgcucgc

SEQ ID NO: 1282379 - RNA, 21 nt, Mycobacterium tuberculosis H37Rv
gcagccaccagcgacgaccac

SEQ ID NO: 1282380 - RNA, 15 nt, Mycobacterium tuberculosis H37Rv
gcagccacgauccuu

SEQ ID NO: 1282381 - RNA, 22 nt, Mycobacterium tuberculosis H37Rv
gcagccagaucuccccgaccgc

SEQ ID NO: 1282382 - RNA, 18 nt, Mycobacterium tuberculosis H37Rv
gcagccagccaccgaucg

SEQ ID NO: 1282383 - RNA, 12 nt, Mycobacterium tuberculosis H37Rv
gcagccagcaac

SEQ ID NO: 1282384 - RNA, 16 nt, Mycobacterium tuberculosis H37Rv
gcagccagggcgccga

SEQ ID NO: 1282385 - RNA, 21 nt, Mycobacterium tuberculosis H37Rv
gcagccagcguccauggucgc

SEQ ID NO: 1282386 - RNA, 18 nt, Mycobacterium tuberculosis H37Rv
gcagaucgauaccgucgu

SEQ ID NO: 1282387 - RNA, 23 nt, Mycobacterium tuberculosis H37Rv
gcagaugcggcugaauucggcga

SEQ ID NO: 1282388 - RNA, 19 nt, Mycobacterium tuberculosis H37Rv
gcagaugaugccguucgga

SEQ ID NO: 1282389 - RNA, 19 nt, Mycobacterium tuberculosis H37Rv
gcagaucguccaccgccga

SEQ ID NO: 1282390 - RNA, 15 nt, Mycobacterium tuberculosis H37Rv
gcagcaccggcucga

SEQ ID NO: 1282391 - RNA, 13 nt, Mycobacterium tuberculosis H37Rv
gcagcacccgggc

SEQ ID NO: 1282392 - RNA, 14 nt, Mycobacterium tuberculosis H37Rv
gcagcaccgucggg

SEQ ID NO: 1282393 - RNA, 13 nt, Mycobacterium tuberculosis H37Rv
gcagcaccgguga

SEQ ID NO: 1282394 - RNA, 18 nt, Mycobacterium tuberculosis H37Rv
gcagcaccggugaccucg

SEQ ID NO: 1282395 - RNA, 23 nt, Mycobacterium tuberculosis H37Rv
gcagcacccacaucagccgcacc

SEQ ID NO: 1282396 - RNA, 21 nt, Mycobacterium tuberculosis H37Rv
gcagauggcgaggucggugag

SEQ ID NO: 1282397 - RNA, 20 nt, Mycobacterium tuberculosis H37Rv
gcagcagacgacgaucagcc

SEQ ID NO: 1282398 - RNA, 16 nt, Mycobacterium tuberculosis H37Rv
gcagcagacgacgauc

SEQ ID NO: 1282399 - RNA, 16 nt, Mycobacterium tuberculosis H37Rv
gcagcacguccgcgga

SEQ ID NO: 1282400 - RNA, 19 nt, Mycobacterium tuberculosis H37Rv
gcagcacggcuucgaccau

SEQ ID NO: 1282401 - RNA, 17 nt, Mycobacterium tuberculosis H37Rv
gcagcacgucgaacucg

SEQ ID NO: 1282402 - RNA, 15 nt, Mycobacterium tuberculosis H37Rv
gcagcacucgguguc

SEQ ID NO: 1282403 - RNA, 17 nt, Mycobacterium tuberculosis H37Rv
gcagcacucuucgauga

SEQ ID NO: 1282404 - RNA, 19 nt, Mycobacterium tuberculosis H37Rv
gcagcacuuccaagccgac

SEQ ID NO: 1282405 - RNA, 18 nt, Mycobacterium tuberculosis H37Rv
gcagcacuuggacccggc

SEQ ID NO: 1282406 - RNA, 23 nt, Mycobacterium tuberculosis H37Rv
gcagcacgucugcguccacguga

SEQ ID NO: 1282407 - RNA, 19 nt, Mycobacterium tuberculosis H37Rv
gcagcagacccgguggcgu

SEQ ID NO: 1282408 - RNA, 13 nt, Mycobacterium tuberculosis H37Rv
gcagcacgcgugg

SEQ ID NO: 1282409 - RNA, 22 nt, Mycobacterium tuberculosis H37Rv
gcagcacccccucggcuucgga

SEQ ID NO: 1282410 - RNA, 14 nt, Mycobacterium tuberculosis H37Rv
gcagaaucgccugc

SEQ ID NO: 1282411 - RNA, 13 nt, Mycobacterium tuberculosis H37Rv
gcagaaucggugg

SEQ ID NO: 1282412 - RNA, 14 nt, Mycobacterium tuberculosis H37Rv
gcagaauucggcgc

SEQ ID NO: 1282413 - RNA, 23 nt, Mycobacterium tuberculosis H37Rv
gcagaaugucguaggcgccguug

SEQ ID NO: 1282414 - RNA, 18 nt, Mycobacterium tuberculosis H37Rv
gcagaauccguucgacga

SEQ ID NO: 1282415 - RNA, 19 nt, Mycobacterium tuberculosis H37Rv
gcagaauccugcgcugcac

SEQ ID NO: 1282416 - RNA, 22 nt, Mycobacterium tuberculosis H37Rv
gcagaagcccccaaaccggcgg

SEQ ID NO: 1282417 - RNA, 14 nt, Mycobacterium tuberculosis H37Rv
gcagaccggugagc

SEQ ID NO: 1282418 - RNA, 19 nt, Mycobacterium tuberculosis H37Rv
gcagaccggugagcaccgg

SEQ ID NO: 1282419 - RNA, 19 nt, Mycobacterium tuberculosis H37Rv
gcagaccggugcugucgac

SEQ ID NO: 1282420 - RNA, 12 nt, Mycobacterium tuberculosis H37Rv
gcagaccgggug

SEQ ID NO: 1282421 - RNA, 18 nt, Mycobacterium tuberculosis H37Rv
gcagacccucgucgucga

SEQ ID NO: 1282422 - RNA, 20 nt, Mycobacterium tuberculosis H37Rv
gcacguucacgcgcggaucg

SEQ ID NO: 1282423 - RNA, 16 nt, Mycobacterium tuberculosis H37Rv
gcacguggaccggcac

SEQ ID NO: 1282424 - RNA, 18 nt, Mycobacterium tuberculosis H37Rv
gcacguugugaucgucag

SEQ ID NO: 1282425 - RNA, 15 nt, Mycobacterium tuberculosis H37Rv
gcacguugucgggcu

SEQ ID NO: 1282426 - RNA, 15 nt, Mycobacterium tuberculosis H37Rv
gcagacucgccaccg

SEQ ID NO: 1282427 - RNA, 21 nt, Mycobacterium tuberculosis H37Rv
gcagacucgccaccgcggcga

SEQ ID NO: 1282428 - RNA, 21 nt, Mycobacterium tuberculosis H37Rv
gcagacgugguagccggcgac

SEQ ID NO: 1282429 - RNA, 21 nt, Mycobacterium tuberculosis H37Rv
gcagauccaggcgucggugac

SEQ ID NO: 1282430 - RNA, 21 nt, Mycobacterium tuberculosis H37Rv
gcagaucaggacgcgaucggc

SEQ ID NO: 1282431 - RNA, 17 nt, Mycobacterium tuberculosis H37Rv
gcagaucaggguggcgc

SEQ ID NO: 1282432 - RNA, 19 nt, Mycobacterium tuberculosis H37Rv
gcagauauugccugccacc

SEQ ID NO: 1282433 - RNA, 20 nt, Mycobacterium tuberculosis H37Rv
gcagacgaaguagccgacca

SEQ ID NO: 1282434 - RNA, 18 nt, Mycobacterium tuberculosis H37Rv
gcagaccugcaucacaag

SEQ ID NO: 1282435 - RNA, 19 nt, Mycobacterium tuberculosis H37Rv
gcagacgcagaaucgccca

SEQ ID NO: 1282436 - RNA, 19 nt, Mycobacterium tuberculosis H37Rv
gcagacgcagaaucgccua

SEQ ID NO: 1282437 - RNA, 20 nt, Mycobacterium tuberculosis H37Rv
gcagacgcaaaaucgcccau

SEQ ID NO: 1282438 - RNA, 19 nt, Mycobacterium tuberculosis H37Rv
gcagacgcaaaaucgccca

SEQ ID NO: 1282439 - RNA, 21 nt, Mycobacterium tuberculosis H37Rv
gcagacgcagagucgcacugc

SEQ ID NO: 1282440 - RNA, 17 nt, Mycobacterium tuberculosis H37Rv
gcagacgccgacuccgc

SEQ ID NO: 1282441 - RNA, 17 nt, Mycobacterium tuberculosis H37Rv
gcagacgcggaaucgca

SEQ ID NO: 1282442 - RNA, 18 nt, Mycobacterium tuberculosis H37Rv
gcagacgcguuucgucga

SEQ ID NO: 1282443 - RNA, 19 nt, Mycobacterium tuberculosis H37Rv
gcagacgcggaaucgcauc

SEQ ID NO: 1282444 - RNA, 17 nt, Mycobacterium tuberculosis H37Rv
gcagacggcugccacgc

SEQ ID NO: 1282445 - RNA, 19 nt, Mycobacterium tuberculosis H37Rv
gcaacgacgucgucgccgc

SEQ ID NO: 1282446 - RNA, 17 nt, Mycobacterium tuberculosis H37Rv
gcaacgacggccgucgc

SEQ ID NO: 1282447 - RNA, 24 nt, Mycobacterium tuberculosis H37Rv
gcaacgacucucaucgacucgacc

SEQ ID NO: 1282448 - RNA, 17 nt, Mycobacterium tuberculosis H37Rv
gcaacgcaaucgucgcc

SEQ ID NO: 1282449 - RNA, 14 nt, Mycobacterium tuberculosis H37Rv
gcaacgaagccggc

SEQ ID NO: 1282450 - RNA, 23 nt, Mycobacterium tuberculosis H37Rv
gcaaccucgguugguccucggcg

SEQ ID NO: 1282451 - RNA, 23 nt, Mycobacterium tuberculosis H37Rv
gcaaccucaugcacgccguagca

SEQ ID NO: 1282452 - RNA, 21 nt, Mycobacterium tuberculosis H37Rv
gcaaccgugccgcaucacccg

SEQ ID NO: 1282453 - RNA, 20 nt, Mycobacterium tuberculosis H37Rv
gcaaccgaccgggccgcacg

SEQ ID NO: 1282454 - RNA, 17 nt, Mycobacterium tuberculosis H37Rv
gcaaccgccaucgucga

SEQ ID NO: 1282455 - RNA, 17 nt, Mycobacterium tuberculosis H37Rv
gcaaccgccggugccga

SEQ ID NO: 1282456 - RNA, 17 nt, Mycobacterium tuberculosis H37Rv
gcaacccggugauggug

SEQ ID NO: 1282457 - RNA, 16 nt, Mycobacterium tuberculosis H37Rv
gcaacccugccgcgau

SEQ ID NO: 1282458 - RNA, 16 nt, Mycobacterium tuberculosis H37Rv
gcaaccgcgcgcgaca

SEQ ID NO: 1282459 - RNA, 18 nt, Mycobacterium tuberculosis H37Rv
gcaaccgggaggccaccg

SEQ ID NO: 1282460 - RNA, 14 nt, Mycobacterium tuberculosis H37Rv
gcaaccgcucggcg

SEQ ID NO: 1282461 - RNA, 14 nt, Mycobacterium tuberculosis H37Rv
gcaaccggucagcc

SEQ ID NO: 1282462 - RNA, 17 nt, Mycobacterium tuberculosis H37Rv
gcaacgcuggcaagucc

SEQ ID NO: 1282463 - RNA, 21 nt, Mycobacterium tuberculosis H37Rv
gcaacgcgguggaccgcucga

SEQ ID NO: 1282464 - RNA, 19 nt, Mycobacterium tuberculosis H37Rv
gcaacgcguauucggcauc

SEQ ID NO: 1282465 - RNA, 22 nt, Mycobacterium tuberculosis H37Rv
gcaacggaaucgguuucgaccu

SEQ ID NO: 1282466 - RNA, 17 nt, Mycobacterium tuberculosis H37Rv
gcaacggacgggaucgc

SEQ ID NO: 1282467 - RNA, 20 nt, Mycobacterium tuberculosis H37Rv
gcaacggacgggaucgccca

SEQ ID NO: 1282468 - RNA, 20 nt, Mycobacterium tuberculosis H37Rv
gcaacgcgguggaccgcucg

SEQ ID NO: 1282469 - RNA, 14 nt, Mycobacterium tuberculosis H37Rv
gcaacgcgucgucg

SEQ ID NO: 1282470 - RNA, 14 nt, Mycobacterium tuberculosis H37Rv
gcaacggcguuggc

SEQ ID NO: 1282471 - RNA, 17 nt, Mycobacterium tuberculosis H37Rv
gcaacggcggcguggga

SEQ ID NO: 1282472 - RNA, 18 nt, Mycobacterium tuberculosis H37Rv
gcaacgugugcaccauca

SEQ ID NO: 1282473 - RNA, 19 nt, Mycobacterium tuberculosis H37Rv
gcaacgucuugcuggucga

SEQ ID NO: 1282474 - RNA, 22 nt, Mycobacterium tuberculosis H37Rv
gcaacguuuacgaugcucagcu

SEQ ID NO: 1282475 - RNA, 19 nt, Mycobacterium tuberculosis H37Rv
gcaacgggucgguccacuu

SEQ ID NO: 1282476 - RNA, 15 nt, Mycobacterium tuberculosis H37Rv
gcaagccaaccagcc

SEQ ID NO: 1282477 - RNA, 15 nt, Mycobacterium tuberculosis H37Rv
gcaagcacaccgcca

SEQ ID NO: 1282478 - RNA, 12 nt, Mycobacterium tuberculosis H37Rv
gcaagcacaccg

SEQ ID NO: 1282479 - RNA, 15 nt, Mycobacterium tuberculosis H37Rv
gcaagccgaacaccg

SEQ ID NO: 1282480 - RNA, 21 nt, Mycobacterium tuberculosis H37Rv
gcaagccgaacaccgucagcg

SEQ ID NO: 1282481 - RNA, 20 nt, Mycobacterium tuberculosis H37Rv
gcaagccgaacaccgucagc

SEQ ID NO: 1282482 - RNA, 17 nt, Mycobacterium tuberculosis H37Rv
gcaagccggacagauca

SEQ ID NO: 1282483 - RNA, 20 nt, Mycobacterium tuberculosis H37Rv
gcaagcccaaaaagaccgcc

SEQ ID NO: 1282484 - RNA, 15 nt, Mycobacterium tuberculosis H37Rv
gcaagcgccgcgcuu

SEQ ID NO: 1282485 - RNA, 16 nt, Mycobacterium tuberculosis H37Rv
gcaagcggacccgacc

SEQ ID NO: 1282486 - RNA, 13 nt, Mycobacterium tuberculosis H37Rv
gcaagcgcggcga

SEQ ID NO: 1282487 - RNA, 21 nt, Mycobacterium tuberculosis H37Rv
gcaagcggacccgaccgucgu

SEQ ID NO: 1282488 - RNA, 22 nt, Mycobacterium tuberculosis H37Rv
gcaaggaaaagccuggccguug

SEQ ID NO: 1282489 - RNA, 18 nt, Mycobacterium tuberculosis H37Rv
gcaacucguccagcagug

SEQ ID NO: 1282490 - RNA, 23 nt, Mycobacterium tuberculosis H37Rv
gcaacucggccacggcgucggcc

SEQ ID NO: 1282491 - RNA, 20 nt, Mycobacterium tuberculosis H37Rv
gcaacucgaucgccugagac

SEQ ID NO: 1282492 - RNA, 21 nt, Mycobacterium tuberculosis H37Rv
gcaacucgccgaaaucggcca

SEQ ID NO: 1282493 - RNA, 20 nt, Mycobacterium tuberculosis H37Rv
gcaacucgccgaaaucggcc

SEQ ID NO: 1282494 - RNA, 13 nt, Mycobacterium tuberculosis H37Rv
gcaacucggccac

SEQ ID NO: 1282495 - RNA, 19 nt, Mycobacterium tuberculosis H37Rv
gcaacuacggcguccccga

SEQ ID NO: 1282496 - RNA, 18 nt, Mycobacterium tuberculosis H37Rv
gcaagacgcggucgacga

SEQ ID NO: 1282497 - RNA, 14 nt, Mycobacterium tuberculosis H37Rv
gcaagaaugccgcc

SEQ ID NO: 1282498 - RNA, 18 nt, Mycobacterium tuberculosis H37Rv
gcaagaaaguuccacgac

SEQ ID NO: 1282499 - RNA, 15 nt, Mycobacterium tuberculosis H37Rv
gcaacugcucgacga

SEQ ID NO: 1282500 - RNA, 15 nt, Mycobacterium tuberculosis H37Rv
gcaauggccagcacc

SEQ ID NO: 1282501 - RNA, 14 nt, Mycobacterium tuberculosis H37Rv
gcaaugcgcgcgau

SEQ ID NO: 1282502 - RNA, 21 nt, Mycobacterium tuberculosis H37Rv
gcaaugcguugaccgauacgc

SEQ ID NO: 1282503 - RNA, 15 nt, Mycobacterium tuberculosis H37Rv
gcaaugacuugcgac

SEQ ID NO: 1282504 - RNA, 13 nt, Mycobacterium tuberculosis H37Rv
gcaaugacggccu

SEQ ID NO: 1282505 - RNA, 18 nt, Mycobacterium tuberculosis H37Rv
gcaaugacuugcgacccg

SEQ ID NO: 1282506 - RNA, 15 nt, Mycobacterium tuberculosis H37Rv
gcaaugcccgaccgg

SEQ ID NO: 1282507 - RNA, 15 nt, Mycobacterium tuberculosis H37Rv
gcaaucggcggcacc

SEQ ID NO: 1282508 - RNA, 21 nt, Mycobacterium tuberculosis H37Rv
gcaaucucccgaaucgugcgg

SEQ ID NO: 1282509 - RNA, 12 nt, Mycobacterium tuberculosis H37Rv
gcacacugccgc

SEQ ID NO: 1282510 - RNA, 16 nt, Mycobacterium tuberculosis H37Rv
gcacacugaccccgcc

SEQ ID NO: 1282511 - RNA, 15 nt, Mycobacterium tuberculosis H37Rv
gcacaccgccagcgg

SEQ ID NO: 1282512 - RNA, 21 nt, Mycobacterium tuberculosis H37Rv
gcacaccggcacugcccagca

SEQ ID NO: 1282513 - RNA, 18 nt, Mycobacterium tuberculosis H37Rv
gcacaccgaggucgccaa

SEQ ID NO: 1282514 - RNA, 12 nt, Mycobacterium tuberculosis H37Rv
gcacaccgaucg

SEQ ID NO: 1282515 - RNA, 18 nt, Mycobacterium tuberculosis H37Rv
gcacaccccgguucgacg

SEQ ID NO: 1282516 - RNA, 17 nt, Mycobacterium tuberculosis H37Rv
gcacacccaucaccgcc

SEQ ID NO: 1282517 - RNA, 17 nt, Mycobacterium tuberculosis H37Rv
gcacaacugcgccagca

SEQ ID NO: 1282518 - RNA, 18 nt, Mycobacterium tuberculosis H37Rv
gcacaacugcgccagcaa

SEQ ID NO: 1282519 - RNA, 13 nt, Mycobacterium tuberculosis H37Rv
gcacaacgcccac

SEQ ID NO: 1282520 - RNA, 18 nt, Mycobacterium tuberculosis H37Rv
gcacaacgcgacgccgcu

SEQ ID NO: 1282521 - RNA, 20 nt, Mycobacterium tuberculosis H37Rv
gcacaacagaauucgaccgc

SEQ ID NO: 1282522 - RNA, 16 nt, Mycobacterium tuberculosis H37Rv
gcaauuccgccgagcg

SEQ ID NO: 1282523 - RNA, 17 nt, Mycobacterium tuberculosis H37Rv
gcaauuccacgaucggc

SEQ ID NO: 1282524 - RNA, 17 nt, Mycobacterium tuberculosis H37Rv
gcacaacccgucgagcc

SEQ ID NO: 1282525 - RNA, 12 nt, Mycobacterium tuberculosis H37Rv
gcacaacccguc

SEQ ID NO: 1282526 - RNA, 21 nt, Mycobacterium tuberculosis H37Rv
gcaagggccgacgucguuggc

SEQ ID NO: 1282527 - RNA, 12 nt, Mycobacterium tuberculosis H37Rv
gcaaggccagca

SEQ ID NO: 1282528 - RNA, 23 nt, Mycobacterium tuberculosis H37Rv
gcaaggccuugcguguaccagcc

SEQ ID NO: 1282529 - RNA, 21 nt, Mycobacterium tuberculosis H37Rv
gcaagugcgggcuguccgggc

SEQ ID NO: 1282530 - RNA, 23 nt, Mycobacterium tuberculosis H37Rv
gcaagugcggaacggccaggauc

SEQ ID NO: 1282531 - RNA, 17 nt, Mycobacterium tuberculosis H37Rv
gcaaguuccacgggugg

SEQ ID NO: 1282532 - RNA, 17 nt, Mycobacterium tuberculosis H37Rv
gcaaguccaccggaucg

SEQ ID NO: 1282533 - RNA, 14 nt, Mycobacterium tuberculosis H37Rv
gcaagucaacaccg

SEQ ID NO: 1282534 - RNA, 15 nt, Mycobacterium tuberculosis H37Rv
gcaaguccugcagcu

SEQ ID NO: 1282535 - RNA, 17 nt, Mycobacterium tuberculosis H37Rv
gcaaguccggucgcgga

SEQ ID NO: 1282536 - RNA, 15 nt, Mycobacterium tuberculosis H37Rv
gcaagucgcccagcc

SEQ ID NO: 1282537 - RNA, 20 nt, Mycobacterium tuberculosis H37Rv
gcaagucgcccagccgagcg

SEQ ID NO: 1282538 - RNA, 18 nt, Mycobacterium tuberculosis H37Rv
gcaaguucgucgggaucg

SEQ ID NO: 1282539 - RNA, 16 nt, Mycobacterium tuberculosis H37Rv
gcaaguucgucgggau

SEQ ID NO: 1282540 - RNA, 18 nt, Mycobacterium tuberculosis H37Rv
gcaauauccggccgagcc

SEQ ID NO: 1282541 - RNA, 20 nt, Mycobacterium tuberculosis H37Rv
gcaauauccggccgagccgu

SEQ ID NO: 1282542 - RNA, 14 nt, Mycobacterium tuberculosis H37Rv
gcaauaugccacag

SEQ ID NO: 1282543 - RNA, 17 nt, Mycobacterium tuberculosis H37Rv
gcaauagaccgcagucg

SEQ ID NO: 1282544 - RNA, 18 nt, Mycobacterium tuberculosis H37Rv
gcaauacguagucgccga

SEQ ID NO: 1282545 - RNA, 19 nt, Mycobacterium tuberculosis H37Rv
gcaauacguagucgccgau

SEQ ID NO: 1282546 - RNA, 21 nt, Mycobacterium tuberculosis H37Rv
gcaaucgcucugugucgccga

SEQ ID NO: 1282547 - RNA, 20 nt, Mycobacterium tuberculosis H37Rv
gcaaucgcgggcgauggcca

SEQ ID NO: 1282548 - RNA, 20 nt, Mycobacterium tuberculosis H37Rv
gcaaucaucucccgaccgcc

SEQ ID NO: 1282549 - RNA, 19 nt, Mycobacterium tuberculosis H37Rv
gcaaucaucucccgaccgc

SEQ ID NO: 1282550 - RNA, 14 nt, Mycobacterium tuberculosis H37Rv
gcaaucgaccacga

SEQ ID NO: 1282551 - RNA, 15 nt, Mycobacterium tuberculosis H37Rv
gcaaucgaccacgac

SEQ ID NO: 1282552 - RNA, 15 nt, Mycobacterium tuberculosis H37Rv
gaugcuucccggaug

SEQ ID NO: 1282553 - RNA, 18 nt, Mycobacterium tuberculosis H37Rv
gaugcuggucgugccgcc

SEQ ID NO: 1282554 - RNA, 18 nt, Mycobacterium tuberculosis H37Rv
gaugcgugccgacccgcu

SEQ ID NO: 1282555 - RNA, 17 nt, Mycobacterium tuberculosis H37Rv
gaugcgucucgcgcgau

SEQ ID NO: 1282556 - RNA, 22 nt, Mycobacterium tuberculosis H37Rv
gaugcguagacauuggcuccga

SEQ ID NO: 1282557 - RNA, 18 nt, Mycobacterium tuberculosis H37Rv
gaugcguagugcggcgug

SEQ ID NO: 1282558 - RNA, 20 nt, Mycobacterium tuberculosis H37Rv
gaugcgucacaccacgacgc

SEQ ID NO: 1282559 - RNA, 22 nt, Mycobacterium tuberculosis H37Rv
gaugcggucgucacggaccgcc

SEQ ID NO: 1282560 - RNA, 21 nt, Mycobacterium tuberculosis H37Rv
gauggccgccaguucuucggg

SEQ ID NO: 1282561 - RNA, 18 nt, Mycobacterium tuberculosis H37Rv
gauggccccgggcgguga

SEQ ID NO: 1282562 - RNA, 21 nt, Mycobacterium tuberculosis H37Rv
gauggcccggcucacagcaca

SEQ ID NO: 1282563 - RNA, 19 nt, Mycobacterium tuberculosis H37Rv
gauggccagcgcggcgucg

SEQ ID NO: 1282564 - RNA, 18 nt, Mycobacterium tuberculosis H37Rv
gauggccacggacccgaa

SEQ ID NO: 1282565 - RNA, 15 nt, Mycobacterium tuberculosis H37Rv
gaugcgggaaaccca

SEQ ID NO: 1282566 - RNA, 17 nt, Mycobacterium tuberculosis H37Rv
gaugcggucaacgcuga

SEQ ID NO: 1282567 - RNA, 15 nt, Mycobacterium tuberculosis H37Rv
gaugcgggcucggcu

SEQ ID NO: 1282568 - RNA, 18 nt, Mycobacterium tuberculosis H37Rv
gaugcggcuauuggccug

SEQ ID NO: 1282569 - RNA, 20 nt, Mycobacterium tuberculosis H37Rv
gaucuggccgaagcccgauc

SEQ ID NO: 1282570 - RNA, 16 nt, Mycobacterium tuberculosis H37Rv
gaucugcucgccgagc

SEQ ID NO: 1282571 - RNA, 12 nt, Mycobacterium tuberculosis H37Rv
gaucugcugcga

SEQ ID NO: 1282572 - RNA, 19 nt, Mycobacterium tuberculosis H37Rv
gaucuggcguucagcggcc

SEQ ID NO: 1282573 - RNA, 20 nt, Mycobacterium tuberculosis H37Rv
gaucuggcggauggccgccu

SEQ ID NO: 1282574 - RNA, 14 nt, Mycobacterium tuberculosis H37Rv
gaucuggcgcagca

SEQ ID NO: 1282575 - RNA, 23 nt, Mycobacterium tuberculosis H37Rv
gaucuggccuuggcaguccagcc

SEQ ID NO: 1282576 - RNA, 19 nt, Mycobacterium tuberculosis H37Rv
gaucugcguugcggcaaca

SEQ ID NO: 1282577 - RNA, 14 nt, Mycobacterium tuberculosis H37Rv
gaucugcucgccga

SEQ ID NO: 1282578 - RNA, 13 nt, Mycobacterium tuberculosis H37Rv
gaucugcgccauc

SEQ ID NO: 1282579 - RNA, 22 nt, Mycobacterium tuberculosis H37Rv
gaucugcgccaggggcaccaua

SEQ ID NO: 1282580 - RNA, 15 nt, Mycobacterium tuberculosis H37Rv
gaugucguucgcguc

SEQ ID NO: 1282581 - RNA, 15 nt, Mycobacterium tuberculosis H37Rv
gaugucucggcacca

SEQ ID NO: 1282582 - RNA, 14 nt, Mycobacterium tuberculosis H37Rv
gaugucgugcgggc

SEQ ID NO: 1282583 - RNA, 22 nt, Mycobacterium tuberculosis H37Rv
gaugucgugcgggcgcaccagg

SEQ ID NO: 1282584 - RNA, 16 nt, Mycobacterium tuberculosis H37Rv
gauguccggguaccga

SEQ ID NO: 1282585 - RNA, 17 nt, Mycobacterium tuberculosis H37Rv
gaugucccaugcacggc

SEQ ID NO: 1282586 - RNA, 12 nt, Mycobacterium tuberculosis H37Rv
gauguccgacgc

SEQ ID NO: 1282587 - RNA, 20 nt, Mycobacterium tuberculosis H37Rv
gauguccgcagcaccgucgg

SEQ ID NO: 1282588 - RNA, 20 nt, Mycobacterium tuberculosis H37Rv
gaugguguccucgucgaggu

SEQ ID NO: 1282589 - RNA, 18 nt, Mycobacterium tuberculosis H37Rv
gauggugugcccgcaccg

SEQ ID NO: 1282590 - RNA, 14 nt, Mycobacterium tuberculosis H37Rv
gaugguuggaucgc

SEQ ID NO: 1282591 - RNA, 15 nt, Mycobacterium tuberculosis H37Rv
gauguccagguggcg

SEQ ID NO: 1282592 - RNA, 23 nt, Mycobacterium tuberculosis H37Rv
gauguaaccguagcccugcucag

SEQ ID NO: 1282593 - RNA, 18 nt, Mycobacterium tuberculosis H37Rv
gaugguggugccaaccug

SEQ ID NO: 1282594 - RNA, 21 nt, Mycobacterium tuberculosis H37Rv
gaugguggugccaaccugggc

SEQ ID NO: 1282595 - RNA, 13 nt, Mycobacterium tuberculosis H37Rv
gaugguggugccg

SEQ ID NO: 1282596 - RNA, 20 nt, Mycobacterium tuberculosis H37Rv
gaugguggugccaaccuggg

SEQ ID NO: 1282597 - RNA, 22 nt, Mycobacterium tuberculosis H37Rv
gauggugcggcccaaccggucg

SEQ ID NO: 1282598 - RNA, 15 nt, Mycobacterium tuberculosis H37Rv
gauggcgucggccag

SEQ ID NO: 1282599 - RNA, 17 nt, Mycobacterium tuberculosis H37Rv
gaugggggagccgguga

SEQ ID NO: 1282600 - RNA, 19 nt, Mycobacterium tuberculosis H37Rv
gaugggggagccggugacg

SEQ ID NO: 1282601 - RNA, 17 nt, Mycobacterium tuberculosis H37Rv
gaugguagucgcgaccg

SEQ ID NO: 1282602 - RNA, 23 nt, Mycobacterium tuberculosis H37Rv
gaugguaccgccacuggcgcuga

SEQ ID NO: 1282603 - RNA, 12 nt, Mycobacterium tuberculosis H37Rv
gaugggugcacc

SEQ ID NO: 1282604 - RNA, 18 nt, Mycobacterium tuberculosis H37Rv
gauggcgauacgcgcguc

SEQ ID NO: 1282605 - RNA, 18 nt, Mycobacterium tuberculosis H37Rv
gauggcgcccugcgccac

SEQ ID NO: 1282606 - RNA, 19 nt, Mycobacterium tuberculosis H37Rv
gauggcgcgaucggugccg

SEQ ID NO: 1282607 - RNA, 20 nt, Mycobacterium tuberculosis H37Rv
gcaacaucggaugaccagug

SEQ ID NO: 1282608 - RNA, 15 nt, Mycobacterium tuberculosis H37Rv
gcaacacccgggcga

SEQ ID NO: 1282609 - RNA, 14 nt, Mycobacterium tuberculosis H37Rv
gcaacaccgcaccg

SEQ ID NO: 1282610 - RNA, 15 nt, Mycobacterium tuberculosis H37Rv
gcaacaccgcaccgg

SEQ ID NO: 1282611 - RNA, 15 nt, Mycobacterium tuberculosis H37Rv
gcaacaccgccaacu

SEQ ID NO: 1282612 - RNA, 15 nt, Mycobacterium tuberculosis H37Rv
gcaaccaccucgugg

SEQ ID NO: 1282613 - RNA, 22 nt, Mycobacterium tuberculosis H37Rv
gcaaccacgccccgaucgguga

SEQ ID NO: 1282614 - RNA, 18 nt, Mycobacterium tuberculosis H37Rv
gcaaccacgccccgaucg

SEQ ID NO: 1282615 - RNA, 17 nt, Mycobacterium tuberculosis H37Rv
gcaaccagcaaugccga

SEQ ID NO: 1282616 - RNA, 16 nt, Mycobacterium tuberculosis H37Rv
gcaacccacacgcccu

SEQ ID NO: 1282617 - RNA, 16 nt, Mycobacterium tuberculosis H37Rv
gcaaccacaucaccgg

SEQ ID NO: 1282618 - RNA, 22 nt, Mycobacterium tuberculosis H37Rv
gcaacccacacgcccucgacgc

SEQ ID NO: 1282619 - RNA, 15 nt, Mycobacterium tuberculosis H37Rv
gcaacaaagucgcca

SEQ ID NO: 1282620 - RNA, 14 nt, Mycobacterium tuberculosis H37Rv
gcaacacaccgaac

SEQ ID NO: 1282621 - RNA, 21 nt, Mycobacterium tuberculosis H37Rv
gcaacaccaccucgacgagca

SEQ ID NO: 1282622 - RNA, 21 nt, Mycobacterium tuberculosis H37Rv
gcaacaccaucagcgacaagu

SEQ ID NO: 1282623 - RNA, 19 nt, Mycobacterium tuberculosis H37Rv
gcaaagucgggggucgcac

SEQ ID NO: 1282624 - RNA, 15 nt, Mycobacterium tuberculosis H37Rv
gcaaagacgcuggcc

SEQ ID NO: 1282625 - RNA, 18 nt, Mycobacterium tuberculosis H37Rv
gcaaaccccggaccaucg

SEQ ID NO: 1282626 - RNA, 19 nt, Mycobacterium tuberculosis H37Rv
gcaaaccccggaccaucga

SEQ ID NO: 1282627 - RNA, 23 nt, Mycobacterium tuberculosis H37Rv
gcaaaccccggaccaucgacaac

SEQ ID NO: 1282628 - RNA, 13 nt, Mycobacterium tuberculosis H37Rv
gcaaagcagcgca

SEQ ID NO: 1282629 - RNA, 22 nt, Mycobacterium tuberculosis H37Rv
gcaaacagauucggugccagca

SEQ ID NO: 1282630 - RNA, 15 nt, Mycobacterium tuberculosis H37Rv
gcaaacaucgcaggc

SEQ ID NO: 1282631 - RNA, 20 nt, Mycobacterium tuberculosis H37Rv
gcaaaccagauugccgagcc

SEQ ID NO: 1282632 - RNA, 19 nt, Mycobacterium tuberculosis H37Rv
gcaaaccauugcgccugaa

SEQ ID NO: 1282633 - RNA, 23 nt, Mycobacterium tuberculosis H37Rv
gcaaacagauucggugccagcag

SEQ ID NO: 1282634 - RNA, 20 nt, Mycobacterium tuberculosis H37Rv
gcaaaaucgcccaauucggc

SEQ ID NO: 1282635 - RNA, 17 nt, Mycobacterium tuberculosis H37Rv
gcaaaauccccucgaca

SEQ ID NO: 1282636 - RNA, 13 nt, Mycobacterium tuberculosis H37Rv
gcaaaacacaccg

SEQ ID NO: 1282637 - RNA, 21 nt, Mycobacterium tuberculosis H37Rv
gauuccggcggccacgccggc

SEQ ID NO: 1282638 - RNA, 23 nt, Mycobacterium tuberculosis H37Rv
gauuccgaacuggucgacgccga

SEQ ID NO: 1282639 - RNA, 20 nt, Mycobacterium tuberculosis H37Rv
gauuccgcgucugcucgcga

SEQ ID NO: 1282640 - RNA, 15 nt, Mycobacterium tuberculosis H37Rv
gauucggugccagca

SEQ ID NO: 1282641 - RNA, 16 nt, Mycobacterium tuberculosis H37Rv
gauucguugucgagca

SEQ ID NO: 1282642 - RNA, 20 nt, Mycobacterium tuberculosis H37Rv
gaugugcgccaccucgacgc

SEQ ID NO: 1282643 - RNA, 21 nt, Mycobacterium tuberculosis H37Rv
gaugugcccggcucucagcga

SEQ ID NO: 1282644 - RNA, 19 nt, Mycobacterium tuberculosis H37Rv
gauuucggugacuccggcu

SEQ ID NO: 1282645 - RNA, 17 nt, Mycobacterium tuberculosis H37Rv
gauuggcgucagcagca

SEQ ID NO: 1282646 - RNA, 18 nt, Mycobacterium tuberculosis H37Rv
gauuucgcgucugcucgc

SEQ ID NO: 1282647 - RNA, 20 nt, Mycobacterium tuberculosis H37Rv
gauuucgcgucugcucgcca

SEQ ID NO: 1282648 - RNA, 20 nt, Mycobacterium tuberculosis H37Rv
gauucugugucugcucgcgc

SEQ ID NO: 1282649 - RNA, 21 nt, Mycobacterium tuberculosis H37Rv
gauucugugucugcucggcga

SEQ ID NO: 1282650 - RNA, 22 nt, Mycobacterium tuberculosis H37Rv
gauucuggucgaaauugggugc

SEQ ID NO: 1282651 - RNA, 16 nt, Mycobacterium tuberculosis H37Rv
gauucugcgucugcuc

SEQ ID NO: 1282652 - RNA, 17 nt, Mycobacterium tuberculosis H37Rv
gauucugcgucugcucg

SEQ ID NO: 1282653 - RNA, 11 nt, Mycobacterium tuberculosis H37Rv
gauugacggug

SEQ ID NO: 1282654 - RNA, 16 nt, Mycobacterium tuberculosis H37Rv
gauuggccaaccccau

SEQ ID NO: 1282655 - RNA, 20 nt, Mycobacterium tuberculosis H37Rv
gauugcuugggugccucgcc

SEQ ID NO: 1282656 - RNA, 15 nt, Mycobacterium tuberculosis H37Rv
cugggcggugaaggc

SEQ ID NO: 1282657 - RNA, 21 nt, Mycobacterium tuberculosis H37Rv
cuggggcggcaugcucaccga

SEQ ID NO: 1282658 - RNA, 18 nt, Mycobacterium tuberculosis H37Rv
cugggcgcgcucaucgac

SEQ ID NO: 1282659 - RNA, 18 nt, Mycobacterium tuberculosis H37Rv
cugggcccgccgucaccg

SEQ ID NO: 1282660 - RNA, 17 nt, Mycobacterium tuberculosis H37Rv
cuggguauccaccgcga

SEQ ID NO: 1282661 - RNA, 16 nt, Mycobacterium tuberculosis H37Rv
cuggguaguucaccgc

SEQ ID NO: 1282662 - RNA, 17 nt, Mycobacterium tuberculosis H37Rv
cugggguccggugacga

SEQ ID NO: 1282663 - RNA, 19 nt, Mycobacterium tuberculosis H37Rv
cugggguuggcucggcgca

SEQ ID NO: 1282664 - RNA, 21 nt, Mycobacterium tuberculosis H37Rv
cuggguuucaaagcgacagcg

SEQ ID NO: 1282665 - RNA, 19 nt, Mycobacterium tuberculosis H37Rv
cugggcaacauaggucaug

SEQ ID NO: 1282666 - RNA, 23 nt, Mycobacterium tuberculosis H37Rv
cugggcaaugacuugcgacccgu

SEQ ID NO: 1282667 - RNA, 13 nt, Mycobacterium tuberculosis H37Rv
cugggaucccgac

SEQ ID NO: 1282668 - RNA, 16 nt, Mycobacterium tuberculosis H37Rv
cugggauguucgauca

SEQ ID NO: 1282669 - RNA, 21 nt, Mycobacterium tuberculosis H37Rv
cugggauguucuuggucaccg

SEQ ID NO: 1282670 - RNA, 15 nt, Mycobacterium tuberculosis H37Rv
cuggccguuucggcg

SEQ ID NO: 1282671 - RNA, 18 nt, Mycobacterium tuberculosis H37Rv
cuggccggugcgcaggua

SEQ ID NO: 1282672 - RNA, 23 nt, Mycobacterium tuberculosis H37Rv
cugggcccccaaucagugcagcg

SEQ ID NO: 1282673 - RNA, 19 nt, Mycobacterium tuberculosis H37Rv
cugggcccgccgucaccgc

SEQ ID NO: 1282674 - RNA, 17 nt, Mycobacterium tuberculosis H37Rv
cugggccgacgggacaa

SEQ ID NO: 1282675 - RNA, 16 nt, Mycobacterium tuberculosis H37Rv
cugggccgagcgcgcc

SEQ ID NO: 1282676 - RNA, 16 nt, Mycobacterium tuberculosis H37Rv
cugggccaacacagcg

SEQ ID NO: 1282677 - RNA, 15 nt, Mycobacterium tuberculosis H37Rv
cugggcaucaccgac

SEQ ID NO: 1282678 - RNA, 17 nt, Mycobacterium tuberculosis H37Rv
cugggcaggaucgaggc

SEQ ID NO: 1282679 - RNA, 18 nt, Mycobacterium tuberculosis H37Rv
cugggcaucaccgacgcg

SEQ ID NO: 1282680 - RNA, 21 nt, Mycobacterium tuberculosis H37Rv
cugguugggggucgggcucgg

SEQ ID NO: 1282681 - RNA, 18 nt, Mycobacterium tuberculosis H37Rv
cugguugggagcuacggu

SEQ ID NO: 1282682 - RNA, 18 nt, Mycobacterium tuberculosis H37Rv
cugguugcgccacugcgu

SEQ ID NO: 1282683 - RNA, 20 nt, Mycobacterium tuberculosis H37Rv
cugguugcgcucauccgguu

SEQ ID NO: 1282684 - RNA, 16 nt, Mycobacterium tuberculosis H37Rv
cugguugaccucggug

SEQ ID NO: 1282685 - RNA, 20 nt, Mycobacterium tuberculosis H37Rv
cuggugugccgcguugccgg

SEQ ID NO: 1282686 - RNA, 20 nt, Mycobacterium tuberculosis H37Rv
cugguuaccgaaggucauca

SEQ ID NO: 1282687 - RNA, 22 nt, Mycobacterium tuberculosis H37Rv
cuggugucggcucgagucgcag

SEQ ID NO: 1282688 - RNA, 13 nt, Mycobacterium tuberculosis H37Rv
cuggugucgaucg

SEQ ID NO: 1282689 - RNA, 24 nt, Mycobacterium tuberculosis H37Rv
cugguguuucaggcagcggcgaca

SEQ ID NO: 1282690 - RNA, 14 nt, Mycobacterium tuberculosis H37Rv
cuggugcgcccgac

SEQ ID NO: 1282691 - RNA, 18 nt, Mycobacterium tuberculosis H37Rv
cuggugcgccacgccacc

SEQ ID NO: 1282692 - RNA, 21 nt, Mycobacterium tuberculosis H37Rv
cuggugcuacuggugugacga

SEQ ID NO: 1282693 - RNA, 22 nt, Mycobacterium tuberculosis H37Rv
cuggugcguagcccacccgggu

SEQ ID NO: 1282694 - RNA, 20 nt, Mycobacterium tuberculosis H37Rv
cuggugcagaauucggcgcg

SEQ ID NO: 1282695 - RNA, 22 nt, Mycobacterium tuberculosis H37Rv
cuggugcagaauucggcgcgac

SEQ ID NO: 1282696 - RNA, 23 nt, Mycobacterium tuberculosis H37Rv
cuggugcagaauucggcgcgaca

SEQ ID NO: 1282697 - RNA, 13 nt, Mycobacterium tuberculosis H37Rv
cuggugauggcca

SEQ ID NO: 1282698 - RNA, 18 nt, Mycobacterium tuberculosis H37Rv
cuggucgugccgccgucg

SEQ ID NO: 1282699 - RNA, 23 nt, Mycobacterium tuberculosis H37Rv
cuggucggugggcuugccgcgca

SEQ ID NO: 1282700 - RNA, 13 nt, Mycobacterium tuberculosis H37Rv
cuggucggcuucg

SEQ ID NO: 1282701 - RNA, 19 nt, Mycobacterium tuberculosis H37Rv
cuggucggcuaccgccgac

SEQ ID NO: 1282702 - RNA, 13 nt, Mycobacterium tuberculosis H37Rv
cuggucggccgca

SEQ ID NO: 1282703 - RNA, 14 nt, Mycobacterium tuberculosis H37Rv
cuggucgauggccu

SEQ ID NO: 1282704 - RNA, 18 nt, Mycobacterium tuberculosis H37Rv
cuggucgccgcggcagcg

SEQ ID NO: 1282705 - RNA, 16 nt, Mycobacterium tuberculosis H37Rv
cuggucgaccggcguu

SEQ ID NO: 1282706 - RNA, 15 nt, Mycobacterium tuberculosis H37Rv
cuggucgagcacgcu

SEQ ID NO: 1282707 - RNA, 19 nt, Mycobacterium tuberculosis H37Rv
cuggucgccaacgccagca

SEQ ID NO: 1282708 - RNA, 19 nt, Mycobacterium tuberculosis H37Rv
cugguagaggcggcgaugg

SEQ ID NO: 1282709 - RNA, 19 nt, Mycobacterium tuberculosis H37Rv
cugugacuaaggucacaga

SEQ ID NO: 1282710 - RNA, 14 nt, Mycobacterium tuberculosis H37Rv
cuguucccacaucg

SEQ ID NO: 1282711 - RNA, 14 nt, Mycobacterium tuberculosis H37Rv
cuguucccacaggc

SEQ ID NO: 1282712 - RNA, 19 nt, Mycobacterium tuberculosis H37Rv
cuguuccuugugaccccgg

SEQ ID NO: 1282713 - RNA, 21 nt, Mycobacterium tuberculosis H37Rv
cugucgccagggagcgcagcg

SEQ ID NO: 1282714 - RNA, 19 nt, Mycobacterium tuberculosis H37Rv
cugucguaccgcggaucgg

SEQ ID NO: 1282715 - RNA, 20 nt, Mycobacterium tuberculosis H37Rv
cugucgauuucgccgucgcu

SEQ ID NO: 1282716 - RNA, 22 nt, Mycobacterium tuberculosis H37Rv
cugucgugauacagcucggugc

SEQ ID NO: 1282717 - RNA, 23 nt, Mycobacterium tuberculosis H37Rv
cugucgugauacagcucggugca

SEQ ID NO: 1282718 - RNA, 20 nt, Mycobacterium tuberculosis H37Rv
cugucgucuuggcgaucggg

SEQ ID NO: 1282719 - RNA, 16 nt, Mycobacterium tuberculosis H37Rv
cugucgucuuggcgau

SEQ ID NO: 1282720 - RNA, 16 nt, Mycobacterium tuberculosis H37Rv
cugucguagcgcgaga

SEQ ID NO: 1282721 - RNA, 22 nt, Mycobacterium tuberculosis H37Rv
cugugacacccgagggccugac

SEQ ID NO: 1282722 - RNA, 15 nt, Mycobacterium tuberculosis H37Rv
cugucgacgucggca

SEQ ID NO: 1282723 - RNA, 20 nt, Mycobacterium tuberculosis H37Rv
cuguccgguggaauccacca

SEQ ID NO: 1282724 - RNA, 21 nt, Mycobacterium tuberculosis H37Rv
cuguccgaccucgccgcgcgu

SEQ ID NO: 1282725 - RNA, 16 nt, Mycobacterium tuberculosis H37Rv
cugucccgcacccggc

SEQ ID NO: 1282726 - RNA, 13 nt, Mycobacterium tuberculosis H37Rv
cuguaacacccgg

SEQ ID NO: 1282727 - RNA, 15 nt, Mycobacterium tuberculosis H37Rv
cugucauugcugccc

SEQ ID NO: 1282728 - RNA, 16 nt, Mycobacterium tuberculosis H37Rv
cugucauugcugccca

SEQ ID NO: 1282729 - RNA, 19 nt, Mycobacterium tuberculosis H37Rv
cuguacauacucugcgaca

SEQ ID NO: 1282730 - RNA, 21 nt, Mycobacterium tuberculosis H37Rv
cuguccaccgaugccacaucg

SEQ ID NO: 1282731 - RNA, 12 nt, Mycobacterium tuberculosis H37Rv
cuucaccgccgu

SEQ ID NO: 1282732 - RNA, 18 nt, Mycobacterium tuberculosis H37Rv
cuucacggucgacgauga

SEQ ID NO: 1282733 - RNA, 12 nt, Mycobacterium tuberculosis H37Rv
aaccggucagcc

SEQ ID NO: 1282734 - RNA, 19 nt, Mycobacterium tuberculosis H37Rv
cuuaucgaacgucucggcc

SEQ ID NO: 1282735 - RNA, 23 nt, Mycobacterium tuberculosis H37Rv
cuuagauagggguggcccguagc

SEQ ID NO: 1282736 - RNA, 15 nt, Mycobacterium tuberculosis H37Rv
cuuagcgcgaaagcg

SEQ ID NO: 1282737 - RNA, 14 nt, Mycobacterium tuberculosis H37Rv
cuuagcugccgucg

SEQ ID NO: 1282738 - RNA, 18 nt, Mycobacterium tuberculosis H37Rv
cuguuggccagccgacaa

SEQ ID NO: 1282739 - RNA, 14 nt, Mycobacterium tuberculosis H37Rv
cuguuggccagccg

SEQ ID NO: 1282740 - RNA, 19 nt, Mycobacterium tuberculosis H37Rv
cuguugacucugcguccac

SEQ ID NO: 1282741 - RNA, 23 nt, Mycobacterium tuberculosis H37Rv
cuguugacgccacgacgcccacc

SEQ ID NO: 1282742 - RNA, 16 nt, Mycobacterium tuberculosis H37Rv
cuugacggcgccaggc

SEQ ID NO: 1282743 - RNA, 23 nt, Mycobacterium tuberculosis H37Rv
cuugagcacacguccggcgauga

SEQ ID NO: 1282744 - RNA, 21 nt, Mycobacterium tuberculosis H37Rv
cuugagcaaaauggccaccgg

SEQ ID NO: 1282745 - RNA, 16 nt, Mycobacterium tuberculosis H37Rv
cuugagcuucucgucg

SEQ ID NO: 1282746 - RNA, 20 nt, Mycobacterium tuberculosis H37Rv
cuugagccgggcaaccagca

SEQ ID NO: 1282747 - RNA, 15 nt, Mycobacterium tuberculosis H37Rv
cuugaugcucgaugc

SEQ ID NO: 1282748 - RNA, 17 nt, Mycobacterium tuberculosis H37Rv
cuugaugcucgaugcga

SEQ ID NO: 1282749 - RNA, 14 nt, Mycobacterium tuberculosis H37Rv
cuugaugcucgaug

SEQ ID NO: 1282750 - RNA, 18 nt, Mycobacterium tuberculosis H37Rv
cuugauaacgacccucaa

SEQ ID NO: 1282751 - RNA, 13 nt, Mycobacterium tuberculosis H37Rv
cuugaucgagcag

SEQ ID NO: 1282752 - RNA, 19 nt, Mycobacterium tuberculosis H37Rv
cuugccgaccugcgcgacg

SEQ ID NO: 1282753 - RNA, 16 nt, Mycobacterium tuberculosis H37Rv
cuugccgaccggucag

SEQ ID NO: 1282754 - RNA, 15 nt, Mycobacterium tuberculosis H37Rv
cuugccgaucgccga

SEQ ID NO: 1282755 - RNA, 13 nt, Mycobacterium tuberculosis H37Rv
cuugcccgacggc

SEQ ID NO: 1282756 - RNA, 16 nt, Mycobacterium tuberculosis H37Rv
cuugcccagcgacaug

SEQ ID NO: 1282757 - RNA, 21 nt, Mycobacterium tuberculosis H37Rv
cuugcaguaacuucaccggcu

SEQ ID NO: 1282758 - RNA, 14 nt, Mycobacterium tuberculosis H37Rv
cuugcagcgcguuc

SEQ ID NO: 1282759 - RNA, 23 nt, Mycobacterium tuberculosis H37Rv
cuugccggguuugaucagcucgg

SEQ ID NO: 1282760 - RNA, 21 nt, Mycobacterium tuberculosis H37Rv
cuugcgaaacgaauccgccau

SEQ ID NO: 1282761 - RNA, 16 nt, Mycobacterium tuberculosis H37Rv
cuugccgucgcugacg

SEQ ID NO: 1282762 - RNA, 17 nt, Mycobacterium tuberculosis H37Rv
cuugccgucuucgccgc

SEQ ID NO: 1282763 - RNA, 19 nt, Mycobacterium tuberculosis H37Rv
cuugccgucuucgccgcca

SEQ ID NO: 1282764 - RNA, 16 nt, Mycobacterium tuberculosis H37Rv
cuugcgaucgccgcua

SEQ ID NO: 1282765 - RNA, 16 nt, Mycobacterium tuberculosis H37Rv
cuugcgcagcaccggu

SEQ ID NO: 1282766 - RNA, 21 nt, Mycobacterium tuberculosis H37Rv
cuugcgcagccgcagccgguu

SEQ ID NO: 1282767 - RNA, 20 nt, Mycobacterium tuberculosis H37Rv
cuugguggucuuggccggug

SEQ ID NO: 1282768 - RNA, 14 nt, Mycobacterium tuberculosis H37Rv
cuugguggccacca

SEQ ID NO: 1282769 - RNA, 23 nt, Mycobacterium tuberculosis H37Rv
cuuggugaagaucgacacccguu

SEQ ID NO: 1282770 - RNA, 16 nt, Mycobacterium tuberculosis H37Rv
cuuggcgacgucgcgg

SEQ ID NO: 1282771 - RNA, 16 nt, Mycobacterium tuberculosis H37Rv
cuuggccucagccacc

SEQ ID NO: 1282772 - RNA, 15 nt, Mycobacterium tuberculosis H37Rv
cuuggccucagccac

SEQ ID NO: 1282773 - RNA, 15 nt, Mycobacterium tuberculosis H37Rv
cuuggccguucggcg

SEQ ID NO: 1282774 - RNA, 14 nt, Mycobacterium tuberculosis H37Rv
cuugcggcagacca

SEQ ID NO: 1282775 - RNA, 14 nt, Mycobacterium tuberculosis H37Rv
cuugcggagccgcc

SEQ ID NO: 1282776 - RNA, 22 nt, Mycobacterium tuberculosis H37Rv
cuugcggcacccagucggcgcc

SEQ ID NO: 1282777 - RNA, 17 nt, Mycobacterium tuberculosis H37Rv
cuugcgggcucucggcg

SEQ ID NO: 1282778 - RNA, 14 nt, Mycobacterium tuberculosis H37Rv
cuugcggcugccca

SEQ ID NO: 1282779 - RNA, 16 nt, Mycobacterium tuberculosis H37Rv
cuuggccaucacggcg

SEQ ID NO: 1282780 - RNA, 16 nt, Mycobacterium tuberculosis H37Rv
cuucggcgagcguacc

SEQ ID NO: 1282781 - RNA, 19 nt, Mycobacterium tuberculosis H37Rv
cuucggcgaucgucucggu

SEQ ID NO: 1282782 - RNA, 21 nt, Mycobacterium tuberculosis H37Rv
cuucggcgaucgucucgguga

SEQ ID NO: 1282783 - RNA, 18 nt, Mycobacterium tuberculosis H37Rv
cuucggccaaccaugcug

SEQ ID NO: 1282784 - RNA, 17 nt, Mycobacterium tuberculosis H37Rv
cuucgccggaccccgag

SEQ ID NO: 1282785 - RNA, 18 nt, Mycobacterium tuberculosis H37Rv
cuucgccgaguugaccgc

SEQ ID NO: 1282786 - RNA, 13 nt, Mycobacterium tuberculosis H37Rv
cuucgccgaagcg

SEQ ID NO: 1282787 - RNA, 16 nt, Mycobacterium tuberculosis H37Rv
cuucgauaccgaccga

SEQ ID NO: 1282788 - RNA, 18 nt, Mycobacterium tuberculosis H37Rv
cuucgacgcggcgaccgu

SEQ ID NO: 1282789 - RNA, 15 nt, Mycobacterium tuberculosis H37Rv
cuucgauaccgaccg

SEQ ID NO: 1282790 - RNA, 14 nt, Mycobacterium tuberculosis H37Rv
cuucgauaccgacc

SEQ ID NO: 1282791 - RNA, 15 nt, Mycobacterium tuberculosis H37Rv
cuuccguggcccaac

SEQ ID NO: 1282792 - RNA, 15 nt, Mycobacterium tuberculosis H37Rv
cuucacugcgaccgu

SEQ ID NO: 1282793 - RNA, 16 nt, Mycobacterium tuberculosis H37Rv
cuucggccgaccgggc

SEQ ID NO: 1282794 - RNA, 18 nt, Mycobacterium tuberculosis H37Rv
cuucucggacacgcugua

SEQ ID NO: 1282795 - RNA, 21 nt, Mycobacterium tuberculosis H37Rv
cuucugggguuggcucggcgc

SEQ ID NO: 1282796 - RNA, 19 nt, Mycobacterium tuberculosis H37Rv
cuucucgucggugcgcgcg

SEQ ID NO: 1282797 - RNA, 22 nt, Mycobacterium tuberculosis H37Rv
cuucuuggcggccuuugucgcc

SEQ ID NO: 1282798 - RNA, 22 nt, Mycobacterium tuberculosis H37Rv
cuucuugacacccaccucgcca

SEQ ID NO: 1282799 - RNA, 23 nt, Mycobacterium tuberculosis H37Rv
cuugaaacggugucucgcccacc

SEQ ID NO: 1282800 - RNA, 14 nt, Mycobacterium tuberculosis H37Rv
cuugaccgcaccgg

SEQ ID NO: 1282801 - RNA, 14 nt, Mycobacterium tuberculosis H37Rv
cuugaccgcgguga

SEQ ID NO: 1282802 - RNA, 22 nt, Mycobacterium tuberculosis H37Rv
cugcgcucgggcugccgcaugc

SEQ ID NO: 1282803 - RNA, 17 nt, Mycobacterium tuberculosis H37Rv
cugcgcuguucggcacg

SEQ ID NO: 1282804 - RNA, 13 nt, Mycobacterium tuberculosis H37Rv
cugcggacuggca

SEQ ID NO: 1282805 - RNA, 20 nt, Mycobacterium tuberculosis H37Rv
cugcggaaaugaccuccugg

SEQ ID NO: 1282806 - RNA, 17 nt, Mycobacterium tuberculosis H37Rv
cugcgcuuugcacagcg

SEQ ID NO: 1282807 - RNA, 22 nt, Mycobacterium tuberculosis H37Rv
cugcgcggcuucgucgacaucg

SEQ ID NO: 1282808 - RNA, 23 nt, Mycobacterium tuberculosis H37Rv
cugcgcgcggccgcgcugcagca

SEQ ID NO: 1282809 - RNA, 19 nt, Mycobacterium tuberculosis H37Rv
cugcgcgucgagcagcacc

SEQ ID NO: 1282810 - RNA, 18 nt, Mycobacterium tuberculosis H37Rv
cugcgcgucgagcagcac

SEQ ID NO: 1282811 - RNA, 17 nt, Mycobacterium tuberculosis H37Rv
cugcgcgucgagcgacc

SEQ ID NO: 1282812 - RNA, 22 nt, Mycobacterium tuberculosis H37Rv
cugcgcgggcgaguagucgacg

SEQ ID NO: 1282813 - RNA, 19 nt, Mycobacterium tuberculosis H37Rv
cugcggcaacggcucgucg

SEQ ID NO: 1282814 - RNA, 11 nt, Mycobacterium tuberculosis H37Rv
cugcggcacca

SEQ ID NO: 1282815 - RNA, 15 nt, Mycobacterium tuberculosis H37Rv
cugcggccagcgcgg

SEQ ID NO: 1282816 - RNA, 17 nt, Mycobacterium tuberculosis H37Rv
cugcggcccgacccggc

SEQ ID NO: 1282817 - RNA, 19 nt, Mycobacterium tuberculosis H37Rv
cugcggcccaugaucucgg

SEQ ID NO: 1282818 - RNA, 15 nt, Mycobacterium tuberculosis H37Rv
cugcgggaggcagcg

SEQ ID NO: 1282819 - RNA, 22 nt, Mycobacterium tuberculosis H37Rv
cugcgggaaguugcccagguga

SEQ ID NO: 1282820 - RNA, 19 nt, Mycobacterium tuberculosis H37Rv
cugcggcggccauucgguc

SEQ ID NO: 1282821 - RNA, 20 nt, Mycobacterium tuberculosis H37Rv
cugcggcuccggcggcagcg

SEQ ID NO: 1282822 - RNA, 18 nt, Mycobacterium tuberculosis H37Rv
cugcggccugcucgacca

SEQ ID NO: 1282823 - RNA, 23 nt, Mycobacterium tuberculosis H37Rv
cugcgccuaaccccggcucgacg

SEQ ID NO: 1282824 - RNA, 15 nt, Mycobacterium tuberculosis H37Rv
cugcgccguucgcuc

SEQ ID NO: 1282825 - RNA, 16 nt, Mycobacterium tuberculosis H37Rv
cugcgccgccacagca

SEQ ID NO: 1282826 - RNA, 13 nt, Mycobacterium tuberculosis H37Rv
cugcgcgccguuc

SEQ ID NO: 1282827 - RNA, 15 nt, Mycobacterium tuberculosis H37Rv
cugcgcgauggccgu

SEQ ID NO: 1282828 - RNA, 14 nt, Mycobacterium tuberculosis H37Rv
cugcgcgauggccg

SEQ ID NO: 1282829 - RNA, 17 nt, Mycobacterium tuberculosis H37Rv
cugcgcgaccgaccagc

SEQ ID NO: 1282830 - RNA, 18 nt, Mycobacterium tuberculosis H37Rv
cugcgcgaccgaccagcc

SEQ ID NO: 1282831 - RNA, 14 nt, Mycobacterium tuberculosis H37Rv
cugcgcgaccgacc

SEQ ID NO: 1282832 - RNA, 19 nt, Mycobacterium tuberculosis H37Rv
cugcgcgaaggggacgugc

SEQ ID NO: 1282833 - RNA, 18 nt, Mycobacterium tuberculosis H37Rv
cugcgcgaagccaccagg

SEQ ID NO: 1282834 - RNA, 14 nt, Mycobacterium tuberculosis H37Rv
cugcgcaccaaggc

SEQ ID NO: 1282835 - RNA, 17 nt, Mycobacterium tuberculosis H37Rv
cugcgcagccgccucaa

SEQ ID NO: 1282836 - RNA, 14 nt, Mycobacterium tuberculosis H37Rv
cugcgcagcgcaac

SEQ ID NO: 1282837 - RNA, 12 nt, Mycobacterium tuberculosis H37Rv
cugcgcagcgca

SEQ ID NO: 1282838 - RNA, 18 nt, Mycobacterium tuberculosis H37Rv
cugcgcaucaccacuggc

SEQ ID NO: 1282839 - RNA, 14 nt, Mycobacterium tuberculosis H37Rv
cugcgcaucaccac

SEQ ID NO: 1282840 - RNA, 20 nt, Mycobacterium tuberculosis H37Rv
cugcgcagugacgccucgac

SEQ ID NO: 1282841 - RNA, 15 nt, Mycobacterium tuberculosis H37Rv
cugcgcagcgccugc

SEQ ID NO: 1282842 - RNA, 13 nt, Mycobacterium tuberculosis H37Rv
cugcgcagcggca

SEQ ID NO: 1282843 - RNA, 18 nt, Mycobacterium tuberculosis H37Rv
cugcgccacagcagcguu

SEQ ID NO: 1282844 - RNA, 17 nt, Mycobacterium tuberculosis H37Rv
cugcgccaggaauugcc

SEQ ID NO: 1282845 - RNA, 17 nt, Mycobacterium tuberculosis H37Rv
cugcgccacgucgacgg

SEQ ID NO: 1282846 - RNA, 14 nt, Mycobacterium tuberculosis H37Rv
cugcgccagaaucc

SEQ ID NO: 1282847 - RNA, 18 nt, Mycobacterium tuberculosis H37Rv
cugcgccagaaucccgcu

SEQ ID NO: 1282848 - RNA, 14 nt, Mycobacterium tuberculosis H37Rv
cugcgcagccgccu

SEQ ID NO: 1282849 - RNA, 22 nt, Mycobacterium tuberculosis H37Rv
cugcgccgaacaccacaccgag

SEQ ID NO: 1282850 - RNA, 14 nt, Mycobacterium tuberculosis H37Rv
cugcgccgaacacc

SEQ ID NO: 1282851 - RNA, 15 nt, Mycobacterium tuberculosis H37Rv
cugcgcccgccacgu

SEQ ID NO: 1282852 - RNA, 17 nt, Mycobacterium tuberculosis H37Rv
cugcgccagcaacagcg

SEQ ID NO: 1282853 - RNA, 20 nt, Mycobacterium tuberculosis H37Rv
cugcgccaucacaucggccu

SEQ ID NO: 1282854 - RNA, 20 nt, Mycobacterium tuberculosis H37Rv
cugcgacgagcccaccgucg

SEQ ID NO: 1282855 - RNA, 18 nt, Mycobacterium tuberculosis H37Rv
cugcgaccgucccggccu

SEQ ID NO: 1282856 - RNA, 23 nt, Mycobacterium tuberculosis H37Rv
cugcgacguuaacugcgccuaac

SEQ ID NO: 1282857 - RNA, 22 nt, Mycobacterium tuberculosis H37Rv
cugcgacuaagggcacuccacc

SEQ ID NO: 1282858 - RNA, 16 nt, Mycobacterium tuberculosis H37Rv
cugcgagcgcagcgca

SEQ ID NO: 1282859 - RNA, 14 nt, Mycobacterium tuberculosis H37Rv
cugcgauuuucggc

SEQ ID NO: 1282860 - RNA, 18 nt, Mycobacterium tuberculosis H37Rv
cugcgaacacgcgaugac

SEQ ID NO: 1282861 - RNA, 16 nt, Mycobacterium tuberculosis H37Rv
cugcgacaagaccggc

SEQ ID NO: 1282862 - RNA, 15 nt, Mycobacterium tuberculosis H37Rv
cugcgaaacgcuggc

SEQ ID NO: 1282863 - RNA, 15 nt, Mycobacterium tuberculosis H37Rv
cugccgggcgcgcgu

SEQ ID NO: 1282864 - RNA, 16 nt, Mycobacterium tuberculosis H37Rv
cugccggucgaugucg

SEQ ID NO: 1282865 - RNA, 17 nt, Mycobacterium tuberculosis H37Rv
cugccggucgaugucgg

SEQ ID NO: 1282866 - RNA, 14 nt, Mycobacterium tuberculosis H37Rv
cugccggugggcgu

SEQ ID NO: 1282867 - RNA, 19 nt, Mycobacterium tuberculosis H37Rv
cugccgguuuccgucugac

SEQ ID NO: 1282868 - RNA, 19 nt, Mycobacterium tuberculosis H37Rv
cugccgucagccguucggc

SEQ ID NO: 1282869 - RNA, 12 nt, Mycobacterium tuberculosis H37Rv
cugccguucggg

SEQ ID NO: 1282870 - RNA, 15 nt, Mycobacterium tuberculosis H37Rv
cugccgucucgucgg

SEQ ID NO: 1282871 - RNA, 17 nt, Mycobacterium tuberculosis H37Rv
cugccucuugcucggcg

SEQ ID NO: 1282872 - RNA, 18 nt, Mycobacterium tuberculosis H37Rv
cugccucucagcacgguu

SEQ ID NO: 1282873 - RNA, 17 nt, Mycobacterium tuberculosis H37Rv
cugccucaccgccgcua

SEQ ID NO: 1282874 - RNA, 14 nt, Mycobacterium tuberculosis H37Rv
cugccgagcagacg

SEQ ID NO: 1282875 - RNA, 21 nt, Mycobacterium tuberculosis H37Rv
cugccgcaccggugcucgucg

SEQ ID NO: 1282876 - RNA, 13 nt, Mycobacterium tuberculosis H37Rv
cugccgcacccgg

SEQ ID NO: 1282877 - RNA, 14 nt, Mycobacterium tuberculosis H37Rv
cugccgcacccggu

SEQ ID NO: 1282878 - RNA, 21 nt, Mycobacterium tuberculosis H37Rv
cugccgaucgggcucacucgc

SEQ ID NO: 1282879 - RNA, 17 nt, Mycobacterium tuberculosis H37Rv
cugccgcugccgaagcg

SEQ ID NO: 1282880 - RNA, 20 nt, Mycobacterium tuberculosis H37Rv
cugccgcguagaacccaggc

SEQ ID NO: 1282881 - RNA, 14 nt, Mycobacterium tuberculosis H37Rv
cugccgcgcgcugc

SEQ ID NO: 1282882 - RNA, 20 nt, Mycobacterium tuberculosis H37Rv
cugccgccggugccgccauu

SEQ ID NO: 1282883 - RNA, 14 nt, Mycobacterium tuberculosis H37Rv
cugccgcggcaccg

SEQ ID NO: 1282884 - RNA, 14 nt, Mycobacterium tuberculosis H37Rv
cugccgcgccgacg

SEQ ID NO: 1282885 - RNA, 13 nt, Mycobacterium tuberculosis H37Rv
cugccggcugaca

SEQ ID NO: 1282886 - RNA, 14 nt, Mycobacterium tuberculosis H37Rv
cugccggcccacca

SEQ ID NO: 1282887 - RNA, 18 nt, Mycobacterium tuberculosis H37Rv
cugccggcaacagcucgc

SEQ ID NO: 1282888 - RNA, 17 nt, Mycobacterium tuberculosis H37Rv
cugccggcacgcaugcc

SEQ ID NO: 1282889 - RNA, 15 nt, Mycobacterium tuberculosis H37Rv
cugccggcagcgucc

SEQ ID NO: 1282890 - RNA, 17 nt, Mycobacterium tuberculosis H37Rv
cugccggcagcguccga

SEQ ID NO: 1282891 - RNA, 14 nt, Mycobacterium tuberculosis H37Rv
cugccggcagcguc

SEQ ID NO: 1282892 - RNA, 17 nt, Mycobacterium tuberculosis H37Rv
cugcgugcagaucacgg

SEQ ID NO: 1282893 - RNA, 19 nt, Mycobacterium tuberculosis H37Rv
cugcguugcggcaacagcg

SEQ ID NO: 1282894 - RNA, 21 nt, Mycobacterium tuberculosis H37Rv
cugcguugggaucccagcgca

SEQ ID NO: 1282895 - RNA, 23 nt, Mycobacterium tuberculosis H37Rv
cugcguuggaauguccggcagcg

SEQ ID NO: 1282896 - RNA, 20 nt, Mycobacterium tuberculosis H37Rv
cugcucccgaaaagcgccuc

SEQ ID NO: 1282897 - RNA, 19 nt, Mycobacterium tuberculosis H37Rv
cugcuccaccgucgaacca

SEQ ID NO: 1282898 - RNA, 18 nt, Mycobacterium tuberculosis H37Rv
aaccgcgugcgucagcgc

SEQ ID NO: 1282899 - RNA, 17 nt, Mycobacterium tuberculosis H37Rv
aaccgcgucgaagccgg

SEQ ID NO: 1282900 - RNA, 14 nt, Mycobacterium tuberculosis H37Rv
cugcuccucggcca

SEQ ID NO: 1282901 - RNA, 19 nt, Mycobacterium tuberculosis H37Rv
cugcuccgcugucaccccu

SEQ ID NO: 1282902 - RNA, 17 nt, Mycobacterium tuberculosis H37Rv
cugcggugccacgguga

SEQ ID NO: 1282903 - RNA, 20 nt, Mycobacterium tuberculosis H37Rv
cugcggugcaggauucggcg

SEQ ID NO: 1282904 - RNA, 21 nt, Mycobacterium tuberculosis H37Rv
cugcgucugcucggcgcggug

SEQ ID NO: 1282905 - RNA, 19 nt, Mycobacterium tuberculosis H37Rv
cugcgucugcucgcgggua

SEQ ID NO: 1282906 - RNA, 15 nt, Mycobacterium tuberculosis H37Rv
cugcgucugcucgcg

SEQ ID NO: 1282907 - RNA, 17 nt, Mycobacterium tuberculosis H37Rv
cugcgucggcccgcggu

SEQ ID NO: 1282908 - RNA, 23 nt, Mycobacterium tuberculosis H37Rv
cugcggguaggugacgacgucgu

SEQ ID NO: 1282909 - RNA, 23 nt, Mycobacterium tuberculosis H37Rv
cugcggguagccgucgaucccgg

SEQ ID NO: 1282910 - RNA, 16 nt, Mycobacterium tuberculosis H37Rv
cugcggucgcccaggc

SEQ ID NO: 1282911 - RNA, 17 nt, Mycobacterium tuberculosis H37Rv
cugcggucgcggcugac

SEQ ID NO: 1282912 - RNA, 18 nt, Mycobacterium tuberculosis H37Rv
cugcgguaaucgccaccg

SEQ ID NO: 1282913 - RNA, 18 nt, Mycobacterium tuberculosis H37Rv
cugcgguacugagccgcg

SEQ ID NO: 1282914 - RNA, 14 nt, Mycobacterium tuberculosis H37Rv
cugcgggucggcca

SEQ ID NO: 1282915 - RNA, 20 nt, Mycobacterium tuberculosis H37Rv
cugcggguucacuuccgggc

SEQ ID NO: 1282916 - RNA, 19 nt, Mycobacterium tuberculosis H37Rv
cugcugagccgucggcgcc

SEQ ID NO: 1282917 - RNA, 19 nt, Mycobacterium tuberculosis H37Rv
cugcucuccgucgcucacg

SEQ ID NO: 1282918 - RNA, 23 nt, Mycobacterium tuberculosis H37Rv
cugcucguggguaccgagcagca

SEQ ID NO: 1282919 - RNA, 18 nt, Mycobacterium tuberculosis H37Rv
cugcucgucuuggcggcg

SEQ ID NO: 1282920 - RNA, 22 nt, Mycobacterium tuberculosis H37Rv
cugcucggucaggcggcuggcc

SEQ ID NO: 1282921 - RNA, 14 nt, Mycobacterium tuberculosis H37Rv
cugcugcggcagcg

SEQ ID NO: 1282922 - RNA, 18 nt, Mycobacterium tuberculosis H37Rv
cugcugccauugccgaug

SEQ ID NO: 1282923 - RNA, 16 nt, Mycobacterium tuberculosis H37Rv
cugcucggagagcagc

SEQ ID NO: 1282924 - RNA, 22 nt, Mycobacterium tuberculosis H37Rv
cugcucggcgcuagcugcugau

SEQ ID NO: 1282925 - RNA, 16 nt, Mycobacterium tuberculosis H37Rv
cugcucggcgcggugg

SEQ ID NO: 1282926 - RNA, 12 nt, Mycobacterium tuberculosis H37Rv
cugcucggcgca

SEQ ID NO: 1282927 - RNA, 14 nt, Mycobacterium tuberculosis H37Rv
cugcucggcggccu

SEQ ID NO: 1282928 - RNA, 23 nt, Mycobacterium tuberculosis H37Rv
cugcucgccccaugucaagcgau

SEQ ID NO: 1282929 - RNA, 15 nt, Mycobacterium tuberculosis H37Rv
cugcucgccaggcaa

SEQ ID NO: 1282930 - RNA, 23 nt, Mycobacterium tuberculosis H37Rv
aaccgcugcggguagccgucgau

SEQ ID NO: 1282931 - RNA, 23 nt, Mycobacterium tuberculosis H37Rv
aaccgcucagcgcagcaucgucg

SEQ ID NO: 1282932 - RNA, 22 nt, Mycobacterium tuberculosis H37Rv
aaccgcucagcgcagcaucguc

SEQ ID NO: 1282933 - RNA, 17 nt, Mycobacterium tuberculosis H37Rv
aaccgcugauagcgguc

SEQ ID NO: 1282934 - RNA, 21 nt, Mycobacterium tuberculosis H37Rv
aaccgcucggcgaugauguug

SEQ ID NO: 1282935 - RNA, 15 nt, Mycobacterium tuberculosis H37Rv
aaccggaucaucgcc

SEQ ID NO: 1282936 - RNA, 23 nt, Mycobacterium tuberculosis H37Rv
cugcucgaucaucgggagccgca

SEQ ID NO: 1282937 - RNA, 18 nt, Mycobacterium tuberculosis H37Rv
cugcuggugucggcucga

SEQ ID NO: 1282938 - RNA, 16 nt, Mycobacterium tuberculosis H37Rv
cugcugugggauucgg

SEQ ID NO: 1282939 - RNA, 19 nt, Mycobacterium tuberculosis H37Rv
cugcugucaccgcaaccga

SEQ ID NO: 1282940 - RNA, 13 nt, Mycobacterium tuberculosis H37Rv
cugcuggcuggga

SEQ ID NO: 1282941 - RNA, 20 nt, Mycobacterium tuberculosis H37Rv
cugcuggaucgucucgcgca

SEQ ID NO: 1282942 - RNA, 16 nt, Mycobacterium tuberculosis H37Rv
cugcuggaucucggug

SEQ ID NO: 1282943 - RNA, 16 nt, Mycobacterium tuberculosis H37Rv
cugcuggaagccgucu

SEQ ID NO: 1282944 - RNA, 23 nt, Mycobacterium tuberculosis H37Rv
cugcuuggucgcccagccacuga

SEQ ID NO: 1282945 - RNA, 22 nt, Mycobacterium tuberculosis H37Rv
cugcuucuccgagaucagcggc

SEQ ID NO: 1282946 - RNA, 22 nt, Mycobacterium tuberculosis H37Rv
cugcuugguggucuuggccggu

SEQ ID NO: 1282947 - RNA, 14 nt, Mycobacterium tuberculosis H37Rv
cuggccagguugcc

SEQ ID NO: 1282948 - RNA, 17 nt, Mycobacterium tuberculosis H37Rv
cuggccagguggccgca

SEQ ID NO: 1282949 - RNA, 17 nt, Mycobacterium tuberculosis H37Rv
cuggcauaucccuugcc

SEQ ID NO: 1282950 - RNA, 14 nt, Mycobacterium tuberculosis H37Rv
cuggcaugccggcg

SEQ ID NO: 1282951 - RNA, 20 nt, Mycobacterium tuberculosis H37Rv
cuggccggguuccagcggca

SEQ ID NO: 1282952 - RNA, 22 nt, Mycobacterium tuberculosis H37Rv
cuggccgcccggcgagcagggc

SEQ ID NO: 1282953 - RNA, 22 nt, Mycobacterium tuberculosis H37Rv
cuggccgcccagaccgccgacg

SEQ ID NO: 1282954 - RNA, 22 nt, Mycobacterium tuberculosis H37Rv
cuggccgccagauuggcgcugc

SEQ ID NO: 1282955 - RNA, 20 nt, Mycobacterium tuberculosis H37Rv
cuggaccgcggugacccgga

SEQ ID NO: 1282956 - RNA, 21 nt, Mycobacterium tuberculosis H37Rv
cuggaucgugccgaacacggu

SEQ ID NO: 1282957 - RNA, 19 nt, Mycobacterium tuberculosis H37Rv
cuggaucgacuucggugga

SEQ ID NO: 1282958 - RNA, 19 nt, Mycobacterium tuberculosis H37Rv
cuggacuuccgguucaucg

SEQ ID NO: 1282959 - RNA, 17 nt, Mycobacterium tuberculosis H37Rv
cuggaucgcgauggccu

SEQ ID NO: 1282960 - RNA, 12 nt, Mycobacterium tuberculosis H37Rv
cuggaugccgau

SEQ ID NO: 1282961 - RNA, 20 nt, Mycobacterium tuberculosis H37Rv
cuggauggcgcccugcgcca

SEQ ID NO: 1282962 - RNA, 16 nt, Mycobacterium tuberculosis H37Rv
gaaauccuccuccgca

SEQ ID NO: 1282963 - RNA, 22 nt, Mycobacterium tuberculosis H37Rv
gaaaucgucggguaccagcacc

SEQ ID NO: 1282964 - RNA, 13 nt, Mycobacterium tuberculosis H37Rv
gaacaccacaccg

SEQ ID NO: 1282965 - RNA, 14 nt, Mycobacterium tuberculosis H37Rv
gaacaccaccaggc

SEQ ID NO: 1282966 - RNA, 21 nt, Mycobacterium tuberculosis H37Rv
gaacaccgccgcgucgagcac

SEQ ID NO: 1282967 - RNA, 16 nt, Mycobacterium tuberculosis H37Rv
gaacaccgccgcgucg

SEQ ID NO: 1282968 - RNA, 22 nt, Mycobacterium tuberculosis H37Rv
gaacaccgaggcgaccggaccg

SEQ ID NO: 1282969 - RNA, 23 nt, Mycobacterium tuberculosis H37Rv
gaacaccgaggcgaccggaccga

SEQ ID NO: 1282970 - RNA, 22 nt, Mycobacterium tuberculosis H37Rv
gaacagacggcucagcgugcgc

SEQ ID NO: 1282971 - RNA, 15 nt, Mycobacterium tuberculosis H37Rv
gaacagcaccgccgg

SEQ ID NO: 1282972 - RNA, 14 nt, Mycobacterium tuberculosis H37Rv
gaacagccccaggg

SEQ ID NO: 1282973 - RNA, 18 nt, Mycobacterium tuberculosis H37Rv
gaacagcuucgcgcagcc

SEQ ID NO: 1282974 - RNA, 15 nt, Mycobacterium tuberculosis H37Rv
gaacagcagguuggc

SEQ ID NO: 1282975 - RNA, 23 nt, Mycobacterium tuberculosis H37Rv
gaacaggccggccgcgauccagc

SEQ ID NO: 1282976 - RNA, 15 nt, Mycobacterium tuberculosis H37Rv
gaacaggccgaggcg

SEQ ID NO: 1282977 - RNA, 19 nt, Mycobacterium tuberculosis H37Rv
gaacaggccggccgcgauc

SEQ ID NO: 1282978 - RNA, 22 nt, Mycobacterium tuberculosis H37Rv
gaacagggaggucgccgcaucg

SEQ ID NO: 1282979 - RNA, 15 nt, Mycobacterium tuberculosis H37Rv
gaacagggacuccca

SEQ ID NO: 1282980 - RNA, 14 nt, Mycobacterium tuberculosis H37Rv
gaacaucuggcgac

SEQ ID NO: 1282981 - RNA, 18 nt, Mycobacterium tuberculosis H37Rv
gaacauccgcacuggguc

SEQ ID NO: 1282982 - RNA, 16 nt, Mycobacterium tuberculosis H37Rv
gaacaucagaucgccg

SEQ ID NO: 1282983 - RNA, 16 nt, Mycobacterium tuberculosis H37Rv
gaacagugccucgcgu

SEQ ID NO: 1282984 - RNA, 15 nt, Mycobacterium tuberculosis H37Rv
gaacagugccucgcg

SEQ ID NO: 1282985 - RNA, 20 nt, Mycobacterium tuberculosis H37Rv
gaacagggugguggcggugu

SEQ ID NO: 1282986 - RNA, 20 nt, Mycobacterium tuberculosis H37Rv
gaacagugacgccacgaccg

SEQ ID NO: 1282987 - RNA, 15 nt, Mycobacterium tuberculosis H37Rv
gaaagucgcgcgcga

SEQ ID NO: 1282988 - RNA, 17 nt, Mycobacterium tuberculosis H37Rv
gaaagucuccggaacca

SEQ ID NO: 1282989 - RNA, 20 nt, Mycobacterium tuberculosis H37Rv
gaaagccugcuucaggaucg

SEQ ID NO: 1282990 - RNA, 19 nt, Mycobacterium tuberculosis H37Rv
gaaaccggccagccgacgc

SEQ ID NO: 1282991 - RNA, 20 nt, Mycobacterium tuberculosis H37Rv
cuugugggcgacggcgauga

SEQ ID NO: 1282992 - RNA, 18 nt, Mycobacterium tuberculosis H37Rv
cuuguggacccgccaggg

SEQ ID NO: 1282993 - RNA, 14 nt, Mycobacterium tuberculosis H37Rv
cuuguggucugcca

SEQ ID NO: 1282994 - RNA, 22 nt, Mycobacterium tuberculosis H37Rv
gaaacgccgcaauggaccgaac

SEQ ID NO: 1282995 - RNA, 21 nt, Mycobacterium tuberculosis H37Rv
gaaacucaagccacgucgucg

SEQ ID NO: 1282996 - RNA, 13 nt, Mycobacterium tuberculosis H37Rv
gaaacgccgagcg

SEQ ID NO: 1282997 - RNA, 14 nt, Mycobacterium tuberculosis H37Rv
gaaacgccauacgu

SEQ ID NO: 1282998 - RNA, 14 nt, Mycobacterium tuberculosis H37Rv
gaaacgccgaccgc

SEQ ID NO: 1282999 - RNA, 15 nt, Mycobacterium tuberculosis H37Rv
gaaacgaucgcgcca

SEQ ID NO: 1283000 - RNA, 21 nt, Mycobacterium tuberculosis H37Rv
gaaaccguggccaucgauccc

SEQ ID NO: 1283001 - RNA, 20 nt, Mycobacterium tuberculosis H37Rv
gaaaccggugguagcgacga

SEQ ID NO: 1283002 - RNA, 21 nt, Mycobacterium tuberculosis H37Rv
gaacugugcuauggccgcacc

SEQ ID NO: 1283003 - RNA, 19 nt, Mycobacterium tuberculosis H37Rv
gaagaaaccgcagucgcgg

SEQ ID NO: 1283004 - RNA, 17 nt, Mycobacterium tuberculosis H37Rv
gaagaacucggcgucgu

SEQ ID NO: 1283005 - RNA, 19 nt, Mycobacterium tuberculosis H37Rv
gaagacggcaagucuggcg

SEQ ID NO: 1283006 - RNA, 21 nt, Mycobacterium tuberculosis H37Rv
gaagacgccggcgaugccggu

SEQ ID NO: 1283007 - RNA, 12 nt, Mycobacterium tuberculosis H37Rv
gaagacccguga

SEQ ID NO: 1283008 - RNA, 17 nt, Mycobacterium tuberculosis H37Rv
gaagaccaggccgguga

SEQ ID NO: 1283009 - RNA, 22 nt, Mycobacterium tuberculosis H37Rv
gaagaaggcgagaagcgucgcu

SEQ ID NO: 1283010 - RNA, 12 nt, Mycobacterium tuberculosis H37Rv
gaagaauccggc

SEQ ID NO: 1283011 - RNA, 15 nt, Mycobacterium tuberculosis H37Rv
gaacucgcgggcgac

SEQ ID NO: 1283012 - RNA, 15 nt, Mycobacterium tuberculosis H37Rv
gaacugggcgaucga

SEQ ID NO: 1283013 - RNA, 16 nt, Mycobacterium tuberculosis H37Rv
gaacugguuucgcacc

SEQ ID NO: 1283014 - RNA, 21 nt, Mycobacterium tuberculosis H37Rv
gaacucgugacagcggcgauc

SEQ ID NO: 1283015 - RNA, 13 nt, Mycobacterium tuberculosis H37Rv
gaacggcgggcga

SEQ ID NO: 1283016 - RNA, 21 nt, Mycobacterium tuberculosis H37Rv
gaacgcgucguugucgucgcc

SEQ ID NO: 1283017 - RNA, 19 nt, Mycobacterium tuberculosis H37Rv
gaacggcucgggcagcguc

SEQ ID NO: 1283018 - RNA, 19 nt, Mycobacterium tuberculosis H37Rv
gaacggcguugcggaauca

SEQ ID NO: 1283019 - RNA, 17 nt, Mycobacterium tuberculosis H37Rv
gaacgggaucgacccgc

SEQ ID NO: 1283020 - RNA, 14 nt, Mycobacterium tuberculosis H37Rv
gaacgggaucgacc

SEQ ID NO: 1283021 - RNA, 23 nt, Mycobacterium tuberculosis H37Rv
gaaccuccucggguucgucaguc

SEQ ID NO: 1283022 - RNA, 15 nt, Mycobacterium tuberculosis H37Rv
gaaccucggcggugu

SEQ ID NO: 1283023 - RNA, 20 nt, Mycobacterium tuberculosis H37Rv
gaaccucggcggugucgacc

SEQ ID NO: 1283024 - RNA, 24 nt, Mycobacterium tuberculosis H37Rv
gaacgaaaugcacgccgggcacug

SEQ ID NO: 1283025 - RNA, 16 nt, Mycobacterium tuberculosis H37Rv
gaaccguacgccagau

SEQ ID NO: 1283026 - RNA, 22 nt, Mycobacterium tuberculosis H37Rv
gaaccgcugcuccucgcgguag

SEQ ID NO: 1283027 - RNA, 13 nt, Mycobacterium tuberculosis H37Rv
gaaccgcugggac

SEQ ID NO: 1283028 - RNA, 20 nt, Mycobacterium tuberculosis H37Rv
gaacaugggaugcucaccgg

SEQ ID NO: 1283029 - RNA, 13 nt, Mycobacterium tuberculosis H37Rv
gaacaugcucacg

SEQ ID NO: 1283030 - RNA, 24 nt, Mycobacterium tuberculosis H37Rv
gaaccaaucgcacgccagcuuggc

SEQ ID NO: 1283031 - RNA, 12 nt, Mycobacterium tuberculosis H37Rv
gaaccaaucgca

SEQ ID NO: 1283032 - RNA, 15 nt, Mycobacterium tuberculosis H37Rv
gaacgccagcagcgc

SEQ ID NO: 1283033 - RNA, 15 nt, Mycobacterium tuberculosis H37Rv
gaacgcccgcaggac

SEQ ID NO: 1283034 - RNA, 22 nt, Mycobacterium tuberculosis H37Rv
gaacgccgaacaccgccgcguc

SEQ ID NO: 1283035 - RNA, 18 nt, Mycobacterium tuberculosis H37Rv
gaacgcccgcaggacgcu

SEQ ID NO: 1283036 - RNA, 21 nt, Mycobacterium tuberculosis H37Rv
gaacgccaccaccuccgcguc

SEQ ID NO: 1283037 - RNA, 14 nt, Mycobacterium tuberculosis H37Rv
gaacgcaucggucc

SEQ ID NO: 1283038 - RNA, 14 nt, Mycobacterium tuberculosis H37Rv
gaacgccacgacgu

SEQ ID NO: 1283039 - RNA, 13 nt, Mycobacterium tuberculosis H37Rv
gaacgccagcagc

SEQ ID NO: 1283040 - RNA, 17 nt, Mycobacterium tuberculosis H37Rv
gaacgcagccagcgcca

SEQ ID NO: 1283041 - RNA, 15 nt, Mycobacterium tuberculosis H37Rv
gaacgcaacagccga

SEQ ID NO: 1283042 - RNA, 14 nt, Mycobacterium tuberculosis H37Rv
gaacgccucaccga

SEQ ID NO: 1283043 - RNA, 22 nt, Mycobacterium tuberculosis H37Rv
gaacgccucaccgacgucgcca

SEQ ID NO: 1283044 - RNA, 23 nt, Mycobacterium tuberculosis H37Rv
gaacgccgucagaacaccggcca

SEQ ID NO: 1283045 - RNA, 20 nt, Mycobacterium tuberculosis H37Rv
gaacgccgucagaacaccgg

SEQ ID NO: 1283046 - RNA, 17 nt, Mycobacterium tuberculosis H37Rv
gaacgccggcaucgcgc

SEQ ID NO: 1283047 - RNA, 15 nt, Mycobacterium tuberculosis H37Rv
gaacgccgccccgau

SEQ ID NO: 1283048 - RNA, 19 nt, Mycobacterium tuberculosis H37Rv
gaacgccgcccgcugggcu

SEQ ID NO: 1283049 - RNA, 15 nt, Mycobacterium tuberculosis H37Rv
gaacgccggcaucgc

SEQ ID NO: 1283050 - RNA, 14 nt, Mycobacterium tuberculosis H37Rv
gaacgcgucgccga

SEQ ID NO: 1283051 - RNA, 12 nt, Mycobacterium tuberculosis H37Rv
gaacgcggcgaa

SEQ ID NO: 1283052 - RNA, 18 nt, Mycobacterium tuberculosis H37Rv
gaacgcggccaacggacc

SEQ ID NO: 1283053 - RNA, 16 nt, Mycobacterium tuberculosis H37Rv
gaacgcggaagccgcc

SEQ ID NO: 1283054 - RNA, 20 nt, Mycobacterium tuberculosis H37Rv
gaagaucuccuccugugcga

SEQ ID NO: 1283055 - RNA, 20 nt, Mycobacterium tuberculosis H37Rv
gaagaugauuucgccgagcg

SEQ ID NO: 1283056 - RNA, 18 nt, Mycobacterium tuberculosis H37Rv
gaagcaagggcgaugguc

SEQ ID NO: 1283057 - RNA, 18 nt, Mycobacterium tuberculosis H37Rv
gaagauuuucucggugcu

SEQ ID NO: 1283058 - RNA, 16 nt, Mycobacterium tuberculosis H37Rv
gaagccaagcgacucg

SEQ ID NO: 1283059 - RNA, 16 nt, Mycobacterium tuberculosis H37Rv
gaagcacgucgucgcg

SEQ ID NO: 1283060 - RNA, 13 nt, Mycobacterium tuberculosis H37Rv
gaagagcuccguc

SEQ ID NO: 1283061 - RNA, 18 nt, Mycobacterium tuberculosis H37Rv
gaagccgcgagcgcgcga

SEQ ID NO: 1283062 - RNA, 20 nt, Mycobacterium tuberculosis H37Rv
gaagccgggucucggugcgg

SEQ ID NO: 1283063 - RNA, 18 nt, Mycobacterium tuberculosis H37Rv
gaagccgcugaucgccga

SEQ ID NO: 1283064 - RNA, 22 nt, Mycobacterium tuberculosis H37Rv
gaagccgcugaucgccgacaau

SEQ ID NO: 1283065 - RNA, 16 nt, Mycobacterium tuberculosis H37Rv
gaagccgacgaccagc

SEQ ID NO: 1283066 - RNA, 13 nt, Mycobacterium tuberculosis H37Rv
gaagccgacgauc

SEQ ID NO: 1283067 - RNA, 14 nt, Mycobacterium tuberculosis H37Rv
gaagccgaccaccg

SEQ ID NO: 1283068 - RNA, 21 nt, Mycobacterium tuberculosis H37Rv
gaagccgcaccgcuguugcau

SEQ ID NO: 1283069 - RNA, 20 nt, Mycobacterium tuberculosis H37Rv
gaagccaagcgacucgccgg

SEQ ID NO: 1283070 - RNA, 20 nt, Mycobacterium tuberculosis H37Rv
gaagcccacgaucgcgucgg

SEQ ID NO: 1283071 - RNA, 13 nt, Mycobacterium tuberculosis H37Rv
gaagcccgacugu

SEQ ID NO: 1283072 - RNA, 14 nt, Mycobacterium tuberculosis H37Rv
gaagcccgacuggu

SEQ ID NO: 1283073 - RNA, 23 nt, Mycobacterium tuberculosis H37Rv
gaagcugcgggucucgcugggaa

SEQ ID NO: 1283074 - RNA, 19 nt, Mycobacterium tuberculosis H37Rv
gaagcgucguugcucgguc

SEQ ID NO: 1283075 - RNA, 15 nt, Mycobacterium tuberculosis H37Rv
gaagcucaucaccgg

SEQ ID NO: 1283076 - RNA, 21 nt, Mycobacterium tuberculosis H37Rv
gaagcuguaggcgaccagaua

SEQ ID NO: 1283077 - RNA, 19 nt, Mycobacterium tuberculosis H37Rv
gaagcuguaggcgaccaga

SEQ ID NO: 1283078 - RNA, 22 nt, Mycobacterium tuberculosis H37Rv
gaaggagaucccccaggcgaac

SEQ ID NO: 1283079 - RNA, 13 nt, Mycobacterium tuberculosis H37Rv
gaaggcauugccc

SEQ ID NO: 1283080 - RNA, 22 nt, Mycobacterium tuberculosis H37Rv
gaagccgguguugauguugccg

SEQ ID NO: 1283081 - RNA, 15 nt, Mycobacterium tuberculosis H37Rv
gaagcgaugccgugc

SEQ ID NO: 1283082 - RNA, 17 nt, Mycobacterium tuberculosis H37Rv
gaagcgaccgucgucac

SEQ ID NO: 1283083 - RNA, 13 nt, Mycobacterium tuberculosis H37Rv
gaagcgcucggca

SEQ ID NO: 1283084 - RNA, 19 nt, Mycobacterium tuberculosis H37Rv
gaagguggcauucgucgag

SEQ ID NO: 1283085 - RNA, 23 nt, Mycobacterium tuberculosis H37Rv
gaaguacuggccgccgcgcaccg

SEQ ID NO: 1283086 - RNA, 21 nt, Mycobacterium tuberculosis H37Rv
gaaguacuccacccaggccga

SEQ ID NO: 1283087 - RNA, 16 nt, Mycobacterium tuberculosis H37Rv
gaaguacgacgacccg

SEQ ID NO: 1283088 - RNA, 23 nt, Mycobacterium tuberculosis H37Rv
gaagucccgggcaccgucggaac

SEQ ID NO: 1283089 - RNA, 15 nt, Mycobacterium tuberculosis H37Rv
gaagucgaucgccga

SEQ ID NO: 1283090 - RNA, 14 nt, Mycobacterium tuberculosis H37Rv
gaaguagccgagcc

SEQ ID NO: 1283091 - RNA, 15 nt, Mycobacterium tuberculosis H37Rv
gaaguagugcucgca

SEQ ID NO: 1283092 - RNA, 16 nt, Mycobacterium tuberculosis H37Rv
gaaggcggccaggugc

SEQ ID NO: 1283093 - RNA, 17 nt, Mycobacterium tuberculosis H37Rv
gaaggccgcaccgccac

SEQ ID NO: 1283094 - RNA, 18 nt, Mycobacterium tuberculosis H37Rv
gaaggcgacccgcugggu

SEQ ID NO: 1283095 - RNA, 19 nt, Mycobacterium tuberculosis H37Rv
gaaggcgacccgcuggguc

SEQ ID NO: 1283096 - RNA, 16 nt, Mycobacterium tuberculosis H37Rv
gaaggcgacgccgaaa

SEQ ID NO: 1283097 - RNA, 18 nt, Mycobacterium tuberculosis H37Rv
gaaggucaauagcgucgu

SEQ ID NO: 1283098 - RNA, 21 nt, Mycobacterium tuberculosis H37Rv
gaaggcguucgacucgaccgc

SEQ ID NO: 1283099 - RNA, 19 nt, Mycobacterium tuberculosis H37Rv
gaauccccccugucgccga

SEQ ID NO: 1283100 - RNA, 17 nt, Mycobacterium tuberculosis H37Rv
gaauccgacgucgacga

SEQ ID NO: 1283101 - RNA, 13 nt, Mycobacterium tuberculosis H37Rv
gaaucgcucgcgc

SEQ ID NO: 1283102 - RNA, 16 nt, Mycobacterium tuberculosis H37Rv
gaaucguucucggucc

SEQ ID NO: 1283103 - RNA, 17 nt, Mycobacterium tuberculosis H37Rv
gaaucgucggcgcggcu

SEQ ID NO: 1283104 - RNA, 15 nt, Mycobacterium tuberculosis H37Rv
gaaucgugcggcgac

SEQ ID NO: 1283105 - RNA, 17 nt, Mycobacterium tuberculosis H37Rv
gaaucgguuucgaccug

SEQ ID NO: 1283106 - RNA, 14 nt, Mycobacterium tuberculosis H37Rv
gaaucggaccgacc

SEQ ID NO: 1283107 - RNA, 17 nt, Mycobacterium tuberculosis H37Rv
gaaucggcccgugccac

SEQ ID NO: 1283108 - RNA, 17 nt, Mycobacterium tuberculosis H37Rv
gaaugccaccucgacgc

SEQ ID NO: 1283109 - RNA, 18 nt, Mycobacterium tuberculosis H37Rv
gaaugcccgggcccgucg

SEQ ID NO: 1283110 - RNA, 15 nt, Mycobacterium tuberculosis H37Rv
gaauggccgccgcag

SEQ ID NO: 1283111 - RNA, 23 nt, Mycobacterium tuberculosis H37Rv
gaauggcccuugcucguccaggu

SEQ ID NO: 1283112 - RNA, 14 nt, Mycobacterium tuberculosis H37Rv
gaauggcagcacga

SEQ ID NO: 1283113 - RNA, 15 nt, Mycobacterium tuberculosis H37Rv
gaaucuccaaguagc

SEQ ID NO: 1283114 - RNA, 14 nt, Mycobacterium tuberculosis H37Rv
gaaugagcacgagc

SEQ ID NO: 1283115 - RNA, 21 nt, Mycobacterium tuberculosis H37Rv
gaagugagcucggcugcucga

SEQ ID NO: 1283116 - RNA, 17 nt, Mycobacterium tuberculosis H37Rv
gaagugacccgaaccgc

SEQ ID NO: 1283117 - RNA, 17 nt, Mycobacterium tuberculosis H37Rv
gaagugcacccggaucu

SEQ ID NO: 1283118 - RNA, 18 nt, Mycobacterium tuberculosis H37Rv
gaaucacguggaccacgg

SEQ ID NO: 1283119 - RNA, 20 nt, Mycobacterium tuberculosis H37Rv
gaaucaccuugcuccacauc

SEQ ID NO: 1283120 - RNA, 21 nt, Mycobacterium tuberculosis H37Rv
gaaucaccccggcggccaucc

SEQ ID NO: 1283121 - RNA, 19 nt, Mycobacterium tuberculosis H37Rv
gaccgccugcaacacgcga

SEQ ID NO: 1283122 - RNA, 22 nt, Mycobacterium tuberculosis H37Rv
gaccgcucugcggccacgccga

SEQ ID NO: 1283123 - RNA, 15 nt, Mycobacterium tuberculosis H37Rv
gaccgcucggaguug

SEQ ID NO: 1283124 - RNA, 13 nt, Mycobacterium tuberculosis H37Rv
gaccgcccgcacc

SEQ ID NO: 1283125 - RNA, 21 nt, Mycobacterium tuberculosis H37Rv
gaccgccgggauaucgucgac

SEQ ID NO: 1283126 - RNA, 14 nt, Mycobacterium tuberculosis H37Rv
gaccgccgcugggu

SEQ ID NO: 1283127 - RNA, 18 nt, Mycobacterium tuberculosis H37Rv
gaccggaaaccacagcgc

SEQ ID NO: 1283128 - RNA, 21 nt, Mycobacterium tuberculosis H37Rv
gaccgcuugcccgcgcagcac

SEQ ID NO: 1283129 - RNA, 20 nt, Mycobacterium tuberculosis H37Rv
gaccggcaauuccguuaggc

SEQ ID NO: 1283130 - RNA, 22 nt, Mycobacterium tuberculosis H37Rv
gaccggcccccggucgagcucg

SEQ ID NO: 1283131 - RNA, 20 nt, Mycobacterium tuberculosis H37Rv
gaccggcccgcauccgcacc

SEQ ID NO: 1283132 - RNA, 13 nt, Mycobacterium tuberculosis H37Rv
gaccggccgacgu

SEQ ID NO: 1283133 - RNA, 12 nt, Mycobacterium tuberculosis H37Rv
gaccggcaucga

SEQ ID NO: 1283134 - RNA, 14 nt, Mycobacterium tuberculosis H37Rv
gaccggcaucgauc

SEQ ID NO: 1283135 - RNA, 14 nt, Mycobacterium tuberculosis H37Rv
gaccggccacgacc

SEQ ID NO: 1283136 - RNA, 16 nt, Mycobacterium tuberculosis H37Rv
gaccggccugcgacga

SEQ ID NO: 1283137 - RNA, 17 nt, Mycobacterium tuberculosis H37Rv
aacggcgaggugcccaa

SEQ ID NO: 1283138 - RNA, 18 nt, Mycobacterium tuberculosis H37Rv
aacggcgaaacucgucga

SEQ ID NO: 1283139 - RNA, 13 nt, Mycobacterium tuberculosis H37Rv
aacggcgaucacc

SEQ ID NO: 1283140 - RNA, 16 nt, Mycobacterium tuberculosis H37Rv
gaccggcucgaucucg

SEQ ID NO: 1283141 - RNA, 15 nt, Mycobacterium tuberculosis H37Rv
gaccggcgucggcug

SEQ ID NO: 1283142 - RNA, 17 nt, Mycobacterium tuberculosis H37Rv
gaccggcguaaccggca

SEQ ID NO: 1283143 - RNA, 16 nt, Mycobacterium tuberculosis H37Rv
gaccggugcugucgac

SEQ ID NO: 1283144 - RNA, 14 nt, Mycobacterium tuberculosis H37Rv
gaccggucugaucg

SEQ ID NO: 1283145 - RNA, 16 nt, Mycobacterium tuberculosis H37Rv
gaccggucacccgugc

SEQ ID NO: 1283146 - RNA, 18 nt, Mycobacterium tuberculosis H37Rv
gaccgggucgcaaccgcc

SEQ ID NO: 1283147 - RNA, 16 nt, Mycobacterium tuberculosis H37Rv
gaccgggucgccgaug

SEQ ID NO: 1283148 - RNA, 15 nt, Mycobacterium tuberculosis H37Rv
gaccgggucguagcc

SEQ ID NO: 1283149 - RNA, 17 nt, Mycobacterium tuberculosis H37Rv
aacgcugucccagcccg

SEQ ID NO: 1283150 - RNA, 14 nt, Mycobacterium tuberculosis H37Rv
aacgcucgucgaca

SEQ ID NO: 1283151 - RNA, 15 nt, Mycobacterium tuberculosis H37Rv
gacccgagcgcucga

SEQ ID NO: 1283152 - RNA, 22 nt, Mycobacterium tuberculosis H37Rv
gacccgacgcuggucggcggcu

SEQ ID NO: 1283153 - RNA, 12 nt, Mycobacterium tuberculosis H37Rv
gacccgaugcgu

SEQ ID NO: 1283154 - RNA, 19 nt, Mycobacterium tuberculosis H37Rv
gacccgacaugguccgacc

SEQ ID NO: 1283155 - RNA, 18 nt, Mycobacterium tuberculosis H37Rv
gacccgacaugguccgac

SEQ ID NO: 1283156 - RNA, 16 nt, Mycobacterium tuberculosis H37Rv
gacccgaccgucgucg

SEQ ID NO: 1283157 - RNA, 22 nt, Mycobacterium tuberculosis H37Rv
gacccgacaugguccgaccagc

SEQ ID NO: 1283158 - RNA, 14 nt, Mycobacterium tuberculosis H37Rv
gacccgacguagcc

SEQ ID NO: 1283159 - RNA, 19 nt, Mycobacterium tuberculosis H37Rv
gacccgaagccgaccgggu

SEQ ID NO: 1283160 - RNA, 15 nt, Mycobacterium tuberculosis H37Rv
gacccgaagccgacc

SEQ ID NO: 1283161 - RNA, 14 nt, Mycobacterium tuberculosis H37Rv
gacccgugcggcca

SEQ ID NO: 1283162 - RNA, 13 nt, Mycobacterium tuberculosis H37Rv
gaccgaaccguca

SEQ ID NO: 1283163 - RNA, 17 nt, Mycobacterium tuberculosis H37Rv
gaccgaagaccuccucg

SEQ ID NO: 1283164 - RNA, 20 nt, Mycobacterium tuberculosis H37Rv
aacgcuucaccucgucgaca

SEQ ID NO: 1283165 - RNA, 16 nt, Mycobacterium tuberculosis H37Rv
aacgcuucaccucguc

SEQ ID NO: 1283166 - RNA, 17 nt, Mycobacterium tuberculosis H37Rv
gacccgugcacgaucgc

SEQ ID NO: 1283167 - RNA, 16 nt, Mycobacterium tuberculosis H37Rv
gaccgaaagccgcacc

SEQ ID NO: 1283168 - RNA, 22 nt, Mycobacterium tuberculosis H37Rv
gaccgaaauggucguucccgcc

SEQ ID NO: 1283169 - RNA, 18 nt, Mycobacterium tuberculosis H37Rv
gaccgaacaacagcggca

SEQ ID NO: 1283170 - RNA, 19 nt, Mycobacterium tuberculosis H37Rv
gaccgaacaacagcggcaa

SEQ ID NO: 1283171 - RNA, 13 nt, Mycobacterium tuberculosis H37Rv
gaccgaacagcgg

SEQ ID NO: 1283172 - RNA, 15 nt, Mycobacterium tuberculosis H37Rv
gacccgucgagcagc

SEQ ID NO: 1283173 - RNA, 14 nt, Mycobacterium tuberculosis H37Rv
gacccgucgagcgu

SEQ ID NO: 1283174 - RNA, 14 nt, Mycobacterium tuberculosis H37Rv
gacccgugagcgga

SEQ ID NO: 1283175 - RNA, 23 nt, Mycobacterium tuberculosis H37Rv
gaccgacugcgggccagcgcauc

SEQ ID NO: 1283176 - RNA, 12 nt, Mycobacterium tuberculosis H37Rv
gaccgaccuggu

SEQ ID NO: 1283177 - RNA, 14 nt, Mycobacterium tuberculosis H37Rv
gaccgaccacgcga

SEQ ID NO: 1283178 - RNA, 14 nt, Mycobacterium tuberculosis H37Rv
gaccgaccuggucg

SEQ ID NO: 1283179 - RNA, 17 nt, Mycobacterium tuberculosis H37Rv
gaccgaccaccgcgaaa

SEQ ID NO: 1283180 - RNA, 18 nt, Mycobacterium tuberculosis H37Rv
gaccgcagcgacgggaaa

SEQ ID NO: 1283181 - RNA, 18 nt, Mycobacterium tuberculosis H37Rv
gaccgcaccgaccugagu

SEQ ID NO: 1283182 - RNA, 21 nt, Mycobacterium tuberculosis H37Rv
gaccgagcaacaccccugggu

SEQ ID NO: 1283183 - RNA, 19 nt, Mycobacterium tuberculosis H37Rv
gaccgauugucggcaacga

SEQ ID NO: 1283184 - RNA, 18 nt, Mycobacterium tuberculosis H37Rv
gaccgcaucucgggcgaa

SEQ ID NO: 1283185 - RNA, 21 nt, Mycobacterium tuberculosis H37Rv
gaccgcauugaacagcggauc

SEQ ID NO: 1283186 - RNA, 16 nt, Mycobacterium tuberculosis H37Rv
gaccgccaccgccagc

SEQ ID NO: 1283187 - RNA, 18 nt, Mycobacterium tuberculosis H37Rv
gaccgccaccgccagcgu

SEQ ID NO: 1283188 - RNA, 23 nt, Mycobacterium tuberculosis H37Rv
gaccgccaccgccagcgucgaca

SEQ ID NO: 1283189 - RNA, 14 nt, Mycobacterium tuberculosis H37Rv
gaccgccaccggcu

SEQ ID NO: 1283190 - RNA, 16 nt, Mycobacterium tuberculosis H37Rv
gaccgauugucggcaa

SEQ ID NO: 1283191 - RNA, 16 nt, Mycobacterium tuberculosis H37Rv
gaccgcagggaccggu

SEQ ID NO: 1283192 - RNA, 14 nt, Mycobacterium tuberculosis H37Rv
gaccgcccgccagc

SEQ ID NO: 1283193 - RNA, 14 nt, Mycobacterium tuberculosis H37Rv
gaccgccaucgcca

SEQ ID NO: 1283194 - RNA, 19 nt, Mycobacterium tuberculosis H37Rv
gaccgccaccuuggcguug

SEQ ID NO: 1283195 - RNA, 17 nt, Mycobacterium tuberculosis H37Rv
gaccguccgacggcgga

SEQ ID NO: 1283196 - RNA, 20 nt, Mycobacterium tuberculosis H37Rv
gaccgucgauuucgacgacc

SEQ ID NO: 1283197 - RNA, 19 nt, Mycobacterium tuberculosis H37Rv
gaccgucgauuucgacgac

SEQ ID NO: 1283198 - RNA, 14 nt, Mycobacterium tuberculosis H37Rv
gaccguccgacggc

SEQ ID NO: 1283199 - RNA, 14 nt, Mycobacterium tuberculosis H37Rv
gaccgucccggccu

SEQ ID NO: 1283200 - RNA, 18 nt, Mycobacterium tuberculosis H37Rv
gaccgucccagcgccgca

SEQ ID NO: 1283201 - RNA, 12 nt, Mycobacterium tuberculosis H37Rv
gaccgucgcacc

SEQ ID NO: 1283202 - RNA, 15 nt, Mycobacterium tuberculosis H37Rv
gaccgucgcgcugcc

SEQ ID NO: 1283203 - RNA, 22 nt, Mycobacterium tuberculosis H37Rv
gaccguagccgugacaaggugc

SEQ ID NO: 1283204 - RNA, 20 nt, Mycobacterium tuberculosis H37Rv
gaccgucacaagucgacacg

SEQ ID NO: 1283205 - RNA, 17 nt, Mycobacterium tuberculosis H37Rv
gaccguauuucguccac

SEQ ID NO: 1283206 - RNA, 17 nt, Mycobacterium tuberculosis H37Rv
gaccguauugaccagcg

SEQ ID NO: 1283207 - RNA, 16 nt, Mycobacterium tuberculosis H37Rv
gaccggugccagcagu

SEQ ID NO: 1283208 - RNA, 17 nt, Mycobacterium tuberculosis H37Rv
gaccguccagcaacagc

SEQ ID NO: 1283209 - RNA, 18 nt, Mycobacterium tuberculosis H37Rv
gaccgugcgucgauggcg

SEQ ID NO: 1283210 - RNA, 21 nt, Mycobacterium tuberculosis H37Rv
aacggcucgggaacuucgccg

SEQ ID NO: 1283211 - RNA, 21 nt, Mycobacterium tuberculosis H37Rv
gaccgucuggaguucgucacc

SEQ ID NO: 1283212 - RNA, 22 nt, Mycobacterium tuberculosis H37Rv
gaccgucuggaguucgucaccg

SEQ ID NO: 1283213 - RNA, 17 nt, Mycobacterium tuberculosis H37Rv
gaccgucgucaccgcga

SEQ ID NO: 1283214 - RNA, 22 nt, Mycobacterium tuberculosis H37Rv
gaccgucuuuggugccgagcag

SEQ ID NO: 1283215 - RNA, 13 nt, Mycobacterium tuberculosis H37Rv
gaccgugaucagc

SEQ ID NO: 1283216 - RNA, 18 nt, Mycobacterium tuberculosis H37Rv
gaccguggauaacgacug

SEQ ID NO: 1283217 - RNA, 19 nt, Mycobacterium tuberculosis H37Rv
gaccguggauaacgacuga

SEQ ID NO: 1283218 - RNA, 21 nt, Mycobacterium tuberculosis H37Rv
gaccgugaucagcgcguagcc

SEQ ID NO: 1283219 - RNA, 15 nt, Mycobacterium tuberculosis H37Rv
gaccucacugcggcg

SEQ ID NO: 1283220 - RNA, 17 nt, Mycobacterium tuberculosis H37Rv
gaccucagccggcggcu

SEQ ID NO: 1283221 - RNA, 16 nt, Mycobacterium tuberculosis H37Rv
gaccguuacaccauca

SEQ ID NO: 1283222 - RNA, 14 nt, Mycobacterium tuberculosis H37Rv
gaccuccacgcccu

SEQ ID NO: 1283223 - RNA, 21 nt, Mycobacterium tuberculosis H37Rv
gaccguuucgaucucgagcag

SEQ ID NO: 1283224 - RNA, 15 nt, Mycobacterium tuberculosis H37Rv
gaccguucggcgguc

SEQ ID NO: 1283225 - RNA, 17 nt, Mycobacterium tuberculosis H37Rv
aacgggggcgccuucac

SEQ ID NO: 1283226 - RNA, 16 nt, Mycobacterium tuberculosis H37Rv
aacgggaugcggucga

SEQ ID NO: 1283227 - RNA, 13 nt, Mycobacterium tuberculosis H37Rv
aacgggaugccgg

SEQ ID NO: 1283228 - RNA, 14 nt, Mycobacterium tuberculosis H37Rv
aacgggauccgcgc

SEQ ID NO: 1283229 - RNA, 16 nt, Mycobacterium tuberculosis H37Rv
gaccucgucgcgucgc

SEQ ID NO: 1283230 - RNA, 17 nt, Mycobacterium tuberculosis H37Rv
gaccucgucgcgucgcc

SEQ ID NO: 1283231 - RNA, 20 nt, Mycobacterium tuberculosis H37Rv
gaccugaugagcucaccggg

SEQ ID NO: 1283232 - RNA, 19 nt, Mycobacterium tuberculosis H37Rv
gaccugauggcgcugcacc

SEQ ID NO: 1283233 - RNA, 13 nt, Mycobacterium tuberculosis H37Rv
gaccucggcgaug

SEQ ID NO: 1283234 - RNA, 18 nt, Mycobacterium tuberculosis H37Rv
gaccucggcgaugucgcg

SEQ ID NO: 1283235 - RNA, 20 nt, Mycobacterium tuberculosis H37Rv
gaccucggcgcgcucggccg

SEQ ID NO: 1283236 - RNA, 22 nt, Mycobacterium tuberculosis H37Rv
gaccucgucaccggucagcgac

SEQ ID NO: 1283237 - RNA, 24 nt, Mycobacterium tuberculosis H37Rv
gaccucgucgaccgggaacagggu

SEQ ID NO: 1283238 - RNA, 16 nt, Mycobacterium tuberculosis H37Rv
gaccucguucgucacc

SEQ ID NO: 1283239 - RNA, 20 nt, Mycobacterium tuberculosis H37Rv
gaccucguucgucaccacga

SEQ ID NO: 1283240 - RNA, 20 nt, Mycobacterium tuberculosis H37Rv
gaccucggcaaccaccucgu

SEQ ID NO: 1283241 - RNA, 19 nt, Mycobacterium tuberculosis H37Rv
gaccucgcgggcgaucggc

SEQ ID NO: 1283242 - RNA, 20 nt, Mycobacterium tuberculosis H37Rv
gaccucgccgcgcgugacag

SEQ ID NO: 1283243 - RNA, 23 nt, Mycobacterium tuberculosis H37Rv
gaccucgccgcggcggaaggcgu

SEQ ID NO: 1283244 - RNA, 14 nt, Mycobacterium tuberculosis H37Rv
gaccucgcccauga

SEQ ID NO: 1283245 - RNA, 18 nt, Mycobacterium tuberculosis H37Rv
gaccuccgcgaucaccga

SEQ ID NO: 1283246 - RNA, 21 nt, Mycobacterium tuberculosis H37Rv
gaccucgagcuugccgucgcu

SEQ ID NO: 1283247 - RNA, 21 nt, Mycobacterium tuberculosis H37Rv
gacgaacccaccgugccgggc

SEQ ID NO: 1283248 - RNA, 15 nt, Mycobacterium tuberculosis H37Rv
gacgaaaucggcggc

SEQ ID NO: 1283249 - RNA, 15 nt, Mycobacterium tuberculosis H37Rv
gacgaacgccgucga

SEQ ID NO: 1283250 - RNA, 18 nt, Mycobacterium tuberculosis H37Rv
gacgaacgccgucgacgc

SEQ ID NO: 1283251 - RNA, 13 nt, Mycobacterium tuberculosis H37Rv
gacgaacgccguc

SEQ ID NO: 1283252 - RNA, 13 nt, Mycobacterium tuberculosis H37Rv
gacgaacgacggg

SEQ ID NO: 1283253 - RNA, 15 nt, Mycobacterium tuberculosis H37Rv
gacgacaaucgggac

SEQ ID NO: 1283254 - RNA, 19 nt, Mycobacterium tuberculosis H37Rv
gacgaacgcgucggucgac

SEQ ID NO: 1283255 - RNA, 22 nt, Mycobacterium tuberculosis H37Rv
gaccuuuucccgcaggcucacc

SEQ ID NO: 1283256 - RNA, 18 nt, Mycobacterium tuberculosis H37Rv
gacgaaaaaaucgugcgg

SEQ ID NO: 1283257 - RNA, 22 nt, Mycobacterium tuberculosis H37Rv
gaccuggccgcccgcugcggcg

SEQ ID NO: 1283258 - RNA, 20 nt, Mycobacterium tuberculosis H37Rv
gaccauagucgccgucgugc

SEQ ID NO: 1283259 - RNA, 21 nt, Mycobacterium tuberculosis H37Rv
gaccauauuggcgcggccgaa

SEQ ID NO: 1283260 - RNA, 17 nt, Mycobacterium tuberculosis H37Rv
gaccaucaccacggccg

SEQ ID NO: 1283261 - RNA, 18 nt, Mycobacterium tuberculosis H37Rv
gaccauacccgcgcgcac

SEQ ID NO: 1283262 - RNA, 16 nt, Mycobacterium tuberculosis H37Rv
gaccaucccgccgauc

SEQ ID NO: 1283263 - RNA, 13 nt, Mycobacterium tuberculosis H37Rv
gacccauggucac

SEQ ID NO: 1283264 - RNA, 17 nt, Mycobacterium tuberculosis H37Rv
gacccccgcaucggcgc

SEQ ID NO: 1283265 - RNA, 21 nt, Mycobacterium tuberculosis H37Rv
gacccccgaucaggccgacgu

SEQ ID NO: 1283266 - RNA, 22 nt, Mycobacterium tuberculosis H37Rv
gaccccaggcgcucaucaccca

SEQ ID NO: 1283267 - RNA, 14 nt, Mycobacterium tuberculosis H37Rv
gaccccacacgccg

SEQ ID NO: 1283268 - RNA, 13 nt, Mycobacterium tuberculosis H37Rv
gaccccgccagcc

SEQ ID NO: 1283269 - RNA, 15 nt, Mycobacterium tuberculosis H37Rv
gaccccgccgaacgg

SEQ ID NO: 1283270 - RNA, 17 nt, Mycobacterium tuberculosis H37Rv
gaccccgcugcgacguu

SEQ ID NO: 1283271 - RNA, 14 nt, Mycobacterium tuberculosis H37Rv
gaccccggcagcgc

SEQ ID NO: 1283272 - RNA, 20 nt, Mycobacterium tuberculosis H37Rv
gaccagcuugaccgaccacg

SEQ ID NO: 1283273 - RNA, 21 nt, Mycobacterium tuberculosis H37Rv
gaccagcuugaccgaccacgc

SEQ ID NO: 1283274 - RNA, 14 nt, Mycobacterium tuberculosis H37Rv
gaccagcguccagc

SEQ ID NO: 1283275 - RNA, 17 nt, Mycobacterium tuberculosis H37Rv
gaccaggucggcuucga

SEQ ID NO: 1283276 - RNA, 17 nt, Mycobacterium tuberculosis H37Rv
gaccagcugccggcgac

SEQ ID NO: 1283277 - RNA, 17 nt, Mycobacterium tuberculosis H37Rv
aacgcgcaggccgacac

SEQ ID NO: 1283278 - RNA, 14 nt, Mycobacterium tuberculosis H37Rv
gaccaccagcgcuc

SEQ ID NO: 1283279 - RNA, 13 nt, Mycobacterium tuberculosis H37Rv
gaccaccaccgag

SEQ ID NO: 1283280 - RNA, 14 nt, Mycobacterium tuberculosis H37Rv
gaccaccaccgagc

SEQ ID NO: 1283281 - RNA, 14 nt, Mycobacterium tuberculosis H37Rv
gaccaccuggucgc

SEQ ID NO: 1283282 - RNA, 12 nt, Mycobacterium tuberculosis H37Rv
gaccacgacgug

SEQ ID NO: 1283283 - RNA, 14 nt, Mycobacterium tuberculosis H37Rv
gaccacgaccgucu

SEQ ID NO: 1283284 - RNA, 22 nt, Mycobacterium tuberculosis H37Rv
gaccacgcaccgccccgccguu

SEQ ID NO: 1283285 - RNA, 12 nt, Mycobacterium tuberculosis H37Rv
gaccacgccgac

SEQ ID NO: 1283286 - RNA, 19 nt, Mycobacterium tuberculosis H37Rv
gaccaccccguagcggucu

SEQ ID NO: 1283287 - RNA, 15 nt, Mycobacterium tuberculosis H37Rv
aacgcaaucgucgcc

SEQ ID NO: 1283288 - RNA, 13 nt, Mycobacterium tuberculosis H37Rv
gaccagcaccaga

SEQ ID NO: 1283289 - RNA, 14 nt, Mycobacterium tuberculosis H37Rv
gaccagagcuucgc

SEQ ID NO: 1283290 - RNA, 15 nt, Mycobacterium tuberculosis H37Rv
gaccagcaccagaac

SEQ ID NO: 1283291 - RNA, 20 nt, Mycobacterium tuberculosis H37Rv
aacgccggcgacggcgucac

SEQ ID NO: 1283292 - RNA, 12 nt, Mycobacterium tuberculosis H37Rv
aacgccggcacc

SEQ ID NO: 1283293 - RNA, 17 nt, Mycobacterium tuberculosis H37Rv
gaccacggugaguuggc

SEQ ID NO: 1283294 - RNA, 16 nt, Mycobacterium tuberculosis H37Rv
aacgcccgggcggcgu

SEQ ID NO: 1283295 - RNA, 22 nt, Mycobacterium tuberculosis H37Rv
aacgcccguguugaagaagccc

SEQ ID NO: 1283296 - RNA, 19 nt, Mycobacterium tuberculosis H37Rv
gaccacgcgagggcauccg

SEQ ID NO: 1283297 - RNA, 18 nt, Mycobacterium tuberculosis H37Rv
aacgccgaccgcgccgca

SEQ ID NO: 1283298 - RNA, 14 nt, Mycobacterium tuberculosis H37Rv
gacauuggugcuga

SEQ ID NO: 1283299 - RNA, 18 nt, Mycobacterium tuberculosis H37Rv
gacauuuccaccacgcgc

SEQ ID NO: 1283300 - RNA, 18 nt, Mycobacterium tuberculosis H37Rv
gacaugcgcaccaugggu

SEQ ID NO: 1283301 - RNA, 13 nt, Mycobacterium tuberculosis H37Rv
gacaugcgcacca

SEQ ID NO: 1283302 - RNA, 15 nt, Mycobacterium tuberculosis H37Rv
gacaugggucggcug

SEQ ID NO: 1283303 - RNA, 13 nt, Mycobacterium tuberculosis H37Rv
gacaggucggcau

SEQ ID NO: 1283304 - RNA, 18 nt, Mycobacterium tuberculosis H37Rv
gacaggucgggcagcacu

SEQ ID NO: 1283305 - RNA, 22 nt, Mycobacterium tuberculosis H37Rv
gacaggucggggcgucguucgc

SEQ ID NO: 1283306 - RNA, 21 nt, Mycobacterium tuberculosis H37Rv
aacgacuggguggugcucacc

SEQ ID NO: 1283307 - RNA, 22 nt, Mycobacterium tuberculosis H37Rv
aacgacgucgucgccgccgaaa

SEQ ID NO: 1283308 - RNA, 15 nt, Mycobacterium tuberculosis H37Rv
aacgagauucgucca

SEQ ID NO: 1283309 - RNA, 22 nt, Mycobacterium tuberculosis H37Rv
aacgacgggucguucuccgcgc

SEQ ID NO: 1283310 - RNA, 24 nt, Mycobacterium tuberculosis H37Rv
gaccaaaccgcuguaaccgguaac

SEQ ID NO: 1283311 - RNA, 14 nt, Mycobacterium tuberculosis H37Rv
gaccaacacgucga

SEQ ID NO: 1283312 - RNA, 21 nt, Mycobacterium tuberculosis H37Rv
gaccaauucgaccgcgcggau

SEQ ID NO: 1283313 - RNA, 21 nt, Mycobacterium tuberculosis H37Rv
gaccaauucgcaaucggcguu

SEQ ID NO: 1283314 - RNA, 22 nt, Mycobacterium tuberculosis H37Rv
gaccacagccgcgccgaccuca

SEQ ID NO: 1283315 - RNA, 22 nt, Mycobacterium tuberculosis H37Rv
gaaugucgaugacgaacggacc

SEQ ID NO: 1283316 - RNA, 19 nt, Mycobacterium tuberculosis H37Rv
gaaugucuuuggucgccgg

SEQ ID NO: 1283317 - RNA, 16 nt, Mycobacterium tuberculosis H37Rv
gaauguagccgacuuc

SEQ ID NO: 1283318 - RNA, 13 nt, Mycobacterium tuberculosis H37Rv
gaauggugaccgg

SEQ ID NO: 1283319 - RNA, 20 nt, Mycobacterium tuberculosis H37Rv
gaaugggggcuggucgccgu

SEQ ID NO: 1283320 - RNA, 18 nt, Mycobacterium tuberculosis H37Rv
gaauggcucacgcuccgc

SEQ ID NO: 1283321 - RNA, 16 nt, Mycobacterium tuberculosis H37Rv
gaauuccgcuaccgca

SEQ ID NO: 1283322 - RNA, 17 nt, Mycobacterium tuberculosis H37Rv
gaauuccccagccgcau

SEQ ID NO: 1283323 - RNA, 18 nt, Mycobacterium tuberculosis H37Rv
gaauucccaugcugcgca

SEQ ID NO: 1283324 - RNA, 21 nt, Mycobacterium tuberculosis H37Rv
gacagcaucacgcccacgaua

SEQ ID NO: 1283325 - RNA, 17 nt, Mycobacterium tuberculosis H37Rv
gacagcagguugccgaa

SEQ ID NO: 1283326 - RNA, 19 nt, Mycobacterium tuberculosis H37Rv
gacagcaucacgcccacga

SEQ ID NO: 1283327 - RNA, 13 nt, Mycobacterium tuberculosis H37Rv
gacagcaucacga

SEQ ID NO: 1283328 - RNA, 19 nt, Mycobacterium tuberculosis H37Rv
gacagcccgaacgaggcgc

SEQ ID NO: 1283329 - RNA, 23 nt, Mycobacterium tuberculosis H37Rv
gacagccccaucaccaccggcac

SEQ ID NO: 1283330 - RNA, 19 nt, Mycobacterium tuberculosis H37Rv
gacagccccaucaccaccg

SEQ ID NO: 1283331 - RNA, 18 nt, Mycobacterium tuberculosis H37Rv
gacagcgcgagaucagcc

SEQ ID NO: 1283332 - RNA, 21 nt, Mycobacterium tuberculosis H37Rv
gacagcgcgcaaagacaccga

SEQ ID NO: 1283333 - RNA, 13 nt, Mycobacterium tuberculosis H37Rv
gacagcgcaucca

SEQ ID NO: 1283334 - RNA, 17 nt, Mycobacterium tuberculosis H37Rv
gacagccguggcgcgac

SEQ ID NO: 1283335 - RNA, 18 nt, Mycobacterium tuberculosis H37Rv
cucguugauacggcaugc

SEQ ID NO: 1283336 - RNA, 20 nt, Mycobacterium tuberculosis H37Rv
cucguugaugaaggucagca

SEQ ID NO: 1283337 - RNA, 23 nt, Mycobacterium tuberculosis H37Rv
cucguugaccgggucgccgauga

SEQ ID NO: 1283338 - RNA, 17 nt, Mycobacterium tuberculosis H37Rv
cucugaccagccggucu

SEQ ID NO: 1283339 - RNA, 13 nt, Mycobacterium tuberculosis H37Rv
cucuucggcacca

SEQ ID NO: 1283340 - RNA, 22 nt, Mycobacterium tuberculosis H37Rv
cucgucggugucgguucggucg

SEQ ID NO: 1283341 - RNA, 14 nt, Mycobacterium tuberculosis H37Rv
cucgucggucaccg

SEQ ID NO: 1283342 - RNA, 20 nt, Mycobacterium tuberculosis H37Rv
cucgucgggcagauucuuca

SEQ ID NO: 1283343 - RNA, 17 nt, Mycobacterium tuberculosis H37Rv
cucgucggcgucgagcu

SEQ ID NO: 1283344 - RNA, 16 nt, Mycobacterium tuberculosis H37Rv
cucgucgccgcgguag

SEQ ID NO: 1283345 - RNA, 19 nt, Mycobacterium tuberculosis H37Rv
cucgucgcaucaccagggu

SEQ ID NO: 1283346 - RNA, 13 nt, Mycobacterium tuberculosis H37Rv
cucgucgcgucgc

SEQ ID NO: 1283347 - RNA, 13 nt, Mycobacterium tuberculosis H37Rv
cucgucggccacc

SEQ ID NO: 1283348 - RNA, 14 nt, Mycobacterium tuberculosis H37Rv
cucgucggccagug

SEQ ID NO: 1283349 - RNA, 23 nt, Mycobacterium tuberculosis H37Rv
cucgucggcgaagguguccucca

SEQ ID NO: 1283350 - RNA, 14 nt, Mycobacterium tuberculosis H37Rv
cucgugggcgacga

SEQ ID NO: 1283351 - RNA, 23 nt, Mycobacterium tuberculosis H37Rv
cucguguaggagcuggcugacga

SEQ ID NO: 1283352 - RNA, 22 nt, Mycobacterium tuberculosis H37Rv
cucguguccggggaccucggcg

SEQ ID NO: 1283353 - RNA, 13 nt, Mycobacterium tuberculosis H37Rv
cucgugcacgcac

SEQ ID NO: 1283354 - RNA, 18 nt, Mycobacterium tuberculosis H37Rv
cucgugcacgcugagccg

SEQ ID NO: 1283355 - RNA, 16 nt, Mycobacterium tuberculosis H37Rv
cucgugcaggaccagc

SEQ ID NO: 1283356 - RNA, 20 nt, Mycobacterium tuberculosis H37Rv
cucgugaucuucggcgaucg

SEQ ID NO: 1283357 - RNA, 17 nt, Mycobacterium tuberculosis H37Rv
cucgguugguccucggc

SEQ ID NO: 1283358 - RNA, 18 nt, Mycobacterium tuberculosis H37Rv
cucgucaccgcgaccagc

SEQ ID NO: 1283359 - RNA, 11 nt, Mycobacterium tuberculosis H37Rv
cucgucaccgg

SEQ ID NO: 1283360 - RNA, 23 nt, Mycobacterium tuberculosis H37Rv
cucguacggaccgucgccgguga

SEQ ID NO: 1283361 - RNA, 14 nt, Mycobacterium tuberculosis H37Rv
cucguacggaccgu

SEQ ID NO: 1283362 - RNA, 17 nt, Mycobacterium tuberculosis H37Rv
cucguaguaguccagca

SEQ ID NO: 1283363 - RNA, 16 nt, Mycobacterium tuberculosis H37Rv
cucgucgagccgaccg

SEQ ID NO: 1283364 - RNA, 18 nt, Mycobacterium tuberculosis H37Rv
cucgucgagccgaccgcg

SEQ ID NO: 1283365 - RNA, 23 nt, Mycobacterium tuberculosis H37Rv
cucgucgagcgcgucggucaccg

SEQ ID NO: 1283366 - RNA, 13 nt, Mycobacterium tuberculosis H37Rv
cucgucgaggucc

SEQ ID NO: 1283367 - RNA, 13 nt, Mycobacterium tuberculosis H37Rv
cucggucgccacc

SEQ ID NO: 1283368 - RNA, 18 nt, Mycobacterium tuberculosis H37Rv
cucgguauauccggguga

SEQ ID NO: 1283369 - RNA, 21 nt, Mycobacterium tuberculosis H37Rv
cucggucagagccgucgaagc

SEQ ID NO: 1283370 - RNA, 19 nt, Mycobacterium tuberculosis H37Rv
cucggucagcucgucggcg

SEQ ID NO: 1283371 - RNA, 22 nt, Mycobacterium tuberculosis H37Rv
cucgguaccaccggcacgguga

SEQ ID NO: 1283372 - RNA, 15 nt, Mycobacterium tuberculosis H37Rv
cucgguaggccggca

SEQ ID NO: 1283373 - RNA, 14 nt, Mycobacterium tuberculosis H37Rv
cucgguggcggacg

SEQ ID NO: 1283374 - RNA, 14 nt, Mycobacterium tuberculosis H37Rv
cucggugaccaggc

SEQ ID NO: 1283375 - RNA, 13 nt, Mycobacterium tuberculosis H37Rv
cucggucucgucg

SEQ ID NO: 1283376 - RNA, 15 nt, Mycobacterium tuberculosis H37Rv
cucggugaucucgcg

SEQ ID NO: 1283377 - RNA, 17 nt, Mycobacterium tuberculosis H37Rv
cucggugaaggucaccg

SEQ ID NO: 1283378 - RNA, 18 nt, Mycobacterium tuberculosis H37Rv
cucggugaaguggcgcac

SEQ ID NO: 1283379 - RNA, 22 nt, Mycobacterium tuberculosis H37Rv
cucggugagcagcucggugaca

SEQ ID NO: 1283380 - RNA, 21 nt, Mycobacterium tuberculosis H37Rv
cucggcgccacggugucgcga

SEQ ID NO: 1283381 - RNA, 17 nt, Mycobacterium tuberculosis H37Rv
cucggcgcagccgguga

SEQ ID NO: 1283382 - RNA, 15 nt, Mycobacterium tuberculosis H37Rv
cucggcgccgcccag

SEQ ID NO: 1283383 - RNA, 17 nt, Mycobacterium tuberculosis H37Rv
cucggcgccguuuggcc

SEQ ID NO: 1283384 - RNA, 22 nt, Mycobacterium tuberculosis H37Rv
cucggcgagcaacacgagcgca

SEQ ID NO: 1283385 - RNA, 14 nt, Mycobacterium tuberculosis H37Rv
cucggcgagcaccg

SEQ ID NO: 1283386 - RNA, 17 nt, Mycobacterium tuberculosis H37Rv
cucggcgaucucgucgc

SEQ ID NO: 1283387 - RNA, 13 nt, Mycobacterium tuberculosis H37Rv
cucgcuggccgca

SEQ ID NO: 1283388 - RNA, 13 nt, Mycobacterium tuberculosis H37Rv
cucggcgaccgac

SEQ ID NO: 1283389 - RNA, 16 nt, Mycobacterium tuberculosis H37Rv
cucggggcugucggcg

SEQ ID NO: 1283390 - RNA, 21 nt, Mycobacterium tuberculosis H37Rv
cucgggcgcgggugaccaggc

SEQ ID NO: 1283391 - RNA, 19 nt, Mycobacterium tuberculosis H37Rv
cucgggcaggcggccagcg

SEQ ID NO: 1283392 - RNA, 18 nt, Mycobacterium tuberculosis H37Rv
cucgggcaacucggugac

SEQ ID NO: 1283393 - RNA, 22 nt, Mycobacterium tuberculosis H37Rv
cucggcuucggagccgacaacg

SEQ ID NO: 1283394 - RNA, 20 nt, Mycobacterium tuberculosis H37Rv
cucggcuagguagucgacga

SEQ ID NO: 1283395 - RNA, 16 nt, Mycobacterium tuberculosis H37Rv
cucggcugcucgacgg

SEQ ID NO: 1283396 - RNA, 19 nt, Mycobacterium tuberculosis H37Rv
cucggcguguccgccgaac

SEQ ID NO: 1283397 - RNA, 21 nt, Mycobacterium tuberculosis H37Rv
cucggcgggauccucgaaggc

SEQ ID NO: 1283398 - RNA, 16 nt, Mycobacterium tuberculosis H37Rv
cucggcgggauccucg

SEQ ID NO: 1283399 - RNA, 20 nt, Mycobacterium tuberculosis H37Rv
cucggcggcgcggucgaagc

SEQ ID NO: 1283400 - RNA, 15 nt, Mycobacterium tuberculosis H37Rv
cucggcgcgcgacga

SEQ ID NO: 1283401 - RNA, 17 nt, Mycobacterium tuberculosis H37Rv
cucggcggccgcgugcu

SEQ ID NO: 1283402 - RNA, 15 nt, Mycobacterium tuberculosis H37Rv
cucggcggcggcacg

SEQ ID NO: 1283403 - RNA, 15 nt, Mycobacterium tuberculosis H37Rv
cucgcucacgccguc

SEQ ID NO: 1283404 - RNA, 16 nt, Mycobacterium tuberculosis H37Rv
cucgcuaauugcggcc

SEQ ID NO: 1283405 - RNA, 19 nt, Mycobacterium tuberculosis H37Rv
cucgcucugcgcggcuucg

SEQ ID NO: 1283406 - RNA, 20 nt, Mycobacterium tuberculosis H37Rv
cucgcugaucaggucuucga

SEQ ID NO: 1283407 - RNA, 12 nt, Mycobacterium tuberculosis H37Rv
cucgcucgacgu

SEQ ID NO: 1283408 - RNA, 14 nt, Mycobacterium tuberculosis H37Rv
cucgcuccgaccgg

SEQ ID NO: 1283409 - RNA, 20 nt, Mycobacterium tuberculosis H37Rv
cucgcugcagcagggcuucg

SEQ ID NO: 1283410 - RNA, 20 nt, Mycobacterium tuberculosis H37Rv
cucgcggugcggcaacagcg

SEQ ID NO: 1283411 - RNA, 20 nt, Mycobacterium tuberculosis H37Rv
cucgcggaccucggcgaccu

SEQ ID NO: 1283412 - RNA, 13 nt, Mycobacterium tuberculosis H37Rv
cucgcgccgguga

SEQ ID NO: 1283413 - RNA, 23 nt, Mycobacterium tuberculosis H37Rv
cucgcgcgccacggugucgucga

SEQ ID NO: 1283414 - RNA, 21 nt, Mycobacterium tuberculosis H37Rv
cucgcgcgucgucgcgcugaa

SEQ ID NO: 1283415 - RNA, 14 nt, Mycobacterium tuberculosis H37Rv
cucgcgcucgaugg

SEQ ID NO: 1283416 - RNA, 23 nt, Mycobacterium tuberculosis H37Rv
cucgcgaucgcagugagcagccg

SEQ ID NO: 1283417 - RNA, 23 nt, Mycobacterium tuberculosis H37Rv
cucgcgcaagcggacccgaccgu

SEQ ID NO: 1283418 - RNA, 16 nt, Mycobacterium tuberculosis H37Rv
cucgcgcaagcggacc

SEQ ID NO: 1283419 - RNA, 16 nt, Mycobacterium tuberculosis H37Rv
cucgcgaagaucagcg

SEQ ID NO: 1283420 - RNA, 15 nt, Mycobacterium tuberculosis H37Rv
cucgcgaaaccgccg

SEQ ID NO: 1283421 - RNA, 16 nt, Mycobacterium tuberculosis H37Rv
cucgccugugggugcu

SEQ ID NO: 1283422 - RNA, 22 nt, Mycobacterium tuberculosis H37Rv
cucgcgaagccgguucgcccag

SEQ ID NO: 1283423 - RNA, 21 nt, Mycobacterium tuberculosis H37Rv
cucgcgaagccgguucgccca

SEQ ID NO: 1283424 - RNA, 17 nt, Mycobacterium tuberculosis H37Rv
cucgccagccugaaccg

SEQ ID NO: 1283425 - RNA, 21 nt, Mycobacterium tuberculosis H37Rv
cucgcccaccuccugguugac

SEQ ID NO: 1283426 - RNA, 16 nt, Mycobacterium tuberculosis H37Rv
cucgccagggucgcga

SEQ ID NO: 1283427 - RNA, 22 nt, Mycobacterium tuberculosis H37Rv
cucgcccaccaccacugcggcc

SEQ ID NO: 1283428 - RNA, 18 nt, Mycobacterium tuberculosis H37Rv
cucgccacauuucaccac

SEQ ID NO: 1283429 - RNA, 17 nt, Mycobacterium tuberculosis H37Rv
cucgauuguggccagcg

SEQ ID NO: 1283430 - RNA, 22 nt, Mycobacterium tuberculosis H37Rv
cucgauucccggcgcgguggcc

SEQ ID NO: 1283431 - RNA, 18 nt, Mycobacterium tuberculosis H37Rv
cuccgugggcagcgcgcc

SEQ ID NO: 1283432 - RNA, 17 nt, Mycobacterium tuberculosis H37Rv
cuccucgucgacgucgg

SEQ ID NO: 1283433 - RNA, 14 nt, Mycobacterium tuberculosis H37Rv
cuccucgucgacgu

SEQ ID NO: 1283434 - RNA, 13 nt, Mycobacterium tuberculosis H37Rv
cuccugaguugcg

SEQ ID NO: 1283435 - RNA, 16 nt, Mycobacterium tuberculosis H37Rv
cuccucggcaggccga

SEQ ID NO: 1283436 - RNA, 11 nt, Mycobacterium tuberculosis H37Rv
cuccucgauga

SEQ ID NO: 1283437 - RNA, 14 nt, Mycobacterium tuberculosis H37Rv
cucgacacgccggu

SEQ ID NO: 1283438 - RNA, 21 nt, Mycobacterium tuberculosis H37Rv
cucgaacaucggaacgugacc

SEQ ID NO: 1283439 - RNA, 17 nt, Mycobacterium tuberculosis H37Rv
cucgaacagcucgauca

SEQ ID NO: 1283440 - RNA, 19 nt, Mycobacterium tuberculosis H37Rv
cuccgcggcgcagcacggc

SEQ ID NO: 1283441 - RNA, 18 nt, Mycobacterium tuberculosis H37Rv
cuccgcgguuguuucggc

SEQ ID NO: 1283442 - RNA, 16 nt, Mycobacterium tuberculosis H37Rv
cuccgcgaucaccgac

SEQ ID NO: 1283443 - RNA, 23 nt, Mycobacterium tuberculosis H37Rv
cuccgcccucaguucacguucgg

SEQ ID NO: 1283444 - RNA, 15 nt, Mycobacterium tuberculosis H37Rv
cuccgccgucgccgc

SEQ ID NO: 1283445 - RNA, 22 nt, Mycobacterium tuberculosis H37Rv
cuccggcggcgaagaagccggc

SEQ ID NO: 1283446 - RNA, 22 nt, Mycobacterium tuberculosis H37Rv
cuccggcgccgcccgaggcacc

SEQ ID NO: 1283447 - RNA, 16 nt, Mycobacterium tuberculosis H37Rv
cuccggcucgacaaca

SEQ ID NO: 1283448 - RNA, 17 nt, Mycobacterium tuberculosis H37Rv
cuccggugugaucggcg

SEQ ID NO: 1283449 - RNA, 14 nt, Mycobacterium tuberculosis H37Rv
cuccgguaucggcg

SEQ ID NO: 1283450 - RNA, 14 nt, Mycobacterium tuberculosis H37Rv
cucgacgcccgcca

SEQ ID NO: 1283451 - RNA, 15 nt, Mycobacterium tuberculosis H37Rv
cucgacgucggugaa

SEQ ID NO: 1283452 - RNA, 18 nt, Mycobacterium tuberculosis H37Rv
cucgacgucgucgucgac

SEQ ID NO: 1283453 - RNA, 15 nt, Mycobacterium tuberculosis H37Rv
cucgacgaucagcac

SEQ ID NO: 1283454 - RNA, 20 nt, Mycobacterium tuberculosis H37Rv
cucgagcaggcgcaccaggc

SEQ ID NO: 1283455 - RNA, 16 nt, Mycobacterium tuberculosis H37Rv
cucgacgaauaccggg

SEQ ID NO: 1283456 - RNA, 19 nt, Mycobacterium tuberculosis H37Rv
cucgacauccucgauggac

SEQ ID NO: 1283457 - RNA, 21 nt, Mycobacterium tuberculosis H37Rv
cucgaucagccgggugcgcac

SEQ ID NO: 1283458 - RNA, 17 nt, Mycobacterium tuberculosis H37Rv
cucgaucaccggcaugc

SEQ ID NO: 1283459 - RNA, 14 nt, Mycobacterium tuberculosis H37Rv
cucgaguaucucgg

SEQ ID NO: 1283460 - RNA, 17 nt, Mycobacterium tuberculosis H37Rv
cucgaguaccgucugga

SEQ ID NO: 1283461 - RNA, 16 nt, Mycobacterium tuberculosis H37Rv
cucgaguugcucgaca

SEQ ID NO: 1283462 - RNA, 20 nt, Mycobacterium tuberculosis H37Rv
cucgauggucucccggcuga

SEQ ID NO: 1283463 - RNA, 16 nt, Mycobacterium tuberculosis H37Rv
cucgauggcggccacc

SEQ ID NO: 1283464 - RNA, 17 nt, Mycobacterium tuberculosis H37Rv
cucgauggcggccacca

SEQ ID NO: 1283465 - RNA, 21 nt, Mycobacterium tuberculosis H37Rv
cucgaugguuuucucgaaguc

SEQ ID NO: 1283466 - RNA, 19 nt, Mycobacterium tuberculosis H37Rv
cucgauguccucgauccgg

SEQ ID NO: 1283467 - RNA, 17 nt, Mycobacterium tuberculosis H37Rv
cucgaugucgcggucgc

SEQ ID NO: 1283468 - RNA, 13 nt, Mycobacterium tuberculosis H37Rv
cucgauggaccgc

SEQ ID NO: 1283469 - RNA, 19 nt, Mycobacterium tuberculosis H37Rv
cucccgcaacauuuucgcc

SEQ ID NO: 1283470 - RNA, 16 nt, Mycobacterium tuberculosis H37Rv
cuccccgcgcgcugau

SEQ ID NO: 1283471 - RNA, 19 nt, Mycobacterium tuberculosis H37Rv
cuccccgaucagcaccgac

SEQ ID NO: 1283472 - RNA, 20 nt, Mycobacterium tuberculosis H37Rv
cuccagcagcucgccggcac

SEQ ID NO: 1283473 - RNA, 13 nt, Mycobacterium tuberculosis H37Rv
cuccagcacccgg

SEQ ID NO: 1283474 - RNA, 15 nt, Mycobacterium tuberculosis H37Rv
cuccagcagcgacgg

SEQ ID NO: 1283475 - RNA, 17 nt, Mycobacterium tuberculosis H37Rv
cuccagcacccggucga

SEQ ID NO: 1283476 - RNA, 21 nt, Mycobacterium tuberculosis H37Rv
cuccagauccacgccgaccau

SEQ ID NO: 1283477 - RNA, 23 nt, Mycobacterium tuberculosis H37Rv
cuccaccgucgcaccagcgaacg

SEQ ID NO: 1283478 - RNA, 13 nt, Mycobacterium tuberculosis H37Rv
cuccaccgucgcc

SEQ ID NO: 1283479 - RNA, 14 nt, Mycobacterium tuberculosis H37Rv
cuccagcaccagca

SEQ ID NO: 1283480 - RNA, 14 nt, Mycobacterium tuberculosis H37Rv
cuccgccaaggagg

SEQ ID NO: 1283481 - RNA, 22 nt, Mycobacterium tuberculosis H37Rv
cuccgacucgauauaacccggc

SEQ ID NO: 1283482 - RNA, 14 nt, Mycobacterium tuberculosis H37Rv
cuccgacgggcgaa

SEQ ID NO: 1283483 - RNA, 18 nt, Mycobacterium tuberculosis H37Rv
cuccgaacauggccagca

SEQ ID NO: 1283484 - RNA, 20 nt, Mycobacterium tuberculosis H37Rv
cucccgcacggccgggucga

SEQ ID NO: 1283485 - RNA, 18 nt, Mycobacterium tuberculosis H37Rv
cucccucuagcgcccgaa

SEQ ID NO: 1283486 - RNA, 18 nt, Mycobacterium tuberculosis H37Rv
cuagucgugccgcgucgg

SEQ ID NO: 1283487 - RNA, 14 nt, Mycobacterium tuberculosis H37Rv
cucagcgaugcuca

SEQ ID NO: 1283488 - RNA, 17 nt, Mycobacterium tuberculosis H37Rv
cucagccgugcccaggc

SEQ ID NO: 1283489 - RNA, 20 nt, Mycobacterium tuberculosis H37Rv
cucagccguucgcagcugau

SEQ ID NO: 1283490 - RNA, 17 nt, Mycobacterium tuberculosis H37Rv
cucagcggcgaccgcau

SEQ ID NO: 1283491 - RNA, 15 nt, Mycobacterium tuberculosis H37Rv
cucauagcgacggcg

SEQ ID NO: 1283492 - RNA, 17 nt, Mycobacterium tuberculosis H37Rv
cucauagagcggcacca

SEQ ID NO: 1283493 - RNA, 20 nt, Mycobacterium tuberculosis H37Rv
cucauaggccugcagccgau

SEQ ID NO: 1283494 - RNA, 14 nt, Mycobacterium tuberculosis H37Rv
cucaucuguaaccu

SEQ ID NO: 1283495 - RNA, 15 nt, Mycobacterium tuberculosis H37Rv
cucaugcacccggua

SEQ ID NO: 1283496 - RNA, 14 nt, Mycobacterium tuberculosis H37Rv
cucaucuucgguca

SEQ ID NO: 1283497 - RNA, 21 nt, Mycobacterium tuberculosis H37Rv
cucaucuuugacaccggucgg

SEQ ID NO: 1283498 - RNA, 18 nt, Mycobacterium tuberculosis H37Rv
cucaugcuaggccaccgg

SEQ ID NO: 1283499 - RNA, 22 nt, Mycobacterium tuberculosis H37Rv
cuccagacguuccaucacggac

SEQ ID NO: 1283500 - RNA, 21 nt, Mycobacterium tuberculosis H37Rv
cuccaccgaaaaguccgccgc

SEQ ID NO: 1283501 - RNA, 20 nt, Mycobacterium tuberculosis H37Rv
cuccaccgcgccgucgucga

SEQ ID NO: 1283502 - RNA, 12 nt, Mycobacterium tuberculosis H37Rv
cguuaccgccaa

SEQ ID NO: 1283503 - RNA, 20 nt, Mycobacterium tuberculosis H37Rv
cguuaccggacccgcugauc

SEQ ID NO: 1283504 - RNA, 13 nt, Mycobacterium tuberculosis H37Rv
cguguuaaccggg

SEQ ID NO: 1283505 - RNA, 18 nt, Mycobacterium tuberculosis H37Rv
cguuauccgacgaaccgg

SEQ ID NO: 1283506 - RNA, 22 nt, Mycobacterium tuberculosis H37Rv
cguuagcuuagcugccgucggu

SEQ ID NO: 1283507 - RNA, 22 nt, Mycobacterium tuberculosis H37Rv
cguuacuggcgucgaugucgcc

SEQ ID NO: 1283508 - RNA, 19 nt, Mycobacterium tuberculosis H37Rv
cgugugcgcgugcugcgga

SEQ ID NO: 1283509 - RNA, 22 nt, Mycobacterium tuberculosis H37Rv
cgugugugcgauccagggccga

SEQ ID NO: 1283510 - RNA, 18 nt, Mycobacterium tuberculosis H37Rv
cguguggugugucaccgg

SEQ ID NO: 1283511 - RNA, 16 nt, Mycobacterium tuberculosis H37Rv
cgugucuugucgcgca

SEQ ID NO: 1283512 - RNA, 15 nt, Mycobacterium tuberculosis H37Rv
cgugucguugccagg

SEQ ID NO: 1283513 - RNA, 19 nt, Mycobacterium tuberculosis H37Rv
cgugucuugucgcgcagca

SEQ ID NO: 1283514 - RNA, 21 nt, Mycobacterium tuberculosis H37Rv
cgugugaggccuucgccgacu

SEQ ID NO: 1283515 - RNA, 19 nt, Mycobacterium tuberculosis H37Rv
cgugucggcggugccgacg

SEQ ID NO: 1283516 - RNA, 23 nt, Mycobacterium tuberculosis H37Rv
cguuccacaucaaaacggcggug

SEQ ID NO: 1283517 - RNA, 19 nt, Mycobacterium tuberculosis H37Rv
cguucauguagcagcgcgg

SEQ ID NO: 1283518 - RNA, 14 nt, Mycobacterium tuberculosis H37Rv
cguuccacacagau

SEQ ID NO: 1283519 - RNA, 17 nt, Mycobacterium tuberculosis H37Rv
cguuccacgccggcauc

SEQ ID NO: 1283520 - RNA, 14 nt, Mycobacterium tuberculosis H37Rv
cguuccaucacgga

SEQ ID NO: 1283521 - RNA, 17 nt, Mycobacterium tuberculosis H37Rv
cguuccaucacggacca

SEQ ID NO: 1283522 - RNA, 18 nt, Mycobacterium tuberculosis H37Rv
cguuccgggccgaucacc

SEQ ID NO: 1283523 - RNA, 16 nt, Mycobacterium tuberculosis H37Rv
cguuccgggccgauca

SEQ ID NO: 1283524 - RNA, 16 nt, Mycobacterium tuberculosis H37Rv
cguucgaaggccaccc

SEQ ID NO: 1283525 - RNA, 18 nt, Mycobacterium tuberculosis H37Rv
cguucgaacuggcuggug

SEQ ID NO: 1283526 - RNA, 22 nt, Mycobacterium tuberculosis H37Rv
cguucgacucgaccgcgacggc

SEQ ID NO: 1283527 - RNA, 14 nt, Mycobacterium tuberculosis H37Rv
cguucgacccagcg

SEQ ID NO: 1283528 - RNA, 19 nt, Mycobacterium tuberculosis H37Rv
cguucgcgucacaccagcg

SEQ ID NO: 1283529 - RNA, 21 nt, Mycobacterium tuberculosis H37Rv
cguucgccggaauacaccagc

SEQ ID NO: 1283530 - RNA, 15 nt, Mycobacterium tuberculosis H37Rv
cguucgccgucggug

SEQ ID NO: 1283531 - RNA, 16 nt, Mycobacterium tuberculosis H37Rv
cguugauacgcgucga

SEQ ID NO: 1283532 - RNA, 17 nt, Mycobacterium tuberculosis H37Rv
cguugaucccgaaccgu

SEQ ID NO: 1283533 - RNA, 16 nt, Mycobacterium tuberculosis H37Rv
cguugcagcucgaucc

SEQ ID NO: 1283534 - RNA, 23 nt, Mycobacterium tuberculosis H37Rv
cguucgcucccccgcuacgcgcg

SEQ ID NO: 1283535 - RNA, 18 nt, Mycobacterium tuberculosis H37Rv
cguucgucggcugcggcg

SEQ ID NO: 1283536 - RNA, 16 nt, Mycobacterium tuberculosis H37Rv
cguucgucguggaucc

SEQ ID NO: 1283537 - RNA, 15 nt, Mycobacterium tuberculosis H37Rv
cguugcguaucgacc

SEQ ID NO: 1283538 - RNA, 20 nt, Mycobacterium tuberculosis H37Rv
cguugccaagcagcugggca

SEQ ID NO: 1283539 - RNA, 20 nt, Mycobacterium tuberculosis H37Rv
cguugcugaugucgccggug

SEQ ID NO: 1283540 - RNA, 19 nt, Mycobacterium tuberculosis H37Rv
cguugcucggucucgucgc

SEQ ID NO: 1283541 - RNA, 19 nt, Mycobacterium tuberculosis H37Rv
cguugcucccacggcaccc

SEQ ID NO: 1283542 - RNA, 17 nt, Mycobacterium tuberculosis H37Rv
cguugcugcgcagcggc

SEQ ID NO: 1283543 - RNA, 14 nt, Mycobacterium tuberculosis H37Rv
cguugcuggcuggg

SEQ ID NO: 1283544 - RNA, 16 nt, Mycobacterium tuberculosis H37Rv
cguugcuggcggccag

SEQ ID NO: 1283545 - RNA, 17 nt, Mycobacterium tuberculosis H37Rv
cguugcugccggcguag

SEQ ID NO: 1283546 - RNA, 23 nt, Mycobacterium tuberculosis H37Rv
cguuggcaaugaccccggcguug

SEQ ID NO: 1283547 - RNA, 15 nt, Mycobacterium tuberculosis H37Rv
cguuggacggcaccg

SEQ ID NO: 1283548 - RNA, 16 nt, Mycobacterium tuberculosis H37Rv
cguuggagccgccacc

SEQ ID NO: 1283549 - RNA, 22 nt, Mycobacterium tuberculosis H37Rv
cguuggcaccgggugcgacggc

SEQ ID NO: 1283550 - RNA, 20 nt, Mycobacterium tuberculosis H37Rv
cguggucgacggggcggucg

SEQ ID NO: 1283551 - RNA, 20 nt, Mycobacterium tuberculosis H37Rv
cguggucgagggcggcgucg

SEQ ID NO: 1283552 - RNA, 23 nt, Mycobacterium tuberculosis H37Rv
cgugguuuugucgacguucggug

SEQ ID NO: 1283553 - RNA, 20 nt, Mycobacterium tuberculosis H37Rv
cgugggugucgguggccgcg

SEQ ID NO: 1283554 - RNA, 15 nt, Mycobacterium tuberculosis H37Rv
cgugguaaccagggc

SEQ ID NO: 1283555 - RNA, 19 nt, Mycobacterium tuberculosis H37Rv
cgugguagcgccucgugag

SEQ ID NO: 1283556 - RNA, 21 nt, Mycobacterium tuberculosis H37Rv
cguggucaccccuucgccagc

SEQ ID NO: 1283557 - RNA, 18 nt, Mycobacterium tuberculosis H37Rv
cgugguauagcgcacugc

SEQ ID NO: 1283558 - RNA, 21 nt, Mycobacterium tuberculosis H37Rv
cgugguauccgccguucucgc

SEQ ID NO: 1283559 - RNA, 16 nt, Mycobacterium tuberculosis H37Rv
cgugucgccgccguug

SEQ ID NO: 1283560 - RNA, 16 nt, Mycobacterium tuberculosis H37Rv
cgugucgccgccacca

SEQ ID NO: 1283561 - RNA, 20 nt, Mycobacterium tuberculosis H37Rv
cgugucgccgauaucgguga

SEQ ID NO: 1283562 - RNA, 16 nt, Mycobacterium tuberculosis H37Rv
cgugucgagcgccgca

SEQ ID NO: 1283563 - RNA, 22 nt, Mycobacterium tuberculosis H37Rv
cgugucaugcucaccgaggaac

SEQ ID NO: 1283564 - RNA, 12 nt, Mycobacterium tuberculosis H37Rv
cguguccgccgu

SEQ ID NO: 1283565 - RNA, 22 nt, Mycobacterium tuberculosis H37Rv
cgugucacccaauggagccgcg

SEQ ID NO: 1283566 - RNA, 15 nt, Mycobacterium tuberculosis H37Rv
cgugucacgcgacca

SEQ ID NO: 1283567 - RNA, 15 nt, Mycobacterium tuberculosis H37Rv
cguguacgucgauca

SEQ ID NO: 1283568 - RNA, 17 nt, Mycobacterium tuberculosis H37Rv
cguguacauugccgacc

SEQ ID NO: 1283569 - RNA, 22 nt, Mycobacterium tuberculosis H37Rv
cguggguacgcaucucgagcau

SEQ ID NO: 1283570 - RNA, 18 nt, Mycobacterium tuberculosis H37Rv
cgugggugagcgaccugg

SEQ ID NO: 1283571 - RNA, 16 nt, Mycobacterium tuberculosis H37Rv
cgugggucaacgucag

SEQ ID NO: 1283572 - RNA, 18 nt, Mycobacterium tuberculosis H37Rv
cgugggugucggcuagca

SEQ ID NO: 1283573 - RNA, 21 nt, Mycobacterium tuberculosis H37Rv
cgugggugucggcuagcaacg

SEQ ID NO: 1283574 - RNA, 23 nt, Mycobacterium tuberculosis H37Rv
cguggcuggcaugccggcgugcg

SEQ ID NO: 1283575 - RNA, 13 nt, Mycobacterium tuberculosis H37Rv
cguggcuggcacc

SEQ ID NO: 1283576 - RNA, 16 nt, Mycobacterium tuberculosis H37Rv
cguggcuaccgcaggu

SEQ ID NO: 1283577 - RNA, 22 nt, Mycobacterium tuberculosis H37Rv
cguggcgggcugcagccgacag

SEQ ID NO: 1283578 - RNA, 15 nt, Mycobacterium tuberculosis H37Rv
cguggcgaaccaggg

SEQ ID NO: 1283579 - RNA, 21 nt, Mycobacterium tuberculosis H37Rv
cguggcccuccucggugaggu

SEQ ID NO: 1283580 - RNA, 15 nt, Mycobacterium tuberculosis H37Rv
cguggcccuccucgg

SEQ ID NO: 1283581 - RNA, 17 nt, Mycobacterium tuberculosis H37Rv
cguggcccuccucggug

SEQ ID NO: 1283582 - RNA, 20 nt, Mycobacterium tuberculosis H37Rv
cguggccgcacugcugguca

SEQ ID NO: 1283583 - RNA, 19 nt, Mycobacterium tuberculosis H37Rv
cgugcgcgcgcagcugacg

SEQ ID NO: 1283584 - RNA, 15 nt, Mycobacterium tuberculosis H37Rv
cgugcgcgcgcagcu

SEQ ID NO: 1283585 - RNA, 19 nt, Mycobacterium tuberculosis H37Rv
cgucucggguggggaucac

SEQ ID NO: 1283586 - RNA, 22 nt, Mycobacterium tuberculosis H37Rv
cgucucgcggugcggcaacagc

SEQ ID NO: 1283587 - RNA, 13 nt, Mycobacterium tuberculosis H37Rv
cgucucgcggugc

SEQ ID NO: 1283588 - RNA, 11 nt, Mycobacterium tuberculosis H37Rv
cgucucgauga

SEQ ID NO: 1283589 - RNA, 19 nt, Mycobacterium tuberculosis H37Rv
cgucucgcggugcggcaac

SEQ ID NO: 1283590 - RNA, 12 nt, Mycobacterium tuberculosis H37Rv
cgugcucaccgg

SEQ ID NO: 1283591 - RNA, 20 nt, Mycobacterium tuberculosis H37Rv
cgugcggaucgcgcugcggg

SEQ ID NO: 1283592 - RNA, 17 nt, Mycobacterium tuberculosis H37Rv
cgugcggucgugccccg

SEQ ID NO: 1283593 - RNA, 19 nt, Mycobacterium tuberculosis H37Rv
cgugcgguauuugaacgcc

SEQ ID NO: 1283594 - RNA, 14 nt, Mycobacterium tuberculosis H37Rv
cguggaugucgcgg

SEQ ID NO: 1283595 - RNA, 18 nt, Mycobacterium tuberculosis H37Rv
cguggcagugcaggcggc

SEQ ID NO: 1283596 - RNA, 16 nt, Mycobacterium tuberculosis H37Rv
cguggcaguacaccgg

SEQ ID NO: 1283597 - RNA, 22 nt, Mycobacterium tuberculosis H37Rv
cguggaguggacugagucguag

SEQ ID NO: 1283598 - RNA, 22 nt, Mycobacterium tuberculosis H37Rv
cguggauaacgacugacaacgg

SEQ ID NO: 1283599 - RNA, 14 nt, Mycobacterium tuberculosis H37Rv
cguggauggccgcc

SEQ ID NO: 1283600 - RNA, 20 nt, Mycobacterium tuberculosis H37Rv
cgugcuguuccagcgucugc

SEQ ID NO: 1283601 - RNA, 21 nt, Mycobacterium tuberculosis H37Rv
cgugcuguuguacugcggaug

SEQ ID NO: 1283602 - RNA, 21 nt, Mycobacterium tuberculosis H37Rv
cgugcuguggaugccgacggc

SEQ ID NO: 1283603 - RNA, 16 nt, Mycobacterium tuberculosis H37Rv
cgugcuguggaugccg

SEQ ID NO: 1283604 - RNA, 15 nt, Mycobacterium tuberculosis H37Rv
cgugcugggccgacg

SEQ ID NO: 1283605 - RNA, 17 nt, Mycobacterium tuberculosis H37Rv
cgugcugggugacaccg

SEQ ID NO: 1283606 - RNA, 19 nt, Mycobacterium tuberculosis H37Rv
cuaggccaagccgcggcua

SEQ ID NO: 1283607 - RNA, 14 nt, Mycobacterium tuberculosis H37Rv
cuagggucaccgac

SEQ ID NO: 1283608 - RNA, 11 nt, Mycobacterium tuberculosis H37Rv
cuagguucagu

SEQ ID NO: 1283609 - RNA, 19 nt, Mycobacterium tuberculosis H37Rv
cuaggugacgccgccagca

SEQ ID NO: 1283610 - RNA, 18 nt, Mycobacterium tuberculosis H37Rv
cuaggucgcgcugaaggu

SEQ ID NO: 1283611 - RNA, 14 nt, Mycobacterium tuberculosis H37Rv
cuaggucagcgggc

SEQ ID NO: 1283612 - RNA, 18 nt, Mycobacterium tuberculosis H37Rv
cuaggucgacgccgacca

SEQ ID NO: 1283613 - RNA, 13 nt, Mycobacterium tuberculosis H37Rv
cuaggucagcggg

SEQ ID NO: 1283614 - RNA, 20 nt, Mycobacterium tuberculosis H37Rv
cuaggccaaaccccugcacg

SEQ ID NO: 1283615 - RNA, 23 nt, Mycobacterium tuberculosis H37Rv
cuaggaagguggcccgcgcguac

SEQ ID NO: 1283616 - RNA, 15 nt, Mycobacterium tuberculosis H37Rv
cuagcggcucaccgc

SEQ ID NO: 1283617 - RNA, 18 nt, Mycobacterium tuberculosis H37Rv
cuagcgcuugcgaccccg

SEQ ID NO: 1283618 - RNA, 15 nt, Mycobacterium tuberculosis H37Rv
cuagcgcggcgacga

SEQ ID NO: 1283619 - RNA, 13 nt, Mycobacterium tuberculosis H37Rv
cuacugcgaucgc

SEQ ID NO: 1283620 - RNA, 15 nt, Mycobacterium tuberculosis H37Rv
cuagacugcugguca

SEQ ID NO: 1283621 - RNA, 16 nt, Mycobacterium tuberculosis H37Rv
cuagacgccgccgcug

SEQ ID NO: 1283622 - RNA, 20 nt, Mycobacterium tuberculosis H37Rv
cuagcgccaaauccggcuug

SEQ ID NO: 1283623 - RNA, 20 nt, Mycobacterium tuberculosis H37Rv
cuaccgagauugggcuggga

SEQ ID NO: 1283624 - RNA, 19 nt, Mycobacterium tuberculosis H37Rv
cuacccgcgcgaccugaau

SEQ ID NO: 1283625 - RNA, 21 nt, Mycobacterium tuberculosis H37Rv
cuaccgccggcggcggccgca

SEQ ID NO: 1283626 - RNA, 18 nt, Mycobacterium tuberculosis H37Rv
cuaccgcccgcgccaccg

SEQ ID NO: 1283627 - RNA, 18 nt, Mycobacterium tuberculosis H37Rv
cuaccgccuugucggcga

SEQ ID NO: 1283628 - RNA, 13 nt, Mycobacterium tuberculosis H37Rv
cuaccgucgacca

SEQ ID NO: 1283629 - RNA, 20 nt, Mycobacterium tuberculosis H37Rv
cuaccgccuugucggcgaug

SEQ ID NO: 1283630 - RNA, 14 nt, Mycobacterium tuberculosis H37Rv
cuacgccccacugc

SEQ ID NO: 1283631 - RNA, 22 nt, Mycobacterium tuberculosis H37Rv
cuacgcgcgcucgcucaccggc

SEQ ID NO: 1283632 - RNA, 21 nt, Mycobacterium tuberculosis H37Rv
cuacgcgcgcucgcucaccgg

SEQ ID NO: 1283633 - RNA, 17 nt, Mycobacterium tuberculosis H37Rv
cuacgcgcgcucgcuca

SEQ ID NO: 1283634 - RNA, 15 nt, Mycobacterium tuberculosis H37Rv
cuacgcgcgcucgcu

SEQ ID NO: 1283635 - RNA, 17 nt, Mycobacterium tuberculosis H37Rv
cuacccauggcccguug

SEQ ID NO: 1283636 - RNA, 22 nt, Mycobacterium tuberculosis H37Rv
cuacaugggggcguuggcgggc

SEQ ID NO: 1283637 - RNA, 18 nt, Mycobacterium tuberculosis H37Rv
cuacaucgaucagaugcg

SEQ ID NO: 1283638 - RNA, 15 nt, Mycobacterium tuberculosis H37Rv
cuaauucgccucgcc

SEQ ID NO: 1283639 - RNA, 21 nt, Mycobacterium tuberculosis H37Rv
cuaaugucgauuucgaugacg

SEQ ID NO: 1283640 - RNA, 16 nt, Mycobacterium tuberculosis H37Rv
cuaaggcucaccaggc

SEQ ID NO: 1283641 - RNA, 13 nt, Mycobacterium tuberculosis H37Rv
cuaaggcucacca

SEQ ID NO: 1283642 - RNA, 17 nt, Mycobacterium tuberculosis H37Rv
cguugugagccacgcgc

SEQ ID NO: 1283643 - RNA, 15 nt, Mycobacterium tuberculosis H37Rv
cguugugcagcgcgu

SEQ ID NO: 1283644 - RNA, 16 nt, Mycobacterium tuberculosis H37Rv
cguuguccagaacggc

SEQ ID NO: 1283645 - RNA, 16 nt, Mycobacterium tuberculosis H37Rv
cguuucgccagccggc

SEQ ID NO: 1283646 - RNA, 22 nt, Mycobacterium tuberculosis H37Rv
cguuucccggguccuggaucag

SEQ ID NO: 1283647 - RNA, 24 nt, Mycobacterium tuberculosis H37Rv
cguuucagcuagaccgaucaccgg

SEQ ID NO: 1283648 - RNA, 21 nt, Mycobacterium tuberculosis H37Rv
cguuggugccuucaccgccgu

SEQ ID NO: 1283649 - RNA, 21 nt, Mycobacterium tuberculosis H37Rv
cguugguugcguccgccgaac

SEQ ID NO: 1283650 - RNA, 22 nt, Mycobacterium tuberculosis H37Rv
cguugguggucggcccuccacc

SEQ ID NO: 1283651 - RNA, 20 nt, Mycobacterium tuberculosis H37Rv
cguugucagcgaacggccag

SEQ ID NO: 1283652 - RNA, 17 nt, Mycobacterium tuberculosis H37Rv
cguuguaugcguuacgc

SEQ ID NO: 1283653 - RNA, 20 nt, Mycobacterium tuberculosis H37Rv
cguugggcaugucgccgaac

SEQ ID NO: 1283654 - RNA, 22 nt, Mycobacterium tuberculosis H37Rv
cguuggcuggugcaggugacga

SEQ ID NO: 1283655 - RNA, 16 nt, Mycobacterium tuberculosis H37Rv
cguugggauccggugg

SEQ ID NO: 1283656 - RNA, 21 nt, Mycobacterium tuberculosis H37Rv
cguuggcgccggccaacaggu

SEQ ID NO: 1283657 - RNA, 19 nt, Mycobacterium tuberculosis H37Rv
cguuggcgaucucgacggc

SEQ ID NO: 1283658 - RNA, 18 nt, Mycobacterium tuberculosis H37Rv
cguuggcgaucucgacgg

SEQ ID NO: 1283659 - RNA, 20 nt, Mycobacterium tuberculosis H37Rv
cuaacgucgaucucggcgca

SEQ ID NO: 1283660 - RNA, 17 nt, Mycobacterium tuberculosis H37Rv
cuaacggcagccaccgu

SEQ ID NO: 1283661 - RNA, 20 nt, Mycobacterium tuberculosis H37Rv
cuaacccgcaccuacccugc

SEQ ID NO: 1283662 - RNA, 19 nt, Mycobacterium tuberculosis H37Rv
cuaacacuagcccgguauc

SEQ ID NO: 1283663 - RNA, 18 nt, Mycobacterium tuberculosis H37Rv
cuaaccccggcucgacgc

SEQ ID NO: 1283664 - RNA, 17 nt, Mycobacterium tuberculosis H37Rv
cuaaagcccccgacacg

SEQ ID NO: 1283665 - RNA, 17 nt, Mycobacterium tuberculosis H37Rv
cuaaagcccucgacacg

SEQ ID NO: 1283666 - RNA, 18 nt, Mycobacterium tuberculosis H37Rv
cuaaagcccucgacacgc

SEQ ID NO: 1283667 - RNA, 16 nt, Mycobacterium tuberculosis H37Rv
cguuucgcgacgucug

SEQ ID NO: 1283668 - RNA, 23 nt, Mycobacterium tuberculosis H37Rv
cguuucgcgacgucugccaggcg

SEQ ID NO: 1283669 - RNA, 21 nt, Mycobacterium tuberculosis H37Rv
cguuucccaggcccgacacgg

SEQ ID NO: 1283670 - RNA, 22 nt, Mycobacterium tuberculosis H37Rv
cguuucggcgggcgccucggug

SEQ ID NO: 1283671 - RNA, 18 nt, Mycobacterium tuberculosis H37Rv
cguuugagcggccaccgu

SEQ ID NO: 1283672 - RNA, 14 nt, Mycobacterium tuberculosis H37Rv
cguuugccggccca

SEQ ID NO: 1283673 - RNA, 12 nt, Mycobacterium tuberculosis H37Rv
cggucugcucca

SEQ ID NO: 1283674 - RNA, 20 nt, Mycobacterium tuberculosis H37Rv
cggucuggcccgcgacaucg

SEQ ID NO: 1283675 - RNA, 20 nt, Mycobacterium tuberculosis H37Rv
cggucugguugucgaucucg

SEQ ID NO: 1283676 - RNA, 14 nt, Mycobacterium tuberculosis H37Rv
cggucuggcgauga

SEQ ID NO: 1283677 - RNA, 13 nt, Mycobacterium tuberculosis H37Rv
cggucuggugguc

SEQ ID NO: 1283678 - RNA, 19 nt, Mycobacterium tuberculosis H37Rv
cggucugguugggccagcu

SEQ ID NO: 1283679 - RNA, 15 nt, Mycobacterium tuberculosis H37Rv
cggucuugcaucgcc

SEQ ID NO: 1283680 - RNA, 17 nt, Mycobacterium tuberculosis H37Rv
cggucuugcaucgccga

SEQ ID NO: 1283681 - RNA, 12 nt, Mycobacterium tuberculosis H37Rv
cggucguggucc

SEQ ID NO: 1283682 - RNA, 16 nt, Mycobacterium tuberculosis H37Rv
cggucggugagccgug

SEQ ID NO: 1283683 - RNA, 23 nt, Mycobacterium tuberculosis H37Rv
cggucguuggauauggucaccgg

SEQ ID NO: 1283684 - RNA, 15 nt, Mycobacterium tuberculosis H37Rv
cggucguuggucggg

SEQ ID NO: 1283685 - RNA, 17 nt, Mycobacterium tuberculosis H37Rv
cggucucaugcacccgg

SEQ ID NO: 1283686 - RNA, 22 nt, Mycobacterium tuberculosis H37Rv
cggucuccaccaccgacgagga

SEQ ID NO: 1283687 - RNA, 19 nt, Mycobacterium tuberculosis H37Rv
cggucucguaaccaggcua

SEQ ID NO: 1283688 - RNA, 15 nt, Mycobacterium tuberculosis H37Rv
cggucugaccgcguc

SEQ ID NO: 1283689 - RNA, 20 nt, Mycobacterium tuberculosis H37Rv
cggucugaccgcgucggcgu

SEQ ID NO: 1283690 - RNA, 18 nt, Mycobacterium tuberculosis H37Rv
cggugaacaaaugccggu

SEQ ID NO: 1283691 - RNA, 15 nt, Mycobacterium tuberculosis H37Rv
cggugaacgacgggu

SEQ ID NO: 1283692 - RNA, 20 nt, Mycobacterium tuberculosis H37Rv
cggugaagaaguucggguag

SEQ ID NO: 1283693 - RNA, 18 nt, Mycobacterium tuberculosis H37Rv
cggugaagaaguucgggu

SEQ ID NO: 1283694 - RNA, 22 nt, Mycobacterium tuberculosis H37Rv
cggugaacuucuccaccagcgu

SEQ ID NO: 1283695 - RNA, 22 nt, Mycobacterium tuberculosis H37Rv
cggugaaggucaccgucgaguc

SEQ ID NO: 1283696 - RNA, 16 nt, Mycobacterium tuberculosis H37Rv
cggugaaaucgcacag

SEQ ID NO: 1283697 - RNA, 18 nt, Mycobacterium tuberculosis H37Rv
cggugaaaugacggcuga

SEQ ID NO: 1283698 - RNA, 19 nt, Mycobacterium tuberculosis H37Rv
cggugaaccaacgcgaccg

SEQ ID NO: 1283699 - RNA, 17 nt, Mycobacterium tuberculosis H37Rv
cggucuuggcgcgccca

SEQ ID NO: 1283700 - RNA, 21 nt, Mycobacterium tuberculosis H37Rv
cggugaaaccggccuucucgc

SEQ ID NO: 1283701 - RNA, 17 nt, Mycobacterium tuberculosis H37Rv
cggugaaaaaggcgacu

SEQ ID NO: 1283702 - RNA, 15 nt, Mycobacterium tuberculosis H37Rv
cggugaauucggcga

SEQ ID NO: 1283703 - RNA, 19 nt, Mycobacterium tuberculosis H37Rv
cggugaaguagugcucgca

SEQ ID NO: 1283704 - RNA, 22 nt, Mycobacterium tuberculosis H37Rv
cggugaaguccuccacgcuggc

SEQ ID NO: 1283705 - RNA, 18 nt, Mycobacterium tuberculosis H37Rv
cggugaauucacgaugcu

SEQ ID NO: 1283706 - RNA, 12 nt, Mycobacterium tuberculosis H37Rv
cggugacccgcu

SEQ ID NO: 1283707 - RNA, 17 nt, Mycobacterium tuberculosis H37Rv
cggugacccgcugggcc

SEQ ID NO: 1283708 - RNA, 13 nt, Mycobacterium tuberculosis H37Rv
cggugaaugccgu

SEQ ID NO: 1283709 - RNA, 15 nt, Mycobacterium tuberculosis H37Rv
cggugaccgcgaugu

SEQ ID NO: 1283710 - RNA, 18 nt, Mycobacterium tuberculosis H37Rv
cggugacaaggauggucg

SEQ ID NO: 1283711 - RNA, 23 nt, Mycobacterium tuberculosis H37Rv
cggugaccagcaaccaccccagg

SEQ ID NO: 1283712 - RNA, 14 nt, Mycobacterium tuberculosis H37Rv
cggucggcugggcg

SEQ ID NO: 1283713 - RNA, 22 nt, Mycobacterium tuberculosis H37Rv
cggucggcgguagccgaccagc

SEQ ID NO: 1283714 - RNA, 20 nt, Mycobacterium tuberculosis H37Rv
cggucgguacccgcacccgu

SEQ ID NO: 1283715 - RNA, 15 nt, Mycobacterium tuberculosis H37Rv
cggucggguuggccg

SEQ ID NO: 1283716 - RNA, 23 nt, Mycobacterium tuberculosis H37Rv
cggucggguuggccgggcuggcg

SEQ ID NO: 1283717 - RNA, 18 nt, Mycobacterium tuberculosis H37Rv
cggucggucaccauggcg

SEQ ID NO: 1283718 - RNA, 18 nt, Mycobacterium tuberculosis H37Rv
cggucguagcuucggguc

SEQ ID NO: 1283719 - RNA, 23 nt, Mycobacterium tuberculosis H37Rv
cggucguagcuucggguccagcg

SEQ ID NO: 1283720 - RNA, 12 nt, Mycobacterium tuberculosis H37Rv
cggucgucgcga

SEQ ID NO: 1283721 - RNA, 22 nt, Mycobacterium tuberculosis H37Rv
cggucguacaugucuaucgugg

SEQ ID NO: 1283722 - RNA, 20 nt, Mycobacterium tuberculosis H37Rv
cggucguagacagucugcga

SEQ ID NO: 1283723 - RNA, 15 nt, Mycobacterium tuberculosis H37Rv
cggucggcagcgacg

SEQ ID NO: 1283724 - RNA, 13 nt, Mycobacterium tuberculosis H37Rv
cggucggcaccac

SEQ ID NO: 1283725 - RNA, 22 nt, Mycobacterium tuberculosis H37Rv
cggucggacggccaucgccagc

SEQ ID NO: 1283726 - RNA, 23 nt, Mycobacterium tuberculosis H37Rv
cggucggagucgagcacaccgag

SEQ ID NO: 1283727 - RNA, 14 nt, Mycobacterium tuberculosis H37Rv
cggucggaucggug

SEQ ID NO: 1283728 - RNA, 15 nt, Mycobacterium tuberculosis H37Rv
cggucggcgacguag

SEQ ID NO: 1283729 - RNA, 19 nt, Mycobacterium tuberculosis H37Rv
cggucggcgaccaccagcg

SEQ ID NO: 1283730 - RNA, 16 nt, Mycobacterium tuberculosis H37Rv
cggucggccaggccgu

SEQ ID NO: 1283731 - RNA, 17 nt, Mycobacterium tuberculosis H37Rv
cggguagacccacauca

SEQ ID NO: 1283732 - RNA, 16 nt, Mycobacterium tuberculosis H37Rv
cggguacuuacggguc

SEQ ID NO: 1283733 - RNA, 14 nt, Mycobacterium tuberculosis H37Rv
cggucgccgcgcgu

SEQ ID NO: 1283734 - RNA, 13 nt, Mycobacterium tuberculosis H37Rv
cggguaccacgcu

SEQ ID NO: 1283735 - RNA, 17 nt, Mycobacterium tuberculosis H37Rv
cggguagacaccgcgau

SEQ ID NO: 1283736 - RNA, 16 nt, Mycobacterium tuberculosis H37Rv
cggguaccagcaccga

SEQ ID NO: 1283737 - RNA, 15 nt, Mycobacterium tuberculosis H37Rv
cggguacacccgcuc

SEQ ID NO: 1283738 - RNA, 23 nt, Mycobacterium tuberculosis H37Rv
cggucgccuggaagaucacgcgu

SEQ ID NO: 1283739 - RNA, 21 nt, Mycobacterium tuberculosis H37Rv
cggguagacccacaucagguc

SEQ ID NO: 1283740 - RNA, 18 nt, Mycobacterium tuberculosis H37Rv
cggucgccgggacgauac

SEQ ID NO: 1283741 - RNA, 16 nt, Mycobacterium tuberculosis H37Rv
cggucgccucaccggc

SEQ ID NO: 1283742 - RNA, 21 nt, Mycobacterium tuberculosis H37Rv
cggucgccggucaucgccgaa

SEQ ID NO: 1283743 - RNA, 20 nt, Mycobacterium tuberculosis H37Rv
cggucgccgugaugcugguc

SEQ ID NO: 1283744 - RNA, 16 nt, Mycobacterium tuberculosis H37Rv
cggucgcggcugacaa

SEQ ID NO: 1283745 - RNA, 12 nt, Mycobacterium tuberculosis H37Rv
cggucgcggaac

SEQ ID NO: 1283746 - RNA, 18 nt, Mycobacterium tuberculosis H37Rv
cggucgcgcgauggaccc

SEQ ID NO: 1283747 - RNA, 19 nt, Mycobacterium tuberculosis H37Rv
cggugaucgccggcuucgc

SEQ ID NO: 1283748 - RNA, 13 nt, Mycobacterium tuberculosis H37Rv
cggugaucgaggu

SEQ ID NO: 1283749 - RNA, 17 nt, Mycobacterium tuberculosis H37Rv
cggugagugaaucgcgg

SEQ ID NO: 1283750 - RNA, 21 nt, Mycobacterium tuberculosis H37Rv
cggugaucacggucggcgggu

SEQ ID NO: 1283751 - RNA, 14 nt, Mycobacterium tuberculosis H37Rv
cggugaucccacga

SEQ ID NO: 1283752 - RNA, 20 nt, Mycobacterium tuberculosis H37Rv
cggugauguccgcacaacga

SEQ ID NO: 1283753 - RNA, 14 nt, Mycobacterium tuberculosis H37Rv
cggugaugguuacc

SEQ ID NO: 1283754 - RNA, 16 nt, Mycobacterium tuberculosis H37Rv
cggugauggucaccgu

SEQ ID NO: 1283755 - RNA, 14 nt, Mycobacterium tuberculosis H37Rv
cggugauggucagc

SEQ ID NO: 1283756 - RNA, 24 nt, Mycobacterium tuberculosis H37Rv
cggugauggccgaccagccgauca

SEQ ID NO: 1283757 - RNA, 21 nt, Mycobacterium tuberculosis H37Rv
cggugauggccgaccagccga

SEQ ID NO: 1283758 - RNA, 14 nt, Mycobacterium tuberculosis H37Rv
cggugaugggccag

SEQ ID NO: 1283759 - RNA, 20 nt, Mycobacterium tuberculosis H37Rv
cggugaugggggagccggug

SEQ ID NO: 1283760 - RNA, 21 nt, Mycobacterium tuberculosis H37Rv
cggugaugggggagccgguga

SEQ ID NO: 1283761 - RNA, 21 nt, Mycobacterium tuberculosis H37Rv
cggugaugaccgcguagagca

SEQ ID NO: 1283762 - RNA, 22 nt, Mycobacterium tuberculosis H37Rv
cggugaugaacgacauccggcc

SEQ ID NO: 1283763 - RNA, 19 nt, Mycobacterium tuberculosis H37Rv
cggugaucuugccggccag

SEQ ID NO: 1283764 - RNA, 23 nt, Mycobacterium tuberculosis H37Rv
cggugaucuugccggccagcagg

SEQ ID NO: 1283765 - RNA, 12 nt, Mycobacterium tuberculosis H37Rv
cggugaccgggu

SEQ ID NO: 1283766 - RNA, 14 nt, Mycobacterium tuberculosis H37Rv
cggugaccguucgg

SEQ ID NO: 1283767 - RNA, 16 nt, Mycobacterium tuberculosis H37Rv
cggugaccucggcgac

SEQ ID NO: 1283768 - RNA, 16 nt, Mycobacterium tuberculosis H37Rv
cggugacgaugaccgc

SEQ ID NO: 1283769 - RNA, 16 nt, Mycobacterium tuberculosis H37Rv
cggugacgcaacaucg

SEQ ID NO: 1283770 - RNA, 19 nt, Mycobacterium tuberculosis H37Rv
cggugacgaugaccgcgcg

SEQ ID NO: 1283771 - RNA, 13 nt, Mycobacterium tuberculosis H37Rv
cggugacgccguc

SEQ ID NO: 1283772 - RNA, 14 nt, Mycobacterium tuberculosis H37Rv
cggugaggugacca

SEQ ID NO: 1283773 - RNA, 20 nt, Mycobacterium tuberculosis H37Rv
cggugagcgagcgcgcguag

SEQ ID NO: 1283774 - RNA, 15 nt, Mycobacterium tuberculosis H37Rv
cggugagcagggcgg

SEQ ID NO: 1283775 - RNA, 18 nt, Mycobacterium tuberculosis H37Rv
cggugagcgagcgcgcgu

SEQ ID NO: 1283776 - RNA, 23 nt, Mycobacterium tuberculosis H37Rv
cggugacucagaacguggccguu

SEQ ID NO: 1283777 - RNA, 12 nt, Mycobacterium tuberculosis H37Rv
cggugagcaccg

SEQ ID NO: 1283778 - RNA, 21 nt, Mycobacterium tuberculosis H37Rv
cggugagcagcucggugacaa

SEQ ID NO: 1283779 - RNA, 20 nt, Mycobacterium tuberculosis H37Rv
cggugagccgugccgccagc

SEQ ID NO: 1283780 - RNA, 21 nt, Mycobacterium tuberculosis H37Rv
cggugacgggguugaccgcca

SEQ ID NO: 1283781 - RNA, 21 nt, Mycobacterium tuberculosis H37Rv
cggugacggggcugaccgcca

SEQ ID NO: 1283782 - RNA, 12 nt, Mycobacterium tuberculosis H37Rv
cggugagaucgg

SEQ ID NO: 1283783 - RNA, 13 nt, Mycobacterium tuberculosis H37Rv
cggugccgaccgg

SEQ ID NO: 1283784 - RNA, 22 nt, Mycobacterium tuberculosis H37Rv
cggugcccugccggcagcggcg

SEQ ID NO: 1283785 - RNA, 15 nt, Mycobacterium tuberculosis H37Rv
cggugccgaccgcgu

SEQ ID NO: 1283786 - RNA, 15 nt, Mycobacterium tuberculosis H37Rv
cggugcccagcagcg

SEQ ID NO: 1283787 - RNA, 15 nt, Mycobacterium tuberculosis H37Rv
cggugccaguacucg

SEQ ID NO: 1283788 - RNA, 22 nt, Mycobacterium tuberculosis H37Rv
cggugcccagcagcgcgacggu

SEQ ID NO: 1283789 - RNA, 13 nt, Mycobacterium tuberculosis H37Rv
cggugcccaucgg

SEQ ID NO: 1283790 - RNA, 18 nt, Mycobacterium tuberculosis H37Rv
cggugccaaaggacgaca

SEQ ID NO: 1283791 - RNA, 23 nt, Mycobacterium tuberculosis H37Rv
cggugccagcaccacgucgacga

SEQ ID NO: 1283792 - RNA, 17 nt, Mycobacterium tuberculosis H37Rv
cggugcagaucggcuca

SEQ ID NO: 1283793 - RNA, 12 nt, Mycobacterium tuberculosis H37Rv
cggugcaggauu

SEQ ID NO: 1283794 - RNA, 21 nt, Mycobacterium tuberculosis H37Rv
cggugcaggaccagaacucgu

SEQ ID NO: 1283795 - RNA, 16 nt, Mycobacterium tuberculosis H37Rv
cggugcagcuccccgc

SEQ ID NO: 1283796 - RNA, 14 nt, Mycobacterium tuberculosis H37Rv
cggugcagcuccgg

SEQ ID NO: 1283797 - RNA, 20 nt, Mycobacterium tuberculosis H37Rv
cggugcaggucguccaucgc

SEQ ID NO: 1283798 - RNA, 21 nt, Mycobacterium tuberculosis H37Rv
cggugccgcugaugcuggcca

SEQ ID NO: 1283799 - RNA, 18 nt, Mycobacterium tuberculosis H37Rv
cggugccgccugcgccgc

SEQ ID NO: 1283800 - RNA, 14 nt, Mycobacterium tuberculosis H37Rv
cggugccgccguug

SEQ ID NO: 1283801 - RNA, 23 nt, Mycobacterium tuberculosis H37Rv
cggugccggcccugcucggccaa

SEQ ID NO: 1283802 - RNA, 13 nt, Mycobacterium tuberculosis H37Rv
cggugccggcgca

SEQ ID NO: 1283803 - RNA, 18 nt, Mycobacterium tuberculosis H37Rv
cggugccggggcugccgc

SEQ ID NO: 1283804 - RNA, 15 nt, Mycobacterium tuberculosis H37Rv
cggugccggcggauc

SEQ ID NO: 1283805 - RNA, 23 nt, Mycobacterium tuberculosis H37Rv
cggugccggggcugccgccguug

SEQ ID NO: 1283806 - RNA, 16 nt, Mycobacterium tuberculosis H37Rv
cggugccggcggcgca

SEQ ID NO: 1283807 - RNA, 23 nt, Mycobacterium tuberculosis H37Rv
cggugccggucgagugccucgac

SEQ ID NO: 1283808 - RNA, 16 nt, Mycobacterium tuberculosis H37Rv
cggugccgucggugcc

SEQ ID NO: 1283809 - RNA, 18 nt, Mycobacterium tuberculosis H37Rv
cggugccgccaucgccgc

SEQ ID NO: 1283810 - RNA, 12 nt, Mycobacterium tuberculosis H37Rv
cggugccgagcg

SEQ ID NO: 1283811 - RNA, 18 nt, Mycobacterium tuberculosis H37Rv
cggugccgacggugaugg

SEQ ID NO: 1283812 - RNA, 14 nt, Mycobacterium tuberculosis H37Rv
cggugccgaccggu

SEQ ID NO: 1283813 - RNA, 15 nt, Mycobacterium tuberculosis H37Rv
cggugccgccaccgg

SEQ ID NO: 1283814 - RNA, 14 nt, Mycobacterium tuberculosis H37Rv
cggugccgccggaa

SEQ ID NO: 1283815 - RNA, 17 nt, Mycobacterium tuberculosis H37Rv
cggugccgccgauaccg

SEQ ID NO: 1283816 - RNA, 18 nt, Mycobacterium tuberculosis H37Rv
cggugccgccgauaccgc

SEQ ID NO: 1283817 - RNA, 12 nt, Mycobacterium tuberculosis H37Rv
cggugccgccga

SEQ ID NO: 1283818 - RNA, 17 nt, Mycobacterium tuberculosis H37Rv
cggugccgccauugacg

SEQ ID NO: 1283819 - RNA, 20 nt, Mycobacterium tuberculosis H37Rv
cggugccgccgcggccacca

SEQ ID NO: 1283820 - RNA, 16 nt, Mycobacterium tuberculosis H37Rv
cggugccgccgucgau

SEQ ID NO: 1283821 - RNA, 23 nt, Mycobacterium tuberculosis H37Rv
cggugccgccgggugcaacggcg

SEQ ID NO: 1283822 - RNA, 19 nt, Mycobacterium tuberculosis H37Rv
cgguggcagcacagcgucg

SEQ ID NO: 1283823 - RNA, 14 nt, Mycobacterium tuberculosis H37Rv
cgguggccacccgg

SEQ ID NO: 1283824 - RNA, 15 nt, Mycobacterium tuberculosis H37Rv
cgguggccagcgucg

SEQ ID NO: 1283825 - RNA, 17 nt, Mycobacterium tuberculosis H37Rv
cgguggccgcgcugguc

SEQ ID NO: 1283826 - RNA, 17 nt, Mycobacterium tuberculosis H37Rv
cgguggccggcaacggc

SEQ ID NO: 1283827 - RNA, 15 nt, Mycobacterium tuberculosis H37Rv
cgguggccgucgggu

SEQ ID NO: 1283828 - RNA, 15 nt, Mycobacterium tuberculosis H37Rv
cgguggccgcaucga

SEQ ID NO: 1283829 - RNA, 14 nt, Mycobacterium tuberculosis H37Rv
cgguggccgcaucg

SEQ ID NO: 1283830 - RNA, 14 nt, Mycobacterium tuberculosis H37Rv
cgguggccgcacga

SEQ ID NO: 1283831 - RNA, 16 nt, Mycobacterium tuberculosis H37Rv
cgguggccucccacgg

SEQ ID NO: 1283832 - RNA, 16 nt, Mycobacterium tuberculosis H37Rv
cgguggcgcggugccg

SEQ ID NO: 1283833 - RNA, 17 nt, Mycobacterium tuberculosis H37Rv
cgguggcggcagcagcg

SEQ ID NO: 1283834 - RNA, 16 nt, Mycobacterium tuberculosis H37Rv
cgguggcggccuccga

SEQ ID NO: 1283835 - RNA, 21 nt, Mycobacterium tuberculosis H37Rv
cgguggcggcggugccacgau

SEQ ID NO: 1283836 - RNA, 18 nt, Mycobacterium tuberculosis H37Rv
cgguggcuucgacggcgg

SEQ ID NO: 1283837 - RNA, 21 nt, Mycobacterium tuberculosis H37Rv
cggugggcgccgacaccggcu

SEQ ID NO: 1283838 - RNA, 13 nt, Mycobacterium tuberculosis H37Rv
cggugggcgggca

SEQ ID NO: 1283839 - RNA, 19 nt, Mycobacterium tuberculosis H37Rv
cgguggcguauucggugca

SEQ ID NO: 1283840 - RNA, 19 nt, Mycobacterium tuberculosis H37Rv
cgguggcgucaugcccagg

SEQ ID NO: 1283841 - RNA, 17 nt, Mycobacterium tuberculosis H37Rv
cgguggcggugucggcg

SEQ ID NO: 1283842 - RNA, 15 nt, Mycobacterium tuberculosis H37Rv
cgguggcguggucuc

SEQ ID NO: 1283843 - RNA, 16 nt, Mycobacterium tuberculosis H37Rv
cgguggcugaucaccg

SEQ ID NO: 1283844 - RNA, 18 nt, Mycobacterium tuberculosis H37Rv
cgguggcuacgccccacu

SEQ ID NO: 1283845 - RNA, 19 nt, Mycobacterium tuberculosis H37Rv
cgguggcucuguagcgucg

SEQ ID NO: 1283846 - RNA, 19 nt, Mycobacterium tuberculosis H37Rv
cgguggucccccgcagcca

SEQ ID NO: 1283847 - RNA, 14 nt, Mycobacterium tuberculosis H37Rv
cggugguagcgacg

SEQ ID NO: 1283848 - RNA, 18 nt, Mycobacterium tuberculosis H37Rv
cggugguagcgacgaugu

SEQ ID NO: 1283849 - RNA, 19 nt, Mycobacterium tuberculosis H37Rv
cggugguaagacgccgaac

SEQ ID NO: 1283850 - RNA, 12 nt, Mycobacterium tuberculosis H37Rv
cgguggucagca

SEQ ID NO: 1283851 - RNA, 18 nt, Mycobacterium tuberculosis H37Rv
cgguggggccggcgucga

SEQ ID NO: 1283852 - RNA, 21 nt, Mycobacterium tuberculosis H37Rv
cggugggcgggugcgcgaggu

SEQ ID NO: 1283853 - RNA, 18 nt, Mycobacterium tuberculosis H37Rv
cgguggggucgccgucga

SEQ ID NO: 1283854 - RNA, 15 nt, Mycobacterium tuberculosis H37Rv
cggugggugccagcc

SEQ ID NO: 1283855 - RNA, 20 nt, Mycobacterium tuberculosis H37Rv
cggugggguuggcuccggug

SEQ ID NO: 1283856 - RNA, 18 nt, Mycobacterium tuberculosis H37Rv
cgguggcagagccgccgu

SEQ ID NO: 1283857 - RNA, 20 nt, Mycobacterium tuberculosis H37Rv
cgguggaggcguagucggcg

SEQ ID NO: 1283858 - RNA, 16 nt, Mycobacterium tuberculosis H37Rv
cgguggacgauacgcg

SEQ ID NO: 1283859 - RNA, 19 nt, Mycobacterium tuberculosis H37Rv
cgguggacggcaggcggcc

SEQ ID NO: 1283860 - RNA, 21 nt, Mycobacterium tuberculosis H37Rv
cggugcugucgacgucggcaa

SEQ ID NO: 1283861 - RNA, 21 nt, Mycobacterium tuberculosis H37Rv
cggugcuguugcgcggucgcg

SEQ ID NO: 1283862 - RNA, 14 nt, Mycobacterium tuberculosis H37Rv
cggugcugcgggaa

SEQ ID NO: 1283863 - RNA, 17 nt, Mycobacterium tuberculosis H37Rv
cggugcuaaccgacgcu

SEQ ID NO: 1283864 - RNA, 18 nt, Mycobacterium tuberculosis H37Rv
cggugcucaagcgcgucg

SEQ ID NO: 1283865 - RNA, 14 nt, Mycobacterium tuberculosis H37Rv
cggugcuaaccgac

SEQ ID NO: 1283866 - RNA, 22 nt, Mycobacterium tuberculosis H37Rv
cggugcuccucggcaggccgac

SEQ ID NO: 1283867 - RNA, 15 nt, Mycobacterium tuberculosis H37Rv
cggugcgucacagcc

SEQ ID NO: 1283868 - RNA, 23 nt, Mycobacterium tuberculosis H37Rv
cggugcggucagauucggcgaug

SEQ ID NO: 1283869 - RNA, 20 nt, Mycobacterium tuberculosis H37Rv
cggugcguccggugcugguc

SEQ ID NO: 1283870 - RNA, 19 nt, Mycobacterium tuberculosis H37Rv
cggugcgccagaucaccgu

SEQ ID NO: 1283871 - RNA, 22 nt, Mycobacterium tuberculosis H37Rv
cggugcgcagguacgccucgac

SEQ ID NO: 1283872 - RNA, 16 nt, Mycobacterium tuberculosis H37Rv
cggugcgcauccgucg

SEQ ID NO: 1283873 - RNA, 18 nt, Mycobacterium tuberculosis H37Rv
cggugcgaccaacacggu

SEQ ID NO: 1283874 - RNA, 12 nt, Mycobacterium tuberculosis H37Rv
cggugcgcacca

SEQ ID NO: 1283875 - RNA, 21 nt, Mycobacterium tuberculosis H37Rv
cggugcgauuccgcgucugcu

SEQ ID NO: 1283876 - RNA, 14 nt, Mycobacterium tuberculosis H37Rv
cggugcgcggcaau

SEQ ID NO: 1283877 - RNA, 19 nt, Mycobacterium tuberculosis H37Rv
cggugcgcuggaucuucga

SEQ ID NO: 1283878 - RNA, 16 nt, Mycobacterium tuberculosis H37Rv
cggugcggaacacgau

SEQ ID NO: 1283879 - RNA, 22 nt, Mycobacterium tuberculosis H37Rv
cggugcgccagaucaccgucga

SEQ ID NO: 1283880 - RNA, 19 nt, Mycobacterium tuberculosis H37Rv
cggugcgcgguugcugguc

SEQ ID NO: 1283881 - RNA, 17 nt, Mycobacterium tuberculosis H37Rv
cgguguauccgacuggc

SEQ ID NO: 1283882 - RNA, 23 nt, Mycobacterium tuberculosis H37Rv
cggugguugugcuguggucggug

SEQ ID NO: 1283883 - RNA, 21 nt, Mycobacterium tuberculosis H37Rv
cggugguuuucccgucgccgc

SEQ ID NO: 1283884 - RNA, 15 nt, Mycobacterium tuberculosis H37Rv
cgguguaacccucga

SEQ ID NO: 1283885 - RNA, 17 nt, Mycobacterium tuberculosis H37Rv
cgguguagaagcgggcg

SEQ ID NO: 1283886 - RNA, 20 nt, Mycobacterium tuberculosis H37Rv
cgguggugccgcggccaccg

SEQ ID NO: 1283887 - RNA, 13 nt, Mycobacterium tuberculosis H37Rv
cgguggugccgcg

SEQ ID NO: 1283888 - RNA, 18 nt, Mycobacterium tuberculosis H37Rv
cgguggugacgucgaggu

SEQ ID NO: 1283889 - RNA, 18 nt, Mycobacterium tuberculosis H37Rv
cgguggucugcgcggugc

SEQ ID NO: 1283890 - RNA, 15 nt, Mycobacterium tuberculosis H37Rv
cgguggugacgucga

SEQ ID NO: 1283891 - RNA, 19 nt, Mycobacterium tuberculosis H37Rv
cgguggucguaggugacga

SEQ ID NO: 1283892 - RNA, 16 nt, Mycobacterium tuberculosis H37Rv
cgguggucugcgcggu

SEQ ID NO: 1283893 - RNA, 17 nt, Mycobacterium tuberculosis H37Rv
cgguggucugcgcggug

SEQ ID NO: 1283894 - RNA, 22 nt, Mycobacterium tuberculosis H37Rv
cggugguccacacgcugcccgc

SEQ ID NO: 1283895 - RNA, 19 nt, Mycobacterium tuberculosis H37Rv
cggugguuagguggcuggc

SEQ ID NO: 1283896 - RNA, 14 nt, Mycobacterium tuberculosis H37Rv
cgguggugcugccg

SEQ ID NO: 1283897 - RNA, 24 nt, Mycobacterium tuberculosis H37Rv
cgguggugguguaggaguacaaca

SEQ ID NO: 1283898 - RNA, 14 nt, Mycobacterium tuberculosis H37Rv
cgguggugggccgu

SEQ ID NO: 1283899 - RNA, 21 nt, Mycobacterium tuberculosis H37Rv
cgguggugccgcggccaccgc

SEQ ID NO: 1283900 - RNA, 18 nt, Mycobacterium tuberculosis H37Rv
cgguggugcucgucggug

SEQ ID NO: 1283901 - RNA, 21 nt, Mycobacterium tuberculosis H37Rv
cgguggugggcgggaucgacu

SEQ ID NO: 1283902 - RNA, 13 nt, Mycobacterium tuberculosis H37Rv
cggugugcgugcg

SEQ ID NO: 1283903 - RNA, 16 nt, Mycobacterium tuberculosis H37Rv
cggugugcgugcgguc

SEQ ID NO: 1283904 - RNA, 13 nt, Mycobacterium tuberculosis H37Rv
cggugugcucacg

SEQ ID NO: 1283905 - RNA, 20 nt, Mycobacterium tuberculosis H37Rv
cgguguggacuucagcaggc

SEQ ID NO: 1283906 - RNA, 12 nt, Mycobacterium tuberculosis H37Rv
cgguguggcacc

SEQ ID NO: 1283907 - RNA, 13 nt, Mycobacterium tuberculosis H37Rv
cgguguggcaccg

SEQ ID NO: 1283908 - RNA, 17 nt, Mycobacterium tuberculosis H37Rv
cggugugcuugcucggg

SEQ ID NO: 1283909 - RNA, 22 nt, Mycobacterium tuberculosis H37Rv
cgguguugagcgaacccgcguu

SEQ ID NO: 1283910 - RNA, 19 nt, Mycobacterium tuberculosis H37Rv
cgguguccagccacgcugu

SEQ ID NO: 1283911 - RNA, 12 nt, Mycobacterium tuberculosis H37Rv
cggugucgacgg

SEQ ID NO: 1283912 - RNA, 17 nt, Mycobacterium tuberculosis H37Rv
cggugucgcgaucgcgg

SEQ ID NO: 1283913 - RNA, 15 nt, Mycobacterium tuberculosis H37Rv
cggugugcacggcga

SEQ ID NO: 1283914 - RNA, 21 nt, Mycobacterium tuberculosis H37Rv
cggugugccagugcugcaccg

SEQ ID NO: 1283915 - RNA, 14 nt, Mycobacterium tuberculosis H37Rv
cggugucggugaca

SEQ ID NO: 1283916 - RNA, 16 nt, Mycobacterium tuberculosis H37Rv
cggugucguucggcga

SEQ ID NO: 1283917 - RNA, 15 nt, Mycobacterium tuberculosis H37Rv
cggugucucgcccac

SEQ ID NO: 1283918 - RNA, 17 nt, Mycobacterium tuberculosis H37Rv
cggugucucgcccacca

SEQ ID NO: 1283919 - RNA, 16 nt, Mycobacterium tuberculosis H37Rv
cgguucagcugcgcca

SEQ ID NO: 1283920 - RNA, 18 nt, Mycobacterium tuberculosis H37Rv
cgguguugcucgccgucg

SEQ ID NO: 1283921 - RNA, 21 nt, Mycobacterium tuberculosis H37Rv
cgguguuggacgcgggccgac

SEQ ID NO: 1283922 - RNA, 17 nt, Mycobacterium tuberculosis H37Rv
cgguuaaggugcgaucc

SEQ ID NO: 1283923 - RNA, 18 nt, Mycobacterium tuberculosis H37Rv
cgguugacgggcucggca

SEQ ID NO: 1283924 - RNA, 14 nt, Mycobacterium tuberculosis H37Rv
cgguugaacgaccu

SEQ ID NO: 1283925 - RNA, 14 nt, Mycobacterium tuberculosis H37Rv
cgguugacacccgg

SEQ ID NO: 1283926 - RNA, 17 nt, Mycobacterium tuberculosis H37Rv
cgguucgucgggcaugc

SEQ ID NO: 1283927 - RNA, 23 nt, Mycobacterium tuberculosis H37Rv
cgguucgucgaacggaucucggu

SEQ ID NO: 1283928 - RNA, 15 nt, Mycobacterium tuberculosis H37Rv
cgguuccucagcggc

SEQ ID NO: 1283929 - RNA, 22 nt, Mycobacterium tuberculosis H37Rv
cgguugcggucaucggcgccaa

SEQ ID NO: 1283930 - RNA, 15 nt, Mycobacterium tuberculosis H37Rv
cgguugcugcgcgaa

SEQ ID NO: 1283931 - RNA, 13 nt, Mycobacterium tuberculosis H37Rv
cgguuggccacca

SEQ ID NO: 1283932 - RNA, 22 nt, Mycobacterium tuberculosis H37Rv
cgguuguguugggagccaccgg

SEQ ID NO: 1283933 - RNA, 21 nt, Mycobacterium tuberculosis H37Rv
cgguugguccgccgucgacca

SEQ ID NO: 1283934 - RNA, 21 nt, Mycobacterium tuberculosis H37Rv
cgguuguagaccucuucggag

SEQ ID NO: 1283935 - RNA, 18 nt, Mycobacterium tuberculosis H37Rv
cgguuggguagcaccgau

SEQ ID NO: 1283936 - RNA, 15 nt, Mycobacterium tuberculosis H37Rv
cguaaagccaacugg

SEQ ID NO: 1283937 - RNA, 17 nt, Mycobacterium tuberculosis H37Rv
cguaaagggcgucguag

SEQ ID NO: 1283938 - RNA, 17 nt, Mycobacterium tuberculosis H37Rv
cguaaaagccgaugacg

SEQ ID NO: 1283939 - RNA, 17 nt, Mycobacterium tuberculosis H37Rv
cgucgccccguuucggu

SEQ ID NO: 1283940 - RNA, 22 nt, Mycobacterium tuberculosis H37Rv
cgucgcccugacacaacaccgg

SEQ ID NO: 1283941 - RNA, 22 nt, Mycobacterium tuberculosis H37Rv
cgucgcccuuagggucgccgca

SEQ ID NO: 1283942 - RNA, 13 nt, Mycobacterium tuberculosis H37Rv
cgucgccgaccgu

SEQ ID NO: 1283943 - RNA, 18 nt, Mycobacterium tuberculosis H37Rv
cgucgccgaccgucacug

SEQ ID NO: 1283944 - RNA, 21 nt, Mycobacterium tuberculosis H37Rv
cgucgccgccgcuaccgccgg

SEQ ID NO: 1283945 - RNA, 15 nt, Mycobacterium tuberculosis H37Rv
cgucgccgaacagcg

SEQ ID NO: 1283946 - RNA, 13 nt, Mycobacterium tuberculosis H37Rv
cgucgccgcccgu

SEQ ID NO: 1283947 - RNA, 13 nt, Mycobacterium tuberculosis H37Rv
cgucgccgccauu

SEQ ID NO: 1283948 - RNA, 13 nt, Mycobacterium tuberculosis H37Rv
cgucgccgccgaa

SEQ ID NO: 1283949 - RNA, 18 nt, Mycobacterium tuberculosis H37Rv
cgucgcaucaccagggug

SEQ ID NO: 1283950 - RNA, 16 nt, Mycobacterium tuberculosis H37Rv
cgucgcaucaccaggg

SEQ ID NO: 1283951 - RNA, 15 nt, Mycobacterium tuberculosis H37Rv
cgucgcccagugcgc

SEQ ID NO: 1283952 - RNA, 22 nt, Mycobacterium tuberculosis H37Rv
cgucgccaagcccaggcgaucg

SEQ ID NO: 1283953 - RNA, 20 nt, Mycobacterium tuberculosis H37Rv
cgucgcagaaaccauucggc

SEQ ID NO: 1283954 - RNA, 15 nt, Mycobacterium tuberculosis H37Rv
cgucgcaucaccagg

SEQ ID NO: 1283955 - RNA, 13 nt, Mycobacterium tuberculosis H37Rv
cgucgcaccagcg

SEQ ID NO: 1283956 - RNA, 20 nt, Mycobacterium tuberculosis H37Rv
cgucgcaaggcccgcaccgc

SEQ ID NO: 1283957 - RNA, 15 nt, Mycobacterium tuberculosis H37Rv
cgucgaguuggccau

SEQ ID NO: 1283958 - RNA, 16 nt, Mycobacterium tuberculosis H37Rv
cgucgacgccggccag

SEQ ID NO: 1283959 - RNA, 22 nt, Mycobacterium tuberculosis H37Rv
cgucgacgcgggagucaucgcg

SEQ ID NO: 1283960 - RNA, 19 nt, Mycobacterium tuberculosis H37Rv
cgucgacgcgguccucgag

SEQ ID NO: 1283961 - RNA, 20 nt, Mycobacterium tuberculosis H37Rv
cgucgacgcccauggcgucg

SEQ ID NO: 1283962 - RNA, 14 nt, Mycobacterium tuberculosis H37Rv
cgucgauaucgcga

SEQ ID NO: 1283963 - RNA, 19 nt, Mycobacterium tuberculosis H37Rv
cgucgaucaacaacagccg

SEQ ID NO: 1283964 - RNA, 18 nt, Mycobacterium tuberculosis H37Rv
cgucgaucacgucgucag

SEQ ID NO: 1283965 - RNA, 23 nt, Mycobacterium tuberculosis H37Rv
cgucgaucacgugguccaaccgg

SEQ ID NO: 1283966 - RNA, 18 nt, Mycobacterium tuberculosis H37Rv
cgucgaucagaacgugac

SEQ ID NO: 1283967 - RNA, 13 nt, Mycobacterium tuberculosis H37Rv
cgucgauggccac

SEQ ID NO: 1283968 - RNA, 19 nt, Mycobacterium tuberculosis H37Rv
cgucgaugcgcgucucgag

SEQ ID NO: 1283969 - RNA, 20 nt, Mycobacterium tuberculosis H37Rv
cgucgcuucggcaccgacug

SEQ ID NO: 1283970 - RNA, 17 nt, Mycobacterium tuberculosis H37Rv
cgucggacauaccgcga

SEQ ID NO: 1283971 - RNA, 18 nt, Mycobacterium tuberculosis H37Rv
cgucgcgugggaugucga

SEQ ID NO: 1283972 - RNA, 23 nt, Mycobacterium tuberculosis H37Rv
cgucgcgguuguggcugaucccg

SEQ ID NO: 1283973 - RNA, 18 nt, Mycobacterium tuberculosis H37Rv
cgucgcguccgcgaucug

SEQ ID NO: 1283974 - RNA, 20 nt, Mycobacterium tuberculosis H37Rv
cgucgcggguccaggcguug

SEQ ID NO: 1283975 - RNA, 15 nt, Mycobacterium tuberculosis H37Rv
cgucgccgucggugc

SEQ ID NO: 1283976 - RNA, 17 nt, Mycobacterium tuberculosis H37Rv
cgucgccguuggagacg

SEQ ID NO: 1283977 - RNA, 14 nt, Mycobacterium tuberculosis H37Rv
cgucgccguugggu

SEQ ID NO: 1283978 - RNA, 13 nt, Mycobacterium tuberculosis H37Rv
cgucgccugcgac

SEQ ID NO: 1283979 - RNA, 12 nt, Mycobacterium tuberculosis H37Rv
cgucgccgccgu

SEQ ID NO: 1283980 - RNA, 16 nt, Mycobacterium tuberculosis H37Rv
cgucgccggugacgac

SEQ ID NO: 1283981 - RNA, 18 nt, Mycobacterium tuberculosis H37Rv
cgucgcgaaucugcgcga

SEQ ID NO: 1283982 - RNA, 17 nt, Mycobacterium tuberculosis H37Rv
cgucgccuucggguucg

SEQ ID NO: 1283983 - RNA, 19 nt, Mycobacterium tuberculosis H37Rv
cgucgccuucggguucggu

SEQ ID NO: 1283984 - RNA, 13 nt, Mycobacterium tuberculosis H37Rv
cgucgcgacgucg

SEQ ID NO: 1283985 - RNA, 17 nt, Mycobacterium tuberculosis H37Rv
cgucggcgaugaacagc

SEQ ID NO: 1283986 - RNA, 16 nt, Mycobacterium tuberculosis H37Rv
cgucggcgacguccag

SEQ ID NO: 1283987 - RNA, 12 nt, Mycobacterium tuberculosis H37Rv
cgucggccagug

SEQ ID NO: 1283988 - RNA, 20 nt, Mycobacterium tuberculosis H37Rv
cgucggccaggaucaaccgg

SEQ ID NO: 1283989 - RNA, 14 nt, Mycobacterium tuberculosis H37Rv
cgucggccaccgcg

SEQ ID NO: 1283990 - RNA, 17 nt, Mycobacterium tuberculosis H37Rv
cgucggccagcagauca

SEQ ID NO: 1283991 - RNA, 16 nt, Mycobacterium tuberculosis H37Rv
cgucggccaccgccug

SEQ ID NO: 1283992 - RNA, 17 nt, Mycobacterium tuberculosis H37Rv
cgucggagccggccacc

SEQ ID NO: 1283993 - RNA, 23 nt, Mycobacterium tuberculosis H37Rv
cgucggagccggccaccucggug

SEQ ID NO: 1283994 - RNA, 14 nt, Mycobacterium tuberculosis H37Rv
cgucggagccgggc

SEQ ID NO: 1283995 - RNA, 20 nt, Mycobacterium tuberculosis H37Rv
cgucgggguugauguagagc

SEQ ID NO: 1283996 - RNA, 15 nt, Mycobacterium tuberculosis H37Rv
cgucgggccgcaacu

SEQ ID NO: 1283997 - RNA, 15 nt, Mycobacterium tuberculosis H37Rv
cgucggucaccgaau

SEQ ID NO: 1283998 - RNA, 19 nt, Mycobacterium tuberculosis H37Rv
cgucggucaugucggccac

SEQ ID NO: 1283999 - RNA, 16 nt, Mycobacterium tuberculosis H37Rv
cgucggucaucgguug

SEQ ID NO: 1284000 - RNA, 22 nt, Mycobacterium tuberculosis H37Rv
cgucgguaagcgccaaggcgau

SEQ ID NO: 1284001 - RNA, 21 nt, Mycobacterium tuberculosis H37Rv
cgucggucaugucggccaccg

SEQ ID NO: 1284002 - RNA, 13 nt, Mycobacterium tuberculosis H37Rv
cgucggucgccgg

SEQ ID NO: 1284003 - RNA, 23 nt, Mycobacterium tuberculosis H37Rv
cgucggucgccgguggccuagca

SEQ ID NO: 1284004 - RNA, 15 nt, Mycobacterium tuberculosis H37Rv
cgucggugaaugccg

SEQ ID NO: 1284005 - RNA, 13 nt, Mycobacterium tuberculosis H37Rv
cgucggugagcgc

SEQ ID NO: 1284006 - RNA, 17 nt, Mycobacterium tuberculosis H37Rv
cgucgggacggccaaca

SEQ ID NO: 1284007 - RNA, 17 nt, Mycobacterium tuberculosis H37Rv
cgucgggcacaccgacg

SEQ ID NO: 1284008 - RNA, 17 nt, Mycobacterium tuberculosis H37Rv
cgucggcguagacguag

SEQ ID NO: 1284009 - RNA, 17 nt, Mycobacterium tuberculosis H37Rv
cgucggcgggcugcagu

SEQ ID NO: 1284010 - RNA, 16 nt, Mycobacterium tuberculosis H37Rv
cgucggcggcgaacag

SEQ ID NO: 1284011 - RNA, 15 nt, Mycobacterium tuberculosis H37Rv
cgucggcgcgcaccu

SEQ ID NO: 1284012 - RNA, 13 nt, Mycobacterium tuberculosis H37Rv
cgucgucaucgag

SEQ ID NO: 1284013 - RNA, 17 nt, Mycobacterium tuberculosis H37Rv
cgucgucacgaucgugc

SEQ ID NO: 1284014 - RNA, 22 nt, Mycobacterium tuberculosis H37Rv
cgucguccagacgccacugcca

SEQ ID NO: 1284015 - RNA, 14 nt, Mycobacterium tuberculosis H37Rv
cgucguccagacgc

SEQ ID NO: 1284016 - RNA, 22 nt, Mycobacterium tuberculosis H37Rv
cgucgucaaguccuucacugcg

SEQ ID NO: 1284017 - RNA, 16 nt, Mycobacterium tuberculosis H37Rv
cgucguaguuggugaa

SEQ ID NO: 1284018 - RNA, 18 nt, Mycobacterium tuberculosis H37Rv
cgucguaguacagcgcga

SEQ ID NO: 1284019 - RNA, 14 nt, Mycobacterium tuberculosis H37Rv
cgucggugugccag

SEQ ID NO: 1284020 - RNA, 14 nt, Mycobacterium tuberculosis H37Rv
cgucggugccacca

SEQ ID NO: 1284021 - RNA, 18 nt, Mycobacterium tuberculosis H37Rv
cgucggugcgccacgacc

SEQ ID NO: 1284022 - RNA, 21 nt, Mycobacterium tuberculosis H37Rv
cgucggugcgcgcggcgacca

SEQ ID NO: 1284023 - RNA, 18 nt, Mycobacterium tuberculosis H37Rv
cgucgguggcagcggugg

SEQ ID NO: 1284024 - RNA, 22 nt, Mycobacterium tuberculosis H37Rv
cgucgguuccgggcgcguggaa

SEQ ID NO: 1284025 - RNA, 18 nt, Mycobacterium tuberculosis H37Rv
cgucguacucgaccgcga

SEQ ID NO: 1284026 - RNA, 19 nt, Mycobacterium tuberculosis H37Rv
cgucguccggccacggucc

SEQ ID NO: 1284027 - RNA, 23 nt, Mycobacterium tuberculosis H37Rv
cgucguccgcgccaguggccacc

SEQ ID NO: 1284028 - RNA, 18 nt, Mycobacterium tuberculosis H37Rv
cgucguccgccgcagcgc

SEQ ID NO: 1284029 - RNA, 15 nt, Mycobacterium tuberculosis H37Rv
cgucguccuguccgg

SEQ ID NO: 1284030 - RNA, 18 nt, Mycobacterium tuberculosis H37Rv
cgucgucccagcgcggug

SEQ ID NO: 1284031 - RNA, 19 nt, Mycobacterium tuberculosis H37Rv
cgucguccagggcgacgag

SEQ ID NO: 1284032 - RNA, 15 nt, Mycobacterium tuberculosis H37Rv
cgucguccgacgggc

SEQ ID NO: 1284033 - RNA, 20 nt, Mycobacterium tuberculosis H37Rv
cgucguccgacgggccgucg

SEQ ID NO: 1284034 - RNA, 22 nt, Mycobacterium tuberculosis H37Rv
cgucgucaccuucaccggguga

SEQ ID NO: 1284035 - RNA, 14 nt, Mycobacterium tuberculosis H37Rv
cgucgucggcguag

SEQ ID NO: 1284036 - RNA, 14 nt, Mycobacterium tuberculosis H37Rv
cgucgucggguucg

SEQ ID NO: 1284037 - RNA, 15 nt, Mycobacterium tuberculosis H37Rv
cgucgucgucccagg

SEQ ID NO: 1284038 - RNA, 14 nt, Mycobacterium tuberculosis H37Rv
cgucgucgucgacg

SEQ ID NO: 1284039 - RNA, 13 nt, Mycobacterium tuberculosis H37Rv
cgucgucgugcac

SEQ ID NO: 1284040 - RNA, 15 nt, Mycobacterium tuberculosis H37Rv
cgucguuucgccagc

SEQ ID NO: 1284041 - RNA, 20 nt, Mycobacterium tuberculosis H37Rv
cgucuagcccgccauccgcc

SEQ ID NO: 1284042 - RNA, 17 nt, Mycobacterium tuberculosis H37Rv
cgucuaccccgagccuu

SEQ ID NO: 1284043 - RNA, 21 nt, Mycobacterium tuberculosis H37Rv
cgucuccuguggggauuccgc

SEQ ID NO: 1284044 - RNA, 17 nt, Mycobacterium tuberculosis H37Rv
cguccaguccgaucacc

SEQ ID NO: 1284045 - RNA, 15 nt, Mycobacterium tuberculosis H37Rv
cguccaguggcagcc

SEQ ID NO: 1284046 - RNA, 21 nt, Mycobacterium tuberculosis H37Rv
cguccaguggcagccagcggc

SEQ ID NO: 1284047 - RNA, 14 nt, Mycobacterium tuberculosis H37Rv
cguccaucaccggc

SEQ ID NO: 1284048 - RNA, 17 nt, Mycobacterium tuberculosis H37Rv
cguccccgccgccguuc

SEQ ID NO: 1284049 - RNA, 15 nt, Mycobacterium tuberculosis H37Rv
cguccccagaccggc

SEQ ID NO: 1284050 - RNA, 19 nt, Mycobacterium tuberculosis H37Rv
cguccccagaccggcggcu

SEQ ID NO: 1284051 - RNA, 14 nt, Mycobacterium tuberculosis H37Rv
cguccccaccgacg

SEQ ID NO: 1284052 - RNA, 20 nt, Mycobacterium tuberculosis H37Rv
cguccccaccgacgccgaua

SEQ ID NO: 1284053 - RNA, 20 nt, Mycobacterium tuberculosis H37Rv
cgucccgccggccccgccga

SEQ ID NO: 1284054 - RNA, 15 nt, Mycobacterium tuberculosis H37Rv
cgucccgguugacgc

SEQ ID NO: 1284055 - RNA, 20 nt, Mycobacterium tuberculosis H37Rv
cguccagauagugcuccacg

SEQ ID NO: 1284056 - RNA, 16 nt, Mycobacterium tuberculosis H37Rv
cgucaguucggugugc

SEQ ID NO: 1284057 - RNA, 22 nt, Mycobacterium tuberculosis H37Rv
cgucauaagacggauuguccgg

SEQ ID NO: 1284058 - RNA, 18 nt, Mycobacterium tuberculosis H37Rv
cguccaagccagcguugg

SEQ ID NO: 1284059 - RNA, 17 nt, Mycobacterium tuberculosis H37Rv
cguccaagccagcguug

SEQ ID NO: 1284060 - RNA, 19 nt, Mycobacterium tuberculosis H37Rv
cgucauccuggucaccagc

SEQ ID NO: 1284061 - RNA, 17 nt, Mycobacterium tuberculosis H37Rv
cgucaucgacgagcgau

SEQ ID NO: 1284062 - RNA, 11 nt, Mycobacterium tuberculosis H37Rv
cgucaucgacu

SEQ ID NO: 1284063 - RNA, 15 nt, Mycobacterium tuberculosis H37Rv
cgucauccaccgcaa

SEQ ID NO: 1284064 - RNA, 14 nt, Mycobacterium tuberculosis H37Rv
cgucauccauccgg

SEQ ID NO: 1284065 - RNA, 20 nt, Mycobacterium tuberculosis H37Rv
cguccgacaacgacugcguu

SEQ ID NO: 1284066 - RNA, 21 nt, Mycobacterium tuberculosis H37Rv
cguccgaccgauaacacccgg

SEQ ID NO: 1284067 - RNA, 22 nt, Mycobacterium tuberculosis H37Rv
cguccgaccgauaacacccggg

SEQ ID NO: 1284068 - RNA, 14 nt, Mycobacterium tuberculosis H37Rv
cguccgaccgguac

SEQ ID NO: 1284069 - RNA, 14 nt, Mycobacterium tuberculosis H37Rv
cguccgaccgauaa

SEQ ID NO: 1284070 - RNA, 15 nt, Mycobacterium tuberculosis H37Rv
cguccgaucgguguc

SEQ ID NO: 1284071 - RNA, 16 nt, Mycobacterium tuberculosis H37Rv
cguccgccgcagcgca

SEQ ID NO: 1284072 - RNA, 15 nt, Mycobacterium tuberculosis H37Rv
cguccgccgcagacg

SEQ ID NO: 1284073 - RNA, 19 nt, Mycobacterium tuberculosis H37Rv
cguccugaaucgguucggc

SEQ ID NO: 1284074 - RNA, 17 nt, Mycobacterium tuberculosis H37Rv
cguccuagcgugccgcc

SEQ ID NO: 1284075 - RNA, 16 nt, Mycobacterium tuberculosis H37Rv
cguccggugcuggucc

SEQ ID NO: 1284076 - RNA, 14 nt, Mycobacterium tuberculosis H37Rv
cguccgggucacca

SEQ ID NO: 1284077 - RNA, 16 nt, Mycobacterium tuberculosis H37Rv
cguccgggucaccagc

SEQ ID NO: 1284078 - RNA, 15 nt, Mycobacterium tuberculosis H37Rv
cguccgggcucgcgc

SEQ ID NO: 1284079 - RNA, 23 nt, Mycobacterium tuberculosis H37Rv
cgucgaaagagaaggcggcgucg

SEQ ID NO: 1284080 - RNA, 15 nt, Mycobacterium tuberculosis H37Rv
cgucgacaucgccau

SEQ ID NO: 1284081 - RNA, 15 nt, Mycobacterium tuberculosis H37Rv
cgucgacaucgguga

SEQ ID NO: 1284082 - RNA, 21 nt, Mycobacterium tuberculosis H37Rv
cgucgacaucaaagucgaggu

SEQ ID NO: 1284083 - RNA, 16 nt, Mycobacterium tuberculosis H37Rv
cgucgacaguucaacg

SEQ ID NO: 1284084 - RNA, 18 nt, Mycobacterium tuberculosis H37Rv
cgucgacagucaacaggg

SEQ ID NO: 1284085 - RNA, 13 nt, Mycobacterium tuberculosis H37Rv
cgucgaccaggcc

SEQ ID NO: 1284086 - RNA, 21 nt, Mycobacterium tuberculosis H37Rv
cgucgaccacgacguucgacg

SEQ ID NO: 1284087 - RNA, 22 nt, Mycobacterium tuberculosis H37Rv
cgucgacccccugccacagcga

SEQ ID NO: 1284088 - RNA, 17 nt, Mycobacterium tuberculosis H37Rv
cgucgacgaugucggca

SEQ ID NO: 1284089 - RNA, 21 nt, Mycobacterium tuberculosis H37Rv
cgucgacccccugccacagcg

SEQ ID NO: 1284090 - RNA, 17 nt, Mycobacterium tuberculosis H37Rv
cguccugccaguccgca

SEQ ID NO: 1284091 - RNA, 22 nt, Mycobacterium tuberculosis H37Rv
cguccugguggcgggaucacca

SEQ ID NO: 1284092 - RNA, 21 nt, Mycobacterium tuberculosis H37Rv
cgucagcaccccgccgccugc

SEQ ID NO: 1284093 - RNA, 22 nt, Mycobacterium tuberculosis H37Rv
cgucagcaccccgccgccugcu

SEQ ID NO: 1284094 - RNA, 21 nt, Mycobacterium tuberculosis H37Rv
cgucagaccgcgaacagcggg

SEQ ID NO: 1284095 - RNA, 22 nt, Mycobacterium tuberculosis H37Rv
cgucacgguggacgauacgcgc

SEQ ID NO: 1284096 - RNA, 23 nt, Mycobacterium tuberculosis H37Rv
cgucacgucguuuggccucagcc

SEQ ID NO: 1284097 - RNA, 17 nt, Mycobacterium tuberculosis H37Rv
cgucacucccuggccgc

SEQ ID NO: 1284098 - RNA, 14 nt, Mycobacterium tuberculosis H37Rv
cgucacucccgaca

SEQ ID NO: 1284099 - RNA, 22 nt, Mycobacterium tuberculosis H37Rv
cgucacugcgaaaaaucaugcc

SEQ ID NO: 1284100 - RNA, 15 nt, Mycobacterium tuberculosis H37Rv
cgucacgucgacggc

SEQ ID NO: 1284101 - RNA, 14 nt, Mycobacterium tuberculosis H37Rv
cgucacgggcguug

SEQ ID NO: 1284102 - RNA, 17 nt, Mycobacterium tuberculosis H37Rv
cgucacgggguccgaug

SEQ ID NO: 1284103 - RNA, 18 nt, Mycobacterium tuberculosis H37Rv
cgucaaucaccaccgcca

SEQ ID NO: 1284104 - RNA, 21 nt, Mycobacterium tuberculosis H37Rv
cgucacaagucgacacgccga

SEQ ID NO: 1284105 - RNA, 22 nt, Mycobacterium tuberculosis H37Rv
cgucacaaugcccaggcucgca

SEQ ID NO: 1284106 - RNA, 14 nt, Mycobacterium tuberculosis H37Rv
cgucacaccgaugc

SEQ ID NO: 1284107 - RNA, 15 nt, Mycobacterium tuberculosis H37Rv
cgucagcgccgcuga

SEQ ID NO: 1284108 - RNA, 14 nt, Mycobacterium tuberculosis H37Rv
cgucagcgcgccgu

SEQ ID NO: 1284109 - RNA, 18 nt, Mycobacterium tuberculosis H37Rv
cgucagcgcgaccgucag

SEQ ID NO: 1284110 - RNA, 23 nt, Mycobacterium tuberculosis H37Rv
cgucagcuuggacccugcgccgc

SEQ ID NO: 1284111 - RNA, 22 nt, Mycobacterium tuberculosis H37Rv
cgucagcuguuugccggcuuug

SEQ ID NO: 1284112 - RNA, 23 nt, Mycobacterium tuberculosis H37Rv
cgucagguucuaccaaaucgaca

SEQ ID NO: 1284113 - RNA, 20 nt, Mycobacterium tuberculosis H37Rv
cgucagguucuaccaaaucg

SEQ ID NO: 1284114 - RNA, 19 nt, Mycobacterium tuberculosis H37Rv
cgucagguuccgcgacaac

SEQ ID NO: 1284115 - RNA, 15 nt, Mycobacterium tuberculosis H37Rv
cgucaguccucaucg

SEQ ID NO: 1284116 - RNA, 17 nt, Mycobacterium tuberculosis H37Rv
cgucaguccucaucgag

SEQ ID NO: 1284117 - RNA, 21 nt, Mycobacterium tuberculosis H37Rv
cgucaggccuccaaaaucgcg

SEQ ID NO: 1284118 - RNA, 14 nt, Mycobacterium tuberculosis H37Rv
cguaggcgccguug

SEQ ID NO: 1284119 - RNA, 16 nt, Mycobacterium tuberculosis H37Rv
cguaguggaagccgac

SEQ ID NO: 1284120 - RNA, 20 nt, Mycobacterium tuberculosis H37Rv
cguaggugccgaagaugacc

SEQ ID NO: 1284121 - RNA, 13 nt, Mycobacterium tuberculosis H37Rv
cguagugaucgca

SEQ ID NO: 1284122 - RNA, 16 nt, Mycobacterium tuberculosis H37Rv
cguauaccgcacccug

SEQ ID NO: 1284123 - RNA, 19 nt, Mycobacterium tuberculosis H37Rv
cguauugauacugcccgcg

SEQ ID NO: 1284124 - RNA, 18 nt, Mycobacterium tuberculosis H37Rv
aacccggucggcagcugg

SEQ ID NO: 1284125 - RNA, 19 nt, Mycobacterium tuberculosis H37Rv
aacccgucuuaucggcguc

SEQ ID NO: 1284126 - RNA, 12 nt, Mycobacterium tuberculosis H37Rv
aacccggcgacc

SEQ ID NO: 1284127 - RNA, 15 nt, Mycobacterium tuberculosis H37Rv
cguauuggacgcugc

SEQ ID NO: 1284128 - RNA, 22 nt, Mycobacterium tuberculosis H37Rv
cgucaacggaagaagcaguagc

SEQ ID NO: 1284129 - RNA, 22 nt, Mycobacterium tuberculosis H37Rv
cgucaaccucgccacgcucggc

SEQ ID NO: 1284130 - RNA, 18 nt, Mycobacterium tuberculosis H37Rv
cgucaaccgaucggucgu

SEQ ID NO: 1284131 - RNA, 19 nt, Mycobacterium tuberculosis H37Rv
uuuucgcaagucuccucga

SEQ ID NO: 1284132 - RNA, 21 nt, Mycobacterium tuberculosis H37Rv
uuugcgaugcccacggugccg

SEQ ID NO: 1284133 - RNA, 16 nt, Mycobacterium tuberculosis H37Rv
uuugcguacaacgccg

SEQ ID NO: 1284134 - RNA, 17 nt, Mycobacterium tuberculosis H37Rv
uuugacgcccucggcga

SEQ ID NO: 1284135 - RNA, 17 nt, Mycobacterium tuberculosis H37Rv
uugucguagcgacgcca

SEQ ID NO: 1284136 - RNA, 14 nt, Mycobacterium tuberculosis H37Rv
uuguugaagccgau

SEQ ID NO: 1284137 - RNA, 17 nt, Mycobacterium tuberculosis H37Rv
uuguuccagcgcaucga

SEQ ID NO: 1284138 - RNA, 19 nt, Mycobacterium tuberculosis H37Rv
uugggaucgugccggcgaa

SEQ ID NO: 1284139 - RNA, 22 nt, Mycobacterium tuberculosis H37Rv
uuggcugccgaacaguucggcg

SEQ ID NO: 1284140 - RNA, 19 nt, Mycobacterium tuberculosis H37Rv
uugggcgauuuugcgucug

SEQ ID NO: 1284141 - RNA, 20 nt, Mycobacterium tuberculosis H37Rv
uuguagcgguccagcgucgc

SEQ ID NO: 1284142 - RNA, 19 nt, Mycobacterium tuberculosis H37Rv
uuguaggccaucgucgugg

SEQ ID NO: 1284143 - RNA, 13 nt, Mycobacterium tuberculosis H37Rv
uuguccucggcga

SEQ ID NO: 1284144 - RNA, 16 nt, Mycobacterium tuberculosis H37Rv
uuggcgcgguccucca

SEQ ID NO: 1284145 - RNA, 21 nt, Mycobacterium tuberculosis H37Rv
uuggcgccggccaguucggcc

SEQ ID NO: 1284146 - RNA, 13 nt, Mycobacterium tuberculosis H37Rv
uuggcgccgauga

SEQ ID NO: 1284147 - RNA, 19 nt, Mycobacterium tuberculosis H37Rv
uuggcgguggcccgauuga

SEQ ID NO: 1284148 - RNA, 15 nt, Mycobacterium tuberculosis H37Rv
uuggcgucagcagca

SEQ ID NO: 1284149 - RNA, 15 nt, Mycobacterium tuberculosis H37Rv
uuggcggccagcgca

SEQ ID NO: 1284150 - RNA, 23 nt, Mycobacterium tuberculosis H37Rv
uuggcgggcgccuuggucgccgc

SEQ ID NO: 1284151 - RNA, 18 nt, Mycobacterium tuberculosis H37Rv
uuggcggucugcgccaaa

SEQ ID NO: 1284152 - RNA, 12 nt, Mycobacterium tuberculosis H37Rv
uucuuggcugca

SEQ ID NO: 1284153 - RNA, 19 nt, Mycobacterium tuberculosis H37Rv
uucuuuaaaccccuggcga

SEQ ID NO: 1284154 - RNA, 14 nt, Mycobacterium tuberculosis H37Rv
uggcugggucguca

SEQ ID NO: 1284155 - RNA, 18 nt, Mycobacterium tuberculosis H37Rv
ugggauguucuuggucac

SEQ ID NO: 1284156 - RNA, 14 nt, Mycobacterium tuberculosis H37Rv
ugggcacucaucga

SEQ ID NO: 1284157 - RNA, 16 nt, Mycobacterium tuberculosis H37Rv
ugggcacggccgucga

SEQ ID NO: 1284158 - RNA, 13 nt, Mycobacterium tuberculosis H37Rv
ugggcaccggcgg

SEQ ID NO: 1284159 - RNA, 12 nt, Mycobacterium tuberculosis H37Rv
ugggcaccggcg

SEQ ID NO: 1284160 - RNA, 18 nt, Mycobacterium tuberculosis H37Rv
ugggcccuucacuguugc

SEQ ID NO: 1284161 - RNA, 16 nt, Mycobacterium tuberculosis H37Rv
ugggccccgaucccga

SEQ ID NO: 1284162 - RNA, 17 nt, Mycobacterium tuberculosis H37Rv
uggcgggagaucgucgc

SEQ ID NO: 1284163 - RNA, 23 nt, Mycobacterium tuberculosis H37Rv
uggcgggaccgugacguaucgcc

SEQ ID NO: 1284164 - RNA, 12 nt, Mycobacterium tuberculosis H37Rv
uggcgggaccgu

SEQ ID NO: 1284165 - RNA, 15 nt, Mycobacterium tuberculosis H37Rv
uggcggcugcacgcu

SEQ ID NO: 1284166 - RNA, 17 nt, Mycobacterium tuberculosis H37Rv
uggcgggcagcuguucg

SEQ ID NO: 1284167 - RNA, 22 nt, Mycobacterium tuberculosis H37Rv
uggcgggcgccuuggucgccgc

SEQ ID NO: 1284168 - RNA, 19 nt, Mycobacterium tuberculosis H37Rv
uggcgggccggaugacgcc

SEQ ID NO: 1284169 - RNA, 19 nt, Mycobacterium tuberculosis H37Rv
uggcggggaaaccggccag

SEQ ID NO: 1284170 - RNA, 14 nt, Mycobacterium tuberculosis H37Rv
uggcgggcugaucg

SEQ ID NO: 1284171 - RNA, 15 nt, Mycobacterium tuberculosis H37Rv
uggcgggcugaucgc

SEQ ID NO: 1284172 - RNA, 16 nt, Mycobacterium tuberculosis H37Rv
uggcgggcugaucgcc

SEQ ID NO: 1284173 - RNA, 16 nt, Mycobacterium tuberculosis H37Rv
uggcgggugcggcgau

SEQ ID NO: 1284174 - RNA, 13 nt, Mycobacterium tuberculosis H37Rv
uggcgguccaccg

SEQ ID NO: 1284175 - RNA, 20 nt, Mycobacterium tuberculosis H37Rv
uggcggguuggguggcaccg

SEQ ID NO: 1284176 - RNA, 20 nt, Mycobacterium tuberculosis H37Rv
uggcggucgguuccggugua

SEQ ID NO: 1284177 - RNA, 12 nt, Mycobacterium tuberculosis H37Rv
uggcggugcugc

SEQ ID NO: 1284178 - RNA, 14 nt, Mycobacterium tuberculosis H37Rv
uggcgguggugccg

SEQ ID NO: 1284179 - RNA, 16 nt, Mycobacterium tuberculosis H37Rv
uggcucgaagcuggcg

SEQ ID NO: 1284180 - RNA, 16 nt, Mycobacterium tuberculosis H37Rv
uggcuccggugaaccg

SEQ ID NO: 1284181 - RNA, 13 nt, Mycobacterium tuberculosis H37Rv
ugggccgguuccu

SEQ ID NO: 1284182 - RNA, 22 nt, Mycobacterium tuberculosis H37Rv
ugggccucaaguugguucaccg

SEQ ID NO: 1284183 - RNA, 22 nt, Mycobacterium tuberculosis H37Rv
ugggccggugcagcacgugugc

SEQ ID NO: 1284184 - RNA, 20 nt, Mycobacterium tuberculosis H37Rv
ugggccguacaacagcgcgc

SEQ ID NO: 1284185 - RNA, 21 nt, Mycobacterium tuberculosis H37Rv
ugggcgccaugcgccaacccg

SEQ ID NO: 1284186 - RNA, 19 nt, Mycobacterium tuberculosis H37Rv
ugggcgccgacaccggcug

SEQ ID NO: 1284187 - RNA, 23 nt, Mycobacterium tuberculosis H37Rv
ugggccucaaguugguucaccgc

SEQ ID NO: 1284188 - RNA, 21 nt, Mycobacterium tuberculosis H37Rv
ugggcgcagagucaacgucgu

SEQ ID NO: 1284189 - RNA, 21 nt, Mycobacterium tuberculosis H37Rv
ugggcggcacuggauccggga

SEQ ID NO: 1284190 - RNA, 15 nt, Mycobacterium tuberculosis H37Rv
ugggcgcgcuggcgg

SEQ ID NO: 1284191 - RNA, 16 nt, Mycobacterium tuberculosis H37Rv
ugggcgcucgcaucau

SEQ ID NO: 1284192 - RNA, 19 nt, Mycobacterium tuberculosis H37Rv
ugggcgcuuaugcgucugc

SEQ ID NO: 1284193 - RNA, 22 nt, Mycobacterium tuberculosis H37Rv
ugggcgcgcucaucgaccgggg

SEQ ID NO: 1284194 - RNA, 20 nt, Mycobacterium tuberculosis H37Rv
ugggcgcgcucaucgaccgc

SEQ ID NO: 1284195 - RNA, 19 nt, Mycobacterium tuberculosis H37Rv
ugggcgcgcucaucgaccg

SEQ ID NO: 1284196 - RNA, 15 nt, Mycobacterium tuberculosis H37Rv
ugggcgcgcucaucg

SEQ ID NO: 1284197 - RNA, 21 nt, Mycobacterium tuberculosis H37Rv
ugggcugggauagcgcgguug

SEQ ID NO: 1284198 - RNA, 18 nt, Mycobacterium tuberculosis H37Rv
uggggauaaacugccgcg

SEQ ID NO: 1284199 - RNA, 16 nt, Mycobacterium tuberculosis H37Rv
uggggaugcgauggcc

SEQ ID NO: 1284200 - RNA, 18 nt, Mycobacterium tuberculosis H37Rv
uggggauagccgcgucgc

SEQ ID NO: 1284201 - RNA, 14 nt, Mycobacterium tuberculosis H37Rv
uggggcacgacgcc

SEQ ID NO: 1284202 - RNA, 13 nt, Mycobacterium tuberculosis H37Rv
uggguauccaccg

SEQ ID NO: 1284203 - RNA, 17 nt, Mycobacterium tuberculosis H37Rv
uggguauccaccgcgag

SEQ ID NO: 1284204 - RNA, 20 nt, Mycobacterium tuberculosis H37Rv
uggguaccucucugucgcgu

SEQ ID NO: 1284205 - RNA, 20 nt, Mycobacterium tuberculosis H37Rv
ugggucagguugucggcgau

SEQ ID NO: 1284206 - RNA, 23 nt, Mycobacterium tuberculosis H37Rv
ugguaguccccgaaccgagcgga

SEQ ID NO: 1284207 - RNA, 16 nt, Mycobacterium tuberculosis H37Rv
ugguacuuucacgcuc

SEQ ID NO: 1284208 - RNA, 19 nt, Mycobacterium tuberculosis H37Rv
ugguaggagaucaccucgg

SEQ ID NO: 1284209 - RNA, 12 nt, Mycobacterium tuberculosis H37Rv
ugggucggcgau

SEQ ID NO: 1284210 - RNA, 15 nt, Mycobacterium tuberculosis H37Rv
uggcgaucggguuga

SEQ ID NO: 1284211 - RNA, 23 nt, Mycobacterium tuberculosis H37Rv
uggcgccgcgccgauuccaccgc

SEQ ID NO: 1284212 - RNA, 19 nt, Mycobacterium tuberculosis H37Rv
uggcgccgaaguagccgac

SEQ ID NO: 1284213 - RNA, 14 nt, Mycobacterium tuberculosis H37Rv
uggcgccggugccg

SEQ ID NO: 1284214 - RNA, 13 nt, Mycobacterium tuberculosis H37Rv
uggcgccgccgac

SEQ ID NO: 1284215 - RNA, 15 nt, Mycobacterium tuberculosis H37Rv
uggcgccgccgacca

SEQ ID NO: 1284216 - RNA, 15 nt, Mycobacterium tuberculosis H37Rv
uggcgccggucgccg

SEQ ID NO: 1284217 - RNA, 17 nt, Mycobacterium tuberculosis H37Rv
uggcgaggucggugagg

SEQ ID NO: 1284218 - RNA, 18 nt, Mycobacterium tuberculosis H37Rv
uggcgagguugcgccgac

SEQ ID NO: 1284219 - RNA, 16 nt, Mycobacterium tuberculosis H37Rv
uggcgaggcagcaccc

SEQ ID NO: 1284220 - RNA, 17 nt, Mycobacterium tuberculosis H37Rv
uggcgaugacgaucgcg

SEQ ID NO: 1284221 - RNA, 19 nt, Mycobacterium tuberculosis H37Rv
uggcgaucuggucgccugc

SEQ ID NO: 1284222 - RNA, 12 nt, Mycobacterium tuberculosis H37Rv
uggcgaucucga

SEQ ID NO: 1284223 - RNA, 15 nt, Mycobacterium tuberculosis H37Rv
uggcgaucgcgacga

SEQ ID NO: 1284224 - RNA, 17 nt, Mycobacterium tuberculosis H37Rv
uggcgaucaugagcagc

SEQ ID NO: 1284225 - RNA, 12 nt, Mycobacterium tuberculosis H37Rv
uggcgcugaucg

SEQ ID NO: 1284226 - RNA, 18 nt, Mycobacterium tuberculosis H37Rv
uggcgcugaagccgacga

SEQ ID NO: 1284227 - RNA, 16 nt, Mycobacterium tuberculosis H37Rv
uggcgcugaagccgac

SEQ ID NO: 1284228 - RNA, 16 nt, Mycobacterium tuberculosis H37Rv
uggcgcguaucgcguc

SEQ ID NO: 1284229 - RNA, 18 nt, Mycobacterium tuberculosis H37Rv
uggcgcgggccggcgacu

SEQ ID NO: 1284230 - RNA, 23 nt, Mycobacterium tuberculosis H37Rv
uggcggcggcauagugcgacugc

SEQ ID NO: 1284231 - RNA, 14 nt, Mycobacterium tuberculosis H37Rv
uggcggcggcggag

SEQ ID NO: 1284232 - RNA, 20 nt, Mycobacterium tuberculosis H37Rv
uggcggcgggccucggcgac

SEQ ID NO: 1284233 - RNA, 22 nt, Mycobacterium tuberculosis H37Rv
uggcggcggugccacgaucggc

SEQ ID NO: 1284234 - RNA, 19 nt, Mycobacterium tuberculosis H37Rv
uggcggcgaucaacucggg

SEQ ID NO: 1284235 - RNA, 20 nt, Mycobacterium tuberculosis H37Rv
uggcggcgacacgccaggug

SEQ ID NO: 1284236 - RNA, 21 nt, Mycobacterium tuberculosis H37Rv
uggcggcgaugguaucgccgc

SEQ ID NO: 1284237 - RNA, 13 nt, Mycobacterium tuberculosis H37Rv
uggcgaccugcgc

SEQ ID NO: 1284238 - RNA, 15 nt, Mycobacterium tuberculosis H37Rv
uggcgacggacuccc

SEQ ID NO: 1284239 - RNA, 19 nt, Mycobacterium tuberculosis H37Rv
uggcgacgucggcggugac

SEQ ID NO: 1284240 - RNA, 14 nt, Mycobacterium tuberculosis H37Rv
uggcgagcuggcgu

SEQ ID NO: 1284241 - RNA, 16 nt, Mycobacterium tuberculosis H37Rv
uggccucauccaccga

SEQ ID NO: 1284242 - RNA, 21 nt, Mycobacterium tuberculosis H37Rv
uggccuagccgcggcaccgcc

SEQ ID NO: 1284243 - RNA, 17 nt, Mycobacterium tuberculosis H37Rv
uggccguuggcggcggu

SEQ ID NO: 1284244 - RNA, 16 nt, Mycobacterium tuberculosis H37Rv
uggccgucagccaggu

SEQ ID NO: 1284245 - RNA, 17 nt, Mycobacterium tuberculosis H37Rv
uggccgucagccaggug

SEQ ID NO: 1284246 - RNA, 13 nt, Mycobacterium tuberculosis H37Rv
uggccgucagcca

SEQ ID NO: 1284247 - RNA, 22 nt, Mycobacterium tuberculosis H37Rv
uggccggguuccagcggcaccg

SEQ ID NO: 1284248 - RNA, 15 nt, Mycobacterium tuberculosis H37Rv
uggccguaacgcgga

SEQ ID NO: 1284249 - RNA, 19 nt, Mycobacterium tuberculosis H37Rv
uggccguaacgcggaucgg

SEQ ID NO: 1284250 - RNA, 17 nt, Mycobacterium tuberculosis H37Rv
uggccgcuuugcgcggu

SEQ ID NO: 1284251 - RNA, 15 nt, Mycobacterium tuberculosis H37Rv
uggaaaccgggcgaa

SEQ ID NO: 1284252 - RNA, 21 nt, Mycobacterium tuberculosis H37Rv
uggccgcgaugacgaccgauc

SEQ ID NO: 1284253 - RNA, 16 nt, Mycobacterium tuberculosis H37Rv
uggugucguagguugc

SEQ ID NO: 1284254 - RNA, 22 nt, Mycobacterium tuberculosis H37Rv
uggugucggaaugggcgccaca

SEQ ID NO: 1284255 - RNA, 18 nt, Mycobacterium tuberculosis H37Rv
ugguguccucgucgaggu

SEQ ID NO: 1284256 - RNA, 17 nt, Mycobacterium tuberculosis H37Rv
uggugugucaccggauu

SEQ ID NO: 1284257 - RNA, 14 nt, Mycobacterium tuberculosis H37Rv
uguaaacaacgcga

SEQ ID NO: 1284258 - RNA, 18 nt, Mycobacterium tuberculosis H37Rv
uggugcgccgggcguccg

SEQ ID NO: 1284259 - RNA, 19 nt, Mycobacterium tuberculosis H37Rv
uggugcgccgggcguccgc

SEQ ID NO: 1284260 - RNA, 14 nt, Mycobacterium tuberculosis H37Rv
uggugccgacccgc

SEQ ID NO: 1284261 - RNA, 15 nt, Mycobacterium tuberculosis H37Rv
uggugccgcggccac

SEQ ID NO: 1284262 - RNA, 17 nt, Mycobacterium tuberculosis H37Rv
uggugcagccgcggucg

SEQ ID NO: 1284263 - RNA, 23 nt, Mycobacterium tuberculosis H37Rv
uggugccaaccugggccaucacg

SEQ ID NO: 1284264 - RNA, 15 nt, Mycobacterium tuberculosis H37Rv
uggugccaaccuggg

SEQ ID NO: 1284265 - RNA, 13 nt, Mycobacterium tuberculosis H37Rv
uggugccaaccug

SEQ ID NO: 1284266 - RNA, 21 nt, Mycobacterium tuberculosis H37Rv
uggugacccugaugaucgucc

SEQ ID NO: 1284267 - RNA, 17 nt, Mycobacterium tuberculosis H37Rv
uggugaagucggugccg

SEQ ID NO: 1284268 - RNA, 17 nt, Mycobacterium tuberculosis H37Rv
uggugauccggucuccg

SEQ ID NO: 1284269 - RNA, 17 nt, Mycobacterium tuberculosis H37Rv
uggugaucacgucggau

SEQ ID NO: 1284270 - RNA, 21 nt, Mycobacterium tuberculosis H37Rv
uggugaugggggagccgguga

SEQ ID NO: 1284271 - RNA, 13 nt, Mycobacterium tuberculosis H37Rv
uggucgggucgca

SEQ ID NO: 1284272 - RNA, 18 nt, Mycobacterium tuberculosis H37Rv
uggucggcggugaacgac

SEQ ID NO: 1284273 - RNA, 14 nt, Mycobacterium tuberculosis H37Rv
uggucuacccgcgg

SEQ ID NO: 1284274 - RNA, 19 nt, Mycobacterium tuberculosis H37Rv
uggucgucauccuggucac

SEQ ID NO: 1284275 - RNA, 15 nt, Mycobacterium tuberculosis H37Rv
uggucgcggcugcca

SEQ ID NO: 1284276 - RNA, 14 nt, Mycobacterium tuberculosis H37Rv
uggucggcucguca

SEQ ID NO: 1284277 - RNA, 13 nt, Mycobacterium tuberculosis H37Rv
uggucggcgacgu

SEQ ID NO: 1284278 - RNA, 22 nt, Mycobacterium tuberculosis H37Rv
uggucgccgccuuacgcaccga

SEQ ID NO: 1284279 - RNA, 22 nt, Mycobacterium tuberculosis H37Rv
uggucgccggcgucgagccgga

SEQ ID NO: 1284280 - RNA, 18 nt, Mycobacterium tuberculosis H37Rv
uggucgccgcggcagcgu

SEQ ID NO: 1284281 - RNA, 18 nt, Mycobacterium tuberculosis H37Rv
uggucgcgaccgaccgca

SEQ ID NO: 1284282 - RNA, 19 nt, Mycobacterium tuberculosis H37Rv
uggucgagcacgcugcugc

SEQ ID NO: 1284283 - RNA, 23 nt, Mycobacterium tuberculosis H37Rv
uggucgagcagugccucggcgau

SEQ ID NO: 1284284 - RNA, 16 nt, Mycobacterium tuberculosis H37Rv
uggucgaugugaucac

SEQ ID NO: 1284285 - RNA, 22 nt, Mycobacterium tuberculosis H37Rv
uggucgaugugaucaccgauga

SEQ ID NO: 1284286 - RNA, 21 nt, Mycobacterium tuberculosis H37Rv
uggucgaacagcgaaccggcu

SEQ ID NO: 1284287 - RNA, 20 nt, Mycobacterium tuberculosis H37Rv
ugguccgggugccggugcgc

SEQ ID NO: 1284288 - RNA, 15 nt, Mycobacterium tuberculosis H37Rv
ugguccgaccagcgg

SEQ ID NO: 1284289 - RNA, 18 nt, Mycobacterium tuberculosis H37Rv
ugguccaggcggugacgu

SEQ ID NO: 1284290 - RNA, 17 nt, Mycobacterium tuberculosis H37Rv
uggucacggcgucgacu

SEQ ID NO: 1284291 - RNA, 12 nt, Mycobacterium tuberculosis H37Rv
uggucacgguuc

SEQ ID NO: 1284292 - RNA, 15 nt, Mycobacterium tuberculosis H37Rv
uggucaacggcagau

SEQ ID NO: 1284293 - RNA, 19 nt, Mycobacterium tuberculosis H37Rv
ugguauuuguccggcggac

SEQ ID NO: 1284294 - RNA, 13 nt, Mycobacterium tuberculosis H37Rv
uggucaacagcgg

SEQ ID NO: 1284295 - RNA, 16 nt, Mycobacterium tuberculosis H37Rv
ugguccaucgcgcugc

SEQ ID NO: 1284296 - RNA, 16 nt, Mycobacterium tuberculosis H37Rv
uggucaggaacacucg

SEQ ID NO: 1284297 - RNA, 21 nt, Mycobacterium tuberculosis H37Rv
uggucaguccgacaccggcgg

SEQ ID NO: 1284298 - RNA, 19 nt, Mycobacterium tuberculosis H37Rv
ugucaaguucgccagcaac

SEQ ID NO: 1284299 - RNA, 21 nt, Mycobacterium tuberculosis H37Rv
ugucaaucauguacaccgucg

SEQ ID NO: 1284300 - RNA, 12 nt, Mycobacterium tuberculosis H37Rv
uguccuuugcca

SEQ ID NO: 1284301 - RNA, 20 nt, Mycobacterium tuberculosis H37Rv
ugucgaagccccucaccucg

SEQ ID NO: 1284302 - RNA, 12 nt, Mycobacterium tuberculosis H37Rv
uguccucgaugc

SEQ ID NO: 1284303 - RNA, 15 nt, Mycobacterium tuberculosis H37Rv
ugucgccaacccggu

SEQ ID NO: 1284304 - RNA, 21 nt, Mycobacterium tuberculosis H37Rv
ugucgaagccccucaccucgg

SEQ ID NO: 1284305 - RNA, 18 nt, Mycobacterium tuberculosis H37Rv
ugucgaagaauaugccga

SEQ ID NO: 1284306 - RNA, 15 nt, Mycobacterium tuberculosis H37Rv
ugucaaugacaccgg

SEQ ID NO: 1284307 - RNA, 21 nt, Mycobacterium tuberculosis H37Rv
uguccagcggcauggugacgu

SEQ ID NO: 1284308 - RNA, 22 nt, Mycobacterium tuberculosis H37Rv
uguccaggagugcgggcaugcc

SEQ ID NO: 1284309 - RNA, 16 nt, Mycobacterium tuberculosis H37Rv
uguccaggguggucag

SEQ ID NO: 1284310 - RNA, 17 nt, Mycobacterium tuberculosis H37Rv
ugucccgaugguggccg

SEQ ID NO: 1284311 - RNA, 18 nt, Mycobacterium tuberculosis H37Rv
ugucccgcaugcacguca

SEQ ID NO: 1284312 - RNA, 23 nt, Mycobacterium tuberculosis H37Rv
ugucccggaccaucgccugcaag

SEQ ID NO: 1284313 - RNA, 23 nt, Mycobacterium tuberculosis H37Rv
ugucgucgccggcggcggugcgc

SEQ ID NO: 1284314 - RNA, 18 nt, Mycobacterium tuberculosis H37Rv
ugucggugaaccaacgcg

SEQ ID NO: 1284315 - RNA, 16 nt, Mycobacterium tuberculosis H37Rv
ugucggugucggugac

SEQ ID NO: 1284316 - RNA, 20 nt, Mycobacterium tuberculosis H37Rv
ugucgggggcuuuugcgucu

SEQ ID NO: 1284317 - RNA, 20 nt, Mycobacterium tuberculosis H37Rv
ugucgggcuggguggccaac

SEQ ID NO: 1284318 - RNA, 22 nt, Mycobacterium tuberculosis H37Rv
ugucgccuucuuggcaggugcc

SEQ ID NO: 1284319 - RNA, 14 nt, Mycobacterium tuberculosis H37Rv
ugucgccgcucggu

SEQ ID NO: 1284320 - RNA, 21 nt, Mycobacterium tuberculosis H37Rv
ugucgccgauaucggugaccg

SEQ ID NO: 1284321 - RNA, 21 nt, Mycobacterium tuberculosis H37Rv
ugucggcagguaccaccgcgg

SEQ ID NO: 1284322 - RNA, 10 nt, Mycobacterium tuberculosis H37Rv
ugucggcgau

SEQ ID NO: 1284323 - RNA, 21 nt, Mycobacterium tuberculosis H37Rv
ugucucgggcgcgggugacca

SEQ ID NO: 1284324 - RNA, 17 nt, Mycobacterium tuberculosis H37Rv
ugucuggucauggccga

SEQ ID NO: 1284325 - RNA, 17 nt, Mycobacterium tuberculosis H37Rv
ugucgucuuggcgaucg

SEQ ID NO: 1284326 - RNA, 19 nt, Mycobacterium tuberculosis H37Rv
ugucgugauacagcucggu

SEQ ID NO: 1284327 - RNA, 21 nt, Mycobacterium tuberculosis H37Rv
ugugcccaugaugcucgauga

SEQ ID NO: 1284328 - RNA, 19 nt, Mycobacterium tuberculosis H37Rv
ugugcccggcucucagcga

SEQ ID NO: 1284329 - RNA, 20 nt, Mycobacterium tuberculosis H37Rv
uucagcgcauuucggaucuc

SEQ ID NO: 1284330 - RNA, 19 nt, Mycobacterium tuberculosis H37Rv
uucauggggcuauggcgca

SEQ ID NO: 1284331 - RNA, 17 nt, Mycobacterium tuberculosis H37Rv
uucccacccacgccgac

SEQ ID NO: 1284332 - RNA, 16 nt, Mycobacterium tuberculosis H37Rv
uucccacccacgccga

SEQ ID NO: 1284333 - RNA, 21 nt, Mycobacterium tuberculosis H37Rv
uucccaggaacgggacgccgu

SEQ ID NO: 1284334 - RNA, 14 nt, Mycobacterium tuberculosis H37Rv
uucaccucggcgac

SEQ ID NO: 1284335 - RNA, 14 nt, Mycobacterium tuberculosis H37Rv
uucacgacgccgag

SEQ ID NO: 1284336 - RNA, 16 nt, Mycobacterium tuberculosis H37Rv
uucaccgccuugguca

SEQ ID NO: 1284337 - RNA, 15 nt, Mycobacterium tuberculosis H37Rv
ugugcucacgcaucg

SEQ ID NO: 1284338 - RNA, 13 nt, Mycobacterium tuberculosis H37Rv
ugugcggugaccg

SEQ ID NO: 1284339 - RNA, 19 nt, Mycobacterium tuberculosis H37Rv
ugugcgggcagguccgcca

SEQ ID NO: 1284340 - RNA, 23 nt, Mycobacterium tuberculosis H37Rv
ugugcgggcggugcacaccgucg

SEQ ID NO: 1284341 - RNA, 13 nt, Mycobacterium tuberculosis H37Rv
ugugcucgccgau

SEQ ID NO: 1284342 - RNA, 19 nt, Mycobacterium tuberculosis H37Rv
uguggcccaacaccgccag

SEQ ID NO: 1284343 - RNA, 17 nt, Mycobacterium tuberculosis H37Rv
uguggccagcaucauca

SEQ ID NO: 1284344 - RNA, 18 nt, Mycobacterium tuberculosis H37Rv
uguuguacggcccgcauc

SEQ ID NO: 1284345 - RNA, 13 nt, Mycobacterium tuberculosis H37Rv
uguuguugacgcc

SEQ ID NO: 1284346 - RNA, 19 nt, Mycobacterium tuberculosis H37Rv
uuaccgguauagccaagug

SEQ ID NO: 1284347 - RNA, 13 nt, Mycobacterium tuberculosis H37Rv
uuagcccgauggu

SEQ ID NO: 1284348 - RNA, 21 nt, Mycobacterium tuberculosis H37Rv
uuagcacaucgccggcgucga

SEQ ID NO: 1284349 - RNA, 19 nt, Mycobacterium tuberculosis H37Rv
uucugugucugcucggcga

SEQ ID NO: 1284350 - RNA, 15 nt, Mycobacterium tuberculosis H37Rv
uucuccaccagcgug

SEQ ID NO: 1284351 - RNA, 20 nt, Mycobacterium tuberculosis H37Rv
uucucgagccgccggaucgc

SEQ ID NO: 1284352 - RNA, 21 nt, Mycobacterium tuberculosis H37Rv
uucuccucgucgcgggcgaug

SEQ ID NO: 1284353 - RNA, 19 nt, Mycobacterium tuberculosis H37Rv
uucugcgccacgucgacgg

SEQ ID NO: 1284354 - RNA, 23 nt, Mycobacterium tuberculosis H37Rv
uucgugcaccacauuggcgauca

SEQ ID NO: 1284355 - RNA, 14 nt, Mycobacterium tuberculosis H37Rv
uucgugcacggcga

SEQ ID NO: 1284356 - RNA, 22 nt, Mycobacterium tuberculosis H37Rv
uucgugcagcccaaggcgacga

SEQ ID NO: 1284357 - RNA, 14 nt, Mycobacterium tuberculosis H37Rv
uucgucgucgucgg

SEQ ID NO: 1284358 - RNA, 17 nt, Mycobacterium tuberculosis H37Rv
uucgucgguguccucgg

SEQ ID NO: 1284359 - RNA, 18 nt, Mycobacterium tuberculosis H37Rv
uucgucgaccgcgccaua

SEQ ID NO: 1284360 - RNA, 18 nt, Mycobacterium tuberculosis H37Rv
uucgggccggagccggug

SEQ ID NO: 1284361 - RNA, 13 nt, Mycobacterium tuberculosis H37Rv
uucggcgugucgg

SEQ ID NO: 1284362 - RNA, 18 nt, Mycobacterium tuberculosis H37Rv
uucggcggccgugucggg

SEQ ID NO: 1284363 - RNA, 14 nt, Mycobacterium tuberculosis H37Rv
uucggcgucaccgu

SEQ ID NO: 1284364 - RNA, 14 nt, Mycobacterium tuberculosis H37Rv
uucggggaccacgc

SEQ ID NO: 1284365 - RNA, 20 nt, Mycobacterium tuberculosis H37Rv
uucggugccgugaucggcgc

SEQ ID NO: 1284366 - RNA, 13 nt, Mycobacterium tuberculosis H37Rv
uucggugcgcggu

SEQ ID NO: 1284367 - RNA, 17 nt, Mycobacterium tuberculosis H37Rv
uucggcccgaggugccg

SEQ ID NO: 1284368 - RNA, 23 nt, Mycobacterium tuberculosis H37Rv
uucggccgucauggcccgaucga

SEQ ID NO: 1284369 - RNA, 14 nt, Mycobacterium tuberculosis H37Rv
uucggccagcgugu

SEQ ID NO: 1284370 - RNA, 20 nt, Mycobacterium tuberculosis H37Rv
uucggcggcauguucaucgc

SEQ ID NO: 1284371 - RNA, 17 nt, Mycobacterium tuberculosis H37Rv
uucggcggccgugucgg

SEQ ID NO: 1284372 - RNA, 17 nt, Mycobacterium tuberculosis H37Rv
uucggcgcugaucgcgc

SEQ ID NO: 1284373 - RNA, 17 nt, Mycobacterium tuberculosis H37Rv
uucggcgccggcgucgg

SEQ ID NO: 1284374 - RNA, 13 nt, Mycobacterium tuberculosis H37Rv
uucggcgaccggc

SEQ ID NO: 1284375 - RNA, 19 nt, Mycobacterium tuberculosis H37Rv
uucggcgagcgcaucggcc

SEQ ID NO: 1284376 - RNA, 18 nt, Mycobacterium tuberculosis H37Rv
uucgccgggcaacgcgaa

SEQ ID NO: 1284377 - RNA, 15 nt, Mycobacterium tuberculosis H37Rv
uucgccggcuccgca

SEQ ID NO: 1284378 - RNA, 18 nt, Mycobacterium tuberculosis H37Rv
uucgcgacaacucgcgaa

SEQ ID NO: 1284379 - RNA, 17 nt, Mycobacterium tuberculosis H37Rv
uucgccguugucgucgg

SEQ ID NO: 1284380 - RNA, 14 nt, Mycobacterium tuberculosis H37Rv
uucgcgcacgucgg

SEQ ID NO: 1284381 - RNA, 19 nt, Mycobacterium tuberculosis H37Rv
uucgcgacgucugccaggc

SEQ ID NO: 1284382 - RNA, 18 nt, Mycobacterium tuberculosis H37Rv
uucgcgagcagacgcgga

SEQ ID NO: 1284383 - RNA, 19 nt, Mycobacterium tuberculosis H37Rv
uucgcgaagaacgacgcca

SEQ ID NO: 1284384 - RNA, 19 nt, Mycobacterium tuberculosis H37Rv
uucgccacgcccgacgcca

SEQ ID NO: 1284385 - RNA, 15 nt, Mycobacterium tuberculosis H37Rv
uucgccagguggccg

SEQ ID NO: 1284386 - RNA, 19 nt, Mycobacterium tuberculosis H37Rv
uucgccccgaggaugccga

SEQ ID NO: 1284387 - RNA, 18 nt, Mycobacterium tuberculosis H37Rv
uucgcugacggccaugga

SEQ ID NO: 1284388 - RNA, 16 nt, Mycobacterium tuberculosis H37Rv
uucgcgucgccgauga

SEQ ID NO: 1284389 - RNA, 22 nt, Mycobacterium tuberculosis H37Rv
uucgcgggacgcgacucggcgg

SEQ ID NO: 1284390 - RNA, 14 nt, Mycobacterium tuberculosis H37Rv
uucggaggugaccu

SEQ ID NO: 1284391 - RNA, 14 nt, Mycobacterium tuberculosis H37Rv
uucggaugucucgg

SEQ ID NO: 1284392 - RNA, 13 nt, Mycobacterium tuberculosis H37Rv
uuccgcaucggcc

SEQ ID NO: 1284393 - RNA, 16 nt, Mycobacterium tuberculosis H37Rv
uuccgauagccgacca

SEQ ID NO: 1284394 - RNA, 13 nt, Mycobacterium tuberculosis H37Rv
uucgagcaccgac

SEQ ID NO: 1284395 - RNA, 23 nt, Mycobacterium tuberculosis H37Rv
uucgagcaacugcucgacgaggc

SEQ ID NO: 1284396 - RNA, 14 nt, Mycobacterium tuberculosis H37Rv
uucgagggugaccc

SEQ ID NO: 1284397 - RNA, 15 nt, Mycobacterium tuberculosis H37Rv
uucgagcugccaggc

SEQ ID NO: 1284398 - RNA, 17 nt, Mycobacterium tuberculosis H37Rv
uucgaucagucgugggc

SEQ ID NO: 1284399 - RNA, 14 nt, Mycobacterium tuberculosis H37Rv
guugacguccaaca

SEQ ID NO: 1284400 - RNA, 14 nt, Mycobacterium tuberculosis H37Rv
guugacgucgagca

SEQ ID NO: 1284401 - RNA, 16 nt, Mycobacterium tuberculosis H37Rv
guugacgggcucggca

SEQ ID NO: 1284402 - RNA, 17 nt, Mycobacterium tuberculosis H37Rv
guugagauggucaccgg

SEQ ID NO: 1284403 - RNA, 16 nt, Mycobacterium tuberculosis H37Rv
guugagcagcuuggug

SEQ ID NO: 1284404 - RNA, 14 nt, Mycobacterium tuberculosis H37Rv
guugagcaucaccg

SEQ ID NO: 1284405 - RNA, 17 nt, Mycobacterium tuberculosis H37Rv
guugagcugucgcaacg

SEQ ID NO: 1284406 - RNA, 20 nt, Mycobacterium tuberculosis H37Rv
guugaggagguccucgacga

SEQ ID NO: 1284407 - RNA, 21 nt, Mycobacterium tuberculosis H37Rv
guucuuuugcgucugcuggcg

SEQ ID NO: 1284408 - RNA, 23 nt, Mycobacterium tuberculosis H37Rv
guugaacucgaguugcucgacac

SEQ ID NO: 1284409 - RNA, 17 nt, Mycobacterium tuberculosis H37Rv
guugaagaaagcgaccg

SEQ ID NO: 1284410 - RNA, 13 nt, Mycobacterium tuberculosis H37Rv
guugacaccaggg

SEQ ID NO: 1284411 - RNA, 21 nt, Mycobacterium tuberculosis H37Rv
guugacaccagggggcgagag

SEQ ID NO: 1284412 - RNA, 14 nt, Mycobacterium tuberculosis H37Rv
guggucugcgcggu

SEQ ID NO: 1284413 - RNA, 17 nt, Mycobacterium tuberculosis H37Rv
guggucuccggcaccga

SEQ ID NO: 1284414 - RNA, 23 nt, Mycobacterium tuberculosis H37Rv
guuggacgccuugcacaagcuga

SEQ ID NO: 1284415 - RNA, 13 nt, Mycobacterium tuberculosis H37Rv
guuggcaccagcc

SEQ ID NO: 1284416 - RNA, 17 nt, Mycobacterium tuberculosis H37Rv
guuggcaccagccggug

SEQ ID NO: 1284417 - RNA, 19 nt, Mycobacterium tuberculosis H37Rv
guugcugaucagagcguuc

SEQ ID NO: 1284418 - RNA, 15 nt, Mycobacterium tuberculosis H37Rv
guugcuggucaagau

SEQ ID NO: 1284419 - RNA, 19 nt, Mycobacterium tuberculosis H37Rv
guugccucgucgccgcggu

SEQ ID NO: 1284420 - RNA, 15 nt, Mycobacterium tuberculosis H37Rv
guugccguccaccga

SEQ ID NO: 1284421 - RNA, 17 nt, Mycobacterium tuberculosis H37Rv
guugccgggguuggucg

SEQ ID NO: 1284422 - RNA, 23 nt, Mycobacterium tuberculosis H37Rv
guugccggucaggcaguccaccg

SEQ ID NO: 1284423 - RNA, 22 nt, Mycobacterium tuberculosis H37Rv
guugccgggucgauuucgccgg

SEQ ID NO: 1284424 - RNA, 14 nt, Mycobacterium tuberculosis H37Rv
guugcgcucgauca

SEQ ID NO: 1284425 - RNA, 15 nt, Mycobacterium tuberculosis H37Rv
guugcggaucgagca

SEQ ID NO: 1284426 - RNA, 23 nt, Mycobacterium tuberculosis H37Rv
guugccguuaccgccaaacgcug

SEQ ID NO: 1284427 - RNA, 13 nt, Mycobacterium tuberculosis H37Rv
guugcgcgguagc

SEQ ID NO: 1284428 - RNA, 15 nt, Mycobacterium tuberculosis H37Rv
guugauucgugcgau

SEQ ID NO: 1284429 - RNA, 17 nt, Mycobacterium tuberculosis H37Rv
guugauuucggcggcga

SEQ ID NO: 1284430 - RNA, 14 nt, Mycobacterium tuberculosis H37Rv
guugaggccgguga

SEQ ID NO: 1284431 - RNA, 18 nt, Mycobacterium tuberculosis H37Rv
guugcacaccgaucggca

SEQ ID NO: 1284432 - RNA, 21 nt, Mycobacterium tuberculosis H37Rv
guugcaauacacguugccgau

SEQ ID NO: 1284433 - RNA, 18 nt, Mycobacterium tuberculosis H37Rv
guugauuucggcggcgau

SEQ ID NO: 1284434 - RNA, 13 nt, Mycobacterium tuberculosis H37Rv
guugcagaccacc

SEQ ID NO: 1284435 - RNA, 15 nt, Mycobacterium tuberculosis H37Rv
guugccaacgaaccg

SEQ ID NO: 1284436 - RNA, 18 nt, Mycobacterium tuberculosis H37Rv
guugccaacgaaccgcuc

SEQ ID NO: 1284437 - RNA, 17 nt, Mycobacterium tuberculosis H37Rv
guugccaacaccggcga

SEQ ID NO: 1284438 - RNA, 21 nt, Mycobacterium tuberculosis H37Rv
guugccggagacgucgccgca

SEQ ID NO: 1284439 - RNA, 16 nt, Mycobacterium tuberculosis H37Rv
guugccggacaaccug

SEQ ID NO: 1284440 - RNA, 13 nt, Mycobacterium tuberculosis H37Rv
guugccggagacg

SEQ ID NO: 1284441 - RNA, 23 nt, Mycobacterium tuberculosis H37Rv
guugccagcgacgcggucaucga

SEQ ID NO: 1284442 - RNA, 16 nt, Mycobacterium tuberculosis H37Rv
guugguguugcggacg

SEQ ID NO: 1284443 - RNA, 21 nt, Mycobacterium tuberculosis H37Rv
guuguaggccgggccggccac

SEQ ID NO: 1284444 - RNA, 15 nt, Mycobacterium tuberculosis H37Rv
guuguaucgcagcau

SEQ ID NO: 1284445 - RNA, 19 nt, Mycobacterium tuberculosis H37Rv
guuguccaccgccaccacg

SEQ ID NO: 1284446 - RNA, 19 nt, Mycobacterium tuberculosis H37Rv
guugucgacgaagguggcg

SEQ ID NO: 1284447 - RNA, 23 nt, Mycobacterium tuberculosis H37Rv
guuguccuucagccaguccagcg

SEQ ID NO: 1284448 - RNA, 14 nt, Mycobacterium tuberculosis H37Rv
guugucgacaucgg

SEQ ID NO: 1284449 - RNA, 15 nt, Mycobacterium tuberculosis H37Rv
guuguccucggcgau

SEQ ID NO: 1284450 - RNA, 14 nt, Mycobacterium tuberculosis H37Rv
guuggcccgccuga

SEQ ID NO: 1284451 - RNA, 18 nt, Mycobacterium tuberculosis H37Rv
guuggcaccagccgguga

SEQ ID NO: 1284452 - RNA, 22 nt, Mycobacterium tuberculosis H37Rv
guuggcagcgggacugcggaag

SEQ ID NO: 1284453 - RNA, 19 nt, Mycobacterium tuberculosis H37Rv
guuggcagggccagcggca

SEQ ID NO: 1284454 - RNA, 19 nt, Mycobacterium tuberculosis H37Rv
guuggcaguggcgcggcga

SEQ ID NO: 1284455 - RNA, 19 nt, Mycobacterium tuberculosis H37Rv
guuucgaccugcgggaucg

SEQ ID NO: 1284456 - RNA, 18 nt, Mycobacterium tuberculosis H37Rv
guuucgcagccgcaccgg

SEQ ID NO: 1284457 - RNA, 21 nt, Mycobacterium tuberculosis H37Rv
guuucgccagauggccacgga

SEQ ID NO: 1284458 - RNA, 14 nt, Mycobacterium tuberculosis H37Rv
guuugacgccgaug

SEQ ID NO: 1284459 - RNA, 14 nt, Mycobacterium tuberculosis H37Rv
guuugaucgcaacg

SEQ ID NO: 1284460 - RNA, 12 nt, Mycobacterium tuberculosis H37Rv
guuuggcggcag

SEQ ID NO: 1284461 - RNA, 18 nt, Mycobacterium tuberculosis H37Rv
guuuuaccucggccgcca

SEQ ID NO: 1284462 - RNA, 23 nt, Mycobacterium tuberculosis H37Rv
uacacgucgcggguaaccggcuc

SEQ ID NO: 1284463 - RNA, 13 nt, Mycobacterium tuberculosis H37Rv
uaauggucgucgc

SEQ ID NO: 1284464 - RNA, 19 nt, Mycobacterium tuberculosis H37Rv
uaauggccgaguccggcaa

SEQ ID NO: 1284465 - RNA, 23 nt, Mycobacterium tuberculosis H37Rv
uacaacagcugggucaugccgua

SEQ ID NO: 1284466 - RNA, 21 nt, Mycobacterium tuberculosis H37Rv
uacaaccacccacccgcacca

SEQ ID NO: 1284467 - RNA, 15 nt, Mycobacterium tuberculosis H37Rv
uaaucaagcagcgug

SEQ ID NO: 1284468 - RNA, 21 nt, Mycobacterium tuberculosis H37Rv
uaaccgagccgaccggcggca

SEQ ID NO: 1284469 - RNA, 14 nt, Mycobacterium tuberculosis H37Rv
uaacuucaccggcu

SEQ ID NO: 1284470 - RNA, 13 nt, Mycobacterium tuberculosis H37Rv
uaacgucacaccg

SEQ ID NO: 1284471 - RNA, 16 nt, Mycobacterium tuberculosis H37Rv
uaacgcggaucgggca

SEQ ID NO: 1284472 - RNA, 15 nt, Mycobacterium tuberculosis H37Rv
uaacgcggcaccacg

SEQ ID NO: 1284473 - RNA, 19 nt, Mycobacterium tuberculosis H37Rv
uaacgcggcaccacgucga

SEQ ID NO: 1284474 - RNA, 19 nt, Mycobacterium tuberculosis H37Rv
uaaaaaccacccccaccga

SEQ ID NO: 1284475 - RNA, 16 nt, Mycobacterium tuberculosis H37Rv
uaaaccucgccgguga

SEQ ID NO: 1284476 - RNA, 15 nt, Mycobacterium tuberculosis H37Rv
uaaagcccggcggca

SEQ ID NO: 1284477 - RNA, 14 nt, Mycobacterium tuberculosis H37Rv
uacgccuccuucgu

SEQ ID NO: 1284478 - RNA, 15 nt, Mycobacterium tuberculosis H37Rv
uacgccucgacagcg

SEQ ID NO: 1284479 - RNA, 22 nt, Mycobacterium tuberculosis H37Rv
uacgcgacgguguagcccaucg

SEQ ID NO: 1284480 - RNA, 14 nt, Mycobacterium tuberculosis H37Rv
uacgcgggugacca

SEQ ID NO: 1284481 - RNA, 13 nt, Mycobacterium tuberculosis H37Rv
uacgcggcugacg

SEQ ID NO: 1284482 - RNA, 15 nt, Mycobacterium tuberculosis H37Rv
uacggccaccaggug

SEQ ID NO: 1284483 - RNA, 16 nt, Mycobacterium tuberculosis H37Rv
uacggcgacacgccag

SEQ ID NO: 1284484 - RNA, 21 nt, Mycobacterium tuberculosis H37Rv
uacggcgaugcggucggccac

SEQ ID NO: 1284485 - RNA, 13 nt, Mycobacterium tuberculosis H37Rv
uacggcgacaccc

SEQ ID NO: 1284486 - RNA, 14 nt, Mycobacterium tuberculosis H37Rv
uacggcccgcaucg

SEQ ID NO: 1284487 - RNA, 15 nt, Mycobacterium tuberculosis H37Rv
uacggcccgcaucgu

SEQ ID NO: 1284488 - RNA, 22 nt, Mycobacterium tuberculosis H37Rv
uacggcgaugcggucggccaca

SEQ ID NO: 1284489 - RNA, 18 nt, Mycobacterium tuberculosis H37Rv
uacggggccgucucgccg

SEQ ID NO: 1284490 - RNA, 18 nt, Mycobacterium tuberculosis H37Rv
uacgggcugacgaucucc

SEQ ID NO: 1284491 - RNA, 18 nt, Mycobacterium tuberculosis H37Rv
uacgguccggcguacucg

SEQ ID NO: 1284492 - RNA, 13 nt, Mycobacterium tuberculosis H37Rv
uacgggugucggg

SEQ ID NO: 1284493 - RNA, 15 nt, Mycobacterium tuberculosis H37Rv
uacgggucggcgacg

SEQ ID NO: 1284494 - RNA, 20 nt, Mycobacterium tuberculosis H37Rv
uacgggucggcgacgaaccg

SEQ ID NO: 1284495 - RNA, 21 nt, Mycobacterium tuberculosis H37Rv
uacgggugccgacucggccac

SEQ ID NO: 1284496 - RNA, 20 nt, Mycobacterium tuberculosis H37Rv
uacguaccacugcucgaugu

SEQ ID NO: 1284497 - RNA, 21 nt, Mycobacterium tuberculosis H37Rv
uacgucgagggugaccaacgu

SEQ ID NO: 1284498 - RNA, 17 nt, Mycobacterium tuberculosis H37Rv
uacgugcgagcccaccu

SEQ ID NO: 1284499 - RNA, 17 nt, Mycobacterium tuberculosis H37Rv
uacguuguacucgugcg

SEQ ID NO: 1284500 - RNA, 19 nt, Mycobacterium tuberculosis H37Rv
uacguuguuugaucgcaac

SEQ ID NO: 1284501 - RNA, 15 nt, Mycobacterium tuberculosis H37Rv
uagaagucgaucgcc

SEQ ID NO: 1284502 - RNA, 15 nt, Mycobacterium tuberculosis H37Rv
uagaacguagcgccc

SEQ ID NO: 1284503 - RNA, 22 nt, Mycobacterium tuberculosis H37Rv
uacuuccauccacaucgauguc

SEQ ID NO: 1284504 - RNA, 13 nt, Mycobacterium tuberculosis H37Rv
uaggcguugaucg

SEQ ID NO: 1284505 - RNA, 15 nt, Mycobacterium tuberculosis H37Rv
uaggcgcggucaccg

SEQ ID NO: 1284506 - RNA, 16 nt, Mycobacterium tuberculosis H37Rv
uaggcgcggucaccgc

SEQ ID NO: 1284507 - RNA, 16 nt, Mycobacterium tuberculosis H37Rv
uagggcaucgucgccg

SEQ ID NO: 1284508 - RNA, 13 nt, Mycobacterium tuberculosis H37Rv
uagggccggugac

SEQ ID NO: 1284509 - RNA, 20 nt, Mycobacterium tuberculosis H37Rv
uaggggcuuuugcgucugcu

SEQ ID NO: 1284510 - RNA, 14 nt, Mycobacterium tuberculosis H37Rv
uagggcuccaccgu

SEQ ID NO: 1284511 - RNA, 13 nt, Mycobacterium tuberculosis H37Rv
uagggcuccucgu

SEQ ID NO: 1284512 - RNA, 18 nt, Mycobacterium tuberculosis H37Rv
uagggcgauuuccaucgc

SEQ ID NO: 1284513 - RNA, 18 nt, Mycobacterium tuberculosis H37Rv
uaggccgcgcccgagacc

SEQ ID NO: 1284514 - RNA, 14 nt, Mycobacterium tuberculosis H37Rv
uaggcgaccagaua

SEQ ID NO: 1284515 - RNA, 20 nt, Mycobacterium tuberculosis H37Rv
uaggccggcggucagcagcg

SEQ ID NO: 1284516 - RNA, 23 nt, Mycobacterium tuberculosis H37Rv
uaggcgaccagauagaacaacgu

SEQ ID NO: 1284517 - RNA, 20 nt, Mycobacterium tuberculosis H37Rv
uaggcgauucugcgucugcu

SEQ ID NO: 1284518 - RNA, 13 nt, Mycobacterium tuberculosis H37Rv
uaggacaccggca

SEQ ID NO: 1284519 - RNA, 22 nt, Mycobacterium tuberculosis H37Rv
uaggccaagccgcggcuaggcc

SEQ ID NO: 1284520 - RNA, 19 nt, Mycobacterium tuberculosis H37Rv
uagcugaccgagcugaucc

SEQ ID NO: 1284521 - RNA, 17 nt, Mycobacterium tuberculosis H37Rv
uagcugacccgcgguag

SEQ ID NO: 1284522 - RNA, 19 nt, Mycobacterium tuberculosis H37Rv
uagcuggaguaggugugcg

SEQ ID NO: 1284523 - RNA, 16 nt, Mycobacterium tuberculosis H37Rv
uagcugcucaucgcgc

SEQ ID NO: 1284524 - RNA, 17 nt, Mycobacterium tuberculosis H37Rv
uagcuggcggggguccg

SEQ ID NO: 1284525 - RNA, 22 nt, Mycobacterium tuberculosis H37Rv
uagcugcggucgaacaucaucg

SEQ ID NO: 1284526 - RNA, 20 nt, Mycobacterium tuberculosis H37Rv
uagcgccgcgcuugcgaucg

SEQ ID NO: 1284527 - RNA, 12 nt, Mycobacterium tuberculosis H37Rv
uagcgcggccag

SEQ ID NO: 1284528 - RNA, 13 nt, Mycobacterium tuberculosis H37Rv
uagcgcggccagc

SEQ ID NO: 1284529 - RNA, 17 nt, Mycobacterium tuberculosis H37Rv
uagcgcucgaacucggc

SEQ ID NO: 1284530 - RNA, 17 nt, Mycobacterium tuberculosis H37Rv
uagcgacgccaucugcu

SEQ ID NO: 1284531 - RNA, 13 nt, Mycobacterium tuberculosis H37Rv
uagccugcgccga

SEQ ID NO: 1284532 - RNA, 22 nt, Mycobacterium tuberculosis H37Rv
uagcgugguacuuucacgcucg

SEQ ID NO: 1284533 - RNA, 14 nt, Mycobacterium tuberculosis H37Rv
uagccguucggcug

SEQ ID NO: 1284534 - RNA, 18 nt, Mycobacterium tuberculosis H37Rv
uagccgggaacgcugacg

SEQ ID NO: 1284535 - RNA, 20 nt, Mycobacterium tuberculosis H37Rv
uagccggcgacaccgcaggu

SEQ ID NO: 1284536 - RNA, 16 nt, Mycobacterium tuberculosis H37Rv
uagccggaucccgguc

SEQ ID NO: 1284537 - RNA, 23 nt, Mycobacterium tuberculosis H37Rv
uagaucauuucgguaauggccgc

SEQ ID NO: 1284538 - RNA, 17 nt, Mycobacterium tuberculosis H37Rv
uagaagcacgucgucgc

SEQ ID NO: 1284539 - RNA, 19 nt, Mycobacterium tuberculosis H37Rv
uaucggugcuggucgccgc

SEQ ID NO: 1284540 - RNA, 12 nt, Mycobacterium tuberculosis H37Rv
uaucggucgacu

SEQ ID NO: 1284541 - RNA, 18 nt, Mycobacterium tuberculosis H37Rv
uauccguacaguccacgc

SEQ ID NO: 1284542 - RNA, 21 nt, Mycobacterium tuberculosis H37Rv
uauccguguguuaggcccgca

SEQ ID NO: 1284543 - RNA, 23 nt, Mycobacterium tuberculosis H37Rv
uaucagccgcgcgccaucgccuc

SEQ ID NO: 1284544 - RNA, 19 nt, Mycobacterium tuberculosis H37Rv
uaucagccgagacaccacg

SEQ ID NO: 1284545 - RNA, 14 nt, Mycobacterium tuberculosis H37Rv
uauuggaucgucgg

SEQ ID NO: 1284546 - RNA, 14 nt, Mycobacterium tuberculosis H37Rv
uauucguuggcgaa

SEQ ID NO: 1284547 - RNA, 21 nt, Mycobacterium tuberculosis H37Rv
uaugacuugcgcgcggcaaca

SEQ ID NO: 1284548 - RNA, 13 nt, Mycobacterium tuberculosis H37Rv
uauggccaccacg

SEQ ID NO: 1284549 - RNA, 19 nt, Mycobacterium tuberculosis H37Rv
uauggcgaagaccgcauca

SEQ ID NO: 1284550 - RNA, 15 nt, Mycobacterium tuberculosis H37Rv
uauggcccgggccga

SEQ ID NO: 1284551 - RNA, 17 nt, Mycobacterium tuberculosis H37Rv
uaggggucgaggucuuu

SEQ ID NO: 1284552 - RNA, 23 nt, Mycobacterium tuberculosis H37Rv
uagucgggcaaggcggcggccag

SEQ ID NO: 1284553 - RNA, 16 nt, Mycobacterium tuberculosis H37Rv
uaguccgcgccgacgg

SEQ ID NO: 1284554 - RNA, 20 nt, Mycobacterium tuberculosis H37Rv
uaguccgagggcgucgccgc

SEQ ID NO: 1284555 - RNA, 17 nt, Mycobacterium tuberculosis H37Rv
uaguccccgaaccgagc

SEQ ID NO: 1284556 - RNA, 17 nt, Mycobacterium tuberculosis H37Rv
uagugaucgaucgcggc

SEQ ID NO: 1284557 - RNA, 21 nt, Mycobacterium tuberculosis H37Rv
uagugaugguucaugaacauc

SEQ ID NO: 1284558 - RNA, 19 nt, Mycobacterium tuberculosis H37Rv
uaguugcgcggcaucccgc

SEQ ID NO: 1284559 - RNA, 17 nt, Mycobacterium tuberculosis H37Rv
uaguucagcgccguccu

SEQ ID NO: 1284560 - RNA, 20 nt, Mycobacterium tuberculosis H37Rv
ucagcggccaacccaucccg

SEQ ID NO: 1284561 - RNA, 19 nt, Mycobacterium tuberculosis H37Rv
ucagcggcguggucucgau

SEQ ID NO: 1284562 - RNA, 14 nt, Mycobacterium tuberculosis H37Rv
ucagcggcucggcg

SEQ ID NO: 1284563 - RNA, 20 nt, Mycobacterium tuberculosis H37Rv
ucagcggcggccacggccau

SEQ ID NO: 1284564 - RNA, 18 nt, Mycobacterium tuberculosis H37Rv
ucagcggcaacgaucgac

SEQ ID NO: 1284565 - RNA, 15 nt, Mycobacterium tuberculosis H37Rv
ucagcgcgguccauc

SEQ ID NO: 1284566 - RNA, 20 nt, Mycobacterium tuberculosis H37Rv
ucagcgcggccacgccgauc

SEQ ID NO: 1284567 - RNA, 14 nt, Mycobacterium tuberculosis H37Rv
ucagcgcgaccgaa

SEQ ID NO: 1284568 - RNA, 17 nt, Mycobacterium tuberculosis H37Rv
ucagcgcgcacacggcu

SEQ ID NO: 1284569 - RNA, 19 nt, Mycobacterium tuberculosis H37Rv
ucagcgcacuggccgcuau

SEQ ID NO: 1284570 - RNA, 16 nt, Mycobacterium tuberculosis H37Rv
ucagcgcaucgccgcu

SEQ ID NO: 1284571 - RNA, 19 nt, Mycobacterium tuberculosis H37Rv
ucagccggaccaccagguc

SEQ ID NO: 1284572 - RNA, 15 nt, Mycobacterium tuberculosis H37Rv
ucagccgguggucug

SEQ ID NO: 1284573 - RNA, 21 nt, Mycobacterium tuberculosis H37Rv
ucagccgcggcggcagcaccc

SEQ ID NO: 1284574 - RNA, 15 nt, Mycobacterium tuberculosis H37Rv
ucagcaccaccagca

SEQ ID NO: 1284575 - RNA, 19 nt, Mycobacterium tuberculosis H37Rv
ucagcaccccauggccacc

SEQ ID NO: 1284576 - RNA, 16 nt, Mycobacterium tuberculosis H37Rv
ucagcacccaccgaag

SEQ ID NO: 1284577 - RNA, 17 nt, Mycobacterium tuberculosis H37Rv
ucagcacccaacccggc

SEQ ID NO: 1284578 - RNA, 12 nt, Mycobacterium tuberculosis H37Rv
ucagccaccggu

SEQ ID NO: 1284579 - RNA, 13 nt, Mycobacterium tuberculosis H37Rv
ucagccaccggug

SEQ ID NO: 1284580 - RNA, 22 nt, Mycobacterium tuberculosis H37Rv
ucagccagggucccgccgccug

SEQ ID NO: 1284581 - RNA, 21 nt, Mycobacterium tuberculosis H37Rv
ucagccagcccaggguguccg

SEQ ID NO: 1284582 - RNA, 14 nt, Mycobacterium tuberculosis H37Rv
ucaggaucgcaccg

SEQ ID NO: 1284583 - RNA, 20 nt, Mycobacterium tuberculosis H37Rv
ucaggacgcgaucggcguca

SEQ ID NO: 1284584 - RNA, 17 nt, Mycobacterium tuberculosis H37Rv
ucaggaaccacccaccg

SEQ ID NO: 1284585 - RNA, 20 nt, Mycobacterium tuberculosis H37Rv
ucaggaaccacccaccggcc

SEQ ID NO: 1284586 - RNA, 22 nt, Mycobacterium tuberculosis H37Rv
ucaggaaccacccaccggccac

SEQ ID NO: 1284587 - RNA, 17 nt, Mycobacterium tuberculosis H37Rv
ucaggcagcuccgccgc

SEQ ID NO: 1284588 - RNA, 17 nt, Mycobacterium tuberculosis H37Rv
ucaggccgccgcggcga

SEQ ID NO: 1284589 - RNA, 20 nt, Mycobacterium tuberculosis H37Rv
ucaggccgacuaaccacugu

SEQ ID NO: 1284590 - RNA, 14 nt, Mycobacterium tuberculosis H37Rv
ucagcgugucgccg

SEQ ID NO: 1284591 - RNA, 21 nt, Mycobacterium tuberculosis H37Rv
ucagcgucugagcgccggcau

SEQ ID NO: 1284592 - RNA, 20 nt, Mycobacterium tuberculosis H37Rv
ucagcgggcagcaggcgaug

SEQ ID NO: 1284593 - RNA, 22 nt, Mycobacterium tuberculosis H37Rv
ucagcugauuaccgacaccgug

SEQ ID NO: 1284594 - RNA, 17 nt, Mycobacterium tuberculosis H37Rv
ucagcuggccgcggcga

SEQ ID NO: 1284595 - RNA, 12 nt, Mycobacterium tuberculosis H37Rv
ucagcugcggau

SEQ ID NO: 1284596 - RNA, 12 nt, Mycobacterium tuberculosis H37Rv
ucagcucggucu

SEQ ID NO: 1284597 - RNA, 14 nt, Mycobacterium tuberculosis H37Rv
ucagcucggguugc

SEQ ID NO: 1284598 - RNA, 14 nt, Mycobacterium tuberculosis H37Rv
ucacggcaccgaag

SEQ ID NO: 1284599 - RNA, 14 nt, Mycobacterium tuberculosis H37Rv
ucacgcugugcggu

SEQ ID NO: 1284600 - RNA, 13 nt, Mycobacterium tuberculosis H37Rv
ucacggaccaggc

SEQ ID NO: 1284601 - RNA, 21 nt, Mycobacterium tuberculosis H37Rv
ucacgccaccgcaacucgccg

SEQ ID NO: 1284602 - RNA, 20 nt, Mycobacterium tuberculosis H37Rv
ucacgcucggcguccgccca

SEQ ID NO: 1284603 - RNA, 13 nt, Mycobacterium tuberculosis H37Rv
ucagacucugccg

SEQ ID NO: 1284604 - RNA, 18 nt, Mycobacterium tuberculosis H37Rv
ucagcaacaacgucugca

SEQ ID NO: 1284605 - RNA, 13 nt, Mycobacterium tuberculosis H37Rv
ucagacgauucgg

SEQ ID NO: 1284606 - RNA, 19 nt, Mycobacterium tuberculosis H37Rv
ucagaccaaugaccgccag

SEQ ID NO: 1284607 - RNA, 12 nt, Mycobacterium tuberculosis H37Rv
ucagaccgcgaa

SEQ ID NO: 1284608 - RNA, 23 nt, Mycobacterium tuberculosis H37Rv
ucacuggaccacucggcggccac

SEQ ID NO: 1284609 - RNA, 16 nt, Mycobacterium tuberculosis H37Rv
ucacguggucggccac

SEQ ID NO: 1284610 - RNA, 17 nt, Mycobacterium tuberculosis H37Rv
ucacgucuaacacgcgg

SEQ ID NO: 1284611 - RNA, 19 nt, Mycobacterium tuberculosis H37Rv
ucaccgccaccaccagggc

SEQ ID NO: 1284612 - RNA, 19 nt, Mycobacterium tuberculosis H37Rv
ucaccgcguguaccgcgac

SEQ ID NO: 1284613 - RNA, 17 nt, Mycobacterium tuberculosis H37Rv
ucaccgccauugccacc

SEQ ID NO: 1284614 - RNA, 15 nt, Mycobacterium tuberculosis H37Rv
ucaccgagauggcga

SEQ ID NO: 1284615 - RNA, 11 nt, Mycobacterium tuberculosis H37Rv
ucaccggcaau

SEQ ID NO: 1284616 - RNA, 16 nt, Mycobacterium tuberculosis H37Rv
ucaccgggcccgacga

SEQ ID NO: 1284617 - RNA, 21 nt, Mycobacterium tuberculosis H37Rv
ucaccuugcuccacaucggcu

SEQ ID NO: 1284618 - RNA, 15 nt, Mycobacterium tuberculosis H37Rv
ucacgaugcucgccg

SEQ ID NO: 1284619 - RNA, 16 nt, Mycobacterium tuberculosis H37Rv
ucacgaucacgucguc

SEQ ID NO: 1284620 - RNA, 11 nt, Mycobacterium tuberculosis H37Rv
ucacgcaccgc

SEQ ID NO: 1284621 - RNA, 23 nt, Mycobacterium tuberculosis H37Rv
ucacgagccaaggcuuccuccga

SEQ ID NO: 1284622 - RNA, 20 nt, Mycobacterium tuberculosis H37Rv
ucacgaggcacaaucaccgc

SEQ ID NO: 1284623 - RNA, 12 nt, Mycobacterium tuberculosis H37Rv
ucacgacggcac

SEQ ID NO: 1284624 - RNA, 18 nt, Mycobacterium tuberculosis H37Rv
ucacgaagugacccgaac

SEQ ID NO: 1284625 - RNA, 21 nt, Mycobacterium tuberculosis H37Rv
ucaugccagccgucaccgcga

SEQ ID NO: 1284626 - RNA, 16 nt, Mycobacterium tuberculosis H37Rv
ucaucgggcacaucgc

SEQ ID NO: 1284627 - RNA, 18 nt, Mycobacterium tuberculosis H37Rv
ucaucggcaaacuccugc

SEQ ID NO: 1284628 - RNA, 14 nt, Mycobacterium tuberculosis H37Rv
ucaucggagucaga

SEQ ID NO: 1284629 - RNA, 15 nt, Mycobacterium tuberculosis H37Rv
ucauccacaccggau

SEQ ID NO: 1284630 - RNA, 19 nt, Mycobacterium tuberculosis H37Rv
ucauguccauagccggcau

SEQ ID NO: 1284631 - RNA, 22 nt, Mycobacterium tuberculosis H37Rv
ucaugggaucaggcugggcaga

SEQ ID NO: 1284632 - RNA, 20 nt, Mycobacterium tuberculosis H37Rv
ucaugggcgccaucccgccg

SEQ ID NO: 1284633 - RNA, 21 nt, Mycobacterium tuberculosis H37Rv
uccaacaggccuaggucgacg

SEQ ID NO: 1284634 - RNA, 22 nt, Mycobacterium tuberculosis H37Rv
uccaacgcacacaccguaccga

SEQ ID NO: 1284635 - RNA, 12 nt, Mycobacterium tuberculosis H37Rv
ucauugcccuug

SEQ ID NO: 1284636 - RNA, 16 nt, Mycobacterium tuberculosis H37Rv
ucauugcaucugccaa

SEQ ID NO: 1284637 - RNA, 14 nt, Mycobacterium tuberculosis H37Rv
ucaguucacgcucg

SEQ ID NO: 1284638 - RNA, 16 nt, Mycobacterium tuberculosis H37Rv
ucaucaggucgucguc

SEQ ID NO: 1284639 - RNA, 18 nt, Mycobacterium tuberculosis H37Rv
ucaucauccacaccggau

SEQ ID NO: 1284640 - RNA, 18 nt, Mycobacterium tuberculosis H37Rv
ucaggucgcagaccagac

SEQ ID NO: 1284641 - RNA, 20 nt, Mycobacterium tuberculosis H37Rv
ucaggugauucgcgcagcgc

SEQ ID NO: 1284642 - RNA, 12 nt, Mycobacterium tuberculosis H37Rv
ucaggucaccgg

SEQ ID NO: 1284643 - RNA, 17 nt, Mycobacterium tuberculosis H37Rv
ucagguagcggcccuuc

SEQ ID NO: 1284644 - RNA, 17 nt, Mycobacterium tuberculosis H37Rv
uccacugccaccgcgag

SEQ ID NO: 1284645 - RNA, 20 nt, Mycobacterium tuberculosis H37Rv
uccacuuguuguccgucgau

SEQ ID NO: 1284646 - RNA, 16 nt, Mycobacterium tuberculosis H37Rv
uccagaucaacgcguc

SEQ ID NO: 1284647 - RNA, 15 nt, Mycobacterium tuberculosis H37Rv
uccagcaacgcggug

SEQ ID NO: 1284648 - RNA, 17 nt, Mycobacterium tuberculosis H37Rv
uccacguucggcugcga

SEQ ID NO: 1284649 - RNA, 22 nt, Mycobacterium tuberculosis H37Rv
uccacgguugccggcggcgacg

SEQ ID NO: 1284650 - RNA, 20 nt, Mycobacterium tuberculosis H37Rv
uccacgguugccggcggcga

SEQ ID NO: 1284651 - RNA, 14 nt, Mycobacterium tuberculosis H37Rv
uccacggagucaac

SEQ ID NO: 1284652 - RNA, 18 nt, Mycobacterium tuberculosis H37Rv
uccacggcagcaccggug

SEQ ID NO: 1284653 - RNA, 20 nt, Mycobacterium tuberculosis H37Rv
uccacgcguagcggucccgc

SEQ ID NO: 1284654 - RNA, 18 nt, Mycobacterium tuberculosis H37Rv
uccacgccgugcuugcga

SEQ ID NO: 1284655 - RNA, 14 nt, Mycobacterium tuberculosis H37Rv
uccaccaccggcac

SEQ ID NO: 1284656 - RNA, 20 nt, Mycobacterium tuberculosis H37Rv
uccaccaagcucgcaaccga

SEQ ID NO: 1284657 - RNA, 19 nt, Mycobacterium tuberculosis H37Rv
uccacaauccgcucggucg

SEQ ID NO: 1284658 - RNA, 22 nt, Mycobacterium tuberculosis H37Rv
uccaacugaucccguagccgug

SEQ ID NO: 1284659 - RNA, 19 nt, Mycobacterium tuberculosis H37Rv
uccaagaacggaugccggu

SEQ ID NO: 1284660 - RNA, 11 nt, Mycobacterium tuberculosis H37Rv
uccaacgccgc

SEQ ID NO: 1284661 - RNA, 13 nt, Mycobacterium tuberculosis H37Rv
uccaccggaucgu

SEQ ID NO: 1284662 - RNA, 19 nt, Mycobacterium tuberculosis H37Rv
uccaccgggauagccgcga

SEQ ID NO: 1284663 - RNA, 20 nt, Mycobacterium tuberculosis H37Rv
uccaccgcggcgucgccgug

SEQ ID NO: 1284664 - RNA, 18 nt, Mycobacterium tuberculosis H37Rv
uccaccgauucggcgacg

SEQ ID NO: 1284665 - RNA, 19 nt, Mycobacterium tuberculosis H37Rv
uccaccgcgaugacgacga

SEQ ID NO: 1284666 - RNA, 12 nt, Mycobacterium tuberculosis H37Rv
uccaggucgaca

SEQ ID NO: 1284667 - RNA, 17 nt, Mycobacterium tuberculosis H37Rv
uccagguggucaucgcc

SEQ ID NO: 1284668 - RNA, 15 nt, Mycobacterium tuberculosis H37Rv
uccagguuccagguc

SEQ ID NO: 1284669 - RNA, 18 nt, Mycobacterium tuberculosis H37Rv
uccaugacaaaccugcau

SEQ ID NO: 1284670 - RNA, 14 nt, Mycobacterium tuberculosis H37Rv
uccaucgcgcaccg

SEQ ID NO: 1284671 - RNA, 18 nt, Mycobacterium tuberculosis H37Rv
uccaucgcgcgccgaccg

SEQ ID NO: 1284672 - RNA, 21 nt, Mycobacterium tuberculosis H37Rv
uccaggcgcugcagcauggcu

SEQ ID NO: 1284673 - RNA, 22 nt, Mycobacterium tuberculosis H37Rv
uccagggugccggucacgucga

SEQ ID NO: 1284674 - RNA, 14 nt, Mycobacterium tuberculosis H37Rv
uccagcucacgaug

SEQ ID NO: 1284675 - RNA, 13 nt, Mycobacterium tuberculosis H37Rv
uccagcgugucgu

SEQ ID NO: 1284676 - RNA, 14 nt, Mycobacterium tuberculosis H37Rv
uccagcgucgccgc

SEQ ID NO: 1284677 - RNA, 23 nt, Mycobacterium tuberculosis H37Rv
uccagcgucugcacguacucggc

SEQ ID NO: 1284678 - RNA, 21 nt, Mycobacterium tuberculosis H37Rv
uccagcggguggccaucaccg

SEQ ID NO: 1284679 - RNA, 23 nt, Mycobacterium tuberculosis H37Rv
uccagcaugcccgccauccgaug

SEQ ID NO: 1284680 - RNA, 22 nt, Mycobacterium tuberculosis H37Rv
uccagcaucaguuugacgccga

SEQ ID NO: 1284681 - RNA, 17 nt, Mycobacterium tuberculosis H37Rv
uccagccaccgaccccg

SEQ ID NO: 1284682 - RNA, 19 nt, Mycobacterium tuberculosis H37Rv
uccagccaggcgauugccc

SEQ ID NO: 1284683 - RNA, 15 nt, Mycobacterium tuberculosis H37Rv
uccagcccgagcaga

SEQ ID NO: 1284684 - RNA, 18 nt, Mycobacterium tuberculosis H37Rv
uccagcggcauggugacg

SEQ ID NO: 1284685 - RNA, 22 nt, Mycobacterium tuberculosis H37Rv
ucccuccgacuaacggugcggu

SEQ ID NO: 1284686 - RNA, 19 nt, Mycobacterium tuberculosis H37Rv
ucccugaucaaggaccgcu

SEQ ID NO: 1284687 - RNA, 18 nt, Mycobacterium tuberculosis H37Rv
ucccuggccuuggugccg

SEQ ID NO: 1284688 - RNA, 19 nt, Mycobacterium tuberculosis H37Rv
uccgaacggguagacccac

SEQ ID NO: 1284689 - RNA, 15 nt, Mycobacterium tuberculosis H37Rv
uccgaagagccagca

SEQ ID NO: 1284690 - RNA, 20 nt, Mycobacterium tuberculosis H37Rv
uccgaagagccagcaacggu

SEQ ID NO: 1284691 - RNA, 22 nt, Mycobacterium tuberculosis H37Rv
uccgaaguccacgcaccacgag

SEQ ID NO: 1284692 - RNA, 20 nt, Mycobacterium tuberculosis H37Rv
uccgacggcggauaaccggc

SEQ ID NO: 1284693 - RNA, 14 nt, Mycobacterium tuberculosis H37Rv
uccgacgucgacga

SEQ ID NO: 1284694 - RNA, 15 nt, Mycobacterium tuberculosis H37Rv
uccgagggugcguug

SEQ ID NO: 1284695 - RNA, 22 nt, Mycobacterium tuberculosis H37Rv
uccgaggagggccgcgaucgac

SEQ ID NO: 1284696 - RNA, 12 nt, Mycobacterium tuberculosis H37Rv
uccgcaccggcg

SEQ ID NO: 1284697 - RNA, 21 nt, Mycobacterium tuberculosis H37Rv
uccgcagugagcaaugccaac

SEQ ID NO: 1284698 - RNA, 19 nt, Mycobacterium tuberculosis H37Rv
uccgcagugagcaaugcca

SEQ ID NO: 1284699 - RNA, 14 nt, Mycobacterium tuberculosis H37Rv
uccgcccagcgagg

SEQ ID NO: 1284700 - RNA, 23 nt, Mycobacterium tuberculosis H37Rv
uccgcccagcgaggugggcguca

SEQ ID NO: 1284701 - RNA, 20 nt, Mycobacterium tuberculosis H37Rv
uccgcccucaguucacguuc

SEQ ID NO: 1284702 - RNA, 18 nt, Mycobacterium tuberculosis H37Rv
uccgccgauagcaccgga

SEQ ID NO: 1284703 - RNA, 21 nt, Mycobacterium tuberculosis H37Rv
uccgcgacgcucgcugcagca

SEQ ID NO: 1284704 - RNA, 19 nt, Mycobacterium tuberculosis H37Rv
uccgcgacaccuguucacc

SEQ ID NO: 1284705 - RNA, 13 nt, Mycobacterium tuberculosis H37Rv
ucccgcaauucgc

SEQ ID NO: 1284706 - RNA, 23 nt, Mycobacterium tuberculosis H37Rv
ucccgccguugccgccgucaccg

SEQ ID NO: 1284707 - RNA, 17 nt, Mycobacterium tuberculosis H37Rv
ucccgccgugcugcggc

SEQ ID NO: 1284708 - RNA, 15 nt, Mycobacterium tuberculosis H37Rv
ucccgccggucacga

SEQ ID NO: 1284709 - RNA, 14 nt, Mycobacterium tuberculosis H37Rv
ucccgccggucacg

SEQ ID NO: 1284710 - RNA, 20 nt, Mycobacterium tuberculosis H37Rv
ucccgccggccccgccgaug

SEQ ID NO: 1284711 - RNA, 14 nt, Mycobacterium tuberculosis H37Rv
ucccgccgcgcguc

SEQ ID NO: 1284712 - RNA, 13 nt, Mycobacterium tuberculosis H37Rv
ucccgccgcaccg

SEQ ID NO: 1284713 - RNA, 14 nt, Mycobacterium tuberculosis H37Rv
ucccgccgcaccgc

SEQ ID NO: 1284714 - RNA, 14 nt, Mycobacterium tuberculosis H37Rv
ucccgccacgucgc

SEQ ID NO: 1284715 - RNA, 14 nt, Mycobacterium tuberculosis H37Rv
ucccgcccagcagc

SEQ ID NO: 1284716 - RNA, 18 nt, Mycobacterium tuberculosis H37Rv
ucccgcccagcagcaccu

SEQ ID NO: 1284717 - RNA, 13 nt, Mycobacterium tuberculosis H37Rv
ucccgcccagcag

SEQ ID NO: 1284718 - RNA, 19 nt, Mycobacterium tuberculosis H37Rv
ucccgccgaucgaaccgcu

SEQ ID NO: 1284719 - RNA, 19 nt, Mycobacterium tuberculosis H37Rv
ucccgccgaccgacaccac

SEQ ID NO: 1284720 - RNA, 17 nt, Mycobacterium tuberculosis H37Rv
ucccugaaauaccaguc

SEQ ID NO: 1284721 - RNA, 17 nt, Mycobacterium tuberculosis H37Rv
ucccuauugcugcggug

SEQ ID NO: 1284722 - RNA, 20 nt, Mycobacterium tuberculosis H37Rv
ucccgucucgacaguggcga

SEQ ID NO: 1284723 - RNA, 13 nt, Mycobacterium tuberculosis H37Rv
ucccgcgaucgcg

SEQ ID NO: 1284724 - RNA, 15 nt, Mycobacterium tuberculosis H37Rv
ucccgccuucucccg

SEQ ID NO: 1284725 - RNA, 23 nt, Mycobacterium tuberculosis H37Rv
ucccgcgagcggaugaaaucggc

SEQ ID NO: 1284726 - RNA, 21 nt, Mycobacterium tuberculosis H37Rv
ucccggccgggucuuccggug

SEQ ID NO: 1284727 - RNA, 13 nt, Mycobacterium tuberculosis H37Rv
ucccggcgaccgg

SEQ ID NO: 1284728 - RNA, 14 nt, Mycobacterium tuberculosis H37Rv
uccgguuacgcucg

SEQ ID NO: 1284729 - RNA, 18 nt, Mycobacterium tuberculosis H37Rv
uccgguuauggcaagccg

SEQ ID NO: 1284730 - RNA, 18 nt, Mycobacterium tuberculosis H37Rv
uccgguguugagaucgcc

SEQ ID NO: 1284731 - RNA, 12 nt, Mycobacterium tuberculosis H37Rv
uccgguggucag

SEQ ID NO: 1284732 - RNA, 17 nt, Mycobacterium tuberculosis H37Rv
uccggugcgccgauccc

SEQ ID NO: 1284733 - RNA, 23 nt, Mycobacterium tuberculosis H37Rv
uccgguggccaacaccgccagca

SEQ ID NO: 1284734 - RNA, 23 nt, Mycobacterium tuberculosis H37Rv
uccggugaaccgggacagcagcc

SEQ ID NO: 1284735 - RNA, 13 nt, Mycobacterium tuberculosis H37Rv
uccggucccgccg

SEQ ID NO: 1284736 - RNA, 16 nt, Mycobacterium tuberculosis H37Rv
uccguccccgcagcgc

SEQ ID NO: 1284737 - RNA, 17 nt, Mycobacterium tuberculosis H37Rv
uccgugccgaugccggc

SEQ ID NO: 1284738 - RNA, 17 nt, Mycobacterium tuberculosis H37Rv
uccgugccagcugccga

SEQ ID NO: 1284739 - RNA, 19 nt, Mycobacterium tuberculosis H37Rv
uccgugccgaccaccagca

SEQ ID NO: 1284740 - RNA, 22 nt, Mycobacterium tuberculosis H37Rv
uccgugccgagcgugcgcuggu

SEQ ID NO: 1284741 - RNA, 15 nt, Mycobacterium tuberculosis H37Rv
uccgguuucgggugc

SEQ ID NO: 1284742 - RNA, 12 nt, Mycobacterium tuberculosis H37Rv
uccgguuucggg

SEQ ID NO: 1284743 - RNA, 18 nt, Mycobacterium tuberculosis H37Rv
uccgguuggacugacguc

SEQ ID NO: 1284744 - RNA, 19 nt, Mycobacterium tuberculosis H37Rv
uccuccguuuggcugccga

SEQ ID NO: 1284745 - RNA, 14 nt, Mycobacterium tuberculosis H37Rv
uccuccugugcgau

SEQ ID NO: 1284746 - RNA, 18 nt, Mycobacterium tuberculosis H37Rv
uccucgaaugucacaccg

SEQ ID NO: 1284747 - RNA, 13 nt, Mycobacterium tuberculosis H37Rv
uccuccagcagcg

SEQ ID NO: 1284748 - RNA, 16 nt, Mycobacterium tuberculosis H37Rv
uccucagcggcccgcu

SEQ ID NO: 1284749 - RNA, 19 nt, Mycobacterium tuberculosis H37Rv
uccguguuucgaacaccgu

SEQ ID NO: 1284750 - RNA, 20 nt, Mycobacterium tuberculosis H37Rv
uccggcuggaagcggcgacu

SEQ ID NO: 1284751 - RNA, 16 nt, Mycobacterium tuberculosis H37Rv
uccggcuuggcggcga

SEQ ID NO: 1284752 - RNA, 22 nt, Mycobacterium tuberculosis H37Rv
uccgggaugaagcucgaccgcc

SEQ ID NO: 1284753 - RNA, 16 nt, Mycobacterium tuberculosis H37Rv
uccgggcaaccgauga

SEQ ID NO: 1284754 - RNA, 22 nt, Mycobacterium tuberculosis H37Rv
uccggcgcuccacugaccaggu

SEQ ID NO: 1284755 - RNA, 14 nt, Mycobacterium tuberculosis H37Rv
uccggcgcgacgcc

SEQ ID NO: 1284756 - RNA, 20 nt, Mycobacterium tuberculosis H37Rv
uccggcgcagcgaccgguaa

SEQ ID NO: 1284757 - RNA, 21 nt, Mycobacterium tuberculosis H37Rv
uccggcgccaggaucgaucgu

SEQ ID NO: 1284758 - RNA, 20 nt, Mycobacterium tuberculosis H37Rv
uccggcccguagcugcgcag

SEQ ID NO: 1284759 - RNA, 14 nt, Mycobacterium tuberculosis H37Rv
uccggaaucgcccg

SEQ ID NO: 1284760 - RNA, 22 nt, Mycobacterium tuberculosis H37Rv
uccggaagcggcguucgaugcc

SEQ ID NO: 1284761 - RNA, 15 nt, Mycobacterium tuberculosis H37Rv
uccgcuguuccucga

SEQ ID NO: 1284762 - RNA, 12 nt, Mycobacterium tuberculosis H37Rv
uccgcgaugugc

SEQ ID NO: 1284763 - RNA, 15 nt, Mycobacterium tuberculosis H37Rv
uccggcccaccgguc

SEQ ID NO: 1284764 - RNA, 17 nt, Mycobacterium tuberculosis H37Rv
uccggcccaccagcgca

SEQ ID NO: 1284765 - RNA, 16 nt, Mycobacterium tuberculosis H37Rv
uccggcccacucacac

SEQ ID NO: 1284766 - RNA, 16 nt, Mycobacterium tuberculosis H37Rv
uccggcauacaucgcc

SEQ ID NO: 1284767 - RNA, 14 nt, Mycobacterium tuberculosis H37Rv
uccggcaccuccag

SEQ ID NO: 1284768 - RNA, 22 nt, Mycobacterium tuberculosis H37Rv
uccggcagaccggugcugucga

SEQ ID NO: 1284769 - RNA, 12 nt, Mycobacterium tuberculosis H37Rv
uccggcaccgcc

SEQ ID NO: 1284770 - RNA, 13 nt, Mycobacterium tuberculosis H37Rv
uccggcacgcguc

SEQ ID NO: 1284771 - RNA, 17 nt, Mycobacterium tuberculosis H37Rv
ucgacgagauccagcgc

SEQ ID NO: 1284772 - RNA, 16 nt, Mycobacterium tuberculosis H37Rv
ucgaccuuauugccga

SEQ ID NO: 1284773 - RNA, 18 nt, Mycobacterium tuberculosis H37Rv
ucgacgagaagacaccgc

SEQ ID NO: 1284774 - RNA, 23 nt, Mycobacterium tuberculosis H37Rv
ucgacgacacguugacgaugugc

SEQ ID NO: 1284775 - RNA, 21 nt, Mycobacterium tuberculosis H37Rv
ucgacgacgcccucacaacga

SEQ ID NO: 1284776 - RNA, 22 nt, Mycobacterium tuberculosis H37Rv
ucgacgacaacgaugucacccu

SEQ ID NO: 1284777 - RNA, 22 nt, Mycobacterium tuberculosis H37Rv
ucgaccggacaaacaucgcacc

SEQ ID NO: 1284778 - RNA, 21 nt, Mycobacterium tuberculosis H37Rv
ucgaccggcgggaugcgcgcc

SEQ ID NO: 1284779 - RNA, 19 nt, Mycobacterium tuberculosis H37Rv
ucgaccguccgggucacca

SEQ ID NO: 1284780 - RNA, 16 nt, Mycobacterium tuberculosis H37Rv
ucgaccgucaccggaa

SEQ ID NO: 1284781 - RNA, 16 nt, Mycobacterium tuberculosis H37Rv
ucgaccgugucaccgc

SEQ ID NO: 1284782 - RNA, 18 nt, Mycobacterium tuberculosis H37Rv
ucgaccuggauugccacc

SEQ ID NO: 1284783 - RNA, 13 nt, Mycobacterium tuberculosis H37Rv
ucgaccucggcaa

SEQ ID NO: 1284784 - RNA, 17 nt, Mycobacterium tuberculosis H37Rv
ucgaccaccacccggaa

SEQ ID NO: 1284785 - RNA, 18 nt, Mycobacterium tuberculosis H37Rv
ucgacaucggugacgguc

SEQ ID NO: 1284786 - RNA, 14 nt, Mycobacterium tuberculosis H37Rv
ucgaccaccucgau

SEQ ID NO: 1284787 - RNA, 20 nt, Mycobacterium tuberculosis H37Rv
ucgaccaucaccacggccgc

SEQ ID NO: 1284788 - RNA, 16 nt, Mycobacterium tuberculosis H37Rv
ucgacccccgcaucgg

SEQ ID NO: 1284789 - RNA, 16 nt, Mycobacterium tuberculosis H37Rv
ucgacccccugccaca

SEQ ID NO: 1284790 - RNA, 21 nt, Mycobacterium tuberculosis H37Rv
ucgacccccgcaucggcgcca

SEQ ID NO: 1284791 - RNA, 19 nt, Mycobacterium tuberculosis H37Rv
ucgaccgauagcuggccga

SEQ ID NO: 1284792 - RNA, 15 nt, Mycobacterium tuberculosis H37Rv
ucgaccgcccgccag

SEQ ID NO: 1284793 - RNA, 16 nt, Mycobacterium tuberculosis H37Rv
ucgaccgaacccgacg

SEQ ID NO: 1284794 - RNA, 16 nt, Mycobacterium tuberculosis H37Rv
ucgacccggucgacgg

SEQ ID NO: 1284795 - RNA, 15 nt, Mycobacterium tuberculosis H37Rv
ucgacccgcgcaacc

SEQ ID NO: 1284796 - RNA, 17 nt, Mycobacterium tuberculosis H37Rv
ucgacaggugccagacc

SEQ ID NO: 1284797 - RNA, 17 nt, Mycobacterium tuberculosis H37Rv
ucgacagauugcucggu

SEQ ID NO: 1284798 - RNA, 17 nt, Mycobacterium tuberculosis H37Rv
ucgacaggccaccgcag

SEQ ID NO: 1284799 - RNA, 14 nt, Mycobacterium tuberculosis H37Rv
ucgacaccgcccga

SEQ ID NO: 1284800 - RNA, 13 nt, Mycobacterium tuberculosis H37Rv
ucgacaccgagga

SEQ ID NO: 1284801 - RNA, 16 nt, Mycobacterium tuberculosis H37Rv
ucgacacccauccucg

SEQ ID NO: 1284802 - RNA, 14 nt, Mycobacterium tuberculosis H37Rv
ucgacacccguuga

SEQ ID NO: 1284803 - RNA, 18 nt, Mycobacterium tuberculosis H37Rv
ucgacaccgugaccgccg

SEQ ID NO: 1284804 - RNA, 16 nt, Mycobacterium tuberculosis H37Rv
ucgaaguagccgacgu

SEQ ID NO: 1284805 - RNA, 18 nt, Mycobacterium tuberculosis H37Rv
ucgacaacugcccgauga

SEQ ID NO: 1284806 - RNA, 22 nt, Mycobacterium tuberculosis H37Rv
ucgacaaccgcugccgcaucgg

SEQ ID NO: 1284807 - RNA, 14 nt, Mycobacterium tuberculosis H37Rv
ucgacaaccucgag

SEQ ID NO: 1284808 - RNA, 19 nt, Mycobacterium tuberculosis H37Rv
ucgacaacacgccgucgac

SEQ ID NO: 1284809 - RNA, 14 nt, Mycobacterium tuberculosis H37Rv
ucgacaaacagcgc

SEQ ID NO: 1284810 - RNA, 21 nt, Mycobacterium tuberculosis H37Rv
ucgacaaacagcgccaucgau

SEQ ID NO: 1284811 - RNA, 19 nt, Mycobacterium tuberculosis H37Rv
ucgaagaccucgucgcguc

SEQ ID NO: 1284812 - RNA, 20 nt, Mycobacterium tuberculosis H37Rv
ucgaacugguuucgcaccgu

SEQ ID NO: 1284813 - RNA, 16 nt, Mycobacterium tuberculosis H37Rv
ucgaacgcagccagcg

SEQ ID NO: 1284814 - RNA, 15 nt, Mycobacterium tuberculosis H37Rv
ucgaacggcuuggcg

SEQ ID NO: 1284815 - RNA, 22 nt, Mycobacterium tuberculosis H37Rv
ucgaagcccgaguugaaggugc

SEQ ID NO: 1284816 - RNA, 13 nt, Mycobacterium tuberculosis H37Rv
ucgaagcgaucgc

SEQ ID NO: 1284817 - RNA, 15 nt, Mycobacterium tuberculosis H37Rv
ucgaaggcacugcga

SEQ ID NO: 1284818 - RNA, 18 nt, Mycobacterium tuberculosis H37Rv
ucgaaggcgugggugucg

SEQ ID NO: 1284819 - RNA, 14 nt, Mycobacterium tuberculosis H37Rv
uccugaguuccggu

SEQ ID NO: 1284820 - RNA, 19 nt, Mycobacterium tuberculosis H37Rv
uccugcacacaggacuugu

SEQ ID NO: 1284821 - RNA, 15 nt, Mycobacterium tuberculosis H37Rv
uccugcagcuggcga

SEQ ID NO: 1284822 - RNA, 19 nt, Mycobacterium tuberculosis H37Rv
uccugccaaugcugcaggu

SEQ ID NO: 1284823 - RNA, 21 nt, Mycobacterium tuberculosis H37Rv
uccucggauaacgucacaccg

SEQ ID NO: 1284824 - RNA, 11 nt, Mycobacterium tuberculosis H37Rv
uccucgaucgu

SEQ ID NO: 1284825 - RNA, 20 nt, Mycobacterium tuberculosis H37Rv
uccucgaucgucgacgcguc

SEQ ID NO: 1284826 - RNA, 21 nt, Mycobacterium tuberculosis H37Rv
uccucggugugcucgccgacc

SEQ ID NO: 1284827 - RNA, 15 nt, Mycobacterium tuberculosis H37Rv
uccucggguucguca

SEQ ID NO: 1284828 - RNA, 14 nt, Mycobacterium tuberculosis H37Rv
uccucggucaccga

SEQ ID NO: 1284829 - RNA, 21 nt, Mycobacterium tuberculosis H37Rv
uccucggcguggcaguacacc

SEQ ID NO: 1284830 - RNA, 19 nt, Mycobacterium tuberculosis H37Rv
uccucggucagcucgucgg

SEQ ID NO: 1284831 - RNA, 16 nt, Mycobacterium tuberculosis H37Rv
uccucugguugggagc

SEQ ID NO: 1284832 - RNA, 16 nt, Mycobacterium tuberculosis H37Rv
ucgaaaccgcccguau

SEQ ID NO: 1284833 - RNA, 22 nt, Mycobacterium tuberculosis H37Rv
uccuuggcccagcgguaguccg

SEQ ID NO: 1284834 - RNA, 13 nt, Mycobacterium tuberculosis H37Rv
ucgaacaucggaa

SEQ ID NO: 1284835 - RNA, 15 nt, Mycobacterium tuberculosis H37Rv
ucgaacaggaucagc

SEQ ID NO: 1284836 - RNA, 16 nt, Mycobacterium tuberculosis H37Rv
ucgaaagccaacucga

SEQ ID NO: 1284837 - RNA, 18 nt, Mycobacterium tuberculosis H37Rv
ucgaacaaccccgguuga

SEQ ID NO: 1284838 - RNA, 18 nt, Mycobacterium tuberculosis H37Rv
uccugcuuguagcgcauc

SEQ ID NO: 1284839 - RNA, 18 nt, Mycobacterium tuberculosis H37Rv
uccugggcccgaaucgcc

SEQ ID NO: 1284840 - RNA, 23 nt, Mycobacterium tuberculosis H37Rv
ucgcgggcagggccucggucgcc

SEQ ID NO: 1284841 - RNA, 16 nt, Mycobacterium tuberculosis H37Rv
ucgcgggacaacagca

SEQ ID NO: 1284842 - RNA, 20 nt, Mycobacterium tuberculosis H37Rv
ucgcgguaguuaacccaggg

SEQ ID NO: 1284843 - RNA, 19 nt, Mycobacterium tuberculosis H37Rv
ucgcgggugcggacaccga

SEQ ID NO: 1284844 - RNA, 14 nt, Mycobacterium tuberculosis H37Rv
ucgcggucgccacc

SEQ ID NO: 1284845 - RNA, 22 nt, Mycobacterium tuberculosis H37Rv
ucgcggucaugggaucaggcug

SEQ ID NO: 1284846 - RNA, 15 nt, Mycobacterium tuberculosis H37Rv
ucgcgggcgaucggc

SEQ ID NO: 1284847 - RNA, 22 nt, Mycobacterium tuberculosis H37Rv
ucgcgggcgucgcugcgcuggu

SEQ ID NO: 1284848 - RNA, 15 nt, Mycobacterium tuberculosis H37Rv
ucgcggcaucgucgc

SEQ ID NO: 1284849 - RNA, 21 nt, Mycobacterium tuberculosis H37Rv
ucgcggcccgagaagcguugc

SEQ ID NO: 1284850 - RNA, 17 nt, Mycobacterium tuberculosis H37Rv
ucgcggccgucuucggu

SEQ ID NO: 1284851 - RNA, 15 nt, Mycobacterium tuberculosis H37Rv
ucgcggcgacccggu

SEQ ID NO: 1284852 - RNA, 24 nt, Mycobacterium tuberculosis H37Rv
ucgcgcggcugugcccgaucagcc

SEQ ID NO: 1284853 - RNA, 23 nt, Mycobacterium tuberculosis H37Rv
ucgcgcggcaccgauggcgcacc

SEQ ID NO: 1284854 - RNA, 13 nt, Mycobacterium tuberculosis H37Rv
ucgcgcgcggcga

SEQ ID NO: 1284855 - RNA, 13 nt, Mycobacterium tuberculosis H37Rv
ucgcggaugccag

SEQ ID NO: 1284856 - RNA, 22 nt, Mycobacterium tuberculosis H37Rv
ucgcgcgucgucgcgcugaacg

SEQ ID NO: 1284857 - RNA, 14 nt, Mycobacterium tuberculosis H37Rv
ucgcgcgucgucgc

SEQ ID NO: 1284858 - RNA, 17 nt, Mycobacterium tuberculosis H37Rv
ucgcggaucucaucggg

SEQ ID NO: 1284859 - RNA, 18 nt, Mycobacterium tuberculosis H37Rv
ucgcgauccacuccggcg

SEQ ID NO: 1284860 - RNA, 19 nt, Mycobacterium tuberculosis H37Rv
ucgcgauccacuccggcga

SEQ ID NO: 1284861 - RNA, 21 nt, Mycobacterium tuberculosis H37Rv
ucgcgacgaugccccgguuga

SEQ ID NO: 1284862 - RNA, 16 nt, Mycobacterium tuberculosis H37Rv
ucgccgucacgcacgc

SEQ ID NO: 1284863 - RNA, 21 nt, Mycobacterium tuberculosis H37Rv
ucgccgucgauguugccgaga

SEQ ID NO: 1284864 - RNA, 15 nt, Mycobacterium tuberculosis H37Rv
ucgcgacccgaucgc

SEQ ID NO: 1284865 - RNA, 23 nt, Mycobacterium tuberculosis H37Rv
ucgcgacaucaccgaacggcgag

SEQ ID NO: 1284866 - RNA, 17 nt, Mycobacterium tuberculosis H37Rv
ucgccggugacgacguc

SEQ ID NO: 1284867 - RNA, 20 nt, Mycobacterium tuberculosis H37Rv
ucgccggugacgacgucgcc

SEQ ID NO: 1284868 - RNA, 16 nt, Mycobacterium tuberculosis H37Rv
ucgcgauguccucgag

SEQ ID NO: 1284869 - RNA, 19 nt, Mycobacterium tuberculosis H37Rv
ucgcgccaucgucgcgccg

SEQ ID NO: 1284870 - RNA, 19 nt, Mycobacterium tuberculosis H37Rv
ucgcgcauugccgacgcgc

SEQ ID NO: 1284871 - RNA, 16 nt, Mycobacterium tuberculosis H37Rv
ucgcgcgcggcauggg

SEQ ID NO: 1284872 - RNA, 13 nt, Mycobacterium tuberculosis H37Rv
ucgcccagggugg

SEQ ID NO: 1284873 - RNA, 18 nt, Mycobacterium tuberculosis H37Rv
ucgcccaggcgugucguc

SEQ ID NO: 1284874 - RNA, 21 nt, Mycobacterium tuberculosis H37Rv
ucgcccgaggcaacgaacgcc

SEQ ID NO: 1284875 - RNA, 16 nt, Mycobacterium tuberculosis H37Rv
ucgcccgcuacggcag

SEQ ID NO: 1284876 - RNA, 20 nt, Mycobacterium tuberculosis H37Rv
ucgcccugacgucacguucg

SEQ ID NO: 1284877 - RNA, 23 nt, Mycobacterium tuberculosis H37Rv
ucgcccugacacccaucgaccgc

SEQ ID NO: 1284878 - RNA, 18 nt, Mycobacterium tuberculosis H37Rv
ucgccgaaaucggccagc

SEQ ID NO: 1284879 - RNA, 15 nt, Mycobacterium tuberculosis H37Rv
ucgccgaacaccgag

SEQ ID NO: 1284880 - RNA, 15 nt, Mycobacterium tuberculosis H37Rv
ucgccgaaaccggga

SEQ ID NO: 1284881 - RNA, 22 nt, Mycobacterium tuberculosis H37Rv
ucgccgaaagccuugccgucga

SEQ ID NO: 1284882 - RNA, 17 nt, Mycobacterium tuberculosis H37Rv
ucgcccaauucggcacg

SEQ ID NO: 1284883 - RNA, 23 nt, Mycobacterium tuberculosis H37Rv
ucgccaugauggacagcugcggg

SEQ ID NO: 1284884 - RNA, 13 nt, Mycobacterium tuberculosis H37Rv
ucgacgaucucgc

SEQ ID NO: 1284885 - RNA, 19 nt, Mycobacterium tuberculosis H37Rv
ucgacgaucucgccggcga

SEQ ID NO: 1284886 - RNA, 23 nt, Mycobacterium tuberculosis H37Rv
ucgacgaugucgaagaucgagcc

SEQ ID NO: 1284887 - RNA, 15 nt, Mycobacterium tuberculosis H37Rv
ucgacgccgagaccg

SEQ ID NO: 1284888 - RNA, 18 nt, Mycobacterium tuberculosis H37Rv
ucgacgccaaaucggcca

SEQ ID NO: 1284889 - RNA, 19 nt, Mycobacterium tuberculosis H37Rv
ucgacgcgaugacacaccg

SEQ ID NO: 1284890 - RNA, 19 nt, Mycobacterium tuberculosis H37Rv
ucgacgccgcagcguccgc

SEQ ID NO: 1284891 - RNA, 18 nt, Mycobacterium tuberculosis H37Rv
ucgccggaccccgagacc

SEQ ID NO: 1284892 - RNA, 16 nt, Mycobacterium tuberculosis H37Rv
ucgccggauagcgcag

SEQ ID NO: 1284893 - RNA, 17 nt, Mycobacterium tuberculosis H37Rv
ucgccggcgcgccgaug

SEQ ID NO: 1284894 - RNA, 18 nt, Mycobacterium tuberculosis H37Rv
ucgccggcgcgccgauga

SEQ ID NO: 1284895 - RNA, 19 nt, Mycobacterium tuberculosis H37Rv
ucgccggcgaagaccgccg

SEQ ID NO: 1284896 - RNA, 15 nt, Mycobacterium tuberculosis H37Rv
ucgccggcggccacc

SEQ ID NO: 1284897 - RNA, 19 nt, Mycobacterium tuberculosis H37Rv
ucgccggcgcucaucgcgu

SEQ ID NO: 1284898 - RNA, 18 nt, Mycobacterium tuberculosis H37Rv
ucgccgcuggcaaucccg

SEQ ID NO: 1284899 - RNA, 15 nt, Mycobacterium tuberculosis H37Rv
ucgccgcuacgccgg

SEQ ID NO: 1284900 - RNA, 18 nt, Mycobacterium tuberculosis H37Rv
ucgccgcucgguccccgc

SEQ ID NO: 1284901 - RNA, 21 nt, Mycobacterium tuberculosis H37Rv
ucgccgcgcuggucggagacc

SEQ ID NO: 1284902 - RNA, 21 nt, Mycobacterium tuberculosis H37Rv
ucgccgcuaacgcaccugcgc

SEQ ID NO: 1284903 - RNA, 14 nt, Mycobacterium tuberculosis H37Rv
ucgccgcgggcagc

SEQ ID NO: 1284904 - RNA, 16 nt, Mycobacterium tuberculosis H37Rv
ucgccgcggcggcagc

SEQ ID NO: 1284905 - RNA, 14 nt, Mycobacterium tuberculosis H37Rv
ucgccgcggcggaa

SEQ ID NO: 1284906 - RNA, 16 nt, Mycobacterium tuberculosis H37Rv
ucgccgcgauggcggu

SEQ ID NO: 1284907 - RNA, 17 nt, Mycobacterium tuberculosis H37Rv
ucgccgccgucggguug

SEQ ID NO: 1284908 - RNA, 22 nt, Mycobacterium tuberculosis H37Rv
ucgccgaugauguuuuccccgc

SEQ ID NO: 1284909 - RNA, 14 nt, Mycobacterium tuberculosis H37Rv
ucgccgaugcggga

SEQ ID NO: 1284910 - RNA, 23 nt, Mycobacterium tuberculosis H37Rv
ucgccgccuucuucucggcgagc

SEQ ID NO: 1284911 - RNA, 17 nt, Mycobacterium tuberculosis H37Rv
ucgccgccuuacgcacc

SEQ ID NO: 1284912 - RNA, 16 nt, Mycobacterium tuberculosis H37Rv
ucgccgaguccggcga

SEQ ID NO: 1284913 - RNA, 20 nt, Mycobacterium tuberculosis H37Rv
ucgccgaucaacagcaccgu

SEQ ID NO: 1284914 - RNA, 17 nt, Mycobacterium tuberculosis H37Rv
ucgccgauagacguguc

SEQ ID NO: 1284915 - RNA, 15 nt, Mycobacterium tuberculosis H37Rv
ucgccgacgccagaa

SEQ ID NO: 1284916 - RNA, 13 nt, Mycobacterium tuberculosis H37Rv
ucgccgacgccca

SEQ ID NO: 1284917 - RNA, 17 nt, Mycobacterium tuberculosis H37Rv
ucgccgaccuuggcguc

SEQ ID NO: 1284918 - RNA, 20 nt, Mycobacterium tuberculosis H37Rv
ucgccgaaucgcugaccgcg

SEQ ID NO: 1284919 - RNA, 24 nt, Mycobacterium tuberculosis H37Rv
ucggccagcucgugaucuucggcg

SEQ ID NO: 1284920 - RNA, 15 nt, Mycobacterium tuberculosis H37Rv
ucggccgucucggca

SEQ ID NO: 1284921 - RNA, 19 nt, Mycobacterium tuberculosis H37Rv
ucggccgucauggcccgau

SEQ ID NO: 1284922 - RNA, 17 nt, Mycobacterium tuberculosis H37Rv
ucggccggggccacccg

SEQ ID NO: 1284923 - RNA, 21 nt, Mycobacterium tuberculosis H37Rv
ucggccggaugagcgaacgcc

SEQ ID NO: 1284924 - RNA, 13 nt, Mycobacterium tuberculosis H37Rv
ucggccgccggau

SEQ ID NO: 1284925 - RNA, 18 nt, Mycobacterium tuberculosis H37Rv
ucggccgccucguacgga

SEQ ID NO: 1284926 - RNA, 14 nt, Mycobacterium tuberculosis H37Rv
ucggcgaggacggc

SEQ ID NO: 1284927 - RNA, 14 nt, Mycobacterium tuberculosis H37Rv
ucggcgagcgucgg

SEQ ID NO: 1284928 - RNA, 13 nt, Mycobacterium tuberculosis H37Rv
ucggcgagcgccc

SEQ ID NO: 1284929 - RNA, 16 nt, Mycobacterium tuberculosis H37Rv
ucggcgagcgcaucgg

SEQ ID NO: 1284930 - RNA, 15 nt, Mycobacterium tuberculosis H37Rv
ucggcgagcagcgca

SEQ ID NO: 1284931 - RNA, 19 nt, Mycobacterium tuberculosis H37Rv
ucggcgagccgcucgcuga

SEQ ID NO: 1284932 - RNA, 22 nt, Mycobacterium tuberculosis H37Rv
ucggcgaccgacgccggugucg

SEQ ID NO: 1284933 - RNA, 18 nt, Mycobacterium tuberculosis H37Rv
ucggcgaaugcgauugcc

SEQ ID NO: 1284934 - RNA, 22 nt, Mycobacterium tuberculosis H37Rv
ucggcgacaggccgagcagaua

SEQ ID NO: 1284935 - RNA, 12 nt, Mycobacterium tuberculosis H37Rv
ucggcgaccagc

SEQ ID NO: 1284936 - RNA, 20 nt, Mycobacterium tuberculosis H37Rv
ucggcgaacgcggcgucgau

SEQ ID NO: 1284937 - RNA, 19 nt, Mycobacterium tuberculosis H37Rv
ucggccugcggcaccggcu

SEQ ID NO: 1284938 - RNA, 16 nt, Mycobacterium tuberculosis H37Rv
ucggcggacccgguga

SEQ ID NO: 1284939 - RNA, 21 nt, Mycobacterium tuberculosis H37Rv
ucggcggaagaccggaucgcc

SEQ ID NO: 1284940 - RNA, 20 nt, Mycobacterium tuberculosis H37Rv
ucggcgccgccguccagcgc

SEQ ID NO: 1284941 - RNA, 21 nt, Mycobacterium tuberculosis H37Rv
ucggcgcugaucgcgcgcacc

SEQ ID NO: 1284942 - RNA, 22 nt, Mycobacterium tuberculosis H37Rv
ucggcgcugcggcgugccgggu

SEQ ID NO: 1284943 - RNA, 17 nt, Mycobacterium tuberculosis H37Rv
ucggcgcuggccgucga

SEQ ID NO: 1284944 - RNA, 15 nt, Mycobacterium tuberculosis H37Rv
ucggcgccgaacuca

SEQ ID NO: 1284945 - RNA, 13 nt, Mycobacterium tuberculosis H37Rv
ucggcgccgcaua

SEQ ID NO: 1284946 - RNA, 15 nt, Mycobacterium tuberculosis H37Rv
ucggcgccgcauacc

SEQ ID NO: 1284947 - RNA, 16 nt, Mycobacterium tuberculosis H37Rv
ucggcgcccgggaucg

SEQ ID NO: 1284948 - RNA, 20 nt, Mycobacterium tuberculosis H37Rv
ucggcgcccgggaucggguc

SEQ ID NO: 1284949 - RNA, 18 nt, Mycobacterium tuberculosis H37Rv
ucggcggcgcgccgaucg

SEQ ID NO: 1284950 - RNA, 23 nt, Mycobacterium tuberculosis H37Rv
ucggcggcggggacucugccacc

SEQ ID NO: 1284951 - RNA, 14 nt, Mycobacterium tuberculosis H37Rv
ucggcggcggcguc

SEQ ID NO: 1284952 - RNA, 16 nt, Mycobacterium tuberculosis H37Rv
ucggcggccaacagca

SEQ ID NO: 1284953 - RNA, 17 nt, Mycobacterium tuberculosis H37Rv
ucggcggcgacguggcg

SEQ ID NO: 1284954 - RNA, 19 nt, Mycobacterium tuberculosis H37Rv
ucggcggacccggugaccc

SEQ ID NO: 1284955 - RNA, 23 nt, Mycobacterium tuberculosis H37Rv
ucggcggcgucuucgucggaguc

SEQ ID NO: 1284956 - RNA, 21 nt, Mycobacterium tuberculosis H37Rv
ucggcggcuucgauugcgcug

SEQ ID NO: 1284957 - RNA, 17 nt, Mycobacterium tuberculosis H37Rv
ucggcgggauccucgaa

SEQ ID NO: 1284958 - RNA, 15 nt, Mycobacterium tuberculosis H37Rv
ucggcgggcggcagc

SEQ ID NO: 1284959 - RNA, 19 nt, Mycobacterium tuberculosis H37Rv
ucggcgguagccgaccagc

SEQ ID NO: 1284960 - RNA, 16 nt, Mycobacterium tuberculosis H37Rv
ucggcggucagcggcu

SEQ ID NO: 1284961 - RNA, 20 nt, Mycobacterium tuberculosis H37Rv
ucggcgggggaccccgccag

SEQ ID NO: 1284962 - RNA, 17 nt, Mycobacterium tuberculosis H37Rv
ucggcggggaccgcggu

SEQ ID NO: 1284963 - RNA, 14 nt, Mycobacterium tuberculosis H37Rv
ucggcgucgaagac

SEQ ID NO: 1284964 - RNA, 17 nt, Mycobacterium tuberculosis H37Rv
ucggcguccuugcgcag

SEQ ID NO: 1284965 - RNA, 17 nt, Mycobacterium tuberculosis H37Rv
ucggcguaggcgauggc

SEQ ID NO: 1284966 - RNA, 17 nt, Mycobacterium tuberculosis H37Rv
ucggcgucauccaccgc

SEQ ID NO: 1284967 - RNA, 22 nt, Mycobacterium tuberculosis H37Rv
ucggcguacccguuaugcgccg

SEQ ID NO: 1284968 - RNA, 16 nt, Mycobacterium tuberculosis H37Rv
ucggcgguucgauccc

SEQ ID NO: 1284969 - RNA, 23 nt, Mycobacterium tuberculosis H37Rv
ucggcggugaaaucgcacagcgc

SEQ ID NO: 1284970 - RNA, 19 nt, Mycobacterium tuberculosis H37Rv
ucggcggugaacgacgggu

SEQ ID NO: 1284971 - RNA, 21 nt, Mycobacterium tuberculosis H37Rv
ucggcagccggcuugggcggu

SEQ ID NO: 1284972 - RNA, 18 nt, Mycobacterium tuberculosis H37Rv
ucggcaccaccgcgaccu

SEQ ID NO: 1284973 - RNA, 13 nt, Mycobacterium tuberculosis H37Rv
ucggcaccaccgc

SEQ ID NO: 1284974 - RNA, 15 nt, Mycobacterium tuberculosis H37Rv
ucggcaagucgacgc

SEQ ID NO: 1284975 - RNA, 18 nt, Mycobacterium tuberculosis H37Rv
ucggcaacggcggcgugg

SEQ ID NO: 1284976 - RNA, 17 nt, Mycobacterium tuberculosis H37Rv
ucggcagcuucucgccg

SEQ ID NO: 1284977 - RNA, 14 nt, Mycobacterium tuberculosis H37Rv
ucggcaggccgcuu

SEQ ID NO: 1284978 - RNA, 16 nt, Mycobacterium tuberculosis H37Rv
ucggcagcggcgcggu

SEQ ID NO: 1284979 - RNA, 20 nt, Mycobacterium tuberculosis H37Rv
ucggccaccaacucggcgac

SEQ ID NO: 1284980 - RNA, 18 nt, Mycobacterium tuberculosis H37Rv
ucggccaccggcgucugc

SEQ ID NO: 1284981 - RNA, 18 nt, Mycobacterium tuberculosis H37Rv
ucggccaccaacucggcg

SEQ ID NO: 1284982 - RNA, 19 nt, Mycobacterium tuberculosis H37Rv
ucggccaccaacucggcga

SEQ ID NO: 1284983 - RNA, 17 nt, Mycobacterium tuberculosis H37Rv
ucggccacauccagcgc

SEQ ID NO: 1284984 - RNA, 15 nt, Mycobacterium tuberculosis H37Rv
ucggaugaccaguga

SEQ ID NO: 1284985 - RNA, 17 nt, Mycobacterium tuberculosis H37Rv
ucggaucggcgccgcau

SEQ ID NO: 1284986 - RNA, 18 nt, Mycobacterium tuberculosis H37Rv
ucggaucgauuccgccgc

SEQ ID NO: 1284987 - RNA, 19 nt, Mycobacterium tuberculosis H37Rv
ucggaugcaacccggugau

SEQ ID NO: 1284988 - RNA, 18 nt, Mycobacterium tuberculosis H37Rv
ucggaauacaacagcugg

SEQ ID NO: 1284989 - RNA, 21 nt, Mycobacterium tuberculosis H37Rv
ucggaucaucgggaugcggac

SEQ ID NO: 1284990 - RNA, 23 nt, Mycobacterium tuberculosis H37Rv
ucggaaaaccgcaccgucccagu

SEQ ID NO: 1284991 - RNA, 13 nt, Mycobacterium tuberculosis H37Rv
ucgcuugcgcacg

SEQ ID NO: 1284992 - RNA, 15 nt, Mycobacterium tuberculosis H37Rv
ucgcgugccacagca

SEQ ID NO: 1284993 - RNA, 22 nt, Mycobacterium tuberculosis H37Rv
ucgcgucugacaucgucgacga

SEQ ID NO: 1284994 - RNA, 14 nt, Mycobacterium tuberculosis H37Rv
ucgcgucugcucgc

SEQ ID NO: 1284995 - RNA, 16 nt, Mycobacterium tuberculosis H37Rv
ucgcgucgccgaugaa

SEQ ID NO: 1284996 - RNA, 14 nt, Mycobacterium tuberculosis H37Rv
ucgcgucgccgaug

SEQ ID NO: 1284997 - RNA, 16 nt, Mycobacterium tuberculosis H37Rv
ucgcguccaugcgggu

SEQ ID NO: 1284998 - RNA, 17 nt, Mycobacterium tuberculosis H37Rv
ucgcguccgcgaucugc

SEQ ID NO: 1284999 - RNA, 15 nt, Mycobacterium tuberculosis H37Rv
ucgcgucaucaacgu

SEQ ID NO: 1285000 - RNA, 19 nt, Mycobacterium tuberculosis H37Rv
ucgcguagcuggccagguu

SEQ ID NO: 1285001 - RNA, 16 nt, Mycobacterium tuberculosis H37Rv
ucgcggucgccaccgu

SEQ ID NO: 1285002 - RNA, 12 nt, Mycobacterium tuberculosis H37Rv
ucgcugaccgcg

SEQ ID NO: 1285003 - RNA, 22 nt, Mycobacterium tuberculosis H37Rv
ucgcugguauagcucacggugg

SEQ ID NO: 1285004 - RNA, 16 nt, Mycobacterium tuberculosis H37Rv
ucgcuggucgauggcc

SEQ ID NO: 1285005 - RNA, 14 nt, Mycobacterium tuberculosis H37Rv
ucgcucugcgcggc

SEQ ID NO: 1285006 - RNA, 17 nt, Mycobacterium tuberculosis H37Rv
ucgcucugugucgccga

SEQ ID NO: 1285007 - RNA, 13 nt, Mycobacterium tuberculosis H37Rv
ucgcucucgguca

SEQ ID NO: 1285008 - RNA, 14 nt, Mycobacterium tuberculosis H37Rv
ucgcguucugcacc

SEQ ID NO: 1285009 - RNA, 20 nt, Mycobacterium tuberculosis H37Rv
ucgcucccccgcuacgcgcg

SEQ ID NO: 1285010 - RNA, 19 nt, Mycobacterium tuberculosis H37Rv
ucgcguugcagaccaccag

SEQ ID NO: 1285011 - RNA, 12 nt, Mycobacterium tuberculosis H37Rv
ucggucaccgaa

SEQ ID NO: 1285012 - RNA, 21 nt, Mycobacterium tuberculosis H37Rv
ucggucaaccccggaccgcgg

SEQ ID NO: 1285013 - RNA, 12 nt, Mycobacterium tuberculosis H37Rv
ucggucaacucg

SEQ ID NO: 1285014 - RNA, 18 nt, Mycobacterium tuberculosis H37Rv
ucggucaaugcgcgcugg

SEQ ID NO: 1285015 - RNA, 12 nt, Mycobacterium tuberculosis H37Rv
ucggucaccgac

SEQ ID NO: 1285016 - RNA, 19 nt, Mycobacterium tuberculosis H37Rv
ucgggucccuuguggucug

SEQ ID NO: 1285017 - RNA, 22 nt, Mycobacterium tuberculosis H37Rv
ucggguauugaaguucgggcaa

SEQ ID NO: 1285018 - RNA, 21 nt, Mycobacterium tuberculosis H37Rv
ucgggucaccgugcggaucgc

SEQ ID NO: 1285019 - RNA, 16 nt, Mycobacterium tuberculosis H37Rv
ucggcguccaggcagc

SEQ ID NO: 1285020 - RNA, 13 nt, Mycobacterium tuberculosis H37Rv
ucggguccaacgc

SEQ ID NO: 1285021 - RNA, 18 nt, Mycobacterium tuberculosis H37Rv
ucgggguucuuccacagc

SEQ ID NO: 1285022 - RNA, 12 nt, Mycobacterium tuberculosis H37Rv
ucggcuccacgc

SEQ ID NO: 1285023 - RNA, 16 nt, Mycobacterium tuberculosis H37Rv
ucgggguggugguauc

SEQ ID NO: 1285024 - RNA, 18 nt, Mycobacterium tuberculosis H37Rv
ucggcuagugugaccguc

SEQ ID NO: 1285025 - RNA, 17 nt, Mycobacterium tuberculosis H37Rv
ucggcuaucgcuagccg

SEQ ID NO: 1285026 - RNA, 19 nt, Mycobacterium tuberculosis H37Rv
ucggcuauggguucgcggu

SEQ ID NO: 1285027 - RNA, 22 nt, Mycobacterium tuberculosis H37Rv
ucggcucagcaacgucacgucg

SEQ ID NO: 1285028 - RNA, 21 nt, Mycobacterium tuberculosis H37Rv
ucggcucagcaacgucacguc

SEQ ID NO: 1285029 - RNA, 17 nt, Mycobacterium tuberculosis H37Rv
ucggcucaccgaacgcg

SEQ ID NO: 1285030 - RNA, 17 nt, Mycobacterium tuberculosis H37Rv
ucggcgugucgcgucgc

SEQ ID NO: 1285031 - RNA, 16 nt, Mycobacterium tuberculosis H37Rv
ucggcguguccgccga

SEQ ID NO: 1285032 - RNA, 14 nt, Mycobacterium tuberculosis H37Rv
ucggcgucgcggau

SEQ ID NO: 1285033 - RNA, 22 nt, Mycobacterium tuberculosis H37Rv
ucggcguugaucgacaucacca

SEQ ID NO: 1285034 - RNA, 17 nt, Mycobacterium tuberculosis H37Rv
ucggcguuaucgaaggc

SEQ ID NO: 1285035 - RNA, 16 nt, Mycobacterium tuberculosis H37Rv
ucggcgugucucgucg

SEQ ID NO: 1285036 - RNA, 13 nt, Mycobacterium tuberculosis H37Rv
ucggucucgaucc

SEQ ID NO: 1285037 - RNA, 17 nt, Mycobacterium tuberculosis H37Rv
ucggugaaggucaccgu

SEQ ID NO: 1285038 - RNA, 14 nt, Mycobacterium tuberculosis H37Rv
ucggugacgaaaca

SEQ ID NO: 1285039 - RNA, 14 nt, Mycobacterium tuberculosis H37Rv
ucggugaucaccgc

SEQ ID NO: 1285040 - RNA, 18 nt, Mycobacterium tuberculosis H37Rv
ucggugaggucgaugccg

SEQ ID NO: 1285041 - RNA, 17 nt, Mycobacterium tuberculosis H37Rv
ucggugaggucgaugcc

SEQ ID NO: 1285042 - RNA, 14 nt, Mycobacterium tuberculosis H37Rv
ucggugacgucgcc

SEQ ID NO: 1285043 - RNA, 16 nt, Mycobacterium tuberculosis H37Rv
ucggugagcgcgucgc

SEQ ID NO: 1285044 - RNA, 19 nt, Mycobacterium tuberculosis H37Rv
ucggugccgugaucggcgc

SEQ ID NO: 1285045 - RNA, 18 nt, Mycobacterium tuberculosis H37Rv
ucggugcacaacgcccac

SEQ ID NO: 1285046 - RNA, 12 nt, Mycobacterium tuberculosis H37Rv
ucggugguacgu

SEQ ID NO: 1285047 - RNA, 15 nt, Mycobacterium tuberculosis H37Rv
ucgguggcggcagca

SEQ ID NO: 1285048 - RNA, 16 nt, Mycobacterium tuberculosis H37Rv
ucgucgagguccucga

SEQ ID NO: 1285049 - RNA, 15 nt, Mycobacterium tuberculosis H37Rv
ucgucgagcugaucc

SEQ ID NO: 1285050 - RNA, 16 nt, Mycobacterium tuberculosis H37Rv
ucgucgagcugaccac

SEQ ID NO: 1285051 - RNA, 19 nt, Mycobacterium tuberculosis H37Rv
ucgucgccccguucacgcu

SEQ ID NO: 1285052 - RNA, 16 nt, Mycobacterium tuberculosis H37Rv
ucgucgaugaagcguc

SEQ ID NO: 1285053 - RNA, 21 nt, Mycobacterium tuberculosis H37Rv
ucgucgcugccgccaccgcug

SEQ ID NO: 1285054 - RNA, 20 nt, Mycobacterium tuberculosis H37Rv
ucgucgcugagcagcgccgc

SEQ ID NO: 1285055 - RNA, 16 nt, Mycobacterium tuberculosis H37Rv
ucgucggccaccgcgg

SEQ ID NO: 1285056 - RNA, 22 nt, Mycobacterium tuberculosis H37Rv
ucgucggccagcagaucagguc

SEQ ID NO: 1285057 - RNA, 18 nt, Mycobacterium tuberculosis H37Rv
ucgucgggucacccagau

SEQ ID NO: 1285058 - RNA, 22 nt, Mycobacterium tuberculosis H37Rv
ucgucggguagggcaucgucgc

SEQ ID NO: 1285059 - RNA, 15 nt, Mycobacterium tuberculosis H37Rv
ucgucgcugagcagc

SEQ ID NO: 1285060 - RNA, 19 nt, Mycobacterium tuberculosis H37Rv
ucgucgcgggccaccgcug

SEQ ID NO: 1285061 - RNA, 22 nt, Mycobacterium tuberculosis H37Rv
ucgucgccgcgguagacgccgc

SEQ ID NO: 1285062 - RNA, 13 nt, Mycobacterium tuberculosis H37Rv
ucgucgccgaccg

SEQ ID NO: 1285063 - RNA, 19 nt, Mycobacterium tuberculosis H37Rv
ucgguuugggaauccgcau

SEQ ID NO: 1285064 - RNA, 14 nt, Mycobacterium tuberculosis H37Rv
ucggugucgccacc

SEQ ID NO: 1285065 - RNA, 19 nt, Mycobacterium tuberculosis H37Rv
ucguccaggucggccgccu

SEQ ID NO: 1285066 - RNA, 23 nt, Mycobacterium tuberculosis H37Rv
ucgucgagagguucgccgucggu

SEQ ID NO: 1285067 - RNA, 20 nt, Mycobacterium tuberculosis H37Rv
ucguccgccgcagcgcaacc

SEQ ID NO: 1285068 - RNA, 15 nt, Mycobacterium tuberculosis H37Rv
ucguccgccugcacc

SEQ ID NO: 1285069 - RNA, 17 nt, Mycobacterium tuberculosis H37Rv
ucguccccagaccggcg

SEQ ID NO: 1285070 - RNA, 18 nt, Mycobacterium tuberculosis H37Rv
ucguccaucagcaacacg

SEQ ID NO: 1285071 - RNA, 14 nt, Mycobacterium tuberculosis H37Rv
ucucgcugaccuuu

SEQ ID NO: 1285072 - RNA, 16 nt, Mycobacterium tuberculosis H37Rv
ucucggcgagcaccgu

SEQ ID NO: 1285073 - RNA, 16 nt, Mycobacterium tuberculosis H37Rv
ucucggcgaacgcgaa

SEQ ID NO: 1285074 - RNA, 22 nt, Mycobacterium tuberculosis H37Rv
ucucgccuucggggugcacgcg

SEQ ID NO: 1285075 - RNA, 13 nt, Mycobacterium tuberculosis H37Rv
ucucgcggacgga

SEQ ID NO: 1285076 - RNA, 16 nt, Mycobacterium tuberculosis H37Rv
ucucgcggaccucggc

SEQ ID NO: 1285077 - RNA, 19 nt, Mycobacterium tuberculosis H37Rv
ucucgcccccagugcacgc

SEQ ID NO: 1285078 - RNA, 21 nt, Mycobacterium tuberculosis H37Rv
ucucguuugcuuucagcagga

SEQ ID NO: 1285079 - RNA, 22 nt, Mycobacterium tuberculosis H37Rv
ucucguggauggccgccaggcg

SEQ ID NO: 1285080 - RNA, 23 nt, Mycobacterium tuberculosis H37Rv
ucucgucgccccguucacgcucg

SEQ ID NO: 1285081 - RNA, 12 nt, Mycobacterium tuberculosis H37Rv
ucucgucgucga

SEQ ID NO: 1285082 - RNA, 19 nt, Mycobacterium tuberculosis H37Rv
ucucguagcgcucagcuga

SEQ ID NO: 1285083 - RNA, 14 nt, Mycobacterium tuberculosis H37Rv
ucucggucugcaug

SEQ ID NO: 1285084 - RNA, 18 nt, Mycobacterium tuberculosis H37Rv
ucucgggcgggucggcgg

SEQ ID NO: 1285085 - RNA, 14 nt, Mycobacterium tuberculosis H37Rv
ucucccuugccgcc

SEQ ID NO: 1285086 - RNA, 15 nt, Mycobacterium tuberculosis H37Rv
ucuccggcaacagca

SEQ ID NO: 1285087 - RNA, 16 nt, Mycobacterium tuberculosis H37Rv
ucuccgccgucgccac

SEQ ID NO: 1285088 - RNA, 21 nt, Mycobacterium tuberculosis H37Rv
ucucgaccucagacagcugca

SEQ ID NO: 1285089 - RNA, 23 nt, Mycobacterium tuberculosis H37Rv
ucucgcagcauguccgcagcggu

SEQ ID NO: 1285090 - RNA, 15 nt, Mycobacterium tuberculosis H37Rv
ucgucgucaccgaug

SEQ ID NO: 1285091 - RNA, 19 nt, Mycobacterium tuberculosis H37Rv
ucgucgguugccacgccgc

SEQ ID NO: 1285092 - RNA, 10 nt, Mycobacterium tuberculosis H37Rv
ucgucgucga

SEQ ID NO: 1285093 - RNA, 12 nt, Mycobacterium tuberculosis H37Rv
ucgucgucgaca

SEQ ID NO: 1285094 - RNA, 13 nt, Mycobacterium tuberculosis H37Rv
ucgucgucgacgg

SEQ ID NO: 1285095 - RNA, 19 nt, Mycobacterium tuberculosis H37Rv
ucguggugcaacacgccgg

SEQ ID NO: 1285096 - RNA, 17 nt, Mycobacterium tuberculosis H37Rv
ucguucauguccaccgc

SEQ ID NO: 1285097 - RNA, 15 nt, Mycobacterium tuberculosis H37Rv
ucuaccuuagcgccg

SEQ ID NO: 1285098 - RNA, 19 nt, Mycobacterium tuberculosis H37Rv
ucuacgucguccagcacca

SEQ ID NO: 1285099 - RNA, 14 nt, Mycobacterium tuberculosis H37Rv
ucuacgccaccgag

SEQ ID NO: 1285100 - RNA, 15 nt, Mycobacterium tuberculosis H37Rv
ucguugccggugccg

SEQ ID NO: 1285101 - RNA, 20 nt, Mycobacterium tuberculosis H37Rv
ucuaaugaggucaacgccac

SEQ ID NO: 1285102 - RNA, 13 nt, Mycobacterium tuberculosis H37Rv
ucguugccgaccg

SEQ ID NO: 1285103 - RNA, 16 nt, Mycobacterium tuberculosis H37Rv
ucguugccguagcuga

SEQ ID NO: 1285104 - RNA, 20 nt, Mycobacterium tuberculosis H37Rv
ucguugccggacaaccuggg

SEQ ID NO: 1285105 - RNA, 16 nt, Mycobacterium tuberculosis H37Rv
ucguugaggccgguga

SEQ ID NO: 1285106 - RNA, 20 nt, Mycobacterium tuberculosis H37Rv
ucguugagaagcgucacagu

SEQ ID NO: 1285107 - RNA, 14 nt, Mycobacterium tuberculosis H37Rv
ucugcguccaccgg

SEQ ID NO: 1285108 - RNA, 14 nt, Mycobacterium tuberculosis H37Rv
ucugcguccaccac

SEQ ID NO: 1285109 - RNA, 17 nt, Mycobacterium tuberculosis H37Rv
ucugcgucugcucggcg

SEQ ID NO: 1285110 - RNA, 20 nt, Mycobacterium tuberculosis H37Rv
ucugcgcagguggucgauca

SEQ ID NO: 1285111 - RNA, 14 nt, Mycobacterium tuberculosis H37Rv
ucugcgccacagca

SEQ ID NO: 1285112 - RNA, 18 nt, Mycobacterium tuberculosis H37Rv
ucugcgccacgucgacgg

SEQ ID NO: 1285113 - RNA, 18 nt, Mycobacterium tuberculosis H37Rv
ucugcagcgucuccuuga

SEQ ID NO: 1285114 - RNA, 22 nt, Mycobacterium tuberculosis H37Rv
ucugauccagccgcgucgucgg

SEQ ID NO: 1285115 - RNA, 18 nt, Mycobacterium tuberculosis H37Rv
ucugcacauucagcgccg

SEQ ID NO: 1285116 - RNA, 13 nt, Mycobacterium tuberculosis H37Rv
ucugaagcccgac

SEQ ID NO: 1285117 - RNA, 22 nt, Mycobacterium tuberculosis H37Rv
ucugaacugacguuaccgccgc

SEQ ID NO: 1285118 - RNA, 14 nt, Mycobacterium tuberculosis H37Rv
ucugaagguguccg

SEQ ID NO: 1285119 - RNA, 17 nt, Mycobacterium tuberculosis H37Rv
ucugacgacgcgacacg

SEQ ID NO: 1285120 - RNA, 14 nt, Mycobacterium tuberculosis H37Rv
ucuggccgaagccc

SEQ ID NO: 1285121 - RNA, 19 nt, Mycobacterium tuberculosis H37Rv
ucuggcuccgauucuucga

SEQ ID NO: 1285122 - RNA, 19 nt, Mycobacterium tuberculosis H37Rv
ucuggcguagugcucgccg

SEQ ID NO: 1285123 - RNA, 18 nt, Mycobacterium tuberculosis H37Rv
ucuggcgaugacgaucgc

SEQ ID NO: 1285124 - RNA, 17 nt, Mycobacterium tuberculosis H37Rv
ucugcucgcgcaaggcg

SEQ ID NO: 1285125 - RNA, 19 nt, Mycobacterium tuberculosis H37Rv
ucugcugagcugcucgccg

SEQ ID NO: 1285126 - RNA, 20 nt, Mycobacterium tuberculosis H37Rv
ucuggacggucauccggccg

SEQ ID NO: 1285127 - RNA, 18 nt, Mycobacterium tuberculosis H37Rv
ucugcucggcgcuagcug

SEQ ID NO: 1285128 - RNA, 14 nt, Mycobacterium tuberculosis H37Rv
ucugcuucaguggc

SEQ ID NO: 1285129 - RNA, 22 nt, Mycobacterium tuberculosis H37Rv
ucugggcuuucgcgugcggcug

SEQ ID NO: 1285130 - RNA, 20 nt, Mycobacterium tuberculosis H37Rv
ucugguugucgaucucggcc

SEQ ID NO: 1285131 - RNA, 14 nt, Mycobacterium tuberculosis H37Rv
ucugugcugcgcug

SEQ ID NO: 1285132 - RNA, 20 nt, Mycobacterium tuberculosis H37Rv
ucugugggugguugugucgg

SEQ ID NO: 1285133 - RNA, 18 nt, Mycobacterium tuberculosis H37Rv
ucuugccgcgccggauga

SEQ ID NO: 1285134 - RNA, 19 nt, Mycobacterium tuberculosis H37Rv
ucuucgcagcgguggucgg

SEQ ID NO: 1285135 - RNA, 15 nt, Mycobacterium tuberculosis H37Rv
ucuuggcacacaggu

SEQ ID NO: 1285136 - RNA, 14 nt, Mycobacterium tuberculosis H37Rv
ucuugcugcacgcu

SEQ ID NO: 1285137 - RNA, 19 nt, Mycobacterium tuberculosis H37Rv
ucuugcugucgaaguggua

SEQ ID NO: 1285138 - RNA, 23 nt, Mycobacterium tuberculosis H37Rv
ugaacgccagcagcgcgaucugc

SEQ ID NO: 1285139 - RNA, 22 nt, Mycobacterium tuberculosis H37Rv
ugaacgcgaauaccagaccggc

SEQ ID NO: 1285140 - RNA, 16 nt, Mycobacterium tuberculosis H37Rv
ugaacgcggacaccgc

SEQ ID NO: 1285141 - RNA, 19 nt, Mycobacterium tuberculosis H37Rv
ugaacaccucauacgccaa

SEQ ID NO: 1285142 - RNA, 13 nt, Mycobacterium tuberculosis H37Rv
ugauggccgacgu

SEQ ID NO: 1285143 - RNA, 21 nt, Mycobacterium tuberculosis H37Rv
ugaugccggcgccggcccgca

SEQ ID NO: 1285144 - RNA, 15 nt, Mycobacterium tuberculosis H37Rv
ugaugguaccgccac

SEQ ID NO: 1285145 - RNA, 18 nt, Mycobacterium tuberculosis H37Rv
ugauggcgcugcaccgua

SEQ ID NO: 1285146 - RNA, 18 nt, Mycobacterium tuberculosis H37Rv
ugaugguguccucgucga

SEQ ID NO: 1285147 - RNA, 14 nt, Mycobacterium tuberculosis H37Rv
ugaugguccgccag

SEQ ID NO: 1285148 - RNA, 21 nt, Mycobacterium tuberculosis H37Rv
ugaugaccaggucggucaggu

SEQ ID NO: 1285149 - RNA, 13 nt, Mycobacterium tuberculosis H37Rv
ugaugaucggaaa

SEQ ID NO: 1285150 - RNA, 19 nt, Mycobacterium tuberculosis H37Rv
ugaucaccgaugagccgac

SEQ ID NO: 1285151 - RNA, 21 nt, Mycobacterium tuberculosis H37Rv
ugaucaccgggcccgacgcgu

SEQ ID NO: 1285152 - RNA, 13 nt, Mycobacterium tuberculosis H37Rv
ugcacggucaacg

SEQ ID NO: 1285153 - RNA, 22 nt, Mycobacterium tuberculosis H37Rv
ugcacggcuuuucgacgcugug

SEQ ID NO: 1285154 - RNA, 21 nt, Mycobacterium tuberculosis H37Rv
ugcacggucaacgaucccggg

SEQ ID NO: 1285155 - RNA, 16 nt, Mycobacterium tuberculosis H37Rv
ugcacggcgcugacga

SEQ ID NO: 1285156 - RNA, 22 nt, Mycobacterium tuberculosis H37Rv
ugcacccaccccgaagaugccu

SEQ ID NO: 1285157 - RNA, 16 nt, Mycobacterium tuberculosis H37Rv
ugcacgcgcucgcgca

SEQ ID NO: 1285158 - RNA, 21 nt, Mycobacterium tuberculosis H37Rv
ugcacggccaugaucacaccg

SEQ ID NO: 1285159 - RNA, 23 nt, Mycobacterium tuberculosis H37Rv
ugcacggccgucauuuccacauc

SEQ ID NO: 1285160 - RNA, 22 nt, Mycobacterium tuberculosis H37Rv
ugcacgcugagccggucgcgca

SEQ ID NO: 1285161 - RNA, 18 nt, Mycobacterium tuberculosis H37Rv
ugcagaccuguccggcau

SEQ ID NO: 1285162 - RNA, 16 nt, Mycobacterium tuberculosis H37Rv
ugcagaccaucuugcc

SEQ ID NO: 1285163 - RNA, 15 nt, Mycobacterium tuberculosis H37Rv
ugcagaaaggccaac

SEQ ID NO: 1285164 - RNA, 18 nt, Mycobacterium tuberculosis H37Rv
ugcacgugacccuggggu

SEQ ID NO: 1285165 - RNA, 12 nt, Mycobacterium tuberculosis H37Rv
ugcaaccgccgg

SEQ ID NO: 1285166 - RNA, 11 nt, Mycobacterium tuberculosis H37Rv
ugcaacucggc

SEQ ID NO: 1285167 - RNA, 19 nt, Mycobacterium tuberculosis H37Rv
ugauuguguuccaccagcg

SEQ ID NO: 1285168 - RNA, 12 nt, Mycobacterium tuberculosis H37Rv
ugauugcgcggg

SEQ ID NO: 1285169 - RNA, 16 nt, Mycobacterium tuberculosis H37Rv
ugcaacaccgcaccgg

SEQ ID NO: 1285170 - RNA, 12 nt, Mycobacterium tuberculosis H37Rv
ugcaacaccgca

SEQ ID NO: 1285171 - RNA, 14 nt, Mycobacterium tuberculosis H37Rv
ugagacgccgucga

SEQ ID NO: 1285172 - RNA, 17 nt, Mycobacterium tuberculosis H37Rv
ugagaccagguucucgg

SEQ ID NO: 1285173 - RNA, 21 nt, Mycobacterium tuberculosis H37Rv
ugagcaaaauggccaccggcg

SEQ ID NO: 1285174 - RNA, 15 nt, Mycobacterium tuberculosis H37Rv
ugagcaccagcagca

SEQ ID NO: 1285175 - RNA, 18 nt, Mycobacterium tuberculosis H37Rv
ugagcaccagcagcacca

SEQ ID NO: 1285176 - RNA, 21 nt, Mycobacterium tuberculosis H37Rv
ugagcaaugacccgcggguga

SEQ ID NO: 1285177 - RNA, 20 nt, Mycobacterium tuberculosis H37Rv
ugagccgccccggcauacuc

SEQ ID NO: 1285178 - RNA, 21 nt, Mycobacterium tuberculosis H37Rv
ugagccgcgaaaucaccgcug

SEQ ID NO: 1285179 - RNA, 19 nt, Mycobacterium tuberculosis H37Rv
ugagcccguugaccugcgc

SEQ ID NO: 1285180 - RNA, 19 nt, Mycobacterium tuberculosis H37Rv
ugacguuguuggauccggc

SEQ ID NO: 1285181 - RNA, 22 nt, Mycobacterium tuberculosis H37Rv
ugacguuguuggauccggccac

SEQ ID NO: 1285182 - RNA, 16 nt, Mycobacterium tuberculosis H37Rv
ugacgucgucggccaa

SEQ ID NO: 1285183 - RNA, 16 nt, Mycobacterium tuberculosis H37Rv
ugacgucgucggugcg

SEQ ID NO: 1285184 - RNA, 17 nt, Mycobacterium tuberculosis H37Rv
ugacgugcucucgcucg

SEQ ID NO: 1285185 - RNA, 22 nt, Mycobacterium tuberculosis H37Rv
ugaagcaguugccgcggucgua

SEQ ID NO: 1285186 - RNA, 18 nt, Mycobacterium tuberculosis H37Rv
ugaacgcuuuccggcggu

SEQ ID NO: 1285187 - RNA, 21 nt, Mycobacterium tuberculosis H37Rv
ugaacggcgcgggccaccacg

SEQ ID NO: 1285188 - RNA, 18 nt, Mycobacterium tuberculosis H37Rv
ugagcgaacccgcguuga

SEQ ID NO: 1285189 - RNA, 21 nt, Mycobacterium tuberculosis H37Rv
ugagccgcucaucgaucccgu

SEQ ID NO: 1285190 - RNA, 11 nt, Mycobacterium tuberculosis H37Rv
ugaggaagccc

SEQ ID NO: 1285191 - RNA, 14 nt, Mycobacterium tuberculosis H37Rv
ugaggacauccggc

SEQ ID NO: 1285192 - RNA, 20 nt, Mycobacterium tuberculosis H37Rv
ugaggaacgccggcaucgcg

SEQ ID NO: 1285193 - RNA, 13 nt, Mycobacterium tuberculosis H37Rv
ugaggccggugaa

SEQ ID NO: 1285194 - RNA, 21 nt, Mycobacterium tuberculosis H37Rv
ugaggccggugaacgguagca

SEQ ID NO: 1285195 - RNA, 13 nt, Mycobacterium tuberculosis H37Rv
ugaggccgucgaa

SEQ ID NO: 1285196 - RNA, 16 nt, Mycobacterium tuberculosis H37Rv
ugaggauggcugcggg

SEQ ID NO: 1285197 - RNA, 16 nt, Mycobacterium tuberculosis H37Rv
ugagugaccacgcugc

SEQ ID NO: 1285198 - RNA, 14 nt, Mycobacterium tuberculosis H37Rv
ugagugcggcguau

SEQ ID NO: 1285199 - RNA, 23 nt, Mycobacterium tuberculosis H37Rv
ugaguccagccggcgcgccggau

SEQ ID NO: 1285200 - RNA, 16 nt, Mycobacterium tuberculosis H37Rv
ugagguucaucgccgg

SEQ ID NO: 1285201 - RNA, 17 nt, Mycobacterium tuberculosis H37Rv
ugagguuggagcgccag

SEQ ID NO: 1285202 - RNA, 15 nt, Mycobacterium tuberculosis H37Rv
ugaggcgcagcgcca

SEQ ID NO: 1285203 - RNA, 22 nt, Mycobacterium tuberculosis H37Rv
ugaucaaacuaccgaacagugg

SEQ ID NO: 1285204 - RNA, 21 nt, Mycobacterium tuberculosis H37Rv
ugauagcggucggucaccaug

SEQ ID NO: 1285205 - RNA, 20 nt, Mycobacterium tuberculosis H37Rv
ugccagugauggcgcggucg

SEQ ID NO: 1285206 - RNA, 14 nt, Mycobacterium tuberculosis H37Rv
ugccagucgaucgc

SEQ ID NO: 1285207 - RNA, 15 nt, Mycobacterium tuberculosis H37Rv
ugccagugcugcacc

SEQ ID NO: 1285208 - RNA, 21 nt, Mycobacterium tuberculosis H37Rv
ugccagggucgaugucgucga

SEQ ID NO: 1285209 - RNA, 13 nt, Mycobacterium tuberculosis H37Rv
ugccaggucggcg

SEQ ID NO: 1285210 - RNA, 23 nt, Mycobacterium tuberculosis H37Rv
ugccaggucggcgggcgcgggug

SEQ ID NO: 1285211 - RNA, 14 nt, Mycobacterium tuberculosis H37Rv
ugccagaccagggc

SEQ ID NO: 1285212 - RNA, 15 nt, Mycobacterium tuberculosis H37Rv
ugccagaacccggac

SEQ ID NO: 1285213 - RNA, 23 nt, Mycobacterium tuberculosis H37Rv
ugccacggugacccugguggugc

SEQ ID NO: 1285214 - RNA, 14 nt, Mycobacterium tuberculosis H37Rv
ugccaggaccgcgc

SEQ ID NO: 1285215 - RNA, 16 nt, Mycobacterium tuberculosis H37Rv
ugcauggcuugcucug

SEQ ID NO: 1285216 - RNA, 22 nt, Mycobacterium tuberculosis H37Rv
ugccaaaagggcggcagcgagg

SEQ ID NO: 1285217 - RNA, 22 nt, Mycobacterium tuberculosis H37Rv
ugccacacaggcguccaucgcc

SEQ ID NO: 1285218 - RNA, 23 nt, Mycobacterium tuberculosis H37Rv
ugccacacaggcguccaucgcca

SEQ ID NO: 1285219 - RNA, 18 nt, Mycobacterium tuberculosis H37Rv
ugccacagcgacagcgug

SEQ ID NO: 1285220 - RNA, 15 nt, Mycobacterium tuberculosis H37Rv
ugccacaacccgcuu

SEQ ID NO: 1285221 - RNA, 21 nt, Mycobacterium tuberculosis H37Rv
ugccacggugacccugguggu

SEQ ID NO: 1285222 - RNA, 20 nt, Mycobacterium tuberculosis H37Rv
ugcaggaucggcuugggaaa

SEQ ID NO: 1285223 - RNA, 17 nt, Mycobacterium tuberculosis H37Rv
ugcagcuccccgccgga

SEQ ID NO: 1285224 - RNA, 15 nt, Mycobacterium tuberculosis H37Rv
ugcagcucgauccgc

SEQ ID NO: 1285225 - RNA, 17 nt, Mycobacterium tuberculosis H37Rv
ugcaggcgcagcugggu

SEQ ID NO: 1285226 - RNA, 12 nt, Mycobacterium tuberculosis H37Rv
ugcaggauucgg

SEQ ID NO: 1285227 - RNA, 16 nt, Mycobacterium tuberculosis H37Rv
ugcagcagcauccggc

SEQ ID NO: 1285228 - RNA, 14 nt, Mycobacterium tuberculosis H37Rv
ugccaucuccggug

SEQ ID NO: 1285229 - RNA, 16 nt, Mycobacterium tuberculosis H37Rv
ugccaucgggcgcggu

SEQ ID NO: 1285230 - RNA, 14 nt, Mycobacterium tuberculosis H37Rv
ugcccgacggcguc

SEQ ID NO: 1285231 - RNA, 16 nt, Mycobacterium tuberculosis H37Rv
ugcccgcaccacaccg

SEQ ID NO: 1285232 - RNA, 19 nt, Mycobacterium tuberculosis H37Rv
ugcccgcaccguagccgcu

SEQ ID NO: 1285233 - RNA, 12 nt, Mycobacterium tuberculosis H37Rv
ugcccgcacgcu

SEQ ID NO: 1285234 - RNA, 16 nt, Mycobacterium tuberculosis H37Rv
ugcccgcauugccaac

SEQ ID NO: 1285235 - RNA, 17 nt, Mycobacterium tuberculosis H37Rv
ugcccgccacgcucggu

SEQ ID NO: 1285236 - RNA, 17 nt, Mycobacterium tuberculosis H37Rv
ugcccgcccagcccggc

SEQ ID NO: 1285237 - RNA, 19 nt, Mycobacterium tuberculosis H37Rv
ugcccugcauaggcgcggu

SEQ ID NO: 1285238 - RNA, 17 nt, Mycobacterium tuberculosis H37Rv
ugcccugauugaagccc

SEQ ID NO: 1285239 - RNA, 15 nt, Mycobacterium tuberculosis H37Rv
ugcccuggcccaucu

SEQ ID NO: 1285240 - RNA, 15 nt, Mycobacterium tuberculosis H37Rv
ugccgaaaaucgcag

SEQ ID NO: 1285241 - RNA, 17 nt, Mycobacterium tuberculosis H37Rv
ugccgaaaaucgcagcc

SEQ ID NO: 1285242 - RNA, 19 nt, Mycobacterium tuberculosis H37Rv
ugcccguauaaccggccau

SEQ ID NO: 1285243 - RNA, 20 nt, Mycobacterium tuberculosis H37Rv
ugcccgggucggccggguug

SEQ ID NO: 1285244 - RNA, 21 nt, Mycobacterium tuberculosis H37Rv
ugcccgggcgggagucgucga

SEQ ID NO: 1285245 - RNA, 17 nt, Mycobacterium tuberculosis H37Rv
ugcccgggcggucgaag

SEQ ID NO: 1285246 - RNA, 20 nt, Mycobacterium tuberculosis H37Rv
ugcccgggcggucgaagacc

SEQ ID NO: 1285247 - RNA, 14 nt, Mycobacterium tuberculosis H37Rv
ugcccgcguugcca

SEQ ID NO: 1285248 - RNA, 20 nt, Mycobacterium tuberculosis H37Rv
ugcccgccucgcagcgacac

SEQ ID NO: 1285249 - RNA, 22 nt, Mycobacterium tuberculosis H37Rv
ugcccgccucgcagcgacacgu

SEQ ID NO: 1285250 - RNA, 16 nt, Mycobacterium tuberculosis H37Rv
ugccgccgagcuggcg

SEQ ID NO: 1285251 - RNA, 19 nt, Mycobacterium tuberculosis H37Rv
ugccgccauuggcaggcau

SEQ ID NO: 1285252 - RNA, 12 nt, Mycobacterium tuberculosis H37Rv
ugccgccgacgc

SEQ ID NO: 1285253 - RNA, 14 nt, Mycobacterium tuberculosis H37Rv
ugccgccaucgccg

SEQ ID NO: 1285254 - RNA, 14 nt, Mycobacterium tuberculosis H37Rv
ugccgccauuggca

SEQ ID NO: 1285255 - RNA, 20 nt, Mycobacterium tuberculosis H37Rv
ugccgccauggccgccguug

SEQ ID NO: 1285256 - RNA, 20 nt, Mycobacterium tuberculosis H37Rv
ugccgccgccggcggucgcg

SEQ ID NO: 1285257 - RNA, 16 nt, Mycobacterium tuberculosis H37Rv
ugccgccggcaccgcc

SEQ ID NO: 1285258 - RNA, 11 nt, Mycobacterium tuberculosis H37Rv
ugccgccggag

SEQ ID NO: 1285259 - RNA, 20 nt, Mycobacterium tuberculosis H37Rv
ugccgccgcggccaccaccg

SEQ ID NO: 1285260 - RNA, 20 nt, Mycobacterium tuberculosis H37Rv
ugccgccuccggugcauauu

SEQ ID NO: 1285261 - RNA, 21 nt, Mycobacterium tuberculosis H37Rv
ugccgccuccgccugccccac

SEQ ID NO: 1285262 - RNA, 19 nt, Mycobacterium tuberculosis H37Rv
ugccgccuccgccugcccc

SEQ ID NO: 1285263 - RNA, 15 nt, Mycobacterium tuberculosis H37Rv
ugccgcgaucgugca

SEQ ID NO: 1285264 - RNA, 21 nt, Mycobacterium tuberculosis H37Rv
ugccgcgcaccaacaccagcg

SEQ ID NO: 1285265 - RNA, 14 nt, Mycobacterium tuberculosis H37Rv
ugccgcgccgacgc

SEQ ID NO: 1285266 - RNA, 14 nt, Mycobacterium tuberculosis H37Rv
ugccgccaccaccg

SEQ ID NO: 1285267 - RNA, 16 nt, Mycobacterium tuberculosis H37Rv
ugccgccaccgccacc

SEQ ID NO: 1285268 - RNA, 13 nt, Mycobacterium tuberculosis H37Rv
ugccgccaaccgc

SEQ ID NO: 1285269 - RNA, 12 nt, Mycobacterium tuberculosis H37Rv
ugccgaugccgg

SEQ ID NO: 1285270 - RNA, 18 nt, Mycobacterium tuberculosis H37Rv
ugccgaugcgacgcagac

SEQ ID NO: 1285271 - RNA, 23 nt, Mycobacterium tuberculosis H37Rv
ugccgaucugcucgccgagcucg

SEQ ID NO: 1285272 - RNA, 13 nt, Mycobacterium tuberculosis H37Rv
ugccgaucccggc

SEQ ID NO: 1285273 - RNA, 23 nt, Mycobacterium tuberculosis H37Rv
ugccgacccgcuucgcccggcug

SEQ ID NO: 1285274 - RNA, 20 nt, Mycobacterium tuberculosis H37Rv
ugccgaaguuuuggaagccc

SEQ ID NO: 1285275 - RNA, 14 nt, Mycobacterium tuberculosis H37Rv
ugccgaucgaugcc

SEQ ID NO: 1285276 - RNA, 15 nt, Mycobacterium tuberculosis H37Rv
ugccgaucgaugcca

SEQ ID NO: 1285277 - RNA, 13 nt, Mycobacterium tuberculosis H37Rv
ugccgaucgccga

SEQ ID NO: 1285278 - RNA, 17 nt, Mycobacterium tuberculosis H37Rv
ugccgaagaugaccgcu

SEQ ID NO: 1285279 - RNA, 12 nt, Mycobacterium tuberculosis H37Rv
ugccgaagccgg

SEQ ID NO: 1285280 - RNA, 21 nt, Mycobacterium tuberculosis H37Rv
ugccgaagcugcccaaccggu

SEQ ID NO: 1285281 - RNA, 13 nt, Mycobacterium tuberculosis H37Rv
ugccgaaacccga

SEQ ID NO: 1285282 - RNA, 17 nt, Mycobacterium tuberculosis H37Rv
ugccgaacccggcggac

SEQ ID NO: 1285283 - RNA, 17 nt, Mycobacterium tuberculosis H37Rv
ugccgaaccgcugcggg

SEQ ID NO: 1285284 - RNA, 16 nt, Mycobacterium tuberculosis H37Rv
ugccgaacuccgcgga

SEQ ID NO: 1285285 - RNA, 14 nt, Mycobacterium tuberculosis H37Rv
ugcgcggcccgcau

SEQ ID NO: 1285286 - RNA, 21 nt, Mycobacterium tuberculosis H37Rv
ugcgcggcccgcaucguugcc

SEQ ID NO: 1285287 - RNA, 15 nt, Mycobacterium tuberculosis H37Rv
ugcgcggcaucccgc

SEQ ID NO: 1285288 - RNA, 16 nt, Mycobacterium tuberculosis H37Rv
ugcgcggcaucccgcc

SEQ ID NO: 1285289 - RNA, 17 nt, Mycobacterium tuberculosis H37Rv
ugcgcggcgugcgcggu

SEQ ID NO: 1285290 - RNA, 17 nt, Mycobacterium tuberculosis H37Rv
ugcgcggcgucgucgau

SEQ ID NO: 1285291 - RNA, 20 nt, Mycobacterium tuberculosis H37Rv
ugcgcgggcaucgucgucgc

SEQ ID NO: 1285292 - RNA, 23 nt, Mycobacterium tuberculosis H37Rv
ugcgcgggcgaguagucgacguc

SEQ ID NO: 1285293 - RNA, 18 nt, Mycobacterium tuberculosis H37Rv
ugcgcugcucacgcagca

SEQ ID NO: 1285294 - RNA, 24 nt, Mycobacterium tuberculosis H37Rv
ugcgcuggaggacccgcuacgacg

SEQ ID NO: 1285295 - RNA, 12 nt, Mycobacterium tuberculosis H37Rv
ugcgcuggcggc

SEQ ID NO: 1285296 - RNA, 20 nt, Mycobacterium tuberculosis H37Rv
ugcgcuggcugacaccgauc

SEQ ID NO: 1285297 - RNA, 18 nt, Mycobacterium tuberculosis H37Rv
ugcgcgaucccaacgccc

SEQ ID NO: 1285298 - RNA, 17 nt, Mycobacterium tuberculosis H37Rv
ugcgcgaggucggcggc

SEQ ID NO: 1285299 - RNA, 19 nt, Mycobacterium tuberculosis H37Rv
ugcgccgagaucgacaucg

SEQ ID NO: 1285300 - RNA, 23 nt, Mycobacterium tuberculosis H37Rv
ugcgcgacggucaaggugcgccg

SEQ ID NO: 1285301 - RNA, 18 nt, Mycobacterium tuberculosis H37Rv
ugcgcgacugauccucga

SEQ ID NO: 1285302 - RNA, 19 nt, Mycobacterium tuberculosis H37Rv
ugcgcgacugauccucgau

SEQ ID NO: 1285303 - RNA, 23 nt, Mycobacterium tuberculosis H37Rv
ugcgcgaugcgauucugcgucug

SEQ ID NO: 1285304 - RNA, 22 nt, Mycobacterium tuberculosis H37Rv
ugcgcgaugcgauucugcgucu

SEQ ID NO: 1285305 - RNA, 22 nt, Mycobacterium tuberculosis H37Rv
ugcgcgaugcccacgcacagca

SEQ ID NO: 1285306 - RNA, 17 nt, Mycobacterium tuberculosis H37Rv
ugcgcccugagcagaug

SEQ ID NO: 1285307 - RNA, 23 nt, Mycobacterium tuberculosis H37Rv
ugcgcccguccgcgcgccgacca

SEQ ID NO: 1285308 - RNA, 21 nt, Mycobacterium tuberculosis H37Rv
ugcgccgaacaccacaccgag

SEQ ID NO: 1285309 - RNA, 22 nt, Mycobacterium tuberculosis H37Rv
ugcgcgaaggauuugauaggcg

SEQ ID NO: 1285310 - RNA, 19 nt, Mycobacterium tuberculosis H37Rv
ugcgccgaaugccaccucg

SEQ ID NO: 1285311 - RNA, 20 nt, Mycobacterium tuberculosis H37Rv
ugcggcccgggcucggcgaa

SEQ ID NO: 1285312 - RNA, 17 nt, Mycobacterium tuberculosis H37Rv
ugcggacaucaccggca

SEQ ID NO: 1285313 - RNA, 16 nt, Mycobacterium tuberculosis H37Rv
ugcgcuuggucgaccg

SEQ ID NO: 1285314 - RNA, 17 nt, Mycobacterium tuberculosis H37Rv
ugcggaagcaucggcug

SEQ ID NO: 1285315 - RNA, 20 nt, Mycobacterium tuberculosis H37Rv
ugcggaacacgaugcgcggu

SEQ ID NO: 1285316 - RNA, 17 nt, Mycobacterium tuberculosis H37Rv
ugcggccugcucgacca

SEQ ID NO: 1285317 - RNA, 14 nt, Mycobacterium tuberculosis H37Rv
ugcggcgaccaggu

SEQ ID NO: 1285318 - RNA, 14 nt, Mycobacterium tuberculosis H37Rv
ugcggucaacgcug

SEQ ID NO: 1285319 - RNA, 14 nt, Mycobacterium tuberculosis H37Rv
ugcgguauugcccg

SEQ ID NO: 1285320 - RNA, 17 nt, Mycobacterium tuberculosis H37Rv
ugcgguauuugaacgcc

SEQ ID NO: 1285321 - RNA, 15 nt, Mycobacterium tuberculosis H37Rv
ugcgguaucggucga

SEQ ID NO: 1285322 - RNA, 13 nt, Mycobacterium tuberculosis H37Rv
ugcgguacccgau

SEQ ID NO: 1285323 - RNA, 23 nt, Mycobacterium tuberculosis H37Rv
ugcgggugggacaccaucuccgc

SEQ ID NO: 1285324 - RNA, 13 nt, Mycobacterium tuberculosis H37Rv
ugcgggugggaaa

SEQ ID NO: 1285325 - RNA, 13 nt, Mycobacterium tuberculosis H37Rv
ugcgggaggcagc

SEQ ID NO: 1285326 - RNA, 16 nt, Mycobacterium tuberculosis H37Rv
ugcgggacgucgucgu

SEQ ID NO: 1285327 - RNA, 20 nt, Mycobacterium tuberculosis H37Rv
ugcgggcaaccacaucaccg

SEQ ID NO: 1285328 - RNA, 16 nt, Mycobacterium tuberculosis H37Rv
ugcgggccgccaggcg

SEQ ID NO: 1285329 - RNA, 20 nt, Mycobacterium tuberculosis H37Rv
ugcggcuuggccaucacggc

SEQ ID NO: 1285330 - RNA, 15 nt, Mycobacterium tuberculosis H37Rv
ugccgugcggaucac

SEQ ID NO: 1285331 - RNA, 15 nt, Mycobacterium tuberculosis H37Rv
ugccguuaccgccaa

SEQ ID NO: 1285332 - RNA, 21 nt, Mycobacterium tuberculosis H37Rv
ugccguggugaaaugccgaga

SEQ ID NO: 1285333 - RNA, 21 nt, Mycobacterium tuberculosis H37Rv
ugccgugccgaaguggagccc

SEQ ID NO: 1285334 - RNA, 19 nt, Mycobacterium tuberculosis H37Rv
ugccgugcugggccgacgg

SEQ ID NO: 1285335 - RNA, 16 nt, Mycobacterium tuberculosis H37Rv
ugccgucagcugaccg

SEQ ID NO: 1285336 - RNA, 22 nt, Mycobacterium tuberculosis H37Rv
ugccgucuuugucacgcaccgc

SEQ ID NO: 1285337 - RNA, 16 nt, Mycobacterium tuberculosis H37Rv
ugccgcggucggcgac

SEQ ID NO: 1285338 - RNA, 19 nt, Mycobacterium tuberculosis H37Rv
ugccgcgguggaugcgaug

SEQ ID NO: 1285339 - RNA, 13 nt, Mycobacterium tuberculosis H37Rv
ugccgcggccacc

SEQ ID NO: 1285340 - RNA, 19 nt, Mycobacterium tuberculosis H37Rv
ugccgcggaggcggccagc

SEQ ID NO: 1285341 - RNA, 17 nt, Mycobacterium tuberculosis H37Rv
ugccguaguaaggagcc

SEQ ID NO: 1285342 - RNA, 15 nt, Mycobacterium tuberculosis H37Rv
ugccguucucgucga

SEQ ID NO: 1285343 - RNA, 22 nt, Mycobacterium tuberculosis H37Rv
ugccguugcgaucgcgugcggu

SEQ ID NO: 1285344 - RNA, 15 nt, Mycobacterium tuberculosis H37Rv
ugccguugcgaucgc

SEQ ID NO: 1285345 - RNA, 14 nt, Mycobacterium tuberculosis H37Rv
ugccguugcgaucg

SEQ ID NO: 1285346 - RNA, 19 nt, Mycobacterium tuberculosis H37Rv
ugccguuggagccgccacc

SEQ ID NO: 1285347 - RNA, 16 nt, Mycobacterium tuberculosis H37Rv
ugccuugggaccgcgc

SEQ ID NO: 1285348 - RNA, 17 nt, Mycobacterium tuberculosis H37Rv
ugccuuggcagcccagu

SEQ ID NO: 1285349 - RNA, 23 nt, Mycobacterium tuberculosis H37Rv
ugccuuggccggcuugucgacca

SEQ ID NO: 1285350 - RNA, 17 nt, Mycobacterium tuberculosis H37Rv
ugccuugaucugagcgc

SEQ ID NO: 1285351 - RNA, 19 nt, Mycobacterium tuberculosis H37Rv
ugccuucuuggcgggagcc

SEQ ID NO: 1285352 - RNA, 19 nt, Mycobacterium tuberculosis H37Rv
ugcgaacgaauccgcucga

SEQ ID NO: 1285353 - RNA, 12 nt, Mycobacterium tuberculosis H37Rv
ugcgccaccucg

SEQ ID NO: 1285354 - RNA, 18 nt, Mycobacterium tuberculosis H37Rv
ugcgcagaacaccaccgc

SEQ ID NO: 1285355 - RNA, 21 nt, Mycobacterium tuberculosis H37Rv
ugcgcacggauucaucacggg

SEQ ID NO: 1285356 - RNA, 16 nt, Mycobacterium tuberculosis H37Rv
ugcgccacgucgacgg

SEQ ID NO: 1285357 - RNA, 15 nt, Mycobacterium tuberculosis H37Rv
ugcgccacgucgacg

SEQ ID NO: 1285358 - RNA, 21 nt, Mycobacterium tuberculosis H37Rv
ugcgccagcaacagcgcggug

SEQ ID NO: 1285359 - RNA, 16 nt, Mycobacterium tuberculosis H37Rv
ugcgcccaauccaccg

SEQ ID NO: 1285360 - RNA, 19 nt, Mycobacterium tuberculosis H37Rv
ugcgcccaauccaccgauu

SEQ ID NO: 1285361 - RNA, 16 nt, Mycobacterium tuberculosis H37Rv
ugcgcccauagcugcc

SEQ ID NO: 1285362 - RNA, 19 nt, Mycobacterium tuberculosis H37Rv
ugcgaggcguaaucaagca

SEQ ID NO: 1285363 - RNA, 20 nt, Mycobacterium tuberculosis H37Rv
ugcgaacucaucgugguaac

SEQ ID NO: 1285364 - RNA, 13 nt, Mycobacterium tuberculosis H37Rv
ugcgaacucggcc

SEQ ID NO: 1285365 - RNA, 19 nt, Mycobacterium tuberculosis H37Rv
ugcgcaccggucaacgugg

SEQ ID NO: 1285366 - RNA, 12 nt, Mycobacterium tuberculosis H37Rv
ugcgcaccgguc

SEQ ID NO: 1285367 - RNA, 16 nt, Mycobacterium tuberculosis H37Rv
ugcgcaccggucaacg

SEQ ID NO: 1285368 - RNA, 15 nt, Mycobacterium tuberculosis H37Rv
ugcgcaccagcaccu

SEQ ID NO: 1285369 - RNA, 19 nt, Mycobacterium tuberculosis H37Rv
ugcgcaccaguccagcggg

SEQ ID NO: 1285370 - RNA, 20 nt, Mycobacterium tuberculosis H37Rv
ugcgcacccgcgggucgucc

SEQ ID NO: 1285371 - RNA, 13 nt, Mycobacterium tuberculosis H37Rv
ugcgaucaguucg

SEQ ID NO: 1285372 - RNA, 19 nt, Mycobacterium tuberculosis H37Rv
ugcuggcaaaguaucgcag

SEQ ID NO: 1285373 - RNA, 14 nt, Mycobacterium tuberculosis H37Rv
ugcuggccgaaccg

SEQ ID NO: 1285374 - RNA, 14 nt, Mycobacterium tuberculosis H37Rv
ugcuggucggcgau

SEQ ID NO: 1285375 - RNA, 19 nt, Mycobacterium tuberculosis H37Rv
ugcuugggcagcucgucca

SEQ ID NO: 1285376 - RNA, 14 nt, Mycobacterium tuberculosis H37Rv
ugcuugcgcaucgc

SEQ ID NO: 1285377 - RNA, 22 nt, Mycobacterium tuberculosis H37Rv
ugcuugcgaaacgaauccgcca

SEQ ID NO: 1285378 - RNA, 14 nt, Mycobacterium tuberculosis H37Rv
ugcuucuucggaca

SEQ ID NO: 1285379 - RNA, 16 nt, Mycobacterium tuberculosis H37Rv
ugcuguugcgcggucg

SEQ ID NO: 1285380 - RNA, 22 nt, Mycobacterium tuberculosis H37Rv
ugcuguuccaucaaggucauca

SEQ ID NO: 1285381 - RNA, 23 nt, Mycobacterium tuberculosis H37Rv
ugcuguugccagucgaucgcggc

SEQ ID NO: 1285382 - RNA, 14 nt, Mycobacterium tuberculosis H37Rv
ugcuuagcgcgaaa

SEQ ID NO: 1285383 - RNA, 18 nt, Mycobacterium tuberculosis H37Rv
ugcugaccaugaccgggc

SEQ ID NO: 1285384 - RNA, 21 nt, Mycobacterium tuberculosis H37Rv
ugcugacgaugcggucgacgg

SEQ ID NO: 1285385 - RNA, 20 nt, Mycobacterium tuberculosis H37Rv
ugcucgucccagaaccggcu

SEQ ID NO: 1285386 - RNA, 19 nt, Mycobacterium tuberculosis H37Rv
ugcucguagcccaggucga

SEQ ID NO: 1285387 - RNA, 16 nt, Mycobacterium tuberculosis H37Rv
ugcucgguggugacca

SEQ ID NO: 1285388 - RNA, 17 nt, Mycobacterium tuberculosis H37Rv
ugcucgggggccgacca

SEQ ID NO: 1285389 - RNA, 18 nt, Mycobacterium tuberculosis H37Rv
ugcucggucucgucgcgg

SEQ ID NO: 1285390 - RNA, 19 nt, Mycobacterium tuberculosis H37Rv
ugcucgggcgugaucccgc

SEQ ID NO: 1285391 - RNA, 13 nt, Mycobacterium tuberculosis H37Rv
ugcugcugcagca

SEQ ID NO: 1285392 - RNA, 12 nt, Mycobacterium tuberculosis H37Rv
ugcugcgcggug

SEQ ID NO: 1285393 - RNA, 20 nt, Mycobacterium tuberculosis H37Rv
ugcugccgggggcccgaccu

SEQ ID NO: 1285394 - RNA, 21 nt, Mycobacterium tuberculosis H37Rv
ugcugccccccagacaauccg

SEQ ID NO: 1285395 - RNA, 19 nt, Mycobacterium tuberculosis H37Rv
ugcugcaaggaauuccggc

SEQ ID NO: 1285396 - RNA, 20 nt, Mycobacterium tuberculosis H37Rv
ugcgugcccguugguguugc

SEQ ID NO: 1285397 - RNA, 13 nt, Mycobacterium tuberculosis H37Rv
ugcgugccgaccc

SEQ ID NO: 1285398 - RNA, 18 nt, Mycobacterium tuberculosis H37Rv
ugcgugccgacccgcuuc

SEQ ID NO: 1285399 - RNA, 20 nt, Mycobacterium tuberculosis H37Rv
ugcgugccgacccgcuucgc

SEQ ID NO: 1285400 - RNA, 13 nt, Mycobacterium tuberculosis H37Rv
ugcgucucgauga

SEQ ID NO: 1285401 - RNA, 17 nt, Mycobacterium tuberculosis H37Rv
ugcgugaugguugcucg

SEQ ID NO: 1285402 - RNA, 15 nt, Mycobacterium tuberculosis H37Rv
ugcguccggugcugg

SEQ ID NO: 1285403 - RNA, 19 nt, Mycobacterium tuberculosis H37Rv
ugcgucgaugccggugugc

SEQ ID NO: 1285404 - RNA, 17 nt, Mycobacterium tuberculosis H37Rv
ugcgucucgguggcugc

SEQ ID NO: 1285405 - RNA, 19 nt, Mycobacterium tuberculosis H37Rv
ugcgucugcucacgcgguc

SEQ ID NO: 1285406 - RNA, 13 nt, Mycobacterium tuberculosis H37Rv
ugcgucgucugca

SEQ ID NO: 1285407 - RNA, 21 nt, Mycobacterium tuberculosis H37Rv
ugcgucguucggagcccugac

SEQ ID NO: 1285408 - RNA, 19 nt, Mycobacterium tuberculosis H37Rv
ugcgucgcggacggugcgg

SEQ ID NO: 1285409 - RNA, 15 nt, Mycobacterium tuberculosis H37Rv
ugcguggcgggcugc

SEQ ID NO: 1285410 - RNA, 17 nt, Mycobacterium tuberculosis H37Rv
ugcguugggaucccagc

SEQ ID NO: 1285411 - RNA, 18 nt, Mycobacterium tuberculosis H37Rv
ugcguucggugaucucgu

SEQ ID NO: 1285412 - RNA, 20 nt, Mycobacterium tuberculosis H37Rv
ugcguucgggcccguagccg

SEQ ID NO: 1285413 - RNA, 16 nt, Mycobacterium tuberculosis H37Rv
ugcguuccaucgccga

SEQ ID NO: 1285414 - RNA, 16 nt, Mycobacterium tuberculosis H37Rv
ugcguuccgaucggca

SEQ ID NO: 1285415 - RNA, 15 nt, Mycobacterium tuberculosis H37Rv
ugcggucgucaccgu

SEQ ID NO: 1285416 - RNA, 15 nt, Mycobacterium tuberculosis H37Rv
ugcguacaacgccgg

SEQ ID NO: 1285417 - RNA, 17 nt, Mycobacterium tuberculosis H37Rv
ugcguacaacgccgguu

SEQ ID NO: 1285418 - RNA, 20 nt, Mycobacterium tuberculosis H37Rv
ugcgguuucaccgacgacgc

SEQ ID NO: 1285419 - RNA, 18 nt, Mycobacterium tuberculosis H37Rv
ugcguagcaggucgacgg

SEQ ID NO: 1285420 - RNA, 13 nt, Mycobacterium tuberculosis H37Rv
ugcguccagcaaa

SEQ ID NO: 1285421 - RNA, 23 nt, Mycobacterium tuberculosis H37Rv
ugcgguggcuuuugcgucugcuc

SEQ ID NO: 1285422 - RNA, 20 nt, Mycobacterium tuberculosis H37Rv
ugcgguggcuuuugcgucug

SEQ ID NO: 1285423 - RNA, 19 nt, Mycobacterium tuberculosis H37Rv
ugcggugguaggacgccag

SEQ ID NO: 1285424 - RNA, 22 nt, Mycobacterium tuberculosis H37Rv
ugcgguggcaggugaucccgau

SEQ ID NO: 1285425 - RNA, 13 nt, Mycobacterium tuberculosis H37Rv
ugcgguccucgau

SEQ ID NO: 1285426 - RNA, 13 nt, Mycobacterium tuberculosis H37Rv
ugcgguccggcuu

SEQ ID NO: 1285427 - RNA, 17 nt, Mycobacterium tuberculosis H37Rv
ugcucaggucgcagacc

SEQ ID NO: 1285428 - RNA, 15 nt, Mycobacterium tuberculosis H37Rv
ugcucacauccgguc

SEQ ID NO: 1285429 - RNA, 18 nt, Mycobacterium tuberculosis H37Rv
ugcucacgcgggucguua

SEQ ID NO: 1285430 - RNA, 19 nt, Mycobacterium tuberculosis H37Rv
ugcucccuauugcugcggu

SEQ ID NO: 1285431 - RNA, 14 nt, Mycobacterium tuberculosis H37Rv
ugcuccugguggca

SEQ ID NO: 1285432 - RNA, 20 nt, Mycobacterium tuberculosis H37Rv
ugcuccuugggucggucacg

SEQ ID NO: 1285433 - RNA, 14 nt, Mycobacterium tuberculosis H37Rv
ugcucgaccgucau

SEQ ID NO: 1285434 - RNA, 13 nt, Mycobacterium tuberculosis H37Rv
ugcucgacgcccg

SEQ ID NO: 1285435 - RNA, 19 nt, Mycobacterium tuberculosis H37Rv
ugcucgacgaucugcagca

SEQ ID NO: 1285436 - RNA, 16 nt, Mycobacterium tuberculosis H37Rv
ugcucgagcaccucgg

SEQ ID NO: 1285437 - RNA, 15 nt, Mycobacterium tuberculosis H37Rv
ugcucgccgggcagc

SEQ ID NO: 1285438 - RNA, 20 nt, Mycobacterium tuberculosis H37Rv
ugcucgcgaucgcagugagc

SEQ ID NO: 1285439 - RNA, 20 nt, Mycobacterium tuberculosis H37Rv
ugcucggaaacagcgaucgc

SEQ ID NO: 1285440 - RNA, 23 nt, Mycobacterium tuberculosis H37Rv
ugcucggaaacagcgaucgccgc

SEQ ID NO: 1285441 - RNA, 16 nt, Mycobacterium tuberculosis H37Rv
ugcucgcacagcacca

SEQ ID NO: 1285442 - RNA, 18 nt, Mycobacterium tuberculosis H37Rv
ugcucgaucaucgggagc

SEQ ID NO: 1285443 - RNA, 15 nt, Mycobacterium tuberculosis H37Rv
ugcucgaucugucgc

SEQ ID NO: 1285444 - RNA, 15 nt, Mycobacterium tuberculosis H37Rv
gccgugccacgucgg

SEQ ID NO: 1285445 - RNA, 14 nt, Mycobacterium tuberculosis H37Rv
gccgugccgccagc

SEQ ID NO: 1285446 - RNA, 16 nt, Mycobacterium tuberculosis H37Rv
gccguggauacgcacg

SEQ ID NO: 1285447 - RNA, 20 nt, Mycobacterium tuberculosis H37Rv
gccguggaugucgcggucga

SEQ ID NO: 1285448 - RNA, 17 nt, Mycobacterium tuberculosis H37Rv
gccguggaagacgucga

SEQ ID NO: 1285449 - RNA, 17 nt, Mycobacterium tuberculosis H37Rv
gccguggaacacgaagu

SEQ ID NO: 1285450 - RNA, 17 nt, Mycobacterium tuberculosis H37Rv
gccguggagcacagcac

SEQ ID NO: 1285451 - RNA, 21 nt, Mycobacterium tuberculosis H37Rv
gccgugcugcggcgacgguga

SEQ ID NO: 1285452 - RNA, 20 nt, Mycobacterium tuberculosis H37Rv
gccgugcagcucggucagcg

SEQ ID NO: 1285453 - RNA, 15 nt, Mycobacterium tuberculosis H37Rv
gccgucggugccgcc

SEQ ID NO: 1285454 - RNA, 12 nt, Mycobacterium tuberculosis H37Rv
gccgucggugcc

SEQ ID NO: 1285455 - RNA, 20 nt, Mycobacterium tuberculosis H37Rv
gccgucggugggugccagcc

SEQ ID NO: 1285456 - RNA, 23 nt, Mycobacterium tuberculosis H37Rv
gccgucgggugcagcacggcgcc

SEQ ID NO: 1285457 - RNA, 23 nt, Mycobacterium tuberculosis H37Rv
gccgucggggguaauugccagcc

SEQ ID NO: 1285458 - RNA, 16 nt, Mycobacterium tuberculosis H37Rv
gccguuaccgccguug

SEQ ID NO: 1285459 - RNA, 23 nt, Mycobacterium tuberculosis H37Rv
gccguuaccgccaaacgcugcgc

SEQ ID NO: 1285460 - RNA, 18 nt, Mycobacterium tuberculosis H37Rv
gccguguucuaccugcac

SEQ ID NO: 1285461 - RNA, 22 nt, Mycobacterium tuberculosis H37Rv
gccguguucgaccgcagggacc

SEQ ID NO: 1285462 - RNA, 18 nt, Mycobacterium tuberculosis H37Rv
gccguguccagcaugccc

SEQ ID NO: 1285463 - RNA, 20 nt, Mycobacterium tuberculosis H37Rv
gccgugguugcacguucggc

SEQ ID NO: 1285464 - RNA, 23 nt, Mycobacterium tuberculosis H37Rv
gccgugguggaugagccggucuu

SEQ ID NO: 1285465 - RNA, 19 nt, Mycobacterium tuberculosis H37Rv
gccgugugcaucggcgacc

SEQ ID NO: 1285466 - RNA, 21 nt, Mycobacterium tuberculosis H37Rv
gccguguccagcaugcccgcc

SEQ ID NO: 1285467 - RNA, 20 nt, Mycobacterium tuberculosis H37Rv
gccgugugcuucgagcaccg

SEQ ID NO: 1285468 - RNA, 19 nt, Mycobacterium tuberculosis H37Rv
gccgugugcuucgagcacc

SEQ ID NO: 1285469 - RNA, 20 nt, Mycobacterium tuberculosis H37Rv
gccgugugcucgaaggaccg

SEQ ID NO: 1285470 - RNA, 22 nt, Mycobacterium tuberculosis H37Rv
gccguggcagucgcacggugcc

SEQ ID NO: 1285471 - RNA, 21 nt, Mycobacterium tuberculosis H37Rv
gccguggcuggacccgcaugg

SEQ ID NO: 1285472 - RNA, 21 nt, Mycobacterium tuberculosis H37Rv
gccgugggugucgguggccgc

SEQ ID NO: 1285473 - RNA, 12 nt, Mycobacterium tuberculosis H37Rv
gccguggucgag

SEQ ID NO: 1285474 - RNA, 17 nt, Mycobacterium tuberculosis H37Rv
gccuaaccccggcucga

SEQ ID NO: 1285475 - RNA, 23 nt, Mycobacterium tuberculosis H37Rv
gccguucgugggcauugcggcgc

SEQ ID NO: 1285476 - RNA, 14 nt, Mycobacterium tuberculosis H37Rv
gccguucgucgcgg

SEQ ID NO: 1285477 - RNA, 16 nt, Mycobacterium tuberculosis H37Rv
gccguuugggccguac

SEQ ID NO: 1285478 - RNA, 17 nt, Mycobacterium tuberculosis H37Rv
gccguucgcgucgccga

SEQ ID NO: 1285479 - RNA, 12 nt, Mycobacterium tuberculosis H37Rv
gccguucggcgc

SEQ ID NO: 1285480 - RNA, 21 nt, Mycobacterium tuberculosis H37Rv
gccguuaccgccguugccgau

SEQ ID NO: 1285481 - RNA, 23 nt, Mycobacterium tuberculosis H37Rv
gccucagccaccgggcgugcggc

SEQ ID NO: 1285482 - RNA, 23 nt, Mycobacterium tuberculosis H37Rv
gccucaugcuaggccaccggcga

SEQ ID NO: 1285483 - RNA, 18 nt, Mycobacterium tuberculosis H37Rv
gccuccaagcccgccgga

SEQ ID NO: 1285484 - RNA, 18 nt, Mycobacterium tuberculosis H37Rv
gccuccacauacgcggcg

SEQ ID NO: 1285485 - RNA, 16 nt, Mycobacterium tuberculosis H37Rv
gccuccaccaggucgu

SEQ ID NO: 1285486 - RNA, 18 nt, Mycobacterium tuberculosis H37Rv
gccuccagaaccgaagcc

SEQ ID NO: 1285487 - RNA, 18 nt, Mycobacterium tuberculosis H37Rv
gccuccagcgcaccggug

SEQ ID NO: 1285488 - RNA, 15 nt, Mycobacterium tuberculosis H37Rv
gccguagaucccgaa

SEQ ID NO: 1285489 - RNA, 17 nt, Mycobacterium tuberculosis H37Rv
gccguagaccacuucga

SEQ ID NO: 1285490 - RNA, 19 nt, Mycobacterium tuberculosis H37Rv
gccguagaagcgcuccagc

SEQ ID NO: 1285491 - RNA, 14 nt, Mycobacterium tuberculosis H37Rv
gccguagaucccga

SEQ ID NO: 1285492 - RNA, 18 nt, Mycobacterium tuberculosis H37Rv
gccguagagucguuuggc

SEQ ID NO: 1285493 - RNA, 20 nt, Mycobacterium tuberculosis H37Rv
gccguagagucguuuggcgc

SEQ ID NO: 1285494 - RNA, 15 nt, Mycobacterium tuberculosis H37Rv
gccguagaccaggcc

SEQ ID NO: 1285495 - RNA, 22 nt, Mycobacterium tuberculosis H37Rv
gccguagagcuggugcgggacg

SEQ ID NO: 1285496 - RNA, 15 nt, Mycobacterium tuberculosis H37Rv
gccguaacggcgaaa

SEQ ID NO: 1285497 - RNA, 14 nt, Mycobacterium tuberculosis H37Rv
gccguacacaccga

SEQ ID NO: 1285498 - RNA, 19 nt, Mycobacterium tuberculosis H37Rv
gccguacagcggcggcguc

SEQ ID NO: 1285499 - RNA, 15 nt, Mycobacterium tuberculosis H37Rv
gccguacagcggcgg

SEQ ID NO: 1285500 - RNA, 22 nt, Mycobacterium tuberculosis H37Rv
gccguaccaguuauucggugcg

SEQ ID NO: 1285501 - RNA, 12 nt, Mycobacterium tuberculosis H37Rv
gccguacgccgu

SEQ ID NO: 1285502 - RNA, 16 nt, Mycobacterium tuberculosis H37Rv
gccgggauaucgucga

SEQ ID NO: 1285503 - RNA, 23 nt, Mycobacterium tuberculosis H37Rv
gccgggaaggauugcgcguucca

SEQ ID NO: 1285504 - RNA, 21 nt, Mycobacterium tuberculosis H37Rv
gccgguuacccggaccgucgu

SEQ ID NO: 1285505 - RNA, 19 nt, Mycobacterium tuberculosis H37Rv
gccgguucagggguggcgc

SEQ ID NO: 1285506 - RNA, 19 nt, Mycobacterium tuberculosis H37Rv
gccgggaucgccguccagc

SEQ ID NO: 1285507 - RNA, 14 nt, Mycobacterium tuberculosis H37Rv
gccgggaugccgcc

SEQ ID NO: 1285508 - RNA, 16 nt, Mycobacterium tuberculosis H37Rv
gccguaacgcggaucg

SEQ ID NO: 1285509 - RNA, 21 nt, Mycobacterium tuberculosis H37Rv
gccgguugcggcugcguuggc

SEQ ID NO: 1285510 - RNA, 19 nt, Mycobacterium tuberculosis H37Rv
gccgguugcggcugcguug

SEQ ID NO: 1285511 - RNA, 15 nt, Mycobacterium tuberculosis H37Rv
gccgguucgcccagc

SEQ ID NO: 1285512 - RNA, 19 nt, Mycobacterium tuberculosis H37Rv
gccgguucuuggcguugau

SEQ ID NO: 1285513 - RNA, 18 nt, Mycobacterium tuberculosis H37Rv
gccgucagggucagcugg

SEQ ID NO: 1285514 - RNA, 14 nt, Mycobacterium tuberculosis H37Rv
gccgucagcucacc

SEQ ID NO: 1285515 - RNA, 16 nt, Mycobacterium tuberculosis H37Rv
gccgucaucgugcccg

SEQ ID NO: 1285516 - RNA, 19 nt, Mycobacterium tuberculosis H37Rv
gccgucaucgugcccgcgu

SEQ ID NO: 1285517 - RNA, 17 nt, Mycobacterium tuberculosis H37Rv
gccgucaucuccgacuc

SEQ ID NO: 1285518 - RNA, 22 nt, Mycobacterium tuberculosis H37Rv
gccgucaguuaaagguggucgu

SEQ ID NO: 1285519 - RNA, 22 nt, Mycobacterium tuberculosis H37Rv
gccguaguugguccaggugacc

SEQ ID NO: 1285520 - RNA, 23 nt, Mycobacterium tuberculosis H37Rv
gccguagguugcgccccgacugc

SEQ ID NO: 1285521 - RNA, 17 nt, Mycobacterium tuberculosis H37Rv
gccguagcugacggccu

SEQ ID NO: 1285522 - RNA, 23 nt, Mycobacterium tuberculosis H37Rv
gccguccgcaccggcggcgccga

SEQ ID NO: 1285523 - RNA, 20 nt, Mycobacterium tuberculosis H37Rv
gccgucccggcucgagcucg

SEQ ID NO: 1285524 - RNA, 14 nt, Mycobacterium tuberculosis H37Rv
gccguccgaccagg

SEQ ID NO: 1285525 - RNA, 23 nt, Mycobacterium tuberculosis H37Rv
gccgucccgaaacgccggguucg

SEQ ID NO: 1285526 - RNA, 16 nt, Mycobacterium tuberculosis H37Rv
gccgucccgcgagcag

SEQ ID NO: 1285527 - RNA, 15 nt, Mycobacterium tuberculosis H37Rv
gccgucccgcgagca

SEQ ID NO: 1285528 - RNA, 20 nt, Mycobacterium tuberculosis H37Rv
gccgucaucuccgacucgau

SEQ ID NO: 1285529 - RNA, 16 nt, Mycobacterium tuberculosis H37Rv
gccgucauggcccgau

SEQ ID NO: 1285530 - RNA, 16 nt, Mycobacterium tuberculosis H37Rv
gccguccaagccagcg

SEQ ID NO: 1285531 - RNA, 21 nt, Mycobacterium tuberculosis H37Rv
gccguccaagccagcguuggc

SEQ ID NO: 1285532 - RNA, 21 nt, Mycobacterium tuberculosis H37Rv
gccguccccgccgucgccacc

SEQ ID NO: 1285533 - RNA, 19 nt, Mycobacterium tuberculosis H37Rv
gccgucggcgccggcaucg

SEQ ID NO: 1285534 - RNA, 18 nt, Mycobacterium tuberculosis H37Rv
gccgucggcgccggcauc

SEQ ID NO: 1285535 - RNA, 13 nt, Mycobacterium tuberculosis H37Rv
gccgucggcgaug

SEQ ID NO: 1285536 - RNA, 16 nt, Mycobacterium tuberculosis H37Rv
gccgucggcgccggca

SEQ ID NO: 1285537 - RNA, 19 nt, Mycobacterium tuberculosis H37Rv
gccgucggccucggcgguc

SEQ ID NO: 1285538 - RNA, 17 nt, Mycobacterium tuberculosis H37Rv
gccgucgcgacgucggc

SEQ ID NO: 1285539 - RNA, 13 nt, Mycobacterium tuberculosis H37Rv
gccgucggccgag

SEQ ID NO: 1285540 - RNA, 16 nt, Mycobacterium tuberculosis H37Rv
gccgucgcgacgucgg

SEQ ID NO: 1285541 - RNA, 21 nt, Mycobacterium tuberculosis H37Rv
gccgucgccgaucagcugcgc

SEQ ID NO: 1285542 - RNA, 16 nt, Mycobacterium tuberculosis H37Rv
gccgucgccguccagu

SEQ ID NO: 1285543 - RNA, 14 nt, Mycobacterium tuberculosis H37Rv
gccgucgagcaacg

SEQ ID NO: 1285544 - RNA, 20 nt, Mycobacterium tuberculosis H37Rv
gccgucgcccuuagggucgc

SEQ ID NO: 1285545 - RNA, 12 nt, Mycobacterium tuberculosis H37Rv
gccgucgccgau

SEQ ID NO: 1285546 - RNA, 22 nt, Mycobacterium tuberculosis H37Rv
gccgucgagcaacgugacccgg

SEQ ID NO: 1285547 - RNA, 22 nt, Mycobacterium tuberculosis H37Rv
gccgucgacguugaugaccugu

SEQ ID NO: 1285548 - RNA, 16 nt, Mycobacterium tuberculosis H37Rv
gccgucgacgaucagc

SEQ ID NO: 1285549 - RNA, 14 nt, Mycobacterium tuberculosis H37Rv
gccgucgacgcggc

SEQ ID NO: 1285550 - RNA, 16 nt, Mycobacterium tuberculosis H37Rv
gccgucgacgcggucc

SEQ ID NO: 1285551 - RNA, 16 nt, Mycobacterium tuberculosis H37Rv
gccgucgacgucgaug

SEQ ID NO: 1285552 - RNA, 22 nt, Mycobacterium tuberculosis H37Rv
gccuccauaucgcagcguuggc

SEQ ID NO: 1285553 - RNA, 18 nt, Mycobacterium tuberculosis H37Rv
gccuccauaucgcagcgu

SEQ ID NO: 1285554 - RNA, 19 nt, Mycobacterium tuberculosis H37Rv
gccuccagcacccggucga

SEQ ID NO: 1285555 - RNA, 22 nt, Mycobacterium tuberculosis H37Rv
gccucggagaucgagaucaccu

SEQ ID NO: 1285556 - RNA, 15 nt, Mycobacterium tuberculosis H37Rv
gccucggcaugcagc

SEQ ID NO: 1285557 - RNA, 13 nt, Mycobacterium tuberculosis H37Rv
gccucggcaucgc

SEQ ID NO: 1285558 - RNA, 16 nt, Mycobacterium tuberculosis H37Rv
gccucggcaugcagcc

SEQ ID NO: 1285559 - RNA, 18 nt, Mycobacterium tuberculosis H37Rv
gccucggcgccgcccagc

SEQ ID NO: 1285560 - RNA, 19 nt, Mycobacterium tuberculosis H37Rv
gccucggcgccgcccagca

SEQ ID NO: 1285561 - RNA, 19 nt, Mycobacterium tuberculosis H37Rv
gccucggcgauaccgagga

SEQ ID NO: 1285562 - RNA, 14 nt, Mycobacterium tuberculosis H37Rv
gccucguacggacc

SEQ ID NO: 1285563 - RNA, 13 nt, Mycobacterium tuberculosis H37Rv
gccucugaccagc

SEQ ID NO: 1285564 - RNA, 18 nt, Mycobacterium tuberculosis H37Rv
gccugauaugacuugcgc

SEQ ID NO: 1285565 - RNA, 21 nt, Mycobacterium tuberculosis H37Rv
gccugagccaccaacaccgcg

SEQ ID NO: 1285566 - RNA, 14 nt, Mycobacterium tuberculosis H37Rv
gccugacacgaugc

SEQ ID NO: 1285567 - RNA, 22 nt, Mycobacterium tuberculosis H37Rv
gccugacgcgucagcggcgagc

SEQ ID NO: 1285568 - RNA, 23 nt, Mycobacterium tuberculosis H37Rv
gccugacgcgucagcggcgagca

SEQ ID NO: 1285569 - RNA, 20 nt, Mycobacterium tuberculosis H37Rv
gccugacgcgucagcggcga

SEQ ID NO: 1285570 - RNA, 19 nt, Mycobacterium tuberculosis H37Rv
gccugacgcgucagcggcg

SEQ ID NO: 1285571 - RNA, 21 nt, Mycobacterium tuberculosis H37Rv
gccugacgaaguccaccacga

SEQ ID NO: 1285572 - RNA, 16 nt, Mycobacterium tuberculosis H37Rv
gccugcaguucggcgu

SEQ ID NO: 1285573 - RNA, 24 nt, Mycobacterium tuberculosis H37Rv
gccugaugcugccagaucggucgg

SEQ ID NO: 1285574 - RNA, 16 nt, Mycobacterium tuberculosis H37Rv
gccuuccucggcaagu

SEQ ID NO: 1285575 - RNA, 19 nt, Mycobacterium tuberculosis H37Rv
gccuggucggccaggucga

SEQ ID NO: 1285576 - RNA, 22 nt, Mycobacterium tuberculosis H37Rv
gccuguucgagaucgccgagca

SEQ ID NO: 1285577 - RNA, 13 nt, Mycobacterium tuberculosis H37Rv
gccuggucggcca

SEQ ID NO: 1285578 - RNA, 18 nt, Mycobacterium tuberculosis H37Rv
gccugggugggagcguug

SEQ ID NO: 1285579 - RNA, 21 nt, Mycobacterium tuberculosis H37Rv
gccugguacucccgcgaucgc

SEQ ID NO: 1285580 - RNA, 23 nt, Mycobacterium tuberculosis H37Rv
gccuucguagaaggaccgcucgu

SEQ ID NO: 1285581 - RNA, 17 nt, Mycobacterium tuberculosis H37Rv
gccuucguagaaggacc

SEQ ID NO: 1285582 - RNA, 16 nt, Mycobacterium tuberculosis H37Rv
gccuucguaaccacga

SEQ ID NO: 1285583 - RNA, 21 nt, Mycobacterium tuberculosis H37Rv
gccuucgucgaugcgguaucg

SEQ ID NO: 1285584 - RNA, 16 nt, Mycobacterium tuberculosis H37Rv
gccuucgccagcggcg

SEQ ID NO: 1285585 - RNA, 13 nt, Mycobacterium tuberculosis H37Rv
gccuucgccagcg

SEQ ID NO: 1285586 - RNA, 17 nt, Mycobacterium tuberculosis H37Rv
gccuugcgggcucucgg

SEQ ID NO: 1285587 - RNA, 21 nt, Mycobacterium tuberculosis H37Rv
gccuucucgcgaagaucagcg

SEQ ID NO: 1285588 - RNA, 17 nt, Mycobacterium tuberculosis H37Rv
gccuuggcaguccagcc

SEQ ID NO: 1285589 - RNA, 15 nt, Mycobacterium tuberculosis H37Rv
gccugcuagcagcag

SEQ ID NO: 1285590 - RNA, 18 nt, Mycobacterium tuberculosis H37Rv
gccugcgggccggcaucg

SEQ ID NO: 1285591 - RNA, 14 nt, Mycobacterium tuberculosis H37Rv
gccugcuuggccac

SEQ ID NO: 1285592 - RNA, 20 nt, Mycobacterium tuberculosis H37Rv
gccugcuucaggaucggcga

SEQ ID NO: 1285593 - RNA, 18 nt, Mycobacterium tuberculosis H37Rv
gccugcccagcaccaccg

SEQ ID NO: 1285594 - RNA, 22 nt, Mycobacterium tuberculosis H37Rv
gccugccaucacgcgcucaccg

SEQ ID NO: 1285595 - RNA, 19 nt, Mycobacterium tuberculosis H37Rv
gccugccauaggcccacgg

SEQ ID NO: 1285596 - RNA, 16 nt, Mycobacterium tuberculosis H37Rv
gccugcccaccuucga

SEQ ID NO: 1285597 - RNA, 14 nt, Mycobacterium tuberculosis H37Rv
gccugcccgggaug

SEQ ID NO: 1285598 - RNA, 23 nt, Mycobacterium tuberculosis H37Rv
gccugcccccgcgcgcacggcgu

SEQ ID NO: 1285599 - RNA, 17 nt, Mycobacterium tuberculosis H37Rv
gccugcaguucggcgua

SEQ ID NO: 1285600 - RNA, 19 nt, Mycobacterium tuberculosis H37Rv
gccugccacccggccaggu

SEQ ID NO: 1285601 - RNA, 18 nt, Mycobacterium tuberculosis H37Rv
gccuggaugccgaucggg

SEQ ID NO: 1285602 - RNA, 16 nt, Mycobacterium tuberculosis H37Rv
gccugcuugucaaccc

SEQ ID NO: 1285603 - RNA, 23 nt, Mycobacterium tuberculosis H37Rv
gccuggaaggaaccgaucggucg

SEQ ID NO: 1285604 - RNA, 13 nt, Mycobacterium tuberculosis H37Rv
gccugggacggcg

SEQ ID NO: 1285605 - RNA, 16 nt, Mycobacterium tuberculosis H37Rv
gccugggaaacugggu

SEQ ID NO: 1285606 - RNA, 19 nt, Mycobacterium tuberculosis H37Rv
gccugggcacggccgucga

SEQ ID NO: 1285607 - RNA, 14 nt, Mycobacterium tuberculosis H37Rv
gccuggauggguug

SEQ ID NO: 1285608 - RNA, 23 nt, Mycobacterium tuberculosis H37Rv
gcgaucugcgacaagaccggcgg

SEQ ID NO: 1285609 - RNA, 13 nt, Mycobacterium tuberculosis H37Rv
gcgaucugcagcg

SEQ ID NO: 1285610 - RNA, 13 nt, Mycobacterium tuberculosis H37Rv
gcgaucggcaugu

SEQ ID NO: 1285611 - RNA, 17 nt, Mycobacterium tuberculosis H37Rv
gcgaucgucagccagcg

SEQ ID NO: 1285612 - RNA, 19 nt, Mycobacterium tuberculosis H37Rv
gcgaucgugcugcccgcaa

SEQ ID NO: 1285613 - RNA, 19 nt, Mycobacterium tuberculosis H37Rv
gcgaucuccuccaccagug

SEQ ID NO: 1285614 - RNA, 24 nt, Mycobacterium tuberculosis H37Rv
gcgaucucgaccguauugaccagc

SEQ ID NO: 1285615 - RNA, 15 nt, Mycobacterium tuberculosis H37Rv
gcgaucggugaaucg

SEQ ID NO: 1285616 - RNA, 19 nt, Mycobacterium tuberculosis H37Rv
gcgaucgucaagccgggca

SEQ ID NO: 1285617 - RNA, 23 nt, Mycobacterium tuberculosis H37Rv
gcgaugacgaccgaucggcgcgu

SEQ ID NO: 1285618 - RNA, 22 nt, Mycobacterium tuberculosis H37Rv
gcgaugacgaccgaucggcgcg

SEQ ID NO: 1285619 - RNA, 21 nt, Mycobacterium tuberculosis H37Rv
gcgaugacggugccgaccgcg

SEQ ID NO: 1285620 - RNA, 20 nt, Mycobacterium tuberculosis H37Rv
gcgaugacgaccgaucggcg

SEQ ID NO: 1285621 - RNA, 19 nt, Mycobacterium tuberculosis H37Rv
gcgaugacgaccgaucggc

SEQ ID NO: 1285622 - RNA, 17 nt, Mycobacterium tuberculosis H37Rv
gcgaugaccucggcgau

SEQ ID NO: 1285623 - RNA, 13 nt, Mycobacterium tuberculosis H37Rv
gcgaugacgaccg

SEQ ID NO: 1285624 - RNA, 18 nt, Mycobacterium tuberculosis H37Rv
gcgaugacaaucaccugg

SEQ ID NO: 1285625 - RNA, 21 nt, Mycobacterium tuberculosis H37Rv
gcgaucuuguccagggugguc

SEQ ID NO: 1285626 - RNA, 16 nt, Mycobacterium tuberculosis H37Rv
gcgaugaacagcgacg

SEQ ID NO: 1285627 - RNA, 13 nt, Mycobacterium tuberculosis H37Rv
gcgaugcguccgc

SEQ ID NO: 1285628 - RNA, 17 nt, Mycobacterium tuberculosis H37Rv
gcgaugcggucggccac

SEQ ID NO: 1285629 - RNA, 23 nt, Mycobacterium tuberculosis H37Rv
gcgaugcggcccucgaauucggc

SEQ ID NO: 1285630 - RNA, 11 nt, Mycobacterium tuberculosis H37Rv
gcgaugcgacc

SEQ ID NO: 1285631 - RNA, 16 nt, Mycobacterium tuberculosis H37Rv
gcgaugauuucgucga

SEQ ID NO: 1285632 - RNA, 15 nt, Mycobacterium tuberculosis H37Rv
gcgaugagcgcgauc

SEQ ID NO: 1285633 - RNA, 16 nt, Mycobacterium tuberculosis H37Rv
gcgaugaucgcaucga

SEQ ID NO: 1285634 - RNA, 17 nt, Mycobacterium tuberculosis H37Rv
gcgaugcacgcccagcg

SEQ ID NO: 1285635 - RNA, 21 nt, Mycobacterium tuberculosis H37Rv
gcgaugauuucgucgaucggc

SEQ ID NO: 1285636 - RNA, 22 nt, Mycobacterium tuberculosis H37Rv
gcgaggucggugaggucgaugc

SEQ ID NO: 1285637 - RNA, 16 nt, Mycobacterium tuberculosis H37Rv
gcgaucaggcugccgc

SEQ ID NO: 1285638 - RNA, 18 nt, Mycobacterium tuberculosis H37Rv
gcgaucaguucgugacgu

SEQ ID NO: 1285639 - RNA, 24 nt, Mycobacterium tuberculosis H37Rv
gcgaucgauuccgcucguucgugc

SEQ ID NO: 1285640 - RNA, 22 nt, Mycobacterium tuberculosis H37Rv
gcgaucgccugggcuuggcgac

SEQ ID NO: 1285641 - RNA, 18 nt, Mycobacterium tuberculosis H37Rv
gcgaucgcgacacggcca

SEQ ID NO: 1285642 - RNA, 23 nt, Mycobacterium tuberculosis H37Rv
gcgaucggcacuuagcccgaugg

SEQ ID NO: 1285643 - RNA, 18 nt, Mycobacterium tuberculosis H37Rv
gcgaucggaggcccgcca

SEQ ID NO: 1285644 - RNA, 19 nt, Mycobacterium tuberculosis H37Rv
gcgaucggcgucacgagcc

SEQ ID NO: 1285645 - RNA, 16 nt, Mycobacterium tuberculosis H37Rv
gcgaucgacaccguga

SEQ ID NO: 1285646 - RNA, 20 nt, Mycobacterium tuberculosis H37Rv
gcgaucgacaccgugaccgc

SEQ ID NO: 1285647 - RNA, 16 nt, Mycobacterium tuberculosis H37Rv
gcgaucgacgcucggc

SEQ ID NO: 1285648 - RNA, 18 nt, Mycobacterium tuberculosis H37Rv
gcgaucgauuccgcucgu

SEQ ID NO: 1285649 - RNA, 17 nt, Mycobacterium tuberculosis H37Rv
gcgaucgauuccgcucg

SEQ ID NO: 1285650 - RNA, 16 nt, Mycobacterium tuberculosis H37Rv
gcgauccggggcuggc

SEQ ID NO: 1285651 - RNA, 21 nt, Mycobacterium tuberculosis H37Rv
gcgauccagggccgacgcgaa

SEQ ID NO: 1285652 - RNA, 20 nt, Mycobacterium tuberculosis H37Rv
gcgauccagggccgacgcga

SEQ ID NO: 1285653 - RNA, 13 nt, Mycobacterium tuberculosis H37Rv
gcgcacacccugc

SEQ ID NO: 1285654 - RNA, 17 nt, Mycobacterium tuberculosis H37Rv
gcgcaccaacaccagcg

SEQ ID NO: 1285655 - RNA, 21 nt, Mycobacterium tuberculosis H37Rv
gcgcaaucgaccacgacgugg

SEQ ID NO: 1285656 - RNA, 16 nt, Mycobacterium tuberculosis H37Rv
gcgcaaucgacaccag

SEQ ID NO: 1285657 - RNA, 24 nt, Mycobacterium tuberculosis H37Rv
gcgcaaugccgacgccaacgccag

SEQ ID NO: 1285658 - RNA, 16 nt, Mycobacterium tuberculosis H37Rv
gcgcaaggcgccgcag

SEQ ID NO: 1285659 - RNA, 18 nt, Mycobacterium tuberculosis H37Rv
gcgcaauagcgacagcag

SEQ ID NO: 1285660 - RNA, 14 nt, Mycobacterium tuberculosis H37Rv
gcgcaacgccgcca

SEQ ID NO: 1285661 - RNA, 19 nt, Mycobacterium tuberculosis H37Rv
gcgcaacgccgccagccug

SEQ ID NO: 1285662 - RNA, 23 nt, Mycobacterium tuberculosis H37Rv
gcgcaacacauccaguaaccguc

SEQ ID NO: 1285663 - RNA, 13 nt, Mycobacterium tuberculosis H37Rv
gcgcaaauugcaa

SEQ ID NO: 1285664 - RNA, 22 nt, Mycobacterium tuberculosis H37Rv
gcgcaacaccgugcaccagcuc

SEQ ID NO: 1285665 - RNA, 20 nt, Mycobacterium tuberculosis H37Rv
gcgcaacaccucgucggcuu

SEQ ID NO: 1285666 - RNA, 14 nt, Mycobacterium tuberculosis H37Rv
gcgcaacucgccac

SEQ ID NO: 1285667 - RNA, 15 nt, Mycobacterium tuberculosis H37Rv
gcgcaacggccagcg

SEQ ID NO: 1285668 - RNA, 20 nt, Mycobacterium tuberculosis H37Rv
gcgcaacuucuucagcagcg

SEQ ID NO: 1285669 - RNA, 20 nt, Mycobacterium tuberculosis H37Rv
gcgcaacgggacgucaccgu

SEQ ID NO: 1285670 - RNA, 14 nt, Mycobacterium tuberculosis H37Rv
gcgauuccaggaug

SEQ ID NO: 1285671 - RNA, 17 nt, Mycobacterium tuberculosis H37Rv
gcgauucugcgucugcu

SEQ ID NO: 1285672 - RNA, 17 nt, Mycobacterium tuberculosis H37Rv
gcgauuccgcgucugcu

SEQ ID NO: 1285673 - RNA, 19 nt, Mycobacterium tuberculosis H37Rv
gcgauucugugucugcucg

SEQ ID NO: 1285674 - RNA, 22 nt, Mycobacterium tuberculosis H37Rv
gcgauucugggcuucaucggcg

SEQ ID NO: 1285675 - RNA, 21 nt, Mycobacterium tuberculosis H37Rv
gcgauucugcgucugcucgcc

SEQ ID NO: 1285676 - RNA, 18 nt, Mycobacterium tuberculosis H37Rv
gcgauucugggcuucauc

SEQ ID NO: 1285677 - RNA, 19 nt, Mycobacterium tuberculosis H37Rv
gcgauucugcgucugcucg

SEQ ID NO: 1285678 - RNA, 18 nt, Mycobacterium tuberculosis H37Rv
gcgauucugcgucugcuc

SEQ ID NO: 1285679 - RNA, 17 nt, Mycobacterium tuberculosis H37Rv
gcgauuuccaucgcgac

SEQ ID NO: 1285680 - RNA, 19 nt, Mycobacterium tuberculosis H37Rv
gcgauuuugugucugcucg

SEQ ID NO: 1285681 - RNA, 18 nt, Mycobacterium tuberculosis H37Rv
gcgauuuugugucugcuc

SEQ ID NO: 1285682 - RNA, 19 nt, Mycobacterium tuberculosis H37Rv
gcgauuuugcgucugcucg

SEQ ID NO: 1285683 - RNA, 18 nt, Mycobacterium tuberculosis H37Rv
gcgauuuugcgucugcuc

SEQ ID NO: 1285684 - RNA, 17 nt, Mycobacterium tuberculosis H37Rv
gcgauuuugcgucgcgc

SEQ ID NO: 1285685 - RNA, 14 nt, Mycobacterium tuberculosis H37Rv
gcgauuuucggcac

SEQ ID NO: 1285686 - RNA, 21 nt, Mycobacterium tuberculosis H37Rv
gcgauggguguugcuggccgc

SEQ ID NO: 1285687 - RNA, 15 nt, Mycobacterium tuberculosis H37Rv
gcgaugggccggucc

SEQ ID NO: 1285688 - RNA, 15 nt, Mycobacterium tuberculosis H37Rv
gcgauggucuccucg

SEQ ID NO: 1285689 - RNA, 23 nt, Mycobacterium tuberculosis H37Rv
gcgaugugcgccaccucgacgca

SEQ ID NO: 1285690 - RNA, 20 nt, Mycobacterium tuberculosis H37Rv
gcgaugugcgccaccucgac

SEQ ID NO: 1285691 - RNA, 16 nt, Mycobacterium tuberculosis H37Rv
gcgaugucguucgcgu

SEQ ID NO: 1285692 - RNA, 14 nt, Mycobacterium tuberculosis H37Rv
gcgaugucgcgcau

SEQ ID NO: 1285693 - RNA, 18 nt, Mycobacterium tuberculosis H37Rv
gcgaugcucacuacccgc

SEQ ID NO: 1285694 - RNA, 16 nt, Mycobacterium tuberculosis H37Rv
gcgaugcugaucaccg

SEQ ID NO: 1285695 - RNA, 17 nt, Mycobacterium tuberculosis H37Rv
gcgauggccaucaucga

SEQ ID NO: 1285696 - RNA, 22 nt, Mycobacterium tuberculosis H37Rv
gcgaugcuucccggaugccgac

SEQ ID NO: 1285697 - RNA, 14 nt, Mycobacterium tuberculosis H37Rv
gcgauggcggcauc

SEQ ID NO: 1285698 - RNA, 16 nt, Mycobacterium tuberculosis H37Rv
gcgauggcgguccacc

SEQ ID NO: 1285699 - RNA, 19 nt, Mycobacterium tuberculosis H37Rv
gcgauggccguccgaccga

SEQ ID NO: 1285700 - RNA, 16 nt, Mycobacterium tuberculosis H37Rv
gcgagauccuucgcgu

SEQ ID NO: 1285701 - RNA, 21 nt, Mycobacterium tuberculosis H37Rv
gcgagacuucgacgcggcgac

SEQ ID NO: 1285702 - RNA, 14 nt, Mycobacterium tuberculosis H37Rv
gcgagagcgcggag

SEQ ID NO: 1285703 - RNA, 15 nt, Mycobacterium tuberculosis H37Rv
gcgagaucagcaugc

SEQ ID NO: 1285704 - RNA, 17 nt, Mycobacterium tuberculosis H37Rv
gcgagaggugcugcacc

SEQ ID NO: 1285705 - RNA, 12 nt, Mycobacterium tuberculosis H37Rv
gcgacuccagcg

SEQ ID NO: 1285706 - RNA, 17 nt, Mycobacterium tuberculosis H37Rv
gcgacucgugucugccu

SEQ ID NO: 1285707 - RNA, 22 nt, Mycobacterium tuberculosis H37Rv
gcgagggcggucagcggccaac

SEQ ID NO: 1285708 - RNA, 19 nt, Mycobacterium tuberculosis H37Rv
gcgaggcucgcguggccgc

SEQ ID NO: 1285709 - RNA, 21 nt, Mycobacterium tuberculosis H37Rv
gcgaggcguaaucaagcagcg

SEQ ID NO: 1285710 - RNA, 16 nt, Mycobacterium tuberculosis H37Rv
gcgaggcgucaccccg

SEQ ID NO: 1285711 - RNA, 16 nt, Mycobacterium tuberculosis H37Rv
gcgaggcgcucacccg

SEQ ID NO: 1285712 - RNA, 14 nt, Mycobacterium tuberculosis H37Rv
gcgaggcgcucacc

SEQ ID NO: 1285713 - RNA, 18 nt, Mycobacterium tuberculosis H37Rv
gcgagcguuucaccaguc

SEQ ID NO: 1285714 - RNA, 16 nt, Mycobacterium tuberculosis H37Rv
gcgagcgcuaucaccg

SEQ ID NO: 1285715 - RNA, 18 nt, Mycobacterium tuberculosis H37Rv
gcgagcgcuaucaccgcc

SEQ ID NO: 1285716 - RNA, 13 nt, Mycobacterium tuberculosis H37Rv
gcgagcggcgaac

SEQ ID NO: 1285717 - RNA, 19 nt, Mycobacterium tuberculosis H37Rv
gcgagcggcgaacucgggc

SEQ ID NO: 1285718 - RNA, 19 nt, Mycobacterium tuberculosis H37Rv
gcgagcacccguugaucgc

SEQ ID NO: 1285719 - RNA, 15 nt, Mycobacterium tuberculosis H37Rv
gcgagcgcggcggag

SEQ ID NO: 1285720 - RNA, 19 nt, Mycobacterium tuberculosis H37Rv
gcgacggccaagaucggcg

SEQ ID NO: 1285721 - RNA, 14 nt, Mycobacterium tuberculosis H37Rv
gcgacggccagcgc

SEQ ID NO: 1285722 - RNA, 21 nt, Mycobacterium tuberculosis H37Rv
gcgacggcggcgucgaugagg

SEQ ID NO: 1285723 - RNA, 21 nt, Mycobacterium tuberculosis H37Rv
gcgacggacucccucgaucac

SEQ ID NO: 1285724 - RNA, 16 nt, Mycobacterium tuberculosis H37Rv
gcgaccuccggaaucg

SEQ ID NO: 1285725 - RNA, 19 nt, Mycobacterium tuberculosis H37Rv
gcgaccuccgcgaucaccg

SEQ ID NO: 1285726 - RNA, 14 nt, Mycobacterium tuberculosis H37Rv
gcgaccucacugcg

SEQ ID NO: 1285727 - RNA, 17 nt, Mycobacterium tuberculosis H37Rv
gcgaccgucguccagac

SEQ ID NO: 1285728 - RNA, 13 nt, Mycobacterium tuberculosis H37Rv
gcgaccucacgaa

SEQ ID NO: 1285729 - RNA, 21 nt, Mycobacterium tuberculosis H37Rv
gcgaccucggguugcagcagc

SEQ ID NO: 1285730 - RNA, 19 nt, Mycobacterium tuberculosis H37Rv
gcgaccuccggaaucgccc

SEQ ID NO: 1285731 - RNA, 15 nt, Mycobacterium tuberculosis H37Rv
gcgaccgguucggcg

SEQ ID NO: 1285732 - RNA, 19 nt, Mycobacterium tuberculosis H37Rv
gcgaccggucugaucggcu

SEQ ID NO: 1285733 - RNA, 16 nt, Mycobacterium tuberculosis H37Rv
gcgaccggucugaucg

SEQ ID NO: 1285734 - RNA, 23 nt, Mycobacterium tuberculosis H37Rv
gcgaccgucgauuucgacgacca

SEQ ID NO: 1285735 - RNA, 22 nt, Mycobacterium tuberculosis H37Rv
gcgaccgucagggucaccugcg

SEQ ID NO: 1285736 - RNA, 16 nt, Mycobacterium tuberculosis H37Rv
gcgaccgucguccaga

SEQ ID NO: 1285737 - RNA, 19 nt, Mycobacterium tuberculosis H37Rv
gcgaccgucgggacggcca

SEQ ID NO: 1285738 - RNA, 20 nt, Mycobacterium tuberculosis H37Rv
gcgaccgucgggacggccaa

SEQ ID NO: 1285739 - RNA, 21 nt, Mycobacterium tuberculosis H37Rv
gcgacggucccggcacgucga

SEQ ID NO: 1285740 - RNA, 17 nt, Mycobacterium tuberculosis H37Rv
gcgacgguuucgaccac

SEQ ID NO: 1285741 - RNA, 14 nt, Mycobacterium tuberculosis H37Rv
gcgacguaaagggc

SEQ ID NO: 1285742 - RNA, 15 nt, Mycobacterium tuberculosis H37Rv
gcgacgggucgggca

SEQ ID NO: 1285743 - RNA, 23 nt, Mycobacterium tuberculosis H37Rv
gcgacguugguugcguccgccga

SEQ ID NO: 1285744 - RNA, 20 nt, Mycobacterium tuberculosis H37Rv
gcgacguugguugcguccgc

SEQ ID NO: 1285745 - RNA, 18 nt, Mycobacterium tuberculosis H37Rv
gcgacguugaacucgagu

SEQ ID NO: 1285746 - RNA, 16 nt, Mycobacterium tuberculosis H37Rv
gcgacguuccgcucga

SEQ ID NO: 1285747 - RNA, 15 nt, Mycobacterium tuberculosis H37Rv
gcgacguggcgccga

SEQ ID NO: 1285748 - RNA, 21 nt, Mycobacterium tuberculosis H37Rv
gcgacgucaggguauccacgc

SEQ ID NO: 1285749 - RNA, 20 nt, Mycobacterium tuberculosis H37Rv
gcgacgucucgcaugcucac

SEQ ID NO: 1285750 - RNA, 23 nt, Mycobacterium tuberculosis H37Rv
gcgacgucucgcaugcucacgau

SEQ ID NO: 1285751 - RNA, 17 nt, Mycobacterium tuberculosis H37Rv
gcgaccgcggucgcugc

SEQ ID NO: 1285752 - RNA, 23 nt, Mycobacterium tuberculosis H37Rv
gcgaccgcgggccgacgcaggug

SEQ ID NO: 1285753 - RNA, 15 nt, Mycobacterium tuberculosis H37Rv
gcgaccgcggcgaag

SEQ ID NO: 1285754 - RNA, 22 nt, Mycobacterium tuberculosis H37Rv
gcgaccggcgagcccgcaucgc

SEQ ID NO: 1285755 - RNA, 14 nt, Mycobacterium tuberculosis H37Rv
gcgaccgcgaccgc

SEQ ID NO: 1285756 - RNA, 13 nt, Mycobacterium tuberculosis H37Rv
gcgaccgcgccaa

SEQ ID NO: 1285757 - RNA, 14 nt, Mycobacterium tuberculosis H37Rv
gcgaccgccugcgc

SEQ ID NO: 1285758 - RNA, 23 nt, Mycobacterium tuberculosis H37Rv
gcgaccgcgcacggcuggcguac

SEQ ID NO: 1285759 - RNA, 14 nt, Mycobacterium tuberculosis H37Rv
gcgaccagaaucuc

SEQ ID NO: 1285760 - RNA, 22 nt, Mycobacterium tuberculosis H37Rv
gcgaccaugcuccuaucacugg

SEQ ID NO: 1285761 - RNA, 21 nt, Mycobacterium tuberculosis H37Rv
gcgaccaggucggcuucgaca

SEQ ID NO: 1285762 - RNA, 21 nt, Mycobacterium tuberculosis H37Rv
gcgaccaugaugccuaccggg

SEQ ID NO: 1285763 - RNA, 14 nt, Mycobacterium tuberculosis H37Rv
gcgacauacccgau

SEQ ID NO: 1285764 - RNA, 17 nt, Mycobacterium tuberculosis H37Rv
gcgacauccgcggcaug

SEQ ID NO: 1285765 - RNA, 13 nt, Mycobacterium tuberculosis H37Rv
gcgacaucgguca

SEQ ID NO: 1285766 - RNA, 15 nt, Mycobacterium tuberculosis H37Rv
gcgacaucgggaaug

SEQ ID NO: 1285767 - RNA, 15 nt, Mycobacterium tuberculosis H37Rv
gcgaccacggcaccg

SEQ ID NO: 1285768 - RNA, 14 nt, Mycobacterium tuberculosis H37Rv
gcgaccacgcaccg

SEQ ID NO: 1285769 - RNA, 22 nt, Mycobacterium tuberculosis H37Rv
gcgaccacggcaccgaucaacg

SEQ ID NO: 1285770 - RNA, 18 nt, Mycobacterium tuberculosis H37Rv
gcgaccacggcaccgauc

SEQ ID NO: 1285771 - RNA, 13 nt, Mycobacterium tuberculosis H37Rv
gcgaccacgauga

SEQ ID NO: 1285772 - RNA, 21 nt, Mycobacterium tuberculosis H37Rv
gcgacaacccggcgucgacga

SEQ ID NO: 1285773 - RNA, 21 nt, Mycobacterium tuberculosis H37Rv
gcgacaaaucggucgacgauc

SEQ ID NO: 1285774 - RNA, 21 nt, Mycobacterium tuberculosis H37Rv
gcgacaacaccacggugccga

SEQ ID NO: 1285775 - RNA, 22 nt, Mycobacterium tuberculosis H37Rv
gcgacaacaccacggugccgac

SEQ ID NO: 1285776 - RNA, 16 nt, Mycobacterium tuberculosis H37Rv
gcgacagaugccgggc

SEQ ID NO: 1285777 - RNA, 15 nt, Mycobacterium tuberculosis H37Rv
gcgacagcagcgcca

SEQ ID NO: 1285778 - RNA, 23 nt, Mycobacterium tuberculosis H37Rv
gcgacagacaaacuccgacacca

SEQ ID NO: 1285779 - RNA, 15 nt, Mycobacterium tuberculosis H37Rv
gcgaaugcgauugcc

SEQ ID NO: 1285780 - RNA, 19 nt, Mycobacterium tuberculosis H37Rv
gcgaaucacguggaccacg

SEQ ID NO: 1285781 - RNA, 13 nt, Mycobacterium tuberculosis H37Rv
gcgaaucccguau

SEQ ID NO: 1285782 - RNA, 15 nt, Mycobacterium tuberculosis H37Rv
gcgaauccgcacagg

SEQ ID NO: 1285783 - RNA, 15 nt, Mycobacterium tuberculosis H37Rv
gccuuguucgcccac

SEQ ID NO: 1285784 - RNA, 15 nt, Mycobacterium tuberculosis H37Rv
gccuugucggcgaug

SEQ ID NO: 1285785 - RNA, 19 nt, Mycobacterium tuberculosis H37Rv
gcgaaggauuugauaggcg

SEQ ID NO: 1285786 - RNA, 17 nt, Mycobacterium tuberculosis H37Rv
gccuuguucuuggccac

SEQ ID NO: 1285787 - RNA, 17 nt, Mycobacterium tuberculosis H37Rv
gcgaagggcaccggcga

SEQ ID NO: 1285788 - RNA, 13 nt, Mycobacterium tuberculosis H37Rv
gcgaaggccagca

SEQ ID NO: 1285789 - RNA, 17 nt, Mycobacterium tuberculosis H37Rv
gcgaagucgagugccgc

SEQ ID NO: 1285790 - RNA, 21 nt, Mycobacterium tuberculosis H37Rv
gcgaagucuugaccgcaccgg

SEQ ID NO: 1285791 - RNA, 17 nt, Mycobacterium tuberculosis H37Rv
gcgaagguccgugccga

SEQ ID NO: 1285792 - RNA, 19 nt, Mycobacterium tuberculosis H37Rv
gcgaagggcaccggcgauc

SEQ ID NO: 1285793 - RNA, 18 nt, Mycobacterium tuberculosis H37Rv
gcgaaguacccggcaaac

SEQ ID NO: 1285794 - RNA, 23 nt, Mycobacterium tuberculosis H37Rv
gcgcgacaacccggcgucgacga

SEQ ID NO: 1285795 - RNA, 13 nt, Mycobacterium tuberculosis H37Rv
gcgcgaucaccga

SEQ ID NO: 1285796 - RNA, 17 nt, Mycobacterium tuberculosis H37Rv
gcgcgaucaacgcguug

SEQ ID NO: 1285797 - RNA, 23 nt, Mycobacterium tuberculosis H37Rv
gcgcgaucaacgcguugcacagc

SEQ ID NO: 1285798 - RNA, 20 nt, Mycobacterium tuberculosis H37Rv
gcgcgaucgauuccgcucgu

SEQ ID NO: 1285799 - RNA, 16 nt, Mycobacterium tuberculosis H37Rv
gcgcgaucgcggucaa

SEQ ID NO: 1285800 - RNA, 15 nt, Mycobacterium tuberculosis H37Rv
gcgcgaugcccacgc

SEQ ID NO: 1285801 - RNA, 21 nt, Mycobacterium tuberculosis H37Rv
gcgcgcaacccugccgcgaug

SEQ ID NO: 1285802 - RNA, 19 nt, Mycobacterium tuberculosis H37Rv
gcgcgcagcaguuggucgc

SEQ ID NO: 1285803 - RNA, 21 nt, Mycobacterium tuberculosis H37Rv
gcgcgcagcucgggcucgugu

SEQ ID NO: 1285804 - RNA, 14 nt, Mycobacterium tuberculosis H37Rv
gcgcgcagcgacgc

SEQ ID NO: 1285805 - RNA, 13 nt, Mycobacterium tuberculosis H37Rv
gcgccguggauca

SEQ ID NO: 1285806 - RNA, 23 nt, Mycobacterium tuberculosis H37Rv
gcgccgugcgaucgucaacgacg

SEQ ID NO: 1285807 - RNA, 15 nt, Mycobacterium tuberculosis H37Rv
gcgccuuucggucac

SEQ ID NO: 1285808 - RNA, 17 nt, Mycobacterium tuberculosis H37Rv
gcgccugcugcggccag

SEQ ID NO: 1285809 - RNA, 21 nt, Mycobacterium tuberculosis H37Rv
gcgcgaaaccaguccaucgac

SEQ ID NO: 1285810 - RNA, 15 nt, Mycobacterium tuberculosis H37Rv
gcgccuuugcccgau

SEQ ID NO: 1285811 - RNA, 22 nt, Mycobacterium tuberculosis H37Rv
gcgccuuugagcccgcgaucac

SEQ ID NO: 1285812 - RNA, 16 nt, Mycobacterium tuberculosis H37Rv
gcgcgaagccaccagg

SEQ ID NO: 1285813 - RNA, 16 nt, Mycobacterium tuberculosis H37Rv
gcgcgaacgucaaccg

SEQ ID NO: 1285814 - RNA, 17 nt, Mycobacterium tuberculosis H37Rv
gcgcgaaccccagccga

SEQ ID NO: 1285815 - RNA, 15 nt, Mycobacterium tuberculosis H37Rv
gcgcgaaggucagcg

SEQ ID NO: 1285816 - RNA, 21 nt, Mycobacterium tuberculosis H37Rv
gcgcgaagucuugaccgcacc

SEQ ID NO: 1285817 - RNA, 23 nt, Mycobacterium tuberculosis H37Rv
gcgcgaagucuugaccgcaccgg

SEQ ID NO: 1285818 - RNA, 19 nt, Mycobacterium tuberculosis H37Rv
gcgcgaaguuugcgacgac

SEQ ID NO: 1285819 - RNA, 12 nt, Mycobacterium tuberculosis H37Rv
gcgcgaacguca

SEQ ID NO: 1285820 - RNA, 19 nt, Mycobacterium tuberculosis H37Rv
gcgcgaaccgcuccgagca

SEQ ID NO: 1285821 - RNA, 23 nt, Mycobacterium tuberculosis H37Rv
gcgcgaaccggcccgguccagcc

SEQ ID NO: 1285822 - RNA, 15 nt, Mycobacterium tuberculosis H37Rv
gcgcgaaaccgcaug

SEQ ID NO: 1285823 - RNA, 13 nt, Mycobacterium tuberculosis H37Rv
gcgccguagagcc

SEQ ID NO: 1285824 - RNA, 13 nt, Mycobacterium tuberculosis H37Rv
gcgccgucaacac

SEQ ID NO: 1285825 - RNA, 23 nt, Mycobacterium tuberculosis H37Rv
gcgccguaaagccaacuggucgc

SEQ ID NO: 1285826 - RNA, 18 nt, Mycobacterium tuberculosis H37Rv
gcgccggugcugcgggaa

SEQ ID NO: 1285827 - RNA, 17 nt, Mycobacterium tuberculosis H37Rv
gcgccgucgucgaccac

SEQ ID NO: 1285828 - RNA, 14 nt, Mycobacterium tuberculosis H37Rv
gcgccgucgucgag

SEQ ID NO: 1285829 - RNA, 16 nt, Mycobacterium tuberculosis H37Rv
gcgccgucgucgagca

SEQ ID NO: 1285830 - RNA, 17 nt, Mycobacterium tuberculosis H37Rv
gcgccgucgucgagcac

SEQ ID NO: 1285831 - RNA, 21 nt, Mycobacterium tuberculosis H37Rv
gcgccgucguugugccggucg

SEQ ID NO: 1285832 - RNA, 13 nt, Mycobacterium tuberculosis H37Rv
gcgccgucgccgu

SEQ ID NO: 1285833 - RNA, 19 nt, Mycobacterium tuberculosis H37Rv
gcgccggucggaucgguga

SEQ ID NO: 1285834 - RNA, 20 nt, Mycobacterium tuberculosis H37Rv
gcgccgguccucgucggcga

SEQ ID NO: 1285835 - RNA, 19 nt, Mycobacterium tuberculosis H37Rv
gcgccgguccucgucggcg

SEQ ID NO: 1285836 - RNA, 20 nt, Mycobacterium tuberculosis H37Rv
gcgccgggugaggcggugac

SEQ ID NO: 1285837 - RNA, 22 nt, Mycobacterium tuberculosis H37Rv
gcgccggggacacagcguccgu

SEQ ID NO: 1285838 - RNA, 22 nt, Mycobacterium tuberculosis H37Rv
gcgccggggauaccggucagca

SEQ ID NO: 1285839 - RNA, 17 nt, Mycobacterium tuberculosis H37Rv
gcgccggggacacagcg

SEQ ID NO: 1285840 - RNA, 16 nt, Mycobacterium tuberculosis H37Rv
gcgccgggcguccgcc

SEQ ID NO: 1285841 - RNA, 20 nt, Mycobacterium tuberculosis H37Rv
gcgccggcugccacacaggc

SEQ ID NO: 1285842 - RNA, 15 nt, Mycobacterium tuberculosis H37Rv
gcgccggcuggcggc

SEQ ID NO: 1285843 - RNA, 23 nt, Mycobacterium tuberculosis H37Rv
gcgccggcuagggcccuggcggc

SEQ ID NO: 1285844 - RNA, 15 nt, Mycobacterium tuberculosis H37Rv
gcgccggcgucggcg

SEQ ID NO: 1285845 - RNA, 22 nt, Mycobacterium tuberculosis H37Rv
gcgccggcgguagucggccagc

SEQ ID NO: 1285846 - RNA, 14 nt, Mycobacterium tuberculosis H37Rv
gcgccggcgugcau

SEQ ID NO: 1285847 - RNA, 12 nt, Mycobacterium tuberculosis H37Rv
gcgccggcguuu

SEQ ID NO: 1285848 - RNA, 20 nt, Mycobacterium tuberculosis H37Rv
gcgccggcgguagucggcca

SEQ ID NO: 1285849 - RNA, 14 nt, Mycobacterium tuberculosis H37Rv
gcgccggccgguca

SEQ ID NO: 1285850 - RNA, 17 nt, Mycobacterium tuberculosis H37Rv
gcgccggccgaucggcc

SEQ ID NO: 1285851 - RNA, 23 nt, Mycobacterium tuberculosis H37Rv
gcgccggccgcacgccggccagc

SEQ ID NO: 1285852 - RNA, 20 nt, Mycobacterium tuberculosis H37Rv
gcgccggccaguucggccuu

SEQ ID NO: 1285853 - RNA, 22 nt, Mycobacterium tuberculosis H37Rv
gcgccggccaugccuucggugc

SEQ ID NO: 1285854 - RNA, 14 nt, Mycobacterium tuberculosis H37Rv
gcgccggcccgcag

SEQ ID NO: 1285855 - RNA, 18 nt, Mycobacterium tuberculosis H37Rv
gcgccggccacgagucgc

SEQ ID NO: 1285856 - RNA, 13 nt, Mycobacterium tuberculosis H37Rv
gcgccggcaucgc

SEQ ID NO: 1285857 - RNA, 14 nt, Mycobacterium tuberculosis H37Rv
gcgccgccggaagc

SEQ ID NO: 1285858 - RNA, 14 nt, Mycobacterium tuberculosis H37Rv
gcgccggcagcagc

SEQ ID NO: 1285859 - RNA, 21 nt, Mycobacterium tuberculosis H37Rv
gcgccgccggcaccgccggca

SEQ ID NO: 1285860 - RNA, 12 nt, Mycobacterium tuberculosis H37Rv
gcgccgccgcgu

SEQ ID NO: 1285861 - RNA, 16 nt, Mycobacterium tuberculosis H37Rv
gcgccgccgccgacga

SEQ ID NO: 1285862 - RNA, 21 nt, Mycobacterium tuberculosis H37Rv
gcgccgcccgcgccaccagca

SEQ ID NO: 1285863 - RNA, 17 nt, Mycobacterium tuberculosis H37Rv
gcgccgcccgcgccacc

SEQ ID NO: 1285864 - RNA, 19 nt, Mycobacterium tuberculosis H37Rv
gcgccgauaccggcggcga

SEQ ID NO: 1285865 - RNA, 16 nt, Mycobacterium tuberculosis H37Rv
gcgccgauacccagcg

SEQ ID NO: 1285866 - RNA, 15 nt, Mycobacterium tuberculosis H37Rv
gcgccgacggccagc

SEQ ID NO: 1285867 - RNA, 23 nt, Mycobacterium tuberculosis H37Rv
gcgccgaaacagcacccagacga

SEQ ID NO: 1285868 - RNA, 21 nt, Mycobacterium tuberculosis H37Rv
gcgccgaaacucaagccacgu

SEQ ID NO: 1285869 - RNA, 21 nt, Mycobacterium tuberculosis H37Rv
gcgccgaacaccggcuccagc

SEQ ID NO: 1285870 - RNA, 18 nt, Mycobacterium tuberculosis H37Rv
gcgccgccacugccggca

SEQ ID NO: 1285871 - RNA, 18 nt, Mycobacterium tuberculosis H37Rv
gcgccgccagcaccaccg

SEQ ID NO: 1285872 - RNA, 16 nt, Mycobacterium tuberculosis H37Rv
gcgccgccauugccau

SEQ ID NO: 1285873 - RNA, 13 nt, Mycobacterium tuberculosis H37Rv
gcgccgcagcgau

SEQ ID NO: 1285874 - RNA, 15 nt, Mycobacterium tuberculosis H37Rv
gcgccgccacagcac

SEQ ID NO: 1285875 - RNA, 22 nt, Mycobacterium tuberculosis H37Rv
gcgccgcagcgauauccacaau

SEQ ID NO: 1285876 - RNA, 12 nt, Mycobacterium tuberculosis H37Rv
gcgccgcagcgc

SEQ ID NO: 1285877 - RNA, 23 nt, Mycobacterium tuberculosis H37Rv
gcgccgcaaugacgucgucggcc

SEQ ID NO: 1285878 - RNA, 19 nt, Mycobacterium tuberculosis H37Rv
gcgccgcaaucagacggcg

SEQ ID NO: 1285879 - RNA, 13 nt, Mycobacterium tuberculosis H37Rv
gcgccgaucggca

SEQ ID NO: 1285880 - RNA, 22 nt, Mycobacterium tuberculosis H37Rv
gcgccgaucggcaccgugucga

SEQ ID NO: 1285881 - RNA, 18 nt, Mycobacterium tuberculosis H37Rv
gcgccgcaaccgccgcgu

SEQ ID NO: 1285882 - RNA, 20 nt, Mycobacterium tuberculosis H37Rv
gcgccgcaaccgccgcguca

SEQ ID NO: 1285883 - RNA, 18 nt, Mycobacterium tuberculosis H37Rv
gcgccaucgccuccagcc

SEQ ID NO: 1285884 - RNA, 15 nt, Mycobacterium tuberculosis H37Rv
gcgccaucucgacgg

SEQ ID NO: 1285885 - RNA, 13 nt, Mycobacterium tuberculosis H37Rv
gcgccaucucgac

SEQ ID NO: 1285886 - RNA, 20 nt, Mycobacterium tuberculosis H37Rv
gcgccaucgucgcgccgcgu

SEQ ID NO: 1285887 - RNA, 14 nt, Mycobacterium tuberculosis H37Rv
gcgccccuggcacc

SEQ ID NO: 1285888 - RNA, 19 nt, Mycobacterium tuberculosis H37Rv
gcgccauggaucccacgag

SEQ ID NO: 1285889 - RNA, 12 nt, Mycobacterium tuberculosis H37Rv
gcgccccgaugc

SEQ ID NO: 1285890 - RNA, 13 nt, Mycobacterium tuberculosis H37Rv
gcgcccgcgagag

SEQ ID NO: 1285891 - RNA, 18 nt, Mycobacterium tuberculosis H37Rv
gcgcccggcggaucccga

SEQ ID NO: 1285892 - RNA, 17 nt, Mycobacterium tuberculosis H37Rv
gcgcccggcccgccacc

SEQ ID NO: 1285893 - RNA, 16 nt, Mycobacterium tuberculosis H37Rv
gcgcccguuggccaag

SEQ ID NO: 1285894 - RNA, 16 nt, Mycobacterium tuberculosis H37Rv
gcgcccugagccaccc

SEQ ID NO: 1285895 - RNA, 14 nt, Mycobacterium tuberculosis H37Rv
gcgcccgucgcugg

SEQ ID NO: 1285896 - RNA, 13 nt, Mycobacterium tuberculosis H37Rv
gcgcccgugccgc

SEQ ID NO: 1285897 - RNA, 23 nt, Mycobacterium tuberculosis H37Rv
gcgcccgggguguucgucgacca

SEQ ID NO: 1285898 - RNA, 18 nt, Mycobacterium tuberculosis H37Rv
gcgcccggucacgcugug

SEQ ID NO: 1285899 - RNA, 14 nt, Mycobacterium tuberculosis H37Rv
gcgccacagcagcg

SEQ ID NO: 1285900 - RNA, 21 nt, Mycobacterium tuberculosis H37Rv
gcgccaacgcccccauccggu

SEQ ID NO: 1285901 - RNA, 19 nt, Mycobacterium tuberculosis H37Rv
gcgccaccagcaccgccgc

SEQ ID NO: 1285902 - RNA, 20 nt, Mycobacterium tuberculosis H37Rv
gcgccaccagcaccgccgcu

SEQ ID NO: 1285903 - RNA, 21 nt, Mycobacterium tuberculosis H37Rv
gcgccacccgcgccgcccgcu

SEQ ID NO: 1285904 - RNA, 16 nt, Mycobacterium tuberculosis H37Rv
gcgccaagacgucggc

SEQ ID NO: 1285905 - RNA, 18 nt, Mycobacterium tuberculosis H37Rv
gcgccaacgggcugcccc

SEQ ID NO: 1285906 - RNA, 17 nt, Mycobacterium tuberculosis H37Rv
gcgccaagccgugccgc

SEQ ID NO: 1285907 - RNA, 14 nt, Mycobacterium tuberculosis H37Rv
gcgccaaauccggc

SEQ ID NO: 1285908 - RNA, 21 nt, Mycobacterium tuberculosis H37Rv
gcgccaacagaugccacccag

SEQ ID NO: 1285909 - RNA, 16 nt, Mycobacterium tuberculosis H37Rv
gcgcauuuguugcugc

SEQ ID NO: 1285910 - RNA, 23 nt, Mycobacterium tuberculosis H37Rv
gcgcauuucggaucucgaccucg

SEQ ID NO: 1285911 - RNA, 13 nt, Mycobacterium tuberculosis H37Rv
gcgcauucgccgg

SEQ ID NO: 1285912 - RNA, 20 nt, Mycobacterium tuberculosis H37Rv
gcgcauucgccgggcggcau

SEQ ID NO: 1285913 - RNA, 18 nt, Mycobacterium tuberculosis H37Rv
gcgcaugucgauccggcg

SEQ ID NO: 1285914 - RNA, 20 nt, Mycobacterium tuberculosis H37Rv
gcgcauggacaacagcuugg

SEQ ID NO: 1285915 - RNA, 15 nt, Mycobacterium tuberculosis H37Rv
gcgccaggggugugc

SEQ ID NO: 1285916 - RNA, 15 nt, Mycobacterium tuberculosis H37Rv
gcgccaggcggcaau

SEQ ID NO: 1285917 - RNA, 13 nt, Mycobacterium tuberculosis H37Rv
gcgccacgccacc

SEQ ID NO: 1285918 - RNA, 12 nt, Mycobacterium tuberculosis H37Rv
gcgccagcggug

SEQ ID NO: 1285919 - RNA, 14 nt, Mycobacterium tuberculosis H37Rv
gcgccagcgggcug

SEQ ID NO: 1285920 - RNA, 13 nt, Mycobacterium tuberculosis H37Rv
gcgccacgcaccc

SEQ ID NO: 1285921 - RNA, 21 nt, Mycobacterium tuberculosis H37Rv
gcgccaccguuaccgccguuu

SEQ ID NO: 1285922 - RNA, 19 nt, Mycobacterium tuberculosis H37Rv
gcgccaccguuaccgccgu

SEQ ID NO: 1285923 - RNA, 19 nt, Mycobacterium tuberculosis H37Rv
gcgccaccgugguucggcg

SEQ ID NO: 1285924 - RNA, 15 nt, Mycobacterium tuberculosis H37Rv
gcgccaccggcaccg

SEQ ID NO: 1285925 - RNA, 22 nt, Mycobacterium tuberculosis H37Rv
gcgccaccgccgcugccggugu

SEQ ID NO: 1285926 - RNA, 21 nt, Mycobacterium tuberculosis H37Rv
gcgccaccgaguagaacuucg

SEQ ID NO: 1285927 - RNA, 15 nt, Mycobacterium tuberculosis H37Rv
gcgcgggcucggugg

SEQ ID NO: 1285928 - RNA, 21 nt, Mycobacterium tuberculosis H37Rv
gcgcgggcgggguaucaaccg

SEQ ID NO: 1285929 - RNA, 18 nt, Mycobacterium tuberculosis H37Rv
gcgcggcgugcuugagca

SEQ ID NO: 1285930 - RNA, 12 nt, Mycobacterium tuberculosis H37Rv
gcgcggucaccg

SEQ ID NO: 1285931 - RNA, 14 nt, Mycobacterium tuberculosis H37Rv
gcgcggucaccgcg

SEQ ID NO: 1285932 - RNA, 17 nt, Mycobacterium tuberculosis H37Rv
gcgcgguccaucccgag

SEQ ID NO: 1285933 - RNA, 20 nt, Mycobacterium tuberculosis H37Rv
gcgcgguggucgcgaccgac

SEQ ID NO: 1285934 - RNA, 12 nt, Mycobacterium tuberculosis H37Rv
gcgcggucgcgc

SEQ ID NO: 1285935 - RNA, 12 nt, Mycobacterium tuberculosis H37Rv
gcgcggugguca

SEQ ID NO: 1285936 - RNA, 23 nt, Mycobacterium tuberculosis H37Rv
gcgcgguaccggugucaguccga

SEQ ID NO: 1285937 - RNA, 16 nt, Mycobacterium tuberculosis H37Rv
gcgcgucaggccagcg

SEQ ID NO: 1285938 - RNA, 14 nt, Mycobacterium tuberculosis H37Rv
gcgcgucaggccag

SEQ ID NO: 1285939 - RNA, 17 nt, Mycobacterium tuberculosis H37Rv
gcgcgucaggccagcgc

SEQ ID NO: 1285940 - RNA, 16 nt, Mycobacterium tuberculosis H37Rv
gcgcguauggcucacc

SEQ ID NO: 1285941 - RNA, 20 nt, Mycobacterium tuberculosis H37Rv
gcgcgguuucggcgucaccg

SEQ ID NO: 1285942 - RNA, 16 nt, Mycobacterium tuberculosis H37Rv
gcgcgguuuucggcug

SEQ ID NO: 1285943 - RNA, 18 nt, Mycobacterium tuberculosis H37Rv
gcgcgguuucggcgucac

SEQ ID NO: 1285944 - RNA, 19 nt, Mycobacterium tuberculosis H37Rv
gcgcgguggucagcaccgg

SEQ ID NO: 1285945 - RNA, 22 nt, Mycobacterium tuberculosis H37Rv
gcgcgguguagagcgcaccgcg

SEQ ID NO: 1285946 - RNA, 17 nt, Mycobacterium tuberculosis H37Rv
gcgcgguucgucggcga

SEQ ID NO: 1285947 - RNA, 18 nt, Mycobacterium tuberculosis H37Rv
gcgcggccgugaacggcg

SEQ ID NO: 1285948 - RNA, 22 nt, Mycobacterium tuberculosis H37Rv
gcgcggccguagugcacgucgg

SEQ ID NO: 1285949 - RNA, 13 nt, Mycobacterium tuberculosis H37Rv
gcgcggcccgcau

SEQ ID NO: 1285950 - RNA, 18 nt, Mycobacterium tuberculosis H37Rv
gcgcggcccgcaucguug

SEQ ID NO: 1285951 - RNA, 22 nt, Mycobacterium tuberculosis H37Rv
gcgcggcccgcaucguugccga

SEQ ID NO: 1285952 - RNA, 17 nt, Mycobacterium tuberculosis H37Rv
gcgcggcccagguccgc

SEQ ID NO: 1285953 - RNA, 12 nt, Mycobacterium tuberculosis H37Rv
gcgcggcgccag

SEQ ID NO: 1285954 - RNA, 14 nt, Mycobacterium tuberculosis H37Rv
gcgcggcgaccugu

SEQ ID NO: 1285955 - RNA, 13 nt, Mycobacterium tuberculosis H37Rv
gcgcggcgagggc

SEQ ID NO: 1285956 - RNA, 22 nt, Mycobacterium tuberculosis H37Rv
gcgcggccagcccacucgucga

SEQ ID NO: 1285957 - RNA, 14 nt, Mycobacterium tuberculosis H37Rv
gcgcggccagcagc

SEQ ID NO: 1285958 - RNA, 18 nt, Mycobacterium tuberculosis H37Rv
gcgcggccacgccgauca

SEQ ID NO: 1285959 - RNA, 15 nt, Mycobacterium tuberculosis H37Rv
gcgcgccccgccgca

SEQ ID NO: 1285960 - RNA, 15 nt, Mycobacterium tuberculosis H37Rv
gcgcggcaucccgcc

SEQ ID NO: 1285961 - RNA, 12 nt, Mycobacterium tuberculosis H37Rv
gcgcggcauccc

SEQ ID NO: 1285962 - RNA, 19 nt, Mycobacterium tuberculosis H37Rv
gcgcgccccaccgcgccga

SEQ ID NO: 1285963 - RNA, 12 nt, Mycobacterium tuberculosis H37Rv
gcgcgcccgaca

SEQ ID NO: 1285964 - RNA, 13 nt, Mycobacterium tuberculosis H37Rv
gcgcgcccgacga

SEQ ID NO: 1285965 - RNA, 21 nt, Mycobacterium tuberculosis H37Rv
gcgcgccauuggcgccgccga

SEQ ID NO: 1285966 - RNA, 15 nt, Mycobacterium tuberculosis H37Rv
gcgcgccauuggcgc

SEQ ID NO: 1285967 - RNA, 16 nt, Mycobacterium tuberculosis H37Rv
gcgcguuccaucaggg

SEQ ID NO: 1285968 - RNA, 19 nt, Mycobacterium tuberculosis H37Rv
gcgcguucggcgagcagcg

SEQ ID NO: 1285969 - RNA, 17 nt, Mycobacterium tuberculosis H37Rv
gcgcguucggcgagcag

SEQ ID NO: 1285970 - RNA, 18 nt, Mycobacterium tuberculosis H37Rv
gcgcguucgaccucgacu

SEQ ID NO: 1285971 - RNA, 16 nt, Mycobacterium tuberculosis H37Rv
gcgcguucgaccucga

SEQ ID NO: 1285972 - RNA, 15 nt, Mycobacterium tuberculosis H37Rv
gcgcguucgaccucg

SEQ ID NO: 1285973 - RNA, 17 nt, Mycobacterium tuberculosis H37Rv
gcgcguucggcaccugg

SEQ ID NO: 1285974 - RNA, 18 nt, Mycobacterium tuberculosis H37Rv
gcgcuacagcaucaaccg

SEQ ID NO: 1285975 - RNA, 23 nt, Mycobacterium tuberculosis H37Rv
gcgcguugaccgaacgcacgucg

SEQ ID NO: 1285976 - RNA, 18 nt, Mycobacterium tuberculosis H37Rv
gcgcguugaagucgccgg

SEQ ID NO: 1285977 - RNA, 19 nt, Mycobacterium tuberculosis H37Rv
gcgcgugugcgucgcacga

SEQ ID NO: 1285978 - RNA, 20 nt, Mycobacterium tuberculosis H37Rv
gcgcgugcugcagaucggcc

SEQ ID NO: 1285979 - RNA, 13 nt, Mycobacterium tuberculosis H37Rv
gcgcuagcgguau

SEQ ID NO: 1285980 - RNA, 21 nt, Mycobacterium tuberculosis H37Rv
gcgcucauguucucgaccgcg

SEQ ID NO: 1285981 - RNA, 20 nt, Mycobacterium tuberculosis H37Rv
gcgcucaucacccagcgccg

SEQ ID NO: 1285982 - RNA, 18 nt, Mycobacterium tuberculosis H37Rv
gcgcuggaaugcggucga

SEQ ID NO: 1285983 - RNA, 21 nt, Mycobacterium tuberculosis H37Rv
gcgcugcugccgaugugugga

SEQ ID NO: 1285984 - RNA, 14 nt, Mycobacterium tuberculosis H37Rv
gcgcugcggccagc

SEQ ID NO: 1285985 - RNA, 12 nt, Mycobacterium tuberculosis H37Rv
gcgcugcucacg

SEQ ID NO: 1285986 - RNA, 18 nt, Mycobacterium tuberculosis H37Rv
gcgcugcuugaggucccg

SEQ ID NO: 1285987 - RNA, 17 nt, Mycobacterium tuberculosis H37Rv
gcgcugcagcucacgac

SEQ ID NO: 1285988 - RNA, 22 nt, Mycobacterium tuberculosis H37Rv
gcgcugcccgccgccccguuca

SEQ ID NO: 1285989 - RNA, 21 nt, Mycobacterium tuberculosis H37Rv
gcgcugccaaacuaacggcag

SEQ ID NO: 1285990 - RNA, 14 nt, Mycobacterium tuberculosis H37Rv
gcgcugcagcaugg

SEQ ID NO: 1285991 - RNA, 17 nt, Mycobacterium tuberculosis H37Rv
gcgcugaagguggcgaa

SEQ ID NO: 1285992 - RNA, 17 nt, Mycobacterium tuberculosis H37Rv
gcgcucgcggguucggc

SEQ ID NO: 1285993 - RNA, 22 nt, Mycobacterium tuberculosis H37Rv
gcgcucgcgcgguagucgucgc

SEQ ID NO: 1285994 - RNA, 17 nt, Mycobacterium tuberculosis H37Rv
gcgcucgcucaccggcg

SEQ ID NO: 1285995 - RNA, 15 nt, Mycobacterium tuberculosis H37Rv
gcgcucggccagcau

SEQ ID NO: 1285996 - RNA, 17 nt, Mycobacterium tuberculosis H37Rv
gcgcucgcaccaccacg

SEQ ID NO: 1285997 - RNA, 14 nt, Mycobacterium tuberculosis H37Rv
gcgcucgcaccacc

SEQ ID NO: 1285998 - RNA, 17 nt, Mycobacterium tuberculosis H37Rv
gcgcucgaucacuagcg

SEQ ID NO: 1285999 - RNA, 16 nt, Mycobacterium tuberculosis H37Rv
gcgcucgggcccagcg

SEQ ID NO: 1286000 - RNA, 23 nt, Mycobacterium tuberculosis H37Rv
gcgcucggcgagcaacacgagcg

SEQ ID NO: 1286001 - RNA, 18 nt, Mycobacterium tuberculosis H37Rv
gcggaagcaucggcugcg

SEQ ID NO: 1286002 - RNA, 14 nt, Mycobacterium tuberculosis H37Rv
gcggaagaccggau

SEQ ID NO: 1286003 - RNA, 13 nt, Mycobacterium tuberculosis H37Rv
gcggaagaccgga

SEQ ID NO: 1286004 - RNA, 17 nt, Mycobacterium tuberculosis H37Rv
gcggaaucgcaucggcg

SEQ ID NO: 1286005 - RNA, 21 nt, Mycobacterium tuberculosis H37Rv
gcggaaucaccgaaugcacga

SEQ ID NO: 1286006 - RNA, 22 nt, Mycobacterium tuberculosis H37Rv
gcggaagugucgucggaccucg

SEQ ID NO: 1286007 - RNA, 16 nt, Mycobacterium tuberculosis H37Rv
gcggaacacgaugcgc

SEQ ID NO: 1286008 - RNA, 13 nt, Mycobacterium tuberculosis H37Rv
gcggaacgaugcc

SEQ ID NO: 1286009 - RNA, 14 nt, Mycobacterium tuberculosis H37Rv
gcggaacgauggac

SEQ ID NO: 1286010 - RNA, 17 nt, Mycobacterium tuberculosis H37Rv
gcggaaccguacgccag

SEQ ID NO: 1286011 - RNA, 16 nt, Mycobacterium tuberculosis H37Rv
gcgcugggacggucgc

SEQ ID NO: 1286012 - RNA, 20 nt, Mycobacterium tuberculosis H37Rv
gcgcugggcgcgcucaucga

SEQ ID NO: 1286013 - RNA, 23 nt, Mycobacterium tuberculosis H37Rv
gcgcugggcgcgcucaucgaccg

SEQ ID NO: 1286014 - RNA, 21 nt, Mycobacterium tuberculosis H37Rv
gcgcugggauguucgaucagc

SEQ ID NO: 1286015 - RNA, 14 nt, Mycobacterium tuberculosis H37Rv
gcgcuggcggcgca

SEQ ID NO: 1286016 - RNA, 13 nt, Mycobacterium tuberculosis H37Rv
gcggacaccucgg

SEQ ID NO: 1286017 - RNA, 13 nt, Mycobacterium tuberculosis H37Rv
gcggacaucaccg

SEQ ID NO: 1286018 - RNA, 19 nt, Mycobacterium tuberculosis H37Rv
gcggacaaaagaacgccag

SEQ ID NO: 1286019 - RNA, 18 nt, Mycobacterium tuberculosis H37Rv
gcggacagcaucacgauc

SEQ ID NO: 1286020 - RNA, 19 nt, Mycobacterium tuberculosis H37Rv
gcggacaccuuucuccaca

SEQ ID NO: 1286021 - RNA, 23 nt, Mycobacterium tuberculosis H37Rv
gcggacaccuuucuccacauugg

SEQ ID NO: 1286022 - RNA, 14 nt, Mycobacterium tuberculosis H37Rv
gcggacccgaccgu

SEQ ID NO: 1286023 - RNA, 19 nt, Mycobacterium tuberculosis H37Rv
gcggacccgaccgucgucg

SEQ ID NO: 1286024 - RNA, 15 nt, Mycobacterium tuberculosis H37Rv
gcggacccgccguga

SEQ ID NO: 1286025 - RNA, 17 nt, Mycobacterium tuberculosis H37Rv
gcggacccucgccgaag

SEQ ID NO: 1286026 - RNA, 14 nt, Mycobacterium tuberculosis H37Rv
gcggaccgauuguc

SEQ ID NO: 1286027 - RNA, 17 nt, Mycobacterium tuberculosis H37Rv
gcggacccgaccgucgu

SEQ ID NO: 1286028 - RNA, 15 nt, Mycobacterium tuberculosis H37Rv
gcggacgacgucggg

SEQ ID NO: 1286029 - RNA, 17 nt, Mycobacterium tuberculosis H37Rv
gcggaccugcgccggug

SEQ ID NO: 1286030 - RNA, 15 nt, Mycobacterium tuberculosis H37Rv
gcggaccucggcgac

SEQ ID NO: 1286031 - RNA, 18 nt, Mycobacterium tuberculosis H37Rv
gcggaccugcgagaucgg

SEQ ID NO: 1286032 - RNA, 21 nt, Mycobacterium tuberculosis H37Rv
gcggacgugaccagaucgacg

SEQ ID NO: 1286033 - RNA, 23 nt, Mycobacterium tuberculosis H37Rv
gcggacgguguacaggucgccgg

SEQ ID NO: 1286034 - RNA, 17 nt, Mycobacterium tuberculosis H37Rv
gcggacugacgucgaag

SEQ ID NO: 1286035 - RNA, 17 nt, Mycobacterium tuberculosis H37Rv
gcggagagccugcucgc

SEQ ID NO: 1286036 - RNA, 22 nt, Mycobacterium tuberculosis H37Rv
gcggagacgaucgccaggccga

SEQ ID NO: 1286037 - RNA, 17 nt, Mycobacterium tuberculosis H37Rv
gcggagacgaucgccag

SEQ ID NO: 1286038 - RNA, 21 nt, Mycobacterium tuberculosis H37Rv
gcggagccaggacgacgccga

SEQ ID NO: 1286039 - RNA, 18 nt, Mycobacterium tuberculosis H37Rv
gcggagccaggacgacgc

SEQ ID NO: 1286040 - RNA, 15 nt, Mycobacterium tuberculosis H37Rv
gcggagccgucgcau

SEQ ID NO: 1286041 - RNA, 16 nt, Mycobacterium tuberculosis H37Rv
gcggaggcugggcuga

SEQ ID NO: 1286042 - RNA, 16 nt, Mycobacterium tuberculosis H37Rv
gcggaggguucgccga

SEQ ID NO: 1286043 - RNA, 16 nt, Mycobacterium tuberculosis H37Rv
gcggaggcggccagcc

SEQ ID NO: 1286044 - RNA, 14 nt, Mycobacterium tuberculosis H37Rv
gcggaggcggccag

SEQ ID NO: 1286045 - RNA, 22 nt, Mycobacterium tuberculosis H37Rv
gcggaucaacaggccggcucgc

SEQ ID NO: 1286046 - RNA, 19 nt, Mycobacterium tuberculosis H37Rv
gcggaucaggucuggcgcg

SEQ ID NO: 1286047 - RNA, 19 nt, Mycobacterium tuberculosis H37Rv
gcggaucauccuucgccgg

SEQ ID NO: 1286048 - RNA, 16 nt, Mycobacterium tuberculosis H37Rv
gcggaucgaccgccag

SEQ ID NO: 1286049 - RNA, 14 nt, Mycobacterium tuberculosis H37Rv
gcggaguccgucga

SEQ ID NO: 1286050 - RNA, 14 nt, Mycobacterium tuberculosis H37Rv
gcggaguucgcuga

SEQ ID NO: 1286051 - RNA, 19 nt, Mycobacterium tuberculosis H37Rv
gcggauacaugguccggcc

SEQ ID NO: 1286052 - RNA, 15 nt, Mycobacterium tuberculosis H37Rv
gcggcagcggcgauc

SEQ ID NO: 1286053 - RNA, 20 nt, Mycobacterium tuberculosis H37Rv
gcggcagcuacuaugccaac

SEQ ID NO: 1286054 - RNA, 19 nt, Mycobacterium tuberculosis H37Rv
gcggcagcgaaagcgucga

SEQ ID NO: 1286055 - RNA, 15 nt, Mycobacterium tuberculosis H37Rv
gcggcagcgaucggg

SEQ ID NO: 1286056 - RNA, 18 nt, Mycobacterium tuberculosis H37Rv
gcggcagcgaucggggcg

SEQ ID NO: 1286057 - RNA, 16 nt, Mycobacterium tuberculosis H37Rv
gcggcagcggcguagc

SEQ ID NO: 1286058 - RNA, 17 nt, Mycobacterium tuberculosis H37Rv
gcggcagcgcggccaau

SEQ ID NO: 1286059 - RNA, 23 nt, Mycobacterium tuberculosis H37Rv
gcggcacuuuguagcccgcgauc

SEQ ID NO: 1286060 - RNA, 18 nt, Mycobacterium tuberculosis H37Rv
gcggcagauacucggcga

SEQ ID NO: 1286061 - RNA, 19 nt, Mycobacterium tuberculosis H37Rv
gcggcagauacucggcgac

SEQ ID NO: 1286062 - RNA, 20 nt, Mycobacterium tuberculosis H37Rv
gcggcagauacucggcgacu

SEQ ID NO: 1286063 - RNA, 18 nt, Mycobacterium tuberculosis H37Rv
gcggcagcaacgacgucg

SEQ ID NO: 1286064 - RNA, 14 nt, Mycobacterium tuberculosis H37Rv
gcggcacggugugc

SEQ ID NO: 1286065 - RNA, 13 nt, Mycobacterium tuberculosis H37Rv
gcggcacgucggc

SEQ ID NO: 1286066 - RNA, 21 nt, Mycobacterium tuberculosis H37Rv
gcggcagccaagcgagcggcg

SEQ ID NO: 1286067 - RNA, 23 nt, Mycobacterium tuberculosis H37Rv
gcggcagcauauccgccggcgac

SEQ ID NO: 1286068 - RNA, 13 nt, Mycobacterium tuberculosis H37Rv
gcggcaccacccg

SEQ ID NO: 1286069 - RNA, 15 nt, Mycobacterium tuberculosis H37Rv
gcggcaccacgucga

SEQ ID NO: 1286070 - RNA, 17 nt, Mycobacterium tuberculosis H37Rv
gcggcaccacgucgacc

SEQ ID NO: 1286071 - RNA, 15 nt, Mycobacterium tuberculosis H37Rv
gcggcaccagcaccg

SEQ ID NO: 1286072 - RNA, 18 nt, Mycobacterium tuberculosis H37Rv
gcggcacccagucggcgc

SEQ ID NO: 1286073 - RNA, 13 nt, Mycobacterium tuberculosis H37Rv
gcggcaccgccgc

SEQ ID NO: 1286074 - RNA, 20 nt, Mycobacterium tuberculosis H37Rv
gcggcacgaucgccaacgac

SEQ ID NO: 1286075 - RNA, 15 nt, Mycobacterium tuberculosis H37Rv
gcggcacgaucggca

SEQ ID NO: 1286076 - RNA, 17 nt, Mycobacterium tuberculosis H37Rv
gcggcaagggcuucgga

SEQ ID NO: 1286077 - RNA, 17 nt, Mycobacterium tuberculosis H37Rv
gcggcaacgcggucugc

SEQ ID NO: 1286078 - RNA, 20 nt, Mycobacterium tuberculosis H37Rv
gcggcaacgaucgacaccag

SEQ ID NO: 1286079 - RNA, 22 nt, Mycobacterium tuberculosis H37Rv
gcggcaauucgggcauggucgc

SEQ ID NO: 1286080 - RNA, 22 nt, Mycobacterium tuberculosis H37Rv
gcggcaauggccagcaccacgg

SEQ ID NO: 1286081 - RNA, 21 nt, Mycobacterium tuberculosis H37Rv
gcggcacacccaucaccgcca

SEQ ID NO: 1286082 - RNA, 18 nt, Mycobacterium tuberculosis H37Rv
gcggcacacccaucaccg

SEQ ID NO: 1286083 - RNA, 22 nt, Mycobacterium tuberculosis H37Rv
gcggcacacccaucaccgccag

SEQ ID NO: 1286084 - RNA, 17 nt, Mycobacterium tuberculosis H37Rv
gcggcaacaccaccucg

SEQ ID NO: 1286085 - RNA, 22 nt, Mycobacterium tuberculosis H37Rv
gcggcaacaccaccucgacgag

SEQ ID NO: 1286086 - RNA, 21 nt, Mycobacterium tuberculosis H37Rv
gcggcaaaguuggccgcccga

SEQ ID NO: 1286087 - RNA, 12 nt, Mycobacterium tuberculosis H37Rv
gcggaucgccgg

SEQ ID NO: 1286088 - RNA, 15 nt, Mycobacterium tuberculosis H37Rv
gcggaucgcgcugau

SEQ ID NO: 1286089 - RNA, 22 nt, Mycobacterium tuberculosis H37Rv
gcggaucgcgcugaucagccca

SEQ ID NO: 1286090 - RNA, 21 nt, Mycobacterium tuberculosis H37Rv
gcggaucuguuccucggugac

SEQ ID NO: 1286091 - RNA, 14 nt, Mycobacterium tuberculosis H37Rv
gcggaucguggcgc

SEQ ID NO: 1286092 - RNA, 17 nt, Mycobacterium tuberculosis H37Rv
gcggaucgucgucgugu

SEQ ID NO: 1286093 - RNA, 13 nt, Mycobacterium tuberculosis H37Rv
gcggaucugcugc

SEQ ID NO: 1286094 - RNA, 21 nt, Mycobacterium tuberculosis H37Rv
gcggaucugcugcgagaucuu

SEQ ID NO: 1286095 - RNA, 14 nt, Mycobacterium tuberculosis H37Rv
gcggauucggcguc

SEQ ID NO: 1286096 - RNA, 23 nt, Mycobacterium tuberculosis H37Rv
gcggauucgcgcuguccacgaug

SEQ ID NO: 1286097 - RNA, 17 nt, Mycobacterium tuberculosis H37Rv
gcggauucacgcaccgg

SEQ ID NO: 1286098 - RNA, 17 nt, Mycobacterium tuberculosis H37Rv
gcggauuaagucggcgg

SEQ ID NO: 1286099 - RNA, 19 nt, Mycobacterium tuberculosis H37Rv
gcggaugucgucgaccagg

SEQ ID NO: 1286100 - RNA, 15 nt, Mycobacterium tuberculosis H37Rv
gcggaugucgucgac

SEQ ID NO: 1286101 - RNA, 13 nt, Mycobacterium tuberculosis H37Rv
gcggcgccgccca

SEQ ID NO: 1286102 - RNA, 18 nt, Mycobacterium tuberculosis H37Rv
gcggcgccgccacgguac

SEQ ID NO: 1286103 - RNA, 13 nt, Mycobacterium tuberculosis H37Rv
gcggcgccgcccu

SEQ ID NO: 1286104 - RNA, 12 nt, Mycobacterium tuberculosis H37Rv
gcggcgccguug

SEQ ID NO: 1286105 - RNA, 21 nt, Mycobacterium tuberculosis H37Rv
gcggcgccgugaucagcucgc

SEQ ID NO: 1286106 - RNA, 15 nt, Mycobacterium tuberculosis H37Rv
gcggcgcgaagucuu

SEQ ID NO: 1286107 - RNA, 22 nt, Mycobacterium tuberculosis H37Rv
gcggcgcgacggcauguaccga

SEQ ID NO: 1286108 - RNA, 15 nt, Mycobacterium tuberculosis H37Rv
gcggcgcgaucgacg

SEQ ID NO: 1286109 - RNA, 19 nt, Mycobacterium tuberculosis H37Rv
gcggcgaugguaucgccgc

SEQ ID NO: 1286110 - RNA, 16 nt, Mycobacterium tuberculosis H37Rv
gcggcgaucaggcgga

SEQ ID NO: 1286111 - RNA, 15 nt, Mycobacterium tuberculosis H37Rv
gcggcgaucaccaug

SEQ ID NO: 1286112 - RNA, 15 nt, Mycobacterium tuberculosis H37Rv
gcggcgaucugcgac

SEQ ID NO: 1286113 - RNA, 15 nt, Mycobacterium tuberculosis H37Rv
gcggcgccacccgcg

SEQ ID NO: 1286114 - RNA, 19 nt, Mycobacterium tuberculosis H37Rv
gcggcgccgaaaccgccgg

SEQ ID NO: 1286115 - RNA, 13 nt, Mycobacterium tuberculosis H37Rv
gcggcgccgcaga

SEQ ID NO: 1286116 - RNA, 13 nt, Mycobacterium tuberculosis H37Rv
gcggcgccgcacc

SEQ ID NO: 1286117 - RNA, 15 nt, Mycobacterium tuberculosis H37Rv
gcggcagggccugga

SEQ ID NO: 1286118 - RNA, 15 nt, Mycobacterium tuberculosis H37Rv
gcggcgaaccagcgc

SEQ ID NO: 1286119 - RNA, 22 nt, Mycobacterium tuberculosis H37Rv
gcggcaguaccccucgcacaau

SEQ ID NO: 1286120 - RNA, 20 nt, Mycobacterium tuberculosis H37Rv
gcggcgaacaucaccgucgc

SEQ ID NO: 1286121 - RNA, 20 nt, Mycobacterium tuberculosis H37Rv
gcggcgacauccacaccgcg

SEQ ID NO: 1286122 - RNA, 13 nt, Mycobacterium tuberculosis H37Rv
gcggcgaccaccg

SEQ ID NO: 1286123 - RNA, 15 nt, Mycobacterium tuberculosis H37Rv
gcggcgacacaucgc

SEQ ID NO: 1286124 - RNA, 20 nt, Mycobacterium tuberculosis H37Rv
gcggcgaagauaucggcacg

SEQ ID NO: 1286125 - RNA, 17 nt, Mycobacterium tuberculosis H37Rv
gcggcgaagccgggugc

SEQ ID NO: 1286126 - RNA, 14 nt, Mycobacterium tuberculosis H37Rv
gcggcgagcacgcg

SEQ ID NO: 1286127 - RNA, 16 nt, Mycobacterium tuberculosis H37Rv
gcggcgaguuggccgu

SEQ ID NO: 1286128 - RNA, 22 nt, Mycobacterium tuberculosis H37Rv
gcggcgauaccgguugcgguca

SEQ ID NO: 1286129 - RNA, 17 nt, Mycobacterium tuberculosis H37Rv
gcggcgacgaccgucgg

SEQ ID NO: 1286130 - RNA, 16 nt, Mycobacterium tuberculosis H37Rv
gcggcgacgaccgucg

SEQ ID NO: 1286131 - RNA, 14 nt, Mycobacterium tuberculosis H37Rv
gcggcgacgaccgu

SEQ ID NO: 1286132 - RNA, 13 nt, Mycobacterium tuberculosis H37Rv
gcggcgaccguca

SEQ ID NO: 1286133 - RNA, 18 nt, Mycobacterium tuberculosis H37Rv
gcggcugccagaaugggc

SEQ ID NO: 1286134 - RNA, 13 nt, Mycobacterium tuberculosis H37Rv
gcggcuccaccgg

SEQ ID NO: 1286135 - RNA, 20 nt, Mycobacterium tuberculosis H37Rv
gcggcuaggcaccagcggau

SEQ ID NO: 1286136 - RNA, 13 nt, Mycobacterium tuberculosis H37Rv
gcggcgucgccgu

SEQ ID NO: 1286137 - RNA, 21 nt, Mycobacterium tuberculosis H37Rv
gcggcuacccauggcccguug

SEQ ID NO: 1286138 - RNA, 16 nt, Mycobacterium tuberculosis H37Rv
gcggcuacaucggcgg

SEQ ID NO: 1286139 - RNA, 19 nt, Mycobacterium tuberculosis H37Rv
gcggcgucggugccgcuga

SEQ ID NO: 1286140 - RNA, 14 nt, Mycobacterium tuberculosis H37Rv
gcggcgucgucgau

SEQ ID NO: 1286141 - RNA, 22 nt, Mycobacterium tuberculosis H37Rv
gcggcgucuucgucggagucuu

SEQ ID NO: 1286142 - RNA, 18 nt, Mycobacterium tuberculosis H37Rv
gcggcggaacaccgacga

SEQ ID NO: 1286143 - RNA, 19 nt, Mycobacterium tuberculosis H37Rv
gcggcgguaugccacaggc

SEQ ID NO: 1286144 - RNA, 16 nt, Mycobacterium tuberculosis H37Rv
gcggcggucaccaccg

SEQ ID NO: 1286145 - RNA, 17 nt, Mycobacterium tuberculosis H37Rv
gcggcgguaugccacag

SEQ ID NO: 1286146 - RNA, 21 nt, Mycobacterium tuberculosis H37Rv
gcggcgguaccggaaucggcg

SEQ ID NO: 1286147 - RNA, 16 nt, Mycobacterium tuberculosis H37Rv
gcggcgguaccggaau

SEQ ID NO: 1286148 - RNA, 19 nt, Mycobacterium tuberculosis H37Rv
gcggcgguaccggaaucgg

SEQ ID NO: 1286149 - RNA, 13 nt, Mycobacterium tuberculosis H37Rv
gcggcggauuccg

SEQ ID NO: 1286150 - RNA, 19 nt, Mycobacterium tuberculosis H37Rv
gcggcggauggcgucgacc

SEQ ID NO: 1286151 - RNA, 17 nt, Mycobacterium tuberculosis H37Rv
gcggcggugcagcaggg

SEQ ID NO: 1286152 - RNA, 19 nt, Mycobacterium tuberculosis H37Rv
gcggcggucaccaccgacc

SEQ ID NO: 1286153 - RNA, 22 nt, Mycobacterium tuberculosis H37Rv
gcggcggucugagacucgucga

SEQ ID NO: 1286154 - RNA, 17 nt, Mycobacterium tuberculosis H37Rv
gcggcggucgagcgaac

SEQ ID NO: 1286155 - RNA, 16 nt, Mycobacterium tuberculosis H37Rv
gcggcgguccgcgcga

SEQ ID NO: 1286156 - RNA, 22 nt, Mycobacterium tuberculosis H37Rv
gcggcgguggccagcgucgcga

SEQ ID NO: 1286157 - RNA, 17 nt, Mycobacterium tuberculosis H37Rv
gcggcgguggccagcgu

SEQ ID NO: 1286158 - RNA, 16 nt, Mycobacterium tuberculosis H37Rv
gcggcggugcgucagc

SEQ ID NO: 1286159 - RNA, 18 nt, Mycobacterium tuberculosis H37Rv
gcggcuugucgcggugcg

SEQ ID NO: 1286160 - RNA, 14 nt, Mycobacterium tuberculosis H37Rv
gcggcuucagcacg

SEQ ID NO: 1286161 - RNA, 22 nt, Mycobacterium tuberculosis H37Rv
gcggcugugcccgaucagccgu

SEQ ID NO: 1286162 - RNA, 19 nt, Mycobacterium tuberculosis H37Rv
gcggcugugcccgaucagc

SEQ ID NO: 1286163 - RNA, 23 nt, Mycobacterium tuberculosis H37Rv
gcggcugucacgccugccaccgg

SEQ ID NO: 1286164 - RNA, 16 nt, Mycobacterium tuberculosis H37Rv
gcggcugguguccagc

SEQ ID NO: 1286165 - RNA, 16 nt, Mycobacterium tuberculosis H37Rv
gcggcugcugcgcggu

SEQ ID NO: 1286166 - RNA, 18 nt, Mycobacterium tuberculosis H37Rv
gcggcugcugcgcggugc

SEQ ID NO: 1286167 - RNA, 13 nt, Mycobacterium tuberculosis H37Rv
gcggcugcuuggu

SEQ ID NO: 1286168 - RNA, 15 nt, Mycobacterium tuberculosis H37Rv
gcggcugcuuggucg

SEQ ID NO: 1286169 - RNA, 13 nt, Mycobacterium tuberculosis H37Rv
gcggcugcccacc

SEQ ID NO: 1286170 - RNA, 21 nt, Mycobacterium tuberculosis H37Rv
gcggcuggcccgcaugccggc

SEQ ID NO: 1286171 - RNA, 22 nt, Mycobacterium tuberculosis H37Rv
gcgggcaccuuccacgaucgag

SEQ ID NO: 1286172 - RNA, 14 nt, Mycobacterium tuberculosis H37Rv
gcgggcacucagca

SEQ ID NO: 1286173 - RNA, 21 nt, Mycobacterium tuberculosis H37Rv
gcgggcacaauaggcuccagc

SEQ ID NO: 1286174 - RNA, 18 nt, Mycobacterium tuberculosis H37Rv
gcgggcacaccgcaccug

SEQ ID NO: 1286175 - RNA, 21 nt, Mycobacterium tuberculosis H37Rv
gcgggcaagucgcccagccga

SEQ ID NO: 1286176 - RNA, 16 nt, Mycobacterium tuberculosis H37Rv
gcgggcaacugcagca

SEQ ID NO: 1286177 - RNA, 15 nt, Mycobacterium tuberculosis H37Rv
gcgggcaagccggac

SEQ ID NO: 1286178 - RNA, 16 nt, Mycobacterium tuberculosis H37Rv
gcgggcaagaugaucg

SEQ ID NO: 1286179 - RNA, 13 nt, Mycobacterium tuberculosis H37Rv
gcgggaucaccau

SEQ ID NO: 1286180 - RNA, 21 nt, Mycobacterium tuberculosis H37Rv
gcgggaacggugccgaucggg

SEQ ID NO: 1286181 - RNA, 15 nt, Mycobacterium tuberculosis H37Rv
gcgggaacgaucgau

SEQ ID NO: 1286182 - RNA, 23 nt, Mycobacterium tuberculosis H37Rv
gcgggaacgcggcggcgaacucg

SEQ ID NO: 1286183 - RNA, 15 nt, Mycobacterium tuberculosis H37Rv
gcggcuuugccgguu

SEQ ID NO: 1286184 - RNA, 22 nt, Mycobacterium tuberculosis H37Rv
gcgggaaacccaugcaugcguu

SEQ ID NO: 1286185 - RNA, 18 nt, Mycobacterium tuberculosis H37Rv
gcgggaaccccagcuugg

SEQ ID NO: 1286186 - RNA, 13 nt, Mycobacterium tuberculosis H37Rv
gcgguaggcguug

SEQ ID NO: 1286187 - RNA, 12 nt, Mycobacterium tuberculosis H37Rv
gcgguagcgccg

SEQ ID NO: 1286188 - RNA, 20 nt, Mycobacterium tuberculosis H37Rv
gcgguacguaaucgagcgcg

SEQ ID NO: 1286189 - RNA, 17 nt, Mycobacterium tuberculosis H37Rv
gcgguacgggucgccgg

SEQ ID NO: 1286190 - RNA, 14 nt, Mycobacterium tuberculosis H37Rv
gcgguaccgguguc

SEQ ID NO: 1286191 - RNA, 15 nt, Mycobacterium tuberculosis H37Rv
gcgguaccaucaccg

SEQ ID NO: 1286192 - RNA, 17 nt, Mycobacterium tuberculosis H37Rv
gcgguaccaucaccgcg

SEQ ID NO: 1286193 - RNA, 22 nt, Mycobacterium tuberculosis H37Rv
gcgguaccaaccugcgcggcga

SEQ ID NO: 1286194 - RNA, 21 nt, Mycobacterium tuberculosis H37Rv
gcgguacaucgaccaccucga

SEQ ID NO: 1286195 - RNA, 21 nt, Mycobacterium tuberculosis H37Rv
gcggucaacgcugacgugaag

SEQ ID NO: 1286196 - RNA, 16 nt, Mycobacterium tuberculosis H37Rv
gcgguaucggucagcc

SEQ ID NO: 1286197 - RNA, 21 nt, Mycobacterium tuberculosis H37Rv
gcggucccacucgucgucggu

SEQ ID NO: 1286198 - RNA, 15 nt, Mycobacterium tuberculosis H37Rv
gcggucccuccgacu

SEQ ID NO: 1286199 - RNA, 20 nt, Mycobacterium tuberculosis H37Rv
gcgguccagacaucagugcg

SEQ ID NO: 1286200 - RNA, 17 nt, Mycobacterium tuberculosis H37Rv
gcgguccgagcggcauc

SEQ ID NO: 1286201 - RNA, 23 nt, Mycobacterium tuberculosis H37Rv
gcggucccugaagccagcgcaag

SEQ ID NO: 1286202 - RNA, 20 nt, Mycobacterium tuberculosis H37Rv
gcggucccugaucaaggacc

SEQ ID NO: 1286203 - RNA, 20 nt, Mycobacterium tuberculosis H37Rv
gcggucgaucaacaccaacg

SEQ ID NO: 1286204 - RNA, 20 nt, Mycobacterium tuberculosis H37Rv
gcggugagccgccaggaccg

SEQ ID NO: 1286205 - RNA, 20 nt, Mycobacterium tuberculosis H37Rv
gcggugacgggaucgucggc

SEQ ID NO: 1286206 - RNA, 23 nt, Mycobacterium tuberculosis H37Rv
gcggugacuccgcgcgcggacag

SEQ ID NO: 1286207 - RNA, 16 nt, Mycobacterium tuberculosis H37Rv
gcggugcccagcagcg

SEQ ID NO: 1286208 - RNA, 19 nt, Mycobacterium tuberculosis H37Rv
gcggugaacuucuccacca

SEQ ID NO: 1286209 - RNA, 20 nt, Mycobacterium tuberculosis H37Rv
gcggucuuugagccgguagc

SEQ ID NO: 1286210 - RNA, 22 nt, Mycobacterium tuberculosis H37Rv
gcggucggaaugccgucgccgg

SEQ ID NO: 1286211 - RNA, 19 nt, Mycobacterium tuberculosis H37Rv
gcggucggagucgagcaca

SEQ ID NO: 1286212 - RNA, 20 nt, Mycobacterium tuberculosis H37Rv
gcggucggccacauccagcg

SEQ ID NO: 1286213 - RNA, 19 nt, Mycobacterium tuberculosis H37Rv
gcggucggccacauccagc

SEQ ID NO: 1286214 - RNA, 14 nt, Mycobacterium tuberculosis H37Rv
gcgguguugccgga

SEQ ID NO: 1286215 - RNA, 14 nt, Mycobacterium tuberculosis H37Rv
gcgguguuggacgc

SEQ ID NO: 1286216 - RNA, 13 nt, Mycobacterium tuberculosis H37Rv
gcgguguuggcgc

SEQ ID NO: 1286217 - RNA, 18 nt, Mycobacterium tuberculosis H37Rv
gcgguguuggcgccagcc

SEQ ID NO: 1286218 - RNA, 18 nt, Mycobacterium tuberculosis H37Rv
gcgguggucccgauggcg

SEQ ID NO: 1286219 - RNA, 21 nt, Mycobacterium tuberculosis H37Rv
gcggugugccggucuccgaac

SEQ ID NO: 1286220 - RNA, 21 nt, Mycobacterium tuberculosis H37Rv
gcggugugcucacgcaucgcg

SEQ ID NO: 1286221 - RNA, 17 nt, Mycobacterium tuberculosis H37Rv
gcggugucgucgagguc

SEQ ID NO: 1286222 - RNA, 14 nt, Mycobacterium tuberculosis H37Rv
gcggugggcuucca

SEQ ID NO: 1286223 - RNA, 18 nt, Mycobacterium tuberculosis H37Rv
gcgguggcgucgucggcg

SEQ ID NO: 1286224 - RNA, 14 nt, Mycobacterium tuberculosis H37Rv
gcggugggcacagc

SEQ ID NO: 1286225 - RNA, 12 nt, Mycobacterium tuberculosis H37Rv
gcgguggcgucg

SEQ ID NO: 1286226 - RNA, 23 nt, Mycobacterium tuberculosis H37Rv
gcggugccgccggaaucgagacg

SEQ ID NO: 1286227 - RNA, 15 nt, Mycobacterium tuberculosis H37Rv
gcggugcccgcgaac

SEQ ID NO: 1286228 - RNA, 18 nt, Mycobacterium tuberculosis H37Rv
gcggugaggcagcgaccg

SEQ ID NO: 1286229 - RNA, 13 nt, Mycobacterium tuberculosis H37Rv
gcgggcucggugg

SEQ ID NO: 1286230 - RNA, 18 nt, Mycobacterium tuberculosis H37Rv
gcgggcucgguggcggac

SEQ ID NO: 1286231 - RNA, 16 nt, Mycobacterium tuberculosis H37Rv
gcgggcucguguccgc

SEQ ID NO: 1286232 - RNA, 18 nt, Mycobacterium tuberculosis H37Rv
gcggggaccgcggucaug

SEQ ID NO: 1286233 - RNA, 20 nt, Mycobacterium tuberculosis H37Rv
gcggggaugucgaccgcgag

SEQ ID NO: 1286234 - RNA, 20 nt, Mycobacterium tuberculosis H37Rv
gcggggcagaagucguugcg

SEQ ID NO: 1286235 - RNA, 21 nt, Mycobacterium tuberculosis H37Rv
gcgggcacugguggcgauccg

SEQ ID NO: 1286236 - RNA, 20 nt, Mycobacterium tuberculosis H37Rv
gcgggccagcacccgcucca

SEQ ID NO: 1286237 - RNA, 17 nt, Mycobacterium tuberculosis H37Rv
gcgggccacgaucggcu

SEQ ID NO: 1286238 - RNA, 13 nt, Mycobacterium tuberculosis H37Rv
gcgggcgucgcgg

SEQ ID NO: 1286239 - RNA, 17 nt, Mycobacterium tuberculosis H37Rv
gcgggguugaucaccga

SEQ ID NO: 1286240 - RNA, 15 nt, Mycobacterium tuberculosis H37Rv
gcggguagccgucga

SEQ ID NO: 1286241 - RNA, 23 nt, Mycobacterium tuberculosis H37Rv
gcggggccggcggcucgggugcg

SEQ ID NO: 1286242 - RNA, 17 nt, Mycobacterium tuberculosis H37Rv
gcggggguacgucaccg

SEQ ID NO: 1286243 - RNA, 19 nt, Mycobacterium tuberculosis H37Rv
gcggggucgaacagcucga

SEQ ID NO: 1286244 - RNA, 13 nt, Mycobacterium tuberculosis H37Rv
gcggguggugcca

SEQ ID NO: 1286245 - RNA, 18 nt, Mycobacterium tuberculosis H37Rv
gcgggugcggacaccgag

SEQ ID NO: 1286246 - RNA, 12 nt, Mycobacterium tuberculosis H37Rv
gcgggugcgcug

SEQ ID NO: 1286247 - RNA, 23 nt, Mycobacterium tuberculosis H37Rv
gcgggugcgucgaugccggugug

SEQ ID NO: 1286248 - RNA, 16 nt, Mycobacterium tuberculosis H37Rv
gcggguugucggcgac

SEQ ID NO: 1286249 - RNA, 14 nt, Mycobacterium tuberculosis H37Rv
gcggguuggucccg

SEQ ID NO: 1286250 - RNA, 19 nt, Mycobacterium tuberculosis H37Rv
gcggguuggguggcaccgg

SEQ ID NO: 1286251 - RNA, 23 nt, Mycobacterium tuberculosis H37Rv
gcggguuggguggcaccggucgg

SEQ ID NO: 1286252 - RNA, 21 nt, Mycobacterium tuberculosis H37Rv
gcgguaaagaucuugucgcgu

SEQ ID NO: 1286253 - RNA, 19 nt, Mycobacterium tuberculosis H37Rv
gcgggugacuucguggccu

SEQ ID NO: 1286254 - RNA, 13 nt, Mycobacterium tuberculosis H37Rv
gcgggugccagcc

SEQ ID NO: 1286255 - RNA, 22 nt, Mycobacterium tuberculosis H37Rv
gcgggugaugacgccgucggcg

SEQ ID NO: 1286256 - RNA, 18 nt, Mycobacterium tuberculosis H37Rv
gcgggucgcggcuauggc

SEQ ID NO: 1286257 - RNA, 14 nt, Mycobacterium tuberculosis H37Rv
gcgggucagcucga

SEQ ID NO: 1286258 - RNA, 20 nt, Mycobacterium tuberculosis H37Rv
gcgggucagcucgaccugag

SEQ ID NO: 1286259 - RNA, 21 nt, Mycobacterium tuberculosis H37Rv
gcgucggaccguuucgucggc

SEQ ID NO: 1286260 - RNA, 20 nt, Mycobacterium tuberculosis H37Rv
gcgucgcucgucgucaccga

SEQ ID NO: 1286261 - RNA, 19 nt, Mycobacterium tuberculosis H37Rv
gcgucgucuucuucgcgga

SEQ ID NO: 1286262 - RNA, 13 nt, Mycobacterium tuberculosis H37Rv
gcgucgucgauga

SEQ ID NO: 1286263 - RNA, 19 nt, Mycobacterium tuberculosis H37Rv
gcgucgucugcagaccugu

SEQ ID NO: 1286264 - RNA, 13 nt, Mycobacterium tuberculosis H37Rv
gcgucgucgaguu

SEQ ID NO: 1286265 - RNA, 17 nt, Mycobacterium tuberculosis H37Rv
gcgucgucggcggcgac

SEQ ID NO: 1286266 - RNA, 14 nt, Mycobacterium tuberculosis H37Rv
gcgucggcugccgc

SEQ ID NO: 1286267 - RNA, 16 nt, Mycobacterium tuberculosis H37Rv
gcgucgcaggauuccc

SEQ ID NO: 1286268 - RNA, 21 nt, Mycobacterium tuberculosis H37Rv
gcgucgcaacgcgaucaccuc

SEQ ID NO: 1286269 - RNA, 17 nt, Mycobacterium tuberculosis H37Rv
gcgucgcaacgcgauca

SEQ ID NO: 1286270 - RNA, 16 nt, Mycobacterium tuberculosis H37Rv
gcgucgauggcgucgg

SEQ ID NO: 1286271 - RNA, 20 nt, Mycobacterium tuberculosis H37Rv
gcgucgaucguuccgcugga

SEQ ID NO: 1286272 - RNA, 22 nt, Mycobacterium tuberculosis H37Rv
gcgucgagguggcgcacaucgc

SEQ ID NO: 1286273 - RNA, 20 nt, Mycobacterium tuberculosis H37Rv
gcgucgaucacgucgucagc

SEQ ID NO: 1286274 - RNA, 14 nt, Mycobacterium tuberculosis H37Rv
gcgucgagcgaccc

SEQ ID NO: 1286275 - RNA, 20 nt, Mycobacterium tuberculosis H37Rv
gcgucgagcgacccccagcg

SEQ ID NO: 1286276 - RNA, 15 nt, Mycobacterium tuberculosis H37Rv
gcgucgagguggcgc

SEQ ID NO: 1286277 - RNA, 16 nt, Mycobacterium tuberculosis H37Rv
gcgucgagcucguccu

SEQ ID NO: 1286278 - RNA, 15 nt, Mycobacterium tuberculosis H37Rv
gcgucgagcaccuug

SEQ ID NO: 1286279 - RNA, 21 nt, Mycobacterium tuberculosis H37Rv
gcgucgacaacacgccgucga

SEQ ID NO: 1286280 - RNA, 22 nt, Mycobacterium tuberculosis H37Rv
gcgucgaccaagguguccagca

SEQ ID NO: 1286281 - RNA, 18 nt, Mycobacterium tuberculosis H37Rv
gcgucgaaggugaccagg

SEQ ID NO: 1286282 - RNA, 18 nt, Mycobacterium tuberculosis H37Rv
gcgucgaacugccggacu

SEQ ID NO: 1286283 - RNA, 14 nt, Mycobacterium tuberculosis H37Rv
gcgucgacgucggc

SEQ ID NO: 1286284 - RNA, 14 nt, Mycobacterium tuberculosis H37Rv
gcgucgacggcucc

SEQ ID NO: 1286285 - RNA, 13 nt, Mycobacterium tuberculosis H37Rv
gcgucgacccgaa

SEQ ID NO: 1286286 - RNA, 19 nt, Mycobacterium tuberculosis H37Rv
gcguccugguggcgggauc

SEQ ID NO: 1286287 - RNA, 14 nt, Mycobacterium tuberculosis H37Rv
gcguccggugcacc

SEQ ID NO: 1286288 - RNA, 16 nt, Mycobacterium tuberculosis H37Rv
gcguccgucgucggcg

SEQ ID NO: 1286289 - RNA, 16 nt, Mycobacterium tuberculosis H37Rv
gcgguucucgagcucg

SEQ ID NO: 1286290 - RNA, 15 nt, Mycobacterium tuberculosis H37Rv
gcgguucucgagcuc

SEQ ID NO: 1286291 - RNA, 18 nt, Mycobacterium tuberculosis H37Rv
gcgguuuucggcugccgc

SEQ ID NO: 1286292 - RNA, 22 nt, Mycobacterium tuberculosis H37Rv
gcgguuuccgcacgaucgcccg

SEQ ID NO: 1286293 - RNA, 23 nt, Mycobacterium tuberculosis H37Rv
gcguaaaggccuugggcggcacu

SEQ ID NO: 1286294 - RNA, 18 nt, Mycobacterium tuberculosis H37Rv
gcguccguagcgauucug

SEQ ID NO: 1286295 - RNA, 17 nt, Mycobacterium tuberculosis H37Rv
gcguccggugcaccagg

SEQ ID NO: 1286296 - RNA, 13 nt, Mycobacterium tuberculosis H37Rv
gcgugcugcggac

SEQ ID NO: 1286297 - RNA, 13 nt, Mycobacterium tuberculosis H37Rv
gcgugcuggcgca

SEQ ID NO: 1286298 - RNA, 14 nt, Mycobacterium tuberculosis H37Rv
gcgugcuugaccgc

SEQ ID NO: 1286299 - RNA, 13 nt, Mycobacterium tuberculosis H37Rv
gcgugcuugaccg

SEQ ID NO: 1286300 - RNA, 16 nt, Mycobacterium tuberculosis H37Rv
gcgugcuugagcacgu

SEQ ID NO: 1286301 - RNA, 15 nt, Mycobacterium tuberculosis H37Rv
gcgugcugugcucac

SEQ ID NO: 1286302 - RNA, 17 nt, Mycobacterium tuberculosis H37Rv
gcguggcccucggcgau

SEQ ID NO: 1286303 - RNA, 16 nt, Mycobacterium tuberculosis H37Rv
gcguggcccucggcga

SEQ ID NO: 1286304 - RNA, 13 nt, Mycobacterium tuberculosis H37Rv
gcgugcugccgcc

SEQ ID NO: 1286305 - RNA, 18 nt, Mycobacterium tuberculosis H37Rv
gcgugcaucgcgauuccg

SEQ ID NO: 1286306 - RNA, 16 nt, Mycobacterium tuberculosis H37Rv
gcgugcaucgcgauuc

SEQ ID NO: 1286307 - RNA, 15 nt, Mycobacterium tuberculosis H37Rv
gcgugcauaggccgc

SEQ ID NO: 1286308 - RNA, 20 nt, Mycobacterium tuberculosis H37Rv
gcgucugacaucgucgacga

SEQ ID NO: 1286309 - RNA, 23 nt, Mycobacterium tuberculosis H37Rv
gcgucucgaugagcgcgaaguac

SEQ ID NO: 1286310 - RNA, 21 nt, Mycobacterium tuberculosis H37Rv
gcgucugagcgccggcaucgc

SEQ ID NO: 1286311 - RNA, 20 nt, Mycobacterium tuberculosis H37Rv
gcgucugagcgccggcaucg

SEQ ID NO: 1286312 - RNA, 18 nt, Mycobacterium tuberculosis H37Rv
gcgucugcccgcccagcc

SEQ ID NO: 1286313 - RNA, 16 nt, Mycobacterium tuberculosis H37Rv
gcgugcacacccgcaa

SEQ ID NO: 1286314 - RNA, 17 nt, Mycobacterium tuberculosis H37Rv
gcgugcacaggucagcg

SEQ ID NO: 1286315 - RNA, 15 nt, Mycobacterium tuberculosis H37Rv
gcgugacgggcagga

SEQ ID NO: 1286316 - RNA, 20 nt, Mycobacterium tuberculosis H37Rv
gcgugcagaauccguucgac

SEQ ID NO: 1286317 - RNA, 23 nt, Mycobacterium tuberculosis H37Rv
gcgugcagaauccguucgacgag

SEQ ID NO: 1286318 - RNA, 19 nt, Mycobacterium tuberculosis H37Rv
gcgugcagaauccguucga

SEQ ID NO: 1286319 - RNA, 13 nt, Mycobacterium tuberculosis H37Rv
gcgugcagaaucc

SEQ ID NO: 1286320 - RNA, 23 nt, Mycobacterium tuberculosis H37Rv
gcgugcagcaggaaguagccgag

SEQ ID NO: 1286321 - RNA, 18 nt, Mycobacterium tuberculosis H37Rv
gcguggucgccccgauga

SEQ ID NO: 1286322 - RNA, 22 nt, Mycobacterium tuberculosis H37Rv
gcguggucggcaaagcgcucgu

SEQ ID NO: 1286323 - RNA, 21 nt, Mycobacterium tuberculosis H37Rv
gcgugguaccgcuuguccacc

SEQ ID NO: 1286324 - RNA, 14 nt, Mycobacterium tuberculosis H37Rv
gcgugguucggucg

SEQ ID NO: 1286325 - RNA, 13 nt, Mycobacterium tuberculosis H37Rv
gcgugguguccac

SEQ ID NO: 1286326 - RNA, 15 nt, Mycobacterium tuberculosis H37Rv
gcguggucggcgaac

SEQ ID NO: 1286327 - RNA, 20 nt, Mycobacterium tuberculosis H37Rv
gcguggugauccggucuccg

SEQ ID NO: 1286328 - RNA, 19 nt, Mycobacterium tuberculosis H37Rv
gcguggugaagucggugcc

SEQ ID NO: 1286329 - RNA, 20 nt, Mycobacterium tuberculosis H37Rv
gcguggugaagucggugccg

SEQ ID NO: 1286330 - RNA, 23 nt, Mycobacterium tuberculosis H37Rv
gcgugggcagcgcgaucaccgag

SEQ ID NO: 1286331 - RNA, 17 nt, Mycobacterium tuberculosis H37Rv
gcguggcuugguggucg

SEQ ID NO: 1286332 - RNA, 14 nt, Mycobacterium tuberculosis H37Rv
gcgugggcauuccc

SEQ ID NO: 1286333 - RNA, 14 nt, Mycobacterium tuberculosis H37Rv
gcgugggccugcgc

SEQ ID NO: 1286334 - RNA, 14 nt, Mycobacterium tuberculosis H37Rv
gcguuacgcucggc

SEQ ID NO: 1286335 - RNA, 20 nt, Mycobacterium tuberculosis H37Rv
gcguuaaugcuucgcgucga

SEQ ID NO: 1286336 - RNA, 16 nt, Mycobacterium tuberculosis H37Rv
gcguguugcguucggu

SEQ ID NO: 1286337 - RNA, 17 nt, Mycobacterium tuberculosis H37Rv
gcguguccuuugccacc

SEQ ID NO: 1286338 - RNA, 16 nt, Mycobacterium tuberculosis H37Rv
gcguguagccugcggc

SEQ ID NO: 1286339 - RNA, 18 nt, Mycobacterium tuberculosis H37Rv
gcguuccaacucgguucg

SEQ ID NO: 1286340 - RNA, 12 nt, Mycobacterium tuberculosis H37Rv
gcguucaucauc

SEQ ID NO: 1286341 - RNA, 20 nt, Mycobacterium tuberculosis H37Rv
gcguuccauggcccgcucgu

SEQ ID NO: 1286342 - RNA, 21 nt, Mycobacterium tuberculosis H37Rv
gcguuccauuugaguuggucc

SEQ ID NO: 1286343 - RNA, 17 nt, Mycobacterium tuberculosis H37Rv
gcguucggcgagcagcg

SEQ ID NO: 1286344 - RNA, 17 nt, Mycobacterium tuberculosis H37Rv
gcucagcaacgucacgu

SEQ ID NO: 1286345 - RNA, 15 nt, Mycobacterium tuberculosis H37Rv
gcucacgguggccgc

SEQ ID NO: 1286346 - RNA, 13 nt, Mycobacterium tuberculosis H37Rv
gcucacgguggcc

SEQ ID NO: 1286347 - RNA, 19 nt, Mycobacterium tuberculosis H37Rv
gcucacguaaccagugacc

SEQ ID NO: 1286348 - RNA, 22 nt, Mycobacterium tuberculosis H37Rv
gcucaccggggccgucggcaau

SEQ ID NO: 1286349 - RNA, 15 nt, Mycobacterium tuberculosis H37Rv
gcucaccucaugauc

SEQ ID NO: 1286350 - RNA, 22 nt, Mycobacterium tuberculosis H37Rv
gcucaccucaugaucucaccac

SEQ ID NO: 1286351 - RNA, 17 nt, Mycobacterium tuberculosis H37Rv
gcucaccgcgcaucauc

SEQ ID NO: 1286352 - RNA, 17 nt, Mycobacterium tuberculosis H37Rv
gcucaccggcgcccagc

SEQ ID NO: 1286353 - RNA, 17 nt, Mycobacterium tuberculosis H37Rv
gcucaccgaacgcgaug

SEQ ID NO: 1286354 - RNA, 14 nt, Mycobacterium tuberculosis H37Rv
gcucacgaucaccc

SEQ ID NO: 1286355 - RNA, 21 nt, Mycobacterium tuberculosis H37Rv
gcucacgcugaagccgcugga

SEQ ID NO: 1286356 - RNA, 17 nt, Mycobacterium tuberculosis H37Rv
gcucacggcggcgaacu

SEQ ID NO: 1286357 - RNA, 23 nt, Mycobacterium tuberculosis H37Rv
gcucacggacgcugggcgguagc

SEQ ID NO: 1286358 - RNA, 15 nt, Mycobacterium tuberculosis H37Rv
gcucacggacgcugg

SEQ ID NO: 1286359 - RNA, 22 nt, Mycobacterium tuberculosis H37Rv
gcucaggguguucacguucagc

SEQ ID NO: 1286360 - RNA, 22 nt, Mycobacterium tuberculosis H37Rv
gcucaggaacaaugagaucggg

SEQ ID NO: 1286361 - RNA, 22 nt, Mycobacterium tuberculosis H37Rv
gcucagcugguggcggcgguac

SEQ ID NO: 1286362 - RNA, 14 nt, Mycobacterium tuberculosis H37Rv
gcucagcuucgcgu

SEQ ID NO: 1286363 - RNA, 15 nt, Mycobacterium tuberculosis H37Rv
gcucagcuggucggc

SEQ ID NO: 1286364 - RNA, 20 nt, Mycobacterium tuberculosis H37Rv
gcucagcugagaugaggaug

SEQ ID NO: 1286365 - RNA, 14 nt, Mycobacterium tuberculosis H37Rv
gcucagcgugcgcu

SEQ ID NO: 1286366 - RNA, 17 nt, Mycobacterium tuberculosis H37Rv
gcucagcgcggccacgc

SEQ ID NO: 1286367 - RNA, 21 nt, Mycobacterium tuberculosis H37Rv
gcucagcggcgaccgcauccg

SEQ ID NO: 1286368 - RNA, 14 nt, Mycobacterium tuberculosis H37Rv
gcucagccguucgc

SEQ ID NO: 1286369 - RNA, 22 nt, Mycobacterium tuberculosis H37Rv
gcucagcgcagcaucgucgcca

SEQ ID NO: 1286370 - RNA, 18 nt, Mycobacterium tuberculosis H37Rv
gcucaucugcgcgcggaa

SEQ ID NO: 1286371 - RNA, 14 nt, Mycobacterium tuberculosis H37Rv
gcucaucgaccgcg

SEQ ID NO: 1286372 - RNA, 15 nt, Mycobacterium tuberculosis H37Rv
gcucaucaccggcgc

SEQ ID NO: 1286373 - RNA, 14 nt, Mycobacterium tuberculosis H37Rv
gcuccacccaccug

SEQ ID NO: 1286374 - RNA, 17 nt, Mycobacterium tuberculosis H37Rv
gcuccagcaccgugacc

SEQ ID NO: 1286375 - RNA, 19 nt, Mycobacterium tuberculosis H37Rv
gcuaggucaggugauucgc

SEQ ID NO: 1286376 - RNA, 19 nt, Mycobacterium tuberculosis H37Rv
gcuagugugaccgucagcc

SEQ ID NO: 1286377 - RNA, 19 nt, Mycobacterium tuberculosis H37Rv
gcuaguugggugggugcag

SEQ ID NO: 1286378 - RNA, 20 nt, Mycobacterium tuberculosis H37Rv
gcuagcgccaaauccggcuu

SEQ ID NO: 1286379 - RNA, 22 nt, Mycobacterium tuberculosis H37Rv
gcuagcggauucagcgucgcca

SEQ ID NO: 1286380 - RNA, 15 nt, Mycobacterium tuberculosis H37Rv
gcuagcgcuugcgac

SEQ ID NO: 1286381 - RNA, 15 nt, Mycobacterium tuberculosis H37Rv
gcuaucccaggggca

SEQ ID NO: 1286382 - RNA, 22 nt, Mycobacterium tuberculosis H37Rv
gcuauggcauuaccacuucggc

SEQ ID NO: 1286383 - RNA, 22 nt, Mycobacterium tuberculosis H37Rv
gcuaugcgccgcaugccaccga

SEQ ID NO: 1286384 - RNA, 16 nt, Mycobacterium tuberculosis H37Rv
gcucacccgcccggaa

SEQ ID NO: 1286385 - RNA, 20 nt, Mycobacterium tuberculosis H37Rv
gcucacauacagcaggccgc

SEQ ID NO: 1286386 - RNA, 16 nt, Mycobacterium tuberculosis H37Rv
gcucacagcacagcgc

SEQ ID NO: 1286387 - RNA, 16 nt, Mycobacterium tuberculosis H37Rv
gcucaaaucaugcgau

SEQ ID NO: 1286388 - RNA, 14 nt, Mycobacterium tuberculosis H37Rv
gcucaacaccagcc

SEQ ID NO: 1286389 - RNA, 21 nt, Mycobacterium tuberculosis H37Rv
gcucaacacgagcgguacgcc

SEQ ID NO: 1286390 - RNA, 18 nt, Mycobacterium tuberculosis H37Rv
gcuacgggccgcgguacc

SEQ ID NO: 1286391 - RNA, 21 nt, Mycobacterium tuberculosis H37Rv
gcuacggggcggucgagccac

SEQ ID NO: 1286392 - RNA, 13 nt, Mycobacterium tuberculosis H37Rv
gcuacgcgcgcuc

SEQ ID NO: 1286393 - RNA, 16 nt, Mycobacterium tuberculosis H37Rv
gcuacguuacgccgag

SEQ ID NO: 1286394 - RNA, 22 nt, Mycobacterium tuberculosis H37Rv
gcuacgucggcucgucgcucga

SEQ ID NO: 1286395 - RNA, 16 nt, Mycobacterium tuberculosis H37Rv
gcuacgucgaccgacg

SEQ ID NO: 1286396 - RNA, 24 nt, Mycobacterium tuberculosis H37Rv
gcuagcagcagcccgacagugguc

SEQ ID NO: 1286397 - RNA, 20 nt, Mycobacterium tuberculosis H37Rv
gcuacuggugugacgauccc

SEQ ID NO: 1286398 - RNA, 20 nt, Mycobacterium tuberculosis H37Rv
gcuagcagagacaugccggc

SEQ ID NO: 1286399 - RNA, 14 nt, Mycobacterium tuberculosis H37Rv
gcuagccguucggc

SEQ ID NO: 1286400 - RNA, 24 nt, Mycobacterium tuberculosis H37Rv
gcuagccccgaucaucgacgauuc

SEQ ID NO: 1286401 - RNA, 23 nt, Mycobacterium tuberculosis H37Rv
gcuagccccgaucaucgacgauu

SEQ ID NO: 1286402 - RNA, 17 nt, Mycobacterium tuberculosis H37Rv
gcguugcaccauucgca

SEQ ID NO: 1286403 - RNA, 16 nt, Mycobacterium tuberculosis H37Rv
gcguugcacagcagcg

SEQ ID NO: 1286404 - RNA, 21 nt, Mycobacterium tuberculosis H37Rv
gcguugcaggaaaguggccga

SEQ ID NO: 1286405 - RNA, 17 nt, Mycobacterium tuberculosis H37Rv
gcguugauacgcgucga

SEQ ID NO: 1286406 - RNA, 20 nt, Mycobacterium tuberculosis H37Rv
gcguucgggcuccagcagcg

SEQ ID NO: 1286407 - RNA, 20 nt, Mycobacterium tuberculosis H37Rv
gcguucgggcccguagccga

SEQ ID NO: 1286408 - RNA, 18 nt, Mycobacterium tuberculosis H37Rv
gcuaccgcccgcgccacc

SEQ ID NO: 1286409 - RNA, 13 nt, Mycobacterium tuberculosis H37Rv
gcuacccgcgcga

SEQ ID NO: 1286410 - RNA, 13 nt, Mycobacterium tuberculosis H37Rv
gcuaccgccggag

SEQ ID NO: 1286411 - RNA, 21 nt, Mycobacterium tuberculosis H37Rv
gcuacccccgauggcgucgcc

SEQ ID NO: 1286412 - RNA, 17 nt, Mycobacterium tuberculosis H37Rv
gcuaccccgcagaaucc

SEQ ID NO: 1286413 - RNA, 23 nt, Mycobacterium tuberculosis H37Rv
gcuacccauggcccguuggcagc

SEQ ID NO: 1286414 - RNA, 20 nt, Mycobacterium tuberculosis H37Rv
gcguugcaucagcacgucgc

SEQ ID NO: 1286415 - RNA, 16 nt, Mycobacterium tuberculosis H37Rv
gcugugaacaggccga

SEQ ID NO: 1286416 - RNA, 12 nt, Mycobacterium tuberculosis H37Rv
gcugucggugcc

SEQ ID NO: 1286417 - RNA, 18 nt, Mycobacterium tuberculosis H37Rv
gcugugcaggcgggaacg

SEQ ID NO: 1286418 - RNA, 15 nt, Mycobacterium tuberculosis H37Rv
gcugugccuucgccu

SEQ ID NO: 1286419 - RNA, 15 nt, Mycobacterium tuberculosis H37Rv
gcugugcgcuggucg

SEQ ID NO: 1286420 - RNA, 18 nt, Mycobacterium tuberculosis H37Rv
gcuggugcgcccaucaug

SEQ ID NO: 1286421 - RNA, 23 nt, Mycobacterium tuberculosis H37Rv
gcuggugaucagcucagugaugc

SEQ ID NO: 1286422 - RNA, 23 nt, Mycobacterium tuberculosis H37Rv
gcuggggaacagcagcgcacugc

SEQ ID NO: 1286423 - RNA, 23 nt, Mycobacterium tuberculosis H37Rv
gcugguccuccaaggcggucacc

SEQ ID NO: 1286424 - RNA, 16 nt, Mycobacterium tuberculosis H37Rv
gcugguccgggugccg

SEQ ID NO: 1286425 - RNA, 14 nt, Mycobacterium tuberculosis H37Rv
gcugguccuugucg

SEQ ID NO: 1286426 - RNA, 15 nt, Mycobacterium tuberculosis H37Rv
gcuggucgugggcca

SEQ ID NO: 1286427 - RNA, 14 nt, Mycobacterium tuberculosis H37Rv
gcuggucggagacc

SEQ ID NO: 1286428 - RNA, 19 nt, Mycobacterium tuberculosis H37Rv
gcuggucgcugcugcgauc

SEQ ID NO: 1286429 - RNA, 14 nt, Mycobacterium tuberculosis H37Rv
gcuggccucgucgc

SEQ ID NO: 1286430 - RNA, 18 nt, Mycobacterium tuberculosis H37Rv
gcuggcgaacucgagguc

SEQ ID NO: 1286431 - RNA, 14 nt, Mycobacterium tuberculosis H37Rv
gcuggccuccagcu

SEQ ID NO: 1286432 - RNA, 13 nt, Mycobacterium tuberculosis H37Rv
gcuggccgaaccg

SEQ ID NO: 1286433 - RNA, 16 nt, Mycobacterium tuberculosis H37Rv
gcuggcgauacagcga

SEQ ID NO: 1286434 - RNA, 18 nt, Mycobacterium tuberculosis H37Rv
gcuggcgagcagacgcga

SEQ ID NO: 1286435 - RNA, 17 nt, Mycobacterium tuberculosis H37Rv
gcuggcgcccccgacga

SEQ ID NO: 1286436 - RNA, 20 nt, Mycobacterium tuberculosis H37Rv
gcuggcgcccccgacgacgg

SEQ ID NO: 1286437 - RNA, 13 nt, Mycobacterium tuberculosis H37Rv
gcuggcgccgaag

SEQ ID NO: 1286438 - RNA, 18 nt, Mycobacterium tuberculosis H37Rv
gcuggcgccgccggugcc

SEQ ID NO: 1286439 - RNA, 19 nt, Mycobacterium tuberculosis H37Rv
gcuggcggguuggucccga

SEQ ID NO: 1286440 - RNA, 14 nt, Mycobacterium tuberculosis H37Rv
gcuggcgucaccgc

SEQ ID NO: 1286441 - RNA, 13 nt, Mycobacterium tuberculosis H37Rv
gcuggcgggcgau

SEQ ID NO: 1286442 - RNA, 23 nt, Mycobacterium tuberculosis H37Rv
gcuggcgggcagcuguucggcca

SEQ ID NO: 1286443 - RNA, 20 nt, Mycobacterium tuberculosis H37Rv
gcugggcccgccgucaccgc

SEQ ID NO: 1286444 - RNA, 20 nt, Mycobacterium tuberculosis H37Rv
gcugcgguaagaaucgaagc

SEQ ID NO: 1286445 - RNA, 15 nt, Mycobacterium tuberculosis H37Rv
gcugccggccagacg

SEQ ID NO: 1286446 - RNA, 17 nt, Mycobacterium tuberculosis H37Rv
gcugcgguaagaaucga

SEQ ID NO: 1286447 - RNA, 22 nt, Mycobacterium tuberculosis H37Rv
gcugcuccaguucgccguuguc

SEQ ID NO: 1286448 - RNA, 15 nt, Mycobacterium tuberculosis H37Rv
gcugcucgaucaucg

SEQ ID NO: 1286449 - RNA, 19 nt, Mycobacterium tuberculosis H37Rv
gcugcucugagcuuggucg

SEQ ID NO: 1286450 - RNA, 20 nt, Mycobacterium tuberculosis H37Rv
gcugcucugagcuuggucgc

SEQ ID NO: 1286451 - RNA, 20 nt, Mycobacterium tuberculosis H37Rv
gcugcucgugagccccagcg

SEQ ID NO: 1286452 - RNA, 18 nt, Mycobacterium tuberculosis H37Rv
gcugcggguagccgucga

SEQ ID NO: 1286453 - RNA, 20 nt, Mycobacterium tuberculosis H37Rv
gcugcggcuuggccaucacg

SEQ ID NO: 1286454 - RNA, 19 nt, Mycobacterium tuberculosis H37Rv
gcugcggguagccgucgau

SEQ ID NO: 1286455 - RNA, 14 nt, Mycobacterium tuberculosis H37Rv
gcugcgggcggucc

SEQ ID NO: 1286456 - RNA, 14 nt, Mycobacterium tuberculosis H37Rv
gcugccggccgcgu

SEQ ID NO: 1286457 - RNA, 14 nt, Mycobacterium tuberculosis H37Rv
gcugccggcagcgu

SEQ ID NO: 1286458 - RNA, 17 nt, Mycobacterium tuberculosis H37Rv
gcugccggcccaccagg

SEQ ID NO: 1286459 - RNA, 23 nt, Mycobacterium tuberculosis H37Rv
gcugccggcacgcaugccgguga

SEQ ID NO: 1286460 - RNA, 15 nt, Mycobacterium tuberculosis H37Rv
gcugccggcaacagc

SEQ ID NO: 1286461 - RNA, 17 nt, Mycobacterium tuberculosis H37Rv
gcugcuuggucgcccag

SEQ ID NO: 1286462 - RNA, 20 nt, Mycobacterium tuberculosis H37Rv
gcugcugucgauuucgccgu

SEQ ID NO: 1286463 - RNA, 17 nt, Mycobacterium tuberculosis H37Rv
gcugcuggucuugccgu

SEQ ID NO: 1286464 - RNA, 18 nt, Mycobacterium tuberculosis H37Rv
gcuggaacuuggcgucga

SEQ ID NO: 1286465 - RNA, 19 nt, Mycobacterium tuberculosis H37Rv
gcuggaacuuggcgucgac

SEQ ID NO: 1286466 - RNA, 21 nt, Mycobacterium tuberculosis H37Rv
gcuggccaccgcaucgccgaa

SEQ ID NO: 1286467 - RNA, 16 nt, Mycobacterium tuberculosis H37Rv
gcuggccacgauccgc

SEQ ID NO: 1286468 - RNA, 19 nt, Mycobacterium tuberculosis H37Rv
gcuggccaccgcaucgccg

SEQ ID NO: 1286469 - RNA, 22 nt, Mycobacterium tuberculosis H37Rv
gcuggccagcacaccgucgacg

SEQ ID NO: 1286470 - RNA, 21 nt, Mycobacterium tuberculosis H37Rv
gcuggccacucacauuggcca

SEQ ID NO: 1286471 - RNA, 14 nt, Mycobacterium tuberculosis H37Rv
gcuggcccaacauc

SEQ ID NO: 1286472 - RNA, 23 nt, Mycobacterium tuberculosis H37Rv
gcuggccagcacaccgucgacga

SEQ ID NO: 1286473 - RNA, 23 nt, Mycobacterium tuberculosis H37Rv
gcuggcccgcucauaccgggagg

SEQ ID NO: 1286474 - RNA, 18 nt, Mycobacterium tuberculosis H37Rv
gcuggcccgcacgaaccg

SEQ ID NO: 1286475 - RNA, 13 nt, Mycobacterium tuberculosis H37Rv
gcuggacggcggg

SEQ ID NO: 1286476 - RNA, 18 nt, Mycobacterium tuberculosis H37Rv
gcuggacuccggucagcg

SEQ ID NO: 1286477 - RNA, 21 nt, Mycobacterium tuberculosis H37Rv
gcuggacggccuccaucgcga

SEQ ID NO: 1286478 - RNA, 23 nt, Mycobacterium tuberculosis H37Rv
gcuggaucgagcuaguucggcgu

SEQ ID NO: 1286479 - RNA, 21 nt, Mycobacterium tuberculosis H37Rv
gcuggcaacgccgcgccguuc

SEQ ID NO: 1286480 - RNA, 11 nt, Mycobacterium tuberculosis H37Rv
gcuggcagacu

SEQ ID NO: 1286481 - RNA, 14 nt, Mycobacterium tuberculosis H37Rv
gcuggcaugccggc

SEQ ID NO: 1286482 - RNA, 15 nt, Mycobacterium tuberculosis H37Rv
gcuggcagcuuuggu

SEQ ID NO: 1286483 - RNA, 15 nt, Mycobacterium tuberculosis H37Rv
gcuggcaggauaccg

SEQ ID NO: 1286484 - RNA, 18 nt, Mycobacterium tuberculosis H37Rv
gcugcagucuuucccggg

SEQ ID NO: 1286485 - RNA, 16 nt, Mycobacterium tuberculosis H37Rv
gcugcagugacucgau

SEQ ID NO: 1286486 - RNA, 19 nt, Mycobacterium tuberculosis H37Rv
gcugcagugacucgaucac

SEQ ID NO: 1286487 - RNA, 14 nt, Mycobacterium tuberculosis H37Rv
gcugccacgaacgc

SEQ ID NO: 1286488 - RNA, 14 nt, Mycobacterium tuberculosis H37Rv
gcugccaccgcggu

SEQ ID NO: 1286489 - RNA, 22 nt, Mycobacterium tuberculosis H37Rv
gcugcauccuccucgucgacgu

SEQ ID NO: 1286490 - RNA, 18 nt, Mycobacterium tuberculosis H37Rv
gcugcaacgauugaacuc

SEQ ID NO: 1286491 - RNA, 15 nt, Mycobacterium tuberculosis H37Rv
gcugcaccguuuccg

SEQ ID NO: 1286492 - RNA, 16 nt, Mycobacterium tuberculosis H37Rv
gcugcaaccgacuucg

SEQ ID NO: 1286493 - RNA, 18 nt, Mycobacterium tuberculosis H37Rv
gcugcaccgucagcccga

SEQ ID NO: 1286494 - RNA, 14 nt, Mycobacterium tuberculosis H37Rv
gcugcagcaauugc

SEQ ID NO: 1286495 - RNA, 20 nt, Mycobacterium tuberculosis H37Rv
gcugcagacccguucgccgu

SEQ ID NO: 1286496 - RNA, 13 nt, Mycobacterium tuberculosis H37Rv
gcugcagacccgu

SEQ ID NO: 1286497 - RNA, 13 nt, Mycobacterium tuberculosis H37Rv
gcugcacguggcc

SEQ ID NO: 1286498 - RNA, 18 nt, Mycobacterium tuberculosis H37Rv
gcugccgaagcggccacc

SEQ ID NO: 1286499 - RNA, 19 nt, Mycobacterium tuberculosis H37Rv
gcugccgaacaguucggcg

SEQ ID NO: 1286500 - RNA, 17 nt, Mycobacterium tuberculosis H37Rv
gcugccgauagcgcggc

SEQ ID NO: 1286501 - RNA, 13 nt, Mycobacterium tuberculosis H37Rv
gcugccgaaguug

SEQ ID NO: 1286502 - RNA, 18 nt, Mycobacterium tuberculosis H37Rv
gcugcccgggcugccgcc

SEQ ID NO: 1286503 - RNA, 18 nt, Mycobacterium tuberculosis H37Rv
gcugccagaucggucggc

SEQ ID NO: 1286504 - RNA, 23 nt, Mycobacterium tuberculosis H37Rv
gcugccagaucggucggccaaag

SEQ ID NO: 1286505 - RNA, 21 nt, Mycobacterium tuberculosis H37Rv
gcugccacacaggcguccauc

SEQ ID NO: 1286506 - RNA, 16 nt, Mycobacterium tuberculosis H37Rv
gcugccagccauggcc

SEQ ID NO: 1286507 - RNA, 22 nt, Mycobacterium tuberculosis H37Rv
gcugaggaacgccggcaucgcg

SEQ ID NO: 1286508 - RNA, 22 nt, Mycobacterium tuberculosis H37Rv
gcugauccacgauaucgaugcg

SEQ ID NO: 1286509 - RNA, 19 nt, Mycobacterium tuberculosis H37Rv
gcugauccggguggcguca

SEQ ID NO: 1286510 - RNA, 20 nt, Mycobacterium tuberculosis H37Rv
gcugauccggguggcgucac

SEQ ID NO: 1286511 - RNA, 16 nt, Mycobacterium tuberculosis H37Rv
gcugagcggccggcau

SEQ ID NO: 1286512 - RNA, 16 nt, Mycobacterium tuberculosis H37Rv
gcugagccgcucaucg

SEQ ID NO: 1286513 - RNA, 19 nt, Mycobacterium tuberculosis H37Rv
gcugagcucgaugucagcg

SEQ ID NO: 1286514 - RNA, 23 nt, Mycobacterium tuberculosis H37Rv
gcugagcucgaugucagcggccg

SEQ ID NO: 1286515 - RNA, 18 nt, Mycobacterium tuberculosis H37Rv
gcugagcguaggccagcg

SEQ ID NO: 1286516 - RNA, 22 nt, Mycobacterium tuberculosis H37Rv
gcugagcugcucgccggccaac

SEQ ID NO: 1286517 - RNA, 14 nt, Mycobacterium tuberculosis H37Rv
gcugagcugcucgc

SEQ ID NO: 1286518 - RNA, 15 nt, Mycobacterium tuberculosis H37Rv
gcugaggaacgccgg

SEQ ID NO: 1286519 - RNA, 22 nt, Mycobacterium tuberculosis H37Rv
gcugauuggcccaccgccguug

SEQ ID NO: 1286520 - RNA, 17 nt, Mycobacterium tuberculosis H37Rv
gcugauuaccgacaccg

SEQ ID NO: 1286521 - RNA, 14 nt, Mycobacterium tuberculosis H37Rv
gcugauugcgaccg

SEQ ID NO: 1286522 - RNA, 20 nt, Mycobacterium tuberculosis H37Rv
gcugcaaaucgucgaugguc

SEQ ID NO: 1286523 - RNA, 18 nt, Mycobacterium tuberculosis H37Rv
gcugacgguuugcggagc

SEQ ID NO: 1286524 - RNA, 14 nt, Mycobacterium tuberculosis H37Rv
gcugacgucaccac

SEQ ID NO: 1286525 - RNA, 15 nt, Mycobacterium tuberculosis H37Rv
gcugacuccugcggc

SEQ ID NO: 1286526 - RNA, 21 nt, Mycobacterium tuberculosis H37Rv
gcugaaucaucaucgggaucg

SEQ ID NO: 1286527 - RNA, 23 nt, Mycobacterium tuberculosis H37Rv
gcugaagccaaaugcgcugucgc

SEQ ID NO: 1286528 - RNA, 23 nt, Mycobacterium tuberculosis H37Rv
gcucguccagcgagcgcagcacg

SEQ ID NO: 1286529 - RNA, 19 nt, Mycobacterium tuberculosis H37Rv
gcucgucgagccgaccgcg

SEQ ID NO: 1286530 - RNA, 21 nt, Mycobacterium tuberculosis H37Rv
gcucgucgagcgcgucgguca

SEQ ID NO: 1286531 - RNA, 13 nt, Mycobacterium tuberculosis H37Rv
gcucgucgagccg

SEQ ID NO: 1286532 - RNA, 14 nt, Mycobacterium tuberculosis H37Rv
gcucguccucgucu

SEQ ID NO: 1286533 - RNA, 21 nt, Mycobacterium tuberculosis H37Rv
gcucguccggugcgaucccac

SEQ ID NO: 1286534 - RNA, 21 nt, Mycobacterium tuberculosis H37Rv
gcucgguccuugccguagaag

SEQ ID NO: 1286535 - RNA, 22 nt, Mycobacterium tuberculosis H37Rv
gcucggugaaggucaccgucga

SEQ ID NO: 1286536 - RNA, 18 nt, Mycobacterium tuberculosis H37Rv
gcucggugaugcccagcg

SEQ ID NO: 1286537 - RNA, 15 nt, Mycobacterium tuberculosis H37Rv
gcucggugacguaga

SEQ ID NO: 1286538 - RNA, 14 nt, Mycobacterium tuberculosis H37Rv
gcucggugacguag

SEQ ID NO: 1286539 - RNA, 14 nt, Mycobacterium tuberculosis H37Rv
gcucguagagguca

SEQ ID NO: 1286540 - RNA, 21 nt, Mycobacterium tuberculosis H37Rv
gcucggugcgccagaucaccg

SEQ ID NO: 1286541 - RNA, 19 nt, Mycobacterium tuberculosis H37Rv
gcucggugcugcgccgaua

SEQ ID NO: 1286542 - RNA, 17 nt, Mycobacterium tuberculosis H37Rv
gcucgguuagcccgauc

SEQ ID NO: 1286543 - RNA, 18 nt, Mycobacterium tuberculosis H37Rv
gcucugaggucaccggcg

SEQ ID NO: 1286544 - RNA, 16 nt, Mycobacterium tuberculosis H37Rv
gcucugaggucaccgg

SEQ ID NO: 1286545 - RNA, 18 nt, Mycobacterium tuberculosis H37Rv
gcucucggugguccagcg

SEQ ID NO: 1286546 - RNA, 14 nt, Mycobacterium tuberculosis H37Rv
gcucucgguggucc

SEQ ID NO: 1286547 - RNA, 13 nt, Mycobacterium tuberculosis H37Rv
gcucucggcgaau

SEQ ID NO: 1286548 - RNA, 20 nt, Mycobacterium tuberculosis H37Rv
gcucuucgcagcgguggucg

SEQ ID NO: 1286549 - RNA, 19 nt, Mycobacterium tuberculosis H37Rv
gcucgguaggccggcaaga

SEQ ID NO: 1286550 - RNA, 21 nt, Mycobacterium tuberculosis H37Rv
gcucgguaccaaagcugucga

SEQ ID NO: 1286551 - RNA, 18 nt, Mycobacterium tuberculosis H37Rv
gcucggucaccacggcgg

SEQ ID NO: 1286552 - RNA, 15 nt, Mycobacterium tuberculosis H37Rv
gcucgggggccgacc

SEQ ID NO: 1286553 - RNA, 15 nt, Mycobacterium tuberculosis H37Rv
gcucggggaguucca

SEQ ID NO: 1286554 - RNA, 14 nt, Mycobacterium tuberculosis H37Rv
gcucgggcugccgc

SEQ ID NO: 1286555 - RNA, 18 nt, Mycobacterium tuberculosis H37Rv
gcucgggaacuucgccga

SEQ ID NO: 1286556 - RNA, 19 nt, Mycobacterium tuberculosis H37Rv
gcucgggcgcgcggcgagc

SEQ ID NO: 1286557 - RNA, 15 nt, Mycobacterium tuberculosis H37Rv
gcucgggcccagcgc

SEQ ID NO: 1286558 - RNA, 20 nt, Mycobacterium tuberculosis H37Rv
gcucgggcccagcgcgcgga

SEQ ID NO: 1286559 - RNA, 23 nt, Mycobacterium tuberculosis H37Rv
gcucggcuucccuaggcuccaac

SEQ ID NO: 1286560 - RNA, 16 nt, Mycobacterium tuberculosis H37Rv
gcucggcgagccucuu

SEQ ID NO: 1286561 - RNA, 15 nt, Mycobacterium tuberculosis H37Rv
gcucggcggccagcu

SEQ ID NO: 1286562 - RNA, 18 nt, Mycobacterium tuberculosis H37Rv
gcucggcguccgcccagc

SEQ ID NO: 1286563 - RNA, 15 nt, Mycobacterium tuberculosis H37Rv
gcucggcgucgccgc

SEQ ID NO: 1286564 - RNA, 19 nt, Mycobacterium tuberculosis H37Rv
gcucggcuagguagucgac

SEQ ID NO: 1286565 - RNA, 21 nt, Mycobacterium tuberculosis H37Rv
gcucggcuagguagucgacga

SEQ ID NO: 1286566 - RNA, 17 nt, Mycobacterium tuberculosis H37Rv
gcuccaggcgcgccgca

SEQ ID NO: 1286567 - RNA, 13 nt, Mycobacterium tuberculosis H37Rv
gcucggcaucgag

SEQ ID NO: 1286568 - RNA, 15 nt, Mycobacterium tuberculosis H37Rv
gcucggcaucgagca

SEQ ID NO: 1286569 - RNA, 21 nt, Mycobacterium tuberculosis H37Rv
gcucggcagccggcuugggcg

SEQ ID NO: 1286570 - RNA, 20 nt, Mycobacterium tuberculosis H37Rv
gcucggcgagcucagugacc

SEQ ID NO: 1286571 - RNA, 14 nt, Mycobacterium tuberculosis H37Rv
gcucggcgcggugg

SEQ ID NO: 1286572 - RNA, 17 nt, Mycobacterium tuberculosis H37Rv
gcucggccuguucggcg

SEQ ID NO: 1286573 - RNA, 15 nt, Mycobacterium tuberculosis H37Rv
gcucggccaccagcg

SEQ ID NO: 1286574 - RNA, 21 nt, Mycobacterium tuberculosis H37Rv
gcucggccgcagccagcggua

SEQ ID NO: 1286575 - RNA, 23 nt, Mycobacterium tuberculosis H37Rv
ggaucgucaggcccauggcagcc

SEQ ID NO: 1286576 - RNA, 17 nt, Mycobacterium tuberculosis H37Rv
ggaucgggcaccccgac

SEQ ID NO: 1286577 - RNA, 20 nt, Mycobacterium tuberculosis H37Rv
ggaucgggcaccccgaccac

SEQ ID NO: 1286578 - RNA, 23 nt, Mycobacterium tuberculosis H37Rv
ggaucguucgcgugccagcgccc

SEQ ID NO: 1286579 - RNA, 17 nt, Mycobacterium tuberculosis H37Rv
ggaucgucucgcgcacc

SEQ ID NO: 1286580 - RNA, 15 nt, Mycobacterium tuberculosis H37Rv
ggaugacaccgaccg

SEQ ID NO: 1286581 - RNA, 18 nt, Mycobacterium tuberculosis H37Rv
ggaugaagcgaugagggu

SEQ ID NO: 1286582 - RNA, 22 nt, Mycobacterium tuberculosis H37Rv
ggaucuguuccucggugacuuc

SEQ ID NO: 1286583 - RNA, 14 nt, Mycobacterium tuberculosis H37Rv
ggaugcagcugccc

SEQ ID NO: 1286584 - RNA, 22 nt, Mycobacterium tuberculosis H37Rv
ggaugaccuucccgucgacgag

SEQ ID NO: 1286585 - RNA, 15 nt, Mycobacterium tuberculosis H37Rv
ggaugcccggauccg

SEQ ID NO: 1286586 - RNA, 20 nt, Mycobacterium tuberculosis H37Rv
ggaugcccguagacgccgag

SEQ ID NO: 1286587 - RNA, 19 nt, Mycobacterium tuberculosis H37Rv
ggaugcccguagacgccga

SEQ ID NO: 1286588 - RNA, 18 nt, Mycobacterium tuberculosis H37Rv
ggaugccugccucggcga

SEQ ID NO: 1286589 - RNA, 17 nt, Mycobacterium tuberculosis H37Rv
ggaugcgaucgucacgc

SEQ ID NO: 1286590 - RNA, 19 nt, Mycobacterium tuberculosis H37Rv
ggaugccggucggcgucga

SEQ ID NO: 1286591 - RNA, 22 nt, Mycobacterium tuberculosis H37Rv
ggaugcggccggugaugaucgc

SEQ ID NO: 1286592 - RNA, 20 nt, Mycobacterium tuberculosis H37Rv
ggauggacaccaccucguca

SEQ ID NO: 1286593 - RNA, 12 nt, Mycobacterium tuberculosis H37Rv
ggauggaccacg

SEQ ID NO: 1286594 - RNA, 13 nt, Mycobacterium tuberculosis H37Rv
ggauggaccacga

SEQ ID NO: 1286595 - RNA, 16 nt, Mycobacterium tuberculosis H37Rv
ggauggcgcccugcgc

SEQ ID NO: 1286596 - RNA, 16 nt, Mycobacterium tuberculosis H37Rv
ggauggcgauggcagg

SEQ ID NO: 1286597 - RNA, 16 nt, Mycobacterium tuberculosis H37Rv
ggaucgaguugcggug

SEQ ID NO: 1286598 - RNA, 23 nt, Mycobacterium tuberculosis H37Rv
ggaucgagcuaguucggcgucca

SEQ ID NO: 1286599 - RNA, 12 nt, Mycobacterium tuberculosis H37Rv
ggaucgccacgg

SEQ ID NO: 1286600 - RNA, 21 nt, Mycobacterium tuberculosis H37Rv
ggaucgcagggaucaccccgg

SEQ ID NO: 1286601 - RNA, 13 nt, Mycobacterium tuberculosis H37Rv
ggaucgccaccgg

SEQ ID NO: 1286602 - RNA, 20 nt, Mycobacterium tuberculosis H37Rv
ggaucgagagccgaccgggu

SEQ ID NO: 1286603 - RNA, 23 nt, Mycobacterium tuberculosis H37Rv
ggaucgaccaauucgaccgcgcg

SEQ ID NO: 1286604 - RNA, 15 nt, Mycobacterium tuberculosis H37Rv
ggaucgaccaugguc

SEQ ID NO: 1286605 - RNA, 21 nt, Mycobacterium tuberculosis H37Rv
ggaucgaccaauucgaccgcg

SEQ ID NO: 1286606 - RNA, 15 nt, Mycobacterium tuberculosis H37Rv
ggaucggcagcagag

SEQ ID NO: 1286607 - RNA, 18 nt, Mycobacterium tuberculosis H37Rv
ggaucggauggcggccac

SEQ ID NO: 1286608 - RNA, 12 nt, Mycobacterium tuberculosis H37Rv
ggaucgcgcuca

SEQ ID NO: 1286609 - RNA, 19 nt, Mycobacterium tuberculosis H37Rv
ggaucgcgcccugagccac

SEQ ID NO: 1286610 - RNA, 14 nt, Mycobacterium tuberculosis H37Rv
ggaucgcgauggcc

SEQ ID NO: 1286611 - RNA, 13 nt, Mycobacterium tuberculosis H37Rv
ggaucgccgucgc

SEQ ID NO: 1286612 - RNA, 13 nt, Mycobacterium tuberculosis H37Rv
ggaucagcgucgg

SEQ ID NO: 1286613 - RNA, 17 nt, Mycobacterium tuberculosis H37Rv
ggaucauguucggccac

SEQ ID NO: 1286614 - RNA, 19 nt, Mycobacterium tuberculosis H37Rv
ggauccgaagagccagcaa

SEQ ID NO: 1286615 - RNA, 20 nt, Mycobacterium tuberculosis H37Rv
ggauccgaccccgcgccgac

SEQ ID NO: 1286616 - RNA, 15 nt, Mycobacterium tuberculosis H37Rv
ggauccaugcgggug

SEQ ID NO: 1286617 - RNA, 13 nt, Mycobacterium tuberculosis H37Rv
ggauaucgucgac

SEQ ID NO: 1286618 - RNA, 18 nt, Mycobacterium tuberculosis H37Rv
ggaucacccacucgacgu

SEQ ID NO: 1286619 - RNA, 15 nt, Mycobacterium tuberculosis H37Rv
ggaucacaucggcca

SEQ ID NO: 1286620 - RNA, 18 nt, Mycobacterium tuberculosis H37Rv
ggaucacacccacgucga

SEQ ID NO: 1286621 - RNA, 13 nt, Mycobacterium tuberculosis H37Rv
ggaucaccaucgc

SEQ ID NO: 1286622 - RNA, 14 nt, Mycobacterium tuberculosis H37Rv
ggagaucgucgcca

SEQ ID NO: 1286623 - RNA, 20 nt, Mycobacterium tuberculosis H37Rv
ggagauguaguccucggugg

SEQ ID NO: 1286624 - RNA, 14 nt, Mycobacterium tuberculosis H37Rv
ggagaugccgacga

SEQ ID NO: 1286625 - RNA, 18 nt, Mycobacterium tuberculosis H37Rv
ggacgcgacucggcgguc

SEQ ID NO: 1286626 - RNA, 16 nt, Mycobacterium tuberculosis H37Rv
ggacgcgaucggcguc

SEQ ID NO: 1286627 - RNA, 20 nt, Mycobacterium tuberculosis H37Rv
ggacgcgaugaccgcaccga

SEQ ID NO: 1286628 - RNA, 14 nt, Mycobacterium tuberculosis H37Rv
ggagaucaccucgg

SEQ ID NO: 1286629 - RNA, 20 nt, Mycobacterium tuberculosis H37Rv
ggacgacgccgacgaugacg

SEQ ID NO: 1286630 - RNA, 15 nt, Mycobacterium tuberculosis H37Rv
ggacgacgccgacga

SEQ ID NO: 1286631 - RNA, 16 nt, Mycobacterium tuberculosis H37Rv
ggacgacgaucaagcc

SEQ ID NO: 1286632 - RNA, 12 nt, Mycobacterium tuberculosis H37Rv
ggacgacaccgc

SEQ ID NO: 1286633 - RNA, 16 nt, Mycobacterium tuberculosis H37Rv
ggacgccgccggagau

SEQ ID NO: 1286634 - RNA, 20 nt, Mycobacterium tuberculosis H37Rv
ggacgaggucauaucgacgg

SEQ ID NO: 1286635 - RNA, 19 nt, Mycobacterium tuberculosis H37Rv
ggacgccuugaucggcgag

SEQ ID NO: 1286636 - RNA, 16 nt, Mycobacterium tuberculosis H37Rv
ggacgcgaacagcucg

SEQ ID NO: 1286637 - RNA, 17 nt, Mycobacterium tuberculosis H37Rv
ggagcaauuccacgauc

SEQ ID NO: 1286638 - RNA, 12 nt, Mycobacterium tuberculosis H37Rv
ggagcccggcau

SEQ ID NO: 1286639 - RNA, 14 nt, Mycobacterium tuberculosis H37Rv
ggagcccgagcuca

SEQ ID NO: 1286640 - RNA, 20 nt, Mycobacterium tuberculosis H37Rv
ggagccggccaccucggugc

SEQ ID NO: 1286641 - RNA, 18 nt, Mycobacterium tuberculosis H37Rv
ggagccgccgacucggca

SEQ ID NO: 1286642 - RNA, 22 nt, Mycobacterium tuberculosis H37Rv
ggagccgccaggugcucgucga

SEQ ID NO: 1286643 - RNA, 13 nt, Mycobacterium tuberculosis H37Rv
ggagccggugacg

SEQ ID NO: 1286644 - RNA, 13 nt, Mycobacterium tuberculosis H37Rv
ggagccuccagcg

SEQ ID NO: 1286645 - RNA, 12 nt, Mycobacterium tuberculosis H37Rv
ggagccucgacc

SEQ ID NO: 1286646 - RNA, 23 nt, Mycobacterium tuberculosis H37Rv
ggagccgugcggucgcgcccuca

SEQ ID NO: 1286647 - RNA, 18 nt, Mycobacterium tuberculosis H37Rv
ggagcgcgaugaccucgg

SEQ ID NO: 1286648 - RNA, 13 nt, Mycobacterium tuberculosis H37Rv
ggagcgcccggcu

SEQ ID NO: 1286649 - RNA, 16 nt, Mycobacterium tuberculosis H37Rv
ggagcgcccggcugau

SEQ ID NO: 1286650 - RNA, 17 nt, Mycobacterium tuberculosis H37Rv
ggagcggcugcggcaac

SEQ ID NO: 1286651 - RNA, 13 nt, Mycobacterium tuberculosis H37Rv
ggagcggcugcac

SEQ ID NO: 1286652 - RNA, 22 nt, Mycobacterium tuberculosis H37Rv
ggagcggaguguagacaggacc

SEQ ID NO: 1286653 - RNA, 18 nt, Mycobacterium tuberculosis H37Rv
ggagcggguggccgggau

SEQ ID NO: 1286654 - RNA, 16 nt, Mycobacterium tuberculosis H37Rv
ggagcgggccagcacc

SEQ ID NO: 1286655 - RNA, 18 nt, Mycobacterium tuberculosis H37Rv
ggagcgcgccucgcccag

SEQ ID NO: 1286656 - RNA, 21 nt, Mycobacterium tuberculosis H37Rv
ggagcgcgaugaccucggcga

SEQ ID NO: 1286657 - RNA, 14 nt, Mycobacterium tuberculosis H37Rv
ggagcgcuugguca

SEQ ID NO: 1286658 - RNA, 16 nt, Mycobacterium tuberculosis H37Rv
ggagguguggucgagc

SEQ ID NO: 1286659 - RNA, 17 nt, Mycobacterium tuberculosis H37Rv
ggagguguggucgagcg

SEQ ID NO: 1286660 - RNA, 17 nt, Mycobacterium tuberculosis H37Rv
ggaggucgggcggcgac

SEQ ID NO: 1286661 - RNA, 18 nt, Mycobacterium tuberculosis H37Rv
ggaggcggaccaggccgc

SEQ ID NO: 1286662 - RNA, 22 nt, Mycobacterium tuberculosis H37Rv
ggaggcuaggcguuugguguga

SEQ ID NO: 1286663 - RNA, 20 nt, Mycobacterium tuberculosis H37Rv
ggaggcuucgaggaacacga

SEQ ID NO: 1286664 - RNA, 20 nt, Mycobacterium tuberculosis H37Rv
ggagucgacggugccgucgg

SEQ ID NO: 1286665 - RNA, 16 nt, Mycobacterium tuberculosis H37Rv
ggagucgacgguuugc

SEQ ID NO: 1286666 - RNA, 15 nt, Mycobacterium tuberculosis H37Rv
ggagucgucggcaac

SEQ ID NO: 1286667 - RNA, 17 nt, Mycobacterium tuberculosis H37Rv
ggagucgacggugccgu

SEQ ID NO: 1286668 - RNA, 17 nt, Mycobacterium tuberculosis H37Rv
ggagcucuugcgggcag

SEQ ID NO: 1286669 - RNA, 23 nt, Mycobacterium tuberculosis H37Rv
ggagcugccgggagggguucacc

SEQ ID NO: 1286670 - RNA, 21 nt, Mycobacterium tuberculosis H37Rv
ggagcuuuuugcgucuguucg

SEQ ID NO: 1286671 - RNA, 16 nt, Mycobacterium tuberculosis H37Rv
ggagcggugccgacgg

SEQ ID NO: 1286672 - RNA, 20 nt, Mycobacterium tuberculosis H37Rv
ggagcggguccccaccgguu

SEQ ID NO: 1286673 - RNA, 13 nt, Mycobacterium tuberculosis H37Rv
ggagcgugggcgu

SEQ ID NO: 1286674 - RNA, 20 nt, Mycobacterium tuberculosis H37Rv
ggagcucacgugcugccgau

SEQ ID NO: 1286675 - RNA, 18 nt, Mycobacterium tuberculosis H37Rv
ggaggaaggucgaaucgc

SEQ ID NO: 1286676 - RNA, 19 nt, Mycobacterium tuberculosis H37Rv
ggaggccaacccugcggcg

SEQ ID NO: 1286677 - RNA, 17 nt, Mycobacterium tuberculosis H37Rv
ggaguuuccgaagcccg

SEQ ID NO: 1286678 - RNA, 16 nt, Mycobacterium tuberculosis H37Rv
ggauacggugcgacga

SEQ ID NO: 1286679 - RNA, 22 nt, Mycobacterium tuberculosis H37Rv
ggauacgggcugacgaucucca

SEQ ID NO: 1286680 - RNA, 14 nt, Mycobacterium tuberculosis H37Rv
ggaccgcgccgauc

SEQ ID NO: 1286681 - RNA, 14 nt, Mycobacterium tuberculosis H37Rv
ggaccgucguggcg

SEQ ID NO: 1286682 - RNA, 16 nt, Mycobacterium tuberculosis H37Rv
ggaccguccgacggcg

SEQ ID NO: 1286683 - RNA, 13 nt, Mycobacterium tuberculosis H37Rv
ggaccucggcgau

SEQ ID NO: 1286684 - RNA, 15 nt, Mycobacterium tuberculosis H37Rv
ggacgaaaucggcgg

SEQ ID NO: 1286685 - RNA, 18 nt, Mycobacterium tuberculosis H37Rv
ggacgaaaaaaucgugcg

SEQ ID NO: 1286686 - RNA, 20 nt, Mycobacterium tuberculosis H37Rv
ggaccacgugaucgacgacc

SEQ ID NO: 1286687 - RNA, 23 nt, Mycobacterium tuberculosis H37Rv
ggaccacuguuggugccgccacc

SEQ ID NO: 1286688 - RNA, 16 nt, Mycobacterium tuberculosis H37Rv
ggaccagagccaacga

SEQ ID NO: 1286689 - RNA, 13 nt, Mycobacterium tuberculosis H37Rv
ggaccacgccgac

SEQ ID NO: 1286690 - RNA, 20 nt, Mycobacterium tuberculosis H37Rv
ggacccgcccuugccgccga

SEQ ID NO: 1286691 - RNA, 16 nt, Mycobacterium tuberculosis H37Rv
ggacccgcuacgacgg

SEQ ID NO: 1286692 - RNA, 15 nt, Mycobacterium tuberculosis H37Rv
ggaccgaugacgauc

SEQ ID NO: 1286693 - RNA, 22 nt, Mycobacterium tuberculosis H37Rv
ggaccgcagcgacgggaaagcc

SEQ ID NO: 1286694 - RNA, 18 nt, Mycobacterium tuberculosis H37Rv
ggaccgccgccgacaauc

SEQ ID NO: 1286695 - RNA, 20 nt, Mycobacterium tuberculosis H37Rv
ggacccgugagcucgucgag

SEQ ID NO: 1286696 - RNA, 16 nt, Mycobacterium tuberculosis H37Rv
ggacccgugcacgauc

SEQ ID NO: 1286697 - RNA, 16 nt, Mycobacterium tuberculosis H37Rv
ggaccgaacgacucga

SEQ ID NO: 1286698 - RNA, 20 nt, Mycobacterium tuberculosis H37Rv
ggaccgauuucgccugcggc

SEQ ID NO: 1286699 - RNA, 19 nt, Mycobacterium tuberculosis H37Rv
ggacacgaucgcgucggcu

SEQ ID NO: 1286700 - RNA, 16 nt, Mycobacterium tuberculosis H37Rv
ggacaccugcugcacc

SEQ ID NO: 1286701 - RNA, 15 nt, Mycobacterium tuberculosis H37Rv
ggacaccugcugcac

SEQ ID NO: 1286702 - RNA, 22 nt, Mycobacterium tuberculosis H37Rv
ggacaccuaccgagaucaccgc

SEQ ID NO: 1286703 - RNA, 19 nt, Mycobacterium tuberculosis H37Rv
ggacaaccgcgccgacaga

SEQ ID NO: 1286704 - RNA, 16 nt, Mycobacterium tuberculosis H37Rv
ggacaccccgcacgga

SEQ ID NO: 1286705 - RNA, 14 nt, Mycobacterium tuberculosis H37Rv
ggacaccugcugca

SEQ ID NO: 1286706 - RNA, 16 nt, Mycobacterium tuberculosis H37Rv
ggacaccgcggcgauc

SEQ ID NO: 1286707 - RNA, 21 nt, Mycobacterium tuberculosis H37Rv
ggacaccuaccgagaucaccg

SEQ ID NO: 1286708 - RNA, 16 nt, Mycobacterium tuberculosis H37Rv
ggacagcaucacgauc

SEQ ID NO: 1286709 - RNA, 19 nt, Mycobacterium tuberculosis H37Rv
ggacagcaucacgaucacg

SEQ ID NO: 1286710 - RNA, 23 nt, Mycobacterium tuberculosis H37Rv
ggacagcaucacgaucacgucgu

SEQ ID NO: 1286711 - RNA, 11 nt, Mycobacterium tuberculosis H37Rv
ggacagcgccu

SEQ ID NO: 1286712 - RNA, 18 nt, Mycobacterium tuberculosis H37Rv
ggacaucgggcggcaccg

SEQ ID NO: 1286713 - RNA, 17 nt, Mycobacterium tuberculosis H37Rv
ggacaucggccggcguc

SEQ ID NO: 1286714 - RNA, 16 nt, Mycobacterium tuberculosis H37Rv
ggacaucggccggcgu

SEQ ID NO: 1286715 - RNA, 17 nt, Mycobacterium tuberculosis H37Rv
ggacaugcgggcagcac

SEQ ID NO: 1286716 - RNA, 22 nt, Mycobacterium tuberculosis H37Rv
ggaacucggcccacacggucgu

SEQ ID NO: 1286717 - RNA, 23 nt, Mycobacterium tuberculosis H37Rv
ggaacugaccacgucggacagcu

SEQ ID NO: 1286718 - RNA, 13 nt, Mycobacterium tuberculosis H37Rv
ggaacggcgucgu

SEQ ID NO: 1286719 - RNA, 14 nt, Mycobacterium tuberculosis H37Rv
ggaacgcucgucga

SEQ ID NO: 1286720 - RNA, 20 nt, Mycobacterium tuberculosis H37Rv
ggaacgcuaggcgauccaga

SEQ ID NO: 1286721 - RNA, 16 nt, Mycobacterium tuberculosis H37Rv
ggaacgccggcaccga

SEQ ID NO: 1286722 - RNA, 16 nt, Mycobacterium tuberculosis H37Rv
ggaaccgguaucgcca

SEQ ID NO: 1286723 - RNA, 19 nt, Mycobacterium tuberculosis H37Rv
ggaaccguccaagccggcu

SEQ ID NO: 1286724 - RNA, 17 nt, Mycobacterium tuberculosis H37Rv
ggaacgaucgaugaccu

SEQ ID NO: 1286725 - RNA, 24 nt, Mycobacterium tuberculosis H37Rv
ggaacgauggacgcccaguugccg

SEQ ID NO: 1286726 - RNA, 13 nt, Mycobacterium tuberculosis H37Rv
ggaaccgaucggu

SEQ ID NO: 1286727 - RNA, 14 nt, Mycobacterium tuberculosis H37Rv
ggaaccgcucguca

SEQ ID NO: 1286728 - RNA, 19 nt, Mycobacterium tuberculosis H37Rv
ggaaaaauuucuucgccga

SEQ ID NO: 1286729 - RNA, 17 nt, Mycobacterium tuberculosis H37Rv
ggaaaaagucaccuugc

SEQ ID NO: 1286730 - RNA, 17 nt, Mycobacterium tuberculosis H37Rv
ggaaaaccgcaccgucc

SEQ ID NO: 1286731 - RNA, 15 nt, Mycobacterium tuberculosis H37Rv
ggacaccaccguggc

SEQ ID NO: 1286732 - RNA, 15 nt, Mycobacterium tuberculosis H37Rv
ggacaagucggcacc

SEQ ID NO: 1286733 - RNA, 14 nt, Mycobacterium tuberculosis H37Rv
ggacaagucggcac

SEQ ID NO: 1286734 - RNA, 17 nt, Mycobacterium tuberculosis H37Rv
ggacaaggucaucggca

SEQ ID NO: 1286735 - RNA, 19 nt, Mycobacterium tuberculosis H37Rv
ggacaaccuggggccacca

SEQ ID NO: 1286736 - RNA, 20 nt, Mycobacterium tuberculosis H37Rv
ggacaacgugccgaacgcca

SEQ ID NO: 1286737 - RNA, 22 nt, Mycobacterium tuberculosis H37Rv
ggacaacgugccgaacgccaga

SEQ ID NO: 1286738 - RNA, 13 nt, Mycobacterium tuberculosis H37Rv
ggaaucgucgcgg

SEQ ID NO: 1286739 - RNA, 21 nt, Mycobacterium tuberculosis H37Rv
ggaaucggcggcggauucggu

SEQ ID NO: 1286740 - RNA, 16 nt, Mycobacterium tuberculosis H37Rv
ggaaucgcaucggcgg

SEQ ID NO: 1286741 - RNA, 20 nt, Mycobacterium tuberculosis H37Rv
ggaaucgguuucgaccugcg

SEQ ID NO: 1286742 - RNA, 23 nt, Mycobacterium tuberculosis H37Rv
ggaaucgucggcgcggcugucgu

SEQ ID NO: 1286743 - RNA, 13 nt, Mycobacterium tuberculosis H37Rv
ggaaucgucggcu

SEQ ID NO: 1286744 - RNA, 16 nt, Mycobacterium tuberculosis H37Rv
ggaauccgcggcgauc

SEQ ID NO: 1286745 - RNA, 20 nt, Mycobacterium tuberculosis H37Rv
ggaauccgcggcgaucacca

SEQ ID NO: 1286746 - RNA, 14 nt, Mycobacterium tuberculosis H37Rv
ggaauccgaacucg

SEQ ID NO: 1286747 - RNA, 22 nt, Mycobacterium tuberculosis H37Rv
ggaaguacuccacccaggccga

SEQ ID NO: 1286748 - RNA, 13 nt, Mycobacterium tuberculosis H37Rv
gcuuggcgggacc

SEQ ID NO: 1286749 - RNA, 13 nt, Mycobacterium tuberculosis H37Rv
gcuuggcgugacc

SEQ ID NO: 1286750 - RNA, 13 nt, Mycobacterium tuberculosis H37Rv
gcuuggcgucggc

SEQ ID NO: 1286751 - RNA, 14 nt, Mycobacterium tuberculosis H37Rv
gcuugcguagcuca

SEQ ID NO: 1286752 - RNA, 15 nt, Mycobacterium tuberculosis H37Rv
gcuuggccgccgcca

SEQ ID NO: 1286753 - RNA, 19 nt, Mycobacterium tuberculosis H37Rv
gcuuuagugucugcucgcg

SEQ ID NO: 1286754 - RNA, 19 nt, Mycobacterium tuberculosis H37Rv
gcuugucgaccacgaccgu

SEQ ID NO: 1286755 - RNA, 18 nt, Mycobacterium tuberculosis H37Rv
gcuuucagcaccggaucg

SEQ ID NO: 1286756 - RNA, 16 nt, Mycobacterium tuberculosis H37Rv
gcuuuuacgucugcuc

SEQ ID NO: 1286757 - RNA, 17 nt, Mycobacterium tuberculosis H37Rv
gcuuuuacgucugcucg

SEQ ID NO: 1286758 - RNA, 20 nt, Mycobacterium tuberculosis H37Rv
gcuuuugcgucugcucgcca

SEQ ID NO: 1286759 - RNA, 21 nt, Mycobacterium tuberculosis H37Rv
gcuuuugcgucugcucgcgca

SEQ ID NO: 1286760 - RNA, 21 nt, Mycobacterium tuberculosis H37Rv
gcuugcgccggaugacaccga

SEQ ID NO: 1286761 - RNA, 18 nt, Mycobacterium tuberculosis H37Rv
gcuugcgcgagcagacgc

SEQ ID NO: 1286762 - RNA, 18 nt, Mycobacterium tuberculosis H37Rv
gcuugccgucuucgccgc

SEQ ID NO: 1286763 - RNA, 19 nt, Mycobacterium tuberculosis H37Rv
gcuugcgcagcaccgguca

SEQ ID NO: 1286764 - RNA, 17 nt, Mycobacterium tuberculosis H37Rv
gcuugcccggcucggca

SEQ ID NO: 1286765 - RNA, 19 nt, Mycobacterium tuberculosis H37Rv
gcuguuguugucgggauug

SEQ ID NO: 1286766 - RNA, 13 nt, Mycobacterium tuberculosis H37Rv
gcugugcucacga

SEQ ID NO: 1286767 - RNA, 15 nt, Mycobacterium tuberculosis H37Rv
gcuugacugcacacc

SEQ ID NO: 1286768 - RNA, 12 nt, Mycobacterium tuberculosis H37Rv
gcuugacuccgc

SEQ ID NO: 1286769 - RNA, 15 nt, Mycobacterium tuberculosis H37Rv
gcuugacaucgguca

SEQ ID NO: 1286770 - RNA, 23 nt, Mycobacterium tuberculosis H37Rv
gcuugaguugguugaugcccuug

SEQ ID NO: 1286771 - RNA, 17 nt, Mycobacterium tuberculosis H37Rv
gcuugaguuucggcgca

SEQ ID NO: 1286772 - RNA, 14 nt, Mycobacterium tuberculosis H37Rv
gcuugaucgccgag

SEQ ID NO: 1286773 - RNA, 15 nt, Mycobacterium tuberculosis H37Rv
ggccuaggacgccgc

SEQ ID NO: 1286774 - RNA, 17 nt, Mycobacterium tuberculosis H37Rv
ggccucccacggcgcgu

SEQ ID NO: 1286775 - RNA, 14 nt, Mycobacterium tuberculosis H37Rv
ggccuccaucgcga

SEQ ID NO: 1286776 - RNA, 15 nt, Mycobacterium tuberculosis H37Rv
ggccuaggucgacgc

SEQ ID NO: 1286777 - RNA, 19 nt, Mycobacterium tuberculosis H37Rv
ggccuaggucgacgccgac

SEQ ID NO: 1286778 - RNA, 16 nt, Mycobacterium tuberculosis H37Rv
ggccguugugcgguug

SEQ ID NO: 1286779 - RNA, 21 nt, Mycobacterium tuberculosis H37Rv
ggccguugcuauucgccagcg

SEQ ID NO: 1286780 - RNA, 24 nt, Mycobacterium tuberculosis H37Rv
ggccguugccaacaacaucagcga

SEQ ID NO: 1286781 - RNA, 17 nt, Mycobacterium tuberculosis H37Rv
ggccguugccccgucgu

SEQ ID NO: 1286782 - RNA, 12 nt, Mycobacterium tuberculosis H37Rv
ggccguggucga

SEQ ID NO: 1286783 - RNA, 15 nt, Mycobacterium tuberculosis H37Rv
ggccguucaaccgga

SEQ ID NO: 1286784 - RNA, 22 nt, Mycobacterium tuberculosis H37Rv
ggccguggucgagggcggcguc

SEQ ID NO: 1286785 - RNA, 17 nt, Mycobacterium tuberculosis H37Rv
ggccguggucgagggcg

SEQ ID NO: 1286786 - RNA, 24 nt, Mycobacterium tuberculosis H37Rv
ggccguggcuggacccgcauggcg

SEQ ID NO: 1286787 - RNA, 18 nt, Mycobacterium tuberculosis H37Rv
ggccguguacgugcucgu

SEQ ID NO: 1286788 - RNA, 14 nt, Mycobacterium tuberculosis H37Rv
ggccgugccgccga

SEQ ID NO: 1286789 - RNA, 15 nt, Mycobacterium tuberculosis H37Rv
ggccguggcuggacc

SEQ ID NO: 1286790 - RNA, 13 nt, Mycobacterium tuberculosis H37Rv
ggccguggcgaau

SEQ ID NO: 1286791 - RNA, 16 nt, Mycobacterium tuberculosis H37Rv
ggccgucucgacacug

SEQ ID NO: 1286792 - RNA, 14 nt, Mycobacterium tuberculosis H37Rv
ggccgugaacggcg

SEQ ID NO: 1286793 - RNA, 18 nt, Mycobacterium tuberculosis H37Rv
ggccgguauuucggcgac

SEQ ID NO: 1286794 - RNA, 22 nt, Mycobacterium tuberculosis H37Rv
ggccggucccaucaguugcaca

SEQ ID NO: 1286795 - RNA, 13 nt, Mycobacterium tuberculosis H37Rv
ggccggucgagac

SEQ ID NO: 1286796 - RNA, 13 nt, Mycobacterium tuberculosis H37Rv
ggccggucgaggc

SEQ ID NO: 1286797 - RNA, 13 nt, Mycobacterium tuberculosis H37Rv
ggccgguccgggg

SEQ ID NO: 1286798 - RNA, 15 nt, Mycobacterium tuberculosis H37Rv
ggccgucgucgguca

SEQ ID NO: 1286799 - RNA, 20 nt, Mycobacterium tuberculosis H37Rv
ggccgucggggaguucgcgc

SEQ ID NO: 1286800 - RNA, 13 nt, Mycobacterium tuberculosis H37Rv
ggccgucggcguc

SEQ ID NO: 1286801 - RNA, 20 nt, Mycobacterium tuberculosis H37Rv
ggccgucgggugcagcacgg

SEQ ID NO: 1286802 - RNA, 15 nt, Mycobacterium tuberculosis H37Rv
ggccgucggcgucga

SEQ ID NO: 1286803 - RNA, 21 nt, Mycobacterium tuberculosis H37Rv
ggccgguccggggcaacgauc

SEQ ID NO: 1286804 - RNA, 12 nt, Mycobacterium tuberculosis H37Rv
ggccgguccggu

SEQ ID NO: 1286805 - RNA, 18 nt, Mycobacterium tuberculosis H37Rv
ggccuggaucgugccgaa

SEQ ID NO: 1286806 - RNA, 17 nt, Mycobacterium tuberculosis H37Rv
ggccugggccgcacaag

SEQ ID NO: 1286807 - RNA, 16 nt, Mycobacterium tuberculosis H37Rv
ggccuucagcguccag

SEQ ID NO: 1286808 - RNA, 20 nt, Mycobacterium tuberculosis H37Rv
ggccuugcugcgcgauggcc

SEQ ID NO: 1286809 - RNA, 18 nt, Mycobacterium tuberculosis H37Rv
ggccuugacagcuuucuu

SEQ ID NO: 1286810 - RNA, 12 nt, Mycobacterium tuberculosis H37Rv
ggccuucgccga

SEQ ID NO: 1286811 - RNA, 19 nt, Mycobacterium tuberculosis H37Rv
ggccugcguccgacgccug

SEQ ID NO: 1286812 - RNA, 20 nt, Mycobacterium tuberculosis H37Rv
ggccucgaagggcuugucgc

SEQ ID NO: 1286813 - RNA, 16 nt, Mycobacterium tuberculosis H37Rv
ggccuccucgucgcuc

SEQ ID NO: 1286814 - RNA, 20 nt, Mycobacterium tuberculosis H37Rv
ggccucugaccagccggucu

SEQ ID NO: 1286815 - RNA, 15 nt, Mycobacterium tuberculosis H37Rv
ggccugaccggucac

SEQ ID NO: 1286816 - RNA, 16 nt, Mycobacterium tuberculosis H37Rv
ggccugagcggccauc

SEQ ID NO: 1286817 - RNA, 20 nt, Mycobacterium tuberculosis H37Rv
ggccugagcgucgucgccgg

SEQ ID NO: 1286818 - RNA, 13 nt, Mycobacterium tuberculosis H37Rv
ggccggccgcuca

SEQ ID NO: 1286819 - RNA, 18 nt, Mycobacterium tuberculosis H37Rv
ggccggccgcucaccccg

SEQ ID NO: 1286820 - RNA, 16 nt, Mycobacterium tuberculosis H37Rv
ggccggagucgacgac

SEQ ID NO: 1286821 - RNA, 15 nt, Mycobacterium tuberculosis H37Rv
ggccggagucgacga

SEQ ID NO: 1286822 - RNA, 20 nt, Mycobacterium tuberculosis H37Rv
ggccggaccuuguuggccau

SEQ ID NO: 1286823 - RNA, 20 nt, Mycobacterium tuberculosis H37Rv
ggccgcucgccucgauggcg

SEQ ID NO: 1286824 - RNA, 15 nt, Mycobacterium tuberculosis H37Rv
ggccgcucgccucga

SEQ ID NO: 1286825 - RNA, 16 nt, Mycobacterium tuberculosis H37Rv
ggccgcuccaccucgg

SEQ ID NO: 1286826 - RNA, 20 nt, Mycobacterium tuberculosis H37Rv
ggccggacccauuggaccga

SEQ ID NO: 1286827 - RNA, 16 nt, Mycobacterium tuberculosis H37Rv
ggccgcuaugcagguc

SEQ ID NO: 1286828 - RNA, 23 nt, Mycobacterium tuberculosis H37Rv
ggccgggucgaacuugaucaccg

SEQ ID NO: 1286829 - RNA, 19 nt, Mycobacterium tuberculosis H37Rv
ggccggggugccggcgaug

SEQ ID NO: 1286830 - RNA, 18 nt, Mycobacterium tuberculosis H37Rv
ggccggggccacccgcag

SEQ ID NO: 1286831 - RNA, 22 nt, Mycobacterium tuberculosis H37Rv
ggccggcguguucugaucggug

SEQ ID NO: 1286832 - RNA, 14 nt, Mycobacterium tuberculosis H37Rv
ggccggcuaccgcg

SEQ ID NO: 1286833 - RNA, 14 nt, Mycobacterium tuberculosis H37Rv
ggccggcgucggcg

SEQ ID NO: 1286834 - RNA, 15 nt, Mycobacterium tuberculosis H37Rv
ggccggcgccgcacc

SEQ ID NO: 1286835 - RNA, 14 nt, Mycobacterium tuberculosis H37Rv
ggccggcgauggcc

SEQ ID NO: 1286836 - RNA, 14 nt, Mycobacterium tuberculosis H37Rv
ggccgcgcggcgac

SEQ ID NO: 1286837 - RNA, 13 nt, Mycobacterium tuberculosis H37Rv
ggccgcgcgcacc

SEQ ID NO: 1286838 - RNA, 17 nt, Mycobacterium tuberculosis H37Rv
ggccgcgcgcaucgcgc

SEQ ID NO: 1286839 - RNA, 22 nt, Mycobacterium tuberculosis H37Rv
ggccgcgcgcacuugcguggcg

SEQ ID NO: 1286840 - RNA, 22 nt, Mycobacterium tuberculosis H37Rv
ggccgcgcgacaacccggcguc

SEQ ID NO: 1286841 - RNA, 13 nt, Mycobacterium tuberculosis H37Rv
ggccgaucagcgu

SEQ ID NO: 1286842 - RNA, 13 nt, Mycobacterium tuberculosis H37Rv
ggccgaucagcgc

SEQ ID NO: 1286843 - RNA, 14 nt, Mycobacterium tuberculosis H37Rv
ggccgaucagcgcg

SEQ ID NO: 1286844 - RNA, 15 nt, Mycobacterium tuberculosis H37Rv
ggccgaucagcgcgg

SEQ ID NO: 1286845 - RNA, 16 nt, Mycobacterium tuberculosis H37Rv
ggccgaucaccccggu

SEQ ID NO: 1286846 - RNA, 22 nt, Mycobacterium tuberculosis H37Rv
ggccgcgucuuggugcgcguca

SEQ ID NO: 1286847 - RNA, 15 nt, Mycobacterium tuberculosis H37Rv
ggccgcgucgucgag

SEQ ID NO: 1286848 - RNA, 16 nt, Mycobacterium tuberculosis H37Rv
ggccgcggugacggcg

SEQ ID NO: 1286849 - RNA, 14 nt, Mycobacterium tuberculosis H37Rv
ggccgcggcgucgu

SEQ ID NO: 1286850 - RNA, 13 nt, Mycobacterium tuberculosis H37Rv
ggccgcggcgguc

SEQ ID NO: 1286851 - RNA, 13 nt, Mycobacterium tuberculosis H37Rv
ggccgcggcgauc

SEQ ID NO: 1286852 - RNA, 15 nt, Mycobacterium tuberculosis H37Rv
ggccgcggcacccag

SEQ ID NO: 1286853 - RNA, 23 nt, Mycobacterium tuberculosis H37Rv
ggccgcggaugcucaggucaccg

SEQ ID NO: 1286854 - RNA, 20 nt, Mycobacterium tuberculosis H37Rv
ggccgcggcacccagguguc

SEQ ID NO: 1286855 - RNA, 20 nt, Mycobacterium tuberculosis H37Rv
ggccgcggccacaucgccag

SEQ ID NO: 1286856 - RNA, 14 nt, Mycobacterium tuberculosis H37Rv
ggccgcgcugguca

SEQ ID NO: 1286857 - RNA, 22 nt, Mycobacterium tuberculosis H37Rv
ggccgcgcucaucgcggcgaac

SEQ ID NO: 1286858 - RNA, 18 nt, Mycobacterium tuberculosis H37Rv
ggcgauuucggcgccugg

SEQ ID NO: 1286859 - RNA, 17 nt, Mycobacterium tuberculosis H37Rv
ggcgauugcagcuucgg

SEQ ID NO: 1286860 - RNA, 15 nt, Mycobacterium tuberculosis H37Rv
ggcgauugauccggu

SEQ ID NO: 1286861 - RNA, 18 nt, Mycobacterium tuberculosis H37Rv
ggcgauuuccaucgcgac

SEQ ID NO: 1286862 - RNA, 21 nt, Mycobacterium tuberculosis H37Rv
ggcgauuuugcgucugcucgg

SEQ ID NO: 1286863 - RNA, 23 nt, Mycobacterium tuberculosis H37Rv
ggcgauuuugcgucugcucggcg

SEQ ID NO: 1286864 - RNA, 19 nt, Mycobacterium tuberculosis H37Rv
ggcgauuuugcgucugcuc

SEQ ID NO: 1286865 - RNA, 18 nt, Mycobacterium tuberculosis H37Rv
ggcgauuuugcgucugcu

SEQ ID NO: 1286866 - RNA, 18 nt, Mycobacterium tuberculosis H37Rv
ggcgcaaaccacccgcaa

SEQ ID NO: 1286867 - RNA, 20 nt, Mycobacterium tuberculosis H37Rv
ggcgauucugugucugcucg

SEQ ID NO: 1286868 - RNA, 20 nt, Mycobacterium tuberculosis H37Rv
ggcgauucugcgucugcucg

SEQ ID NO: 1286869 - RNA, 22 nt, Mycobacterium tuberculosis H37Rv
ggcgaugccgguggggcccucg

SEQ ID NO: 1286870 - RNA, 17 nt, Mycobacterium tuberculosis H37Rv
ggcgaugauguugagcu

SEQ ID NO: 1286871 - RNA, 14 nt, Mycobacterium tuberculosis H37Rv
ggcgaugcagccgg

SEQ ID NO: 1286872 - RNA, 18 nt, Mycobacterium tuberculosis H37Rv
ggcgaugaucgccuucuu

SEQ ID NO: 1286873 - RNA, 14 nt, Mycobacterium tuberculosis H37Rv
ggcgaugaccgggc

SEQ ID NO: 1286874 - RNA, 21 nt, Mycobacterium tuberculosis H37Rv
ggcgaugaccgggcgauucgc

SEQ ID NO: 1286875 - RNA, 22 nt, Mycobacterium tuberculosis H37Rv
ggcgauccgauacagugcgcgg

SEQ ID NO: 1286876 - RNA, 15 nt, Mycobacterium tuberculosis H37Rv
ggcgauccccgacgu

SEQ ID NO: 1286877 - RNA, 18 nt, Mycobacterium tuberculosis H37Rv
ggcgauccggucggccag

SEQ ID NO: 1286878 - RNA, 16 nt, Mycobacterium tuberculosis H37Rv
ggcgaucgucaagccg

SEQ ID NO: 1286879 - RNA, 21 nt, Mycobacterium tuberculosis H37Rv
ggcgaucugcugcucgaucau

SEQ ID NO: 1286880 - RNA, 13 nt, Mycobacterium tuberculosis H37Rv
ggcgaucugcgac

SEQ ID NO: 1286881 - RNA, 19 nt, Mycobacterium tuberculosis H37Rv
ggcgaugacaaucaccugg

SEQ ID NO: 1286882 - RNA, 18 nt, Mycobacterium tuberculosis H37Rv
ggcgaugaccacgccgac

SEQ ID NO: 1286883 - RNA, 16 nt, Mycobacterium tuberculosis H37Rv
ggcgaugaacagcgac

SEQ ID NO: 1286884 - RNA, 18 nt, Mycobacterium tuberculosis H37Rv
ggcgaugaacagcgacgc

SEQ ID NO: 1286885 - RNA, 21 nt, Mycobacterium tuberculosis H37Rv
ggcgaucuuggaucgguugga

SEQ ID NO: 1286886 - RNA, 12 nt, Mycobacterium tuberculosis H37Rv
ggcgaucugcug

SEQ ID NO: 1286887 - RNA, 16 nt, Mycobacterium tuberculosis H37Rv
ggcgaucgucagccag

SEQ ID NO: 1286888 - RNA, 15 nt, Mycobacterium tuberculosis H37Rv
ggcgaucucaccugg

SEQ ID NO: 1286889 - RNA, 18 nt, Mycobacterium tuberculosis H37Rv
ggcgaucucaccuggagc

SEQ ID NO: 1286890 - RNA, 15 nt, Mycobacterium tuberculosis H37Rv
ggcgauacagcgaca

SEQ ID NO: 1286891 - RNA, 16 nt, Mycobacterium tuberculosis H37Rv
ggcgaguagucgacgu

SEQ ID NO: 1286892 - RNA, 13 nt, Mycobacterium tuberculosis H37Rv
ggcgagucaccgg

SEQ ID NO: 1286893 - RNA, 21 nt, Mycobacterium tuberculosis H37Rv
ggcgagucaccggguccaccg

SEQ ID NO: 1286894 - RNA, 22 nt, Mycobacterium tuberculosis H37Rv
ggcgagugaaguuguuggccag

SEQ ID NO: 1286895 - RNA, 15 nt, Mycobacterium tuberculosis H37Rv
ggcgagugguccagc

SEQ ID NO: 1286896 - RNA, 20 nt, Mycobacterium tuberculosis H37Rv
ggcgaucaucaggugcgccu

SEQ ID NO: 1286897 - RNA, 14 nt, Mycobacterium tuberculosis H37Rv
ggcgaucaucaggu

SEQ ID NO: 1286898 - RNA, 23 nt, Mycobacterium tuberculosis H37Rv
ggcgaucagcagccgccgaugau

SEQ ID NO: 1286899 - RNA, 13 nt, Mycobacterium tuberculosis H37Rv
ggcgaucaccgcg

SEQ ID NO: 1286900 - RNA, 20 nt, Mycobacterium tuberculosis H37Rv
ggcgaucaacgcgcacgcgu

SEQ ID NO: 1286901 - RNA, 12 nt, Mycobacterium tuberculosis H37Rv
ggcgaucaccga

SEQ ID NO: 1286902 - RNA, 14 nt, Mycobacterium tuberculosis H37Rv
ggcgaucaacucgg

SEQ ID NO: 1286903 - RNA, 22 nt, Mycobacterium tuberculosis H37Rv
ggcgaggucagagaaagccaau

SEQ ID NO: 1286904 - RNA, 17 nt, Mycobacterium tuberculosis H37Rv
ggcgagggcugacggga

SEQ ID NO: 1286905 - RNA, 15 nt, Mycobacterium tuberculosis H37Rv
ggcgagccgcgccca

SEQ ID NO: 1286906 - RNA, 17 nt, Mycobacterium tuberculosis H37Rv
ggcgagccgugccagca

SEQ ID NO: 1286907 - RNA, 22 nt, Mycobacterium tuberculosis H37Rv
ggcgagcgccuuucggucacgc

SEQ ID NO: 1286908 - RNA, 14 nt, Mycobacterium tuberculosis H37Rv
ggcgagccacggca

SEQ ID NO: 1286909 - RNA, 14 nt, Mycobacterium tuberculosis H37Rv
ggcgagcccgcauc

SEQ ID NO: 1286910 - RNA, 17 nt, Mycobacterium tuberculosis H37Rv
ggcgagcccgcaucgca

SEQ ID NO: 1286911 - RNA, 22 nt, Mycobacterium tuberculosis H37Rv
ggcgagcucaacacgagcggua

SEQ ID NO: 1286912 - RNA, 17 nt, Mycobacterium tuberculosis H37Rv
ggcgagcguuuggacgg

SEQ ID NO: 1286913 - RNA, 15 nt, Mycobacterium tuberculosis H37Rv
ggcgagcucgucgag

SEQ ID NO: 1286914 - RNA, 16 nt, Mycobacterium tuberculosis H37Rv
ggcgagcucgucgagc

SEQ ID NO: 1286915 - RNA, 20 nt, Mycobacterium tuberculosis H37Rv
ggcgacguagacgguccggu

SEQ ID NO: 1286916 - RNA, 22 nt, Mycobacterium tuberculosis H37Rv
ggcgacguauaccgcacccugg

SEQ ID NO: 1286917 - RNA, 12 nt, Mycobacterium tuberculosis H37Rv
ggcgacggccaa

SEQ ID NO: 1286918 - RNA, 22 nt, Mycobacterium tuberculosis H37Rv
ggcgacgaugucgagcgcgauc

SEQ ID NO: 1286919 - RNA, 16 nt, Mycobacterium tuberculosis H37Rv
ggcgacgaugucgagc

SEQ ID NO: 1286920 - RNA, 12 nt, Mycobacterium tuberculosis H37Rv
ggcgacgacgac

SEQ ID NO: 1286921 - RNA, 15 nt, Mycobacterium tuberculosis H37Rv
ggcgacgacccgggu

SEQ ID NO: 1286922 - RNA, 20 nt, Mycobacterium tuberculosis H37Rv
ggcgacgacccgggucggca

SEQ ID NO: 1286923 - RNA, 16 nt, Mycobacterium tuberculosis H37Rv
ggcgagcacgucacgc

SEQ ID NO: 1286924 - RNA, 19 nt, Mycobacterium tuberculosis H37Rv
ggcgagcagggcgucgacc

SEQ ID NO: 1286925 - RNA, 22 nt, Mycobacterium tuberculosis H37Rv
ggcgagcagggcgucgaccgcg

SEQ ID NO: 1286926 - RNA, 22 nt, Mycobacterium tuberculosis H37Rv
ggcgagcagacgcagaaucgca

SEQ ID NO: 1286927 - RNA, 19 nt, Mycobacterium tuberculosis H37Rv
ggcgagcaacucguccagc

SEQ ID NO: 1286928 - RNA, 23 nt, Mycobacterium tuberculosis H37Rv
ggcgagcacccgcuggucgagca

SEQ ID NO: 1286929 - RNA, 17 nt, Mycobacterium tuberculosis H37Rv
ggcgagcaacucgucca

SEQ ID NO: 1286930 - RNA, 16 nt, Mycobacterium tuberculosis H37Rv
ggcgagagcgcggaga

SEQ ID NO: 1286931 - RNA, 16 nt, Mycobacterium tuberculosis H37Rv
ggcgagaacaggaucg

SEQ ID NO: 1286932 - RNA, 21 nt, Mycobacterium tuberculosis H37Rv
ggcgagaacccacgcaugcac

SEQ ID NO: 1286933 - RNA, 20 nt, Mycobacterium tuberculosis H37Rv
ggcgacugucuggucggcua

SEQ ID NO: 1286934 - RNA, 17 nt, Mycobacterium tuberculosis H37Rv
ggcgacucgugucugcc

SEQ ID NO: 1286935 - RNA, 22 nt, Mycobacterium tuberculosis H37Rv
ggcgacuacccagccagccgcg

SEQ ID NO: 1286936 - RNA, 15 nt, Mycobacterium tuberculosis H37Rv
ggcgacuaccggcuc

SEQ ID NO: 1286937 - RNA, 17 nt, Mycobacterium tuberculosis H37Rv
ggcgacguuccgcucga

SEQ ID NO: 1286938 - RNA, 16 nt, Mycobacterium tuberculosis H37Rv
ggcgacguuccgcucg

SEQ ID NO: 1286939 - RNA, 17 nt, Mycobacterium tuberculosis H37Rv
ggcgaacagugacgcca

SEQ ID NO: 1286940 - RNA, 23 nt, Mycobacterium tuberculosis H37Rv
ggcgacacgccagccgugccggu

SEQ ID NO: 1286941 - RNA, 24 nt, Mycobacterium tuberculosis H37Rv
ggcgaaauuccgggccuggccugc

SEQ ID NO: 1286942 - RNA, 14 nt, Mycobacterium tuberculosis H37Rv
ggcgaacacgucgg

SEQ ID NO: 1286943 - RNA, 18 nt, Mycobacterium tuberculosis H37Rv
ggcgaacacgucggccag

SEQ ID NO: 1286944 - RNA, 17 nt, Mycobacterium tuberculosis H37Rv
ggcgaccaccagcgccg

SEQ ID NO: 1286945 - RNA, 19 nt, Mycobacterium tuberculosis H37Rv
ggcgaccacgucggcgaac

SEQ ID NO: 1286946 - RNA, 19 nt, Mycobacterium tuberculosis H37Rv
ggcgaccaccgcggcaugu

SEQ ID NO: 1286947 - RNA, 23 nt, Mycobacterium tuberculosis H37Rv
ggcgaccacggcaccgaucaacg

SEQ ID NO: 1286948 - RNA, 11 nt, Mycobacterium tuberculosis H37Rv
ggcgaccacgc

SEQ ID NO: 1286949 - RNA, 14 nt, Mycobacterium tuberculosis H37Rv
ggcgaccaccaccg

SEQ ID NO: 1286950 - RNA, 23 nt, Mycobacterium tuberculosis H37Rv
ggcgacgaagaagaacucggcgu

SEQ ID NO: 1286951 - RNA, 21 nt, Mycobacterium tuberculosis H37Rv
ggcgaccuccggaaucgcccg

SEQ ID NO: 1286952 - RNA, 20 nt, Mycobacterium tuberculosis H37Rv
ggcgaccgucaaccugcugc

SEQ ID NO: 1286953 - RNA, 23 nt, Mycobacterium tuberculosis H37Rv
ggcgaccggcgagcccgcaucgc

SEQ ID NO: 1286954 - RNA, 18 nt, Mycobacterium tuberculosis H37Rv
ggcgaccgagacggcguc

SEQ ID NO: 1286955 - RNA, 20 nt, Mycobacterium tuberculosis H37Rv
ggcgaccgagacggcgucgg

SEQ ID NO: 1286956 - RNA, 16 nt, Mycobacterium tuberculosis H37Rv
ggcgaccgcauccggu

SEQ ID NO: 1286957 - RNA, 22 nt, Mycobacterium tuberculosis H37Rv
ggcgacccgucccccgcacgcg

SEQ ID NO: 1286958 - RNA, 20 nt, Mycobacterium tuberculosis H37Rv
ggcgacccggguagacaccg

SEQ ID NO: 1286959 - RNA, 15 nt, Mycobacterium tuberculosis H37Rv
ggcgacccagcggua

SEQ ID NO: 1286960 - RNA, 16 nt, Mycobacterium tuberculosis H37Rv
ggcgacccagcgguau

SEQ ID NO: 1286961 - RNA, 22 nt, Mycobacterium tuberculosis H37Rv
ggccgagcucguugcuggcggc

SEQ ID NO: 1286962 - RNA, 18 nt, Mycobacterium tuberculosis H37Rv
ggccgagagcagccagcc

SEQ ID NO: 1286963 - RNA, 19 nt, Mycobacterium tuberculosis H37Rv
ggccgacgggacaacccgu

SEQ ID NO: 1286964 - RNA, 14 nt, Mycobacterium tuberculosis H37Rv
ggccgacgucgacc

SEQ ID NO: 1286965 - RNA, 15 nt, Mycobacterium tuberculosis H37Rv
ggccgagcgcaccgc

SEQ ID NO: 1286966 - RNA, 18 nt, Mycobacterium tuberculosis H37Rv
ggccgagcagggccggca

SEQ ID NO: 1286967 - RNA, 23 nt, Mycobacterium tuberculosis H37Rv
ggccgagacggcguugucgacga

SEQ ID NO: 1286968 - RNA, 13 nt, Mycobacterium tuberculosis H37Rv
ggccgagcccggu

SEQ ID NO: 1286969 - RNA, 18 nt, Mycobacterium tuberculosis H37Rv
ggccgaccagagcuucgc

SEQ ID NO: 1286970 - RNA, 22 nt, Mycobacterium tuberculosis H37Rv
ggccgaccagagcuucgccgcg

SEQ ID NO: 1286971 - RNA, 17 nt, Mycobacterium tuberculosis H37Rv
ggccgacagcacgccag

SEQ ID NO: 1286972 - RNA, 18 nt, Mycobacterium tuberculosis H37Rv
ggccgaccagcacaccgg

SEQ ID NO: 1286973 - RNA, 12 nt, Mycobacterium tuberculosis H37Rv
ggccgaccagcc

SEQ ID NO: 1286974 - RNA, 17 nt, Mycobacterium tuberculosis H37Rv
ggccgacagccaccgcg

SEQ ID NO: 1286975 - RNA, 23 nt, Mycobacterium tuberculosis H37Rv
ggcccucuaugcgggcagcgauc

SEQ ID NO: 1286976 - RNA, 17 nt, Mycobacterium tuberculosis H37Rv
ggccgacaaugucggcg

SEQ ID NO: 1286977 - RNA, 14 nt, Mycobacterium tuberculosis H37Rv
ggccgacacgaacg

SEQ ID NO: 1286978 - RNA, 18 nt, Mycobacterium tuberculosis H37Rv
ggccgacaaugucggcga

SEQ ID NO: 1286979 - RNA, 18 nt, Mycobacterium tuberculosis H37Rv
ggcccucgcgcgcgucga

SEQ ID NO: 1286980 - RNA, 19 nt, Mycobacterium tuberculosis H37Rv
ggccgacaccgccaccacg

SEQ ID NO: 1286981 - RNA, 19 nt, Mycobacterium tuberculosis H37Rv
ggcccguuugccgguucgg

SEQ ID NO: 1286982 - RNA, 18 nt, Mycobacterium tuberculosis H37Rv
ggcccgugccacagcucg

SEQ ID NO: 1286983 - RNA, 20 nt, Mycobacterium tuberculosis H37Rv
ggcccgucauacucgacacc

SEQ ID NO: 1286984 - RNA, 15 nt, Mycobacterium tuberculosis H37Rv
ggcccgucgcgucga

SEQ ID NO: 1286985 - RNA, 16 nt, Mycobacterium tuberculosis H37Rv
ggccccgucgccgauc

SEQ ID NO: 1286986 - RNA, 14 nt, Mycobacterium tuberculosis H37Rv
ggccccggugacgc

SEQ ID NO: 1286987 - RNA, 18 nt, Mycobacterium tuberculosis H37Rv
ggccccgggaacgccuca

SEQ ID NO: 1286988 - RNA, 13 nt, Mycobacterium tuberculosis H37Rv
ggccccaggggca

SEQ ID NO: 1286989 - RNA, 17 nt, Mycobacterium tuberculosis H37Rv
ggccccgcaagcggaug

SEQ ID NO: 1286990 - RNA, 16 nt, Mycobacterium tuberculosis H37Rv
ggcccgacacggcggc

SEQ ID NO: 1286991 - RNA, 12 nt, Mycobacterium tuberculosis H37Rv
ggcccgaaacga

SEQ ID NO: 1286992 - RNA, 12 nt, Mycobacterium tuberculosis H37Rv
ggcccgaccugu

SEQ ID NO: 1286993 - RNA, 21 nt, Mycobacterium tuberculosis H37Rv
ggcccgacccggccgauggug

SEQ ID NO: 1286994 - RNA, 13 nt, Mycobacterium tuberculosis H37Rv
ggcccgcacgauc

SEQ ID NO: 1286995 - RNA, 16 nt, Mycobacterium tuberculosis H37Rv
ggcccgcacguuggcg

SEQ ID NO: 1286996 - RNA, 20 nt, Mycobacterium tuberculosis H37Rv
ggccccccgcgccugccuca

SEQ ID NO: 1286997 - RNA, 13 nt, Mycobacterium tuberculosis H37Rv
ggcccccggcagc

SEQ ID NO: 1286998 - RNA, 13 nt, Mycobacterium tuberculosis H37Rv
ggccccacggcgg

SEQ ID NO: 1286999 - RNA, 20 nt, Mycobacterium tuberculosis H37Rv
ggcccagccgagcggcggca

SEQ ID NO: 1287000 - RNA, 21 nt, Mycobacterium tuberculosis H37Rv
ggcccagccggaccgcgacgg

SEQ ID NO: 1287001 - RNA, 19 nt, Mycobacterium tuberculosis H37Rv
ggcccagcccuucagcguc

SEQ ID NO: 1287002 - RNA, 18 nt, Mycobacterium tuberculosis H37Rv
ggcccagccgagcggcgg

SEQ ID NO: 1287003 - RNA, 20 nt, Mycobacterium tuberculosis H37Rv
ggcccguagcgucgaucacg

SEQ ID NO: 1287004 - RNA, 19 nt, Mycobacterium tuberculosis H37Rv
ggcccggcgcggccgcaag

SEQ ID NO: 1287005 - RNA, 21 nt, Mycobacterium tuberculosis H37Rv
ggcccgccgucaccgccguug

SEQ ID NO: 1287006 - RNA, 20 nt, Mycobacterium tuberculosis H37Rv
ggcccgcgagauagcaccag

SEQ ID NO: 1287007 - RNA, 20 nt, Mycobacterium tuberculosis H37Rv
ggcccgcgaauacgaggacg

SEQ ID NO: 1287008 - RNA, 19 nt, Mycobacterium tuberculosis H37Rv
ggcccgccagcccagcacg

SEQ ID NO: 1287009 - RNA, 12 nt, Mycobacterium tuberculosis H37Rv
ggcccgcccgua

SEQ ID NO: 1287010 - RNA, 17 nt, Mycobacterium tuberculosis H37Rv
ggcccgccacgaugucg

SEQ ID NO: 1287011 - RNA, 20 nt, Mycobacterium tuberculosis H37Rv
ggcccgaaucgccugccaca

SEQ ID NO: 1287012 - RNA, 14 nt, Mycobacterium tuberculosis H37Rv
ggcccgcaggucgg

SEQ ID NO: 1287013 - RNA, 12 nt, Mycobacterium tuberculosis H37Rv
ggcccgcaucgu

SEQ ID NO: 1287014 - RNA, 13 nt, Mycobacterium tuberculosis H37Rv
ggcccgcaucguu

SEQ ID NO: 1287015 - RNA, 15 nt, Mycobacterium tuberculosis H37Rv
ggccaggggcgcagc

SEQ ID NO: 1287016 - RNA, 16 nt, Mycobacterium tuberculosis H37Rv
ggccaggggaucaccg

SEQ ID NO: 1287017 - RNA, 17 nt, Mycobacterium tuberculosis H37Rv
ggccaggggaucaccgg

SEQ ID NO: 1287018 - RNA, 18 nt, Mycobacterium tuberculosis H37Rv
ggccaggggaucaccggc

SEQ ID NO: 1287019 - RNA, 19 nt, Mycobacterium tuberculosis H37Rv
ggccaggggaucaccggcu

SEQ ID NO: 1287020 - RNA, 16 nt, Mycobacterium tuberculosis H37Rv
ggccagggucagcucg

SEQ ID NO: 1287021 - RNA, 15 nt, Mycobacterium tuberculosis H37Rv
ggccaggucgacacc

SEQ ID NO: 1287022 - RNA, 20 nt, Mycobacterium tuberculosis H37Rv
ggccaggcgguacgggucgc

SEQ ID NO: 1287023 - RNA, 23 nt, Mycobacterium tuberculosis H37Rv
ggccagcgcaucuuugaacgcca

SEQ ID NO: 1287024 - RNA, 14 nt, Mycobacterium tuberculosis H37Rv
ggccagcgcaccgc

SEQ ID NO: 1287025 - RNA, 14 nt, Mycobacterium tuberculosis H37Rv
ggccagcgcaucgg

SEQ ID NO: 1287026 - RNA, 16 nt, Mycobacterium tuberculosis H37Rv
ggccaguucgucggcg

SEQ ID NO: 1287027 - RNA, 17 nt, Mycobacterium tuberculosis H37Rv
ggccagugcgcgcguca

SEQ ID NO: 1287028 - RNA, 16 nt, Mycobacterium tuberculosis H37Rv
ggccaucacggucagc

SEQ ID NO: 1287029 - RNA, 19 nt, Mycobacterium tuberculosis H37Rv
ggccaucacggucagcucg

SEQ ID NO: 1287030 - RNA, 19 nt, Mycobacterium tuberculosis H37Rv
ggccaucacggcggggauc

SEQ ID NO: 1287031 - RNA, 14 nt, Mycobacterium tuberculosis H37Rv
ggccaucacgguca

SEQ ID NO: 1287032 - RNA, 19 nt, Mycobacterium tuberculosis H37Rv
ggccauagcgccgcgccca

SEQ ID NO: 1287033 - RNA, 15 nt, Mycobacterium tuberculosis H37Rv
ggccaguaugcggug

SEQ ID NO: 1287034 - RNA, 19 nt, Mycobacterium tuberculosis H37Rv
ggccaguaugcggugcccg

SEQ ID NO: 1287035 - RNA, 17 nt, Mycobacterium tuberculosis H37Rv
ggccaguacgucgauca

SEQ ID NO: 1287036 - RNA, 16 nt, Mycobacterium tuberculosis H37Rv
ggccaguacgucgauc

SEQ ID NO: 1287037 - RNA, 15 nt, Mycobacterium tuberculosis H37Rv
ggccaggucggcgau

SEQ ID NO: 1287038 - RNA, 15 nt, Mycobacterium tuberculosis H37Rv
ggccagggugaccag

SEQ ID NO: 1287039 - RNA, 16 nt, Mycobacterium tuberculosis H37Rv
ggccaggucgagcacc

SEQ ID NO: 1287040 - RNA, 14 nt, Mycobacterium tuberculosis H37Rv
ggccaggucgacgg

SEQ ID NO: 1287041 - RNA, 14 nt, Mycobacterium tuberculosis H37Rv
ggccaggucggcca

SEQ ID NO: 1287042 - RNA, 21 nt, Mycobacterium tuberculosis H37Rv
ggccauucuuggugaucgcga

SEQ ID NO: 1287043 - RNA, 19 nt, Mycobacterium tuberculosis H37Rv
ggccauucaccgcgcacga

SEQ ID NO: 1287044 - RNA, 16 nt, Mycobacterium tuberculosis H37Rv
ggccauguggacggca

SEQ ID NO: 1287045 - RNA, 22 nt, Mycobacterium tuberculosis H37Rv
ggccaugucagcggccugcucg

SEQ ID NO: 1287046 - RNA, 23 nt, Mycobacterium tuberculosis H37Rv
ggccaugucagcggccugcucgg

SEQ ID NO: 1287047 - RNA, 22 nt, Mycobacterium tuberculosis H37Rv
ggccaugguccaagugggccgg

SEQ ID NO: 1287048 - RNA, 16 nt, Mycobacterium tuberculosis H37Rv
ggcccaacaccgccag

SEQ ID NO: 1287049 - RNA, 17 nt, Mycobacterium tuberculosis H37Rv
ggcccaacaccgccaga

SEQ ID NO: 1287050 - RNA, 20 nt, Mycobacterium tuberculosis H37Rv
ggcccacggugcgaucccca

SEQ ID NO: 1287051 - RNA, 13 nt, Mycobacterium tuberculosis H37Rv
ggcccacggcgac

SEQ ID NO: 1287052 - RNA, 17 nt, Mycobacterium tuberculosis H37Rv
ggcccacggcgaccagg

SEQ ID NO: 1287053 - RNA, 17 nt, Mycobacterium tuberculosis H37Rv
ggcccaccggucgcgca

SEQ ID NO: 1287054 - RNA, 14 nt, Mycobacterium tuberculosis H37Rv
ggcccaccagcgca

SEQ ID NO: 1287055 - RNA, 13 nt, Mycobacterium tuberculosis H37Rv
ggcccaccgacgg

SEQ ID NO: 1287056 - RNA, 21 nt, Mycobacterium tuberculosis H37Rv
ggccauccggucgcucgaugg

SEQ ID NO: 1287057 - RNA, 23 nt, Mycobacterium tuberculosis H37Rv
ggccauccggucgcucgauggau

SEQ ID NO: 1287058 - RNA, 18 nt, Mycobacterium tuberculosis H37Rv
ggccauccguaucacggu

SEQ ID NO: 1287059 - RNA, 19 nt, Mycobacterium tuberculosis H37Rv
ggccaucugauccgguguc

SEQ ID NO: 1287060 - RNA, 15 nt, Mycobacterium tuberculosis H37Rv
ggccaucugauccgg

SEQ ID NO: 1287061 - RNA, 19 nt, Mycobacterium tuberculosis H37Rv
ggccaucucgucgaugucg

SEQ ID NO: 1287062 - RNA, 12 nt, Mycobacterium tuberculosis H37Rv
ggccaucgucgu

SEQ ID NO: 1287063 - RNA, 17 nt, Mycobacterium tuberculosis H37Rv
ggccaucucgucgaugu

SEQ ID NO: 1287064 - RNA, 19 nt, Mycobacterium tuberculosis H37Rv
ggccaucgaccguccgggu

SEQ ID NO: 1287065 - RNA, 12 nt, Mycobacterium tuberculosis H37Rv
ggccaugaugau

SEQ ID NO: 1287066 - RNA, 13 nt, Mycobacterium tuberculosis H37Rv
ggccaugcugguc

SEQ ID NO: 1287067 - RNA, 18 nt, Mycobacterium tuberculosis H37Rv
ggauguccgcggccacca

SEQ ID NO: 1287068 - RNA, 22 nt, Mycobacterium tuberculosis H37Rv
ggauguaguuggcgaccugcgc

SEQ ID NO: 1287069 - RNA, 17 nt, Mycobacterium tuberculosis H37Rv
ggaugugggcgcucgca

SEQ ID NO: 1287070 - RNA, 14 nt, Mycobacterium tuberculosis H37Rv
ggcagaucgauacc

SEQ ID NO: 1287071 - RNA, 16 nt, Mycobacterium tuberculosis H37Rv
ggcagcaacaggccca

SEQ ID NO: 1287072 - RNA, 23 nt, Mycobacterium tuberculosis H37Rv
ggcagcaacaggcccacggcgac

SEQ ID NO: 1287073 - RNA, 13 nt, Mycobacterium tuberculosis H37Rv
ggcagcacgaccu

SEQ ID NO: 1287074 - RNA, 19 nt, Mycobacterium tuberculosis H37Rv
ggcagcccguggucgauca

SEQ ID NO: 1287075 - RNA, 16 nt, Mycobacterium tuberculosis H37Rv
ggcagccgggcgucgc

SEQ ID NO: 1287076 - RNA, 18 nt, Mycobacterium tuberculosis H37Rv
ggcagccgcacgguucgg

SEQ ID NO: 1287077 - RNA, 14 nt, Mycobacterium tuberculosis H37Rv
ggcagccaccguca

SEQ ID NO: 1287078 - RNA, 14 nt, Mycobacterium tuberculosis H37Rv
ggcagccaccagcg

SEQ ID NO: 1287079 - RNA, 15 nt, Mycobacterium tuberculosis H37Rv
ggcagcacgucacgc

SEQ ID NO: 1287080 - RNA, 19 nt, Mycobacterium tuberculosis H37Rv
ggcagcgcccagaucgccg

SEQ ID NO: 1287081 - RNA, 17 nt, Mycobacterium tuberculosis H37Rv
ggcagcucaucgcgcac

SEQ ID NO: 1287082 - RNA, 17 nt, Mycobacterium tuberculosis H37Rv
ggcagcugguaaccggc

SEQ ID NO: 1287083 - RNA, 19 nt, Mycobacterium tuberculosis H37Rv
ggcagcugguaggucaccg

SEQ ID NO: 1287084 - RNA, 22 nt, Mycobacterium tuberculosis H37Rv
ggcaggacugaacaguugcaca

SEQ ID NO: 1287085 - RNA, 22 nt, Mycobacterium tuberculosis H37Rv
ggcagcuuggacucaucggcgu

SEQ ID NO: 1287086 - RNA, 19 nt, Mycobacterium tuberculosis H37Rv
ggcagcuuugagucccggu

SEQ ID NO: 1287087 - RNA, 13 nt, Mycobacterium tuberculosis H37Rv
ggcagccucgagu

SEQ ID NO: 1287088 - RNA, 19 nt, Mycobacterium tuberculosis H37Rv
ggcagcgaaagcgucgagc

SEQ ID NO: 1287089 - RNA, 14 nt, Mycobacterium tuberculosis H37Rv
ggcaggugaucccg

SEQ ID NO: 1287090 - RNA, 19 nt, Mycobacterium tuberculosis H37Rv
ggcauaaacaucgguggcg

SEQ ID NO: 1287091 - RNA, 16 nt, Mycobacterium tuberculosis H37Rv
ggcaguggcagcccgu

SEQ ID NO: 1287092 - RNA, 17 nt, Mycobacterium tuberculosis H37Rv
ggcaguucgcggccauc

SEQ ID NO: 1287093 - RNA, 13 nt, Mycobacterium tuberculosis H37Rv
ggcaggccagcau

SEQ ID NO: 1287094 - RNA, 13 nt, Mycobacterium tuberculosis H37Rv
ggcaggcauggcg

SEQ ID NO: 1287095 - RNA, 12 nt, Mycobacterium tuberculosis H37Rv
ggccagaccgaa

SEQ ID NO: 1287096 - RNA, 21 nt, Mycobacterium tuberculosis H37Rv
ggccagagccgcgcgccgguu

SEQ ID NO: 1287097 - RNA, 23 nt, Mycobacterium tuberculosis H37Rv
ggccacugcguuccaucgccgac

SEQ ID NO: 1287098 - RNA, 22 nt, Mycobacterium tuberculosis H37Rv
ggccacuuggaugcgacccguu

SEQ ID NO: 1287099 - RNA, 19 nt, Mycobacterium tuberculosis H37Rv
ggccagaaacgcgauggug

SEQ ID NO: 1287100 - RNA, 14 nt, Mycobacterium tuberculosis H37Rv
ggccagaucacgca

SEQ ID NO: 1287101 - RNA, 17 nt, Mycobacterium tuberculosis H37Rv
ggccagccgcuccacgu

SEQ ID NO: 1287102 - RNA, 11 nt, Mycobacterium tuberculosis H37Rv
ggccagccgac

SEQ ID NO: 1287103 - RNA, 17 nt, Mycobacterium tuberculosis H37Rv
ggccagcccgagcucgg

SEQ ID NO: 1287104 - RNA, 18 nt, Mycobacterium tuberculosis H37Rv
ggccacgaccucgggauc

SEQ ID NO: 1287105 - RNA, 17 nt, Mycobacterium tuberculosis H37Rv
ggccacgccgaucaaca

SEQ ID NO: 1287106 - RNA, 22 nt, Mycobacterium tuberculosis H37Rv
ggccaccagugcgggguccagc

SEQ ID NO: 1287107 - RNA, 21 nt, Mycobacterium tuberculosis H37Rv
ggccaccaucaccucgcacga

SEQ ID NO: 1287108 - RNA, 22 nt, Mycobacterium tuberculosis H37Rv
ggccaccccgaccucccggcaa

SEQ ID NO: 1287109 - RNA, 14 nt, Mycobacterium tuberculosis H37Rv
ggccacccccguca

SEQ ID NO: 1287110 - RNA, 17 nt, Mycobacterium tuberculosis H37Rv
ggccaccacgugcgcgu

SEQ ID NO: 1287111 - RNA, 14 nt, Mycobacterium tuberculosis H37Rv
ggccaccaccucgg

SEQ ID NO: 1287112 - RNA, 18 nt, Mycobacterium tuberculosis H37Rv
ggccaccacgcgccgcac

SEQ ID NO: 1287113 - RNA, 21 nt, Mycobacterium tuberculosis H37Rv
ggccaccaccgccgccggcac

SEQ ID NO: 1287114 - RNA, 23 nt, Mycobacterium tuberculosis H37Rv
ggccaccaccgccgccggcaccg

SEQ ID NO: 1287115 - RNA, 17 nt, Mycobacterium tuberculosis H37Rv
ggccaccaccacggcca

SEQ ID NO: 1287116 - RNA, 14 nt, Mycobacterium tuberculosis H37Rv
ggccacaugccaca

SEQ ID NO: 1287117 - RNA, 23 nt, Mycobacterium tuberculosis H37Rv
ggccacaaccgaauccaucgaga

SEQ ID NO: 1287118 - RNA, 22 nt, Mycobacterium tuberculosis H37Rv
ggccacagcaacgugugcacca

SEQ ID NO: 1287119 - RNA, 13 nt, Mycobacterium tuberculosis H37Rv
ggccacaccguca

SEQ ID NO: 1287120 - RNA, 14 nt, Mycobacterium tuberculosis H37Rv
ggccaagccggagc

SEQ ID NO: 1287121 - RNA, 20 nt, Mycobacterium tuberculosis H37Rv
ggccaauagaagcacgucgu

SEQ ID NO: 1287122 - RNA, 15 nt, Mycobacterium tuberculosis H37Rv
ggccaagccggcgag

SEQ ID NO: 1287123 - RNA, 20 nt, Mycobacterium tuberculosis H37Rv
ggcauugcccgagcccagcg

SEQ ID NO: 1287124 - RNA, 18 nt, Mycobacterium tuberculosis H37Rv
ggcauugcuccgguuggc

SEQ ID NO: 1287125 - RNA, 18 nt, Mycobacterium tuberculosis H37Rv
ggccaacccugcggcguc

SEQ ID NO: 1287126 - RNA, 18 nt, Mycobacterium tuberculosis H37Rv
ggccaaccgggugugcgu

SEQ ID NO: 1287127 - RNA, 16 nt, Mycobacterium tuberculosis H37Rv
ggccaacggcgcugcc

SEQ ID NO: 1287128 - RNA, 17 nt, Mycobacterium tuberculosis H37Rv
ggccaacgacggccgac

SEQ ID NO: 1287129 - RNA, 19 nt, Mycobacterium tuberculosis H37Rv
ggccaacgacggccgacaa

SEQ ID NO: 1287130 - RNA, 14 nt, Mycobacterium tuberculosis H37Rv
ggccaagaucggcg

SEQ ID NO: 1287131 - RNA, 19 nt, Mycobacterium tuberculosis H37Rv
ggccaacuugcucagcucg

SEQ ID NO: 1287132 - RNA, 15 nt, Mycobacterium tuberculosis H37Rv
ggccaacucgacauc

SEQ ID NO: 1287133 - RNA, 20 nt, Mycobacterium tuberculosis H37Rv
ggcauguaccgaccgcguug

SEQ ID NO: 1287134 - RNA, 19 nt, Mycobacterium tuberculosis H37Rv
ggcauguaccgaccgcguu

SEQ ID NO: 1287135 - RNA, 14 nt, Mycobacterium tuberculosis H37Rv
ggcauggucgccgg

SEQ ID NO: 1287136 - RNA, 15 nt, Mycobacterium tuberculosis H37Rv
ggcauggcgccguug

SEQ ID NO: 1287137 - RNA, 14 nt, Mycobacterium tuberculosis H37Rv
ggcauucgucgagu

SEQ ID NO: 1287138 - RNA, 16 nt, Mycobacterium tuberculosis H37Rv
ggcauucccgcucgca

SEQ ID NO: 1287139 - RNA, 16 nt, Mycobacterium tuberculosis H37Rv
ggcauucccgcggcaa

SEQ ID NO: 1287140 - RNA, 16 nt, Mycobacterium tuberculosis H37Rv
ggcauagcagccagcg

SEQ ID NO: 1287141 - RNA, 17 nt, Mycobacterium tuberculosis H37Rv
ggcauagcagccagcgu

SEQ ID NO: 1287142 - RNA, 22 nt, Mycobacterium tuberculosis H37Rv
ggcauagaucgggucguuggcg

SEQ ID NO: 1287143 - RNA, 14 nt, Mycobacterium tuberculosis H37Rv
ggcaucaccgccgc

SEQ ID NO: 1287144 - RNA, 22 nt, Mycobacterium tuberculosis H37Rv
ggcaucaccgacgcgucggcga

SEQ ID NO: 1287145 - RNA, 14 nt, Mycobacterium tuberculosis H37Rv
ggcaucaccgacgc

SEQ ID NO: 1287146 - RNA, 16 nt, Mycobacterium tuberculosis H37Rv
ggcaucaccggaaccc

SEQ ID NO: 1287147 - RNA, 17 nt, Mycobacterium tuberculosis H37Rv
ggcauccaaaaucgccu

SEQ ID NO: 1287148 - RNA, 24 nt, Mycobacterium tuberculosis H37Rv
ggcgcgaucgcucauucgugcccg

SEQ ID NO: 1287149 - RNA, 20 nt, Mycobacterium tuberculosis H37Rv
ggcgcgaucgacgcucggcu

SEQ ID NO: 1287150 - RNA, 14 nt, Mycobacterium tuberculosis H37Rv
ggcgcgcaccaccg

SEQ ID NO: 1287151 - RNA, 21 nt, Mycobacterium tuberculosis H37Rv
ggcgcgauacagacggggauc

SEQ ID NO: 1287152 - RNA, 21 nt, Mycobacterium tuberculosis H37Rv
ggcgcgcaucugcucggcauc

SEQ ID NO: 1287153 - RNA, 18 nt, Mycobacterium tuberculosis H37Rv
ggcgcgcagcgacgcggu

SEQ ID NO: 1287154 - RNA, 14 nt, Mycobacterium tuberculosis H37Rv
ggcgcgcaccucgg

SEQ ID NO: 1287155 - RNA, 17 nt, Mycobacterium tuberculosis H37Rv
ggcgcgcaccccggcau

SEQ ID NO: 1287156 - RNA, 16 nt, Mycobacterium tuberculosis H37Rv
ggcgcgcugcccacgg

SEQ ID NO: 1287157 - RNA, 19 nt, Mycobacterium tuberculosis H37Rv
ggcgcgcugcacggaaucg

SEQ ID NO: 1287158 - RNA, 17 nt, Mycobacterium tuberculosis H37Rv
ggcgcgcucaucgaccg

SEQ ID NO: 1287159 - RNA, 13 nt, Mycobacterium tuberculosis H37Rv
ggcgcgcucggcc

SEQ ID NO: 1287160 - RNA, 22 nt, Mycobacterium tuberculosis H37Rv
ggcgcggaacgcgucgccgacg

SEQ ID NO: 1287161 - RNA, 12 nt, Mycobacterium tuberculosis H37Rv
ggcgcgccgcau

SEQ ID NO: 1287162 - RNA, 18 nt, Mycobacterium tuberculosis H37Rv
ggcgcgccggccaugccu

SEQ ID NO: 1287163 - RNA, 23 nt, Mycobacterium tuberculosis H37Rv
ggcgcgccccaccgcgccgagca

SEQ ID NO: 1287164 - RNA, 17 nt, Mycobacterium tuberculosis H37Rv
ggcgcguggucgggaac

SEQ ID NO: 1287165 - RNA, 15 nt, Mycobacterium tuberculosis H37Rv
ggcgcggcgggcagc

SEQ ID NO: 1287166 - RNA, 14 nt, Mycobacterium tuberculosis H37Rv
ggcgcggcggcguc

SEQ ID NO: 1287167 - RNA, 13 nt, Mycobacterium tuberculosis H37Rv
ggcgcuagcgccg

SEQ ID NO: 1287168 - RNA, 18 nt, Mycobacterium tuberculosis H37Rv
ggcgcucgcaucaucgga

SEQ ID NO: 1287169 - RNA, 14 nt, Mycobacterium tuberculosis H37Rv
ggcgcucggcgagc

SEQ ID NO: 1287170 - RNA, 17 nt, Mycobacterium tuberculosis H37Rv
ggcgcucggcgagcuca

SEQ ID NO: 1287171 - RNA, 21 nt, Mycobacterium tuberculosis H37Rv
ggcgcuaccagccauagugcg

SEQ ID NO: 1287172 - RNA, 22 nt, Mycobacterium tuberculosis H37Rv
ggcgcuagccagggaucagccg

SEQ ID NO: 1287173 - RNA, 17 nt, Mycobacterium tuberculosis H37Rv
ggcgcuaaaacgccagu

SEQ ID NO: 1287174 - RNA, 20 nt, Mycobacterium tuberculosis H37Rv
ggcgcugauccggucggcca

SEQ ID NO: 1287175 - RNA, 16 nt, Mycobacterium tuberculosis H37Rv
ggcgcugaagccgacg

SEQ ID NO: 1287176 - RNA, 14 nt, Mycobacterium tuberculosis H37Rv
ggcgcugcgcgauc

SEQ ID NO: 1287177 - RNA, 13 nt, Mycobacterium tuberculosis H37Rv
ggcgcugcgcacc

SEQ ID NO: 1287178 - RNA, 15 nt, Mycobacterium tuberculosis H37Rv
ggcgcugccgggauc

SEQ ID NO: 1287179 - RNA, 14 nt, Mycobacterium tuberculosis H37Rv
ggcgcugccgggau

SEQ ID NO: 1287180 - RNA, 16 nt, Mycobacterium tuberculosis H37Rv
ggcggaaaaucggcug

SEQ ID NO: 1287181 - RNA, 19 nt, Mycobacterium tuberculosis H37Rv
ggcggccaacagcacccgg

SEQ ID NO: 1287182 - RNA, 20 nt, Mycobacterium tuberculosis H37Rv
ggcggccaccgucagcgcga

SEQ ID NO: 1287183 - RNA, 19 nt, Mycobacterium tuberculosis H37Rv
ggcggccaccgucagcgcg

SEQ ID NO: 1287184 - RNA, 15 nt, Mycobacterium tuberculosis H37Rv
ggcggccagcaucgg

SEQ ID NO: 1287185 - RNA, 13 nt, Mycobacterium tuberculosis H37Rv
ggcggccagcauc

SEQ ID NO: 1287186 - RNA, 13 nt, Mycobacterium tuberculosis H37Rv
ggcggccagcgca

SEQ ID NO: 1287187 - RNA, 14 nt, Mycobacterium tuberculosis H37Rv
ggcggccagcgaac

SEQ ID NO: 1287188 - RNA, 16 nt, Mycobacterium tuberculosis H37Rv
ggcggccgcagcggcc

SEQ ID NO: 1287189 - RNA, 19 nt, Mycobacterium tuberculosis H37Rv
ggcggccgccaucagccgc

SEQ ID NO: 1287190 - RNA, 16 nt, Mycobacterium tuberculosis H37Rv
ggcggccgagcgcacc

SEQ ID NO: 1287191 - RNA, 22 nt, Mycobacterium tuberculosis H37Rv
ggcggcccgcucgggguugcuc

SEQ ID NO: 1287192 - RNA, 15 nt, Mycobacterium tuberculosis H37Rv
ggcggccagcuccag

SEQ ID NO: 1287193 - RNA, 13 nt, Mycobacterium tuberculosis H37Rv
ggcggcaucgccg

SEQ ID NO: 1287194 - RNA, 21 nt, Mycobacterium tuberculosis H37Rv
ggcggcaucgaguucggcccg

SEQ ID NO: 1287195 - RNA, 15 nt, Mycobacterium tuberculosis H37Rv
ggcggcauccccagu

SEQ ID NO: 1287196 - RNA, 18 nt, Mycobacterium tuberculosis H37Rv
ggcggcaucgaggccagc

SEQ ID NO: 1287197 - RNA, 15 nt, Mycobacterium tuberculosis H37Rv
ggcggcaucgccgag

SEQ ID NO: 1287198 - RNA, 20 nt, Mycobacterium tuberculosis H37Rv
ggcggcaucgccgaggugga

SEQ ID NO: 1287199 - RNA, 14 nt, Mycobacterium tuberculosis H37Rv
ggcggcaucgccga

SEQ ID NO: 1287200 - RNA, 20 nt, Mycobacterium tuberculosis H37Rv
ggcggcagcgaggcucgcag

SEQ ID NO: 1287201 - RNA, 19 nt, Mycobacterium tuberculosis H37Rv
ggcggcacuggauccggga

SEQ ID NO: 1287202 - RNA, 21 nt, Mycobacterium tuberculosis H37Rv
ggcggcacuggauccgggagu

SEQ ID NO: 1287203 - RNA, 17 nt, Mycobacterium tuberculosis H37Rv
ggcggcaagcucgacga

SEQ ID NO: 1287204 - RNA, 14 nt, Mycobacterium tuberculosis H37Rv
ggcggcaaggacgg

SEQ ID NO: 1287205 - RNA, 17 nt, Mycobacterium tuberculosis H37Rv
ggcggcacgcucgcgca

SEQ ID NO: 1287206 - RNA, 17 nt, Mycobacterium tuberculosis H37Rv
ggcggaaggacggcagc

SEQ ID NO: 1287207 - RNA, 19 nt, Mycobacterium tuberculosis H37Rv
ggcggaaucgucggcuagc

SEQ ID NO: 1287208 - RNA, 16 nt, Mycobacterium tuberculosis H37Rv
ggcgggacucggcgag

SEQ ID NO: 1287209 - RNA, 13 nt, Mycobacterium tuberculosis H37Rv
ggcggcuccaccg

SEQ ID NO: 1287210 - RNA, 22 nt, Mycobacterium tuberculosis H37Rv
ggcggcucccauggcgcgagca

SEQ ID NO: 1287211 - RNA, 18 nt, Mycobacterium tuberculosis H37Rv
ggcggcgugguauccgcc

SEQ ID NO: 1287212 - RNA, 22 nt, Mycobacterium tuberculosis H37Rv
ggcggcgugguuuugucgacgu

SEQ ID NO: 1287213 - RNA, 21 nt, Mycobacterium tuberculosis H37Rv
ggcggcgugaagugagcucgg

SEQ ID NO: 1287214 - RNA, 23 nt, Mycobacterium tuberculosis H37Rv
ggcggcuaggcaccagcggaucg

SEQ ID NO: 1287215 - RNA, 14 nt, Mycobacterium tuberculosis H37Rv
ggcggcgugcccgu

SEQ ID NO: 1287216 - RNA, 16 nt, Mycobacterium tuberculosis H37Rv
ggcggcgugcuccugc

SEQ ID NO: 1287217 - RNA, 13 nt, Mycobacterium tuberculosis H37Rv
ggcggcguccagc

SEQ ID NO: 1287218 - RNA, 14 nt, Mycobacterium tuberculosis H37Rv
ggcggcgucgacgg

SEQ ID NO: 1287219 - RNA, 13 nt, Mycobacterium tuberculosis H37Rv
ggcggcgucgaca

SEQ ID NO: 1287220 - RNA, 18 nt, Mycobacterium tuberculosis H37Rv
ggcggcgggccucggcga

SEQ ID NO: 1287221 - RNA, 15 nt, Mycobacterium tuberculosis H37Rv
ggcggcggugcguca

SEQ ID NO: 1287222 - RNA, 15 nt, Mycobacterium tuberculosis H37Rv
ggcggcggucgagcu

SEQ ID NO: 1287223 - RNA, 13 nt, Mycobacterium tuberculosis H37Rv
ggcggcgguccgc

SEQ ID NO: 1287224 - RNA, 14 nt, Mycobacterium tuberculosis H37Rv
ggcggcggccagcc

SEQ ID NO: 1287225 - RNA, 23 nt, Mycobacterium tuberculosis H37Rv
ggcggcggccauagugaggccga

SEQ ID NO: 1287226 - RNA, 15 nt, Mycobacterium tuberculosis H37Rv
ggcggcggcgcgauc

SEQ ID NO: 1287227 - RNA, 18 nt, Mycobacterium tuberculosis H37Rv
ggcggcggauuccggcau

SEQ ID NO: 1287228 - RNA, 13 nt, Mycobacterium tuberculosis H37Rv
ggcggcggcacgc

SEQ ID NO: 1287229 - RNA, 22 nt, Mycobacterium tuberculosis H37Rv
ggcggcgccggggggcugcugc

SEQ ID NO: 1287230 - RNA, 17 nt, Mycobacterium tuberculosis H37Rv
ggcggccuugcucagca

SEQ ID NO: 1287231 - RNA, 17 nt, Mycobacterium tuberculosis H37Rv
ggcggccuuuuccgggu

SEQ ID NO: 1287232 - RNA, 19 nt, Mycobacterium tuberculosis H37Rv
ggcggcgaacucggcgaug

SEQ ID NO: 1287233 - RNA, 13 nt, Mycobacterium tuberculosis H37Rv
ggcggcgccgcag

SEQ ID NO: 1287234 - RNA, 20 nt, Mycobacterium tuberculosis H37Rv
ggcggcgccgcagaucaccg

SEQ ID NO: 1287235 - RNA, 18 nt, Mycobacterium tuberculosis H37Rv
ggcggcgccccgguuggc

SEQ ID NO: 1287236 - RNA, 22 nt, Mycobacterium tuberculosis H37Rv
ggcuaccccagggagugccgca

SEQ ID NO: 1287237 - RNA, 17 nt, Mycobacterium tuberculosis H37Rv
ggcuacccaauaggcga

SEQ ID NO: 1287238 - RNA, 20 nt, Mycobacterium tuberculosis H37Rv
ggcuaauagcucgccggcga

SEQ ID NO: 1287239 - RNA, 14 nt, Mycobacterium tuberculosis H37Rv
ggcguuggcaugag

SEQ ID NO: 1287240 - RNA, 20 nt, Mycobacterium tuberculosis H37Rv
ggcguugcugaugucgccgg

SEQ ID NO: 1287241 - RNA, 14 nt, Mycobacterium tuberculosis H37Rv
ggcguugccaccgg

SEQ ID NO: 1287242 - RNA, 12 nt, Mycobacterium tuberculosis H37Rv
ggcguugccgcc

SEQ ID NO: 1287243 - RNA, 18 nt, Mycobacterium tuberculosis H37Rv
ggcguuaaugcuucgcgu

SEQ ID NO: 1287244 - RNA, 15 nt, Mycobacterium tuberculosis H37Rv
ggcgugucgcgucgu

SEQ ID NO: 1287245 - RNA, 19 nt, Mycobacterium tuberculosis H37Rv
ggcguguucgacggcaagc

SEQ ID NO: 1287246 - RNA, 16 nt, Mycobacterium tuberculosis H37Rv
ggcguguacgucgauc

SEQ ID NO: 1287247 - RNA, 18 nt, Mycobacterium tuberculosis H37Rv
ggcguguagccugcggcg

SEQ ID NO: 1287248 - RNA, 23 nt, Mycobacterium tuberculosis H37Rv
ggcgugguggaaacugaugucgc

SEQ ID NO: 1287249 - RNA, 15 nt, Mycobacterium tuberculosis H37Rv
ggcgugucacgucgc

SEQ ID NO: 1287250 - RNA, 18 nt, Mycobacterium tuberculosis H37Rv
ggcguggucgcgcggcac

SEQ ID NO: 1287251 - RNA, 24 nt, Mycobacterium tuberculosis H37Rv
ggcguggucaccccuucgccagcg

SEQ ID NO: 1287252 - RNA, 22 nt, Mycobacterium tuberculosis H37Rv
ggcguggucaccccuucgccag

SEQ ID NO: 1287253 - RNA, 19 nt, Mycobacterium tuberculosis H37Rv
ggcgugggugucggcuagc

SEQ ID NO: 1287254 - RNA, 23 nt, Mycobacterium tuberculosis H37Rv
ggcgugcagaauccguucgacga

SEQ ID NO: 1287255 - RNA, 20 nt, Mycobacterium tuberculosis H37Rv
ggcgugcacccccaucaccg

SEQ ID NO: 1287256 - RNA, 16 nt, Mycobacterium tuberculosis H37Rv
ggcgugagcgcgcgca

SEQ ID NO: 1287257 - RNA, 15 nt, Mycobacterium tuberculosis H37Rv
ggcgucgcaacgcga

SEQ ID NO: 1287258 - RNA, 23 nt, Mycobacterium tuberculosis H37Rv
ggcgucgaugucauccgacaagc

SEQ ID NO: 1287259 - RNA, 22 nt, Mycobacterium tuberculosis H37Rv
ggcgucgaugucgccgcccaca

SEQ ID NO: 1287260 - RNA, 20 nt, Mycobacterium tuberculosis H37Rv
ggcgugggugucggcgaagc

SEQ ID NO: 1287261 - RNA, 17 nt, Mycobacterium tuberculosis H37Rv
ggcguggcccucggcga

SEQ ID NO: 1287262 - RNA, 23 nt, Mycobacterium tuberculosis H37Rv
ggcguggaucuuggccagcagcg

SEQ ID NO: 1287263 - RNA, 14 nt, Mycobacterium tuberculosis H37Rv
ggcgugcccgucgu

SEQ ID NO: 1287264 - RNA, 17 nt, Mycobacterium tuberculosis H37Rv
ggcgugcccgccggcga

SEQ ID NO: 1287265 - RNA, 23 nt, Mycobacterium tuberculosis H37Rv
ggcucgcaccgugaguacucggu

SEQ ID NO: 1287266 - RNA, 23 nt, Mycobacterium tuberculosis H37Rv
ggcucgcauguucuccacgccga

SEQ ID NO: 1287267 - RNA, 15 nt, Mycobacterium tuberculosis H37Rv
ggcucgccaccucgg

SEQ ID NO: 1287268 - RNA, 22 nt, Mycobacterium tuberculosis H37Rv
ggcucgaguguggccgaaagcc

SEQ ID NO: 1287269 - RNA, 15 nt, Mycobacterium tuberculosis H37Rv
ggcucgacugccacc

SEQ ID NO: 1287270 - RNA, 19 nt, Mycobacterium tuberculosis H37Rv
ggcucgagcaagaucaccu

SEQ ID NO: 1287271 - RNA, 16 nt, Mycobacterium tuberculosis H37Rv
ggcucgagucgcagca

SEQ ID NO: 1287272 - RNA, 19 nt, Mycobacterium tuberculosis H37Rv
ggcucgagucgcagcacgg

SEQ ID NO: 1287273 - RNA, 16 nt, Mycobacterium tuberculosis H37Rv
ggcucgaagcuggcgc

SEQ ID NO: 1287274 - RNA, 20 nt, Mycobacterium tuberculosis H37Rv
ggcucgaagcuggcgccgca

SEQ ID NO: 1287275 - RNA, 14 nt, Mycobacterium tuberculosis H37Rv
ggcuccgugguugc

SEQ ID NO: 1287276 - RNA, 15 nt, Mycobacterium tuberculosis H37Rv
ggcucgcucgccgag

SEQ ID NO: 1287277 - RNA, 16 nt, Mycobacterium tuberculosis H37Rv
ggcucgcgcucgaugg

SEQ ID NO: 1287278 - RNA, 18 nt, Mycobacterium tuberculosis H37Rv
ggcucgcgaucgucacgg

SEQ ID NO: 1287279 - RNA, 17 nt, Mycobacterium tuberculosis H37Rv
ggcucggccagccagcg

SEQ ID NO: 1287280 - RNA, 17 nt, Mycobacterium tuberculosis H37Rv
ggcucgcugcaccagcu

SEQ ID NO: 1287281 - RNA, 20 nt, Mycobacterium tuberculosis H37Rv
ggcuaccgcaggugccaccu

SEQ ID NO: 1287282 - RNA, 20 nt, Mycobacterium tuberculosis H37Rv
ggcuaccgccuugucggcga

SEQ ID NO: 1287283 - RNA, 13 nt, Mycobacterium tuberculosis H37Rv
ggcuaccgccgac

SEQ ID NO: 1287284 - RNA, 17 nt, Mycobacterium tuberculosis H37Rv
ggcuaccgcgcucccgg

SEQ ID NO: 1287285 - RNA, 15 nt, Mycobacterium tuberculosis H37Rv
ggcucacucgccgaa

SEQ ID NO: 1287286 - RNA, 12 nt, Mycobacterium tuberculosis H37Rv
ggcucagcagcg

SEQ ID NO: 1287287 - RNA, 15 nt, Mycobacterium tuberculosis H37Rv
ggcucagcgugcgcu

SEQ ID NO: 1287288 - RNA, 14 nt, Mycobacterium tuberculosis H37Rv
ggcucagcggcgac

SEQ ID NO: 1287289 - RNA, 21 nt, Mycobacterium tuberculosis H37Rv
ggcucagcugggccgcugugc

SEQ ID NO: 1287290 - RNA, 13 nt, Mycobacterium tuberculosis H37Rv
ggcucaucccgac

SEQ ID NO: 1287291 - RNA, 16 nt, Mycobacterium tuberculosis H37Rv
ggcucagucacgcacu

SEQ ID NO: 1287292 - RNA, 13 nt, Mycobacterium tuberculosis H37Rv
ggcuccaccgggc

SEQ ID NO: 1287293 - RNA, 19 nt, Mycobacterium tuberculosis H37Rv
ggcuccagcgcgcgccgca

SEQ ID NO: 1287294 - RNA, 21 nt, Mycobacterium tuberculosis H37Rv
ggcuccuccgguaucggcgac

SEQ ID NO: 1287295 - RNA, 16 nt, Mycobacterium tuberculosis H37Rv
ggcgguuccacgcugc

SEQ ID NO: 1287296 - RNA, 20 nt, Mycobacterium tuberculosis H37Rv
ggcgguguccagaacggugg

SEQ ID NO: 1287297 - RNA, 17 nt, Mycobacterium tuberculosis H37Rv
ggcgguggugucgcucg

SEQ ID NO: 1287298 - RNA, 16 nt, Mycobacterium tuberculosis H37Rv
ggcgguggugucgcuc

SEQ ID NO: 1287299 - RNA, 18 nt, Mycobacterium tuberculosis H37Rv
ggcgguggggccggcguc

SEQ ID NO: 1287300 - RNA, 23 nt, Mycobacterium tuberculosis H37Rv
ggcggugugcucacgcaucgcga

SEQ ID NO: 1287301 - RNA, 23 nt, Mycobacterium tuberculosis H37Rv
ggcgguuuuguucccgaguuggu

SEQ ID NO: 1287302 - RNA, 16 nt, Mycobacterium tuberculosis H37Rv
ggcguaaucgggaagu

SEQ ID NO: 1287303 - RNA, 15 nt, Mycobacterium tuberculosis H37Rv
ggcguacaccagggu

SEQ ID NO: 1287304 - RNA, 15 nt, Mycobacterium tuberculosis H37Rv
ggcguacucggcauc

SEQ ID NO: 1287305 - RNA, 15 nt, Mycobacterium tuberculosis H37Rv
ggcguagggcugucc

SEQ ID NO: 1287306 - RNA, 19 nt, Mycobacterium tuberculosis H37Rv
ggcguagcccaugccgaug

SEQ ID NO: 1287307 - RNA, 14 nt, Mycobacterium tuberculosis H37Rv
ggcgggcugcagcc

SEQ ID NO: 1287308 - RNA, 19 nt, Mycobacterium tuberculosis H37Rv
ggcggggaaaccggccagc

SEQ ID NO: 1287309 - RNA, 20 nt, Mycobacterium tuberculosis H37Rv
ggcgggcuuggcgucgacgu

SEQ ID NO: 1287310 - RNA, 12 nt, Mycobacterium tuberculosis H37Rv
ggcggugccgcc

SEQ ID NO: 1287311 - RNA, 15 nt, Mycobacterium tuberculosis H37Rv
ggcgguggccgacaa

SEQ ID NO: 1287312 - RNA, 21 nt, Mycobacterium tuberculosis H37Rv
ggcggugggcuuggcgccgau

SEQ ID NO: 1287313 - RNA, 16 nt, Mycobacterium tuberculosis H37Rv
ggcgggagucgucgag

SEQ ID NO: 1287314 - RNA, 20 nt, Mycobacterium tuberculosis H37Rv
ggcgggcgaucuuggcgaca

SEQ ID NO: 1287315 - RNA, 21 nt, Mycobacterium tuberculosis H37Rv
ggcgggcgaucucggcgagca

SEQ ID NO: 1287316 - RNA, 16 nt, Mycobacterium tuberculosis H37Rv
ggcgggcacucagcag

SEQ ID NO: 1287317 - RNA, 12 nt, Mycobacterium tuberculosis H37Rv
ggcgggcugguu

SEQ ID NO: 1287318 - RNA, 22 nt, Mycobacterium tuberculosis H37Rv
ggcgucgaccacaggcaucgga

SEQ ID NO: 1287319 - RNA, 13 nt, Mycobacterium tuberculosis H37Rv
ggcgucgaccacg

SEQ ID NO: 1287320 - RNA, 18 nt, Mycobacterium tuberculosis H37Rv
ggcgucgacccugcccag

SEQ ID NO: 1287321 - RNA, 22 nt, Mycobacterium tuberculosis H37Rv
ggcgucgaacagugccucgcgu

SEQ ID NO: 1287322 - RNA, 15 nt, Mycobacterium tuberculosis H37Rv
ggcguccuugcgcag

SEQ ID NO: 1287323 - RNA, 16 nt, Mycobacterium tuberculosis H37Rv
ggcgucgaugacgacg

SEQ ID NO: 1287324 - RNA, 17 nt, Mycobacterium tuberculosis H37Rv
ggcgucgaugacgacgc

SEQ ID NO: 1287325 - RNA, 21 nt, Mycobacterium tuberculosis H37Rv
ggcgucgaugacgacgccguc

SEQ ID NO: 1287326 - RNA, 20 nt, Mycobacterium tuberculosis H37Rv
ggcgucgagguuuuucgaug

SEQ ID NO: 1287327 - RNA, 18 nt, Mycobacterium tuberculosis H37Rv
ggcgucgaguucgguugc

SEQ ID NO: 1287328 - RNA, 13 nt, Mycobacterium tuberculosis H37Rv
ggcgucgagcucg

SEQ ID NO: 1287329 - RNA, 14 nt, Mycobacterium tuberculosis H37Rv
ggcgucgacgucga

SEQ ID NO: 1287330 - RNA, 15 nt, Mycobacterium tuberculosis H37Rv
ggcgucgacgucgac

SEQ ID NO: 1287331 - RNA, 22 nt, Mycobacterium tuberculosis H37Rv
ggcgucgacgucgacggcgaug

SEQ ID NO: 1287332 - RNA, 14 nt, Mycobacterium tuberculosis H37Rv
ggcguccucgucga

SEQ ID NO: 1287333 - RNA, 18 nt, Mycobacterium tuberculosis H37Rv
ggcgucccaaucgggauc

SEQ ID NO: 1287334 - RNA, 15 nt, Mycobacterium tuberculosis H37Rv
ggcgucccggcgguc

SEQ ID NO: 1287335 - RNA, 22 nt, Mycobacterium tuberculosis H37Rv
ggcgucccgcccggaugcgaug

SEQ ID NO: 1287336 - RNA, 14 nt, Mycobacterium tuberculosis H37Rv
ggcguccaucgcca

SEQ ID NO: 1287337 - RNA, 14 nt, Mycobacterium tuberculosis H37Rv
ggcguccaucucgg

SEQ ID NO: 1287338 - RNA, 22 nt, Mycobacterium tuberculosis H37Rv
ggcgucaccgccggugcugacg

SEQ ID NO: 1287339 - RNA, 23 nt, Mycobacterium tuberculosis H37Rv
ggcgucaagcaaguccaccggau

SEQ ID NO: 1287340 - RNA, 20 nt, Mycobacterium tuberculosis H37Rv
ggcgucaccgccggugcuga

SEQ ID NO: 1287341 - RNA, 20 nt, Mycobacterium tuberculosis H37Rv
ggcgucaaaggccuugacgu

SEQ ID NO: 1287342 - RNA, 16 nt, Mycobacterium tuberculosis H37Rv
ggcguauucggugcac

SEQ ID NO: 1287343 - RNA, 22 nt, Mycobacterium tuberculosis H37Rv
ggcguauccuugcgacguucuu

SEQ ID NO: 1287344 - RNA, 21 nt, Mycobacterium tuberculosis H37Rv
ggcguagucggcggugcagau

SEQ ID NO: 1287345 - RNA, 19 nt, Mycobacterium tuberculosis H37Rv
ggcguagucgcugucggca

SEQ ID NO: 1287346 - RNA, 16 nt, Mycobacterium tuberculosis H37Rv
ggcgucauccgcggca

SEQ ID NO: 1287347 - RNA, 23 nt, Mycobacterium tuberculosis H37Rv
ggcguccagaagaagaugaucgc

SEQ ID NO: 1287348 - RNA, 19 nt, Mycobacterium tuberculosis H37Rv
ggcgucaugaugucgacau

SEQ ID NO: 1287349 - RNA, 16 nt, Mycobacterium tuberculosis H37Rv
ggcgucaugaugucga

SEQ ID NO: 1287350 - RNA, 24 nt, Mycobacterium tuberculosis H37Rv
ggcguccaccugcuccgcugucac

SEQ ID NO: 1287351 - RNA, 15 nt, Mycobacterium tuberculosis H37Rv
ggcguccacgcugac

SEQ ID NO: 1287352 - RNA, 20 nt, Mycobacterium tuberculosis H37Rv
gggcuaccggcagcugcucg

SEQ ID NO: 1287353 - RNA, 19 nt, Mycobacterium tuberculosis H37Rv
gggcuaccggcagcugcuc

SEQ ID NO: 1287354 - RNA, 18 nt, Mycobacterium tuberculosis H37Rv
gggcgugugcaguccgau

SEQ ID NO: 1287355 - RNA, 23 nt, Mycobacterium tuberculosis H37Rv
gggcguucccccggcaccgccgg

SEQ ID NO: 1287356 - RNA, 15 nt, Mycobacterium tuberculosis H37Rv
gggcgcgcaucugcu

SEQ ID NO: 1287357 - RNA, 20 nt, Mycobacterium tuberculosis H37Rv
gggcucggcggcccggccga

SEQ ID NO: 1287358 - RNA, 14 nt, Mycobacterium tuberculosis H37Rv
gggcucuggccagu

SEQ ID NO: 1287359 - RNA, 16 nt, Mycobacterium tuberculosis H37Rv
gggcucucggcgucga

SEQ ID NO: 1287360 - RNA, 15 nt, Mycobacterium tuberculosis H37Rv
gggcugaggcggcga

SEQ ID NO: 1287361 - RNA, 15 nt, Mycobacterium tuberculosis H37Rv
gggcugguaucgagc

SEQ ID NO: 1287362 - RNA, 18 nt, Mycobacterium tuberculosis H37Rv
gggcuuaugcgucugcuc

SEQ ID NO: 1287363 - RNA, 14 nt, Mycobacterium tuberculosis H37Rv
gggcuguccaccga

SEQ ID NO: 1287364 - RNA, 19 nt, Mycobacterium tuberculosis H37Rv
ggggagcuauucggugucg

SEQ ID NO: 1287365 - RNA, 20 nt, Mycobacterium tuberculosis H37Rv
ggggacucugccacccagca

SEQ ID NO: 1287366 - RNA, 12 nt, Mycobacterium tuberculosis H37Rv
ggggaccagaua

SEQ ID NO: 1287367 - RNA, 18 nt, Mycobacterium tuberculosis H37Rv
ggggaccucuucggugug

SEQ ID NO: 1287368 - RNA, 12 nt, Mycobacterium tuberculosis H37Rv
ggggaucggugg

SEQ ID NO: 1287369 - RNA, 20 nt, Mycobacterium tuberculosis H37Rv
ggggaguuccaaaucggugg

SEQ ID NO: 1287370 - RNA, 12 nt, Mycobacterium tuberculosis H37Rv
ggggaucaccgg

SEQ ID NO: 1287371 - RNA, 22 nt, Mycobacterium tuberculosis H37Rv
ggggauaaucguuuucggccug

SEQ ID NO: 1287372 - RNA, 12 nt, Mycobacterium tuberculosis H37Rv
ggggaucagcgu

SEQ ID NO: 1287373 - RNA, 19 nt, Mycobacterium tuberculosis H37Rv
gggcuuuagugucugcucg

SEQ ID NO: 1287374 - RNA, 20 nt, Mycobacterium tuberculosis H37Rv
gggcuuuagugucugcucgc

SEQ ID NO: 1287375 - RNA, 20 nt, Mycobacterium tuberculosis H37Rv
gggcuuggcgucgacgucga

SEQ ID NO: 1287376 - RNA, 14 nt, Mycobacterium tuberculosis H37Rv
gggcuuggugccca

SEQ ID NO: 1287377 - RNA, 19 nt, Mycobacterium tuberculosis H37Rv
gggcuuguacgaacugcug

SEQ ID NO: 1287378 - RNA, 18 nt, Mycobacterium tuberculosis H37Rv
gggcuuuagugucugcuc

SEQ ID NO: 1287379 - RNA, 20 nt, Mycobacterium tuberculosis H37Rv
gggcuuuuacgucugcucgc

SEQ ID NO: 1287380 - RNA, 18 nt, Mycobacterium tuberculosis H37Rv
gggcuuuuacgucugcuc

SEQ ID NO: 1287381 - RNA, 18 nt, Mycobacterium tuberculosis H37Rv
gggcuuuugcgucugcuc

SEQ ID NO: 1287382 - RNA, 20 nt, Mycobacterium tuberculosis H37Rv
gggcuuuugcgucugcucgc

SEQ ID NO: 1287383 - RNA, 17 nt, Mycobacterium tuberculosis H37Rv
gggcuuuugcgucugcu

SEQ ID NO: 1287384 - RNA, 15 nt, Mycobacterium tuberculosis H37Rv
ggggaacuuaccgag

SEQ ID NO: 1287385 - RNA, 21 nt, Mycobacterium tuberculosis H37Rv
ggggaacuuaccgaggccaug

SEQ ID NO: 1287386 - RNA, 14 nt, Mycobacterium tuberculosis H37Rv
ggggaagacgaccg

SEQ ID NO: 1287387 - RNA, 15 nt, Mycobacterium tuberculosis H37Rv
ggggccgaauccgau

SEQ ID NO: 1287388 - RNA, 18 nt, Mycobacterium tuberculosis H37Rv
ggggcagccgggcgucgc

SEQ ID NO: 1287389 - RNA, 20 nt, Mycobacterium tuberculosis H37Rv
ggggauuuugcgucugcuca

SEQ ID NO: 1287390 - RNA, 21 nt, Mycobacterium tuberculosis H37Rv
ggggauuuugcgucugcucac

SEQ ID NO: 1287391 - RNA, 20 nt, Mycobacterium tuberculosis H37Rv
ggggauuuugcgucugcucg

SEQ ID NO: 1287392 - RNA, 15 nt, Mycobacterium tuberculosis H37Rv
ggggcaauugccugc

SEQ ID NO: 1287393 - RNA, 21 nt, Mycobacterium tuberculosis H37Rv
ggggauuuauugagucggcug

SEQ ID NO: 1287394 - RNA, 21 nt, Mycobacterium tuberculosis H37Rv
ggggcaccguuaccgccgucg

SEQ ID NO: 1287395 - RNA, 18 nt, Mycobacterium tuberculosis H37Rv
ggggcaccgagcugagcg

SEQ ID NO: 1287396 - RNA, 20 nt, Mycobacterium tuberculosis H37Rv
ggggcaccacgcugugcucg

SEQ ID NO: 1287397 - RNA, 14 nt, Mycobacterium tuberculosis H37Rv
ggggcaccagcgaa

SEQ ID NO: 1287398 - RNA, 14 nt, Mycobacterium tuberculosis H37Rv
ggggcggucgagcc

SEQ ID NO: 1287399 - RNA, 19 nt, Mycobacterium tuberculosis H37Rv
ggggcgcugcagcucacga

SEQ ID NO: 1287400 - RNA, 15 nt, Mycobacterium tuberculosis H37Rv
ggggcgccgccguug

SEQ ID NO: 1287401 - RNA, 20 nt, Mycobacterium tuberculosis H37Rv
ggggccgucgucggucaccg

SEQ ID NO: 1287402 - RNA, 18 nt, Mycobacterium tuberculosis H37Rv
ggggccugcguccgacgc

SEQ ID NO: 1287403 - RNA, 14 nt, Mycobacterium tuberculosis H37Rv
ggggccggcgucga

SEQ ID NO: 1287404 - RNA, 15 nt, Mycobacterium tuberculosis H37Rv
ggggccggucgggca

SEQ ID NO: 1287405 - RNA, 16 nt, Mycobacterium tuberculosis H37Rv
ggggccgcaggccagc

SEQ ID NO: 1287406 - RNA, 16 nt, Mycobacterium tuberculosis H37Rv
ggguacugcggcucgc

SEQ ID NO: 1287407 - RNA, 19 nt, Mycobacterium tuberculosis H37Rv
ggguagacggggcgagcau

SEQ ID NO: 1287408 - RNA, 19 nt, Mycobacterium tuberculosis H37Rv
ggguacccgguggcaccau

SEQ ID NO: 1287409 - RNA, 14 nt, Mycobacterium tuberculosis H37Rv
ggguagacaccgcg

SEQ ID NO: 1287410 - RNA, 13 nt, Mycobacterium tuberculosis H37Rv
ggguagccgucga

SEQ ID NO: 1287411 - RNA, 20 nt, Mycobacterium tuberculosis H37Rv
ggguaacaccuuucgccgag

SEQ ID NO: 1287412 - RNA, 16 nt, Mycobacterium tuberculosis H37Rv
ggguacacccgcucgc

SEQ ID NO: 1287413 - RNA, 22 nt, Mycobacterium tuberculosis H37Rv
ggguacaagacgauucaccaau

SEQ ID NO: 1287414 - RNA, 21 nt, Mycobacterium tuberculosis H37Rv
ggggugugcgggcggugcaca

SEQ ID NO: 1287415 - RNA, 21 nt, Mycobacterium tuberculosis H37Rv
gggguguucgaugggugcacc

SEQ ID NO: 1287416 - RNA, 16 nt, Mycobacterium tuberculosis H37Rv
gggguguucgucgacc

SEQ ID NO: 1287417 - RNA, 19 nt, Mycobacterium tuberculosis H37Rv
gggguuguucggcagccau

SEQ ID NO: 1287418 - RNA, 11 nt, Mycobacterium tuberculosis H37Rv
ggggugccgau

SEQ ID NO: 1287419 - RNA, 13 nt, Mycobacterium tuberculosis H37Rv
ggggugcuuucgc

SEQ ID NO: 1287420 - RNA, 22 nt, Mycobacterium tuberculosis H37Rv
ggggugcgcgcgaccauacccg

SEQ ID NO: 1287421 - RNA, 19 nt, Mycobacterium tuberculosis H37Rv
ggggucuugacggcgccag

SEQ ID NO: 1287422 - RNA, 11 nt, Mycobacterium tuberculosis H37Rv
ggggucgagcg

SEQ ID NO: 1287423 - RNA, 16 nt, Mycobacterium tuberculosis H37Rv
ggggcugccgccguug

SEQ ID NO: 1287424 - RNA, 19 nt, Mycobacterium tuberculosis H37Rv
ggggcuuaugcgucugcuc

SEQ ID NO: 1287425 - RNA, 19 nt, Mycobacterium tuberculosis H37Rv
ggggcguuagggccgccau

SEQ ID NO: 1287426 - RNA, 20 nt, Mycobacterium tuberculosis H37Rv
gggggauuucgcgucugcuc

SEQ ID NO: 1287427 - RNA, 19 nt, Mycobacterium tuberculosis H37Rv
gggggauccagcaggccgg

SEQ ID NO: 1287428 - RNA, 16 nt, Mycobacterium tuberculosis H37Rv
gggggauccagcaggc

SEQ ID NO: 1287429 - RNA, 22 nt, Mycobacterium tuberculosis H37Rv
ggggcuucaucuggcgccguua

SEQ ID NO: 1287430 - RNA, 20 nt, Mycobacterium tuberculosis H37Rv
ggggcuuaugcgucugcucg

SEQ ID NO: 1287431 - RNA, 19 nt, Mycobacterium tuberculosis H37Rv
ggggcuucugcgucugcuc

SEQ ID NO: 1287432 - RNA, 19 nt, Mycobacterium tuberculosis H37Rv
ggggcuuuuacgucugcuc

SEQ ID NO: 1287433 - RNA, 19 nt, Mycobacterium tuberculosis H37Rv
ggggcuuuugcgucugcug

SEQ ID NO: 1287434 - RNA, 16 nt, Mycobacterium tuberculosis H37Rv
ggggguggcagcgcgg

SEQ ID NO: 1287435 - RNA, 13 nt, Mycobacterium tuberculosis H37Rv
ggggucgaacgcg

SEQ ID NO: 1287436 - RNA, 18 nt, Mycobacterium tuberculosis H37Rv
gggguaguugaggccguc

SEQ ID NO: 1287437 - RNA, 19 nt, Mycobacterium tuberculosis H37Rv
gggggcuuuuacgucugcu

SEQ ID NO: 1287438 - RNA, 21 nt, Mycobacterium tuberculosis H37Rv
gggggcuucugcgucugcucg

SEQ ID NO: 1287439 - RNA, 20 nt, Mycobacterium tuberculosis H37Rv
gggggcuucugcgucugcuc

SEQ ID NO: 1287440 - RNA, 19 nt, Mycobacterium tuberculosis H37Rv
gggggcuucugcgucugcu

SEQ ID NO: 1287441 - RNA, 20 nt, Mycobacterium tuberculosis H37Rv
gggggcuuuuacgucugcuc

SEQ ID NO: 1287442 - RNA, 19 nt, Mycobacterium tuberculosis H37Rv
gggggcuuuugcgucugcu

SEQ ID NO: 1287443 - RNA, 21 nt, Mycobacterium tuberculosis H37Rv
gggggcuuauguguccgcucg

SEQ ID NO: 1287444 - RNA, 20 nt, Mycobacterium tuberculosis H37Rv
gggggcuuauguguccgcuc

SEQ ID NO: 1287445 - RNA, 20 nt, Mycobacterium tuberculosis H37Rv
gggggcuuaugcgucugcuc

SEQ ID NO: 1287446 - RNA, 19 nt, Mycobacterium tuberculosis H37Rv
gggggcuuaugcgucugcu

SEQ ID NO: 1287447 - RNA, 13 nt, Mycobacterium tuberculosis H37Rv
gggggcaggucga

SEQ ID NO: 1287448 - RNA, 14 nt, Mycobacterium tuberculosis H37Rv
gggggcugcugcuc

SEQ ID NO: 1287449 - RNA, 17 nt, Mycobacterium tuberculosis H37Rv
gggucgcgcugccaguu

SEQ ID NO: 1287450 - RNA, 18 nt, Mycobacterium tuberculosis H37Rv
gggucgccgccaucagcc

SEQ ID NO: 1287451 - RNA, 15 nt, Mycobacterium tuberculosis H37Rv
gggucggcccgccaa

SEQ ID NO: 1287452 - RNA, 12 nt, Mycobacterium tuberculosis H37Rv
gggucgcaaccg

SEQ ID NO: 1287453 - RNA, 15 nt, Mycobacterium tuberculosis H37Rv
gggucgaugucggca

SEQ ID NO: 1287454 - RNA, 16 nt, Mycobacterium tuberculosis H37Rv
gggucgaucaccgaca

SEQ ID NO: 1287455 - RNA, 19 nt, Mycobacterium tuberculosis H37Rv
gggucgacguuaccgaccg

SEQ ID NO: 1287456 - RNA, 21 nt, Mycobacterium tuberculosis H37Rv
gggucgguuuccuccggcagc

SEQ ID NO: 1287457 - RNA, 12 nt, Mycobacterium tuberculosis H37Rv
gggucugcucau

SEQ ID NO: 1287458 - RNA, 14 nt, Mycobacterium tuberculosis H37Rv
gggucaccagcgca

SEQ ID NO: 1287459 - RNA, 16 nt, Mycobacterium tuberculosis H37Rv
gggucaccgugcggau

SEQ ID NO: 1287460 - RNA, 15 nt, Mycobacterium tuberculosis H37Rv
ggguaguucaccgcg

SEQ ID NO: 1287461 - RNA, 20 nt, Mycobacterium tuberculosis H37Rv
ggguauugauugacugcuug

SEQ ID NO: 1287462 - RNA, 22 nt, Mycobacterium tuberculosis H37Rv
ggguaucgacccuccagcacgc

SEQ ID NO: 1287463 - RNA, 12 nt, Mycobacterium tuberculosis H37Rv
gggucagcgccg

SEQ ID NO: 1287464 - RNA, 16 nt, Mycobacterium tuberculosis H37Rv
gggucagcccagccaa

SEQ ID NO: 1287465 - RNA, 17 nt, Mycobacterium tuberculosis H37Rv
gggucagcucgccagcc

SEQ ID NO: 1287466 - RNA, 19 nt, Mycobacterium tuberculosis H37Rv
gggucagcugggacccgag

SEQ ID NO: 1287467 - RNA, 20 nt, Mycobacterium tuberculosis H37Rv
gggucagguugucggcgauc

SEQ ID NO: 1287468 - RNA, 18 nt, Mycobacterium tuberculosis H37Rv
ggguccaacccgcgauuc

SEQ ID NO: 1287469 - RNA, 20 nt, Mycobacterium tuberculosis H37Rv
ggguccaagaaccacgacgu

SEQ ID NO: 1287470 - RNA, 13 nt, Mycobacterium tuberculosis H37Rv
ggguccgggccaa

SEQ ID NO: 1287471 - RNA, 17 nt, Mycobacterium tuberculosis H37Rv
ggguccagcgucccgau

SEQ ID NO: 1287472 - RNA, 21 nt, Mycobacterium tuberculosis H37Rv
gggccguguucuaccugcacc

SEQ ID NO: 1287473 - RNA, 18 nt, Mycobacterium tuberculosis H37Rv
gggccgucucgccgugga

SEQ ID NO: 1287474 - RNA, 12 nt, Mycobacterium tuberculosis H37Rv
gggccgucggca

SEQ ID NO: 1287475 - RNA, 23 nt, Mycobacterium tuberculosis H37Rv
gggccguccggcuuggcggcgau

SEQ ID NO: 1287476 - RNA, 12 nt, Mycobacterium tuberculosis H37Rv
gggccgaggugu

SEQ ID NO: 1287477 - RNA, 14 nt, Mycobacterium tuberculosis H37Rv
gggccggugcagca

SEQ ID NO: 1287478 - RNA, 17 nt, Mycobacterium tuberculosis H37Rv
gggccgacgggacaacc

SEQ ID NO: 1287479 - RNA, 16 nt, Mycobacterium tuberculosis H37Rv
gggccgagccgacauc

SEQ ID NO: 1287480 - RNA, 21 nt, Mycobacterium tuberculosis H37Rv
gggccgaauaccacaccguga

SEQ ID NO: 1287481 - RNA, 16 nt, Mycobacterium tuberculosis H37Rv
gggcgccacgggugac

SEQ ID NO: 1287482 - RNA, 14 nt, Mycobacterium tuberculosis H37Rv
gggcgcaccgcgga

SEQ ID NO: 1287483 - RNA, 12 nt, Mycobacterium tuberculosis H37Rv
gggcgccggugu

SEQ ID NO: 1287484 - RNA, 15 nt, Mycobacterium tuberculosis H37Rv
gggcgccgcgcucga

SEQ ID NO: 1287485 - RNA, 16 nt, Mycobacterium tuberculosis H37Rv
gggcgccgacaccggc

SEQ ID NO: 1287486 - RNA, 16 nt, Mycobacterium tuberculosis H37Rv
gggcgauucugcgucu

SEQ ID NO: 1287487 - RNA, 19 nt, Mycobacterium tuberculosis H37Rv
gggcgauucugcgucugcu

SEQ ID NO: 1287488 - RNA, 20 nt, Mycobacterium tuberculosis H37Rv
gggcgauuuugcgucugcuc

SEQ ID NO: 1287489 - RNA, 20 nt, Mycobacterium tuberculosis H37Rv
gggcgauucugugucugcuc

SEQ ID NO: 1287490 - RNA, 20 nt, Mycobacterium tuberculosis H37Rv
gggcgauucugcgucugcuc

SEQ ID NO: 1287491 - RNA, 14 nt, Mycobacterium tuberculosis H37Rv
gggcgcaacgggac

SEQ ID NO: 1287492 - RNA, 21 nt, Mycobacterium tuberculosis H37Rv
gggccagcaaguacgcgucgg

SEQ ID NO: 1287493 - RNA, 19 nt, Mycobacterium tuberculosis H37Rv
gggccauaaaugcgcguuc

SEQ ID NO: 1287494 - RNA, 17 nt, Mycobacterium tuberculosis H37Rv
gggccaggcgaagucga

SEQ ID NO: 1287495 - RNA, 13 nt, Mycobacterium tuberculosis H37Rv
gggccagcggcag

SEQ ID NO: 1287496 - RNA, 18 nt, Mycobacterium tuberculosis H37Rv
gggcccagcggccgcgau

SEQ ID NO: 1287497 - RNA, 19 nt, Mycobacterium tuberculosis H37Rv
gggccccuucgcagcaugu

SEQ ID NO: 1287498 - RNA, 15 nt, Mycobacterium tuberculosis H37Rv
gggccgaccagucga

SEQ ID NO: 1287499 - RNA, 19 nt, Mycobacterium tuberculosis H37Rv
gggccgaccagucgacguc

SEQ ID NO: 1287500 - RNA, 16 nt, Mycobacterium tuberculosis H37Rv
gggccccuccggccac

SEQ ID NO: 1287501 - RNA, 13 nt, Mycobacterium tuberculosis H37Rv
gggcccagcaggu

SEQ ID NO: 1287502 - RNA, 15 nt, Mycobacterium tuberculosis H37Rv
gggccauucaccgcg

SEQ ID NO: 1287503 - RNA, 17 nt, Mycobacterium tuberculosis H37Rv
gggccaggucagccgcg

SEQ ID NO: 1287504 - RNA, 13 nt, Mycobacterium tuberculosis H37Rv
gggccaucacggu

SEQ ID NO: 1287505 - RNA, 19 nt, Mycobacterium tuberculosis H37Rv
gggcaagucgcccagccga

SEQ ID NO: 1287506 - RNA, 16 nt, Mycobacterium tuberculosis H37Rv
gggcaaggacaagccg

SEQ ID NO: 1287507 - RNA, 19 nt, Mycobacterium tuberculosis H37Rv
gggcaauccggucagcgcg

SEQ ID NO: 1287508 - RNA, 12 nt, Mycobacterium tuberculosis H37Rv
gggcacagccag

SEQ ID NO: 1287509 - RNA, 21 nt, Mycobacterium tuberculosis H37Rv
gggcaucucggcuacgccucg

SEQ ID NO: 1287510 - RNA, 15 nt, Mycobacterium tuberculosis H37Rv
gggcaucgucgccga

SEQ ID NO: 1287511 - RNA, 14 nt, Mycobacterium tuberculosis H37Rv
gggcaugucgccga

SEQ ID NO: 1287512 - RNA, 14 nt, Mycobacterium tuberculosis H37Rv
gggcaccacccgau

SEQ ID NO: 1287513 - RNA, 19 nt, Mycobacterium tuberculosis H37Rv
gggccagaucgaagcgcag

SEQ ID NO: 1287514 - RNA, 20 nt, Mycobacterium tuberculosis H37Rv
ggcugucaguucccgcuuga

SEQ ID NO: 1287515 - RNA, 18 nt, Mycobacterium tuberculosis H37Rv
ggcugucacgccugccac

SEQ ID NO: 1287516 - RNA, 15 nt, Mycobacterium tuberculosis H37Rv
ggcuguccagcagcg

SEQ ID NO: 1287517 - RNA, 19 nt, Mycobacterium tuberculosis H37Rv
ggcucgucgaugucgacgu

SEQ ID NO: 1287518 - RNA, 23 nt, Mycobacterium tuberculosis H37Rv
ggcucggucccgcuacaccugcg

SEQ ID NO: 1287519 - RNA, 18 nt, Mycobacterium tuberculosis H37Rv
ggcugugaucgagucgcg

SEQ ID NO: 1287520 - RNA, 23 nt, Mycobacterium tuberculosis H37Rv
ggcugugccgagcuugucgagca

SEQ ID NO: 1287521 - RNA, 17 nt, Mycobacterium tuberculosis H37Rv
ggcugugaucgagucgc

SEQ ID NO: 1287522 - RNA, 20 nt, Mycobacterium tuberculosis H37Rv
ggcugucgugauacagcucg

SEQ ID NO: 1287523 - RNA, 13 nt, Mycobacterium tuberculosis H37Rv
ggcuguggccgcg

SEQ ID NO: 1287524 - RNA, 13 nt, Mycobacterium tuberculosis H37Rv
ggcuguccaccga

SEQ ID NO: 1287525 - RNA, 20 nt, Mycobacterium tuberculosis H37Rv
ggcuucgaguuuggcgacga

SEQ ID NO: 1287526 - RNA, 19 nt, Mycobacterium tuberculosis H37Rv
ggcuuccuccgacgcgauc

SEQ ID NO: 1287527 - RNA, 18 nt, Mycobacterium tuberculosis H37Rv
ggcuucgacgucggcgac

SEQ ID NO: 1287528 - RNA, 18 nt, Mycobacterium tuberculosis H37Rv
ggcuucgacggcggccaa

SEQ ID NO: 1287529 - RNA, 19 nt, Mycobacterium tuberculosis H37Rv
ggcuucgacaaccucgagu

SEQ ID NO: 1287530 - RNA, 22 nt, Mycobacterium tuberculosis H37Rv
ggcuucgcgguuggcggcgaug

SEQ ID NO: 1287531 - RNA, 21 nt, Mycobacterium tuberculosis H37Rv
ggcuucggcgaacccuccgca

SEQ ID NO: 1287532 - RNA, 19 nt, Mycobacterium tuberculosis H37Rv
ggcuugcccggcucggcag

SEQ ID NO: 1287533 - RNA, 22 nt, Mycobacterium tuberculosis H37Rv
ggcuuccggggugacaucgcga

SEQ ID NO: 1287534 - RNA, 13 nt, Mycobacterium tuberculosis H37Rv
ggcuuauugcccg

SEQ ID NO: 1287535 - RNA, 17 nt, Mycobacterium tuberculosis H37Rv
ggcuuaugcgucugcuc

SEQ ID NO: 1287536 - RNA, 16 nt, Mycobacterium tuberculosis H37Rv
ggcuguucucgccgaa

SEQ ID NO: 1287537 - RNA, 20 nt, Mycobacterium tuberculosis H37Rv
ggcuguugcguucggucagu

SEQ ID NO: 1287538 - RNA, 20 nt, Mycobacterium tuberculosis H37Rv
ggcuuacuugaucucggcga

SEQ ID NO: 1287539 - RNA, 14 nt, Mycobacterium tuberculosis H37Rv
gggaugcccgcuga

SEQ ID NO: 1287540 - RNA, 20 nt, Mycobacterium tuberculosis H37Rv
gggaucugagggcucggugg

SEQ ID NO: 1287541 - RNA, 18 nt, Mycobacterium tuberculosis H37Rv
gggaucgugccggcgaac

SEQ ID NO: 1287542 - RNA, 18 nt, Mycobacterium tuberculosis H37Rv
gggcaaccagcagcaggu

SEQ ID NO: 1287543 - RNA, 13 nt, Mycobacterium tuberculosis H37Rv
gggcaacgccucg

SEQ ID NO: 1287544 - RNA, 14 nt, Mycobacterium tuberculosis H37Rv
gggauggccgccga

SEQ ID NO: 1287545 - RNA, 13 nt, Mycobacterium tuberculosis H37Rv
gggaguucgcgca

SEQ ID NO: 1287546 - RNA, 16 nt, Mycobacterium tuberculosis H37Rv
gggagucuucggcgac

SEQ ID NO: 1287547 - RNA, 14 nt, Mycobacterium tuberculosis H37Rv
gggauagccgcgac

SEQ ID NO: 1287548 - RNA, 17 nt, Mycobacterium tuberculosis H37Rv
gggagcgcccggcugau

SEQ ID NO: 1287549 - RNA, 19 nt, Mycobacterium tuberculosis H37Rv
gggagguacccccagcacc

SEQ ID NO: 1287550 - RNA, 21 nt, Mycobacterium tuberculosis H37Rv
gggagccaccggcgucgacgu

SEQ ID NO: 1287551 - RNA, 15 nt, Mycobacterium tuberculosis H37Rv
ggcuuggaccagcgu

SEQ ID NO: 1287552 - RNA, 23 nt, Mycobacterium tuberculosis H37Rv
ggcuuggccuagccgcggcaccg

SEQ ID NO: 1287553 - RNA, 22 nt, Mycobacterium tuberculosis H37Rv
ggcuuggcgccgaugccggcca

SEQ ID NO: 1287554 - RNA, 21 nt, Mycobacterium tuberculosis H37Rv
ggcuugcgugaugguugcucg

SEQ ID NO: 1287555 - RNA, 17 nt, Mycobacterium tuberculosis H37Rv
ggcuugcggcacccagu

SEQ ID NO: 1287556 - RNA, 17 nt, Mycobacterium tuberculosis H37Rv
ggcuuggaucucaucca

SEQ ID NO: 1287557 - RNA, 18 nt, Mycobacterium tuberculosis H37Rv
gggaagaacaucaccucg

SEQ ID NO: 1287558 - RNA, 17 nt, Mycobacterium tuberculosis H37Rv
gggacccggaccuucgg

SEQ ID NO: 1287559 - RNA, 17 nt, Mycobacterium tuberculosis H37Rv
gggaccccgccagccgg

SEQ ID NO: 1287560 - RNA, 16 nt, Mycobacterium tuberculosis H37Rv
gggaccccgcugcgac

SEQ ID NO: 1287561 - RNA, 16 nt, Mycobacterium tuberculosis H37Rv
gggacaucugcccacc

SEQ ID NO: 1287562 - RNA, 12 nt, Mycobacterium tuberculosis H37Rv
gggacaucaccg

SEQ ID NO: 1287563 - RNA, 14 nt, Mycobacterium tuberculosis H37Rv
gggacgacggcaag

SEQ ID NO: 1287564 - RNA, 20 nt, Mycobacterium tuberculosis H37Rv
gggaccuugaucgagcaggg

SEQ ID NO: 1287565 - RNA, 13 nt, Mycobacterium tuberculosis H37Rv
gggaccgguuaua

SEQ ID NO: 1287566 - RNA, 22 nt, Mycobacterium tuberculosis H37Rv
gucgagcgaccccacacgccga

SEQ ID NO: 1287567 - RNA, 21 nt, Mycobacterium tuberculosis H37Rv
gucgagcgcccacuggugauc

SEQ ID NO: 1287568 - RNA, 16 nt, Mycobacterium tuberculosis H37Rv
gucgagccggugccgc

SEQ ID NO: 1287569 - RNA, 14 nt, Mycobacterium tuberculosis H37Rv
gucgagcaugcgau

SEQ ID NO: 1287570 - RNA, 16 nt, Mycobacterium tuberculosis H37Rv
gucgagcaucccgguc

SEQ ID NO: 1287571 - RNA, 22 nt, Mycobacterium tuberculosis H37Rv
gucgagcgcuucgucgccgaac

SEQ ID NO: 1287572 - RNA, 21 nt, Mycobacterium tuberculosis H37Rv
gucgagcacgaugucgaugcc

SEQ ID NO: 1287573 - RNA, 15 nt, Mycobacterium tuberculosis H37Rv
gucgacgucgauggu

SEQ ID NO: 1287574 - RNA, 12 nt, Mycobacterium tuberculosis H37Rv
gucgacgucgac

SEQ ID NO: 1287575 - RNA, 16 nt, Mycobacterium tuberculosis H37Rv
gucgacgucggcaauc

SEQ ID NO: 1287576 - RNA, 18 nt, Mycobacterium tuberculosis H37Rv
gucgagcaccugccgauc

SEQ ID NO: 1287577 - RNA, 19 nt, Mycobacterium tuberculosis H37Rv
gucgagcaccugccgaucg

SEQ ID NO: 1287578 - RNA, 21 nt, Mycobacterium tuberculosis H37Rv
gucgacggcgauggcgcgcaa

SEQ ID NO: 1287579 - RNA, 14 nt, Mycobacterium tuberculosis H37Rv
gucgacggucaucc

SEQ ID NO: 1287580 - RNA, 20 nt, Mycobacterium tuberculosis H37Rv
gucgacggucuggcccgcga

SEQ ID NO: 1287581 - RNA, 13 nt, Mycobacterium tuberculosis H37Rv
gucgacggucacc

SEQ ID NO: 1287582 - RNA, 14 nt, Mycobacterium tuberculosis H37Rv
gucgacggcaucgg

SEQ ID NO: 1287583 - RNA, 21 nt, Mycobacterium tuberculosis H37Rv
guccgaugcgugccgacccgc

SEQ ID NO: 1287584 - RNA, 16 nt, Mycobacterium tuberculosis H37Rv
guccgcaaccucgccg

SEQ ID NO: 1287585 - RNA, 21 nt, Mycobacterium tuberculosis H37Rv
guccgaucguuucagcuagac

SEQ ID NO: 1287586 - RNA, 20 nt, Mycobacterium tuberculosis H37Rv
guccgccaacggcaccucga

SEQ ID NO: 1287587 - RNA, 22 nt, Mycobacterium tuberculosis H37Rv
guccgccaacggcaccucgacg

SEQ ID NO: 1287588 - RNA, 23 nt, Mycobacterium tuberculosis H37Rv
guccgccaacggcaccucgacgu

SEQ ID NO: 1287589 - RNA, 14 nt, Mycobacterium tuberculosis H37Rv
guccgccaccgcga

SEQ ID NO: 1287590 - RNA, 23 nt, Mycobacterium tuberculosis H37Rv
gucgaucgccgcgauggcggucc

SEQ ID NO: 1287591 - RNA, 20 nt, Mycobacterium tuberculosis H37Rv
gucgaucuccgucggugagc

SEQ ID NO: 1287592 - RNA, 23 nt, Mycobacterium tuberculosis H37Rv
gucgaucuccucuugcaccaggg

SEQ ID NO: 1287593 - RNA, 19 nt, Mycobacterium tuberculosis H37Rv
gucgagcuuuucgaccuuc

SEQ ID NO: 1287594 - RNA, 19 nt, Mycobacterium tuberculosis H37Rv
gucgagcacguccucgacc

SEQ ID NO: 1287595 - RNA, 16 nt, Mycobacterium tuberculosis H37Rv
gucgauccggccagag

SEQ ID NO: 1287596 - RNA, 19 nt, Mycobacterium tuberculosis H37Rv
gucgaucgaauugcguucg

SEQ ID NO: 1287597 - RNA, 12 nt, Mycobacterium tuberculosis H37Rv
gucgaugccggc

SEQ ID NO: 1287598 - RNA, 16 nt, Mycobacterium tuberculosis H37Rv
gucgaucucgaucgac

SEQ ID NO: 1287599 - RNA, 20 nt, Mycobacterium tuberculosis H37Rv
gucgaugaagcgucguugcu

SEQ ID NO: 1287600 - RNA, 15 nt, Mycobacterium tuberculosis H37Rv
gucgaugaugccgga

SEQ ID NO: 1287601 - RNA, 19 nt, Mycobacterium tuberculosis H37Rv
gucgcaccacagugccaau

SEQ ID NO: 1287602 - RNA, 20 nt, Mycobacterium tuberculosis H37Rv
gucgcaccagcgaacgcugc

SEQ ID NO: 1287603 - RNA, 16 nt, Mycobacterium tuberculosis H37Rv
gucgcaccacagugcc

SEQ ID NO: 1287604 - RNA, 14 nt, Mycobacterium tuberculosis H37Rv
gucgcacggugccg

SEQ ID NO: 1287605 - RNA, 19 nt, Mycobacterium tuberculosis H37Rv
gucgcacccaacuccauca

SEQ ID NO: 1287606 - RNA, 18 nt, Mycobacterium tuberculosis H37Rv
gucgcaauaugccacaga

SEQ ID NO: 1287607 - RNA, 22 nt, Mycobacterium tuberculosis H37Rv
gucgcaaggcccgcaccgcuga

SEQ ID NO: 1287608 - RNA, 14 nt, Mycobacterium tuberculosis H37Rv
gucgcaacgcgauc

SEQ ID NO: 1287609 - RNA, 18 nt, Mycobacterium tuberculosis H37Rv
gucgcaacgcgaucaccu

SEQ ID NO: 1287610 - RNA, 15 nt, Mycobacterium tuberculosis H37Rv
gucgauuugaucgac

SEQ ID NO: 1287611 - RNA, 21 nt, Mycobacterium tuberculosis H37Rv
gucgcaaacuucgcgcacgcc

SEQ ID NO: 1287612 - RNA, 13 nt, Mycobacterium tuberculosis H37Rv
gucgccauaccug

SEQ ID NO: 1287613 - RNA, 20 nt, Mycobacterium tuberculosis H37Rv
gucgccagggagcgcagcgc

SEQ ID NO: 1287614 - RNA, 23 nt, Mycobacterium tuberculosis H37Rv
gucgccagggagcgcagcgccgg

SEQ ID NO: 1287615 - RNA, 18 nt, Mycobacterium tuberculosis H37Rv
gucgccaugucggccagg

SEQ ID NO: 1287616 - RNA, 19 nt, Mycobacterium tuberculosis H37Rv
gucgccaugucggccaggu

SEQ ID NO: 1287617 - RNA, 16 nt, Mycobacterium tuberculosis H37Rv
gucgccaugucggcca

SEQ ID NO: 1287618 - RNA, 18 nt, Mycobacterium tuberculosis H37Rv
gucgcccagccacugacg

SEQ ID NO: 1287619 - RNA, 15 nt, Mycobacterium tuberculosis H37Rv
gucgcgcugccggcc

SEQ ID NO: 1287620 - RNA, 14 nt, Mycobacterium tuberculosis H37Rv
gucgcggacccgcg

SEQ ID NO: 1287621 - RNA, 14 nt, Mycobacterium tuberculosis H37Rv
gucgcgcugccggc

SEQ ID NO: 1287622 - RNA, 13 nt, Mycobacterium tuberculosis H37Rv
gucgcgccaggcu

SEQ ID NO: 1287623 - RNA, 19 nt, Mycobacterium tuberculosis H37Rv
gucgcgcauuucguggcgc

SEQ ID NO: 1287624 - RNA, 17 nt, Mycobacterium tuberculosis H37Rv
gucgcgcagcuccaccg

SEQ ID NO: 1287625 - RNA, 20 nt, Mycobacterium tuberculosis H37Rv
gucgccuccucgugcaggac

SEQ ID NO: 1287626 - RNA, 19 nt, Mycobacterium tuberculosis H37Rv
gucgccgucgauguugccg

SEQ ID NO: 1287627 - RNA, 18 nt, Mycobacterium tuberculosis H37Rv
gucgccgugcuguuccag

SEQ ID NO: 1287628 - RNA, 21 nt, Mycobacterium tuberculosis H37Rv
gucgccgugcuguuccagcgu

SEQ ID NO: 1287629 - RNA, 19 nt, Mycobacterium tuberculosis H37Rv
gucgccgcuuuggaggugc

SEQ ID NO: 1287630 - RNA, 16 nt, Mycobacterium tuberculosis H37Rv
gucgccguccagucgg

SEQ ID NO: 1287631 - RNA, 21 nt, Mycobacterium tuberculosis H37Rv
gucgccggcacacccaucagc

SEQ ID NO: 1287632 - RNA, 15 nt, Mycobacterium tuberculosis H37Rv
gucgccguacagcgc

SEQ ID NO: 1287633 - RNA, 21 nt, Mycobacterium tuberculosis H37Rv
gucgccccguuucggucgaca

SEQ ID NO: 1287634 - RNA, 16 nt, Mycobacterium tuberculosis H37Rv
gucgccccgaugaccg

SEQ ID NO: 1287635 - RNA, 13 nt, Mycobacterium tuberculosis H37Rv
gucgcccagccga

SEQ ID NO: 1287636 - RNA, 17 nt, Mycobacterium tuberculosis H37Rv
gucgcccagccgagcgu

SEQ ID NO: 1287637 - RNA, 22 nt, Mycobacterium tuberculosis H37Rv
gucgcccaacaccgcgccgacg

SEQ ID NO: 1287638 - RNA, 15 nt, Mycobacterium tuberculosis H37Rv
gucgccgacgccggu

SEQ ID NO: 1287639 - RNA, 15 nt, Mycobacterium tuberculosis H37Rv
gucgccggaccagag

SEQ ID NO: 1287640 - RNA, 22 nt, Mycobacterium tuberculosis H37Rv
gucgccggaccagagccaacga

SEQ ID NO: 1287641 - RNA, 20 nt, Mycobacterium tuberculosis H37Rv
gucgccgccuuacgcaccga

SEQ ID NO: 1287642 - RNA, 21 nt, Mycobacterium tuberculosis H37Rv
gucgccgccguugccgccagc

SEQ ID NO: 1287643 - RNA, 20 nt, Mycobacterium tuberculosis H37Rv
gucgccgaguaccggccagc

SEQ ID NO: 1287644 - RNA, 20 nt, Mycobacterium tuberculosis H37Rv
gucgccgaucaccgcaucgg

SEQ ID NO: 1287645 - RNA, 14 nt, Mycobacterium tuberculosis H37Rv
gucgcggagaacgc

SEQ ID NO: 1287646 - RNA, 18 nt, Mycobacterium tuberculosis H37Rv
gucgcggccacggucagc

SEQ ID NO: 1287647 - RNA, 16 nt, Mycobacterium tuberculosis H37Rv
gucgcggccacgguca

SEQ ID NO: 1287648 - RNA, 18 nt, Mycobacterium tuberculosis H37Rv
gucgcgguggcggcggug

SEQ ID NO: 1287649 - RNA, 20 nt, Mycobacterium tuberculosis H37Rv
gucgcgguggcggcggugcc

SEQ ID NO: 1287650 - RNA, 22 nt, Mycobacterium tuberculosis H37Rv
gucgcggccgcggccucccgca

SEQ ID NO: 1287651 - RNA, 23 nt, Mycobacterium tuberculosis H37Rv
gucgcgucgcaggauucccaguc

SEQ ID NO: 1287652 - RNA, 12 nt, Mycobacterium tuberculosis H37Rv
gucgcguucggc

SEQ ID NO: 1287653 - RNA, 16 nt, Mycobacterium tuberculosis H37Rv
gucgcugaacagacgg

SEQ ID NO: 1287654 - RNA, 17 nt, Mycobacterium tuberculosis H37Rv
gucgcugaagccgucgu

SEQ ID NO: 1287655 - RNA, 18 nt, Mycobacterium tuberculosis H37Rv
gucgcugaagccgucgua

SEQ ID NO: 1287656 - RNA, 18 nt, Mycobacterium tuberculosis H37Rv
gucgcugagcagcgccgc

SEQ ID NO: 1287657 - RNA, 17 nt, Mycobacterium tuberculosis H37Rv
gucgcugagcacggcgc

SEQ ID NO: 1287658 - RNA, 22 nt, Mycobacterium tuberculosis H37Rv
gucgcguccacccacgaucagc

SEQ ID NO: 1287659 - RNA, 18 nt, Mycobacterium tuberculosis H37Rv
gucgcugaugagcucgua

SEQ ID NO: 1287660 - RNA, 15 nt, Mycobacterium tuberculosis H37Rv
gucgcugauccgggc

SEQ ID NO: 1287661 - RNA, 23 nt, Mycobacterium tuberculosis H37Rv
gucggccaccugcucgucgguca

SEQ ID NO: 1287662 - RNA, 14 nt, Mycobacterium tuberculosis H37Rv
gucggccaggccgu

SEQ ID NO: 1287663 - RNA, 14 nt, Mycobacterium tuberculosis H37Rv
gucggccagcucgc

SEQ ID NO: 1287664 - RNA, 13 nt, Mycobacterium tuberculosis H37Rv
gucggcaaucucg

SEQ ID NO: 1287665 - RNA, 19 nt, Mycobacterium tuberculosis H37Rv
gucggcaaugacguacggg

SEQ ID NO: 1287666 - RNA, 19 nt, Mycobacterium tuberculosis H37Rv
gucggcaccaccacgccga

SEQ ID NO: 1287667 - RNA, 13 nt, Mycobacterium tuberculosis H37Rv
gucggcaccgauc

SEQ ID NO: 1287668 - RNA, 17 nt, Mycobacterium tuberculosis H37Rv
gucggaaugggcgccac

SEQ ID NO: 1287669 - RNA, 22 nt, Mycobacterium tuberculosis H37Rv
gucggcaacccacacgcccucg

SEQ ID NO: 1287670 - RNA, 16 nt, Mycobacterium tuberculosis H37Rv
gucggacauaccgcga

SEQ ID NO: 1287671 - RNA, 22 nt, Mycobacterium tuberculosis H37Rv
gucgcuggugggaucgcagcgc

SEQ ID NO: 1287672 - RNA, 16 nt, Mycobacterium tuberculosis H37Rv
gucggcccgcggucgc

SEQ ID NO: 1287673 - RNA, 14 nt, Mycobacterium tuberculosis H37Rv
gucggccgacaccg

SEQ ID NO: 1287674 - RNA, 20 nt, Mycobacterium tuberculosis H37Rv
gucggccccuuugucgagca

SEQ ID NO: 1287675 - RNA, 15 nt, Mycobacterium tuberculosis H37Rv
gucggcccuccaccg

SEQ ID NO: 1287676 - RNA, 19 nt, Mycobacterium tuberculosis H37Rv
gucggcccuccaccggugu

SEQ ID NO: 1287677 - RNA, 22 nt, Mycobacterium tuberculosis H37Rv
gucggccaggccgucggcgucg

SEQ ID NO: 1287678 - RNA, 15 nt, Mycobacterium tuberculosis H37Rv
gucggccauccaccg

SEQ ID NO: 1287679 - RNA, 19 nt, Mycobacterium tuberculosis H37Rv
gucggccaucgaguccacc

SEQ ID NO: 1287680 - RNA, 19 nt, Mycobacterium tuberculosis H37Rv
gucggccauccaccgcaga

SEQ ID NO: 1287681 - RNA, 19 nt, Mycobacterium tuberculosis H37Rv
gucggcccauaacagcugg

SEQ ID NO: 1287682 - RNA, 20 nt, Mycobacterium tuberculosis H37Rv
gucggccccacaagucgcgc

SEQ ID NO: 1287683 - RNA, 22 nt, Mycobacterium tuberculosis H37Rv
gucggccugguacucccgcgau

SEQ ID NO: 1287684 - RNA, 19 nt, Mycobacterium tuberculosis H37Rv
gucggccugaccggucacc

SEQ ID NO: 1287685 - RNA, 17 nt, Mycobacterium tuberculosis H37Rv
gucggccugaccgguca

SEQ ID NO: 1287686 - RNA, 16 nt, Mycobacterium tuberculosis H37Rv
gucggccggggccacc

SEQ ID NO: 1287687 - RNA, 21 nt, Mycobacterium tuberculosis H37Rv
gucggcgagcagacgccgcgu

SEQ ID NO: 1287688 - RNA, 14 nt, Mycobacterium tuberculosis H37Rv
gucggcgacgaacc

SEQ ID NO: 1287689 - RNA, 15 nt, Mycobacterium tuberculosis H37Rv
gucggcgacgaaccg

SEQ ID NO: 1287690 - RNA, 15 nt, Mycobacterium tuberculosis H37Rv
gucggcgaucaacgc

SEQ ID NO: 1287691 - RNA, 19 nt, Mycobacterium tuberculosis H37Rv
gucggcgaacgcggcgucg

SEQ ID NO: 1287692 - RNA, 21 nt, Mycobacterium tuberculosis H37Rv
gucggcgaacgcguccagcgc

SEQ ID NO: 1287693 - RNA, 21 nt, Mycobacterium tuberculosis H37Rv
gucggcgaccaccagcgccga

SEQ ID NO: 1287694 - RNA, 22 nt, Mycobacterium tuberculosis H37Rv
gucggcgaagguguccuccagc

SEQ ID NO: 1287695 - RNA, 23 nt, Mycobacterium tuberculosis H37Rv
gucggcgaagguguccuccagcu

SEQ ID NO: 1287696 - RNA, 22 nt, Mycobacterium tuberculosis H37Rv
gucggcgaccaggucggcuucg

SEQ ID NO: 1287697 - RNA, 17 nt, Mycobacterium tuberculosis H37Rv
gucggcgaauccgccgc

SEQ ID NO: 1287698 - RNA, 22 nt, Mycobacterium tuberculosis H37Rv
gucggcgaccgagacggcgucg

SEQ ID NO: 1287699 - RNA, 16 nt, Mycobacterium tuberculosis H37Rv
gucggcgccggcaucg

SEQ ID NO: 1287700 - RNA, 21 nt, Mycobacterium tuberculosis H37Rv
gucggcgccggcggccgcggu

SEQ ID NO: 1287701 - RNA, 21 nt, Mycobacterium tuberculosis H37Rv
gucggcgaugaacagcgacgc

SEQ ID NO: 1287702 - RNA, 16 nt, Mycobacterium tuberculosis H37Rv
gucggcgaucugcgca

SEQ ID NO: 1287703 - RNA, 16 nt, Mycobacterium tuberculosis H37Rv
gucggcgaugucgaag

SEQ ID NO: 1287704 - RNA, 17 nt, Mycobacterium tuberculosis H37Rv
gucggcgaugucgaagc

SEQ ID NO: 1287705 - RNA, 22 nt, Mycobacterium tuberculosis H37Rv
gucggcgucgaauucagcugca

SEQ ID NO: 1287706 - RNA, 19 nt, Mycobacterium tuberculosis H37Rv
gucgggaugcccgcugauc

SEQ ID NO: 1287707 - RNA, 18 nt, Mycobacterium tuberculosis H37Rv
gucgggauccaugcgggu

SEQ ID NO: 1287708 - RNA, 19 nt, Mycobacterium tuberculosis H37Rv
gucggcguuaccgaccuug

SEQ ID NO: 1287709 - RNA, 20 nt, Mycobacterium tuberculosis H37Rv
gucggcggacgcgggugcca

SEQ ID NO: 1287710 - RNA, 19 nt, Mycobacterium tuberculosis H37Rv
gucggcgcugcgcgcgauc

SEQ ID NO: 1287711 - RNA, 20 nt, Mycobacterium tuberculosis H37Rv
gucggcgcggcugccgcggu

SEQ ID NO: 1287712 - RNA, 22 nt, Mycobacterium tuberculosis H37Rv
gucgggcccacuugugacccgg

SEQ ID NO: 1287713 - RNA, 20 nt, Mycobacterium tuberculosis H37Rv
gucgggcagcugguagguca

SEQ ID NO: 1287714 - RNA, 19 nt, Mycobacterium tuberculosis H37Rv
gucgggcacugugagguca

SEQ ID NO: 1287715 - RNA, 17 nt, Mycobacterium tuberculosis H37Rv
gucgggcggcgucgaac

SEQ ID NO: 1287716 - RNA, 15 nt, Mycobacterium tuberculosis H37Rv
gucgggcgugucggg

SEQ ID NO: 1287717 - RNA, 18 nt, Mycobacterium tuberculosis H37Rv
gucgggcgugucgggaac

SEQ ID NO: 1287718 - RNA, 14 nt, Mycobacterium tuberculosis H37Rv
gucgggcggcgucg

SEQ ID NO: 1287719 - RNA, 15 nt, Mycobacterium tuberculosis H37Rv
gucgggccugccgga

SEQ ID NO: 1287720 - RNA, 23 nt, Mycobacterium tuberculosis H37Rv
gucgggcuugacccuugggcacc

SEQ ID NO: 1287721 - RNA, 16 nt, Mycobacterium tuberculosis H37Rv
gucggggaugccgaac

SEQ ID NO: 1287722 - RNA, 20 nt, Mycobacterium tuberculosis H37Rv
gucggugaaaugacggcuga

SEQ ID NO: 1287723 - RNA, 22 nt, Mycobacterium tuberculosis H37Rv
gucggugaaaugacggcugaac

SEQ ID NO: 1287724 - RNA, 22 nt, Mycobacterium tuberculosis H37Rv
gucggugaccguucggcggucg

SEQ ID NO: 1287725 - RNA, 21 nt, Mycobacterium tuberculosis H37Rv
gucgguggccgcggcggucug

SEQ ID NO: 1287726 - RNA, 20 nt, Mycobacterium tuberculosis H37Rv
gucggugggcggcgagcgcg

SEQ ID NO: 1287727 - RNA, 15 nt, Mycobacterium tuberculosis H37Rv
gucgugcacggcggc

SEQ ID NO: 1287728 - RNA, 16 nt, Mycobacterium tuberculosis H37Rv
gucgucgccggcgcuc

SEQ ID NO: 1287729 - RNA, 18 nt, Mycobacterium tuberculosis H37Rv
gucgucgacaaacagcgc

SEQ ID NO: 1287730 - RNA, 23 nt, Mycobacterium tuberculosis H37Rv
gucgucgccaaucgaguagcuga

SEQ ID NO: 1287731 - RNA, 20 nt, Mycobacterium tuberculosis H37Rv
gucgguggucucggcaucca

SEQ ID NO: 1287732 - RNA, 18 nt, Mycobacterium tuberculosis H37Rv
gucggugaccucggcgac

SEQ ID NO: 1287733 - RNA, 11 nt, Mycobacterium tuberculosis H37Rv
gucggugaccu

SEQ ID NO: 1287734 - RNA, 22 nt, Mycobacterium tuberculosis H37Rv
gucggugugcaucgccggcacg

SEQ ID NO: 1287735 - RNA, 15 nt, Mycobacterium tuberculosis H37Rv
gucggugucggugac

SEQ ID NO: 1287736 - RNA, 18 nt, Mycobacterium tuberculosis H37Rv
gucggugugcaucgccgg

SEQ ID NO: 1287737 - RNA, 15 nt, Mycobacterium tuberculosis H37Rv
gucguccgacgggcc

SEQ ID NO: 1287738 - RNA, 14 nt, Mycobacterium tuberculosis H37Rv
gucguuggacggca

SEQ ID NO: 1287739 - RNA, 18 nt, Mycobacterium tuberculosis H37Rv
gucguuggcucgugcccg

SEQ ID NO: 1287740 - RNA, 22 nt, Mycobacterium tuberculosis H37Rv
gucguuggcucgugcccgacca

SEQ ID NO: 1287741 - RNA, 20 nt, Mycobacterium tuberculosis H37Rv
gucguggauccagccaugcg

SEQ ID NO: 1287742 - RNA, 15 nt, Mycobacterium tuberculosis H37Rv
gucgugcccgggacc

SEQ ID NO: 1287743 - RNA, 21 nt, Mycobacterium tuberculosis H37Rv
gucgugccccggcgcggucau

SEQ ID NO: 1287744 - RNA, 22 nt, Mycobacterium tuberculosis H37Rv
gucgugcgauucacacucgggc

SEQ ID NO: 1287745 - RNA, 21 nt, Mycobacterium tuberculosis H37Rv
gucgugccggggcugccgaac

SEQ ID NO: 1287746 - RNA, 17 nt, Mycobacterium tuberculosis H37Rv
gucucagugcucgccca

SEQ ID NO: 1287747 - RNA, 14 nt, Mycobacterium tuberculosis H37Rv
gucuccacgccguu

SEQ ID NO: 1287748 - RNA, 16 nt, Mycobacterium tuberculosis H37Rv
gucuacgccgggaauu

SEQ ID NO: 1287749 - RNA, 17 nt, Mycobacterium tuberculosis H37Rv
gucuccaguagccggug

SEQ ID NO: 1287750 - RNA, 19 nt, Mycobacterium tuberculosis H37Rv
gucucccagaggucgagcg

SEQ ID NO: 1287751 - RNA, 23 nt, Mycobacterium tuberculosis H37Rv
gucuccgcccgcgggccccaucg

SEQ ID NO: 1287752 - RNA, 15 nt, Mycobacterium tuberculosis H37Rv
gucuccggcaacagc

SEQ ID NO: 1287753 - RNA, 17 nt, Mycobacterium tuberculosis H37Rv
gucuccggacgcacgau

SEQ ID NO: 1287754 - RNA, 17 nt, Mycobacterium tuberculosis H37Rv
gucuccggaucgccgaa

SEQ ID NO: 1287755 - RNA, 18 nt, Mycobacterium tuberculosis H37Rv
gucuccggcaccgagucu

SEQ ID NO: 1287756 - RNA, 15 nt, Mycobacterium tuberculosis H37Rv
gucugcccgaggucc

SEQ ID NO: 1287757 - RNA, 14 nt, Mycobacterium tuberculosis H37Rv
gucugccacgucgg

SEQ ID NO: 1287758 - RNA, 17 nt, Mycobacterium tuberculosis H37Rv
gucugcagugcagcgau

SEQ ID NO: 1287759 - RNA, 14 nt, Mycobacterium tuberculosis H37Rv
gucugaucggcuuc

SEQ ID NO: 1287760 - RNA, 17 nt, Mycobacterium tuberculosis H37Rv
gucuuggaacacggccg

SEQ ID NO: 1287761 - RNA, 21 nt, Mycobacterium tuberculosis H37Rv
gucuuccucggccacccgcag

SEQ ID NO: 1287762 - RNA, 13 nt, Mycobacterium tuberculosis H37Rv
gucugugcucacg

SEQ ID NO: 1287763 - RNA, 23 nt, Mycobacterium tuberculosis H37Rv
gucugugauugcgcgggcaucgu

SEQ ID NO: 1287764 - RNA, 23 nt, Mycobacterium tuberculosis H37Rv
gucugcgccuucgccagcggcgc

SEQ ID NO: 1287765 - RNA, 20 nt, Mycobacterium tuberculosis H37Rv
gugaaagacaacccgcucgg

SEQ ID NO: 1287766 - RNA, 15 nt, Mycobacterium tuberculosis H37Rv
gugaaaccggccuuc

SEQ ID NO: 1287767 - RNA, 19 nt, Mycobacterium tuberculosis H37Rv
gugaaaucgcacagcgcga

SEQ ID NO: 1287768 - RNA, 17 nt, Mycobacterium tuberculosis H37Rv
gugaacaccgccagcag

SEQ ID NO: 1287769 - RNA, 14 nt, Mycobacterium tuberculosis H37Rv
gucuugucgccgag

SEQ ID NO: 1287770 - RNA, 13 nt, Mycobacterium tuberculosis H37Rv
gucuugggucucg

SEQ ID NO: 1287771 - RNA, 19 nt, Mycobacterium tuberculosis H37Rv
guggucaguccgacaccgg

SEQ ID NO: 1287772 - RNA, 21 nt, Mycobacterium tuberculosis H37Rv
guggucggcgacgucgcgcag

SEQ ID NO: 1287773 - RNA, 23 nt, Mycobacterium tuberculosis H37Rv
guggucgugggugagcgaccugg

SEQ ID NO: 1287774 - RNA, 16 nt, Mycobacterium tuberculosis H37Rv
guggucguaggugacg

SEQ ID NO: 1287775 - RNA, 14 nt, Mycobacterium tuberculosis H37Rv
guggucgccccgau

SEQ ID NO: 1287776 - RNA, 15 nt, Mycobacterium tuberculosis H37Rv
gugguaagacgccga

SEQ ID NO: 1287777 - RNA, 16 nt, Mycobacterium tuberculosis H37Rv
gugguaacaccggcga

SEQ ID NO: 1287778 - RNA, 17 nt, Mycobacterium tuberculosis H37Rv
gugggucaagaucggug

SEQ ID NO: 1287779 - RNA, 17 nt, Mycobacterium tuberculosis H37Rv
guggguagccagcgcgc

SEQ ID NO: 1287780 - RNA, 17 nt, Mycobacterium tuberculosis H37Rv
guggggcggcuugggcg

SEQ ID NO: 1287781 - RNA, 19 nt, Mycobacterium tuberculosis H37Rv
gugguaggccggggcgucg

SEQ ID NO: 1287782 - RNA, 14 nt, Mycobacterium tuberculosis H37Rv
gugguaggccggug

SEQ ID NO: 1287783 - RNA, 20 nt, Mycobacterium tuberculosis H37Rv
gugguacuuucacgcucguu

SEQ ID NO: 1287784 - RNA, 13 nt, Mycobacterium tuberculosis H37Rv
gugguaucgccgg

SEQ ID NO: 1287785 - RNA, 15 nt, Mycobacterium tuberculosis H37Rv
gugguaucggcgugc

SEQ ID NO: 1287786 - RNA, 15 nt, Mycobacterium tuberculosis H37Rv
guggucaccaccauc

SEQ ID NO: 1287787 - RNA, 15 nt, Mycobacterium tuberculosis H37Rv
guggucaacggccga

SEQ ID NO: 1287788 - RNA, 22 nt, Mycobacterium tuberculosis H37Rv
gugggcacagcgaccaucgccg

SEQ ID NO: 1287789 - RNA, 23 nt, Mycobacterium tuberculosis H37Rv
gugggccacuugaugcucgaugc

SEQ ID NO: 1287790 - RNA, 21 nt, Mycobacterium tuberculosis H37Rv
gugggcagauacgagcuguac

SEQ ID NO: 1287791 - RNA, 20 nt, Mycobacterium tuberculosis H37Rv
gugggcagcgcgaucaccga

SEQ ID NO: 1287792 - RNA, 19 nt, Mycobacterium tuberculosis H37Rv
gugggccucgaucagcgcc

SEQ ID NO: 1287793 - RNA, 14 nt, Mycobacterium tuberculosis H37Rv
gugggcgacggcca

SEQ ID NO: 1287794 - RNA, 17 nt, Mycobacterium tuberculosis H37Rv
gugggcgccgacaccgg

SEQ ID NO: 1287795 - RNA, 15 nt, Mycobacterium tuberculosis H37Rv
gugggccagcagcaa

SEQ ID NO: 1287796 - RNA, 14 nt, Mycobacterium tuberculosis H37Rv
gugggccccgccga

SEQ ID NO: 1287797 - RNA, 19 nt, Mycobacterium tuberculosis H37Rv
gugggcuaggucgcgcuga

SEQ ID NO: 1287798 - RNA, 17 nt, Mycobacterium tuberculosis H37Rv
gugggcucguagcgcgc

SEQ ID NO: 1287799 - RNA, 17 nt, Mycobacterium tuberculosis H37Rv
gugggcguggcugguca

SEQ ID NO: 1287800 - RNA, 19 nt, Mycobacterium tuberculosis H37Rv
gugggcgccgucgccguug

SEQ ID NO: 1287801 - RNA, 18 nt, Mycobacterium tuberculosis H37Rv
gugggcggcgagcgcgau

SEQ ID NO: 1287802 - RNA, 16 nt, Mycobacterium tuberculosis H37Rv
guggggucgccgucga

SEQ ID NO: 1287803 - RNA, 21 nt, Mycobacterium tuberculosis H37Rv
gugggcuuuugcgucugcucg

SEQ ID NO: 1287804 - RNA, 20 nt, Mycobacterium tuberculosis H37Rv
gugggcuuuugcgucugcuc

SEQ ID NO: 1287805 - RNA, 13 nt, Mycobacterium tuberculosis H37Rv
guggggaucgacc

SEQ ID NO: 1287806 - RNA, 21 nt, Mycobacterium tuberculosis H37Rv
guggggauucguugucgagca

SEQ ID NO: 1287807 - RNA, 22 nt, Mycobacterium tuberculosis H37Rv
guggcgccgccggcaccgccgg

SEQ ID NO: 1287808 - RNA, 14 nt, Mycobacterium tuberculosis H37Rv
guggcgccggccac

SEQ ID NO: 1287809 - RNA, 12 nt, Mycobacterium tuberculosis H37Rv
guggcgccguug

SEQ ID NO: 1287810 - RNA, 14 nt, Mycobacterium tuberculosis H37Rv
guggcgcgccgcau

SEQ ID NO: 1287811 - RNA, 15 nt, Mycobacterium tuberculosis H37Rv
guggcgggagaucgu

SEQ ID NO: 1287812 - RNA, 21 nt, Mycobacterium tuberculosis H37Rv
guggcggaucgcgagcgccgc

SEQ ID NO: 1287813 - RNA, 20 nt, Mycobacterium tuberculosis H37Rv
guggcggcagcagcgccgua

SEQ ID NO: 1287814 - RNA, 14 nt, Mycobacterium tuberculosis H37Rv
guggcgcugaucgg

SEQ ID NO: 1287815 - RNA, 20 nt, Mycobacterium tuberculosis H37Rv
guggcgcgcggcgccgcaau

SEQ ID NO: 1287816 - RNA, 16 nt, Mycobacterium tuberculosis H37Rv
guggcgcggugccggc

SEQ ID NO: 1287817 - RNA, 14 nt, Mycobacterium tuberculosis H37Rv
guggcgggucagcg

SEQ ID NO: 1287818 - RNA, 16 nt, Mycobacterium tuberculosis H37Rv
guggcgggucagcgcg

SEQ ID NO: 1287819 - RNA, 18 nt, Mycobacterium tuberculosis H37Rv
guggcgguggccgucggg

SEQ ID NO: 1287820 - RNA, 20 nt, Mycobacterium tuberculosis H37Rv
guggcgggguugaucaccga

SEQ ID NO: 1287821 - RNA, 16 nt, Mycobacterium tuberculosis H37Rv
guggcgggcuugccgu

SEQ ID NO: 1287822 - RNA, 19 nt, Mycobacterium tuberculosis H37Rv
guggcgugcgcguccagau

SEQ ID NO: 1287823 - RNA, 10 nt, Mycobacterium tuberculosis H37Rv
guggcgucgu

SEQ ID NO: 1287824 - RNA, 13 nt, Mycobacterium tuberculosis H37Rv
guggcgucgcucg

SEQ ID NO: 1287825 - RNA, 20 nt, Mycobacterium tuberculosis H37Rv
guggcgucaugcccaggugc

SEQ ID NO: 1287826 - RNA, 17 nt, Mycobacterium tuberculosis H37Rv
guggcguaauugucgau

SEQ ID NO: 1287827 - RNA, 15 nt, Mycobacterium tuberculosis H37Rv
guggcguguucgacg

SEQ ID NO: 1287828 - RNA, 20 nt, Mycobacterium tuberculosis H37Rv
guggcucgacgaugcgguca

SEQ ID NO: 1287829 - RNA, 18 nt, Mycobacterium tuberculosis H37Rv
guggcuauuccgacucga

SEQ ID NO: 1287830 - RNA, 18 nt, Mycobacterium tuberculosis H37Rv
guggcugaucccggccag

SEQ ID NO: 1287831 - RNA, 22 nt, Mycobacterium tuberculosis H37Rv
guggcuuuugcgucugcucgcg

SEQ ID NO: 1287832 - RNA, 20 nt, Mycobacterium tuberculosis H37Rv
guggcuuuugcgucugcucg

SEQ ID NO: 1287833 - RNA, 19 nt, Mycobacterium tuberculosis H37Rv
guggcuuuugcgucugcuc

SEQ ID NO: 1287834 - RNA, 22 nt, Mycobacterium tuberculosis H37Rv
gugggacaccaucuccgccguc

SEQ ID NO: 1287835 - RNA, 14 nt, Mycobacterium tuberculosis H37Rv
gugggagcagccga

SEQ ID NO: 1287836 - RNA, 13 nt, Mycobacterium tuberculosis H37Rv
guggcacgcauga

SEQ ID NO: 1287837 - RNA, 21 nt, Mycobacterium tuberculosis H37Rv
guggcacguggcgaccggcga

SEQ ID NO: 1287838 - RNA, 18 nt, Mycobacterium tuberculosis H37Rv
guggcaggugaucccgau

SEQ ID NO: 1287839 - RNA, 18 nt, Mycobacterium tuberculosis H37Rv
guggcacgcaugagggca

SEQ ID NO: 1287840 - RNA, 13 nt, Mycobacterium tuberculosis H37Rv
guggcacccggcu

SEQ ID NO: 1287841 - RNA, 17 nt, Mycobacterium tuberculosis H37Rv
guggcagagccgccguu

SEQ ID NO: 1287842 - RNA, 20 nt, Mycobacterium tuberculosis H37Rv
guggccagcaggcggcugaa

SEQ ID NO: 1287843 - RNA, 16 nt, Mycobacterium tuberculosis H37Rv
guggcauccagcagcg

SEQ ID NO: 1287844 - RNA, 13 nt, Mycobacterium tuberculosis H37Rv
guggcaugcgaca

SEQ ID NO: 1287845 - RNA, 21 nt, Mycobacterium tuberculosis H37Rv
guggccaucgaucccuugucg

SEQ ID NO: 1287846 - RNA, 16 nt, Mycobacterium tuberculosis H37Rv
guggccccaagcgugc

SEQ ID NO: 1287847 - RNA, 23 nt, Mycobacterium tuberculosis H37Rv
guggccccaagcgugcugccgcc

SEQ ID NO: 1287848 - RNA, 21 nt, Mycobacterium tuberculosis H37Rv
guggcccgucauacucgacac

SEQ ID NO: 1287849 - RNA, 17 nt, Mycobacterium tuberculosis H37Rv
guggccucauccaccga

SEQ ID NO: 1287850 - RNA, 22 nt, Mycobacterium tuberculosis H37Rv
guggccguggguuugagccaau

SEQ ID NO: 1287851 - RNA, 19 nt, Mycobacterium tuberculosis H37Rv
guggccucauccaccgaug

SEQ ID NO: 1287852 - RNA, 15 nt, Mycobacterium tuberculosis H37Rv
guggccucguccagc

SEQ ID NO: 1287853 - RNA, 17 nt, Mycobacterium tuberculosis H37Rv
guggccuugcgucaucg

SEQ ID NO: 1287854 - RNA, 14 nt, Mycobacterium tuberculosis H37Rv
guggccugucgaag

SEQ ID NO: 1287855 - RNA, 17 nt, Mycobacterium tuberculosis H37Rv
guggcgaccggcgaccg

SEQ ID NO: 1287856 - RNA, 20 nt, Mycobacterium tuberculosis H37Rv
guggcgaaaucgucgaaccg

SEQ ID NO: 1287857 - RNA, 17 nt, Mycobacterium tuberculosis H37Rv
guggcgaacccggucaa

SEQ ID NO: 1287858 - RNA, 23 nt, Mycobacterium tuberculosis H37Rv
guggccgccuucgccgccgccga

SEQ ID NO: 1287859 - RNA, 20 nt, Mycobacterium tuberculosis H37Rv
guggccggggugccggcgau

SEQ ID NO: 1287860 - RNA, 18 nt, Mycobacterium tuberculosis H37Rv
guggccgcugccagccgu

SEQ ID NO: 1287861 - RNA, 19 nt, Mycobacterium tuberculosis H37Rv
guggaccggucgacagcga

SEQ ID NO: 1287862 - RNA, 20 nt, Mycobacterium tuberculosis H37Rv
guggacgcagagucaacaga

SEQ ID NO: 1287863 - RNA, 12 nt, Mycobacterium tuberculosis H37Rv
guggaccgccga

SEQ ID NO: 1287864 - RNA, 21 nt, Mycobacterium tuberculosis H37Rv
guggcaccauaauggucgucg

SEQ ID NO: 1287865 - RNA, 20 nt, Mycobacterium tuberculosis H37Rv
guggcaacgguacgcgcuga

SEQ ID NO: 1287866 - RNA, 21 nt, Mycobacterium tuberculosis H37Rv
guggcaagccuaaaaccccga

SEQ ID NO: 1287867 - RNA, 11 nt, Mycobacterium tuberculosis H37Rv
guggaucacca

SEQ ID NO: 1287868 - RNA, 12 nt, Mycobacterium tuberculosis H37Rv
guggaucaccau

SEQ ID NO: 1287869 - RNA, 19 nt, Mycobacterium tuberculosis H37Rv
guggagggcccggccggac

SEQ ID NO: 1287870 - RNA, 19 nt, Mycobacterium tuberculosis H37Rv
gugcuuccauucgcggucc

SEQ ID NO: 1287871 - RNA, 18 nt, Mycobacterium tuberculosis H37Rv
gugcuggugguaucggcg

SEQ ID NO: 1287872 - RNA, 14 nt, Mycobacterium tuberculosis H37Rv
gugcuggucgccgc

SEQ ID NO: 1287873 - RNA, 15 nt, Mycobacterium tuberculosis H37Rv
gugcuggcgcaacca

SEQ ID NO: 1287874 - RNA, 22 nt, Mycobacterium tuberculosis H37Rv
gugcuggcuuugaucgcccggu

SEQ ID NO: 1287875 - RNA, 17 nt, Mycobacterium tuberculosis H37Rv
gugcuugcccgguugug

SEQ ID NO: 1287876 - RNA, 19 nt, Mycobacterium tuberculosis H37Rv
gugcuuucgcgucugcucg

SEQ ID NO: 1287877 - RNA, 19 nt, Mycobacterium tuberculosis H37Rv
guggaaaaaggcggcguug

SEQ ID NO: 1287878 - RNA, 22 nt, Mycobacterium tuberculosis H37Rv
guggaaacugaugucgccgauu

SEQ ID NO: 1287879 - RNA, 18 nt, Mycobacterium tuberculosis H37Rv
guggaacauccgcacugg

SEQ ID NO: 1287880 - RNA, 22 nt, Mycobacterium tuberculosis H37Rv
guggaagauguugccgccgguc

SEQ ID NO: 1287881 - RNA, 15 nt, Mycobacterium tuberculosis H37Rv
guggaaccacggcgc

SEQ ID NO: 1287882 - RNA, 21 nt, Mycobacterium tuberculosis H37Rv
guggaagccgaccaccgccgg

SEQ ID NO: 1287883 - RNA, 17 nt, Mycobacterium tuberculosis H37Rv
gugccaguacucggcca

SEQ ID NO: 1287884 - RNA, 23 nt, Mycobacterium tuberculosis H37Rv
gugccaguacucggccagcgccu

SEQ ID NO: 1287885 - RNA, 18 nt, Mycobacterium tuberculosis H37Rv
gugcccaccaccgacagc

SEQ ID NO: 1287886 - RNA, 20 nt, Mycobacterium tuberculosis H37Rv
gugccauccuuaugcgcggu

SEQ ID NO: 1287887 - RNA, 12 nt, Mycobacterium tuberculosis H37Rv
gugccaucgcca

SEQ ID NO: 1287888 - RNA, 22 nt, Mycobacterium tuberculosis H37Rv
gugccaucuacaucgucgagcg

SEQ ID NO: 1287889 - RNA, 18 nt, Mycobacterium tuberculosis H37Rv
gugcccaggaaggcgacg

SEQ ID NO: 1287890 - RNA, 15 nt, Mycobacterium tuberculosis H37Rv
gugccccacucgggu

SEQ ID NO: 1287891 - RNA, 13 nt, Mycobacterium tuberculosis H37Rv
gugcccaucggca

SEQ ID NO: 1287892 - RNA, 16 nt, Mycobacterium tuberculosis H37Rv
gugcccagcagcgcga

SEQ ID NO: 1287893 - RNA, 12 nt, Mycobacterium tuberculosis H37Rv
gugcccgaccac

SEQ ID NO: 1287894 - RNA, 13 nt, Mycobacterium tuberculosis H37Rv
gugcccgacccgc

SEQ ID NO: 1287895 - RNA, 23 nt, Mycobacterium tuberculosis H37Rv
gugccccggcgguaccagagcag

SEQ ID NO: 1287896 - RNA, 16 nt, Mycobacterium tuberculosis H37Rv
gugcaucgaucaccgc

SEQ ID NO: 1287897 - RNA, 17 nt, Mycobacterium tuberculosis H37Rv
gugcaucgaucaccgcu

SEQ ID NO: 1287898 - RNA, 23 nt, Mycobacterium tuberculosis H37Rv
gugcauagcaauccgcacagcga

SEQ ID NO: 1287899 - RNA, 13 nt, Mycobacterium tuberculosis H37Rv
gugcaggaccagc

SEQ ID NO: 1287900 - RNA, 21 nt, Mycobacterium tuberculosis H37Rv
gugcaccgaagauggccagcg

SEQ ID NO: 1287901 - RNA, 18 nt, Mycobacterium tuberculosis H37Rv
gugcaccgaagcggucgc

SEQ ID NO: 1287902 - RNA, 13 nt, Mycobacterium tuberculosis H37Rv
gugcaccagcuca

SEQ ID NO: 1287903 - RNA, 18 nt, Mycobacterium tuberculosis H37Rv
gugcaccacauuggcgau

SEQ ID NO: 1287904 - RNA, 19 nt, Mycobacterium tuberculosis H37Rv
gugcaccgaagauggccag

SEQ ID NO: 1287905 - RNA, 15 nt, Mycobacterium tuberculosis H37Rv
gugagcccguugacc

SEQ ID NO: 1287906 - RNA, 14 nt, Mycobacterium tuberculosis H37Rv
gugagcgagcgcgc

SEQ ID NO: 1287907 - RNA, 20 nt, Mycobacterium tuberculosis H37Rv
gugagccauacgcgcugacc

SEQ ID NO: 1287908 - RNA, 16 nt, Mycobacterium tuberculosis H37Rv
gugagccccagcgacg

SEQ ID NO: 1287909 - RNA, 21 nt, Mycobacterium tuberculosis H37Rv
gugagcucggcugcucgacgg

SEQ ID NO: 1287910 - RNA, 19 nt, Mycobacterium tuberculosis H37Rv
gugagcugcgccagaaucc

SEQ ID NO: 1287911 - RNA, 14 nt, Mycobacterium tuberculosis H37Rv
gugagcugcucacg

SEQ ID NO: 1287912 - RNA, 20 nt, Mycobacterium tuberculosis H37Rv
gugagcuacucacggugauc

SEQ ID NO: 1287913 - RNA, 22 nt, Mycobacterium tuberculosis H37Rv
gugaacggcucgggcagcguca

SEQ ID NO: 1287914 - RNA, 18 nt, Mycobacterium tuberculosis H37Rv
gugaacggcgcgggccac

SEQ ID NO: 1287915 - RNA, 16 nt, Mycobacterium tuberculosis H37Rv
gugaacgccgccccga

SEQ ID NO: 1287916 - RNA, 16 nt, Mycobacterium tuberculosis H37Rv
gugaaccacucgguga

SEQ ID NO: 1287917 - RNA, 17 nt, Mycobacterium tuberculosis H37Rv
gugaacacgucgcggua

SEQ ID NO: 1287918 - RNA, 21 nt, Mycobacterium tuberculosis H37Rv
gugaacaggccgaggcgaguu

SEQ ID NO: 1287919 - RNA, 16 nt, Mycobacterium tuberculosis H37Rv
gugaaccaacgcgacc

SEQ ID NO: 1287920 - RNA, 22 nt, Mycobacterium tuberculosis H37Rv
gugaaccaacgcgaccgcaucu

SEQ ID NO: 1287921 - RNA, 23 nt, Mycobacterium tuberculosis H37Rv
gugaacgaagggaaggacgcgca

SEQ ID NO: 1287922 - RNA, 20 nt, Mycobacterium tuberculosis H37Rv
gugaaccuggcgacgcgaca

SEQ ID NO: 1287923 - RNA, 13 nt, Mycobacterium tuberculosis H37Rv
gugauccgacagu

SEQ ID NO: 1287924 - RNA, 12 nt, Mycobacterium tuberculosis H37Rv
gugaucgcacag

SEQ ID NO: 1287925 - RNA, 22 nt, Mycobacterium tuberculosis H37Rv
gugaucgcauuggcggcggucc

SEQ ID NO: 1287926 - RNA, 15 nt, Mycobacterium tuberculosis H37Rv
gugaucgagucgcga

SEQ ID NO: 1287927 - RNA, 16 nt, Mycobacterium tuberculosis H37Rv
gugaugccaucaacga

SEQ ID NO: 1287928 - RNA, 12 nt, Mycobacterium tuberculosis H37Rv
gugaugccacgg

SEQ ID NO: 1287929 - RNA, 19 nt, Mycobacterium tuberculosis H37Rv
gugcacaccgucgcaccca

SEQ ID NO: 1287930 - RNA, 17 nt, Mycobacterium tuberculosis H37Rv
gugaugcgggcucggcu

SEQ ID NO: 1287931 - RNA, 12 nt, Mycobacterium tuberculosis H37Rv
gugcucggugac

SEQ ID NO: 1287932 - RNA, 20 nt, Mycobacterium tuberculosis H37Rv
gugcucggaucggcucgcca

SEQ ID NO: 1287933 - RNA, 21 nt, Mycobacterium tuberculosis H37Rv
gugcucguagacuugcugcuc

SEQ ID NO: 1287934 - RNA, 14 nt, Mycobacterium tuberculosis H37Rv
gugcucgucgccug

SEQ ID NO: 1287935 - RNA, 17 nt, Mycobacterium tuberculosis H37Rv
gugcucucgcucgugca

SEQ ID NO: 1287936 - RNA, 20 nt, Mycobacterium tuberculosis H37Rv
gugcucgccguaagcaccag

SEQ ID NO: 1287937 - RNA, 22 nt, Mycobacterium tuberculosis H37Rv
gugcucgccguaagcaccagcc

SEQ ID NO: 1287938 - RNA, 14 nt, Mycobacterium tuberculosis H37Rv
gugcugcaccgauu

SEQ ID NO: 1287939 - RNA, 14 nt, Mycobacterium tuberculosis H37Rv
gugcugcaccuggc

SEQ ID NO: 1287940 - RNA, 20 nt, Mycobacterium tuberculosis H37Rv
gugcucagcgcgcgccgcug

SEQ ID NO: 1287941 - RNA, 23 nt, Mycobacterium tuberculosis H37Rv
gugcucagcuucgcgucgggcuu

SEQ ID NO: 1287942 - RNA, 13 nt, Mycobacterium tuberculosis H37Rv
gugcucacggcgg

SEQ ID NO: 1287943 - RNA, 19 nt, Mycobacterium tuberculosis H37Rv
gugcucacgcaucgcgaag

SEQ ID NO: 1287944 - RNA, 22 nt, Mycobacterium tuberculosis H37Rv
gugcguacugguccgcacgguu

SEQ ID NO: 1287945 - RNA, 21 nt, Mycobacterium tuberculosis H37Rv
gugcucgagcaccucggccuc

SEQ ID NO: 1287946 - RNA, 12 nt, Mycobacterium tuberculosis H37Rv
gugcucgccgau

SEQ ID NO: 1287947 - RNA, 22 nt, Mycobacterium tuberculosis H37Rv
gugcucgccggaucuugccgcu

SEQ ID NO: 1287948 - RNA, 22 nt, Mycobacterium tuberculosis H37Rv
gugcgcccgacggaguucgacg

SEQ ID NO: 1287949 - RNA, 22 nt, Mycobacterium tuberculosis H37Rv
gugcggcguuaucgucggcuug

SEQ ID NO: 1287950 - RNA, 20 nt, Mycobacterium tuberculosis H37Rv
gugcgguauuugaacgcccg

SEQ ID NO: 1287951 - RNA, 19 nt, Mycobacterium tuberculosis H37Rv
gugcgguaucggucagcca

SEQ ID NO: 1287952 - RNA, 15 nt, Mycobacterium tuberculosis H37Rv
gugcgguaucgguca

SEQ ID NO: 1287953 - RNA, 18 nt, Mycobacterium tuberculosis H37Rv
gugcgguacaucgaccac

SEQ ID NO: 1287954 - RNA, 15 nt, Mycobacterium tuberculosis H37Rv
gugcgguugcgcgga

SEQ ID NO: 1287955 - RNA, 16 nt, Mycobacterium tuberculosis H37Rv
gugcggugagauggcg

SEQ ID NO: 1287956 - RNA, 24 nt, Mycobacterium tuberculosis H37Rv
gugcggugaccgugaacggcucgg

SEQ ID NO: 1287957 - RNA, 18 nt, Mycobacterium tuberculosis H37Rv
gugcggucucacucaucg

SEQ ID NO: 1287958 - RNA, 14 nt, Mycobacterium tuberculosis H37Rv
gugcggucucgacc

SEQ ID NO: 1287959 - RNA, 21 nt, Mycobacterium tuberculosis H37Rv
gugccuugaucugagcgcggg

SEQ ID NO: 1287960 - RNA, 18 nt, Mycobacterium tuberculosis H37Rv
gugccuuccucggcaagu

SEQ ID NO: 1287961 - RNA, 17 nt, Mycobacterium tuberculosis H37Rv
gugccugcaguucggcg

SEQ ID NO: 1287962 - RNA, 17 nt, Mycobacterium tuberculosis H37Rv
gugccuuucggcagacc

SEQ ID NO: 1287963 - RNA, 16 nt, Mycobacterium tuberculosis H37Rv
gugcgaaaaucgcgcg

SEQ ID NO: 1287964 - RNA, 20 nt, Mycobacterium tuberculosis H37Rv
gugcgacucugcgucugcuc

SEQ ID NO: 1287965 - RNA, 19 nt, Mycobacterium tuberculosis H37Rv
gugcgacucugcgucugcu

SEQ ID NO: 1287966 - RNA, 14 nt, Mycobacterium tuberculosis H37Rv
gugcgacggcguug

SEQ ID NO: 1287967 - RNA, 18 nt, Mycobacterium tuberculosis H37Rv
gugcgacucugcgucugc

SEQ ID NO: 1287968 - RNA, 17 nt, Mycobacterium tuberculosis H37Rv
gugcgcaucagcgguac

SEQ ID NO: 1287969 - RNA, 15 nt, Mycobacterium tuberculosis H37Rv
gugcgccacgaccgc

SEQ ID NO: 1287970 - RNA, 20 nt, Mycobacterium tuberculosis H37Rv
gugcgcccaauccaccgauu

SEQ ID NO: 1287971 - RNA, 12 nt, Mycobacterium tuberculosis H37Rv
gugcgccagcga

SEQ ID NO: 1287972 - RNA, 18 nt, Mycobacterium tuberculosis H37Rv
gugcgcccaauccaccga

SEQ ID NO: 1287973 - RNA, 21 nt, Mycobacterium tuberculosis H37Rv
gugcgccaaggucugccgggc

SEQ ID NO: 1287974 - RNA, 20 nt, Mycobacterium tuberculosis H37Rv
gugcgacgcaggaucacacu

SEQ ID NO: 1287975 - RNA, 21 nt, Mycobacterium tuberculosis H37Rv
gugcgcagcuuggccagccac

SEQ ID NO: 1287976 - RNA, 16 nt, Mycobacterium tuberculosis H37Rv
gugccgcuagcggauu

SEQ ID NO: 1287977 - RNA, 22 nt, Mycobacterium tuberculosis H37Rv
gugccggcagcgguggcaagcc

SEQ ID NO: 1287978 - RNA, 11 nt, Mycobacterium tuberculosis H37Rv
gugccggcaua

SEQ ID NO: 1287979 - RNA, 15 nt, Mycobacterium tuberculosis H37Rv
gugccggcgacgcua

SEQ ID NO: 1287980 - RNA, 14 nt, Mycobacterium tuberculosis H37Rv
gugccggcgacgcu

SEQ ID NO: 1287981 - RNA, 19 nt, Mycobacterium tuberculosis H37Rv
gugccuacaccggcaagcc

SEQ ID NO: 1287982 - RNA, 15 nt, Mycobacterium tuberculosis H37Rv
gugccuacaccggca

SEQ ID NO: 1287983 - RNA, 16 nt, Mycobacterium tuberculosis H37Rv
gugcccggccgccagc

SEQ ID NO: 1287984 - RNA, 23 nt, Mycobacterium tuberculosis H37Rv
gugccgcgucaaccgaucggucg

SEQ ID NO: 1287985 - RNA, 19 nt, Mycobacterium tuberculosis H37Rv
gugccgcgucggccgcgcu

SEQ ID NO: 1287986 - RNA, 16 nt, Mycobacterium tuberculosis H37Rv
gugccgcggucccguc

SEQ ID NO: 1287987 - RNA, 18 nt, Mycobacterium tuberculosis H37Rv
gugccgccugcgccgcca

SEQ ID NO: 1287988 - RNA, 17 nt, Mycobacterium tuberculosis H37Rv
gugccgccgggggacga

SEQ ID NO: 1287989 - RNA, 18 nt, Mycobacterium tuberculosis H37Rv
gugccgccgucgccgcca

SEQ ID NO: 1287990 - RNA, 13 nt, Mycobacterium tuberculosis H37Rv
gugccgcgcagcu

SEQ ID NO: 1287991 - RNA, 14 nt, Mycobacterium tuberculosis H37Rv
gucaguaggcggau

SEQ ID NO: 1287992 - RNA, 16 nt, Mycobacterium tuberculosis H37Rv
gucagguucgcaccgg

SEQ ID NO: 1287993 - RNA, 14 nt, Mycobacterium tuberculosis H37Rv
gucaguccucaucg

SEQ ID NO: 1287994 - RNA, 21 nt, Mycobacterium tuberculosis H37Rv
gucaguccucaucgagcgcgc

SEQ ID NO: 1287995 - RNA, 20 nt, Mycobacterium tuberculosis H37Rv
gucaggcggccgucgucggc

SEQ ID NO: 1287996 - RNA, 19 nt, Mycobacterium tuberculosis H37Rv
gucaggccagagucgcccg

SEQ ID NO: 1287997 - RNA, 16 nt, Mycobacterium tuberculosis H37Rv
gucaggccagagucgc

SEQ ID NO: 1287998 - RNA, 18 nt, Mycobacterium tuberculosis H37Rv
gucaggccagggugacca

SEQ ID NO: 1287999 - RNA, 19 nt, Mycobacterium tuberculosis H37Rv
gucaggcccauggcagccc

SEQ ID NO: 1288000 - RNA, 17 nt, Mycobacterium tuberculosis H37Rv
gucaggcucacacucgg

SEQ ID NO: 1288001 - RNA, 21 nt, Mycobacterium tuberculosis H37Rv
gucaggguguugcggcugacc

SEQ ID NO: 1288002 - RNA, 16 nt, Mycobacterium tuberculosis H37Rv
gucaggaucgcaccga

SEQ ID NO: 1288003 - RNA, 21 nt, Mycobacterium tuberculosis H37Rv
gucagcuaauaccugcggauu

SEQ ID NO: 1288004 - RNA, 22 nt, Mycobacterium tuberculosis H37Rv
gucagcgccgcgcgcgccgcau

SEQ ID NO: 1288005 - RNA, 21 nt, Mycobacterium tuberculosis H37Rv
gucagcgucugagcgccggca

SEQ ID NO: 1288006 - RNA, 18 nt, Mycobacterium tuberculosis H37Rv
gucagcggccugcucggg

SEQ ID NO: 1288007 - RNA, 12 nt, Mycobacterium tuberculosis H37Rv
gucagcgggcuu

SEQ ID NO: 1288008 - RNA, 14 nt, Mycobacterium tuberculosis H37Rv
gucaucgacgagcg

SEQ ID NO: 1288009 - RNA, 15 nt, Mycobacterium tuberculosis H37Rv
gucaucgcguaguga

SEQ ID NO: 1288010 - RNA, 19 nt, Mycobacterium tuberculosis H37Rv
gucaucgccggguagcugu

SEQ ID NO: 1288011 - RNA, 14 nt, Mycobacterium tuberculosis H37Rv
gucaucgccagcgg

SEQ ID NO: 1288012 - RNA, 18 nt, Mycobacterium tuberculosis H37Rv
gucaucauggccggaucc

SEQ ID NO: 1288013 - RNA, 22 nt, Mycobacterium tuberculosis H37Rv
gucaucccuuucgcgccgcgag

SEQ ID NO: 1288014 - RNA, 17 nt, Mycobacterium tuberculosis H37Rv
gucauccgggcgaccac

SEQ ID NO: 1288015 - RNA, 18 nt, Mycobacterium tuberculosis H37Rv
gucaguuacgcaucguca

SEQ ID NO: 1288016 - RNA, 18 nt, Mycobacterium tuberculosis H37Rv
gucauacucgacaccgac

SEQ ID NO: 1288017 - RNA, 19 nt, Mycobacterium tuberculosis H37Rv
gucaucagcgugcauggcg

SEQ ID NO: 1288018 - RNA, 15 nt, Mycobacterium tuberculosis H37Rv
gucaucggcuaucgc

SEQ ID NO: 1288019 - RNA, 17 nt, Mycobacterium tuberculosis H37Rv
gucaugaacgaccggac

SEQ ID NO: 1288020 - RNA, 13 nt, Mycobacterium tuberculosis H37Rv
gucaugcaagcgc

SEQ ID NO: 1288021 - RNA, 15 nt, Mycobacterium tuberculosis H37Rv
gucauggcccgaucg

SEQ ID NO: 1288022 - RNA, 19 nt, Mycobacterium tuberculosis H37Rv
gucaugcggaucacaucgg

SEQ ID NO: 1288023 - RNA, 20 nt, Mycobacterium tuberculosis H37Rv
gucauggcgaaccgucagcg

SEQ ID NO: 1288024 - RNA, 21 nt, Mycobacterium tuberculosis H37Rv
gucauggcgaguacggccugc

SEQ ID NO: 1288025 - RNA, 19 nt, Mycobacterium tuberculosis H37Rv
gucaugccgccgccgagau

SEQ ID NO: 1288026 - RNA, 15 nt, Mycobacterium tuberculosis H37Rv
gucaugggcggcuuc

SEQ ID NO: 1288027 - RNA, 18 nt, Mycobacterium tuberculosis H37Rv
gucauguccauagccggc

SEQ ID NO: 1288028 - RNA, 21 nt, Mycobacterium tuberculosis H37Rv
guccaaaacaccgccagcuca

SEQ ID NO: 1288029 - RNA, 16 nt, Mycobacterium tuberculosis H37Rv
guccaggcugaucccg

SEQ ID NO: 1288030 - RNA, 16 nt, Mycobacterium tuberculosis H37Rv
guccagcgcggccuug

SEQ ID NO: 1288031 - RNA, 23 nt, Mycobacterium tuberculosis H37Rv
guccagcgccgcggcccgcucga

SEQ ID NO: 1288032 - RNA, 21 nt, Mycobacterium tuberculosis H37Rv
guccaggugcgccguggcauc

SEQ ID NO: 1288033 - RNA, 24 nt, Mycobacterium tuberculosis H37Rv
guccaucgcgcggcugugcccgau

SEQ ID NO: 1288034 - RNA, 20 nt, Mycobacterium tuberculosis H37Rv
guccaggugcgccguggcau

SEQ ID NO: 1288035 - RNA, 22 nt, Mycobacterium tuberculosis H37Rv
gucccaaucgucggccagcaga

SEQ ID NO: 1288036 - RNA, 15 nt, Mycobacterium tuberculosis H37Rv
gucccaaucgggauc

SEQ ID NO: 1288037 - RNA, 13 nt, Mycobacterium tuberculosis H37Rv
gucccaaucggga

SEQ ID NO: 1288038 - RNA, 19 nt, Mycobacterium tuberculosis H37Rv
guccgacgcaccaacgcga

SEQ ID NO: 1288039 - RNA, 17 nt, Mycobacterium tuberculosis H37Rv
gucccgggcaccgucgg

SEQ ID NO: 1288040 - RNA, 22 nt, Mycobacterium tuberculosis H37Rv
guccgacaccacggaccagcgc

SEQ ID NO: 1288041 - RNA, 19 nt, Mycobacterium tuberculosis H37Rv
guccgaccagcggccgacc

SEQ ID NO: 1288042 - RNA, 15 nt, Mycobacterium tuberculosis H37Rv
guccgaccagggauc

SEQ ID NO: 1288043 - RNA, 15 nt, Mycobacterium tuberculosis H37Rv
gucccgguguccagc

SEQ ID NO: 1288044 - RNA, 17 nt, Mycobacterium tuberculosis H37Rv
gucccggcgaccggguc

SEQ ID NO: 1288045 - RNA, 16 nt, Mycobacterium tuberculosis H37Rv
gucccaguacgaucgu

SEQ ID NO: 1288046 - RNA, 18 nt, Mycobacterium tuberculosis H37Rv
gucccagcgccgcacaga

SEQ ID NO: 1288047 - RNA, 17 nt, Mycobacterium tuberculosis H37Rv
gucccacgccagcgcga

SEQ ID NO: 1288048 - RNA, 22 nt, Mycobacterium tuberculosis H37Rv
guccacggcguuacguggugga

SEQ ID NO: 1288049 - RNA, 22 nt, Mycobacterium tuberculosis H37Rv
guccagaauccagguggucauc

SEQ ID NO: 1288050 - RNA, 20 nt, Mycobacterium tuberculosis H37Rv
guccagaacgguggcgcggu

SEQ ID NO: 1288051 - RNA, 15 nt, Mycobacterium tuberculosis H37Rv
guccagaacgguggc

SEQ ID NO: 1288052 - RNA, 15 nt, Mycobacterium tuberculosis H37Rv
guccagaacggcgau

SEQ ID NO: 1288053 - RNA, 16 nt, Mycobacterium tuberculosis H37Rv
guccagacccagcucg

SEQ ID NO: 1288054 - RNA, 17 nt, Mycobacterium tuberculosis H37Rv
guccagcgaucccggug

SEQ ID NO: 1288055 - RNA, 17 nt, Mycobacterium tuberculosis H37Rv
guccagccaacgggaac

SEQ ID NO: 1288056 - RNA, 22 nt, Mycobacterium tuberculosis H37Rv
guccagcagcgaaaaccgucgc

SEQ ID NO: 1288057 - RNA, 14 nt, Mycobacterium tuberculosis H37Rv
guccagcagcgacg

SEQ ID NO: 1288058 - RNA, 19 nt, Mycobacterium tuberculosis H37Rv
guccaccgaugccacaucg

SEQ ID NO: 1288059 - RNA, 14 nt, Mycobacterium tuberculosis H37Rv
guccaccgcacgga

SEQ ID NO: 1288060 - RNA, 14 nt, Mycobacterium tuberculosis H37Rv
guccaccaccggca

SEQ ID NO: 1288061 - RNA, 14 nt, Mycobacterium tuberculosis H37Rv
guccaccgaugcca

SEQ ID NO: 1288062 - RNA, 14 nt, Mycobacterium tuberculosis H37Rv
guccaccggaccga

SEQ ID NO: 1288063 - RNA, 16 nt, Mycobacterium tuberculosis H37Rv
guccaccgcugccggc

SEQ ID NO: 1288064 - RNA, 23 nt, Mycobacterium tuberculosis H37Rv
guccacccacgaucagcagcguc

SEQ ID NO: 1288065 - RNA, 18 nt, Mycobacterium tuberculosis H37Rv
guccaagaaccacgacgu

SEQ ID NO: 1288066 - RNA, 20 nt, Mycobacterium tuberculosis H37Rv
guccaacucggcccggguga

SEQ ID NO: 1288067 - RNA, 15 nt, Mycobacterium tuberculosis H37Rv
guccaaccccagcga

SEQ ID NO: 1288068 - RNA, 18 nt, Mycobacterium tuberculosis H37Rv
guccaauuggcgucgucg

SEQ ID NO: 1288069 - RNA, 22 nt, Mycobacterium tuberculosis H37Rv
guccacauccagggugccgguc

SEQ ID NO: 1288070 - RNA, 15 nt, Mycobacterium tuberculosis H37Rv
guccaccaccggcac

SEQ ID NO: 1288071 - RNA, 19 nt, Mycobacterium tuberculosis H37Rv
guccacaugguacggacgc

SEQ ID NO: 1288072 - RNA, 13 nt, Mycobacterium tuberculosis H37Rv
guagggugggucg

SEQ ID NO: 1288073 - RNA, 13 nt, Mycobacterium tuberculosis H37Rv
guaggucagcgcg

SEQ ID NO: 1288074 - RNA, 22 nt, Mycobacterium tuberculosis H37Rv
guaggugauggcuuggaccagc

SEQ ID NO: 1288075 - RNA, 19 nt, Mycobacterium tuberculosis H37Rv
guaucgauugaugcguggu

SEQ ID NO: 1288076 - RNA, 22 nt, Mycobacterium tuberculosis H37Rv
guaucgccaguggugcaccgau

SEQ ID NO: 1288077 - RNA, 15 nt, Mycobacterium tuberculosis H37Rv
guaucggcagauggu

SEQ ID NO: 1288078 - RNA, 19 nt, Mycobacterium tuberculosis H37Rv
gucaagaucggugccagca

SEQ ID NO: 1288079 - RNA, 22 nt, Mycobacterium tuberculosis H37Rv
gucaagcaaguccaccggaucg

SEQ ID NO: 1288080 - RNA, 22 nt, Mycobacterium tuberculosis H37Rv
gucaacuccacgcggaccucga

SEQ ID NO: 1288081 - RNA, 17 nt, Mycobacterium tuberculosis H37Rv
gucaaguucgccagcaa

SEQ ID NO: 1288082 - RNA, 21 nt, Mycobacterium tuberculosis H37Rv
gucaagcagcagcagcuucgg

SEQ ID NO: 1288083 - RNA, 19 nt, Mycobacterium tuberculosis H37Rv
gucaagccacacccggcgu

SEQ ID NO: 1288084 - RNA, 20 nt, Mycobacterium tuberculosis H37Rv
guauuuugccggauucuccg

SEQ ID NO: 1288085 - RNA, 18 nt, Mycobacterium tuberculosis H37Rv
gucaacgccacgccgaug

SEQ ID NO: 1288086 - RNA, 21 nt, Mycobacterium tuberculosis H37Rv
gucaacggucucaacgcaucg

SEQ ID NO: 1288087 - RNA, 22 nt, Mycobacterium tuberculosis H37Rv
gucaacggucucaacgcaucgg

SEQ ID NO: 1288088 - RNA, 20 nt, Mycobacterium tuberculosis H37Rv
gucaacgggaugccggcgaa

SEQ ID NO: 1288089 - RNA, 16 nt, Mycobacterium tuberculosis H37Rv
gucaacucaccgucgg

SEQ ID NO: 1288090 - RNA, 15 nt, Mycobacterium tuberculosis H37Rv
gucaacucaccgucg

SEQ ID NO: 1288091 - RNA, 14 nt, Mycobacterium tuberculosis H37Rv
guauuuuucgacca

SEQ ID NO: 1288092 - RNA, 15 nt, Mycobacterium tuberculosis H37Rv
guauucggccgcgag

SEQ ID NO: 1288093 - RNA, 19 nt, Mycobacterium tuberculosis H37Rv
guauucgguggagcgcggg

SEQ ID NO: 1288094 - RNA, 13 nt, Mycobacterium tuberculosis H37Rv
guauucguggucg

SEQ ID NO: 1288095 - RNA, 22 nt, Mycobacterium tuberculosis H37Rv
guauucguggucggccucgaga

SEQ ID NO: 1288096 - RNA, 23 nt, Mycobacterium tuberculosis H37Rv
gucagccgcgcgggucacgaccu

SEQ ID NO: 1288097 - RNA, 15 nt, Mycobacterium tuberculosis H37Rv
gucagccugccaggu

SEQ ID NO: 1288098 - RNA, 16 nt, Mycobacterium tuberculosis H37Rv
gucagcgacgcacgca

SEQ ID NO: 1288099 - RNA, 17 nt, Mycobacterium tuberculosis H37Rv
gucagccaccggugagc

SEQ ID NO: 1288100 - RNA, 18 nt, Mycobacterium tuberculosis H37Rv
gucagcaugggguagauc

SEQ ID NO: 1288101 - RNA, 21 nt, Mycobacterium tuberculosis H37Rv
gucacucgcaagaaccggcau

SEQ ID NO: 1288102 - RNA, 19 nt, Mycobacterium tuberculosis H37Rv
gucaccugcaucgucgcca

SEQ ID NO: 1288103 - RNA, 19 nt, Mycobacterium tuberculosis H37Rv
gucagaaaaagccgcguag

SEQ ID NO: 1288104 - RNA, 15 nt, Mycobacterium tuberculosis H37Rv
gucagcacgcugacc

SEQ ID NO: 1288105 - RNA, 19 nt, Mycobacterium tuberculosis H37Rv
gucagcagaugggcgucgg

SEQ ID NO: 1288106 - RNA, 22 nt, Mycobacterium tuberculosis H37Rv
gucagcagaugggcgucgguca

SEQ ID NO: 1288107 - RNA, 17 nt, Mycobacterium tuberculosis H37Rv
gucaccugggccagcag

SEQ ID NO: 1288108 - RNA, 16 nt, Mycobacterium tuberculosis H37Rv
gucaccuucaccgggu

SEQ ID NO: 1288109 - RNA, 15 nt, Mycobacterium tuberculosis H37Rv
gucacgacguccgau

SEQ ID NO: 1288110 - RNA, 16 nt, Mycobacterium tuberculosis H37Rv
gucacgaucacgaugu

SEQ ID NO: 1288111 - RNA, 14 nt, Mycobacterium tuberculosis H37Rv
gucacgacguccga

SEQ ID NO: 1288112 - RNA, 15 nt, Mycobacterium tuberculosis H37Rv
gucaccguacggcca

SEQ ID NO: 1288113 - RNA, 18 nt, Mycobacterium tuberculosis H37Rv
gucaccguccacgacagc

SEQ ID NO: 1288114 - RNA, 13 nt, Mycobacterium tuberculosis H37Rv
gucaccaggccga

SEQ ID NO: 1288115 - RNA, 13 nt, Mycobacterium tuberculosis H37Rv
gucaccagcugga

SEQ ID NO: 1288116 - RNA, 19 nt, Mycobacterium tuberculosis H37Rv
gucaccagcgcaucggcca

SEQ ID NO: 1288117 - RNA, 23 nt, Mycobacterium tuberculosis H37Rv
gucacccaauucacgacgccgag

SEQ ID NO: 1288118 - RNA, 22 nt, Mycobacterium tuberculosis H37Rv
gucaccauggcgccgcgccgau

SEQ ID NO: 1288119 - RNA, 21 nt, Mycobacterium tuberculosis H37Rv
gucaccauggcgccgcgccga

SEQ ID NO: 1288120 - RNA, 17 nt, Mycobacterium tuberculosis H37Rv
gucaccaggcugcaguc

SEQ ID NO: 1288121 - RNA, 17 nt, Mycobacterium tuberculosis H37Rv
gucaaucaccaccgcca

SEQ ID NO: 1288122 - RNA, 14 nt, Mycobacterium tuberculosis H37Rv
guaggccgccggac

SEQ ID NO: 1288123 - RNA, 14 nt, Mycobacterium tuberculosis H37Rv
guaggcgaccgcca

SEQ ID NO: 1288124 - RNA, 12 nt, Mycobacterium tuberculosis H37Rv
guaggcgaccgc

SEQ ID NO: 1288125 - RNA, 20 nt, Mycobacterium tuberculosis H37Rv
guaggcuuccagcucgucgu

SEQ ID NO: 1288126 - RNA, 22 nt, Mycobacterium tuberculosis H37Rv
guaggcguuggacgcgaacagc

SEQ ID NO: 1288127 - RNA, 17 nt, Mycobacterium tuberculosis H37Rv
guaggcgguguccagaa

SEQ ID NO: 1288128 - RNA, 18 nt, Mycobacterium tuberculosis H37Rv
guagggaugcggccggau

SEQ ID NO: 1288129 - RNA, 16 nt, Mycobacterium tuberculosis H37Rv
guaggcggcgacccgc

SEQ ID NO: 1288130 - RNA, 14 nt, Mycobacterium tuberculosis H37Rv
guaggcggucagau

SEQ ID NO: 1288131 - RNA, 17 nt, Mycobacterium tuberculosis H37Rv
guaggcggaucuuggug

SEQ ID NO: 1288132 - RNA, 13 nt, Mycobacterium tuberculosis H37Rv
guaggcggccagc

SEQ ID NO: 1288133 - RNA, 14 nt, Mycobacterium tuberculosis H37Rv
guaggcgccgcgac

SEQ ID NO: 1288134 - RNA, 19 nt, Mycobacterium tuberculosis H37Rv
guaggcgccguuguuguag

SEQ ID NO: 1288135 - RNA, 15 nt, Mycobacterium tuberculosis H37Rv
guagaucaucagcga

SEQ ID NO: 1288136 - RNA, 17 nt, Mycobacterium tuberculosis H37Rv
guagaucgccucgacgc

SEQ ID NO: 1288137 - RNA, 17 nt, Mycobacterium tuberculosis H37Rv
guagccgccgucgccgg

SEQ ID NO: 1288138 - RNA, 13 nt, Mycobacterium tuberculosis H37Rv
guagccgaccggc

SEQ ID NO: 1288139 - RNA, 13 nt, Mycobacterium tuberculosis H37Rv
guagccgaccagc

SEQ ID NO: 1288140 - RNA, 12 nt, Mycobacterium tuberculosis H37Rv
guagcgugcgac

SEQ ID NO: 1288141 - RNA, 21 nt, Mycobacterium tuberculosis H37Rv
guagcggucguagacagucug

SEQ ID NO: 1288142 - RNA, 13 nt, Mycobacterium tuberculosis H37Rv
guagcgucgcacc

SEQ ID NO: 1288143 - RNA, 14 nt, Mycobacterium tuberculosis H37Rv
guagcugaccaucg

SEQ ID NO: 1288144 - RNA, 13 nt, Mycobacterium tuberculosis H37Rv
guaggcaccccgg

SEQ ID NO: 1288145 - RNA, 23 nt, Mycobacterium tuberculosis H37Rv
guacugcugcuugagcucgcuga

SEQ ID NO: 1288146 - RNA, 12 nt, Mycobacterium tuberculosis H37Rv
guacugcggaug

SEQ ID NO: 1288147 - RNA, 14 nt, Mycobacterium tuberculosis H37Rv
guagaccaggccca

SEQ ID NO: 1288148 - RNA, 19 nt, Mycobacterium tuberculosis H37Rv
guagaccccaaucgaccgc

SEQ ID NO: 1288149 - RNA, 19 nt, Mycobacterium tuberculosis H37Rv
guagacccacagucgccgg

SEQ ID NO: 1288150 - RNA, 23 nt, Mycobacterium tuberculosis H37Rv
guagacggggugagccgacccgc

SEQ ID NO: 1288151 - RNA, 15 nt, Mycobacterium tuberculosis H37Rv
guagacuugcugcuc

SEQ ID NO: 1288152 - RNA, 12 nt, Mycobacterium tuberculosis H37Rv
guagacgguccg

SEQ ID NO: 1288153 - RNA, 23 nt, Mycobacterium tuberculosis H37Rv
guagagauacgggaacguccagc

SEQ ID NO: 1288154 - RNA, 14 nt, Mycobacterium tuberculosis H37Rv
guacgcggcugacg

SEQ ID NO: 1288155 - RNA, 20 nt, Mycobacterium tuberculosis H37Rv
guacggacgcugcauuggcg

SEQ ID NO: 1288156 - RNA, 18 nt, Mycobacterium tuberculosis H37Rv
guacgggagccggcuguu

SEQ ID NO: 1288157 - RNA, 18 nt, Mycobacterium tuberculosis H37Rv
guacggcguacgccggac

SEQ ID NO: 1288158 - RNA, 14 nt, Mycobacterium tuberculosis H37Rv
guacgggucgccgg

SEQ ID NO: 1288159 - RNA, 15 nt, Mycobacterium tuberculosis H37Rv
guacggggucgccgg

SEQ ID NO: 1288160 - RNA, 16 nt, Mycobacterium tuberculosis H37Rv
guaagcgagucgacga

SEQ ID NO: 1288161 - RNA, 14 nt, Mycobacterium tuberculosis H37Rv
guaagcgaccgacg

SEQ ID NO: 1288162 - RNA, 21 nt, Mycobacterium tuberculosis H37Rv
guaaucaccgaauaccgccgc

SEQ ID NO: 1288163 - RNA, 13 nt, Mycobacterium tuberculosis H37Rv
gguccggggcaac

SEQ ID NO: 1288164 - RNA, 13 nt, Mycobacterium tuberculosis H37Rv
ggucgaccaucgg

SEQ ID NO: 1288165 - RNA, 14 nt, Mycobacterium tuberculosis H37Rv
ggucgaccaucggu

SEQ ID NO: 1288166 - RNA, 17 nt, Mycobacterium tuberculosis H37Rv
gguccgucggguagugc

SEQ ID NO: 1288167 - RNA, 20 nt, Mycobacterium tuberculosis H37Rv
ggucgacgggucggcgccga

SEQ ID NO: 1288168 - RNA, 15 nt, Mycobacterium tuberculosis H37Rv
ggucgacgggcucgu

SEQ ID NO: 1288169 - RNA, 18 nt, Mycobacterium tuberculosis H37Rv
ggucgacgaacaccccgg

SEQ ID NO: 1288170 - RNA, 23 nt, Mycobacterium tuberculosis H37Rv
ggucgacuccagcaccagcacgg

SEQ ID NO: 1288171 - RNA, 22 nt, Mycobacterium tuberculosis H37Rv
ggucgacggguucuuuaccgau

SEQ ID NO: 1288172 - RNA, 20 nt, Mycobacterium tuberculosis H37Rv
ggucgacuccagcaccagca

SEQ ID NO: 1288173 - RNA, 17 nt, Mycobacterium tuberculosis H37Rv
ggucgacugggacgacg

SEQ ID NO: 1288174 - RNA, 22 nt, Mycobacterium tuberculosis H37Rv
ggucgacgccgaccacccggau

SEQ ID NO: 1288175 - RNA, 13 nt, Mycobacterium tuberculosis H37Rv
ggucgacgccgag

SEQ ID NO: 1288176 - RNA, 11 nt, Mycobacterium tuberculosis H37Rv
ggucgacgauc

SEQ ID NO: 1288177 - RNA, 14 nt, Mycobacterium tuberculosis H37Rv
ggucgacccggcca

SEQ ID NO: 1288178 - RNA, 17 nt, Mycobacterium tuberculosis H37Rv
ggucgccgaccacucga

SEQ ID NO: 1288179 - RNA, 21 nt, Mycobacterium tuberculosis H37Rv
ggucgcccgugucguaccagc

SEQ ID NO: 1288180 - RNA, 17 nt, Mycobacterium tuberculosis H37Rv
ggucgccccgaugaccg

SEQ ID NO: 1288181 - RNA, 17 nt, Mycobacterium tuberculosis H37Rv
ggucgcaauauccggcc

SEQ ID NO: 1288182 - RNA, 20 nt, Mycobacterium tuberculosis H37Rv
ggucgauggcguacagcacc

SEQ ID NO: 1288183 - RNA, 15 nt, Mycobacterium tuberculosis H37Rv
ggucgauguccgcag

SEQ ID NO: 1288184 - RNA, 14 nt, Mycobacterium tuberculosis H37Rv
ggucgaugccgaug

SEQ ID NO: 1288185 - RNA, 20 nt, Mycobacterium tuberculosis H37Rv
ggucgaucaugacgagccga

SEQ ID NO: 1288186 - RNA, 17 nt, Mycobacterium tuberculosis H37Rv
ggucgaucauggcggca

SEQ ID NO: 1288187 - RNA, 17 nt, Mycobacterium tuberculosis H37Rv
ggucccagccuggcaac

SEQ ID NO: 1288188 - RNA, 16 nt, Mycobacterium tuberculosis H37Rv
ggucccgaugaccuug

SEQ ID NO: 1288189 - RNA, 20 nt, Mycobacterium tuberculosis H37Rv
gguccagccuuuuucggcga

SEQ ID NO: 1288190 - RNA, 12 nt, Mycobacterium tuberculosis H37Rv
ggucaucgccac

SEQ ID NO: 1288191 - RNA, 19 nt, Mycobacterium tuberculosis H37Rv
ggucaucgccacgccugcu

SEQ ID NO: 1288192 - RNA, 21 nt, Mycobacterium tuberculosis H37Rv
ggucaucgguugaccggucga

SEQ ID NO: 1288193 - RNA, 22 nt, Mycobacterium tuberculosis H37Rv
ggucaucuuguugucgacaucg

SEQ ID NO: 1288194 - RNA, 14 nt, Mycobacterium tuberculosis H37Rv
ggucaggccgacgu

SEQ ID NO: 1288195 - RNA, 18 nt, Mycobacterium tuberculosis H37Rv
ggucagcucgucggcgau

SEQ ID NO: 1288196 - RNA, 16 nt, Mycobacterium tuberculosis H37Rv
ggucagcucgaccuga

SEQ ID NO: 1288197 - RNA, 17 nt, Mycobacterium tuberculosis H37Rv
ggucagcggggugcugc

SEQ ID NO: 1288198 - RNA, 17 nt, Mycobacterium tuberculosis H37Rv
ggucagcgggucgaccc

SEQ ID NO: 1288199 - RNA, 17 nt, Mycobacterium tuberculosis H37Rv
ggucagcgcugccaccg

SEQ ID NO: 1288200 - RNA, 17 nt, Mycobacterium tuberculosis H37Rv
ggucagcggauccaggc

SEQ ID NO: 1288201 - RNA, 21 nt, Mycobacterium tuberculosis H37Rv
ggucagcgcguauggcucacc

SEQ ID NO: 1288202 - RNA, 16 nt, Mycobacterium tuberculosis H37Rv
ggucagcgcugccacc

SEQ ID NO: 1288203 - RNA, 18 nt, Mycobacterium tuberculosis H37Rv
gggugaccaggccgagcu

SEQ ID NO: 1288204 - RNA, 12 nt, Mycobacterium tuberculosis H37Rv
gggugacccgcu

SEQ ID NO: 1288205 - RNA, 20 nt, Mycobacterium tuberculosis H37Rv
gggugaacgcggacaccgcg

SEQ ID NO: 1288206 - RNA, 13 nt, Mycobacterium tuberculosis H37Rv
gggugaaccaauu

SEQ ID NO: 1288207 - RNA, 21 nt, Mycobacterium tuberculosis H37Rv
ggugccagccggauguugguc

SEQ ID NO: 1288208 - RNA, 22 nt, Mycobacterium tuberculosis H37Rv
ggugccagcaccacgucgacga

SEQ ID NO: 1288209 - RNA, 17 nt, Mycobacterium tuberculosis H37Rv
ggugccacgaucggcgg

SEQ ID NO: 1288210 - RNA, 16 nt, Mycobacterium tuberculosis H37Rv
ggugccagcaccacgu

SEQ ID NO: 1288211 - RNA, 18 nt, Mycobacterium tuberculosis H37Rv
ggugcaucgccacagucg

SEQ ID NO: 1288212 - RNA, 11 nt, Mycobacterium tuberculosis H37Rv
ggugcagguga

SEQ ID NO: 1288213 - RNA, 18 nt, Mycobacterium tuberculosis H37Rv
ggugcagggugagcacgu

SEQ ID NO: 1288214 - RNA, 24 nt, Mycobacterium tuberculosis H37Rv
ggugcacaccgucgcgcucgcacc

SEQ ID NO: 1288215 - RNA, 17 nt, Mycobacterium tuberculosis H37Rv
ggugcaccgucgucacc

SEQ ID NO: 1288216 - RNA, 13 nt, Mycobacterium tuberculosis H37Rv
ggugcaccgauuc

SEQ ID NO: 1288217 - RNA, 20 nt, Mycobacterium tuberculosis H37Rv
ggugagggaacccacagugg

SEQ ID NO: 1288218 - RNA, 15 nt, Mycobacterium tuberculosis H37Rv
ggugcaacgcgccuu

SEQ ID NO: 1288219 - RNA, 14 nt, Mycobacterium tuberculosis H37Rv
ggucuuugcccgcc

SEQ ID NO: 1288220 - RNA, 18 nt, Mycobacterium tuberculosis H37Rv
ggugaaaaucgccaucgg

SEQ ID NO: 1288221 - RNA, 15 nt, Mycobacterium tuberculosis H37Rv
ggugaaaaucgccau

SEQ ID NO: 1288222 - RNA, 16 nt, Mycobacterium tuberculosis H37Rv
ggucuuuguccacgag

SEQ ID NO: 1288223 - RNA, 15 nt, Mycobacterium tuberculosis H37Rv
ggugaaaugacggcu

SEQ ID NO: 1288224 - RNA, 13 nt, Mycobacterium tuberculosis H37Rv
ggugacacgacgu

SEQ ID NO: 1288225 - RNA, 17 nt, Mycobacterium tuberculosis H37Rv
ggugaccagcaggccgg

SEQ ID NO: 1288226 - RNA, 16 nt, Mycobacterium tuberculosis H37Rv
ggugaccacggcaagc

SEQ ID NO: 1288227 - RNA, 22 nt, Mycobacterium tuberculosis H37Rv
ggugacaaggauggucgccugc

SEQ ID NO: 1288228 - RNA, 14 nt, Mycobacterium tuberculosis H37Rv
ggugaacaccagca

SEQ ID NO: 1288229 - RNA, 18 nt, Mycobacterium tuberculosis H37Rv
ggugaccgagaucgucgc

SEQ ID NO: 1288230 - RNA, 16 nt, Mycobacterium tuberculosis H37Rv
ggugacccccgagauc

SEQ ID NO: 1288231 - RNA, 18 nt, Mycobacterium tuberculosis H37Rv
ggugaccagggugacgga

SEQ ID NO: 1288232 - RNA, 15 nt, Mycobacterium tuberculosis H37Rv
ggugagcgacgcuga

SEQ ID NO: 1288233 - RNA, 22 nt, Mycobacterium tuberculosis H37Rv
ggugagcugcacgccgauaccg

SEQ ID NO: 1288234 - RNA, 22 nt, Mycobacterium tuberculosis H37Rv
ggugagcagcucggugacaagc

SEQ ID NO: 1288235 - RNA, 17 nt, Mycobacterium tuberculosis H37Rv
ggugagcagggcggcga

SEQ ID NO: 1288236 - RNA, 21 nt, Mycobacterium tuberculosis H37Rv
ggugagccgccaggaccggga

SEQ ID NO: 1288237 - RNA, 17 nt, Mycobacterium tuberculosis H37Rv
ggucggcuucgacaacc

SEQ ID NO: 1288238 - RNA, 13 nt, Mycobacterium tuberculosis H37Rv
ggucggugcgguc

SEQ ID NO: 1288239 - RNA, 19 nt, Mycobacterium tuberculosis H37Rv
ggucgggcggcgaccucgg

SEQ ID NO: 1288240 - RNA, 19 nt, Mycobacterium tuberculosis H37Rv
ggucggcgguucgaucccg

SEQ ID NO: 1288241 - RNA, 23 nt, Mycobacterium tuberculosis H37Rv
ggucggugccagcaccacgucga

SEQ ID NO: 1288242 - RNA, 17 nt, Mycobacterium tuberculosis H37Rv
ggucgggcaaccugccg

SEQ ID NO: 1288243 - RNA, 21 nt, Mycobacterium tuberculosis H37Rv
ggucggcuucgacaaccucga

SEQ ID NO: 1288244 - RNA, 16 nt, Mycobacterium tuberculosis H37Rv
ggucggccaccgugga

SEQ ID NO: 1288245 - RNA, 13 nt, Mycobacterium tuberculosis H37Rv
ggucggccaggcc

SEQ ID NO: 1288246 - RNA, 21 nt, Mycobacterium tuberculosis H37Rv
ggucggcaccagguugccgag

SEQ ID NO: 1288247 - RNA, 23 nt, Mycobacterium tuberculosis H37Rv
ggucggcagcuucucgccgacga

SEQ ID NO: 1288248 - RNA, 21 nt, Mycobacterium tuberculosis H37Rv
ggucggcagcuucucgccgac

SEQ ID NO: 1288249 - RNA, 17 nt, Mycobacterium tuberculosis H37Rv
ggucgcgcggcaccgau

SEQ ID NO: 1288250 - RNA, 14 nt, Mycobacterium tuberculosis H37Rv
ggucgcgcugaagg

SEQ ID NO: 1288251 - RNA, 20 nt, Mycobacterium tuberculosis H37Rv
ggucgcggagaacgcgucgc

SEQ ID NO: 1288252 - RNA, 15 nt, Mycobacterium tuberculosis H37Rv
ggucucccggcugau

SEQ ID NO: 1288253 - RNA, 23 nt, Mycobacterium tuberculosis H37Rv
ggucuccgaacggguagacccac

SEQ ID NO: 1288254 - RNA, 15 nt, Mycobacterium tuberculosis H37Rv
ggucuccggcgcacc

SEQ ID NO: 1288255 - RNA, 18 nt, Mycobacterium tuberculosis H37Rv
ggucuccggaucgccgaa

SEQ ID NO: 1288256 - RNA, 20 nt, Mycobacterium tuberculosis H37Rv
ggucuccggcaccgagucua

SEQ ID NO: 1288257 - RNA, 18 nt, Mycobacterium tuberculosis H37Rv
ggucguaggacaccaccg

SEQ ID NO: 1288258 - RNA, 20 nt, Mycobacterium tuberculosis H37Rv
ggucguaggacaccaccgug

SEQ ID NO: 1288259 - RNA, 16 nt, Mycobacterium tuberculosis H37Rv
ggucgucauccugguc

SEQ ID NO: 1288260 - RNA, 20 nt, Mycobacterium tuberculosis H37Rv
ggucguagacgguuaccgcg

SEQ ID NO: 1288261 - RNA, 19 nt, Mycobacterium tuberculosis H37Rv
ggucugcagugcagcgauc

SEQ ID NO: 1288262 - RNA, 13 nt, Mycobacterium tuberculosis H37Rv
ggucucgagucgg

SEQ ID NO: 1288263 - RNA, 13 nt, Mycobacterium tuberculosis H37Rv
ggugccgccguug

SEQ ID NO: 1288264 - RNA, 17 nt, Mycobacterium tuberculosis H37Rv
ggugccgcgcagcugcc

SEQ ID NO: 1288265 - RNA, 23 nt, Mycobacterium tuberculosis H37Rv
ggugccgagcgcaaggucgacgg

SEQ ID NO: 1288266 - RNA, 16 nt, Mycobacterium tuberculosis H37Rv
ggugcccaugaugguc

SEQ ID NO: 1288267 - RNA, 17 nt, Mycobacterium tuberculosis H37Rv
ggugcccgcgaacgauc

SEQ ID NO: 1288268 - RNA, 17 nt, Mycobacterium tuberculosis H37Rv
ggugcccugccggcagc

SEQ ID NO: 1288269 - RNA, 12 nt, Mycobacterium tuberculosis H37Rv
ggugccgacguc

SEQ ID NO: 1288270 - RNA, 23 nt, Mycobacterium tuberculosis H37Rv
ggugccguuggagccgccaccga

SEQ ID NO: 1288271 - RNA, 19 nt, Mycobacterium tuberculosis H37Rv
ggugccguugcgucugcuc

SEQ ID NO: 1288272 - RNA, 14 nt, Mycobacterium tuberculosis H37Rv
ggugccggucacgu

SEQ ID NO: 1288273 - RNA, 19 nt, Mycobacterium tuberculosis H37Rv
ggugccggucacgucgauc

SEQ ID NO: 1288274 - RNA, 18 nt, Mycobacterium tuberculosis H37Rv
ggugccggggcugccgcc

SEQ ID NO: 1288275 - RNA, 18 nt, Mycobacterium tuberculosis H37Rv
ggugccggugcuccucgg

SEQ ID NO: 1288276 - RNA, 14 nt, Mycobacterium tuberculosis H37Rv
ggugccggucgagu

SEQ ID NO: 1288277 - RNA, 23 nt, Mycobacterium tuberculosis H37Rv
ggugccgggaucgccguccagca

SEQ ID NO: 1288278 - RNA, 23 nt, Mycobacterium tuberculosis H37Rv
ggugcgccacgccaccgcgguca

SEQ ID NO: 1288279 - RNA, 15 nt, Mycobacterium tuberculosis H37Rv
ggugcgccgaucccg

SEQ ID NO: 1288280 - RNA, 14 nt, Mycobacterium tuberculosis H37Rv
ggugcgcaccaccg

SEQ ID NO: 1288281 - RNA, 16 nt, Mycobacterium tuberculosis H37Rv
gguggugucgguucgu

SEQ ID NO: 1288282 - RNA, 17 nt, Mycobacterium tuberculosis H37Rv
ggugguuccgcccggug

SEQ ID NO: 1288283 - RNA, 13 nt, Mycobacterium tuberculosis H37Rv
gguggucagcacc

SEQ ID NO: 1288284 - RNA, 19 nt, Mycobacterium tuberculosis H37Rv
gguggucaccaccaucacg

SEQ ID NO: 1288285 - RNA, 18 nt, Mycobacterium tuberculosis H37Rv
ggugguagcugacgcugc

SEQ ID NO: 1288286 - RNA, 13 nt, Mycobacterium tuberculosis H37Rv
ggugggucgacga

SEQ ID NO: 1288287 - RNA, 14 nt, Mycobacterium tuberculosis H37Rv
gguggggucgacgc

SEQ ID NO: 1288288 - RNA, 19 nt, Mycobacterium tuberculosis H37Rv
gguggcgagguggucacgc

SEQ ID NO: 1288289 - RNA, 14 nt, Mycobacterium tuberculosis H37Rv
gguggccagcgcgg

SEQ ID NO: 1288290 - RNA, 18 nt, Mycobacterium tuberculosis H37Rv
gguggcccgaccgggaac

SEQ ID NO: 1288291 - RNA, 17 nt, Mycobacterium tuberculosis H37Rv
gguggccagcgucgcga

SEQ ID NO: 1288292 - RNA, 22 nt, Mycobacterium tuberculosis H37Rv
gguggccagaucgaacgcagcc

SEQ ID NO: 1288293 - RNA, 17 nt, Mycobacterium tuberculosis H37Rv
ggugcggccgcggcgau

SEQ ID NO: 1288294 - RNA, 17 nt, Mycobacterium tuberculosis H37Rv
ggugcgggccacgaucg

SEQ ID NO: 1288295 - RNA, 18 nt, Mycobacterium tuberculosis H37Rv
ggugcgggccgguggaaa

SEQ ID NO: 1288296 - RNA, 16 nt, Mycobacterium tuberculosis H37Rv
ggugcgcuggcccaau

SEQ ID NO: 1288297 - RNA, 20 nt, Mycobacterium tuberculosis H37Rv
ggugcuuucgcgucugcucg

SEQ ID NO: 1288298 - RNA, 22 nt, Mycobacterium tuberculosis H37Rv
gguggaacuccggguggcggcg

SEQ ID NO: 1288299 - RNA, 21 nt, Mycobacterium tuberculosis H37Rv
gguggaagugugauuccgggu

SEQ ID NO: 1288300 - RNA, 18 nt, Mycobacterium tuberculosis H37Rv
ggugcuuccucgcgagcu

SEQ ID NO: 1288301 - RNA, 19 nt, Mycobacterium tuberculosis H37Rv
ggugcugucgacgucggca

SEQ ID NO: 1288302 - RNA, 18 nt, Mycobacterium tuberculosis H37Rv
gguggacgaggcggucga

SEQ ID NO: 1288303 - RNA, 20 nt, Mycobacterium tuberculosis H37Rv
gguggcaucggcggccugcu

SEQ ID NO: 1288304 - RNA, 21 nt, Mycobacterium tuberculosis H37Rv
gguggcaucggcggccugcuc

SEQ ID NO: 1288305 - RNA, 22 nt, Mycobacterium tuberculosis H37Rv
gguggcaucggcggccugcucg

SEQ ID NO: 1288306 - RNA, 17 nt, Mycobacterium tuberculosis H37Rv
gguggaauccaccagcc

SEQ ID NO: 1288307 - RNA, 14 nt, Mycobacterium tuberculosis H37Rv
gguggaauccacca

SEQ ID NO: 1288308 - RNA, 13 nt, Mycobacterium tuberculosis H37Rv
gguugccgcgauc

SEQ ID NO: 1288309 - RNA, 15 nt, Mycobacterium tuberculosis H37Rv
gguugccgucagggu

SEQ ID NO: 1288310 - RNA, 13 nt, Mycobacterium tuberculosis H37Rv
guaaccagcgcca

SEQ ID NO: 1288311 - RNA, 17 nt, Mycobacterium tuberculosis H37Rv
guaaccagcgccacgau

SEQ ID NO: 1288312 - RNA, 14 nt, Mycobacterium tuberculosis H37Rv
guaaccccgcacga

SEQ ID NO: 1288313 - RNA, 20 nt, Mycobacterium tuberculosis H37Rv
gguucgcacaccuccucgac

SEQ ID NO: 1288314 - RNA, 18 nt, Mycobacterium tuberculosis H37Rv
gguucacggggaccagau

SEQ ID NO: 1288315 - RNA, 15 nt, Mycobacterium tuberculosis H37Rv
gguucagcucgagga

SEQ ID NO: 1288316 - RNA, 22 nt, Mycobacterium tuberculosis H37Rv
gguucagccacgcagcacggca

SEQ ID NO: 1288317 - RNA, 23 nt, Mycobacterium tuberculosis H37Rv
gguucaucaagguguugcggugg

SEQ ID NO: 1288318 - RNA, 19 nt, Mycobacterium tuberculosis H37Rv
gguguuggacacucccggg

SEQ ID NO: 1288319 - RNA, 16 nt, Mycobacterium tuberculosis H37Rv
gguguuggcgccagcc

SEQ ID NO: 1288320 - RNA, 18 nt, Mycobacterium tuberculosis H37Rv
gguucaccucggcgacga

SEQ ID NO: 1288321 - RNA, 21 nt, Mycobacterium tuberculosis H37Rv
gguucaacgcgcgcacgccac

SEQ ID NO: 1288322 - RNA, 20 nt, Mycobacterium tuberculosis H37Rv
gguguacagucgcgcgcucg

SEQ ID NO: 1288323 - RNA, 14 nt, Mycobacterium tuberculosis H37Rv
gguguagcagcgcc

SEQ ID NO: 1288324 - RNA, 20 nt, Mycobacterium tuberculosis H37Rv
gguguggcgcugaucggcag

SEQ ID NO: 1288325 - RNA, 11 nt, Mycobacterium tuberculosis H37Rv
ggugugugccu

SEQ ID NO: 1288326 - RNA, 20 nt, Mycobacterium tuberculosis H37Rv
gguguugaugggcagccgcc

SEQ ID NO: 1288327 - RNA, 23 nt, Mycobacterium tuberculosis H37Rv
gguguguuccaacuccugcagcc

SEQ ID NO: 1288328 - RNA, 19 nt, Mycobacterium tuberculosis H37Rv
gguucgggcagcacccgcg

SEQ ID NO: 1288329 - RNA, 18 nt, Mycobacterium tuberculosis H37Rv
gguucugggccugcggca

SEQ ID NO: 1288330 - RNA, 14 nt, Mycobacterium tuberculosis H37Rv
gguucuucgaauag

SEQ ID NO: 1288331 - RNA, 19 nt, Mycobacterium tuberculosis H37Rv
gguucuuccuggucgacgc

SEQ ID NO: 1288332 - RNA, 14 nt, Mycobacterium tuberculosis H37Rv
gguugaugcccuug

SEQ ID NO: 1288333 - RNA, 21 nt, Mycobacterium tuberculosis H37Rv
gguugaguugcagaccgggug

SEQ ID NO: 1288334 - RNA, 12 nt, Mycobacterium tuberculosis H37Rv
gguugaucagcc

SEQ ID NO: 1288335 - RNA, 19 nt, Mycobacterium tuberculosis H37Rv
gguugacccggcagcccgg

SEQ ID NO: 1288336 - RNA, 15 nt, Mycobacterium tuberculosis H37Rv
gguugaccaccagcg

SEQ ID NO: 1288337 - RNA, 23 nt, Mycobacterium tuberculosis H37Rv
gguugaaaacgcccggcacacgg

SEQ ID NO: 1288338 - RNA, 22 nt, Mycobacterium tuberculosis H37Rv
cgacaccgaggaccucgucacc

SEQ ID NO: 1288339 - RNA, 14 nt, Mycobacterium tuberculosis H37Rv
cgacaccgccacca

SEQ ID NO: 1288340 - RNA, 18 nt, Mycobacterium tuberculosis H37Rv
cgacaccgcggacccgca

SEQ ID NO: 1288341 - RNA, 15 nt, Mycobacterium tuberculosis H37Rv
cgacaccgugucgcc

SEQ ID NO: 1288342 - RNA, 19 nt, Mycobacterium tuberculosis H37Rv
cgacaccggcggcaucgag

SEQ ID NO: 1288343 - RNA, 14 nt, Mycobacterium tuberculosis H37Rv
cgacacccgcucgg

SEQ ID NO: 1288344 - RNA, 14 nt, Mycobacterium tuberculosis H37Rv
cgacacccgcacga

SEQ ID NO: 1288345 - RNA, 17 nt, Mycobacterium tuberculosis H37Rv
cgaaugguaucgagugg

SEQ ID NO: 1288346 - RNA, 20 nt, Mycobacterium tuberculosis H37Rv
cgacaccacggcgcgcagcg

SEQ ID NO: 1288347 - RNA, 19 nt, Mycobacterium tuberculosis H37Rv
cgaaugccauaaccggugg

SEQ ID NO: 1288348 - RNA, 23 nt, Mycobacterium tuberculosis H37Rv
cgaaugcugggcccgccagccca

SEQ ID NO: 1288349 - RNA, 14 nt, Mycobacterium tuberculosis H37Rv
cgacagccguggcg

SEQ ID NO: 1288350 - RNA, 22 nt, Mycobacterium tuberculosis H37Rv
cgacagccgauccgaucgcaga

SEQ ID NO: 1288351 - RNA, 20 nt, Mycobacterium tuberculosis H37Rv
cgacagccgauccgaucgca

SEQ ID NO: 1288352 - RNA, 22 nt, Mycobacterium tuberculosis H37Rv
cgacacggcggcugcggcgucg

SEQ ID NO: 1288353 - RNA, 17 nt, Mycobacterium tuberculosis H37Rv
cgacagccgauccgauc

SEQ ID NO: 1288354 - RNA, 16 nt, Mycobacterium tuberculosis H37Rv
cgacacgccugggcga

SEQ ID NO: 1288355 - RNA, 16 nt, Mycobacterium tuberculosis H37Rv
cgacacgaacgcugcu

SEQ ID NO: 1288356 - RNA, 13 nt, Mycobacterium tuberculosis H37Rv
cgacacgccgaac

SEQ ID NO: 1288357 - RNA, 17 nt, Mycobacterium tuberculosis H37Rv
cgacacgccauccacga

SEQ ID NO: 1288358 - RNA, 20 nt, Mycobacterium tuberculosis H37Rv
cgacaccucgaaggcacugc

SEQ ID NO: 1288359 - RNA, 16 nt, Mycobacterium tuberculosis H37Rv
cgacagcuuggccggu

SEQ ID NO: 1288360 - RNA, 14 nt, Mycobacterium tuberculosis H37Rv
cgacaggccaccgc

SEQ ID NO: 1288361 - RNA, 14 nt, Mycobacterium tuberculosis H37Rv
cgacagcggcaccg

SEQ ID NO: 1288362 - RNA, 18 nt, Mycobacterium tuberculosis H37Rv
cgaaguacgacgacccga

SEQ ID NO: 1288363 - RNA, 20 nt, Mycobacterium tuberculosis H37Rv
cgaagguccgugccgaugcc

SEQ ID NO: 1288364 - RNA, 22 nt, Mycobacterium tuberculosis H37Rv
cgaaguccaccacgacgucggu

SEQ ID NO: 1288365 - RNA, 18 nt, Mycobacterium tuberculosis H37Rv
cgaaguccacgcaccacg

SEQ ID NO: 1288366 - RNA, 17 nt, Mycobacterium tuberculosis H37Rv
cgaagucacgcacccgg

SEQ ID NO: 1288367 - RNA, 20 nt, Mycobacterium tuberculosis H37Rv
cgaagggaucacgaccgcgc

SEQ ID NO: 1288368 - RNA, 23 nt, Mycobacterium tuberculosis H37Rv
cgaagcccagcaccaccacccga

SEQ ID NO: 1288369 - RNA, 17 nt, Mycobacterium tuberculosis H37Rv
cgaagccaccaggucga

SEQ ID NO: 1288370 - RNA, 14 nt, Mycobacterium tuberculosis H37Rv
cgaagccaccaggu

SEQ ID NO: 1288371 - RNA, 14 nt, Mycobacterium tuberculosis H37Rv
cgaagccagaucgc

SEQ ID NO: 1288372 - RNA, 23 nt, Mycobacterium tuberculosis H37Rv
cgaagcacaccguccgucggcgc

SEQ ID NO: 1288373 - RNA, 13 nt, Mycobacterium tuberculosis H37Rv
cgaagauggccag

SEQ ID NO: 1288374 - RNA, 18 nt, Mycobacterium tuberculosis H37Rv
cgaagauggccagcgcgg

SEQ ID NO: 1288375 - RNA, 15 nt, Mycobacterium tuberculosis H37Rv
cgaagaugaccucgg

SEQ ID NO: 1288376 - RNA, 19 nt, Mycobacterium tuberculosis H37Rv
cgaagaugccuggaaucgc

SEQ ID NO: 1288377 - RNA, 14 nt, Mycobacterium tuberculosis H37Rv
cgaagauaucggca

SEQ ID NO: 1288378 - RNA, 17 nt, Mycobacterium tuberculosis H37Rv
cgaaguugaugucgcgu

SEQ ID NO: 1288379 - RNA, 22 nt, Mycobacterium tuberculosis H37Rv
cgaagugggucaagaucggugc

SEQ ID NO: 1288380 - RNA, 15 nt, Mycobacterium tuberculosis H37Rv
cgaagucuugaccgc

SEQ ID NO: 1288381 - RNA, 20 nt, Mycobacterium tuberculosis H37Rv
cgaagucgucgaggucacgc

SEQ ID NO: 1288382 - RNA, 13 nt, Mycobacterium tuberculosis H37Rv
cgaagucucggug

SEQ ID NO: 1288383 - RNA, 17 nt, Mycobacterium tuberculosis H37Rv
cgaagucgucgagguca

SEQ ID NO: 1288384 - RNA, 12 nt, Mycobacterium tuberculosis H37Rv
cgaagucgacga

SEQ ID NO: 1288385 - RNA, 20 nt, Mycobacterium tuberculosis H37Rv
cgaaucgccggcggccacca

SEQ ID NO: 1288386 - RNA, 15 nt, Mycobacterium tuberculosis H37Rv
cgaaucgcugccgcc

SEQ ID NO: 1288387 - RNA, 16 nt, Mycobacterium tuberculosis H37Rv
cgaaucgcugaccgcg

SEQ ID NO: 1288388 - RNA, 16 nt, Mycobacterium tuberculosis H37Rv
cgaaucgcuucgagca

SEQ ID NO: 1288389 - RNA, 18 nt, Mycobacterium tuberculosis H37Rv
cgaaugccaccucgacgc

SEQ ID NO: 1288390 - RNA, 19 nt, Mycobacterium tuberculosis H37Rv
cgaccagcgccgcacccgc

SEQ ID NO: 1288391 - RNA, 18 nt, Mycobacterium tuberculosis H37Rv
cgaccagcggccgaccgc

SEQ ID NO: 1288392 - RNA, 19 nt, Mycobacterium tuberculosis H37Rv
cgaccaggccacugccgac

SEQ ID NO: 1288393 - RNA, 19 nt, Mycobacterium tuberculosis H37Rv
cgaccaggccagagccgcc

SEQ ID NO: 1288394 - RNA, 22 nt, Mycobacterium tuberculosis H37Rv
cgaccacugcccgggguccauc

SEQ ID NO: 1288395 - RNA, 15 nt, Mycobacterium tuberculosis H37Rv
cgaccagaacgccag

SEQ ID NO: 1288396 - RNA, 12 nt, Mycobacterium tuberculosis H37Rv
cgaccagaaucg

SEQ ID NO: 1288397 - RNA, 13 nt, Mycobacterium tuberculosis H37Rv
cgaccagaaucgg

SEQ ID NO: 1288398 - RNA, 19 nt, Mycobacterium tuberculosis H37Rv
cgaccagauagaacaacgu

SEQ ID NO: 1288399 - RNA, 21 nt, Mycobacterium tuberculosis H37Rv
cgaccagaggcgugucgacuc

SEQ ID NO: 1288400 - RNA, 14 nt, Mycobacterium tuberculosis H37Rv
cgaccagcacccgc

SEQ ID NO: 1288401 - RNA, 13 nt, Mycobacterium tuberculosis H37Rv
cgaccagccccgc

SEQ ID NO: 1288402 - RNA, 16 nt, Mycobacterium tuberculosis H37Rv
cgacccaagucgccga

SEQ ID NO: 1288403 - RNA, 14 nt, Mycobacterium tuberculosis H37Rv
cgacccaucaccag

SEQ ID NO: 1288404 - RNA, 13 nt, Mycobacterium tuberculosis H37Rv
cgaccauacccgc

SEQ ID NO: 1288405 - RNA, 22 nt, Mycobacterium tuberculosis H37Rv
cgaccaugguagcgccccgaug

SEQ ID NO: 1288406 - RNA, 18 nt, Mycobacterium tuberculosis H37Rv
cgaccauacccgcgcgca

SEQ ID NO: 1288407 - RNA, 22 nt, Mycobacterium tuberculosis H37Rv
cgaccauauuggcgcggccgaa

SEQ ID NO: 1288408 - RNA, 13 nt, Mycobacterium tuberculosis H37Rv
cgaccaucaccac

SEQ ID NO: 1288409 - RNA, 17 nt, Mycobacterium tuberculosis H37Rv
cgaccaucaccacggcc

SEQ ID NO: 1288410 - RNA, 15 nt, Mycobacterium tuberculosis H37Rv
cgacagucaacaggg

SEQ ID NO: 1288411 - RNA, 18 nt, Mycobacterium tuberculosis H37Rv
cgacagucaacagggcca

SEQ ID NO: 1288412 - RNA, 17 nt, Mycobacterium tuberculosis H37Rv
cgacaguggucccggug

SEQ ID NO: 1288413 - RNA, 18 nt, Mycobacterium tuberculosis H37Rv
cgacaguggucccgguga

SEQ ID NO: 1288414 - RNA, 15 nt, Mycobacterium tuberculosis H37Rv
cgacaguggcucacc

SEQ ID NO: 1288415 - RNA, 15 nt, Mycobacterium tuberculosis H37Rv
cgacagugcgcauca

SEQ ID NO: 1288416 - RNA, 11 nt, Mycobacterium tuberculosis H37Rv
cgacauucguc

SEQ ID NO: 1288417 - RNA, 18 nt, Mycobacterium tuberculosis H37Rv
cgacauucguccgggcaa

SEQ ID NO: 1288418 - RNA, 19 nt, Mycobacterium tuberculosis H37Rv
cgacauuggccgucaucgc

SEQ ID NO: 1288419 - RNA, 18 nt, Mycobacterium tuberculosis H37Rv
cgaccaagucaugcccac

SEQ ID NO: 1288420 - RNA, 15 nt, Mycobacterium tuberculosis H37Rv
cgaccaagucaugcc

SEQ ID NO: 1288421 - RNA, 15 nt, Mycobacterium tuberculosis H37Rv
cgaccaacacgucga

SEQ ID NO: 1288422 - RNA, 19 nt, Mycobacterium tuberculosis H37Rv
cgaccaacacgucgagcag

SEQ ID NO: 1288423 - RNA, 23 nt, Mycobacterium tuberculosis H37Rv
cgacaugcccgccaauccgcguc

SEQ ID NO: 1288424 - RNA, 20 nt, Mycobacterium tuberculosis H37Rv
cgacaugguccgaccagcgg

SEQ ID NO: 1288425 - RNA, 16 nt, Mycobacterium tuberculosis H37Rv
cgacaugguugguguc

SEQ ID NO: 1288426 - RNA, 18 nt, Mycobacterium tuberculosis H37Rv
cgaccaccagagcgucga

SEQ ID NO: 1288427 - RNA, 15 nt, Mycobacterium tuberculosis H37Rv
cgaccaauagcacgg

SEQ ID NO: 1288428 - RNA, 21 nt, Mycobacterium tuberculosis H37Rv
cgaccaauaccaguccguuca

SEQ ID NO: 1288429 - RNA, 17 nt, Mycobacterium tuberculosis H37Rv
cgaccaauaggucccca

SEQ ID NO: 1288430 - RNA, 15 nt, Mycobacterium tuberculosis H37Rv
cgaccaauuggucga

SEQ ID NO: 1288431 - RNA, 14 nt, Mycobacterium tuberculosis H37Rv
cgaccacuccacgc

SEQ ID NO: 1288432 - RNA, 13 nt, Mycobacterium tuberculosis H37Rv
cgaccacgguguc

SEQ ID NO: 1288433 - RNA, 19 nt, Mycobacterium tuberculosis H37Rv
cgaccacgccgccggcgcu

SEQ ID NO: 1288434 - RNA, 12 nt, Mycobacterium tuberculosis H37Rv
cgaccacgacgu

SEQ ID NO: 1288435 - RNA, 16 nt, Mycobacterium tuberculosis H37Rv
cgaccaccucgaugcc

SEQ ID NO: 1288436 - RNA, 14 nt, Mycobacterium tuberculosis H37Rv
cgaccacauuccgc

SEQ ID NO: 1288437 - RNA, 22 nt, Mycobacterium tuberculosis H37Rv
cgaccaccgcgaaagcaccgag

SEQ ID NO: 1288438 - RNA, 15 nt, Mycobacterium tuberculosis H37Rv
cgaccaccgcgucgg

SEQ ID NO: 1288439 - RNA, 22 nt, Mycobacterium tuberculosis H37Rv
cgaccaccggguagccggcgug

SEQ ID NO: 1288440 - RNA, 16 nt, Mycobacterium tuberculosis H37Rv
ccugugcugccaacgg

SEQ ID NO: 1288441 - RNA, 15 nt, Mycobacterium tuberculosis H37Rv
ccugugcugccaacg

SEQ ID NO: 1288442 - RNA, 13 nt, Mycobacterium tuberculosis H37Rv
ccugucgcgcacc

SEQ ID NO: 1288443 - RNA, 16 nt, Mycobacterium tuberculosis H37Rv
ccuggauggguugacg

SEQ ID NO: 1288444 - RNA, 19 nt, Mycobacterium tuberculosis H37Rv
ccuggcaacgacacgccgc

SEQ ID NO: 1288445 - RNA, 22 nt, Mycobacterium tuberculosis H37Rv
ccuggccaucgagggcaucggg

SEQ ID NO: 1288446 - RNA, 23 nt, Mycobacterium tuberculosis H37Rv
ccuggccaaccgggucguucggg

SEQ ID NO: 1288447 - RNA, 22 nt, Mycobacterium tuberculosis H37Rv
ccuucgaugaaauccuccuccg

SEQ ID NO: 1288448 - RNA, 23 nt, Mycobacterium tuberculosis H37Rv
ccuuccgcgcuucacagccacca

SEQ ID NO: 1288449 - RNA, 22 nt, Mycobacterium tuberculosis H37Rv
ccuuauugccgagcucggcuag

SEQ ID NO: 1288450 - RNA, 14 nt, Mycobacterium tuberculosis H37Rv
ccuuccagaucgcg

SEQ ID NO: 1288451 - RNA, 16 nt, Mycobacterium tuberculosis H37Rv
ccuguucggcggcugc

SEQ ID NO: 1288452 - RNA, 14 nt, Mycobacterium tuberculosis H37Rv
ccuguuguugucgg

SEQ ID NO: 1288453 - RNA, 19 nt, Mycobacterium tuberculosis H37Rv
ccuuaucgcucucggucag

SEQ ID NO: 1288454 - RNA, 21 nt, Mycobacterium tuberculosis H37Rv
ccuuaugcgcggugaccgggu

SEQ ID NO: 1288455 - RNA, 22 nt, Mycobacterium tuberculosis H37Rv
cgaaacucaccagcaccccgag

SEQ ID NO: 1288456 - RNA, 16 nt, Mycobacterium tuberculosis H37Rv
cgaaaaacaccagcga

SEQ ID NO: 1288457 - RNA, 17 nt, Mycobacterium tuberculosis H37Rv
cgaaaaacaccagcgag

SEQ ID NO: 1288458 - RNA, 14 nt, Mycobacterium tuberculosis H37Rv
ccuuguucgcccac

SEQ ID NO: 1288459 - RNA, 15 nt, Mycobacterium tuberculosis H37Rv
ccuugguuagccgcg

SEQ ID NO: 1288460 - RNA, 15 nt, Mycobacterium tuberculosis H37Rv
ccuuggccagcaggg

SEQ ID NO: 1288461 - RNA, 22 nt, Mycobacterium tuberculosis H37Rv
ccuugcgcgcgcagaucgucca

SEQ ID NO: 1288462 - RNA, 15 nt, Mycobacterium tuberculosis H37Rv
ccuugggaccgcgcc

SEQ ID NO: 1288463 - RNA, 15 nt, Mycobacterium tuberculosis H37Rv
ccuuggcgggaucga

SEQ ID NO: 1288464 - RNA, 23 nt, Mycobacterium tuberculosis H37Rv
ccuuggcgcggcacccggucggc

SEQ ID NO: 1288465 - RNA, 15 nt, Mycobacterium tuberculosis H37Rv
ccuucuuggcaggug

SEQ ID NO: 1288466 - RNA, 14 nt, Mycobacterium tuberculosis H37Rv
ccuucugguucggg

SEQ ID NO: 1288467 - RNA, 18 nt, Mycobacterium tuberculosis H37Rv
ccuugcgcagcaccaggg

SEQ ID NO: 1288468 - RNA, 21 nt, Mycobacterium tuberculosis H37Rv
ccuugccgccggcuccgccag

SEQ ID NO: 1288469 - RNA, 15 nt, Mycobacterium tuberculosis H37Rv
ccuucuuugccggcg

SEQ ID NO: 1288470 - RNA, 14 nt, Mycobacterium tuberculosis H37Rv
cgaaccgcacggug

SEQ ID NO: 1288471 - RNA, 17 nt, Mycobacterium tuberculosis H37Rv
cgaacccuucgcggugu

SEQ ID NO: 1288472 - RNA, 16 nt, Mycobacterium tuberculosis H37Rv
cgaaccgccagaaucc

SEQ ID NO: 1288473 - RNA, 17 nt, Mycobacterium tuberculosis H37Rv
cgaacgaauccgcucga

SEQ ID NO: 1288474 - RNA, 18 nt, Mycobacterium tuberculosis H37Rv
cgaacgacgcuuucccga

SEQ ID NO: 1288475 - RNA, 16 nt, Mycobacterium tuberculosis H37Rv
cgaacgaucccgccga

SEQ ID NO: 1288476 - RNA, 21 nt, Mycobacterium tuberculosis H37Rv
cgaacgacgcuuucccgauga

SEQ ID NO: 1288477 - RNA, 18 nt, Mycobacterium tuberculosis H37Rv
cgaacgcaugcucgaucg

SEQ ID NO: 1288478 - RNA, 17 nt, Mycobacterium tuberculosis H37Rv
cgaacgccugcucgucg

SEQ ID NO: 1288479 - RNA, 17 nt, Mycobacterium tuberculosis H37Rv
cgaacgccgucgacgcg

SEQ ID NO: 1288480 - RNA, 16 nt, Mycobacterium tuberculosis H37Rv
cgaacggccaggacaa

SEQ ID NO: 1288481 - RNA, 13 nt, Mycobacterium tuberculosis H37Rv
cgaacgcgcgcgu

SEQ ID NO: 1288482 - RNA, 23 nt, Mycobacterium tuberculosis H37Rv
cgaacgcggccaccgaccgcacg

SEQ ID NO: 1288483 - RNA, 16 nt, Mycobacterium tuberculosis H37Rv
cgaacgccugcuggua

SEQ ID NO: 1288484 - RNA, 17 nt, Mycobacterium tuberculosis H37Rv
cgaagagccagcaacgg

SEQ ID NO: 1288485 - RNA, 14 nt, Mycobacterium tuberculosis H37Rv
cgaagagccagcaa

SEQ ID NO: 1288486 - RNA, 23 nt, Mycobacterium tuberculosis H37Rv
cgaacuuccauucauggccgcga

SEQ ID NO: 1288487 - RNA, 20 nt, Mycobacterium tuberculosis H37Rv
cgaagaacaacaucgccaua

SEQ ID NO: 1288488 - RNA, 19 nt, Mycobacterium tuberculosis H37Rv
cgaagacuagcugcuagcc

SEQ ID NO: 1288489 - RNA, 19 nt, Mycobacterium tuberculosis H37Rv
cgaacugccggacuaccgc

SEQ ID NO: 1288490 - RNA, 19 nt, Mycobacterium tuberculosis H37Rv
cgaacugcagccauucuuc

SEQ ID NO: 1288491 - RNA, 20 nt, Mycobacterium tuberculosis H37Rv
cgaacugcagccauucuucg

SEQ ID NO: 1288492 - RNA, 17 nt, Mycobacterium tuberculosis H37Rv
cgaacugccucaaaccg

SEQ ID NO: 1288493 - RNA, 20 nt, Mycobacterium tuberculosis H37Rv
cgaacugcuugcgcaucgcc

SEQ ID NO: 1288494 - RNA, 18 nt, Mycobacterium tuberculosis H37Rv
cgaacgggucggcgacca

SEQ ID NO: 1288495 - RNA, 22 nt, Mycobacterium tuberculosis H37Rv
cgaacgggugaaggaugcggcc

SEQ ID NO: 1288496 - RNA, 13 nt, Mycobacterium tuberculosis H37Rv
cgaacggcggugu

SEQ ID NO: 1288497 - RNA, 13 nt, Mycobacterium tuberculosis H37Rv
cgaacagucgcag

SEQ ID NO: 1288498 - RNA, 22 nt, Mycobacterium tuberculosis H37Rv
cgaacagucgagugaagccgac

SEQ ID NO: 1288499 - RNA, 19 nt, Mycobacterium tuberculosis H37Rv
cgaacagggaggucgccgc

SEQ ID NO: 1288500 - RNA, 17 nt, Mycobacterium tuberculosis H37Rv
cgaacagugccugggug

SEQ ID NO: 1288501 - RNA, 13 nt, Mycobacterium tuberculosis H37Rv
cgaacaucgccag

SEQ ID NO: 1288502 - RNA, 21 nt, Mycobacterium tuberculosis H37Rv
cgaacaugauccgccggcaac

SEQ ID NO: 1288503 - RNA, 13 nt, Mycobacterium tuberculosis H37Rv
cgaacccaggcac

SEQ ID NO: 1288504 - RNA, 14 nt, Mycobacterium tuberculosis H37Rv
cgaacccgguguug

SEQ ID NO: 1288505 - RNA, 15 nt, Mycobacterium tuberculosis H37Rv
cgaacccgccaccgc

SEQ ID NO: 1288506 - RNA, 18 nt, Mycobacterium tuberculosis H37Rv
cgaacccgaucgucgagc

SEQ ID NO: 1288507 - RNA, 20 nt, Mycobacterium tuberculosis H37Rv
cgaaccagucgaagaagacc

SEQ ID NO: 1288508 - RNA, 17 nt, Mycobacterium tuberculosis H37Rv
cgaaccaccaccggcaa

SEQ ID NO: 1288509 - RNA, 16 nt, Mycobacterium tuberculosis H37Rv
cgaacagcagcccgcc

SEQ ID NO: 1288510 - RNA, 21 nt, Mycobacterium tuberculosis H37Rv
cgaacagcaugauccgcuggg

SEQ ID NO: 1288511 - RNA, 15 nt, Mycobacterium tuberculosis H37Rv
cgaacagcgaaccgc

SEQ ID NO: 1288512 - RNA, 15 nt, Mycobacterium tuberculosis H37Rv
cgaacagggcugcga

SEQ ID NO: 1288513 - RNA, 20 nt, Mycobacterium tuberculosis H37Rv
cgaaagccaggcggcaagga

SEQ ID NO: 1288514 - RNA, 17 nt, Mycobacterium tuberculosis H37Rv
cgaaacucaccagcacc

SEQ ID NO: 1288515 - RNA, 20 nt, Mycobacterium tuberculosis H37Rv
cgaaagccaacucgaccgac

SEQ ID NO: 1288516 - RNA, 18 nt, Mycobacterium tuberculosis H37Rv
cgaacacgcacacgaucg

SEQ ID NO: 1288517 - RNA, 16 nt, Mycobacterium tuberculosis H37Rv
cgaacacgucggccag

SEQ ID NO: 1288518 - RNA, 15 nt, Mycobacterium tuberculosis H37Rv
cgaacacguucgggu

SEQ ID NO: 1288519 - RNA, 17 nt, Mycobacterium tuberculosis H37Rv
cgaacagacaugcgcac

SEQ ID NO: 1288520 - RNA, 22 nt, Mycobacterium tuberculosis H37Rv
cgaccucaucggcaccgucucg

SEQ ID NO: 1288521 - RNA, 14 nt, Mycobacterium tuberculosis H37Rv
cgaccucaucggca

SEQ ID NO: 1288522 - RNA, 15 nt, Mycobacterium tuberculosis H37Rv
cgaccucaucggcac

SEQ ID NO: 1288523 - RNA, 14 nt, Mycobacterium tuberculosis H37Rv
cgaccguugcauac

SEQ ID NO: 1288524 - RNA, 17 nt, Mycobacterium tuberculosis H37Rv
cgaccucacugcggcgc

SEQ ID NO: 1288525 - RNA, 17 nt, Mycobacterium tuberculosis H37Rv
cgaccuaccgucgacca

SEQ ID NO: 1288526 - RNA, 15 nt, Mycobacterium tuberculosis H37Rv
cgaccuacugcgguc

SEQ ID NO: 1288527 - RNA, 18 nt, Mycobacterium tuberculosis H37Rv
cgaccgugguggucgggc

SEQ ID NO: 1288528 - RNA, 22 nt, Mycobacterium tuberculosis H37Rv
cgaccgugguggucgggcgcaa

SEQ ID NO: 1288529 - RNA, 17 nt, Mycobacterium tuberculosis H37Rv
cgaccccaggcgcucau

SEQ ID NO: 1288530 - RNA, 14 nt, Mycobacterium tuberculosis H37Rv
cgacccccugccac

SEQ ID NO: 1288531 - RNA, 20 nt, Mycobacterium tuberculosis H37Rv
cgacccaucaccagcggcug

SEQ ID NO: 1288532 - RNA, 15 nt, Mycobacterium tuberculosis H37Rv
cgacccaucaccagc

SEQ ID NO: 1288533 - RNA, 17 nt, Mycobacterium tuberculosis H37Rv
cgaccuccgcgaucacc

SEQ ID NO: 1288534 - RNA, 18 nt, Mycobacterium tuberculosis H37Rv
cgaccugagucggcauug

SEQ ID NO: 1288535 - RNA, 14 nt, Mycobacterium tuberculosis H37Rv
cgaccugacugguc

SEQ ID NO: 1288536 - RNA, 19 nt, Mycobacterium tuberculosis H37Rv
cgaccucgucggccgacac

SEQ ID NO: 1288537 - RNA, 21 nt, Mycobacterium tuberculosis H37Rv
cgaccucugcacggccgucau

SEQ ID NO: 1288538 - RNA, 20 nt, Mycobacterium tuberculosis H37Rv
cgaccucggguugcagcagc

SEQ ID NO: 1288539 - RNA, 22 nt, Mycobacterium tuberculosis H37Rv
cgacgaccgucacaagucgaca

SEQ ID NO: 1288540 - RNA, 14 nt, Mycobacterium tuberculosis H37Rv
cgacgaccagcaga

SEQ ID NO: 1288541 - RNA, 12 nt, Mycobacterium tuberculosis H37Rv
cgacgaccagca

SEQ ID NO: 1288542 - RNA, 23 nt, Mycobacterium tuberculosis H37Rv
cgacgacccgggucggcacgacc

SEQ ID NO: 1288543 - RNA, 18 nt, Mycobacterium tuberculosis H37Rv
cgacgacccguugacguu

SEQ ID NO: 1288544 - RNA, 18 nt, Mycobacterium tuberculosis H37Rv
cgacgacccgggucggca

SEQ ID NO: 1288545 - RNA, 23 nt, Mycobacterium tuberculosis H37Rv
cgacgaccaccuucugacgcggc

SEQ ID NO: 1288546 - RNA, 15 nt, Mycobacterium tuberculosis H37Rv
cgacgaccaccuucu

SEQ ID NO: 1288547 - RNA, 23 nt, Mycobacterium tuberculosis H37Rv
cgacgacaucgguggcccggugc

SEQ ID NO: 1288548 - RNA, 19 nt, Mycobacterium tuberculosis H37Rv
cgacgaccacaccacgaug

SEQ ID NO: 1288549 - RNA, 21 nt, Mycobacterium tuberculosis H37Rv
cgacgaccacaccacgauggc

SEQ ID NO: 1288550 - RNA, 20 nt, Mycobacterium tuberculosis H37Rv
cgacgacauuggugcugaca

SEQ ID NO: 1288551 - RNA, 13 nt, Mycobacterium tuberculosis H37Rv
cgacgaacucgcc

SEQ ID NO: 1288552 - RNA, 16 nt, Mycobacterium tuberculosis H37Rv
cgacgaacucgcccag

SEQ ID NO: 1288553 - RNA, 22 nt, Mycobacterium tuberculosis H37Rv
cgacgaagaagaacucggcguc

SEQ ID NO: 1288554 - RNA, 21 nt, Mycobacterium tuberculosis H37Rv
cgaccuggacaaccucgucga

SEQ ID NO: 1288555 - RNA, 18 nt, Mycobacterium tuberculosis H37Rv
cgacgaacaccagcgcgc

SEQ ID NO: 1288556 - RNA, 19 nt, Mycobacterium tuberculosis H37Rv
cgaccuggacgcggccaau

SEQ ID NO: 1288557 - RNA, 16 nt, Mycobacterium tuberculosis H37Rv
cgacgaacagcggugg

SEQ ID NO: 1288558 - RNA, 19 nt, Mycobacterium tuberculosis H37Rv
cgacgaaccgguugccguu

SEQ ID NO: 1288559 - RNA, 14 nt, Mycobacterium tuberculosis H37Rv
cgacgaaccgccag

SEQ ID NO: 1288560 - RNA, 14 nt, Mycobacterium tuberculosis H37Rv
cgacgaacgccguc

SEQ ID NO: 1288561 - RNA, 17 nt, Mycobacterium tuberculosis H37Rv
cgacgaacuccgcguug

SEQ ID NO: 1288562 - RNA, 13 nt, Mycobacterium tuberculosis H37Rv
cgaccugcucgcu

SEQ ID NO: 1288563 - RNA, 18 nt, Mycobacterium tuberculosis H37Rv
cgaccugcgcgacggcgc

SEQ ID NO: 1288564 - RNA, 16 nt, Mycobacterium tuberculosis H37Rv
cgacgaggcaaugcga

SEQ ID NO: 1288565 - RNA, 21 nt, Mycobacterium tuberculosis H37Rv
cgacgagcggcuucagcacgu

SEQ ID NO: 1288566 - RNA, 16 nt, Mycobacterium tuberculosis H37Rv
cgacgagcgcagcgug

SEQ ID NO: 1288567 - RNA, 14 nt, Mycobacterium tuberculosis H37Rv
cgacgagcgcagcg

SEQ ID NO: 1288568 - RNA, 15 nt, Mycobacterium tuberculosis H37Rv
cgacgacgcccacca

SEQ ID NO: 1288569 - RNA, 14 nt, Mycobacterium tuberculosis H37Rv
cgacgacgacaccg

SEQ ID NO: 1288570 - RNA, 13 nt, Mycobacterium tuberculosis H37Rv
cgacgacgccaau

SEQ ID NO: 1288571 - RNA, 23 nt, Mycobacterium tuberculosis H37Rv
cgacgacguccucgacgaucagc

SEQ ID NO: 1288572 - RNA, 21 nt, Mycobacterium tuberculosis H37Rv
cgacgagggcgggacccguga

SEQ ID NO: 1288573 - RNA, 14 nt, Mycobacterium tuberculosis H37Rv
cgacgagggcggga

SEQ ID NO: 1288574 - RNA, 14 nt, Mycobacterium tuberculosis H37Rv
cgacgaugucggca

SEQ ID NO: 1288575 - RNA, 15 nt, Mycobacterium tuberculosis H37Rv
cgacgaugucgagcg

SEQ ID NO: 1288576 - RNA, 18 nt, Mycobacterium tuberculosis H37Rv
cgacgcagaacggcguug

SEQ ID NO: 1288577 - RNA, 15 nt, Mycobacterium tuberculosis H37Rv
cgacgcacacccggu

SEQ ID NO: 1288578 - RNA, 16 nt, Mycobacterium tuberculosis H37Rv
cgacgcaaagcagcgc

SEQ ID NO: 1288579 - RNA, 17 nt, Mycobacterium tuberculosis H37Rv
cgacgccaacgccagcg

SEQ ID NO: 1288580 - RNA, 17 nt, Mycobacterium tuberculosis H37Rv
cgacgccaccgccacca

SEQ ID NO: 1288581 - RNA, 14 nt, Mycobacterium tuberculosis H37Rv
cgacgcccucacaa

SEQ ID NO: 1288582 - RNA, 18 nt, Mycobacterium tuberculosis H37Rv
cgacgcccauggcgucga

SEQ ID NO: 1288583 - RNA, 23 nt, Mycobacterium tuberculosis H37Rv
cgacgcccauggcgucgaaccag

SEQ ID NO: 1288584 - RNA, 16 nt, Mycobacterium tuberculosis H37Rv
cgacgcccgccaccgg

SEQ ID NO: 1288585 - RNA, 14 nt, Mycobacterium tuberculosis H37Rv
cgacgcccauggcg

SEQ ID NO: 1288586 - RNA, 14 nt, Mycobacterium tuberculosis H37Rv
cgacgccggccuug

SEQ ID NO: 1288587 - RNA, 16 nt, Mycobacterium tuberculosis H37Rv
cgacgccggcccgacg

SEQ ID NO: 1288588 - RNA, 20 nt, Mycobacterium tuberculosis H37Rv
cgacgccggccagcggccau

SEQ ID NO: 1288589 - RNA, 21 nt, Mycobacterium tuberculosis H37Rv
cgacgcccucacaacgauugc

SEQ ID NO: 1288590 - RNA, 18 nt, Mycobacterium tuberculosis H37Rv
cgacgcccucacaacgau

SEQ ID NO: 1288591 - RNA, 16 nt, Mycobacterium tuberculosis H37Rv
cgacgccgaaaaugcc

SEQ ID NO: 1288592 - RNA, 24 nt, Mycobacterium tuberculosis H37Rv
cgacggcaagcgcaucgcacagcg

SEQ ID NO: 1288593 - RNA, 15 nt, Mycobacterium tuberculosis H37Rv
cgacggaugaucagc

SEQ ID NO: 1288594 - RNA, 19 nt, Mycobacterium tuberculosis H37Rv
cgacggacuucccgcgcga

SEQ ID NO: 1288595 - RNA, 16 nt, Mycobacterium tuberculosis H37Rv
cgacggaguucgacgu

SEQ ID NO: 1288596 - RNA, 19 nt, Mycobacterium tuberculosis H37Rv
cgacggaguucgacgucgg

SEQ ID NO: 1288597 - RNA, 13 nt, Mycobacterium tuberculosis H37Rv
cgacggagaucga

SEQ ID NO: 1288598 - RNA, 17 nt, Mycobacterium tuberculosis H37Rv
cgacgcuuucccgauga

SEQ ID NO: 1288599 - RNA, 23 nt, Mycobacterium tuberculosis H37Rv
cgacgcuguggcucgacgaugcg

SEQ ID NO: 1288600 - RNA, 23 nt, Mycobacterium tuberculosis H37Rv
cgacgcugugggcuuugccgucg

SEQ ID NO: 1288601 - RNA, 19 nt, Mycobacterium tuberculosis H37Rv
cgacgcuguggcucgacga

SEQ ID NO: 1288602 - RNA, 18 nt, Mycobacterium tuberculosis H37Rv
cgacgcuguggcucgacg

SEQ ID NO: 1288603 - RNA, 20 nt, Mycobacterium tuberculosis H37Rv
cgacgcgcucggcgaucugc

SEQ ID NO: 1288604 - RNA, 14 nt, Mycobacterium tuberculosis H37Rv
cgacgcgcucggcg

SEQ ID NO: 1288605 - RNA, 18 nt, Mycobacterium tuberculosis H37Rv
cgacgcgcggccagccca

SEQ ID NO: 1288606 - RNA, 13 nt, Mycobacterium tuberculosis H37Rv
cgacggcgccauu

SEQ ID NO: 1288607 - RNA, 13 nt, Mycobacterium tuberculosis H37Rv
cgacggcgcaugc

SEQ ID NO: 1288608 - RNA, 13 nt, Mycobacterium tuberculosis H37Rv
cgacggcgccgaa

SEQ ID NO: 1288609 - RNA, 15 nt, Mycobacterium tuberculosis H37Rv
cgacggccucgucga

SEQ ID NO: 1288610 - RNA, 14 nt, Mycobacterium tuberculosis H37Rv
cgacggcgacggcg

SEQ ID NO: 1288611 - RNA, 21 nt, Mycobacterium tuberculosis H37Rv
cgacggccagcaagacgauga

SEQ ID NO: 1288612 - RNA, 14 nt, Mycobacterium tuberculosis H37Rv
cgacggccagccca

SEQ ID NO: 1288613 - RNA, 16 nt, Mycobacterium tuberculosis H37Rv
cgacggccagugcgca

SEQ ID NO: 1288614 - RNA, 16 nt, Mycobacterium tuberculosis H37Rv
cgacggccggcaagca

SEQ ID NO: 1288615 - RNA, 21 nt, Mycobacterium tuberculosis H37Rv
cgacggcauguaccgaccgcg

SEQ ID NO: 1288616 - RNA, 22 nt, Mycobacterium tuberculosis H37Rv
cgacggcaucaacgcgggcgcu

SEQ ID NO: 1288617 - RNA, 15 nt, Mycobacterium tuberculosis H37Rv
cgacggcaucgucga

SEQ ID NO: 1288618 - RNA, 17 nt, Mycobacterium tuberculosis H37Rv
cgacggcauguaccgac

SEQ ID NO: 1288619 - RNA, 16 nt, Mycobacterium tuberculosis H37Rv
cgacggccagcaagac

SEQ ID NO: 1288620 - RNA, 22 nt, Mycobacterium tuberculosis H37Rv
cgacggccaccccgucgggguc

SEQ ID NO: 1288621 - RNA, 15 nt, Mycobacterium tuberculosis H37Rv
cgacggccacggugg

SEQ ID NO: 1288622 - RNA, 20 nt, Mycobacterium tuberculosis H37Rv
cgacggccacgguggagcgc

SEQ ID NO: 1288623 - RNA, 13 nt, Mycobacterium tuberculosis H37Rv
cgacggcaccaug

SEQ ID NO: 1288624 - RNA, 13 nt, Mycobacterium tuberculosis H37Rv
cgacggcagugcu

SEQ ID NO: 1288625 - RNA, 22 nt, Mycobacterium tuberculosis H37Rv
cgacggugccgucggugccgcg

SEQ ID NO: 1288626 - RNA, 14 nt, Mycobacterium tuberculosis H37Rv
cgacggugccgucg

SEQ ID NO: 1288627 - RNA, 13 nt, Mycobacterium tuberculosis H37Rv
cgacgguguccgg

SEQ ID NO: 1288628 - RNA, 14 nt, Mycobacterium tuberculosis H37Rv
cgacguccaccagc

SEQ ID NO: 1288629 - RNA, 17 nt, Mycobacterium tuberculosis H37Rv
cgacggucagguccugg

SEQ ID NO: 1288630 - RNA, 15 nt, Mycobacterium tuberculosis H37Rv
cgacgucaucgucgg

SEQ ID NO: 1288631 - RNA, 20 nt, Mycobacterium tuberculosis H37Rv
cgacggucccggcacgucga

SEQ ID NO: 1288632 - RNA, 14 nt, Mycobacterium tuberculosis H37Rv
cgacggugaugggg

SEQ ID NO: 1288633 - RNA, 13 nt, Mycobacterium tuberculosis H37Rv
cgacggcgucacc

SEQ ID NO: 1288634 - RNA, 16 nt, Mycobacterium tuberculosis H37Rv
cgacucggugcgguga

SEQ ID NO: 1288635 - RNA, 16 nt, Mycobacterium tuberculosis H37Rv
cgacucgccggcgaau

SEQ ID NO: 1288636 - RNA, 16 nt, Mycobacterium tuberculosis H37Rv
cgacguucgacgacag

SEQ ID NO: 1288637 - RNA, 15 nt, Mycobacterium tuberculosis H37Rv
cgacguuccgcucga

SEQ ID NO: 1288638 - RNA, 15 nt, Mycobacterium tuberculosis H37Rv
cgacguucgggucga

SEQ ID NO: 1288639 - RNA, 15 nt, Mycobacterium tuberculosis H37Rv
cgacguggccgacgu

SEQ ID NO: 1288640 - RNA, 21 nt, Mycobacterium tuberculosis H37Rv
cgacguguugcacguacgggc

SEQ ID NO: 1288641 - RNA, 18 nt, Mycobacterium tuberculosis H37Rv
cgacgucgucgucgacgg

SEQ ID NO: 1288642 - RNA, 15 nt, Mycobacterium tuberculosis H37Rv
cgacguggauggugg

SEQ ID NO: 1288643 - RNA, 15 nt, Mycobacterium tuberculosis H37Rv
cgacgucucgcaugc

SEQ ID NO: 1288644 - RNA, 23 nt, Mycobacterium tuberculosis H37Rv
cgacgucggccgcaucgcccaac

SEQ ID NO: 1288645 - RNA, 19 nt, Mycobacterium tuberculosis H37Rv
cgacgucggcgaccagguc

SEQ ID NO: 1288646 - RNA, 12 nt, Mycobacterium tuberculosis H37Rv
cgacgucgguga

SEQ ID NO: 1288647 - RNA, 18 nt, Mycobacterium tuberculosis H37Rv
cgacguccgaucgguguc

SEQ ID NO: 1288648 - RNA, 22 nt, Mycobacterium tuberculosis H37Rv
cgacgucggccgcaucgcccaa

SEQ ID NO: 1288649 - RNA, 21 nt, Mycobacterium tuberculosis H37Rv
cgaggauguaguuggugaugc

SEQ ID NO: 1288650 - RNA, 17 nt, Mycobacterium tuberculosis H37Rv
cgaggaugucgaugacc

SEQ ID NO: 1288651 - RNA, 20 nt, Mycobacterium tuberculosis H37Rv
cgaggaucccgcugcacgac

SEQ ID NO: 1288652 - RNA, 18 nt, Mycobacterium tuberculosis H37Rv
cgaggaguuggugcagcg

SEQ ID NO: 1288653 - RNA, 20 nt, Mycobacterium tuberculosis H37Rv
cgaggauauuuccuacggug

SEQ ID NO: 1288654 - RNA, 19 nt, Mycobacterium tuberculosis H37Rv
cgaggacugggugcgcggc

SEQ ID NO: 1288655 - RNA, 14 nt, Mycobacterium tuberculosis H37Rv
cgaggacgucaccg

SEQ ID NO: 1288656 - RNA, 22 nt, Mycobacterium tuberculosis H37Rv
cgaggaccaccacuaggucgcc

SEQ ID NO: 1288657 - RNA, 21 nt, Mycobacterium tuberculosis H37Rv
cgaggacacauugaccaggug

SEQ ID NO: 1288658 - RNA, 20 nt, Mycobacterium tuberculosis H37Rv
cgaggacacauugaccaggu

SEQ ID NO: 1288659 - RNA, 14 nt, Mycobacterium tuberculosis H37Rv
cgaggacggcguag

SEQ ID NO: 1288660 - RNA, 20 nt, Mycobacterium tuberculosis H37Rv
cgaggacgccggcgccgcca

SEQ ID NO: 1288661 - RNA, 12 nt, Mycobacterium tuberculosis H37Rv
cgaggaccucgu

SEQ ID NO: 1288662 - RNA, 14 nt, Mycobacterium tuberculosis H37Rv
cgaggcagcgucgu

SEQ ID NO: 1288663 - RNA, 19 nt, Mycobacterium tuberculosis H37Rv
cgaggcagcgucgucgacg

SEQ ID NO: 1288664 - RNA, 22 nt, Mycobacterium tuberculosis H37Rv
cgaggcagacacgagucgccag

SEQ ID NO: 1288665 - RNA, 16 nt, Mycobacterium tuberculosis H37Rv
cgaggcaaccgacacu

SEQ ID NO: 1288666 - RNA, 18 nt, Mycobacterium tuberculosis H37Rv
cgaggcaccgacaucguc

SEQ ID NO: 1288667 - RNA, 22 nt, Mycobacterium tuberculosis H37Rv
cgaggcacccgugccgccgaug

SEQ ID NO: 1288668 - RNA, 16 nt, Mycobacterium tuberculosis H37Rv
cgaggccaugcucgcc

SEQ ID NO: 1288669 - RNA, 14 nt, Mycobacterium tuberculosis H37Rv
cgaggccagcggua

SEQ ID NO: 1288670 - RNA, 22 nt, Mycobacterium tuberculosis H37Rv
cgaggccagcgguaaugccagc

SEQ ID NO: 1288671 - RNA, 13 nt, Mycobacterium tuberculosis H37Rv
cgaggcgcccaac

SEQ ID NO: 1288672 - RNA, 15 nt, Mycobacterium tuberculosis H37Rv
cgaggccgccgagau

SEQ ID NO: 1288673 - RNA, 14 nt, Mycobacterium tuberculosis H37Rv
cgaggccgccguug

SEQ ID NO: 1288674 - RNA, 18 nt, Mycobacterium tuberculosis H37Rv
cgagcguagcgaccucgc

SEQ ID NO: 1288675 - RNA, 20 nt, Mycobacterium tuberculosis H37Rv
cgagcguccgggucgacgcg

SEQ ID NO: 1288676 - RNA, 13 nt, Mycobacterium tuberculosis H37Rv
cgagcgucgggca

SEQ ID NO: 1288677 - RNA, 16 nt, Mycobacterium tuberculosis H37Rv
cgagcgucgggcacau

SEQ ID NO: 1288678 - RNA, 17 nt, Mycobacterium tuberculosis H37Rv
cgagcgcuaucaccgcc

SEQ ID NO: 1288679 - RNA, 20 nt, Mycobacterium tuberculosis H37Rv
cgagcguaacguggcugcga

SEQ ID NO: 1288680 - RNA, 17 nt, Mycobacterium tuberculosis H37Rv
cgagcgucagauccggc

SEQ ID NO: 1288681 - RNA, 18 nt, Mycobacterium tuberculosis H37Rv
cgagcgucagauccggcc

SEQ ID NO: 1288682 - RNA, 17 nt, Mycobacterium tuberculosis H37Rv
cgagcguuuggacgggc

SEQ ID NO: 1288683 - RNA, 18 nt, Mycobacterium tuberculosis H37Rv
cgagcguuuggacgggcg

SEQ ID NO: 1288684 - RNA, 16 nt, Mycobacterium tuberculosis H37Rv
cgagcucccgggcgcu

SEQ ID NO: 1288685 - RNA, 19 nt, Mycobacterium tuberculosis H37Rv
cgagcgugaaccuggcgac

SEQ ID NO: 1288686 - RNA, 20 nt, Mycobacterium tuberculosis H37Rv
cgagcgugucacguaacgcc

SEQ ID NO: 1288687 - RNA, 13 nt, Mycobacterium tuberculosis H37Rv
cgagcgcgcgacg

SEQ ID NO: 1288688 - RNA, 20 nt, Mycobacterium tuberculosis H37Rv
cgagcgcgccgcgcucgccg

SEQ ID NO: 1288689 - RNA, 13 nt, Mycobacterium tuberculosis H37Rv
cgagcgcaccacg

SEQ ID NO: 1288690 - RNA, 12 nt, Mycobacterium tuberculosis H37Rv
cgagcgcaccgc

SEQ ID NO: 1288691 - RNA, 13 nt, Mycobacterium tuberculosis H37Rv
cgagcgcagcgca

SEQ ID NO: 1288692 - RNA, 12 nt, Mycobacterium tuberculosis H37Rv
cgagcgcacugg

SEQ ID NO: 1288693 - RNA, 16 nt, Mycobacterium tuberculosis H37Rv
cgagcgcuaucaccgc

SEQ ID NO: 1288694 - RNA, 15 nt, Mycobacterium tuberculosis H37Rv
cgagcgcgucgguca

SEQ ID NO: 1288695 - RNA, 20 nt, Mycobacterium tuberculosis H37Rv
cgagcgcggugccgccaccg

SEQ ID NO: 1288696 - RNA, 16 nt, Mycobacterium tuberculosis H37Rv
cgagcgcgcgcuguug

SEQ ID NO: 1288697 - RNA, 18 nt, Mycobacterium tuberculosis H37Rv
cgagcuuccacgccggac

SEQ ID NO: 1288698 - RNA, 22 nt, Mycobacterium tuberculosis H37Rv
cgagcuucagcgcgcugcagug

SEQ ID NO: 1288699 - RNA, 15 nt, Mycobacterium tuberculosis H37Rv
cgagcuugucgagca

SEQ ID NO: 1288700 - RNA, 22 nt, Mycobacterium tuberculosis H37Rv
cgagcuugccgucgcugacgcc

SEQ ID NO: 1288701 - RNA, 18 nt, Mycobacterium tuberculosis H37Rv
cgagcuggcgaccugguc

SEQ ID NO: 1288702 - RNA, 21 nt, Mycobacterium tuberculosis H37Rv
cgagcugcgggucgcguuucg

SEQ ID NO: 1288703 - RNA, 14 nt, Mycobacterium tuberculosis H37Rv
cgagcugaccuggu

SEQ ID NO: 1288704 - RNA, 17 nt, Mycobacterium tuberculosis H37Rv
cgagcugauacgcaugc

SEQ ID NO: 1288705 - RNA, 14 nt, Mycobacterium tuberculosis H37Rv
cgagcucgucgagc

SEQ ID NO: 1288706 - RNA, 20 nt, Mycobacterium tuberculosis H37Rv
cgagcucguccucgucuucg

SEQ ID NO: 1288707 - RNA, 17 nt, Mycobacterium tuberculosis H37Rv
cgagcucggcgcccagc

SEQ ID NO: 1288708 - RNA, 13 nt, Mycobacterium tuberculosis H37Rv
cgagcucggcgcc

SEQ ID NO: 1288709 - RNA, 15 nt, Mycobacterium tuberculosis H37Rv
cgagcucggcgaugc

SEQ ID NO: 1288710 - RNA, 14 nt, Mycobacterium tuberculosis H37Rv
cgagcucguccucg

SEQ ID NO: 1288711 - RNA, 13 nt, Mycobacterium tuberculosis H37Rv
cgagcucggucac

SEQ ID NO: 1288712 - RNA, 15 nt, Mycobacterium tuberculosis H37Rv
cgagcucgggugcga

SEQ ID NO: 1288713 - RNA, 18 nt, Mycobacterium tuberculosis H37Rv
cgagcuccgaugccgacg

SEQ ID NO: 1288714 - RNA, 17 nt, Mycobacterium tuberculosis H37Rv
cgagcuccgaugccgac

SEQ ID NO: 1288715 - RNA, 13 nt, Mycobacterium tuberculosis H37Rv
cgagccgacaucg

SEQ ID NO: 1288716 - RNA, 19 nt, Mycobacterium tuberculosis H37Rv
cgagccgacccgacgcugg

SEQ ID NO: 1288717 - RNA, 21 nt, Mycobacterium tuberculosis H37Rv
cgagccgacccgacgcugguc

SEQ ID NO: 1288718 - RNA, 18 nt, Mycobacterium tuberculosis H37Rv
cgagcccguccucgucgg

SEQ ID NO: 1288719 - RNA, 16 nt, Mycobacterium tuberculosis H37Rv
cgagcccggugcuacc

SEQ ID NO: 1288720 - RNA, 13 nt, Mycobacterium tuberculosis H37Rv
cgagccgcacgau

SEQ ID NO: 1288721 - RNA, 20 nt, Mycobacterium tuberculosis H37Rv
cgagccgauauaccagggca

SEQ ID NO: 1288722 - RNA, 13 nt, Mycobacterium tuberculosis H37Rv
cgagccgaccgcg

SEQ ID NO: 1288723 - RNA, 22 nt, Mycobacterium tuberculosis H37Rv
cgagcgauacgucgucagccag

SEQ ID NO: 1288724 - RNA, 18 nt, Mycobacterium tuberculosis H37Rv
cgagcgauacgucgucag

SEQ ID NO: 1288725 - RNA, 12 nt, Mycobacterium tuberculosis H37Rv
cgagcgcaccac

SEQ ID NO: 1288726 - RNA, 19 nt, Mycobacterium tuberculosis H37Rv
cgagcgcaaucgaccacga

SEQ ID NO: 1288727 - RNA, 16 nt, Mycobacterium tuberculosis H37Rv
cgagccgucgucgagc

SEQ ID NO: 1288728 - RNA, 15 nt, Mycobacterium tuberculosis H37Rv
cgagccgugccagca

SEQ ID NO: 1288729 - RNA, 20 nt, Mycobacterium tuberculosis H37Rv
cgagccucgcucuccauggc

SEQ ID NO: 1288730 - RNA, 21 nt, Mycobacterium tuberculosis H37Rv
cgagcccgaaccaccgcguug

SEQ ID NO: 1288731 - RNA, 14 nt, Mycobacterium tuberculosis H37Rv
cgagcccgcaucgc

SEQ ID NO: 1288732 - RNA, 21 nt, Mycobacterium tuberculosis H37Rv
cgagcccgccacagccccagg

SEQ ID NO: 1288733 - RNA, 20 nt, Mycobacterium tuberculosis H37Rv
cgagcccgccagcgccgcug

SEQ ID NO: 1288734 - RNA, 16 nt, Mycobacterium tuberculosis H37Rv
cgagcccgccggguug

SEQ ID NO: 1288735 - RNA, 19 nt, Mycobacterium tuberculosis H37Rv
cgagcaugccguugacaac

SEQ ID NO: 1288736 - RNA, 19 nt, Mycobacterium tuberculosis H37Rv
cgagcaucaacgaaccagc

SEQ ID NO: 1288737 - RNA, 17 nt, Mycobacterium tuberculosis H37Rv
cgagcauaccgccgcug

SEQ ID NO: 1288738 - RNA, 18 nt, Mycobacterium tuberculosis H37Rv
cgagcagggccggcaccg

SEQ ID NO: 1288739 - RNA, 17 nt, Mycobacterium tuberculosis H37Rv
cgagcauccgacacugc

SEQ ID NO: 1288740 - RNA, 19 nt, Mycobacterium tuberculosis H37Rv
cgagcauccgacacugcgg

SEQ ID NO: 1288741 - RNA, 20 nt, Mycobacterium tuberculosis H37Rv
cgagcagacgcggaaucgca

SEQ ID NO: 1288742 - RNA, 19 nt, Mycobacterium tuberculosis H37Rv
cgagcagacgcggaaucgc

SEQ ID NO: 1288743 - RNA, 18 nt, Mycobacterium tuberculosis H37Rv
cgagcagacgcggaaucg

SEQ ID NO: 1288744 - RNA, 16 nt, Mycobacterium tuberculosis H37Rv
cgagcagacgcggaau

SEQ ID NO: 1288745 - RNA, 13 nt, Mycobacterium tuberculosis H37Rv
cgagcagacgcga

SEQ ID NO: 1288746 - RNA, 19 nt, Mycobacterium tuberculosis H37Rv
cgagcagacgcagagucgc

SEQ ID NO: 1288747 - RNA, 19 nt, Mycobacterium tuberculosis H37Rv
cgagcagacgcgaaauccc

SEQ ID NO: 1288748 - RNA, 23 nt, Mycobacterium tuberculosis H37Rv
cgagcaggcccaacgcgaugucc

SEQ ID NO: 1288749 - RNA, 18 nt, Mycobacterium tuberculosis H37Rv
cgagcagcuucucggcga

SEQ ID NO: 1288750 - RNA, 18 nt, Mycobacterium tuberculosis H37Rv
cgagcaggcccaacgcga

SEQ ID NO: 1288751 - RNA, 23 nt, Mycobacterium tuberculosis H37Rv
cgagcaaaccagauugccgagcc

SEQ ID NO: 1288752 - RNA, 16 nt, Mycobacterium tuberculosis H37Rv
cgagcaacaccagggc

SEQ ID NO: 1288753 - RNA, 15 nt, Mycobacterium tuberculosis H37Rv
cgagcaccugccgau

SEQ ID NO: 1288754 - RNA, 23 nt, Mycobacterium tuberculosis H37Rv
cgagauggcgaucaugagcagca

SEQ ID NO: 1288755 - RNA, 16 nt, Mycobacterium tuberculosis H37Rv
cgagauggcgaucaug

SEQ ID NO: 1288756 - RNA, 18 nt, Mycobacterium tuberculosis H37Rv
cgagaugccaucggugau

SEQ ID NO: 1288757 - RNA, 18 nt, Mycobacterium tuberculosis H37Rv
cgagcagacacagaaucg

SEQ ID NO: 1288758 - RNA, 16 nt, Mycobacterium tuberculosis H37Rv
cgagcagaaacaacgu

SEQ ID NO: 1288759 - RNA, 15 nt, Mycobacterium tuberculosis H37Rv
cgagcacucggccac

SEQ ID NO: 1288760 - RNA, 17 nt, Mycobacterium tuberculosis H37Rv
cgagcagacgccgcguu

SEQ ID NO: 1288761 - RNA, 19 nt, Mycobacterium tuberculosis H37Rv
cgagcagacgcagaaucgc

SEQ ID NO: 1288762 - RNA, 16 nt, Mycobacterium tuberculosis H37Rv
cgagcagacgcagaau

SEQ ID NO: 1288763 - RNA, 20 nt, Mycobacterium tuberculosis H37Rv
cgagcagacgcaaaaucgca

SEQ ID NO: 1288764 - RNA, 19 nt, Mycobacterium tuberculosis H37Rv
cgagcagacacagaaucgc

SEQ ID NO: 1288765 - RNA, 19 nt, Mycobacterium tuberculosis H37Rv
cgagcagacgcaaaauccc

SEQ ID NO: 1288766 - RNA, 18 nt, Mycobacterium tuberculosis H37Rv
cgagcagacgcaaaaucg

SEQ ID NO: 1288767 - RNA, 18 nt, Mycobacterium tuberculosis H37Rv
cgagcacgcugcugcggg

SEQ ID NO: 1288768 - RNA, 15 nt, Mycobacterium tuberculosis H37Rv
cgagcacgaugucga

SEQ ID NO: 1288769 - RNA, 17 nt, Mycobacterium tuberculosis H37Rv
cgagcacgccgaccaau

SEQ ID NO: 1288770 - RNA, 20 nt, Mycobacterium tuberculosis H37Rv
cgacucugcgucugcucacc

SEQ ID NO: 1288771 - RNA, 18 nt, Mycobacterium tuberculosis H37Rv
cgacucgguugaggacga

SEQ ID NO: 1288772 - RNA, 19 nt, Mycobacterium tuberculosis H37Rv
cgacucugcgucugcucac

SEQ ID NO: 1288773 - RNA, 14 nt, Mycobacterium tuberculosis H37Rv
cgacucucaucgac

SEQ ID NO: 1288774 - RNA, 18 nt, Mycobacterium tuberculosis H37Rv
cgacucucaucgacucga

SEQ ID NO: 1288775 - RNA, 21 nt, Mycobacterium tuberculosis H37Rv
cgagacggcgucgggccguug

SEQ ID NO: 1288776 - RNA, 13 nt, Mycobacterium tuberculosis H37Rv
cgagacggcguug

SEQ ID NO: 1288777 - RNA, 22 nt, Mycobacterium tuberculosis H37Rv
cgagacggcguugucgacgaag

SEQ ID NO: 1288778 - RNA, 15 nt, Mycobacterium tuberculosis H37Rv
cgacugccgcgggca

SEQ ID NO: 1288779 - RNA, 18 nt, Mycobacterium tuberculosis H37Rv
cgacugccgcgggcagcg

SEQ ID NO: 1288780 - RNA, 22 nt, Mycobacterium tuberculosis H37Rv
cgagaggagggcggccgcggug

SEQ ID NO: 1288781 - RNA, 20 nt, Mycobacterium tuberculosis H37Rv
cgagagggaucacgccacca

SEQ ID NO: 1288782 - RNA, 15 nt, Mycobacterium tuberculosis H37Rv
cgagauccagcgcaa

SEQ ID NO: 1288783 - RNA, 18 nt, Mycobacterium tuberculosis H37Rv
cgagauccucgucgaggu

SEQ ID NO: 1288784 - RNA, 15 nt, Mycobacterium tuberculosis H37Rv
cgagauccucgucga

SEQ ID NO: 1288785 - RNA, 17 nt, Mycobacterium tuberculosis H37Rv
cgagauccuucgcguug

SEQ ID NO: 1288786 - RNA, 18 nt, Mycobacterium tuberculosis H37Rv
cgagaucgcgugcgacga

SEQ ID NO: 1288787 - RNA, 16 nt, Mycobacterium tuberculosis H37Rv
cgagacuucgguguag

SEQ ID NO: 1288788 - RNA, 19 nt, Mycobacterium tuberculosis H37Rv
cgagacuuggugauccgag

SEQ ID NO: 1288789 - RNA, 14 nt, Mycobacterium tuberculosis H37Rv
cgagagaguucgca

SEQ ID NO: 1288790 - RNA, 18 nt, Mycobacterium tuberculosis H37Rv
cgagagaguucgcaugcu

SEQ ID NO: 1288791 - RNA, 22 nt, Mycobacterium tuberculosis H37Rv
cgccaucaccgccguuaccgcc

SEQ ID NO: 1288792 - RNA, 22 nt, Mycobacterium tuberculosis H37Rv
cgccaucagaccaaugaccgcc

SEQ ID NO: 1288793 - RNA, 14 nt, Mycobacterium tuberculosis H37Rv
cgccauccaugaug

SEQ ID NO: 1288794 - RNA, 23 nt, Mycobacterium tuberculosis H37Rv
cgccauaccugccggaccaccgg

SEQ ID NO: 1288795 - RNA, 21 nt, Mycobacterium tuberculosis H37Rv
cgccauacgucgccucgagau

SEQ ID NO: 1288796 - RNA, 23 nt, Mycobacterium tuberculosis H37Rv
cgccauacgucgccucgagaugg

SEQ ID NO: 1288797 - RNA, 13 nt, Mycobacterium tuberculosis H37Rv
cgccauagcgggc

SEQ ID NO: 1288798 - RNA, 21 nt, Mycobacterium tuberculosis H37Rv
cgccauaaagagauggguagc

SEQ ID NO: 1288799 - RNA, 20 nt, Mycobacterium tuberculosis H37Rv
cgccaguugcguuguccacc

SEQ ID NO: 1288800 - RNA, 15 nt, Mycobacterium tuberculosis H37Rv
cgccaguucggcguc

SEQ ID NO: 1288801 - RNA, 22 nt, Mycobacterium tuberculosis H37Rv
cgccaucgccgccggugccgcc

SEQ ID NO: 1288802 - RNA, 23 nt, Mycobacterium tuberculosis H37Rv
cgccaucucgacggugaccggau

SEQ ID NO: 1288803 - RNA, 18 nt, Mycobacterium tuberculosis H37Rv
cgccaugcacguugccga

SEQ ID NO: 1288804 - RNA, 14 nt, Mycobacterium tuberculosis H37Rv
cgccaugaagccgg

SEQ ID NO: 1288805 - RNA, 18 nt, Mycobacterium tuberculosis H37Rv
cgccaucucgacggugac

SEQ ID NO: 1288806 - RNA, 17 nt, Mycobacterium tuberculosis H37Rv
cgccaucucgacgguga

SEQ ID NO: 1288807 - RNA, 18 nt, Mycobacterium tuberculosis H37Rv
cgccaucgguugacccgg

SEQ ID NO: 1288808 - RNA, 20 nt, Mycobacterium tuberculosis H37Rv
cgccaggcggcaauucgggc

SEQ ID NO: 1288809 - RNA, 17 nt, Mycobacterium tuberculosis H37Rv
cgccaggcggcaauucg

SEQ ID NO: 1288810 - RNA, 22 nt, Mycobacterium tuberculosis H37Rv
cgccaggccguugccccgucgu

SEQ ID NO: 1288811 - RNA, 15 nt, Mycobacterium tuberculosis H37Rv
cgccaggccgcgcga

SEQ ID NO: 1288812 - RNA, 21 nt, Mycobacterium tuberculosis H37Rv
cgccagggcacguggcgguac

SEQ ID NO: 1288813 - RNA, 23 nt, Mycobacterium tuberculosis H37Rv
cgccagguccgccggugccgccg

SEQ ID NO: 1288814 - RNA, 18 nt, Mycobacterium tuberculosis H37Rv
cgccagguacucggugca

SEQ ID NO: 1288815 - RNA, 15 nt, Mycobacterium tuberculosis H37Rv
cgccagucccacugg

SEQ ID NO: 1288816 - RNA, 17 nt, Mycobacterium tuberculosis H37Rv
cgccaguccgaucgccg

SEQ ID NO: 1288817 - RNA, 16 nt, Mycobacterium tuberculosis H37Rv
cgccagucccggcgca

SEQ ID NO: 1288818 - RNA, 16 nt, Mycobacterium tuberculosis H37Rv
cgccaguauggccgcc

SEQ ID NO: 1288819 - RNA, 22 nt, Mycobacterium tuberculosis H37Rv
cgccagguuaggcaauagccgg

SEQ ID NO: 1288820 - RNA, 17 nt, Mycobacterium tuberculosis H37Rv
cgccaguguugcgcugc

SEQ ID NO: 1288821 - RNA, 23 nt, Mycobacterium tuberculosis H37Rv
cgccagugcccgcacugccgccg

SEQ ID NO: 1288822 - RNA, 22 nt, Mycobacterium tuberculosis H37Rv
cgccagucgcaggaucggcgga

SEQ ID NO: 1288823 - RNA, 13 nt, Mycobacterium tuberculosis H37Rv
cgccagucgagca

SEQ ID NO: 1288824 - RNA, 17 nt, Mycobacterium tuberculosis H37Rv
cgccagucgagcaccug

SEQ ID NO: 1288825 - RNA, 14 nt, Mycobacterium tuberculosis H37Rv
cgccaguucgcggc

SEQ ID NO: 1288826 - RNA, 20 nt, Mycobacterium tuberculosis H37Rv
cgccaguucgcggcugcguu

SEQ ID NO: 1288827 - RNA, 18 nt, Mycobacterium tuberculosis H37Rv
cgccaguggugcaccgau

SEQ ID NO: 1288828 - RNA, 18 nt, Mycobacterium tuberculosis H37Rv
cgccaguucggcgggagc

SEQ ID NO: 1288829 - RNA, 21 nt, Mycobacterium tuberculosis H37Rv
cgccagugcccgcacugccgc

SEQ ID NO: 1288830 - RNA, 16 nt, Mycobacterium tuberculosis H37Rv
cgccaguuccggugac

SEQ ID NO: 1288831 - RNA, 20 nt, Mycobacterium tuberculosis H37Rv
cgccagcaccagcgucgcgg

SEQ ID NO: 1288832 - RNA, 19 nt, Mycobacterium tuberculosis H37Rv
cgccagcacaaccaucgcg

SEQ ID NO: 1288833 - RNA, 13 nt, Mycobacterium tuberculosis H37Rv
cgccagcagaucu

SEQ ID NO: 1288834 - RNA, 17 nt, Mycobacterium tuberculosis H37Rv
cgccagccaggcgaagu

SEQ ID NO: 1288835 - RNA, 11 nt, Mycobacterium tuberculosis H37Rv
cgccagcgcga

SEQ ID NO: 1288836 - RNA, 16 nt, Mycobacterium tuberculosis H37Rv
cgccagccugaaccgc

SEQ ID NO: 1288837 - RNA, 17 nt, Mycobacterium tuberculosis H37Rv
cgccagccugaaccgcc

SEQ ID NO: 1288838 - RNA, 14 nt, Mycobacterium tuberculosis H37Rv
cgccagccgguugg

SEQ ID NO: 1288839 - RNA, 12 nt, Mycobacterium tuberculosis H37Rv
cgccagaccgcc

SEQ ID NO: 1288840 - RNA, 15 nt, Mycobacterium tuberculosis H37Rv
cgccagaccgccgau

SEQ ID NO: 1288841 - RNA, 17 nt, Mycobacterium tuberculosis H37Rv
cgccagcaaugcccgca

SEQ ID NO: 1288842 - RNA, 16 nt, Mycobacterium tuberculosis H37Rv
cgccagcaccaccggc

SEQ ID NO: 1288843 - RNA, 15 nt, Mycobacterium tuberculosis H37Rv
cgccagcaacgucgg

SEQ ID NO: 1288844 - RNA, 14 nt, Mycobacterium tuberculosis H37Rv
cgccagcaaugccc

SEQ ID NO: 1288845 - RNA, 16 nt, Mycobacterium tuberculosis H37Rv
cgccagagucggagac

SEQ ID NO: 1288846 - RNA, 16 nt, Mycobacterium tuberculosis H37Rv
cgccacugccagccgu

SEQ ID NO: 1288847 - RNA, 17 nt, Mycobacterium tuberculosis H37Rv
cgccacugccagccgug

SEQ ID NO: 1288848 - RNA, 21 nt, Mycobacterium tuberculosis H37Rv
cgccacugaccgcgaucgccg

SEQ ID NO: 1288849 - RNA, 16 nt, Mycobacterium tuberculosis H37Rv
cgccacugaccgcgau

SEQ ID NO: 1288850 - RNA, 14 nt, Mycobacterium tuberculosis H37Rv
cgccacgucgacgg

SEQ ID NO: 1288851 - RNA, 15 nt, Mycobacterium tuberculosis H37Rv
cgccacgucgacggu

SEQ ID NO: 1288852 - RNA, 20 nt, Mycobacterium tuberculosis H37Rv
cgccaaucauggugcguagc

SEQ ID NO: 1288853 - RNA, 19 nt, Mycobacterium tuberculosis H37Rv
cgccaauccgcgucgucga

SEQ ID NO: 1288854 - RNA, 21 nt, Mycobacterium tuberculosis H37Rv
cgccaaguacgcgaccgcgau

SEQ ID NO: 1288855 - RNA, 22 nt, Mycobacterium tuberculosis H37Rv
cgccacgcgucuucggucgcgg

SEQ ID NO: 1288856 - RNA, 15 nt, Mycobacterium tuberculosis H37Rv
cgccacgacgucguc

SEQ ID NO: 1288857 - RNA, 15 nt, Mycobacterium tuberculosis H37Rv
cgccaccuucgacga

SEQ ID NO: 1288858 - RNA, 17 nt, Mycobacterium tuberculosis H37Rv
cgccaccuguugcccuu

SEQ ID NO: 1288859 - RNA, 18 nt, Mycobacterium tuberculosis H37Rv
cgcagcaucuccgccggu

SEQ ID NO: 1288860 - RNA, 15 nt, Mycobacterium tuberculosis H37Rv
cgcagcaucgucgcc

SEQ ID NO: 1288861 - RNA, 15 nt, Mycobacterium tuberculosis H37Rv
cgcagccccgacagu

SEQ ID NO: 1288862 - RNA, 14 nt, Mycobacterium tuberculosis H37Rv
cgcagccgcaccgg

SEQ ID NO: 1288863 - RNA, 17 nt, Mycobacterium tuberculosis H37Rv
cgcagccgaucgucucg

SEQ ID NO: 1288864 - RNA, 15 nt, Mycobacterium tuberculosis H37Rv
cgcagccccucgucg

SEQ ID NO: 1288865 - RNA, 14 nt, Mycobacterium tuberculosis H37Rv
cgcagcaggugagc

SEQ ID NO: 1288866 - RNA, 16 nt, Mycobacterium tuberculosis H37Rv
cgcagaucaccgccag

SEQ ID NO: 1288867 - RNA, 19 nt, Mycobacterium tuberculosis H37Rv
cgcagauccccgccaccga

SEQ ID NO: 1288868 - RNA, 22 nt, Mycobacterium tuberculosis H37Rv
cgcagauagcgcucgaacucgg

SEQ ID NO: 1288869 - RNA, 22 nt, Mycobacterium tuberculosis H37Rv
cgcagaucaggguggcgcggua

SEQ ID NO: 1288870 - RNA, 12 nt, Mycobacterium tuberculosis H37Rv
cgcagaucgugg

SEQ ID NO: 1288871 - RNA, 14 nt, Mycobacterium tuberculosis H37Rv
cgcagagucaacag

SEQ ID NO: 1288872 - RNA, 11 nt, Mycobacterium tuberculosis H37Rv
cgcagagcgua

SEQ ID NO: 1288873 - RNA, 15 nt, Mycobacterium tuberculosis H37Rv
cgcagacgugguagc

SEQ ID NO: 1288874 - RNA, 15 nt, Mycobacterium tuberculosis H37Rv
cgcagacgacaaccg

SEQ ID NO: 1288875 - RNA, 19 nt, Mycobacterium tuberculosis H37Rv
cgcagaccagacugcagug

SEQ ID NO: 1288876 - RNA, 23 nt, Mycobacterium tuberculosis H37Rv
cgcagaccagacugcagugccgu

SEQ ID NO: 1288877 - RNA, 16 nt, Mycobacterium tuberculosis H37Rv
cgcagacacugcugcg

SEQ ID NO: 1288878 - RNA, 15 nt, Mycobacterium tuberculosis H37Rv
cgcagacgccgacuc

SEQ ID NO: 1288879 - RNA, 15 nt, Mycobacterium tuberculosis H37Rv
cgcagaccugcauca

SEQ ID NO: 1288880 - RNA, 14 nt, Mycobacterium tuberculosis H37Rv
cgcagaccguccag

SEQ ID NO: 1288881 - RNA, 15 nt, Mycobacterium tuberculosis H37Rv
cgcagaaucgcauga

SEQ ID NO: 1288882 - RNA, 15 nt, Mycobacterium tuberculosis H37Rv
cgcagaaucgcacgc

SEQ ID NO: 1288883 - RNA, 18 nt, Mycobacterium tuberculosis H37Rv
cgcagaauccggcaacca

SEQ ID NO: 1288884 - RNA, 15 nt, Mycobacterium tuberculosis H37Rv
cgcaccgcccgccga

SEQ ID NO: 1288885 - RNA, 17 nt, Mycobacterium tuberculosis H37Rv
cgcaccgccacccugac

SEQ ID NO: 1288886 - RNA, 19 nt, Mycobacterium tuberculosis H37Rv
cgcaccgccacccugacca

SEQ ID NO: 1288887 - RNA, 17 nt, Mycobacterium tuberculosis H37Rv
cgcagcuuguccgguga

SEQ ID NO: 1288888 - RNA, 23 nt, Mycobacterium tuberculosis H37Rv
cgcagcguguugcguucggugau

SEQ ID NO: 1288889 - RNA, 16 nt, Mycobacterium tuberculosis H37Rv
cgcagcucgaccagga

SEQ ID NO: 1288890 - RNA, 18 nt, Mycobacterium tuberculosis H37Rv
cgcagcguuggccgcugu

SEQ ID NO: 1288891 - RNA, 15 nt, Mycobacterium tuberculosis H37Rv
cgcagcugccgcacc

SEQ ID NO: 1288892 - RNA, 17 nt, Mycobacterium tuberculosis H37Rv
cgcagcgugagugcagc

SEQ ID NO: 1288893 - RNA, 22 nt, Mycobacterium tuberculosis H37Rv
cgcagcgugagugcagcacgau

SEQ ID NO: 1288894 - RNA, 22 nt, Mycobacterium tuberculosis H37Rv
cgcagcggugaggugaccaacg

SEQ ID NO: 1288895 - RNA, 16 nt, Mycobacterium tuberculosis H37Rv
cgcagcgguccgccgc

SEQ ID NO: 1288896 - RNA, 15 nt, Mycobacterium tuberculosis H37Rv
cgcagcgggcggugu

SEQ ID NO: 1288897 - RNA, 20 nt, Mycobacterium tuberculosis H37Rv
cgcagcggcauccacaccga

SEQ ID NO: 1288898 - RNA, 19 nt, Mycobacterium tuberculosis H37Rv
cgcagcggcaaggucaacg

SEQ ID NO: 1288899 - RNA, 15 nt, Mycobacterium tuberculosis H37Rv
cgcagccgcucgacg

SEQ ID NO: 1288900 - RNA, 23 nt, Mycobacterium tuberculosis H37Rv
cgcagccgccucaaugaccaccg

SEQ ID NO: 1288901 - RNA, 19 nt, Mycobacterium tuberculosis H37Rv
cgcaguggcguuacgcucg

SEQ ID NO: 1288902 - RNA, 20 nt, Mycobacterium tuberculosis H37Rv
cgcaguggcguuacgcucgg

SEQ ID NO: 1288903 - RNA, 20 nt, Mycobacterium tuberculosis H37Rv
cgcagugacguuccgcucgc

SEQ ID NO: 1288904 - RNA, 15 nt, Mycobacterium tuberculosis H37Rv
cgcagugacguuccg

SEQ ID NO: 1288905 - RNA, 19 nt, Mycobacterium tuberculosis H37Rv
cgcaguccgguuacgcucg

SEQ ID NO: 1288906 - RNA, 15 nt, Mycobacterium tuberculosis H37Rv
cgcagucgggcagcg

SEQ ID NO: 1288907 - RNA, 18 nt, Mycobacterium tuberculosis H37Rv
cgcagucaacgcaaucga

SEQ ID NO: 1288908 - RNA, 23 nt, Mycobacterium tuberculosis H37Rv
cgcaguacuugaccguccaccga

SEQ ID NO: 1288909 - RNA, 15 nt, Mycobacterium tuberculosis H37Rv
cgcaguacuugaccg

SEQ ID NO: 1288910 - RNA, 18 nt, Mycobacterium tuberculosis H37Rv
cgcagggccgcgcgcacu

SEQ ID NO: 1288911 - RNA, 19 nt, Mycobacterium tuberculosis H37Rv
cgcauauugcggcgccgug

SEQ ID NO: 1288912 - RNA, 15 nt, Mycobacterium tuberculosis H37Rv
cgcaucaccagggug

SEQ ID NO: 1288913 - RNA, 16 nt, Mycobacterium tuberculosis H37Rv
cgcauagggccaccgc

SEQ ID NO: 1288914 - RNA, 20 nt, Mycobacterium tuberculosis H37Rv
cgcauaggcggccaucgacg

SEQ ID NO: 1288915 - RNA, 20 nt, Mycobacterium tuberculosis H37Rv
cgcaguuggcaccagccggu

SEQ ID NO: 1288916 - RNA, 22 nt, Mycobacterium tuberculosis H37Rv
cgcaguuggcaccagccgguga

SEQ ID NO: 1288917 - RNA, 13 nt, Mycobacterium tuberculosis H37Rv
cgcaguuggcacc

SEQ ID NO: 1288918 - RNA, 14 nt, Mycobacterium tuberculosis H37Rv
cgcauaaaucgggg

SEQ ID NO: 1288919 - RNA, 19 nt, Mycobacterium tuberculosis H37Rv
cgcauaacgccagucccgg

SEQ ID NO: 1288920 - RNA, 15 nt, Mycobacterium tuberculosis H37Rv
cgcauccgcgacggc

SEQ ID NO: 1288921 - RNA, 16 nt, Mycobacterium tuberculosis H37Rv
cgcaugccccgaccgc

SEQ ID NO: 1288922 - RNA, 14 nt, Mycobacterium tuberculosis H37Rv
cgcaugcucgaucg

SEQ ID NO: 1288923 - RNA, 20 nt, Mycobacterium tuberculosis H37Rv
cgcaugcucagcaucgucga

SEQ ID NO: 1288924 - RNA, 16 nt, Mycobacterium tuberculosis H37Rv
cgcaugcucacgaucu

SEQ ID NO: 1288925 - RNA, 22 nt, Mycobacterium tuberculosis H37Rv
cgcaugcucacgaucugcgcgu

SEQ ID NO: 1288926 - RNA, 17 nt, Mycobacterium tuberculosis H37Rv
cgcaugcgugacccgac

SEQ ID NO: 1288927 - RNA, 21 nt, Mycobacterium tuberculosis H37Rv
cgcaugccccgaccgcguaca

SEQ ID NO: 1288928 - RNA, 21 nt, Mycobacterium tuberculosis H37Rv
cgcaucauagacagggccgcu

SEQ ID NO: 1288929 - RNA, 22 nt, Mycobacterium tuberculosis H37Rv
cgcaucaugucgaagaaccggc

SEQ ID NO: 1288930 - RNA, 14 nt, Mycobacterium tuberculosis H37Rv
cgcauccagccgug

SEQ ID NO: 1288931 - RNA, 15 nt, Mycobacterium tuberculosis H37Rv
cgcauucugcugcca

SEQ ID NO: 1288932 - RNA, 15 nt, Mycobacterium tuberculosis H37Rv
cgccaaaacggucga

SEQ ID NO: 1288933 - RNA, 23 nt, Mycobacterium tuberculosis H37Rv
cgccaaaauccgcccaccggucg

SEQ ID NO: 1288934 - RNA, 19 nt, Mycobacterium tuberculosis H37Rv
cgccaaaacggucgaccgu

SEQ ID NO: 1288935 - RNA, 20 nt, Mycobacterium tuberculosis H37Rv
cgccaaacgcugcgcccgga

SEQ ID NO: 1288936 - RNA, 21 nt, Mycobacterium tuberculosis H37Rv
cgcauguuggugaucaaaccg

SEQ ID NO: 1288937 - RNA, 18 nt, Mycobacterium tuberculosis H37Rv
cgcauucggcgagccgcg

SEQ ID NO: 1288938 - RNA, 20 nt, Mycobacterium tuberculosis H37Rv
cgccaaccacuuuccggccg

SEQ ID NO: 1288939 - RNA, 22 nt, Mycobacterium tuberculosis H37Rv
cgccaaccacuuuccggccgau

SEQ ID NO: 1288940 - RNA, 20 nt, Mycobacterium tuberculosis H37Rv
cgccaaagccgggauugccg

SEQ ID NO: 1288941 - RNA, 16 nt, Mycobacterium tuberculosis H37Rv
cgccaaccuuugcguu

SEQ ID NO: 1288942 - RNA, 16 nt, Mycobacterium tuberculosis H37Rv
cgccaacgccagcggg

SEQ ID NO: 1288943 - RNA, 14 nt, Mycobacterium tuberculosis H37Rv
cgccaacggcaccu

SEQ ID NO: 1288944 - RNA, 20 nt, Mycobacterium tuberculosis H37Rv
cgccaaccgcgugcgucagc

SEQ ID NO: 1288945 - RNA, 14 nt, Mycobacterium tuberculosis H37Rv
cgcaccacaccgug

SEQ ID NO: 1288946 - RNA, 16 nt, Mycobacterium tuberculosis H37Rv
cgcaccacaccacggu

SEQ ID NO: 1288947 - RNA, 20 nt, Mycobacterium tuberculosis H37Rv
cgcaccaacguugugccgcu

SEQ ID NO: 1288948 - RNA, 19 nt, Mycobacterium tuberculosis H37Rv
cgcacauugguguccacca

SEQ ID NO: 1288949 - RNA, 16 nt, Mycobacterium tuberculosis H37Rv
cgcacagcggauucgg

SEQ ID NO: 1288950 - RNA, 21 nt, Mycobacterium tuberculosis H37Rv
cgcaccacgaugaucuugccg

SEQ ID NO: 1288951 - RNA, 15 nt, Mycobacterium tuberculosis H37Rv
cgcaccaccgucucg

SEQ ID NO: 1288952 - RNA, 19 nt, Mycobacterium tuberculosis H37Rv
cgcaccaccuccccgaucu

SEQ ID NO: 1288953 - RNA, 16 nt, Mycobacterium tuberculosis H37Rv
cgcaccaggcggccgu

SEQ ID NO: 1288954 - RNA, 14 nt, Mycobacterium tuberculosis H37Rv
cgcaccagcggcug

SEQ ID NO: 1288955 - RNA, 22 nt, Mycobacterium tuberculosis H37Rv
cgcaccagcggcugaccgggca

SEQ ID NO: 1288956 - RNA, 20 nt, Mycobacterium tuberculosis H37Rv
cgcaccgaugccuugaccgc

SEQ ID NO: 1288957 - RNA, 18 nt, Mycobacterium tuberculosis H37Rv
cgcaccgagcgagaccac

SEQ ID NO: 1288958 - RNA, 22 nt, Mycobacterium tuberculosis H37Rv
cgcaccgaaaccaugccgccga

SEQ ID NO: 1288959 - RNA, 18 nt, Mycobacterium tuberculosis H37Rv
cgcaccgaaacgccgacc

SEQ ID NO: 1288960 - RNA, 17 nt, Mycobacterium tuberculosis H37Rv
cgcacccugcgugcggc

SEQ ID NO: 1288961 - RNA, 13 nt, Mycobacterium tuberculosis H37Rv
cgcacccugggua

SEQ ID NO: 1288962 - RNA, 22 nt, Mycobacterium tuberculosis H37Rv
cgcaccccggcggcguccaucg

SEQ ID NO: 1288963 - RNA, 13 nt, Mycobacterium tuberculosis H37Rv
cgcacccgcucgg

SEQ ID NO: 1288964 - RNA, 14 nt, Mycobacterium tuberculosis H37Rv
cgcacccguccggc

SEQ ID NO: 1288965 - RNA, 21 nt, Mycobacterium tuberculosis H37Rv
cgcacccguugcgacaccucc

SEQ ID NO: 1288966 - RNA, 15 nt, Mycobacterium tuberculosis H37Rv
cgcacccgcucgucg

SEQ ID NO: 1288967 - RNA, 15 nt, Mycobacterium tuberculosis H37Rv
cgcacccggucgagc

SEQ ID NO: 1288968 - RNA, 19 nt, Mycobacterium tuberculosis H37Rv
cgcaccccggccgcgcgca

SEQ ID NO: 1288969 - RNA, 18 nt, Mycobacterium tuberculosis H37Rv
cgcacccaugaucccgcu

SEQ ID NO: 1288970 - RNA, 14 nt, Mycobacterium tuberculosis H37Rv
cgcacccagggcgu

SEQ ID NO: 1288971 - RNA, 20 nt, Mycobacterium tuberculosis H37Rv
cgcacccaugaucccgcuga

SEQ ID NO: 1288972 - RNA, 15 nt, Mycobacterium tuberculosis H37Rv
cgcacccccgucgau

SEQ ID NO: 1288973 - RNA, 17 nt, Mycobacterium tuberculosis H37Rv
cgcacccagaccgccga

SEQ ID NO: 1288974 - RNA, 16 nt, Mycobacterium tuberculosis H37Rv
cgcaccaugucgguga

SEQ ID NO: 1288975 - RNA, 14 nt, Mycobacterium tuberculosis H37Rv
cgcaccaguggcgc

SEQ ID NO: 1288976 - RNA, 17 nt, Mycobacterium tuberculosis H37Rv
cgcacaaaaucagcgau

SEQ ID NO: 1288977 - RNA, 22 nt, Mycobacterium tuberculosis H37Rv
cgcaauuccggugaucgcggug

SEQ ID NO: 1288978 - RNA, 20 nt, Mycobacterium tuberculosis H37Rv
cgcaaugccaaucgcacugg

SEQ ID NO: 1288979 - RNA, 12 nt, Mycobacterium tuberculosis H37Rv
cgcaaugcggcc

SEQ ID NO: 1288980 - RNA, 15 nt, Mycobacterium tuberculosis H37Rv
cgcacagcaccacgu

SEQ ID NO: 1288981 - RNA, 15 nt, Mycobacterium tuberculosis H37Rv
cgcacacgaucgcgg

SEQ ID NO: 1288982 - RNA, 22 nt, Mycobacterium tuberculosis H37Rv
cgcacaccggcuuugcuugccg

SEQ ID NO: 1288983 - RNA, 16 nt, Mycobacterium tuberculosis H37Rv
cgcacaccugcgcggc

SEQ ID NO: 1288984 - RNA, 19 nt, Mycobacterium tuberculosis H37Rv
cgcacagcccgaugccgug

SEQ ID NO: 1288985 - RNA, 14 nt, Mycobacterium tuberculosis H37Rv
cgcacaaacgggcg

SEQ ID NO: 1288986 - RNA, 13 nt, Mycobacterium tuberculosis H37Rv
cgcacaacugcgc

SEQ ID NO: 1288987 - RNA, 21 nt, Mycobacterium tuberculosis H37Rv
cgcacaaguucuucgacagcg

SEQ ID NO: 1288988 - RNA, 15 nt, Mycobacterium tuberculosis H37Rv
cgcacacccgguugg

SEQ ID NO: 1288989 - RNA, 17 nt, Mycobacterium tuberculosis H37Rv
cgcaagucuccucgaau

SEQ ID NO: 1288990 - RNA, 16 nt, Mycobacterium tuberculosis H37Rv
cgcaagaaugccgccg

SEQ ID NO: 1288991 - RNA, 19 nt, Mycobacterium tuberculosis H37Rv
cgcaacucccagcacggug

SEQ ID NO: 1288992 - RNA, 23 nt, Mycobacterium tuberculosis H37Rv
cgcaacucccagcacgguggcuu

SEQ ID NO: 1288993 - RNA, 21 nt, Mycobacterium tuberculosis H37Rv
cgcaauagaccgcagucgcug

SEQ ID NO: 1288994 - RNA, 22 nt, Mycobacterium tuberculosis H37Rv
cgcaauacccgagcguccggug

SEQ ID NO: 1288995 - RNA, 19 nt, Mycobacterium tuberculosis H37Rv
cgcaauauccggccgagcc

SEQ ID NO: 1288996 - RNA, 21 nt, Mycobacterium tuberculosis H37Rv
cgcaauaugccacagaccgaa

SEQ ID NO: 1288997 - RNA, 18 nt, Mycobacterium tuberculosis H37Rv
cgcaaucgacugaucgaa

SEQ ID NO: 1288998 - RNA, 14 nt, Mycobacterium tuberculosis H37Rv
cgcaaucgcgacgg

SEQ ID NO: 1288999 - RNA, 18 nt, Mycobacterium tuberculosis H37Rv
cgcaaucgucgccuucgg

SEQ ID NO: 1289000 - RNA, 18 nt, Mycobacterium tuberculosis H37Rv
cgaugcgugccgacccgc

SEQ ID NO: 1289001 - RNA, 20 nt, Mycobacterium tuberculosis H37Rv
cgaugcguucgggcuccagc

SEQ ID NO: 1289002 - RNA, 18 nt, Mycobacterium tuberculosis H37Rv
cgaugcucacuacccgca

SEQ ID NO: 1289003 - RNA, 21 nt, Mycobacterium tuberculosis H37Rv
cgaugcguccgcccagccgca

SEQ ID NO: 1289004 - RNA, 18 nt, Mycobacterium tuberculosis H37Rv
cgaugcccucgauggcca

SEQ ID NO: 1289005 - RNA, 20 nt, Mycobacterium tuberculosis H37Rv
cgaugcccuccucgaccgcg

SEQ ID NO: 1289006 - RNA, 16 nt, Mycobacterium tuberculosis H37Rv
cgaugcccaucacgcc

SEQ ID NO: 1289007 - RNA, 24 nt, Mycobacterium tuberculosis H37Rv
cgaugcugaucaccgucguacucg

SEQ ID NO: 1289008 - RNA, 22 nt, Mycobacterium tuberculosis H37Rv
cgaugcucgucccagaaccggc

SEQ ID NO: 1289009 - RNA, 20 nt, Mycobacterium tuberculosis H37Rv
cgaugcuggcaaaguaucgc

SEQ ID NO: 1289010 - RNA, 23 nt, Mycobacterium tuberculosis H37Rv
cgaugcugggcgagacggcguug

SEQ ID NO: 1289011 - RNA, 14 nt, Mycobacterium tuberculosis H37Rv
cgauggccgacgcu

SEQ ID NO: 1289012 - RNA, 16 nt, Mycobacterium tuberculosis H37Rv
cgauggccgacgcugc

SEQ ID NO: 1289013 - RNA, 19 nt, Mycobacterium tuberculosis H37Rv
cgauggcccggcucacagc

SEQ ID NO: 1289014 - RNA, 17 nt, Mycobacterium tuberculosis H37Rv
cgauggccaguucuuca

SEQ ID NO: 1289015 - RNA, 18 nt, Mycobacterium tuberculosis H37Rv
cgauggccaucaucgacg

SEQ ID NO: 1289016 - RNA, 23 nt, Mycobacterium tuberculosis H37Rv
cgaugucgacucguggcgccacg

SEQ ID NO: 1289017 - RNA, 19 nt, Mycobacterium tuberculosis H37Rv
cgauguccgacgccaccgc

SEQ ID NO: 1289018 - RNA, 18 nt, Mycobacterium tuberculosis H37Rv
cgauguccgcagcaccgu

SEQ ID NO: 1289019 - RNA, 20 nt, Mycobacterium tuberculosis H37Rv
cgauguccgcagcaccgucg

SEQ ID NO: 1289020 - RNA, 22 nt, Mycobacterium tuberculosis H37Rv
cgauggucuccucggucaccga

SEQ ID NO: 1289021 - RNA, 14 nt, Mycobacterium tuberculosis H37Rv
cgauggugaugggg

SEQ ID NO: 1289022 - RNA, 17 nt, Mycobacterium tuberculosis H37Rv
cgauggugccgacccgc

SEQ ID NO: 1289023 - RNA, 12 nt, Mycobacterium tuberculosis H37Rv
cgauggcgucgg

SEQ ID NO: 1289024 - RNA, 15 nt, Mycobacterium tuberculosis H37Rv
cgauggcgucgccgg

SEQ ID NO: 1289025 - RNA, 18 nt, Mycobacterium tuberculosis H37Rv
cgauggcgguggggcugu

SEQ ID NO: 1289026 - RNA, 20 nt, Mycobacterium tuberculosis H37Rv
cgauggccgccaguucuucg

SEQ ID NO: 1289027 - RNA, 18 nt, Mycobacterium tuberculosis H37Rv
cgauggcuaccuuggacu

SEQ ID NO: 1289028 - RNA, 16 nt, Mycobacterium tuberculosis H37Rv
cgauggcgucggccag

SEQ ID NO: 1289029 - RNA, 21 nt, Mycobacterium tuberculosis H37Rv
cgauggucuccucggucaccg

SEQ ID NO: 1289030 - RNA, 15 nt, Mycobacterium tuberculosis H37Rv
cgcaaccgccgccau

SEQ ID NO: 1289031 - RNA, 14 nt, Mycobacterium tuberculosis H37Rv
cgcaacccggacga

SEQ ID NO: 1289032 - RNA, 19 nt, Mycobacterium tuberculosis H37Rv
cgcaacccugccgcgauga

SEQ ID NO: 1289033 - RNA, 19 nt, Mycobacterium tuberculosis H37Rv
cgcaaccgggccucaugcu

SEQ ID NO: 1289034 - RNA, 21 nt, Mycobacterium tuberculosis H37Rv
cgcaaccacgccccgaucggu

SEQ ID NO: 1289035 - RNA, 18 nt, Mycobacterium tuberculosis H37Rv
cgcaacgggacgucaccg

SEQ ID NO: 1289036 - RNA, 16 nt, Mycobacterium tuberculosis H37Rv
cgcaacgggacgucac

SEQ ID NO: 1289037 - RNA, 17 nt, Mycobacterium tuberculosis H37Rv
cgcaacgggacgucacc

SEQ ID NO: 1289038 - RNA, 17 nt, Mycobacterium tuberculosis H37Rv
cgcaaccggccguccag

SEQ ID NO: 1289039 - RNA, 16 nt, Mycobacterium tuberculosis H37Rv
cgcaaaaucgucagcg

SEQ ID NO: 1289040 - RNA, 17 nt, Mycobacterium tuberculosis H37Rv
cgcaacaucggaugacc

SEQ ID NO: 1289041 - RNA, 16 nt, Mycobacterium tuberculosis H37Rv
cgcaaagacagcgcgg

SEQ ID NO: 1289042 - RNA, 18 nt, Mycobacterium tuberculosis H37Rv
cgcaaagacagcgcggga

SEQ ID NO: 1289043 - RNA, 15 nt, Mycobacterium tuberculosis H37Rv
cgauugcugcggcuu

SEQ ID NO: 1289044 - RNA, 15 nt, Mycobacterium tuberculosis H37Rv
cgauuggaccgccaa

SEQ ID NO: 1289045 - RNA, 16 nt, Mycobacterium tuberculosis H37Rv
cgauuggaccgccaau

SEQ ID NO: 1289046 - RNA, 22 nt, Mycobacterium tuberculosis H37Rv
cgauuccgcgucugcucggcgg

SEQ ID NO: 1289047 - RNA, 22 nt, Mycobacterium tuberculosis H37Rv
cgauuccggaguucuuguagcc

SEQ ID NO: 1289048 - RNA, 18 nt, Mycobacterium tuberculosis H37Rv
cgauucgcggcagccggc

SEQ ID NO: 1289049 - RNA, 16 nt, Mycobacterium tuberculosis H37Rv
cgauucggcgacgaac

SEQ ID NO: 1289050 - RNA, 12 nt, Mycobacterium tuberculosis H37Rv
cgauugccacca

SEQ ID NO: 1289051 - RNA, 18 nt, Mycobacterium tuberculosis H37Rv
cgauugcccgcgcucgca

SEQ ID NO: 1289052 - RNA, 19 nt, Mycobacterium tuberculosis H37Rv
cgaugugaaccgggcacca

SEQ ID NO: 1289053 - RNA, 13 nt, Mycobacterium tuberculosis H37Rv
cgauuccaggaug

SEQ ID NO: 1289054 - RNA, 18 nt, Mycobacterium tuberculosis H37Rv
cgauuccaggauggccau

SEQ ID NO: 1289055 - RNA, 19 nt, Mycobacterium tuberculosis H37Rv
cgauuccgcgucugcucgc

SEQ ID NO: 1289056 - RNA, 19 nt, Mycobacterium tuberculosis H37Rv
cgauuccgaacuggucgac

SEQ ID NO: 1289057 - RNA, 18 nt, Mycobacterium tuberculosis H37Rv
cgaugucguaccgggcga

SEQ ID NO: 1289058 - RNA, 14 nt, Mycobacterium tuberculosis H37Rv
cgaugucggcacca

SEQ ID NO: 1289059 - RNA, 14 nt, Mycobacterium tuberculosis H37Rv
cgaugucgucguug

SEQ ID NO: 1289060 - RNA, 16 nt, Mycobacterium tuberculosis H37Rv
cgaugucgcgcauugc

SEQ ID NO: 1289061 - RNA, 12 nt, Mycobacterium tuberculosis H37Rv
cgaucaccagcc

SEQ ID NO: 1289062 - RNA, 22 nt, Mycobacterium tuberculosis H37Rv
cgaucacaccacgguuggccac

SEQ ID NO: 1289063 - RNA, 15 nt, Mycobacterium tuberculosis H37Rv
cgaucaccugcagca

SEQ ID NO: 1289064 - RNA, 14 nt, Mycobacterium tuberculosis H37Rv
cgaucacggcaccg

SEQ ID NO: 1289065 - RNA, 20 nt, Mycobacterium tuberculosis H37Rv
cgaucagccgggugcgcacc

SEQ ID NO: 1289066 - RNA, 12 nt, Mycobacterium tuberculosis H37Rv
cgaucagcaggg

SEQ ID NO: 1289067 - RNA, 17 nt, Mycobacterium tuberculosis H37Rv
cgaucagcccggccuug

SEQ ID NO: 1289068 - RNA, 20 nt, Mycobacterium tuberculosis H37Rv
cgaucagcagggcggcguua

SEQ ID NO: 1289069 - RNA, 17 nt, Mycobacterium tuberculosis H37Rv
cgaucagcagccgccga

SEQ ID NO: 1289070 - RNA, 14 nt, Mycobacterium tuberculosis H37Rv
cgaucacggcggga

SEQ ID NO: 1289071 - RNA, 22 nt, Mycobacterium tuberculosis H37Rv
cgauccagggucaccucgucgc

SEQ ID NO: 1289072 - RNA, 15 nt, Mycobacterium tuberculosis H37Rv
cgauccccaggccgc

SEQ ID NO: 1289073 - RNA, 16 nt, Mycobacterium tuberculosis H37Rv
cgauccccagcaccac

SEQ ID NO: 1289074 - RNA, 15 nt, Mycobacterium tuberculosis H37Rv
cgauccccgacgucg

SEQ ID NO: 1289075 - RNA, 20 nt, Mycobacterium tuberculosis H37Rv
cgauccucgcccgcaccagc

SEQ ID NO: 1289076 - RNA, 13 nt, Mycobacterium tuberculosis H37Rv
cgauccagcaggc

SEQ ID NO: 1289077 - RNA, 20 nt, Mycobacterium tuberculosis H37Rv
cgauccagggucaccucguc

SEQ ID NO: 1289078 - RNA, 13 nt, Mycobacterium tuberculosis H37Rv
cgauccagacggu

SEQ ID NO: 1289079 - RNA, 23 nt, Mycobacterium tuberculosis H37Rv
cgaucaucgggguggccaccagc

SEQ ID NO: 1289080 - RNA, 22 nt, Mycobacterium tuberculosis H37Rv
cgaucaucauauccgccccagc

SEQ ID NO: 1289081 - RNA, 16 nt, Mycobacterium tuberculosis H37Rv
cgaucaucgaccuggc

SEQ ID NO: 1289082 - RNA, 15 nt, Mycobacterium tuberculosis H37Rv
cgauaucgcugcgga

SEQ ID NO: 1289083 - RNA, 22 nt, Mycobacterium tuberculosis H37Rv
cgauaucgggcucagcggcgac

SEQ ID NO: 1289084 - RNA, 16 nt, Mycobacterium tuberculosis H37Rv
cgauaucggcggcuug

SEQ ID NO: 1289085 - RNA, 15 nt, Mycobacterium tuberculosis H37Rv
cgaucaacgcgcacg

SEQ ID NO: 1289086 - RNA, 13 nt, Mycobacterium tuberculosis H37Rv
cgaucaagccuuc

SEQ ID NO: 1289087 - RNA, 18 nt, Mycobacterium tuberculosis H37Rv
cgaucaagccuucgucga

SEQ ID NO: 1289088 - RNA, 14 nt, Mycobacterium tuberculosis H37Rv
cgaucaacgcguug

SEQ ID NO: 1289089 - RNA, 21 nt, Mycobacterium tuberculosis H37Rv
cgaucaaugcgaugcggucgu

SEQ ID NO: 1289090 - RNA, 16 nt, Mycobacterium tuberculosis H37Rv
cgauauaggacgccgc

SEQ ID NO: 1289091 - RNA, 14 nt, Mycobacterium tuberculosis H37Rv
cgauaggugagcgc

SEQ ID NO: 1289092 - RNA, 18 nt, Mycobacterium tuberculosis H37Rv
cgauagccaccgacgaca

SEQ ID NO: 1289093 - RNA, 22 nt, Mycobacterium tuberculosis H37Rv
cgauacaacgcggcuuugccgg

SEQ ID NO: 1289094 - RNA, 21 nt, Mycobacterium tuberculosis H37Rv
cgaggcguucaccacgaucgc

SEQ ID NO: 1289095 - RNA, 18 nt, Mycobacterium tuberculosis H37Rv
cgaggcggaugcgguaag

SEQ ID NO: 1289096 - RNA, 20 nt, Mycobacterium tuberculosis H37Rv
cgaugauggcgcgaucggug

SEQ ID NO: 1289097 - RNA, 18 nt, Mycobacterium tuberculosis H37Rv
cgaugauggacaccagcc

SEQ ID NO: 1289098 - RNA, 19 nt, Mycobacterium tuberculosis H37Rv
cgaugaugcggcgcagcga

SEQ ID NO: 1289099 - RNA, 13 nt, Mycobacterium tuberculosis H37Rv
cgaugauggcggu

SEQ ID NO: 1289100 - RNA, 19 nt, Mycobacterium tuberculosis H37Rv
cgaugauggcgguaccggg

SEQ ID NO: 1289101 - RNA, 15 nt, Mycobacterium tuberculosis H37Rv
cgaugaugucggccg

SEQ ID NO: 1289102 - RNA, 18 nt, Mycobacterium tuberculosis H37Rv
cgaugaugugcgaccaca

SEQ ID NO: 1289103 - RNA, 16 nt, Mycobacterium tuberculosis H37Rv
cgaugaucgcaucgac

SEQ ID NO: 1289104 - RNA, 19 nt, Mycobacterium tuberculosis H37Rv
cgaugaugcgcucggccug

SEQ ID NO: 1289105 - RNA, 13 nt, Mycobacterium tuberculosis H37Rv
cgaugaugcggcg

SEQ ID NO: 1289106 - RNA, 22 nt, Mycobacterium tuberculosis H37Rv
cgaugacgccgucagcggccaa

SEQ ID NO: 1289107 - RNA, 12 nt, Mycobacterium tuberculosis H37Rv
cgaugacgccgu

SEQ ID NO: 1289108 - RNA, 23 nt, Mycobacterium tuberculosis H37Rv
cgaugaccagauguaccucaucg

SEQ ID NO: 1289109 - RNA, 18 nt, Mycobacterium tuberculosis H37Rv
cgaugaccacgccgacga

SEQ ID NO: 1289110 - RNA, 16 nt, Mycobacterium tuberculosis H37Rv
cgaugacgaagugcag

SEQ ID NO: 1289111 - RNA, 19 nt, Mycobacterium tuberculosis H37Rv
cgaugacgaacggacccgg

SEQ ID NO: 1289112 - RNA, 19 nt, Mycobacterium tuberculosis H37Rv
cgaugacaaucaccuggua

SEQ ID NO: 1289113 - RNA, 18 nt, Mycobacterium tuberculosis H37Rv
cgaugacagacaucgcga

SEQ ID NO: 1289114 - RNA, 17 nt, Mycobacterium tuberculosis H37Rv
cgaugaaccgggcagca

SEQ ID NO: 1289115 - RNA, 13 nt, Mycobacterium tuberculosis H37Rv
cgaucuucucgcg

SEQ ID NO: 1289116 - RNA, 15 nt, Mycobacterium tuberculosis H37Rv
cgaucuucucgcgga

SEQ ID NO: 1289117 - RNA, 22 nt, Mycobacterium tuberculosis H37Rv
cgaucuucucgcggacggauuc

SEQ ID NO: 1289118 - RNA, 23 nt, Mycobacterium tuberculosis H37Rv
cgaucucgucgcggucgaucaca

SEQ ID NO: 1289119 - RNA, 22 nt, Mycobacterium tuberculosis H37Rv
cgaucucgucgcggucgaucac

SEQ ID NO: 1289120 - RNA, 15 nt, Mycobacterium tuberculosis H37Rv
cgaucuuggccaccg

SEQ ID NO: 1289121 - RNA, 17 nt, Mycobacterium tuberculosis H37Rv
cgaucuuggaucgguug

SEQ ID NO: 1289122 - RNA, 13 nt, Mycobacterium tuberculosis H37Rv
cgaugaacagcga

SEQ ID NO: 1289123 - RNA, 18 nt, Mycobacterium tuberculosis H37Rv
cgaucgacaccagggcgu

SEQ ID NO: 1289124 - RNA, 21 nt, Mycobacterium tuberculosis H37Rv
cgaucgaauugcguucgccgc

SEQ ID NO: 1289125 - RNA, 13 nt, Mycobacterium tuberculosis H37Rv
cgaucgacaccag

SEQ ID NO: 1289126 - RNA, 15 nt, Mycobacterium tuberculosis H37Rv
cgaucgccaggccga

SEQ ID NO: 1289127 - RNA, 23 nt, Mycobacterium tuberculosis H37Rv
cgaucgccgcgaagcgcucggca

SEQ ID NO: 1289128 - RNA, 16 nt, Mycobacterium tuberculosis H37Rv
cgaucgccgcgaagcg

SEQ ID NO: 1289129 - RNA, 18 nt, Mycobacterium tuberculosis H37Rv
cgaucgccgcgcuggucg

SEQ ID NO: 1289130 - RNA, 15 nt, Mycobacterium tuberculosis H37Rv
cgaucgcgacccgau

SEQ ID NO: 1289131 - RNA, 14 nt, Mycobacterium tuberculosis H37Rv
cgaucgcgagccca

SEQ ID NO: 1289132 - RNA, 18 nt, Mycobacterium tuberculosis H37Rv
cgaucgccugagacucgc

SEQ ID NO: 1289133 - RNA, 21 nt, Mycobacterium tuberculosis H37Rv
cgaucgcggucuugacaccgc

SEQ ID NO: 1289134 - RNA, 14 nt, Mycobacterium tuberculosis H37Rv
cgaucgcgcuggga

SEQ ID NO: 1289135 - RNA, 16 nt, Mycobacterium tuberculosis H37Rv
cgaucgcgccgucggc

SEQ ID NO: 1289136 - RNA, 20 nt, Mycobacterium tuberculosis H37Rv
cgaucgcgccgucggcgaug

SEQ ID NO: 1289137 - RNA, 16 nt, Mycobacterium tuberculosis H37Rv
cgaucgcucauucgug

SEQ ID NO: 1289138 - RNA, 22 nt, Mycobacterium tuberculosis H37Rv
cgaucgcuccggcccugccgcc

SEQ ID NO: 1289139 - RNA, 13 nt, Mycobacterium tuberculosis H37Rv
cgaucggccacca

SEQ ID NO: 1289140 - RNA, 23 nt, Mycobacterium tuberculosis H37Rv
cgaucggcugguuacucaccaac

SEQ ID NO: 1289141 - RNA, 18 nt, Mycobacterium tuberculosis H37Rv
cgaucggccagggugucc

SEQ ID NO: 1289142 - RNA, 13 nt, Mycobacterium tuberculosis H37Rv
cgaucucggccag

SEQ ID NO: 1289143 - RNA, 19 nt, Mycobacterium tuberculosis H37Rv
cgaucgucaacgacgacga

SEQ ID NO: 1289144 - RNA, 15 nt, Mycobacterium tuberculosis H37Rv
cgaucgucaacgacg

SEQ ID NO: 1289145 - RNA, 18 nt, Mycobacterium tuberculosis H37Rv
cgaucgggcuucggccag

SEQ ID NO: 1289146 - RNA, 22 nt, Mycobacterium tuberculosis H37Rv
cgaucgggcucacucgccgaau

SEQ ID NO: 1289147 - RNA, 18 nt, Mycobacterium tuberculosis H37Rv
cgaucggcucacgacugc

SEQ ID NO: 1289148 - RNA, 15 nt, Mycobacterium tuberculosis H37Rv
cgaucggggcgacga

SEQ ID NO: 1289149 - RNA, 15 nt, Mycobacterium tuberculosis H37Rv
cgaucggggcgguga

SEQ ID NO: 1289150 - RNA, 16 nt, Mycobacterium tuberculosis H37Rv
cgaucggucguccgga

SEQ ID NO: 1289151 - RNA, 16 nt, Mycobacterium tuberculosis H37Rv
cgaucggugcgaucag

SEQ ID NO: 1289152 - RNA, 23 nt, Mycobacterium tuberculosis H37Rv
cgaucggugccgaagcugcccaa

SEQ ID NO: 1289153 - RNA, 19 nt, Mycobacterium tuberculosis H37Rv
ccggacguucuggaucgug

SEQ ID NO: 1289154 - RNA, 14 nt, Mycobacterium tuberculosis H37Rv
ccggacuaccgccg

SEQ ID NO: 1289155 - RNA, 13 nt, Mycobacterium tuberculosis H37Rv
ccggaggcaaucc

SEQ ID NO: 1289156 - RNA, 22 nt, Mycobacterium tuberculosis H37Rv
ccggagaucuugcgcaaugccg

SEQ ID NO: 1289157 - RNA, 15 nt, Mycobacterium tuberculosis H37Rv
ccggagccgaaccca

SEQ ID NO: 1289158 - RNA, 16 nt, Mycobacterium tuberculosis H37Rv
ccggagacgucgccgc

SEQ ID NO: 1289159 - RNA, 22 nt, Mycobacterium tuberculosis H37Rv
ccggacccgcccuugccgccga

SEQ ID NO: 1289160 - RNA, 16 nt, Mycobacterium tuberculosis H37Rv
ccggaccgaugguuga

SEQ ID NO: 1289161 - RNA, 14 nt, Mycobacterium tuberculosis H37Rv
ccggaccugaccgg

SEQ ID NO: 1289162 - RNA, 23 nt, Mycobacterium tuberculosis H37Rv
ccggacgaaacgaucgcgccauc

SEQ ID NO: 1289163 - RNA, 12 nt, Mycobacterium tuberculosis H37Rv
ccggacgauggc

SEQ ID NO: 1289164 - RNA, 23 nt, Mycobacterium tuberculosis H37Rv
ccggacaacagagucaccgcgcu

SEQ ID NO: 1289165 - RNA, 14 nt, Mycobacterium tuberculosis H37Rv
ccggacagcgcauc

SEQ ID NO: 1289166 - RNA, 21 nt, Mycobacterium tuberculosis H37Rv
ccggacaggcuugacugcaca

SEQ ID NO: 1289167 - RNA, 13 nt, Mycobacterium tuberculosis H37Rv
ccggacauccgau

SEQ ID NO: 1289168 - RNA, 20 nt, Mycobacterium tuberculosis H37Rv
ccggaugacaccgaccgggu

SEQ ID NO: 1289169 - RNA, 17 nt, Mycobacterium tuberculosis H37Rv
ccggaugacaccgaccg

SEQ ID NO: 1289170 - RNA, 14 nt, Mycobacterium tuberculosis H37Rv
ccggaucgucgaac

SEQ ID NO: 1289171 - RNA, 20 nt, Mycobacterium tuberculosis H37Rv
ccggaucggccuguccaccg

SEQ ID NO: 1289172 - RNA, 18 nt, Mycobacterium tuberculosis H37Rv
ccggaucgggaccgggaa

SEQ ID NO: 1289173 - RNA, 15 nt, Mycobacterium tuberculosis H37Rv
ccggaugcgcaaccg

SEQ ID NO: 1289174 - RNA, 19 nt, Mycobacterium tuberculosis H37Rv
ccggaugcugucagcagcc

SEQ ID NO: 1289175 - RNA, 15 nt, Mycobacterium tuberculosis H37Rv
ccggauguccgccga

SEQ ID NO: 1289176 - RNA, 22 nt, Mycobacterium tuberculosis H37Rv
ccggauugaagucgucggccau

SEQ ID NO: 1289177 - RNA, 17 nt, Mycobacterium tuberculosis H37Rv
ccggauugacgccgaau

SEQ ID NO: 1289178 - RNA, 18 nt, Mycobacterium tuberculosis H37Rv
ccggauugaagucgucgg

SEQ ID NO: 1289179 - RNA, 17 nt, Mycobacterium tuberculosis H37Rv
ccggauucuucggugaa

SEQ ID NO: 1289180 - RNA, 16 nt, Mycobacterium tuberculosis H37Rv
ccggauagacggcgac

SEQ ID NO: 1289181 - RNA, 18 nt, Mycobacterium tuberculosis H37Rv
ccggauagacgugcacca

SEQ ID NO: 1289182 - RNA, 15 nt, Mycobacterium tuberculosis H37Rv
ccggauacgggcguu

SEQ ID NO: 1289183 - RNA, 14 nt, Mycobacterium tuberculosis H37Rv
ccggagucgacgac

SEQ ID NO: 1289184 - RNA, 17 nt, Mycobacterium tuberculosis H37Rv
ccggagucgucggcaac

SEQ ID NO: 1289185 - RNA, 20 nt, Mycobacterium tuberculosis H37Rv
ccggaguugucgacggccac

SEQ ID NO: 1289186 - RNA, 14 nt, Mycobacterium tuberculosis H37Rv
ccggauagcaccgg

SEQ ID NO: 1289187 - RNA, 17 nt, Mycobacterium tuberculosis H37Rv
ccggauagcaccggcac

SEQ ID NO: 1289188 - RNA, 13 nt, Mycobacterium tuberculosis H37Rv
ccggauccgccag

SEQ ID NO: 1289189 - RNA, 20 nt, Mycobacterium tuberculosis H37Rv
ccggaucgccgaaucggcag

SEQ ID NO: 1289190 - RNA, 12 nt, Mycobacterium tuberculosis H37Rv
ccggaucgaaac

SEQ ID NO: 1289191 - RNA, 13 nt, Mycobacterium tuberculosis H37Rv
ccggaucggccug

SEQ ID NO: 1289192 - RNA, 17 nt, Mycobacterium tuberculosis H37Rv
ccggauccgccagaccg

SEQ ID NO: 1289193 - RNA, 15 nt, Mycobacterium tuberculosis H37Rv
ccggauccucggccg

SEQ ID NO: 1289194 - RNA, 21 nt, Mycobacterium tuberculosis H37Rv
ccggccacgguccggcccacc

SEQ ID NO: 1289195 - RNA, 13 nt, Mycobacterium tuberculosis H37Rv
ccggccacgaccu

SEQ ID NO: 1289196 - RNA, 13 nt, Mycobacterium tuberculosis H37Rv
ccggccagauggu

SEQ ID NO: 1289197 - RNA, 15 nt, Mycobacterium tuberculosis H37Rv
ccggccagccgacgc

SEQ ID NO: 1289198 - RNA, 13 nt, Mycobacterium tuberculosis H37Rv
ccggcaucgcgcg

SEQ ID NO: 1289199 - RNA, 21 nt, Mycobacterium tuberculosis H37Rv
ccggcaugcccgcggugacca

SEQ ID NO: 1289200 - RNA, 12 nt, Mycobacterium tuberculosis H37Rv
ccggcaugccag

SEQ ID NO: 1289201 - RNA, 20 nt, Mycobacterium tuberculosis H37Rv
ccggcaucuccaccgucgcc

SEQ ID NO: 1289202 - RNA, 22 nt, Mycobacterium tuberculosis H37Rv
ccggcaugccgccaugcgcacc

SEQ ID NO: 1289203 - RNA, 18 nt, Mycobacterium tuberculosis H37Rv
ccggcaugcgugccggca

SEQ ID NO: 1289204 - RNA, 16 nt, Mycobacterium tuberculosis H37Rv
ccggcauggcggcaua

SEQ ID NO: 1289205 - RNA, 23 nt, Mycobacterium tuberculosis H37Rv
ccggcauggcggcauagccgaac

SEQ ID NO: 1289206 - RNA, 21 nt, Mycobacterium tuberculosis H37Rv
ccggcagcgucggccgguacg

SEQ ID NO: 1289207 - RNA, 20 nt, Mycobacterium tuberculosis H37Rv
ccggcagcgguaagcgcauc

SEQ ID NO: 1289208 - RNA, 19 nt, Mycobacterium tuberculosis H37Rv
ccggcaggcuaaucagcca

SEQ ID NO: 1289209 - RNA, 19 nt, Mycobacterium tuberculosis H37Rv
ccggcagcugcucggucag

SEQ ID NO: 1289210 - RNA, 12 nt, Mycobacterium tuberculosis H37Rv
ccggcagcgaug

SEQ ID NO: 1289211 - RNA, 15 nt, Mycobacterium tuberculosis H37Rv
ccggcaacagcacca

SEQ ID NO: 1289212 - RNA, 15 nt, Mycobacterium tuberculosis H37Rv
ccggcaacgcggcuc

SEQ ID NO: 1289213 - RNA, 18 nt, Mycobacterium tuberculosis H37Rv
ccggcaagccacgccggu

SEQ ID NO: 1289214 - RNA, 16 nt, Mycobacterium tuberculosis H37Rv
ccggcaagcacaccgc

SEQ ID NO: 1289215 - RNA, 19 nt, Mycobacterium tuberculosis H37Rv
ccggcaaugccgcggccag

SEQ ID NO: 1289216 - RNA, 17 nt, Mycobacterium tuberculosis H37Rv
ccggcaaucggcggcac

SEQ ID NO: 1289217 - RNA, 16 nt, Mycobacterium tuberculosis H37Rv
ccggcaccagcggcac

SEQ ID NO: 1289218 - RNA, 19 nt, Mycobacterium tuberculosis H37Rv
ccggcaccaacgccaccgu

SEQ ID NO: 1289219 - RNA, 17 nt, Mycobacterium tuberculosis H37Rv
ccggcaccagcggcacc

SEQ ID NO: 1289220 - RNA, 13 nt, Mycobacterium tuberculosis H37Rv
ccggcacccaguu

SEQ ID NO: 1289221 - RNA, 20 nt, Mycobacterium tuberculosis H37Rv
ccggcacccgcacggccucc

SEQ ID NO: 1289222 - RNA, 20 nt, Mycobacterium tuberculosis H37Rv
ccggcacccgcggcgaaccg

SEQ ID NO: 1289223 - RNA, 19 nt, Mycobacterium tuberculosis H37Rv
ccggcacggugucgcgcga

SEQ ID NO: 1289224 - RNA, 15 nt, Mycobacterium tuberculosis H37Rv
ccggcaccgccggca

SEQ ID NO: 1289225 - RNA, 13 nt, Mycobacterium tuberculosis H37Rv
ccggcaccggaug

SEQ ID NO: 1289226 - RNA, 16 nt, Mycobacterium tuberculosis H37Rv
ccggcacccggugaga

SEQ ID NO: 1289227 - RNA, 15 nt, Mycobacterium tuberculosis H37Rv
ccggcaccgagucua

SEQ ID NO: 1289228 - RNA, 16 nt, Mycobacterium tuberculosis H37Rv
ccggcacgcagccaau

SEQ ID NO: 1289229 - RNA, 21 nt, Mycobacterium tuberculosis H37Rv
ccggcaccuccgccggcaccu

SEQ ID NO: 1289230 - RNA, 23 nt, Mycobacterium tuberculosis H37Rv
ccggcaccuccgccggcaccucc

SEQ ID NO: 1289231 - RNA, 20 nt, Mycobacterium tuberculosis H37Rv
ccgcgcuaaugucgauuucg

SEQ ID NO: 1289232 - RNA, 15 nt, Mycobacterium tuberculosis H37Rv
ccgcgcucucgguca

SEQ ID NO: 1289233 - RNA, 18 nt, Mycobacterium tuberculosis H37Rv
ccgcgcgggucacgaccu

SEQ ID NO: 1289234 - RNA, 17 nt, Mycobacterium tuberculosis H37Rv
ccgcgcgguacugcgca

SEQ ID NO: 1289235 - RNA, 13 nt, Mycobacterium tuberculosis H37Rv
ccgcgcguucggc

SEQ ID NO: 1289236 - RNA, 16 nt, Mycobacterium tuberculosis H37Rv
ccgcgcguucggcgag

SEQ ID NO: 1289237 - RNA, 14 nt, Mycobacterium tuberculosis H37Rv
ccgcgccgaacacg

SEQ ID NO: 1289238 - RNA, 22 nt, Mycobacterium tuberculosis H37Rv
ccgcgcccggcgcuagcgccgc

SEQ ID NO: 1289239 - RNA, 22 nt, Mycobacterium tuberculosis H37Rv
ccgcgcccggcgcaagcgccgc

SEQ ID NO: 1289240 - RNA, 22 nt, Mycobacterium tuberculosis H37Rv
ccgcgcuucacagccaccagcc

SEQ ID NO: 1289241 - RNA, 20 nt, Mycobacterium tuberculosis H37Rv
ccgcggaauccgcggcgauc

SEQ ID NO: 1289242 - RNA, 16 nt, Mycobacterium tuberculosis H37Rv
ccgcggacucgggcag

SEQ ID NO: 1289243 - RNA, 19 nt, Mycobacterium tuberculosis H37Rv
ccgcggacguggucggagc

SEQ ID NO: 1289244 - RNA, 23 nt, Mycobacterium tuberculosis H37Rv
ccgcggacggcgaacuuggccga

SEQ ID NO: 1289245 - RNA, 19 nt, Mycobacterium tuberculosis H37Rv
ccgcgcuugcgaucggcac

SEQ ID NO: 1289246 - RNA, 23 nt, Mycobacterium tuberculosis H37Rv
ccgcgcugguugaacauguccag

SEQ ID NO: 1289247 - RNA, 18 nt, Mycobacterium tuberculosis H37Rv
ccgcgcuggugauucgca

SEQ ID NO: 1289248 - RNA, 22 nt, Mycobacterium tuberculosis H37Rv
ccgcggcagcggauacauuucg

SEQ ID NO: 1289249 - RNA, 17 nt, Mycobacterium tuberculosis H37Rv
ccgcggcacgcuccagc

SEQ ID NO: 1289250 - RNA, 22 nt, Mycobacterium tuberculosis H37Rv
ccgcggcagcguugacggucag

SEQ ID NO: 1289251 - RNA, 13 nt, Mycobacterium tuberculosis H37Rv
ccgcggcagcacg

SEQ ID NO: 1289252 - RNA, 15 nt, Mycobacterium tuberculosis H37Rv
ccgcggccaccaccg

SEQ ID NO: 1289253 - RNA, 23 nt, Mycobacterium tuberculosis H37Rv
ccgcggucucagugcucgcccag

SEQ ID NO: 1289254 - RNA, 15 nt, Mycobacterium tuberculosis H37Rv
ccgcgucgagcaccu

SEQ ID NO: 1289255 - RNA, 18 nt, Mycobacterium tuberculosis H37Rv
ccgcguaauucgacuucg

SEQ ID NO: 1289256 - RNA, 23 nt, Mycobacterium tuberculosis H37Rv
ccgcguaauucgacuucgggguc

SEQ ID NO: 1289257 - RNA, 18 nt, Mycobacterium tuberculosis H37Rv
ccgcggucagcucggcag

SEQ ID NO: 1289258 - RNA, 19 nt, Mycobacterium tuberculosis H37Rv
ccgcggucagcucggcagc

SEQ ID NO: 1289259 - RNA, 17 nt, Mycobacterium tuberculosis H37Rv
ccgcgggugcggcaugg

SEQ ID NO: 1289260 - RNA, 23 nt, Mycobacterium tuberculosis H37Rv
ccgcgguugugcugggugccgca

SEQ ID NO: 1289261 - RNA, 22 nt, Mycobacterium tuberculosis H37Rv
ccgcggucuucuucaccgccuu

SEQ ID NO: 1289262 - RNA, 22 nt, Mycobacterium tuberculosis H37Rv
ccgcggucugcgccuucgccag

SEQ ID NO: 1289263 - RNA, 21 nt, Mycobacterium tuberculosis H37Rv
ccgcggucugcgccuucgcca

SEQ ID NO: 1289264 - RNA, 20 nt, Mycobacterium tuberculosis H37Rv
ccgcggucucggugccgagc

SEQ ID NO: 1289265 - RNA, 23 nt, Mycobacterium tuberculosis H37Rv
ccgcggucgaucaggccguguac

SEQ ID NO: 1289266 - RNA, 22 nt, Mycobacterium tuberculosis H37Rv
ccgcggucgccaagaucgggug

SEQ ID NO: 1289267 - RNA, 14 nt, Mycobacterium tuberculosis H37Rv
ccgcggucggccac

SEQ ID NO: 1289268 - RNA, 16 nt, Mycobacterium tuberculosis H37Rv
ccgcgggggaccgccc

SEQ ID NO: 1289269 - RNA, 23 nt, Mycobacterium tuberculosis H37Rv
ccgcggguagcgguucaucaccg

SEQ ID NO: 1289270 - RNA, 16 nt, Mycobacterium tuberculosis H37Rv
ccgcgggucgugccag

SEQ ID NO: 1289271 - RNA, 21 nt, Mycobacterium tuberculosis H37Rv
ccgcgggcgccuuccaggcgg

SEQ ID NO: 1289272 - RNA, 19 nt, Mycobacterium tuberculosis H37Rv
ccgcgggcggcaucgccga

SEQ ID NO: 1289273 - RNA, 14 nt, Mycobacterium tuberculosis H37Rv
ccgcgggcgaaccg

SEQ ID NO: 1289274 - RNA, 21 nt, Mycobacterium tuberculosis H37Rv
ccgcgggcaccuuccacgauc

SEQ ID NO: 1289275 - RNA, 12 nt, Mycobacterium tuberculosis H37Rv
ccgcggcggaug

SEQ ID NO: 1289276 - RNA, 12 nt, Mycobacterium tuberculosis H37Rv
ccgcggcgccac

SEQ ID NO: 1289277 - RNA, 13 nt, Mycobacterium tuberculosis H37Rv
ccgcggcgcgcaa

SEQ ID NO: 1289278 - RNA, 14 nt, Mycobacterium tuberculosis H37Rv
ccgcggcgcagcac

SEQ ID NO: 1289279 - RNA, 15 nt, Mycobacterium tuberculosis H37Rv
ccgcggcgaucacca

SEQ ID NO: 1289280 - RNA, 21 nt, Mycobacterium tuberculosis H37Rv
ccgcggcgacgucucgcaugc

SEQ ID NO: 1289281 - RNA, 20 nt, Mycobacterium tuberculosis H37Rv
ccgcggcgaaccagcgcguc

SEQ ID NO: 1289282 - RNA, 20 nt, Mycobacterium tuberculosis H37Rv
ccgcugcauccgcagcacca

SEQ ID NO: 1289283 - RNA, 15 nt, Mycobacterium tuberculosis H37Rv
ccgcugccgaagcgg

SEQ ID NO: 1289284 - RNA, 14 nt, Mycobacterium tuberculosis H37Rv
ccgcugccauugcc

SEQ ID NO: 1289285 - RNA, 21 nt, Mycobacterium tuberculosis H37Rv
ccgcugcgaaagcacgugcac

SEQ ID NO: 1289286 - RNA, 16 nt, Mycobacterium tuberculosis H37Rv
ccgcugccagggugcg

SEQ ID NO: 1289287 - RNA, 15 nt, Mycobacterium tuberculosis H37Rv
ccgcugccggcacgc

SEQ ID NO: 1289288 - RNA, 16 nt, Mycobacterium tuberculosis H37Rv
ccgcugaugagccgca

SEQ ID NO: 1289289 - RNA, 17 nt, Mycobacterium tuberculosis H37Rv
ccgcugaucgccgacaa

SEQ ID NO: 1289290 - RNA, 23 nt, Mycobacterium tuberculosis H37Rv
ccgcucggcgcgcggguugucgg

SEQ ID NO: 1289291 - RNA, 19 nt, Mycobacterium tuberculosis H37Rv
ccgcugagccggugcacuc

SEQ ID NO: 1289292 - RNA, 14 nt, Mycobacterium tuberculosis H37Rv
ccgcugaggaaccc

SEQ ID NO: 1289293 - RNA, 15 nt, Mycobacterium tuberculosis H37Rv
ccgcucgcugaaccg

SEQ ID NO: 1289294 - RNA, 19 nt, Mycobacterium tuberculosis H37Rv
ccgcucgcugaaccggauc

SEQ ID NO: 1289295 - RNA, 20 nt, Mycobacterium tuberculosis H37Rv
ccgcucaacaaucggugguc

SEQ ID NO: 1289296 - RNA, 20 nt, Mycobacterium tuberculosis H37Rv
ccgcuaucgaggaggcgguc

SEQ ID NO: 1289297 - RNA, 13 nt, Mycobacterium tuberculosis H37Rv
ccgcuauucggcg

SEQ ID NO: 1289298 - RNA, 22 nt, Mycobacterium tuberculosis H37Rv
ccgcucacccgcccggaacggg

SEQ ID NO: 1289299 - RNA, 18 nt, Mycobacterium tuberculosis H37Rv
ccgcucacaagccgugca

SEQ ID NO: 1289300 - RNA, 18 nt, Mycobacterium tuberculosis H37Rv
ccgcucggcaaccugcga

SEQ ID NO: 1289301 - RNA, 16 nt, Mycobacterium tuberculosis H37Rv
ccgcucaucgaucccg

SEQ ID NO: 1289302 - RNA, 15 nt, Mycobacterium tuberculosis H37Rv
ccgcucccugcaccc

SEQ ID NO: 1289303 - RNA, 22 nt, Mycobacterium tuberculosis H37Rv
ccgcucccaugaucgccgaccu

SEQ ID NO: 1289304 - RNA, 19 nt, Mycobacterium tuberculosis H37Rv
ccgcuggucgaccggcguu

SEQ ID NO: 1289305 - RNA, 17 nt, Mycobacterium tuberculosis H37Rv
ccgcuggucgucgaguu

SEQ ID NO: 1289306 - RNA, 16 nt, Mycobacterium tuberculosis H37Rv
ccgcugguggucagca

SEQ ID NO: 1289307 - RNA, 15 nt, Mycobacterium tuberculosis H37Rv
ccgcugggucgaccg

SEQ ID NO: 1289308 - RNA, 12 nt, Mycobacterium tuberculosis H37Rv
ccgcugggucgc

SEQ ID NO: 1289309 - RNA, 18 nt, Mycobacterium tuberculosis H37Rv
ccgcuuagcaaucggcag

SEQ ID NO: 1289310 - RNA, 16 nt, Mycobacterium tuberculosis H37Rv
ccgcuucaggcgccac

SEQ ID NO: 1289311 - RNA, 16 nt, Mycobacterium tuberculosis H37Rv
ccgcuguugaucgaca

SEQ ID NO: 1289312 - RNA, 18 nt, Mycobacterium tuberculosis H37Rv
ccgcuguguucagcgcau

SEQ ID NO: 1289313 - RNA, 20 nt, Mycobacterium tuberculosis H37Rv
ccgcugugcggucgucaccg

SEQ ID NO: 1289314 - RNA, 17 nt, Mycobacterium tuberculosis H37Rv
ccgcuucgcccggcugc

SEQ ID NO: 1289315 - RNA, 19 nt, Mycobacterium tuberculosis H37Rv
ccgcuugaccccuggccgc

SEQ ID NO: 1289316 - RNA, 21 nt, Mycobacterium tuberculosis H37Rv
ccgcuuggaccguugccgaug

SEQ ID NO: 1289317 - RNA, 15 nt, Mycobacterium tuberculosis H37Rv
ccggaaaccacagcg

SEQ ID NO: 1289318 - RNA, 18 nt, Mycobacterium tuberculosis H37Rv
ccggaaccggacagcgua

SEQ ID NO: 1289319 - RNA, 17 nt, Mycobacterium tuberculosis H37Rv
ccggaaccggucagccg

SEQ ID NO: 1289320 - RNA, 21 nt, Mycobacterium tuberculosis H37Rv
ccgccuucuuggcggccuuug

SEQ ID NO: 1289321 - RNA, 20 nt, Mycobacterium tuberculosis H37Rv
ccgccuucgaucaucgaccu

SEQ ID NO: 1289322 - RNA, 15 nt, Mycobacterium tuberculosis H37Rv
ccgccuuggccacca

SEQ ID NO: 1289323 - RNA, 19 nt, Mycobacterium tuberculosis H37Rv
ccgcgaccggcguaaccgg

SEQ ID NO: 1289324 - RNA, 14 nt, Mycobacterium tuberculosis H37Rv
ccgcgaccgcgcac

SEQ ID NO: 1289325 - RNA, 16 nt, Mycobacterium tuberculosis H37Rv
ccgcgagcagcccggc

SEQ ID NO: 1289326 - RNA, 15 nt, Mycobacterium tuberculosis H37Rv
ccgcgacgacgaggu

SEQ ID NO: 1289327 - RNA, 20 nt, Mycobacterium tuberculosis H37Rv
ccgcgaugaucgcaucgacg

SEQ ID NO: 1289328 - RNA, 21 nt, Mycobacterium tuberculosis H37Rv
ccgcgaugagcggcgcggcaa

SEQ ID NO: 1289329 - RNA, 19 nt, Mycobacterium tuberculosis H37Rv
ccgcgaugauaccugccca

SEQ ID NO: 1289330 - RNA, 14 nt, Mycobacterium tuberculosis H37Rv
ccgcgaugaucgca

SEQ ID NO: 1289331 - RNA, 17 nt, Mycobacterium tuberculosis H37Rv
ccgcgaucgggccgauc

SEQ ID NO: 1289332 - RNA, 15 nt, Mycobacterium tuberculosis H37Rv
ccgcgaucuccuugg

SEQ ID NO: 1289333 - RNA, 15 nt, Mycobacterium tuberculosis H37Rv
ccgcgaucucggagc

SEQ ID NO: 1289334 - RNA, 20 nt, Mycobacterium tuberculosis H37Rv
ccgcgaugacggugccgacc

SEQ ID NO: 1289335 - RNA, 13 nt, Mycobacterium tuberculosis H37Rv
ccgcgaugagcgg

SEQ ID NO: 1289336 - RNA, 22 nt, Mycobacterium tuberculosis H37Rv
ccgcgagguacccaucgucgag

SEQ ID NO: 1289337 - RNA, 18 nt, Mycobacterium tuberculosis H37Rv
ccgcgaggcaagaacccg

SEQ ID NO: 1289338 - RNA, 16 nt, Mycobacterium tuberculosis H37Rv
ccgcgaucgccgacgc

SEQ ID NO: 1289339 - RNA, 16 nt, Mycobacterium tuberculosis H37Rv
ccgcgaucgcgacacg

SEQ ID NO: 1289340 - RNA, 14 nt, Mycobacterium tuberculosis H37Rv
ccgcgaucggcuga

SEQ ID NO: 1289341 - RNA, 18 nt, Mycobacterium tuberculosis H37Rv
ccgcgccagccuccacca

SEQ ID NO: 1289342 - RNA, 20 nt, Mycobacterium tuberculosis H37Rv
ccgccguccccgccgucgcc

SEQ ID NO: 1289343 - RNA, 13 nt, Mycobacterium tuberculosis H37Rv
ccgccgucgccga

SEQ ID NO: 1289344 - RNA, 15 nt, Mycobacterium tuberculosis H37Rv
ccgccgucgccgaac

SEQ ID NO: 1289345 - RNA, 21 nt, Mycobacterium tuberculosis H37Rv
ccgccgucgacguugaugacc

SEQ ID NO: 1289346 - RNA, 18 nt, Mycobacterium tuberculosis H37Rv
ccgccgucgccaccggua

SEQ ID NO: 1289347 - RNA, 21 nt, Mycobacterium tuberculosis H37Rv
ccgccguccccgccgucgcca

SEQ ID NO: 1289348 - RNA, 13 nt, Mycobacterium tuberculosis H37Rv
ccgccgucgacgu

SEQ ID NO: 1289349 - RNA, 19 nt, Mycobacterium tuberculosis H37Rv
ccgccgggcccccgccuac

SEQ ID NO: 1289350 - RNA, 20 nt, Mycobacterium tuberculosis H37Rv
ccgccgucaccgccguugcc

SEQ ID NO: 1289351 - RNA, 18 nt, Mycobacterium tuberculosis H37Rv
ccgccgucaccgccgacc

SEQ ID NO: 1289352 - RNA, 15 nt, Mycobacterium tuberculosis H37Rv
ccgccgggaucaccg

SEQ ID NO: 1289353 - RNA, 18 nt, Mycobacterium tuberculosis H37Rv
ccgccgugcugcggcgac

SEQ ID NO: 1289354 - RNA, 15 nt, Mycobacterium tuberculosis H37Rv
ccgccguuaccgccg

SEQ ID NO: 1289355 - RNA, 20 nt, Mycobacterium tuberculosis H37Rv
ccgccguuaccgccguuacc

SEQ ID NO: 1289356 - RNA, 19 nt, Mycobacterium tuberculosis H37Rv
ccgccguuaccgccguugc

SEQ ID NO: 1289357 - RNA, 19 nt, Mycobacterium tuberculosis H37Rv
ccgccguuacggagggcac

SEQ ID NO: 1289358 - RNA, 15 nt, Mycobacterium tuberculosis H37Rv
ccgccgucgugugac

SEQ ID NO: 1289359 - RNA, 19 nt, Mycobacterium tuberculosis H37Rv
ccgccgucgccgccgcuac

SEQ ID NO: 1289360 - RNA, 13 nt, Mycobacterium tuberculosis H37Rv
ccgccgucgccgc

SEQ ID NO: 1289361 - RNA, 20 nt, Mycobacterium tuberculosis H37Rv
ccgccgucggcaucgacgcg

SEQ ID NO: 1289362 - RNA, 16 nt, Mycobacterium tuberculosis H37Rv
ccgccgucgccguaca

SEQ ID NO: 1289363 - RNA, 16 nt, Mycobacterium tuberculosis H37Rv
ccgccuggacgccgcc

SEQ ID NO: 1289364 - RNA, 19 nt, Mycobacterium tuberculosis H37Rv
ccgccguugccgccgucac

SEQ ID NO: 1289365 - RNA, 14 nt, Mycobacterium tuberculosis H37Rv
ccgccuccucgaua

SEQ ID NO: 1289366 - RNA, 17 nt, Mycobacterium tuberculosis H37Rv
ccgccguugccgaucag

SEQ ID NO: 1289367 - RNA, 20 nt, Mycobacterium tuberculosis H37Rv
ccgccguugccaccguagcc

SEQ ID NO: 1289368 - RNA, 13 nt, Mycobacterium tuberculosis H37Rv
ccgccguugccga

SEQ ID NO: 1289369 - RNA, 18 nt, Mycobacterium tuberculosis H37Rv
ccgccguugccgccggug

SEQ ID NO: 1289370 - RNA, 18 nt, Mycobacterium tuberculosis H37Rv
ccgccguugccgaucagc

SEQ ID NO: 1289371 - RNA, 23 nt, Mycobacterium tuberculosis H37Rv
ccgccguugccgaucaguccggc

SEQ ID NO: 1289372 - RNA, 19 nt, Mycobacterium tuberculosis H37Rv
ccgccguugccgaugagca

SEQ ID NO: 1289373 - RNA, 18 nt, Mycobacterium tuberculosis H37Rv
ccgccguugccgccguca

SEQ ID NO: 1289374 - RNA, 19 nt, Mycobacterium tuberculosis H37Rv
ccgccguugccgccgacgc

SEQ ID NO: 1289375 - RNA, 18 nt, Mycobacterium tuberculosis H37Rv
ccgccgcgggcgccgguu

SEQ ID NO: 1289376 - RNA, 20 nt, Mycobacterium tuberculosis H37Rv
ccgccgcgguuaucgccgag

SEQ ID NO: 1289377 - RNA, 18 nt, Mycobacterium tuberculosis H37Rv
ccgccgcugccgccggug

SEQ ID NO: 1289378 - RNA, 14 nt, Mycobacterium tuberculosis H37Rv
ccgccggacccguc

SEQ ID NO: 1289379 - RNA, 23 nt, Mycobacterium tuberculosis H37Rv
ccgccggacccgucgagcagcau

SEQ ID NO: 1289380 - RNA, 19 nt, Mycobacterium tuberculosis H37Rv
ccgccggacccgucgagca

SEQ ID NO: 1289381 - RNA, 18 nt, Mycobacterium tuberculosis H37Rv
ccgccggcugcgccagua

SEQ ID NO: 1289382 - RNA, 18 nt, Mycobacterium tuberculosis H37Rv
ccgccggcggucgcguac

SEQ ID NO: 1289383 - RNA, 20 nt, Mycobacterium tuberculosis H37Rv
ccgccggccuugugcucgau

SEQ ID NO: 1289384 - RNA, 18 nt, Mycobacterium tuberculosis H37Rv
ccgccggccgucgaucuu

SEQ ID NO: 1289385 - RNA, 24 nt, Mycobacterium tuberculosis H37Rv
ccgccggccggaacgcccggcuga

SEQ ID NO: 1289386 - RNA, 21 nt, Mycobacterium tuberculosis H37Rv
ccgccggccccgccgaugccg

SEQ ID NO: 1289387 - RNA, 16 nt, Mycobacterium tuberculosis H37Rv
ccgccgccaucgccga

SEQ ID NO: 1289388 - RNA, 18 nt, Mycobacterium tuberculosis H37Rv
ccgccgccccggcgcugg

SEQ ID NO: 1289389 - RNA, 16 nt, Mycobacterium tuberculosis H37Rv
ccgccgcauucggcga

SEQ ID NO: 1289390 - RNA, 23 nt, Mycobacterium tuberculosis H37Rv
ccgccgccaaugccaccauugcc

SEQ ID NO: 1289391 - RNA, 21 nt, Mycobacterium tuberculosis H37Rv
ccgccgaugcgauuccgcguc

SEQ ID NO: 1289392 - RNA, 13 nt, Mycobacterium tuberculosis H37Rv
ccgccgaugccgc

SEQ ID NO: 1289393 - RNA, 15 nt, Mycobacterium tuberculosis H37Rv
ccgccgcggccacca

SEQ ID NO: 1289394 - RNA, 13 nt, Mycobacterium tuberculosis H37Rv
ccgccgcggccac

SEQ ID NO: 1289395 - RNA, 15 nt, Mycobacterium tuberculosis H37Rv
ccgccgcggcagcau

SEQ ID NO: 1289396 - RNA, 13 nt, Mycobacterium tuberculosis H37Rv
ccgccgcgcguuc

SEQ ID NO: 1289397 - RNA, 14 nt, Mycobacterium tuberculosis H37Rv
ccgccgcgccggug

SEQ ID NO: 1289398 - RNA, 15 nt, Mycobacterium tuberculosis H37Rv
ccgccccgccguuga

SEQ ID NO: 1289399 - RNA, 20 nt, Mycobacterium tuberculosis H37Rv
ccgcccgcacguucacgcgc

SEQ ID NO: 1289400 - RNA, 18 nt, Mycobacterium tuberculosis H37Rv
ccgcccgaggcacccgug

SEQ ID NO: 1289401 - RNA, 16 nt, Mycobacterium tuberculosis H37Rv
ccgccccgggccacca

SEQ ID NO: 1289402 - RNA, 19 nt, Mycobacterium tuberculosis H37Rv
ccgcccgcgccgccgcuac

SEQ ID NO: 1289403 - RNA, 13 nt, Mycobacterium tuberculosis H37Rv
ccgccgaccgaca

SEQ ID NO: 1289404 - RNA, 12 nt, Mycobacterium tuberculosis H37Rv
ccgccgacagcc

SEQ ID NO: 1289405 - RNA, 16 nt, Mycobacterium tuberculosis H37Rv
ccgccgaagccgcgca

SEQ ID NO: 1289406 - RNA, 22 nt, Mycobacterium tuberculosis H37Rv
ccgccgaagcucaucgccgcua

SEQ ID NO: 1289407 - RNA, 23 nt, Mycobacterium tuberculosis H37Rv
ccgccgaacgugaacucacggcg

SEQ ID NO: 1289408 - RNA, 20 nt, Mycobacterium tuberculosis H37Rv
ccgccgaacugcuugcgcau

SEQ ID NO: 1289409 - RNA, 14 nt, Mycobacterium tuberculosis H37Rv
ccgccgaagccgac

SEQ ID NO: 1289410 - RNA, 18 nt, Mycobacterium tuberculosis H37Rv
ccgccgaugccgccggca

SEQ ID NO: 1289411 - RNA, 19 nt, Mycobacterium tuberculosis H37Rv
ccgccgaugccgccggcac

SEQ ID NO: 1289412 - RNA, 15 nt, Mycobacterium tuberculosis H37Rv
ccgccgaucgggcuu

SEQ ID NO: 1289413 - RNA, 16 nt, Mycobacterium tuberculosis H37Rv
ccgccgaucugcugca

SEQ ID NO: 1289414 - RNA, 21 nt, Mycobacterium tuberculosis H37Rv
ccgccgaucgacacccgcucg

SEQ ID NO: 1289415 - RNA, 16 nt, Mycobacterium tuberculosis H37Rv
ccgccgaucggccaca

SEQ ID NO: 1289416 - RNA, 13 nt, Mycobacterium tuberculosis H37Rv
ccgccgaucaccg

SEQ ID NO: 1289417 - RNA, 18 nt, Mycobacterium tuberculosis H37Rv
ccgccgauccuagaucga

SEQ ID NO: 1289418 - RNA, 20 nt, Mycobacterium tuberculosis H37Rv
ccgccgauccuagaucgaga

SEQ ID NO: 1289419 - RNA, 15 nt, Mycobacterium tuberculosis H37Rv
ccgccgaacggcaau

SEQ ID NO: 1289420 - RNA, 22 nt, Mycobacterium tuberculosis H37Rv
ccgccgaacgccucugcgauca

SEQ ID NO: 1289421 - RNA, 22 nt, Mycobacterium tuberculosis H37Rv
ccgcccuguccggguagcggcg

SEQ ID NO: 1289422 - RNA, 17 nt, Mycobacterium tuberculosis H37Rv
ccgcccaggagcaccuc

SEQ ID NO: 1289423 - RNA, 14 nt, Mycobacterium tuberculosis H37Rv
ccgcccagcaucuc

SEQ ID NO: 1289424 - RNA, 18 nt, Mycobacterium tuberculosis H37Rv
ccgccauugccgccggug

SEQ ID NO: 1289425 - RNA, 22 nt, Mycobacterium tuberculosis H37Rv
ccgccauugccgccgucgccgc

SEQ ID NO: 1289426 - RNA, 13 nt, Mycobacterium tuberculosis H37Rv
ccgccauugccgc

SEQ ID NO: 1289427 - RNA, 20 nt, Mycobacterium tuberculosis H37Rv
ccgccauugacgccguugcc

SEQ ID NO: 1289428 - RNA, 17 nt, Mycobacterium tuberculosis H37Rv
ccgcccaccacacagcc

SEQ ID NO: 1289429 - RNA, 22 nt, Mycobacterium tuberculosis H37Rv
ccgcccacaugaacgaccaccg

SEQ ID NO: 1289430 - RNA, 15 nt, Mycobacterium tuberculosis H37Rv
ccgccauugucgcca

SEQ ID NO: 1289431 - RNA, 20 nt, Mycobacterium tuberculosis H37Rv
ccgcccaagguggcggccag

SEQ ID NO: 1289432 - RNA, 13 nt, Mycobacterium tuberculosis H37Rv
ccgcccagaccgc

SEQ ID NO: 1289433 - RNA, 20 nt, Mycobacterium tuberculosis H37Rv
ccgcccagagugaauccggc

SEQ ID NO: 1289434 - RNA, 12 nt, Mycobacterium tuberculosis H37Rv
ccgccagugccc

SEQ ID NO: 1289435 - RNA, 17 nt, Mycobacterium tuberculosis H37Rv
ccgccagggcggcaucc

SEQ ID NO: 1289436 - RNA, 18 nt, Mycobacterium tuberculosis H37Rv
ccgccagcaugacaccgg

SEQ ID NO: 1289437 - RNA, 17 nt, Mycobacterium tuberculosis H37Rv
ccgccagcaugacaccg

SEQ ID NO: 1289438 - RNA, 13 nt, Mycobacterium tuberculosis H37Rv
ccgccaucgccga

SEQ ID NO: 1289439 - RNA, 18 nt, Mycobacterium tuberculosis H37Rv
ccgccaguucuucgggcg

SEQ ID NO: 1289440 - RNA, 22 nt, Mycobacterium tuberculosis H37Rv
ccgccauuccagccggugccgc

SEQ ID NO: 1289441 - RNA, 13 nt, Mycobacterium tuberculosis H37Rv
ccgccaugcggcg

SEQ ID NO: 1289442 - RNA, 15 nt, Mycobacterium tuberculosis H37Rv
ccgccaccaccaggg

SEQ ID NO: 1289443 - RNA, 22 nt, Mycobacterium tuberculosis H37Rv
ccgccaccacgccgucgacaac

SEQ ID NO: 1289444 - RNA, 19 nt, Mycobacterium tuberculosis H37Rv
ccgccacacggggccgcca

SEQ ID NO: 1289445 - RNA, 14 nt, Mycobacterium tuberculosis H37Rv
ccgccacaccgccg

SEQ ID NO: 1289446 - RNA, 13 nt, Mycobacterium tuberculosis H37Rv
ccgccaacggcac

SEQ ID NO: 1289447 - RNA, 15 nt, Mycobacterium tuberculosis H37Rv
ccgccacgucgccgg

SEQ ID NO: 1289448 - RNA, 18 nt, Mycobacterium tuberculosis H37Rv
ccgccacguacuuggacg

SEQ ID NO: 1289449 - RNA, 18 nt, Mycobacterium tuberculosis H37Rv
ccgccacgguucgggcag

SEQ ID NO: 1289450 - RNA, 14 nt, Mycobacterium tuberculosis H37Rv
ccgccacgaugucg

SEQ ID NO: 1289451 - RNA, 20 nt, Mycobacterium tuberculosis H37Rv
ccgccaccagggcacguucg

SEQ ID NO: 1289452 - RNA, 22 nt, Mycobacterium tuberculosis H37Rv
ccgcauggacgcgaugaccgca

SEQ ID NO: 1289453 - RNA, 15 nt, Mycobacterium tuberculosis H37Rv
ccgcauggacgcgau

SEQ ID NO: 1289454 - RNA, 15 nt, Mycobacterium tuberculosis H37Rv
ccgccaaccgcgugc

SEQ ID NO: 1289455 - RNA, 16 nt, Mycobacterium tuberculosis H37Rv
ccgcaucggcccccaa

SEQ ID NO: 1289456 - RNA, 14 nt, Mycobacterium tuberculosis H37Rv
ccgcaucggcacgc

SEQ ID NO: 1289457 - RNA, 18 nt, Mycobacterium tuberculosis H37Rv
ccgcaucguuuucgccga

SEQ ID NO: 1289458 - RNA, 18 nt, Mycobacterium tuberculosis H37Rv
ccgcaucguugccgaccg

SEQ ID NO: 1289459 - RNA, 18 nt, Mycobacterium tuberculosis H37Rv
ccgcaucgucgccgcgca

SEQ ID NO: 1289460 - RNA, 13 nt, Mycobacterium tuberculosis H37Rv
ccgcaugccggcg

SEQ ID NO: 1289461 - RNA, 19 nt, Mycobacterium tuberculosis H37Rv
ccgcagcgaaaacccgguc

SEQ ID NO: 1289462 - RNA, 22 nt, Mycobacterium tuberculosis H37Rv
ccgcagcgccuaccagcaccgg

SEQ ID NO: 1289463 - RNA, 13 nt, Mycobacterium tuberculosis H37Rv
ccgcaucggcaag

SEQ ID NO: 1289464 - RNA, 21 nt, Mycobacterium tuberculosis H37Rv
ccgcagcgcgaaggucagcga

SEQ ID NO: 1289465 - RNA, 23 nt, Mycobacterium tuberculosis H37Rv
ccgcagcggccagcccagccggg

SEQ ID NO: 1289466 - RNA, 17 nt, Mycobacterium tuberculosis H37Rv
ccgaugcccgacaccgc

SEQ ID NO: 1289467 - RNA, 20 nt, Mycobacterium tuberculosis H37Rv
ccgaugcacuccaugaaucg

SEQ ID NO: 1289468 - RNA, 14 nt, Mycobacterium tuberculosis H37Rv
ccgacgaugccgcg

SEQ ID NO: 1289469 - RNA, 15 nt, Mycobacterium tuberculosis H37Rv
ccgacgaucaacgga

SEQ ID NO: 1289470 - RNA, 20 nt, Mycobacterium tuberculosis H37Rv
ccgacgagauacggccacca

SEQ ID NO: 1289471 - RNA, 23 nt, Mycobacterium tuberculosis H37Rv
ccgacgagauacggccaccaggu

SEQ ID NO: 1289472 - RNA, 21 nt, Mycobacterium tuberculosis H37Rv
ccgacgaggacgucaccguca

SEQ ID NO: 1289473 - RNA, 16 nt, Mycobacterium tuberculosis H37Rv
ccgacgaacagcgguc

SEQ ID NO: 1289474 - RNA, 15 nt, Mycobacterium tuberculosis H37Rv
ccgacgacgacguuc

SEQ ID NO: 1289475 - RNA, 16 nt, Mycobacterium tuberculosis H37Rv
ccgaugcgugccgacc

SEQ ID NO: 1289476 - RNA, 19 nt, Mycobacterium tuberculosis H37Rv
ccgaugcgugccgacccgc

SEQ ID NO: 1289477 - RNA, 22 nt, Mycobacterium tuberculosis H37Rv
ccgaugcuggcaaaguaucgca

SEQ ID NO: 1289478 - RNA, 14 nt, Mycobacterium tuberculosis H37Rv
ccgaugcugacgau

SEQ ID NO: 1289479 - RNA, 13 nt, Mycobacterium tuberculosis H37Rv
ccgaugccuugac

SEQ ID NO: 1289480 - RNA, 22 nt, Mycobacterium tuberculosis H37Rv
ccgaugcgcagugcaccgcguc

SEQ ID NO: 1289481 - RNA, 19 nt, Mycobacterium tuberculosis H37Rv
ccgauucugauaucgucgg

SEQ ID NO: 1289482 - RNA, 22 nt, Mycobacterium tuberculosis H37Rv
ccgauucugauaucgucggugc

SEQ ID NO: 1289483 - RNA, 15 nt, Mycobacterium tuberculosis H37Rv
ccgauugaguucggc

SEQ ID NO: 1289484 - RNA, 15 nt, Mycobacterium tuberculosis H37Rv
ccgauugucggcaac

SEQ ID NO: 1289485 - RNA, 14 nt, Mycobacterium tuberculosis H37Rv
ccgauucucgaucu

SEQ ID NO: 1289486 - RNA, 14 nt, Mycobacterium tuberculosis H37Rv
ccgcaaacgcggcg

SEQ ID NO: 1289487 - RNA, 16 nt, Mycobacterium tuberculosis H37Rv
ccgauuuauccggauc

SEQ ID NO: 1289488 - RNA, 19 nt, Mycobacterium tuberculosis H37Rv
ccgcaaaguagacgugcca

SEQ ID NO: 1289489 - RNA, 21 nt, Mycobacterium tuberculosis H37Rv
ccgcaacgcuucggcagcucc

SEQ ID NO: 1289490 - RNA, 14 nt, Mycobacterium tuberculosis H37Rv
ccgaugguggccgc

SEQ ID NO: 1289491 - RNA, 16 nt, Mycobacterium tuberculosis H37Rv
ccgaugguggugccaa

SEQ ID NO: 1289492 - RNA, 22 nt, Mycobacterium tuberculosis H37Rv
ccgauggugaugggggagccgg

SEQ ID NO: 1289493 - RNA, 14 nt, Mycobacterium tuberculosis H37Rv
ccgcaacucgccga

SEQ ID NO: 1289494 - RNA, 18 nt, Mycobacterium tuberculosis H37Rv
ccgcaagaaucagcagca

SEQ ID NO: 1289495 - RNA, 18 nt, Mycobacterium tuberculosis H37Rv
ccgcacccccgacaccgc

SEQ ID NO: 1289496 - RNA, 20 nt, Mycobacterium tuberculosis H37Rv
ccgcaccgccacccugacca

SEQ ID NO: 1289497 - RNA, 14 nt, Mycobacterium tuberculosis H37Rv
ccgcacccguugcg

SEQ ID NO: 1289498 - RNA, 19 nt, Mycobacterium tuberculosis H37Rv
ccgcaccguagccgcugca

SEQ ID NO: 1289499 - RNA, 15 nt, Mycobacterium tuberculosis H37Rv
ccgcaccgccggcaa

SEQ ID NO: 1289500 - RNA, 22 nt, Mycobacterium tuberculosis H37Rv
ccgcaccgcuguugcaucgccg

SEQ ID NO: 1289501 - RNA, 16 nt, Mycobacterium tuberculosis H37Rv
ccgcaccgucccagug

SEQ ID NO: 1289502 - RNA, 17 nt, Mycobacterium tuberculosis H37Rv
ccgcaccucaccggguu

SEQ ID NO: 1289503 - RNA, 11 nt, Mycobacterium tuberculosis H37Rv
ccgcacgacga

SEQ ID NO: 1289504 - RNA, 23 nt, Mycobacterium tuberculosis H37Rv
ccgcaccguaguaguucagccag

SEQ ID NO: 1289505 - RNA, 20 nt, Mycobacterium tuberculosis H37Rv
ccgcaccguggacaccuggc

SEQ ID NO: 1289506 - RNA, 15 nt, Mycobacterium tuberculosis H37Rv
ccgcaccugcgauga

SEQ ID NO: 1289507 - RNA, 14 nt, Mycobacterium tuberculosis H37Rv
ccgcacguucacgc

SEQ ID NO: 1289508 - RNA, 15 nt, Mycobacterium tuberculosis H37Rv
ccgcacgaagccggc

SEQ ID NO: 1289509 - RNA, 21 nt, Mycobacterium tuberculosis H37Rv
ccgcacgauggccgucgauca

SEQ ID NO: 1289510 - RNA, 22 nt, Mycobacterium tuberculosis H37Rv
ccgcacugccgccgguuccgcc

SEQ ID NO: 1289511 - RNA, 13 nt, Mycobacterium tuberculosis H37Rv
ccgcacuccacga

SEQ ID NO: 1289512 - RNA, 13 nt, Mycobacterium tuberculosis H37Rv
ccgcagaccgguu

SEQ ID NO: 1289513 - RNA, 17 nt, Mycobacterium tuberculosis H37Rv
ccgcagaauccggcaac

SEQ ID NO: 1289514 - RNA, 16 nt, Mycobacterium tuberculosis H37Rv
ccgcagaauccggcaa

SEQ ID NO: 1289515 - RNA, 17 nt, Mycobacterium tuberculosis H37Rv
ccgcacugugcccucaa

SEQ ID NO: 1289516 - RNA, 17 nt, Mycobacterium tuberculosis H37Rv
ccgcagcaccgucgggc

SEQ ID NO: 1289517 - RNA, 13 nt, Mycobacterium tuberculosis H37Rv
ccgcagccgguua

SEQ ID NO: 1289518 - RNA, 23 nt, Mycobacterium tuberculosis H37Rv
ccgucacccccgauagcgaccgc

SEQ ID NO: 1289519 - RNA, 23 nt, Mycobacterium tuberculosis H37Rv
ccguaguaguucagccaggccgc

SEQ ID NO: 1289520 - RNA, 22 nt, Mycobacterium tuberculosis H37Rv
ccguagugaacggcucgggcag

SEQ ID NO: 1289521 - RNA, 11 nt, Mycobacterium tuberculosis H37Rv
ccguaggcggc

SEQ ID NO: 1289522 - RNA, 14 nt, Mycobacterium tuberculosis H37Rv
ccguagccgagcuu

SEQ ID NO: 1289523 - RNA, 15 nt, Mycobacterium tuberculosis H37Rv
ccguagccgcugcac

SEQ ID NO: 1289524 - RNA, 16 nt, Mycobacterium tuberculosis H37Rv
ccguagacgccgagca

SEQ ID NO: 1289525 - RNA, 14 nt, Mycobacterium tuberculosis H37Rv
ccguagccagcagg

SEQ ID NO: 1289526 - RNA, 15 nt, Mycobacterium tuberculosis H37Rv
ccgguucgcccagca

SEQ ID NO: 1289527 - RNA, 14 nt, Mycobacterium tuberculosis H37Rv
ccgguuccucagcg

SEQ ID NO: 1289528 - RNA, 19 nt, Mycobacterium tuberculosis H37Rv
ccgucacgcccgcgaaccg

SEQ ID NO: 1289529 - RNA, 18 nt, Mycobacterium tuberculosis H37Rv
ccgucaccggucggccau

SEQ ID NO: 1289530 - RNA, 20 nt, Mycobacterium tuberculosis H37Rv
ccgucaccgccguugccgau

SEQ ID NO: 1289531 - RNA, 21 nt, Mycobacterium tuberculosis H37Rv
ccguccgcugguggucagcac

SEQ ID NO: 1289532 - RNA, 18 nt, Mycobacterium tuberculosis H37Rv
ccguccucgaucgcgcag

SEQ ID NO: 1289533 - RNA, 17 nt, Mycobacterium tuberculosis H37Rv
ccguccucgucggugug

SEQ ID NO: 1289534 - RNA, 15 nt, Mycobacterium tuberculosis H37Rv
ccguccgggucacca

SEQ ID NO: 1289535 - RNA, 18 nt, Mycobacterium tuberculosis H37Rv
ccguccgguggacgcaga

SEQ ID NO: 1289536 - RNA, 18 nt, Mycobacterium tuberculosis H37Rv
ccguccgguggaccgccg

SEQ ID NO: 1289537 - RNA, 15 nt, Mycobacterium tuberculosis H37Rv
ccggugguggcgacc

SEQ ID NO: 1289538 - RNA, 18 nt, Mycobacterium tuberculosis H37Rv
ccggugguggcgaccccg

SEQ ID NO: 1289539 - RNA, 13 nt, Mycobacterium tuberculosis H37Rv
ccgguggugagga

SEQ ID NO: 1289540 - RNA, 24 nt, Mycobacterium tuberculosis H37Rv
ccgguggugaggaucauggcgucg

SEQ ID NO: 1289541 - RNA, 20 nt, Mycobacterium tuberculosis H37Rv
ccgguuaugcgguacccgau

SEQ ID NO: 1289542 - RNA, 20 nt, Mycobacterium tuberculosis H37Rv
ccgguguugauguugccgga

SEQ ID NO: 1289543 - RNA, 13 nt, Mycobacterium tuberculosis H37Rv
ccgguguugccga

SEQ ID NO: 1289544 - RNA, 19 nt, Mycobacterium tuberculosis H37Rv
ccgguguaauugccgacgc

SEQ ID NO: 1289545 - RNA, 15 nt, Mycobacterium tuberculosis H37Rv
ccgguguugccguga

SEQ ID NO: 1289546 - RNA, 22 nt, Mycobacterium tuberculosis H37Rv
ccgguggggauagccgcgucgc

SEQ ID NO: 1289547 - RNA, 19 nt, Mycobacterium tuberculosis H37Rv
ccggugguagcgacgaugu

SEQ ID NO: 1289548 - RNA, 14 nt, Mycobacterium tuberculosis H37Rv
ccgguggguagcca

SEQ ID NO: 1289549 - RNA, 22 nt, Mycobacterium tuberculosis H37Rv
ccggugcucgucgagcaugcga

SEQ ID NO: 1289550 - RNA, 18 nt, Mycobacterium tuberculosis H37Rv
ccggugcucgucgagcau

SEQ ID NO: 1289551 - RNA, 21 nt, Mycobacterium tuberculosis H37Rv
ccggugcugguccaggcggug

SEQ ID NO: 1289552 - RNA, 18 nt, Mycobacterium tuberculosis H37Rv
ccggugcgguggugcgca

SEQ ID NO: 1289553 - RNA, 17 nt, Mycobacterium tuberculosis H37Rv
ccggugcucgucgagca

SEQ ID NO: 1289554 - RNA, 19 nt, Mycobacterium tuberculosis H37Rv
ccggugcuccucggcaggc

SEQ ID NO: 1289555 - RNA, 20 nt, Mycobacterium tuberculosis H37Rv
ccggugcucaagcgcgucgu

SEQ ID NO: 1289556 - RNA, 18 nt, Mycobacterium tuberculosis H37Rv
ccggugcucaagcgcguc

SEQ ID NO: 1289557 - RNA, 17 nt, Mycobacterium tuberculosis H37Rv
ccggugcuaaccgacgc

SEQ ID NO: 1289558 - RNA, 20 nt, Mycobacterium tuberculosis H37Rv
ccggugcuaaccgacgcuga

SEQ ID NO: 1289559 - RNA, 12 nt, Mycobacterium tuberculosis H37Rv
ccggugccggcg

SEQ ID NO: 1289560 - RNA, 12 nt, Mycobacterium tuberculosis H37Rv
ccggugccgcgg

SEQ ID NO: 1289561 - RNA, 22 nt, Mycobacterium tuberculosis H37Rv
ccggugccguuggagccgccac

SEQ ID NO: 1289562 - RNA, 17 nt, Mycobacterium tuberculosis H37Rv
ccggugcgcgcggucga

SEQ ID NO: 1289563 - RNA, 13 nt, Mycobacterium tuberculosis H37Rv
ccggugcgccgau

SEQ ID NO: 1289564 - RNA, 19 nt, Mycobacterium tuberculosis H37Rv
ccggucggugagccgugcc

SEQ ID NO: 1289565 - RNA, 15 nt, Mycobacterium tuberculosis H37Rv
ccggucggucucggc

SEQ ID NO: 1289566 - RNA, 18 nt, Mycobacterium tuberculosis H37Rv
ccggucggcgguagccga

SEQ ID NO: 1289567 - RNA, 14 nt, Mycobacterium tuberculosis H37Rv
ccggucggcgucga

SEQ ID NO: 1289568 - RNA, 18 nt, Mycobacterium tuberculosis H37Rv
ccggucuggcgaugacga

SEQ ID NO: 1289569 - RNA, 20 nt, Mycobacterium tuberculosis H37Rv
ccggucugcugggcacgaug

SEQ ID NO: 1289570 - RNA, 16 nt, Mycobacterium tuberculosis H37Rv
ccggucuggcgaugac

SEQ ID NO: 1289571 - RNA, 20 nt, Mycobacterium tuberculosis H37Rv
ccggugccgccguugccauu

SEQ ID NO: 1289572 - RNA, 20 nt, Mycobacterium tuberculosis H37Rv
ccggugccgccgcggccacc

SEQ ID NO: 1289573 - RNA, 23 nt, Mycobacterium tuberculosis H37Rv
ccggugaacgguagcacugucga

SEQ ID NO: 1289574 - RNA, 16 nt, Mycobacterium tuberculosis H37Rv
ccggugaacggcagca

SEQ ID NO: 1289575 - RNA, 16 nt, Mycobacterium tuberculosis H37Rv
ccggucuuggacagca

SEQ ID NO: 1289576 - RNA, 18 nt, Mycobacterium tuberculosis H37Rv
ccgguagcggcggcauga

SEQ ID NO: 1289577 - RNA, 12 nt, Mycobacterium tuberculosis H37Rv
ccgguagccggg

SEQ ID NO: 1289578 - RNA, 13 nt, Mycobacterium tuberculosis H37Rv
ccgguaccgccac

SEQ ID NO: 1289579 - RNA, 21 nt, Mycobacterium tuberculosis H37Rv
ccgguaccgcccgcaccgugg

SEQ ID NO: 1289580 - RNA, 17 nt, Mycobacterium tuberculosis H37Rv
ccgguacgccgcgccga

SEQ ID NO: 1289581 - RNA, 14 nt, Mycobacterium tuberculosis H37Rv
ccgguaccggcgac

SEQ ID NO: 1289582 - RNA, 20 nt, Mycobacterium tuberculosis H37Rv
ccgguagaucuucggccgca

SEQ ID NO: 1289583 - RNA, 18 nt, Mycobacterium tuberculosis H37Rv
ccggguuuuccaucuuca

SEQ ID NO: 1289584 - RNA, 13 nt, Mycobacterium tuberculosis H37Rv
ccggguuggccga

SEQ ID NO: 1289585 - RNA, 15 nt, Mycobacterium tuberculosis H37Rv
ccggguuggccgaac

SEQ ID NO: 1289586 - RNA, 14 nt, Mycobacterium tuberculosis H37Rv
ccggguugagccgc

SEQ ID NO: 1289587 - RNA, 19 nt, Mycobacterium tuberculosis H37Rv
ccggguuccagcggcaccg

SEQ ID NO: 1289588 - RNA, 13 nt, Mycobacterium tuberculosis H37Rv
ccgggugggccag

SEQ ID NO: 1289589 - RNA, 19 nt, Mycobacterium tuberculosis H37Rv
ccggguguuggggaucgca

SEQ ID NO: 1289590 - RNA, 14 nt, Mycobacterium tuberculosis H37Rv
ccgggucucggugc

SEQ ID NO: 1289591 - RNA, 17 nt, Mycobacterium tuberculosis H37Rv
ccgggucuccggcgcac

SEQ ID NO: 1289592 - RNA, 21 nt, Mycobacterium tuberculosis H37Rv
ccgggucuuccggugcgccga

SEQ ID NO: 1289593 - RNA, 19 nt, Mycobacterium tuberculosis H37Rv
ccggguggcgucgaucucg

SEQ ID NO: 1289594 - RNA, 20 nt, Mycobacterium tuberculosis H37Rv
ccgggugggagcagccgaac

SEQ ID NO: 1289595 - RNA, 15 nt, Mycobacterium tuberculosis H37Rv
ccgggucggugacga

SEQ ID NO: 1289596 - RNA, 17 nt, Mycobacterium tuberculosis H37Rv
ccgggucguagccgaac

SEQ ID NO: 1289597 - RNA, 21 nt, Mycobacterium tuberculosis H37Rv
ccgggucguagccgaacccgc

SEQ ID NO: 1289598 - RNA, 15 nt, Mycobacterium tuberculosis H37Rv
ccgggucgggcaccg

SEQ ID NO: 1289599 - RNA, 17 nt, Mycobacterium tuberculosis H37Rv
ccgggucggcacgaccc

SEQ ID NO: 1289600 - RNA, 14 nt, Mycobacterium tuberculosis H37Rv
ccgggucggcgaac

SEQ ID NO: 1289601 - RNA, 11 nt, Mycobacterium tuberculosis H37Rv
ccgggcucgcg

SEQ ID NO: 1289602 - RNA, 17 nt, Mycobacterium tuberculosis H37Rv
ccgggcucgcgaucguc

SEQ ID NO: 1289603 - RNA, 15 nt, Mycobacterium tuberculosis H37Rv
ccgggcucggcgaag

SEQ ID NO: 1289604 - RNA, 22 nt, Mycobacterium tuberculosis H37Rv
ccgggcucagacuuucgcccag

SEQ ID NO: 1289605 - RNA, 17 nt, Mycobacterium tuberculosis H37Rv
ccgggcuccaauugcgg

SEQ ID NO: 1289606 - RNA, 14 nt, Mycobacterium tuberculosis H37Rv
ccgguaucggcgac

SEQ ID NO: 1289607 - RNA, 13 nt, Mycobacterium tuberculosis H37Rv
ccgguaucggcga

SEQ ID NO: 1289608 - RNA, 19 nt, Mycobacterium tuberculosis H37Rv
ccgguaucgucccggcgac

SEQ ID NO: 1289609 - RNA, 22 nt, Mycobacterium tuberculosis H37Rv
ccgguaugcgccaucucgacgg

SEQ ID NO: 1289610 - RNA, 19 nt, Mycobacterium tuberculosis H37Rv
ccgguagucgccgucgggu

SEQ ID NO: 1289611 - RNA, 15 nt, Mycobacterium tuberculosis H37Rv
ccgguaggcggccag

SEQ ID NO: 1289612 - RNA, 16 nt, Mycobacterium tuberculosis H37Rv
ccggucauaccaagcg

SEQ ID NO: 1289613 - RNA, 17 nt, Mycobacterium tuberculosis H37Rv
ccggucagcgacgcacg

SEQ ID NO: 1289614 - RNA, 21 nt, Mycobacterium tuberculosis H37Rv
ccggucagccggaccaccagg

SEQ ID NO: 1289615 - RNA, 23 nt, Mycobacterium tuberculosis H37Rv
ccggucagcgacgcacgcaguuc

SEQ ID NO: 1289616 - RNA, 19 nt, Mycobacterium tuberculosis H37Rv
ccggucagcgcggcgcaca

SEQ ID NO: 1289617 - RNA, 14 nt, Mycobacterium tuberculosis H37Rv
ccgguccgucgggu

SEQ ID NO: 1289618 - RNA, 19 nt, Mycobacterium tuberculosis H37Rv
ccgguccggggcaacgauc

SEQ ID NO: 1289619 - RNA, 23 nt, Mycobacterium tuberculosis H37Rv
ccgguccgauucgugcggucauc

SEQ ID NO: 1289620 - RNA, 16 nt, Mycobacterium tuberculosis H37Rv
ccgguccccucggugc

SEQ ID NO: 1289621 - RNA, 13 nt, Mycobacterium tuberculosis H37Rv
ccggucggcgaaa

SEQ ID NO: 1289622 - RNA, 15 nt, Mycobacterium tuberculosis H37Rv
ccggucggcagcugg

SEQ ID NO: 1289623 - RNA, 22 nt, Mycobacterium tuberculosis H37Rv
ccggucggcagcuucucgccga

SEQ ID NO: 1289624 - RNA, 13 nt, Mycobacterium tuberculosis H37Rv
ccggucggaucgg

SEQ ID NO: 1289625 - RNA, 23 nt, Mycobacterium tuberculosis H37Rv
ccggucgcgcauuucguggcgcg

SEQ ID NO: 1289626 - RNA, 15 nt, Mycobacterium tuberculosis H37Rv
ccggucgccgggacg

SEQ ID NO: 1289627 - RNA, 19 nt, Mycobacterium tuberculosis H37Rv
ccggucgaugaccucguca

SEQ ID NO: 1289628 - RNA, 18 nt, Mycobacterium tuberculosis H37Rv
ccggucgcacuuggcccc

SEQ ID NO: 1289629 - RNA, 22 nt, Mycobacterium tuberculosis H37Rv
ccggucgcccgagucgaaaccg

SEQ ID NO: 1289630 - RNA, 15 nt, Mycobacterium tuberculosis H37Rv
ccggcggauucggcg

SEQ ID NO: 1289631 - RNA, 15 nt, Mycobacterium tuberculosis H37Rv
ccggcggcaucgagu

SEQ ID NO: 1289632 - RNA, 23 nt, Mycobacterium tuberculosis H37Rv
ccggcggcaucgaguucggcccg

SEQ ID NO: 1289633 - RNA, 18 nt, Mycobacterium tuberculosis H37Rv
ccggcggcgagcggccuc

SEQ ID NO: 1289634 - RNA, 14 nt, Mycobacterium tuberculosis H37Rv
ccggcgggcagaug

SEQ ID NO: 1289635 - RNA, 15 nt, Mycobacterium tuberculosis H37Rv
ccggcgggcagaugg

SEQ ID NO: 1289636 - RNA, 22 nt, Mycobacterium tuberculosis H37Rv
ccggcggcgcccaucgcgacgg

SEQ ID NO: 1289637 - RNA, 16 nt, Mycobacterium tuberculosis H37Rv
ccggcggcgccgaaac

SEQ ID NO: 1289638 - RNA, 17 nt, Mycobacterium tuberculosis H37Rv
ccggcgggugccgagcu

SEQ ID NO: 1289639 - RNA, 14 nt, Mycobacterium tuberculosis H37Rv
ccggcgggugccga

SEQ ID NO: 1289640 - RNA, 18 nt, Mycobacterium tuberculosis H37Rv
ccggcggggugcgcccac

SEQ ID NO: 1289641 - RNA, 13 nt, Mycobacterium tuberculosis H37Rv
ccggcgggcucgg

SEQ ID NO: 1289642 - RNA, 15 nt, Mycobacterium tuberculosis H37Rv
ccggcgggcucgguc

SEQ ID NO: 1289643 - RNA, 22 nt, Mycobacterium tuberculosis H37Rv
ccggcgggcgcgggcgccggga

SEQ ID NO: 1289644 - RNA, 22 nt, Mycobacterium tuberculosis H37Rv
ccggcguacuucgacagcggcg

SEQ ID NO: 1289645 - RNA, 20 nt, Mycobacterium tuberculosis H37Rv
ccggcguauagcccguagcc

SEQ ID NO: 1289646 - RNA, 14 nt, Mycobacterium tuberculosis H37Rv
ccggcguagcggcg

SEQ ID NO: 1289647 - RNA, 14 nt, Mycobacterium tuberculosis H37Rv
ccggcgguggccga

SEQ ID NO: 1289648 - RNA, 16 nt, Mycobacterium tuberculosis H37Rv
ccggcguacucgguga

SEQ ID NO: 1289649 - RNA, 21 nt, Mycobacterium tuberculosis H37Rv
ccggcggacgcccggcgcacc

SEQ ID NO: 1289650 - RNA, 18 nt, Mycobacterium tuberculosis H37Rv
ccggcggacccucgccga

SEQ ID NO: 1289651 - RNA, 19 nt, Mycobacterium tuberculosis H37Rv
ccggcgcuccaacgcacac

SEQ ID NO: 1289652 - RNA, 15 nt, Mycobacterium tuberculosis H37Rv
ccggcgcucaucgcg

SEQ ID NO: 1289653 - RNA, 17 nt, Mycobacterium tuberculosis H37Rv
ccggcgcguuggguuga

SEQ ID NO: 1289654 - RNA, 19 nt, Mycobacterium tuberculosis H37Rv
ccggcgcguuccaucaggg

SEQ ID NO: 1289655 - RNA, 20 nt, Mycobacterium tuberculosis H37Rv
ccggcgcggagugcccaggg

SEQ ID NO: 1289656 - RNA, 13 nt, Mycobacterium tuberculosis H37Rv
ccggcgcggccag

SEQ ID NO: 1289657 - RNA, 12 nt, Mycobacterium tuberculosis H37Rv
ccggcgcgccga

SEQ ID NO: 1289658 - RNA, 15 nt, Mycobacterium tuberculosis H37Rv
ccggcgcgccgauga

SEQ ID NO: 1289659 - RNA, 19 nt, Mycobacterium tuberculosis H37Rv
ccggcgcgccccgccgcac

SEQ ID NO: 1289660 - RNA, 18 nt, Mycobacterium tuberculosis H37Rv
ccggcgcgauggcgauag

SEQ ID NO: 1289661 - RNA, 13 nt, Mycobacterium tuberculosis H37Rv
ccggcgcgauggu

SEQ ID NO: 1289662 - RNA, 12 nt, Mycobacterium tuberculosis H37Rv
ccggcgcgcacc

SEQ ID NO: 1289663 - RNA, 19 nt, Mycobacterium tuberculosis H37Rv
ccggcgccuuggucgccgc

SEQ ID NO: 1289664 - RNA, 19 nt, Mycobacterium tuberculosis H37Rv
ccggcgccucaucggacag

SEQ ID NO: 1289665 - RNA, 15 nt, Mycobacterium tuberculosis H37Rv
ccggcgccuccggca

SEQ ID NO: 1289666 - RNA, 20 nt, Mycobacterium tuberculosis H37Rv
ccggcgccgcgggugcggca

SEQ ID NO: 1289667 - RNA, 18 nt, Mycobacterium tuberculosis H37Rv
ccggcgcccaggccgauc

SEQ ID NO: 1289668 - RNA, 22 nt, Mycobacterium tuberculosis H37Rv
ccggcgcccaggccgaucagcg

SEQ ID NO: 1289669 - RNA, 17 nt, Mycobacterium tuberculosis H37Rv
ccggcgccgccguuacc

SEQ ID NO: 1289670 - RNA, 23 nt, Mycobacterium tuberculosis H37Rv
ccggcgcccagcgccucgauggu

SEQ ID NO: 1289671 - RNA, 13 nt, Mycobacterium tuberculosis H37Rv
ccggcgcccaggc

SEQ ID NO: 1289672 - RNA, 15 nt, Mycobacterium tuberculosis H37Rv
ccggcgccaggaucg

SEQ ID NO: 1289673 - RNA, 16 nt, Mycobacterium tuberculosis H37Rv
ccggcgccaucggguc

SEQ ID NO: 1289674 - RNA, 19 nt, Mycobacterium tuberculosis H37Rv
ccggccaggaguuugacca

SEQ ID NO: 1289675 - RNA, 21 nt, Mycobacterium tuberculosis H37Rv
ccggccagcggccauccggcg

SEQ ID NO: 1289676 - RNA, 21 nt, Mycobacterium tuberculosis H37Rv
ccggccagccgcacgguugcc

SEQ ID NO: 1289677 - RNA, 22 nt, Mycobacterium tuberculosis H37Rv
ccgggaucgggucaccgugcgg

SEQ ID NO: 1289678 - RNA, 14 nt, Mycobacterium tuberculosis H37Rv
ccgggcaccgucgg

SEQ ID NO: 1289679 - RNA, 14 nt, Mycobacterium tuberculosis H37Rv
ccgggcagccccuc

SEQ ID NO: 1289680 - RNA, 23 nt, Mycobacterium tuberculosis H37Rv
ccgggcagaugaugccguucgga

SEQ ID NO: 1289681 - RNA, 17 nt, Mycobacterium tuberculosis H37Rv
ccgggcagaugaugccg

SEQ ID NO: 1289682 - RNA, 18 nt, Mycobacterium tuberculosis H37Rv
ccgggcagaugaugccgu

SEQ ID NO: 1289683 - RNA, 18 nt, Mycobacterium tuberculosis H37Rv
ccgggcacugugauuucg

SEQ ID NO: 1289684 - RNA, 19 nt, Mycobacterium tuberculosis H37Rv
ccgggccaguucgucggcg

SEQ ID NO: 1289685 - RNA, 17 nt, Mycobacterium tuberculosis H37Rv
ccgggccauucaccgcg

SEQ ID NO: 1289686 - RNA, 20 nt, Mycobacterium tuberculosis H37Rv
ccgggccauucaccgcgcac

SEQ ID NO: 1289687 - RNA, 22 nt, Mycobacterium tuberculosis H37Rv
ccgggccagaucgaagcgcagc

SEQ ID NO: 1289688 - RNA, 18 nt, Mycobacterium tuberculosis H37Rv
ccgggcaguuuggcggca

SEQ ID NO: 1289689 - RNA, 19 nt, Mycobacterium tuberculosis H37Rv
ccgggcaguucacgguuga

SEQ ID NO: 1289690 - RNA, 23 nt, Mycobacterium tuberculosis H37Rv
ccgggcggccaaccccgaugagg

SEQ ID NO: 1289691 - RNA, 19 nt, Mycobacterium tuberculosis H37Rv
ccgggcgcugcuugagguc

SEQ ID NO: 1289692 - RNA, 18 nt, Mycobacterium tuberculosis H37Rv
ccgggcggaacgccggca

SEQ ID NO: 1289693 - RNA, 20 nt, Mycobacterium tuberculosis H37Rv
ccgggccuguaccggcaaac

SEQ ID NO: 1289694 - RNA, 16 nt, Mycobacterium tuberculosis H37Rv
ccgggcgccgaucacg

SEQ ID NO: 1289695 - RNA, 23 nt, Mycobacterium tuberculosis H37Rv
ccgggccuuguucuuggccaccc

SEQ ID NO: 1289696 - RNA, 15 nt, Mycobacterium tuberculosis H37Rv
ccgggccguccggcg

SEQ ID NO: 1289697 - RNA, 13 nt, Mycobacterium tuberculosis H37Rv
ccgggccggucgg

SEQ ID NO: 1289698 - RNA, 14 nt, Mycobacterium tuberculosis H37Rv
ccgggcccgcguuc

SEQ ID NO: 1289699 - RNA, 18 nt, Mycobacterium tuberculosis H37Rv
ccgggccaggccgaugcc

SEQ ID NO: 1289700 - RNA, 20 nt, Mycobacterium tuberculosis H37Rv
ccgggccccuucgcagcaug

SEQ ID NO: 1289701 - RNA, 18 nt, Mycobacterium tuberculosis H37Rv
ccggcucaaggacgcacc

SEQ ID NO: 1289702 - RNA, 22 nt, Mycobacterium tuberculosis H37Rv
ccggcgucggcgcccagcucga

SEQ ID NO: 1289703 - RNA, 14 nt, Mycobacterium tuberculosis H37Rv
ccggcgucggcguc

SEQ ID NO: 1289704 - RNA, 14 nt, Mycobacterium tuberculosis H37Rv
ccggcgucucgcag

SEQ ID NO: 1289705 - RNA, 14 nt, Mycobacterium tuberculosis H37Rv
ccggcucaucgcag

SEQ ID NO: 1289706 - RNA, 19 nt, Mycobacterium tuberculosis H37Rv
ccggcucaucgcagccggu

SEQ ID NO: 1289707 - RNA, 20 nt, Mycobacterium tuberculosis H37Rv
ccggcucacagcacagcgca

SEQ ID NO: 1289708 - RNA, 17 nt, Mycobacterium tuberculosis H37Rv
ccggcucaccgaucccg

SEQ ID NO: 1289709 - RNA, 20 nt, Mycobacterium tuberculosis H37Rv
ccggcucccgggggcacucc

SEQ ID NO: 1289710 - RNA, 14 nt, Mycobacterium tuberculosis H37Rv
ccggcucgucgggc

SEQ ID NO: 1289711 - RNA, 21 nt, Mycobacterium tuberculosis H37Rv
ccggcugaaacguccuugaac

SEQ ID NO: 1289712 - RNA, 22 nt, Mycobacterium tuberculosis H37Rv
ccggcuguuaggcgauaucgca

SEQ ID NO: 1289713 - RNA, 17 nt, Mycobacterium tuberculosis H37Rv
ccggcuguuaggcgaua

SEQ ID NO: 1289714 - RNA, 12 nt, Mycobacterium tuberculosis H37Rv
ccggcugaccgg

SEQ ID NO: 1289715 - RNA, 13 nt, Mycobacterium tuberculosis H37Rv
ccgggaacgaggu

SEQ ID NO: 1289716 - RNA, 16 nt, Mycobacterium tuberculosis H37Rv
ccgggaauggacaggu

SEQ ID NO: 1289717 - RNA, 19 nt, Mycobacterium tuberculosis H37Rv
ccgggacaaucucggccgc

SEQ ID NO: 1289718 - RNA, 18 nt, Mycobacterium tuberculosis H37Rv
ccgggacaaucucggccg

SEQ ID NO: 1289719 - RNA, 16 nt, Mycobacterium tuberculosis H37Rv
ccgggaauuucgacac

SEQ ID NO: 1289720 - RNA, 21 nt, Mycobacterium tuberculosis H37Rv
ccgggacaaccgcgccgacag

SEQ ID NO: 1289721 - RNA, 23 nt, Mycobacterium tuberculosis H37Rv
ccgggacaaguucgguagcgauc

SEQ ID NO: 1289722 - RNA, 17 nt, Mycobacterium tuberculosis H37Rv
ccgggacaaucucggcc

SEQ ID NO: 1289723 - RNA, 19 nt, Mycobacterium tuberculosis H37Rv
ccgggauaguuuucggccg

SEQ ID NO: 1289724 - RNA, 15 nt, Mycobacterium tuberculosis H37Rv
ccucgaauucggccg

SEQ ID NO: 1289725 - RNA, 17 nt, Mycobacterium tuberculosis H37Rv
ccucgaaggcacugcga

SEQ ID NO: 1289726 - RNA, 19 nt, Mycobacterium tuberculosis H37Rv
ccucgaaggcacugcgauc

SEQ ID NO: 1289727 - RNA, 17 nt, Mycobacterium tuberculosis H37Rv
ccucggacacggcagcc

SEQ ID NO: 1289728 - RNA, 23 nt, Mycobacterium tuberculosis H37Rv
ccucggagaugaacucggcgauc

SEQ ID NO: 1289729 - RNA, 21 nt, Mycobacterium tuberculosis H37Rv
ccucggauugcagcgcgaugg

SEQ ID NO: 1289730 - RNA, 22 nt, Mycobacterium tuberculosis H37Rv
ccucgucgagagguucgccguc

SEQ ID NO: 1289731 - RNA, 19 nt, Mycobacterium tuberculosis H37Rv
ccucguagucccacugcca

SEQ ID NO: 1289732 - RNA, 15 nt, Mycobacterium tuberculosis H37Rv
ccucguccagcucgg

SEQ ID NO: 1289733 - RNA, 13 nt, Mycobacterium tuberculosis H37Rv
ccucgucccggac

SEQ ID NO: 1289734 - RNA, 18 nt, Mycobacterium tuberculosis H37Rv
ccucggguguggucacca

SEQ ID NO: 1289735 - RNA, 15 nt, Mycobacterium tuberculosis H37Rv
ccucgggaucggcgg

SEQ ID NO: 1289736 - RNA, 19 nt, Mycobacterium tuberculosis H37Rv
ccucggcgggauccucgaa

SEQ ID NO: 1289737 - RNA, 20 nt, Mycobacterium tuberculosis H37Rv
ccucggcgguaaaugccugc

SEQ ID NO: 1289738 - RNA, 11 nt, Mycobacterium tuberculosis H37Rv
ccucggcaugc

SEQ ID NO: 1289739 - RNA, 12 nt, Mycobacterium tuberculosis H37Rv
ccucggccaccc

SEQ ID NO: 1289740 - RNA, 16 nt, Mycobacterium tuberculosis H37Rv
ccugacucaucaccga

SEQ ID NO: 1289741 - RNA, 19 nt, Mycobacterium tuberculosis H37Rv
ccugacgucacguucggcg

SEQ ID NO: 1289742 - RNA, 21 nt, Mycobacterium tuberculosis H37Rv
ccucuaaaccaagaaucaccg

SEQ ID NO: 1289743 - RNA, 19 nt, Mycobacterium tuberculosis H37Rv
ccucgucuucgucgguguc

SEQ ID NO: 1289744 - RNA, 22 nt, Mycobacterium tuberculosis H37Rv
ccucgugcacgcacagcccgau

SEQ ID NO: 1289745 - RNA, 18 nt, Mycobacterium tuberculosis H37Rv
ccucgucggcgacggcca

SEQ ID NO: 1289746 - RNA, 15 nt, Mycobacterium tuberculosis H37Rv
ccucgucgaggucag

SEQ ID NO: 1289747 - RNA, 12 nt, Mycobacterium tuberculosis H37Rv
ccucgucgccgc

SEQ ID NO: 1289748 - RNA, 19 nt, Mycobacterium tuberculosis H37Rv
ccugcaagcuaagcgccug

SEQ ID NO: 1289749 - RNA, 12 nt, Mycobacterium tuberculosis H37Rv
ccugagcggcca

SEQ ID NO: 1289750 - RNA, 19 nt, Mycobacterium tuberculosis H37Rv
ccugcaccacggcggccac

SEQ ID NO: 1289751 - RNA, 14 nt, Mycobacterium tuberculosis H37Rv
ccuggaucagccag

SEQ ID NO: 1289752 - RNA, 13 nt, Mycobacterium tuberculosis H37Rv
ccugcuuggccac

SEQ ID NO: 1289753 - RNA, 16 nt, Mycobacterium tuberculosis H37Rv
ccugcuucaggaucgg

SEQ ID NO: 1289754 - RNA, 18 nt, Mycobacterium tuberculosis H37Rv
ccugcugugggauucggg

SEQ ID NO: 1289755 - RNA, 22 nt, Mycobacterium tuberculosis H37Rv
ccugcuggccguaacgcggauc

SEQ ID NO: 1289756 - RNA, 19 nt, Mycobacterium tuberculosis H37Rv
ccugcugcaaccgacuucg

SEQ ID NO: 1289757 - RNA, 18 nt, Mycobacterium tuberculosis H37Rv
ccugcucgucggccaccg

SEQ ID NO: 1289758 - RNA, 19 nt, Mycobacterium tuberculosis H37Rv
ccugcgccucggcggccag

SEQ ID NO: 1289759 - RNA, 17 nt, Mycobacterium tuberculosis H37Rv
ccugcgcuguucggcac

SEQ ID NO: 1289760 - RNA, 18 nt, Mycobacterium tuberculosis H37Rv
ccugcgcggcgaucgcuc

SEQ ID NO: 1289761 - RNA, 23 nt, Mycobacterium tuberculosis H37Rv
ccugcgcggcgugcgcggugaug

SEQ ID NO: 1289762 - RNA, 20 nt, Mycobacterium tuberculosis H37Rv
ccugcggcaggugcggucaa

SEQ ID NO: 1289763 - RNA, 19 nt, Mycobacterium tuberculosis H37Rv
ccugcgggaaguugcccag

SEQ ID NO: 1289764 - RNA, 23 nt, Mycobacterium tuberculosis H37Rv
ccugcggcugcuuggucgcccag

SEQ ID NO: 1289765 - RNA, 21 nt, Mycobacterium tuberculosis H37Rv
ccugcggugcaggauucggcg

SEQ ID NO: 1289766 - RNA, 22 nt, Mycobacterium tuberculosis H37Rv
ccugcgaauagccaccaagcac

SEQ ID NO: 1289767 - RNA, 15 nt, Mycobacterium tuberculosis H37Rv
ccugcgacgagccca

SEQ ID NO: 1289768 - RNA, 15 nt, Mycobacterium tuberculosis H37Rv
ccugcgccgacccgc

SEQ ID NO: 1289769 - RNA, 18 nt, Mycobacterium tuberculosis H37Rv
ccugcgcaucaccacugg

SEQ ID NO: 1289770 - RNA, 13 nt, Mycobacterium tuberculosis H37Rv
ccugcgccgcacg

SEQ ID NO: 1289771 - RNA, 19 nt, Mycobacterium tuberculosis H37Rv
ccugcgccuuggucgccgg

SEQ ID NO: 1289772 - RNA, 16 nt, Mycobacterium tuberculosis H37Rv
ccgucggauggaaggc

SEQ ID NO: 1289773 - RNA, 14 nt, Mycobacterium tuberculosis H37Rv
ccgucggcaccagc

SEQ ID NO: 1289774 - RNA, 18 nt, Mycobacterium tuberculosis H37Rv
ccgucgcggcggcacuac

SEQ ID NO: 1289775 - RNA, 19 nt, Mycobacterium tuberculosis H37Rv
ccgucggcaccagcagcca

SEQ ID NO: 1289776 - RNA, 18 nt, Mycobacterium tuberculosis H37Rv
ccgucggcaccagcagcc

SEQ ID NO: 1289777 - RNA, 20 nt, Mycobacterium tuberculosis H37Rv
ccgucggcgugcagcagcuu

SEQ ID NO: 1289778 - RNA, 17 nt, Mycobacterium tuberculosis H37Rv
ccgucgcgcucgcacca

SEQ ID NO: 1289779 - RNA, 15 nt, Mycobacterium tuberculosis H37Rv
ccgucgcggcacgcc

SEQ ID NO: 1289780 - RNA, 16 nt, Mycobacterium tuberculosis H37Rv
ccgucgcgucgaccgg

SEQ ID NO: 1289781 - RNA, 13 nt, Mycobacterium tuberculosis H37Rv
ccgucgcguuggc

SEQ ID NO: 1289782 - RNA, 18 nt, Mycobacterium tuberculosis H37Rv
ccgucgcguuggcgguag

SEQ ID NO: 1289783 - RNA, 22 nt, Mycobacterium tuberculosis H37Rv
ccgucgguaaagggcucgaugg

SEQ ID NO: 1289784 - RNA, 24 nt, Mycobacterium tuberculosis H37Rv
ccgucggugggugccagccggucg

SEQ ID NO: 1289785 - RNA, 18 nt, Mycobacterium tuberculosis H37Rv
ccgucggggaugccgaac

SEQ ID NO: 1289786 - RNA, 14 nt, Mycobacterium tuberculosis H37Rv
ccgucggggucggg

SEQ ID NO: 1289787 - RNA, 19 nt, Mycobacterium tuberculosis H37Rv
ccgucgguaaagggcucga

SEQ ID NO: 1289788 - RNA, 19 nt, Mycobacterium tuberculosis H37Rv
ccgucggggacauccgcuu

SEQ ID NO: 1289789 - RNA, 22 nt, Mycobacterium tuberculosis H37Rv
ccgucggggaguucgcgcagca

SEQ ID NO: 1289790 - RNA, 24 nt, Mycobacterium tuberculosis H37Rv
ccgucgggauggacggcagccagc

SEQ ID NO: 1289791 - RNA, 13 nt, Mycobacterium tuberculosis H37Rv
ccgucggacaccg

SEQ ID NO: 1289792 - RNA, 22 nt, Mycobacterium tuberculosis H37Rv
ccgucgggauggacggcagcca

SEQ ID NO: 1289793 - RNA, 22 nt, Mycobacterium tuberculosis H37Rv
ccgucgccuccagcagguccgc

SEQ ID NO: 1289794 - RNA, 18 nt, Mycobacterium tuberculosis H37Rv
ccgucgccggugccggua

SEQ ID NO: 1289795 - RNA, 18 nt, Mycobacterium tuberculosis H37Rv
ccgucgcgacgucggccg

SEQ ID NO: 1289796 - RNA, 15 nt, Mycobacterium tuberculosis H37Rv
ccgucgagucgccga

SEQ ID NO: 1289797 - RNA, 19 nt, Mycobacterium tuberculosis H37Rv
ccgucgaucagcggcagca

SEQ ID NO: 1289798 - RNA, 15 nt, Mycobacterium tuberculosis H37Rv
ccgucgaguccaggc

SEQ ID NO: 1289799 - RNA, 20 nt, Mycobacterium tuberculosis H37Rv
ccgucgaguccaggccggca

SEQ ID NO: 1289800 - RNA, 22 nt, Mycobacterium tuberculosis H37Rv
ccgucgagcgucugcgaucccg

SEQ ID NO: 1289801 - RNA, 16 nt, Mycobacterium tuberculosis H37Rv
ccgucgagucgacggc

SEQ ID NO: 1289802 - RNA, 19 nt, Mycobacterium tuberculosis H37Rv
ccgucgagucgacggcauc

SEQ ID NO: 1289803 - RNA, 20 nt, Mycobacterium tuberculosis H37Rv
ccgucgagucgacggcaucg

SEQ ID NO: 1289804 - RNA, 22 nt, Mycobacterium tuberculosis H37Rv
ccgucgagucgacggcaucggg

SEQ ID NO: 1289805 - RNA, 13 nt, Mycobacterium tuberculosis H37Rv
ccgucgcaccagc

SEQ ID NO: 1289806 - RNA, 16 nt, Mycobacterium tuberculosis H37Rv
ccgucgauguugccga

SEQ ID NO: 1289807 - RNA, 18 nt, Mycobacterium tuberculosis H37Rv
ccgucgauguugccgaga

SEQ ID NO: 1289808 - RNA, 12 nt, Mycobacterium tuberculosis H37Rv
ccgucgauuucg

SEQ ID NO: 1289809 - RNA, 16 nt, Mycobacterium tuberculosis H37Rv
ccgucgauuucgacga

SEQ ID NO: 1289810 - RNA, 21 nt, Mycobacterium tuberculosis H37Rv
ccgugccaaugacuuggccag

SEQ ID NO: 1289811 - RNA, 23 nt, Mycobacterium tuberculosis H37Rv
ccguggcggcgggccucggcgac

SEQ ID NO: 1289812 - RNA, 13 nt, Mycobacterium tuberculosis H37Rv
ccguggucgauca

SEQ ID NO: 1289813 - RNA, 13 nt, Mycobacterium tuberculosis H37Rv
ccgugggcggguu

SEQ ID NO: 1289814 - RNA, 18 nt, Mycobacterium tuberculosis H37Rv
ccgugcacgucagcggau

SEQ ID NO: 1289815 - RNA, 17 nt, Mycobacterium tuberculosis H37Rv
ccgugcacgaucgcggu

SEQ ID NO: 1289816 - RNA, 17 nt, Mycobacterium tuberculosis H37Rv
ccgugauccgccgacag

SEQ ID NO: 1289817 - RNA, 14 nt, Mycobacterium tuberculosis H37Rv
ccgugaucggcgcc

SEQ ID NO: 1289818 - RNA, 22 nt, Mycobacterium tuberculosis H37Rv
ccgugaguagguccacguucgg

SEQ ID NO: 1289819 - RNA, 12 nt, Mycobacterium tuberculosis H37Rv
ccgucucgacac

SEQ ID NO: 1289820 - RNA, 16 nt, Mycobacterium tuberculosis H37Rv
ccguugaugucggcag

SEQ ID NO: 1289821 - RNA, 13 nt, Mycobacterium tuberculosis H37Rv
ccguugacgccgu

SEQ ID NO: 1289822 - RNA, 20 nt, Mycobacterium tuberculosis H37Rv
ccguugaccucuucgggcag

SEQ ID NO: 1289823 - RNA, 13 nt, Mycobacterium tuberculosis H37Rv
ccguugccgauca

SEQ ID NO: 1289824 - RNA, 19 nt, Mycobacterium tuberculosis H37Rv
ccguugcccccauugccgc

SEQ ID NO: 1289825 - RNA, 15 nt, Mycobacterium tuberculosis H37Rv
ccguugcccaacccg

SEQ ID NO: 1289826 - RNA, 19 nt, Mycobacterium tuberculosis H37Rv
ccguugcccgacucggccg

SEQ ID NO: 1289827 - RNA, 21 nt, Mycobacterium tuberculosis H37Rv
ccguggugaucaaacuaccga

SEQ ID NO: 1289828 - RNA, 12 nt, Mycobacterium tuberculosis H37Rv
ccguucggcugc

SEQ ID NO: 1289829 - RNA, 20 nt, Mycobacterium tuberculosis H37Rv
ccgugucgcagaucaggacg

SEQ ID NO: 1289830 - RNA, 12 nt, Mycobacterium tuberculosis H37Rv
ccguucggcgcc

SEQ ID NO: 1289831 - RNA, 18 nt, Mycobacterium tuberculosis H37Rv
ccgugguugcacguucgg

SEQ ID NO: 1289832 - RNA, 13 nt, Mycobacterium tuberculosis H37Rv
ccguugguagccg

SEQ ID NO: 1289833 - RNA, 23 nt, Mycobacterium tuberculosis H37Rv
ccguuggcaaugaccccggcguu

SEQ ID NO: 1289834 - RNA, 17 nt, Mycobacterium tuberculosis H37Rv
ccguuggagacgucgca

SEQ ID NO: 1289835 - RNA, 14 nt, Mycobacterium tuberculosis H37Rv
ccguugccggcguu

SEQ ID NO: 1289836 - RNA, 21 nt, Mycobacterium tuberculosis H37Rv
ccguugccggcguugccgccg

SEQ ID NO: 1289837 - RNA, 17 nt, Mycobacterium tuberculosis H37Rv
ccguugcgaucgcgugc

SEQ ID NO: 1289838 - RNA, 13 nt, Mycobacterium tuberculosis H37Rv
ccguuucggcgcc

SEQ ID NO: 1289839 - RNA, 17 nt, Mycobacterium tuberculosis H37Rv
ccuaucugccgguaccg

SEQ ID NO: 1289840 - RNA, 20 nt, Mycobacterium tuberculosis H37Rv
ccucaccgaucucgaccagc

SEQ ID NO: 1289841 - RNA, 16 nt, Mycobacterium tuberculosis H37Rv
ccucacaugcccggac

SEQ ID NO: 1289842 - RNA, 16 nt, Mycobacterium tuberculosis H37Rv
ccucaaggucggccag

SEQ ID NO: 1289843 - RNA, 16 nt, Mycobacterium tuberculosis H37Rv
ccucagaggucgccgg

SEQ ID NO: 1289844 - RNA, 16 nt, Mycobacterium tuberculosis H37Rv
ccuccagauucgccgc

SEQ ID NO: 1289845 - RNA, 16 nt, Mycobacterium tuberculosis H37Rv
ccuccaggaucucuuc

SEQ ID NO: 1289846 - RNA, 15 nt, Mycobacterium tuberculosis H37Rv
ccuccagcagguccg

SEQ ID NO: 1289847 - RNA, 17 nt, Mycobacterium tuberculosis H37Rv
ccuccgcaaucgcgacg

SEQ ID NO: 1289848 - RNA, 21 nt, Mycobacterium tuberculosis H37Rv
ccuccgaggccgccaucgccg

SEQ ID NO: 1289849 - RNA, 19 nt, Mycobacterium tuberculosis H37Rv
ccuccgcaucgcggcgacg

SEQ ID NO: 1289850 - RNA, 18 nt, Mycobacterium tuberculosis H37Rv
ccucgaaaccguggccau

SEQ ID NO: 1289851 - RNA, 17 nt, Mycobacterium tuberculosis H37Rv
ccucccacucacccagc

SEQ ID NO: 1289852 - RNA, 21 nt, Mycobacterium tuberculosis H37Rv
ccucccggacuucaugaucgg

SEQ ID NO: 1289853 - RNA, 22 nt, Mycobacterium tuberculosis H37Rv
ccucccaccagcggcggcccuu

SEQ ID NO: 1289854 - RNA, 22 nt, Mycobacterium tuberculosis H37Rv
cgcccgggauaguuuucggccg

SEQ ID NO: 1289855 - RNA, 20 nt, Mycobacterium tuberculosis H37Rv
cgcccgggaucgggucaccg

SEQ ID NO: 1289856 - RNA, 16 nt, Mycobacterium tuberculosis H37Rv
cgcccguacacgauca

SEQ ID NO: 1289857 - RNA, 20 nt, Mycobacterium tuberculosis H37Rv
cgcccguagaacaguucgac

SEQ ID NO: 1289858 - RNA, 22 nt, Mycobacterium tuberculosis H37Rv
cgcccguagaacaguucgacau

SEQ ID NO: 1289859 - RNA, 11 nt, Mycobacterium tuberculosis H37Rv
cgcccgggcac

SEQ ID NO: 1289860 - RNA, 20 nt, Mycobacterium tuberculosis H37Rv
cgcccggaaaggccgcggug

SEQ ID NO: 1289861 - RNA, 21 nt, Mycobacterium tuberculosis H37Rv
cgcccgcuaggcgaagcgucu

SEQ ID NO: 1289862 - RNA, 14 nt, Mycobacterium tuberculosis H37Rv
cgcccgcgugacgc

SEQ ID NO: 1289863 - RNA, 13 nt, Mycobacterium tuberculosis H37Rv
cgcccgcuaccaa

SEQ ID NO: 1289864 - RNA, 12 nt, Mycobacterium tuberculosis H37Rv
cgcccucgucgc

SEQ ID NO: 1289865 - RNA, 17 nt, Mycobacterium tuberculosis H37Rv
cgcccucgucgaucgcc

SEQ ID NO: 1289866 - RNA, 13 nt, Mycobacterium tuberculosis H37Rv
cgcccucggcgac

SEQ ID NO: 1289867 - RNA, 23 nt, Mycobacterium tuberculosis H37Rv
cgcccucaguucacgcucgacga

SEQ ID NO: 1289868 - RNA, 19 nt, Mycobacterium tuberculosis H37Rv
cgcccucaguucacgcucg

SEQ ID NO: 1289869 - RNA, 14 nt, Mycobacterium tuberculosis H37Rv
cgcccucagccgcg

SEQ ID NO: 1289870 - RNA, 20 nt, Mycobacterium tuberculosis H37Rv
cgcccucgacgccgcgcagc

SEQ ID NO: 1289871 - RNA, 19 nt, Mycobacterium tuberculosis H37Rv
cgcccucaguucacguucg

SEQ ID NO: 1289872 - RNA, 20 nt, Mycobacterium tuberculosis H37Rv
cgcccucgacgcgcucgggc

SEQ ID NO: 1289873 - RNA, 14 nt, Mycobacterium tuberculosis H37Rv
cgcccgucgcgaau

SEQ ID NO: 1289874 - RNA, 17 nt, Mycobacterium tuberculosis H37Rv
cgcccguggcggugagc

SEQ ID NO: 1289875 - RNA, 20 nt, Mycobacterium tuberculosis H37Rv
cgcccgcaagucggacgggu

SEQ ID NO: 1289876 - RNA, 14 nt, Mycobacterium tuberculosis H37Rv
cgcccgccgcgaac

SEQ ID NO: 1289877 - RNA, 13 nt, Mycobacterium tuberculosis H37Rv
cgcccgccggcaa

SEQ ID NO: 1289878 - RNA, 18 nt, Mycobacterium tuberculosis H37Rv
cgcccgaguuguggacgc

SEQ ID NO: 1289879 - RNA, 17 nt, Mycobacterium tuberculosis H37Rv
cgcccgagucucgucgg

SEQ ID NO: 1289880 - RNA, 20 nt, Mycobacterium tuberculosis H37Rv
cgcccgaggcaacgaacgcc

SEQ ID NO: 1289881 - RNA, 13 nt, Mycobacterium tuberculosis H37Rv
cgcccgaggcacc

SEQ ID NO: 1289882 - RNA, 14 nt, Mycobacterium tuberculosis H37Rv
cgcccgaucggcgg

SEQ ID NO: 1289883 - RNA, 15 nt, Mycobacterium tuberculosis H37Rv
cgcccgauccgguua

SEQ ID NO: 1289884 - RNA, 15 nt, Mycobacterium tuberculosis H37Rv
cgcccgaucggcgga

SEQ ID NO: 1289885 - RNA, 19 nt, Mycobacterium tuberculosis H37Rv
cgccccgcgccuuggcacc

SEQ ID NO: 1289886 - RNA, 14 nt, Mycobacterium tuberculosis H37Rv
cgccccgcgccuug

SEQ ID NO: 1289887 - RNA, 13 nt, Mycobacterium tuberculosis H37Rv
cgccccgccguug

SEQ ID NO: 1289888 - RNA, 13 nt, Mycobacterium tuberculosis H37Rv
cgccccggccgcu

SEQ ID NO: 1289889 - RNA, 23 nt, Mycobacterium tuberculosis H37Rv
cgcccgacgaggaugucgaugac

SEQ ID NO: 1289890 - RNA, 20 nt, Mycobacterium tuberculosis H37Rv
cgcccgacggaguucgacgu

SEQ ID NO: 1289891 - RNA, 17 nt, Mycobacterium tuberculosis H37Rv
cgcccccgccauugccg

SEQ ID NO: 1289892 - RNA, 18 nt, Mycobacterium tuberculosis H37Rv
cgcccccgccauugccgc

SEQ ID NO: 1289893 - RNA, 14 nt, Mycobacterium tuberculosis H37Rv
cgcccccgucggcc

SEQ ID NO: 1289894 - RNA, 22 nt, Mycobacterium tuberculosis H37Rv
cgcccccguuaccgccgucgcc

SEQ ID NO: 1289895 - RNA, 22 nt, Mycobacterium tuberculosis H37Rv
cgccccgcagcugcgucccgga

SEQ ID NO: 1289896 - RNA, 16 nt, Mycobacterium tuberculosis H37Rv
cgccccgaucggugac

SEQ ID NO: 1289897 - RNA, 15 nt, Mycobacterium tuberculosis H37Rv
cgccccgaucggcca

SEQ ID NO: 1289898 - RNA, 13 nt, Mycobacterium tuberculosis H37Rv
cgccgaccuucgg

SEQ ID NO: 1289899 - RNA, 17 nt, Mycobacterium tuberculosis H37Rv
cgccgaccuucggcccg

SEQ ID NO: 1289900 - RNA, 17 nt, Mycobacterium tuberculosis H37Rv
cgccgacgaacugcagc

SEQ ID NO: 1289901 - RNA, 20 nt, Mycobacterium tuberculosis H37Rv
cgccgacgacuccggcaagc

SEQ ID NO: 1289902 - RNA, 20 nt, Mycobacterium tuberculosis H37Rv
cgccgacgaccgccugcaac

SEQ ID NO: 1289903 - RNA, 21 nt, Mycobacterium tuberculosis H37Rv
cgccgaccgucacugaugggc

SEQ ID NO: 1289904 - RNA, 17 nt, Mycobacterium tuberculosis H37Rv
cgccgaccucaucggca

SEQ ID NO: 1289905 - RNA, 20 nt, Mycobacterium tuberculosis H37Rv
cgccgaccuagucaccuuga

SEQ ID NO: 1289906 - RNA, 16 nt, Mycobacterium tuberculosis H37Rv
cgccgacucggcaccg

SEQ ID NO: 1289907 - RNA, 16 nt, Mycobacterium tuberculosis H37Rv
cgccgacuccgcguag

SEQ ID NO: 1289908 - RNA, 17 nt, Mycobacterium tuberculosis H37Rv
cgccgagauccgcgcuu

SEQ ID NO: 1289909 - RNA, 17 nt, Mycobacterium tuberculosis H37Rv
cgccgagauccacgcca

SEQ ID NO: 1289910 - RNA, 20 nt, Mycobacterium tuberculosis H37Rv
cgccgagaugcuggucggcg

SEQ ID NO: 1289911 - RNA, 16 nt, Mycobacterium tuberculosis H37Rv
cgccgagaugcugguc

SEQ ID NO: 1289912 - RNA, 20 nt, Mycobacterium tuberculosis H37Rv
cgccgagaugcugcacccgg

SEQ ID NO: 1289913 - RNA, 21 nt, Mycobacterium tuberculosis H37Rv
cgccgacguauagaccaggua

SEQ ID NO: 1289914 - RNA, 20 nt, Mycobacterium tuberculosis H37Rv
cgccgagcuggcaacgccgc

SEQ ID NO: 1289915 - RNA, 18 nt, Mycobacterium tuberculosis H37Rv
cgccgagcuagaucacgg

SEQ ID NO: 1289916 - RNA, 14 nt, Mycobacterium tuberculosis H37Rv
cgccgagcuggcgc

SEQ ID NO: 1289917 - RNA, 14 nt, Mycobacterium tuberculosis H37Rv
cgccgaggcguucg

SEQ ID NO: 1289918 - RNA, 17 nt, Mycobacterium tuberculosis H37Rv
cgccgagcuagaucacg

SEQ ID NO: 1289919 - RNA, 16 nt, Mycobacterium tuberculosis H37Rv
cgccgagcucggcgcc

SEQ ID NO: 1289920 - RNA, 18 nt, Mycobacterium tuberculosis H37Rv
cgccgagcggaucgucgu

SEQ ID NO: 1289921 - RNA, 16 nt, Mycobacterium tuberculosis H37Rv
cgccgagcgguugccu

SEQ ID NO: 1289922 - RNA, 21 nt, Mycobacterium tuberculosis H37Rv
cgccgagaugcuggucggcga

SEQ ID NO: 1289923 - RNA, 17 nt, Mycobacterium tuberculosis H37Rv
cgccgagcacacgucgg

SEQ ID NO: 1289924 - RNA, 16 nt, Mycobacterium tuberculosis H37Rv
cgccgaguugaccgcc

SEQ ID NO: 1289925 - RNA, 17 nt, Mycobacterium tuberculosis H37Rv
cgccgaguccggcgagc

SEQ ID NO: 1289926 - RNA, 17 nt, Mycobacterium tuberculosis H37Rv
cgccgaguaccggccag

SEQ ID NO: 1289927 - RNA, 12 nt, Mycobacterium tuberculosis H37Rv
cgccgaggucgg

SEQ ID NO: 1289928 - RNA, 23 nt, Mycobacterium tuberculosis H37Rv
cgccgaggucgaaccgccggcug

SEQ ID NO: 1289929 - RNA, 20 nt, Mycobacterium tuberculosis H37Rv
cgcccugacccggagccgcc

SEQ ID NO: 1289930 - RNA, 13 nt, Mycobacterium tuberculosis H37Rv
cgcccugaccgcc

SEQ ID NO: 1289931 - RNA, 19 nt, Mycobacterium tuberculosis H37Rv
cgcccugagaacacguucg

SEQ ID NO: 1289932 - RNA, 20 nt, Mycobacterium tuberculosis H37Rv
cgcccugacgucacguucgg

SEQ ID NO: 1289933 - RNA, 19 nt, Mycobacterium tuberculosis H37Rv
cgcccuuagggucgccgca

SEQ ID NO: 1289934 - RNA, 17 nt, Mycobacterium tuberculosis H37Rv
cgccgaacaccgguaac

SEQ ID NO: 1289935 - RNA, 23 nt, Mycobacterium tuberculosis H37Rv
cgccgaacaccggcuccagcaug

SEQ ID NO: 1289936 - RNA, 23 nt, Mycobacterium tuberculosis H37Rv
cgccgaacacgcacacgaucgcg

SEQ ID NO: 1289937 - RNA, 24 nt, Mycobacterium tuberculosis H37Rv
cgccgaacagcagcccgcccugac

SEQ ID NO: 1289938 - RNA, 16 nt, Mycobacterium tuberculosis H37Rv
cgccgaaccagcgaug

SEQ ID NO: 1289939 - RNA, 17 nt, Mycobacterium tuberculosis H37Rv
cgccgaauccgacgucg

SEQ ID NO: 1289940 - RNA, 15 nt, Mycobacterium tuberculosis H37Rv
cgccgaauccgacgu

SEQ ID NO: 1289941 - RNA, 18 nt, Mycobacterium tuberculosis H37Rv
cgccgaaguagccgaccg

SEQ ID NO: 1289942 - RNA, 21 nt, Mycobacterium tuberculosis H37Rv
cgccgaaguagacggugguga

SEQ ID NO: 1289943 - RNA, 15 nt, Mycobacterium tuberculosis H37Rv
cgccgaaucgcugac

SEQ ID NO: 1289944 - RNA, 21 nt, Mycobacterium tuberculosis H37Rv
cgccgaccagaacgacgccgc

SEQ ID NO: 1289945 - RNA, 20 nt, Mycobacterium tuberculosis H37Rv
cgccgaacgugcaaccaugg

SEQ ID NO: 1289946 - RNA, 20 nt, Mycobacterium tuberculosis H37Rv
cgccgaacgugcaaccacgg

SEQ ID NO: 1289947 - RNA, 19 nt, Mycobacterium tuberculosis H37Rv
cgccgaaccagcgaugggu

SEQ ID NO: 1289948 - RNA, 13 nt, Mycobacterium tuberculosis H37Rv
cgccgaacgcucc

SEQ ID NO: 1289949 - RNA, 23 nt, Mycobacterium tuberculosis H37Rv
cgccgcaucauagacagggccgc

SEQ ID NO: 1289950 - RNA, 16 nt, Mycobacterium tuberculosis H37Rv
cgccgcaucguuuucg

SEQ ID NO: 1289951 - RNA, 14 nt, Mycobacterium tuberculosis H37Rv
cgccgcaucggcgg

SEQ ID NO: 1289952 - RNA, 14 nt, Mycobacterium tuberculosis H37Rv
cgccgcaucggcga

SEQ ID NO: 1289953 - RNA, 23 nt, Mycobacterium tuberculosis H37Rv
cgccgcauugcagaaccgccaac

SEQ ID NO: 1289954 - RNA, 17 nt, Mycobacterium tuberculosis H37Rv
cgccgcauucggcgaug

SEQ ID NO: 1289955 - RNA, 16 nt, Mycobacterium tuberculosis H37Rv
cgccgauaucgcagau

SEQ ID NO: 1289956 - RNA, 15 nt, Mycobacterium tuberculosis H37Rv
cgccgauaucgguga

SEQ ID NO: 1289957 - RNA, 13 nt, Mycobacterium tuberculosis H37Rv
cgccgaucgaacc

SEQ ID NO: 1289958 - RNA, 23 nt, Mycobacterium tuberculosis H37Rv
cgccgauacccagcgggucgcgg

SEQ ID NO: 1289959 - RNA, 13 nt, Mycobacterium tuberculosis H37Rv
cgccgauaccgcc

SEQ ID NO: 1289960 - RNA, 14 nt, Mycobacterium tuberculosis H37Rv
cgccgauaccgccg

SEQ ID NO: 1289961 - RNA, 13 nt, Mycobacterium tuberculosis H37Rv
cgccgaucgagac

SEQ ID NO: 1289962 - RNA, 17 nt, Mycobacterium tuberculosis H37Rv
cgccgaucuugagccgg

SEQ ID NO: 1289963 - RNA, 15 nt, Mycobacterium tuberculosis H37Rv
cgccgaucgacaccc

SEQ ID NO: 1289964 - RNA, 22 nt, Mycobacterium tuberculosis H37Rv
cgccgauaucggugaccguggc

SEQ ID NO: 1289965 - RNA, 20 nt, Mycobacterium tuberculosis H37Rv
cgccgauaucgcagauggcg

SEQ ID NO: 1289966 - RNA, 18 nt, Mycobacterium tuberculosis H37Rv
cgccgccaagcucggcca

SEQ ID NO: 1289967 - RNA, 12 nt, Mycobacterium tuberculosis H37Rv
cgccgcaucggc

SEQ ID NO: 1289968 - RNA, 18 nt, Mycobacterium tuberculosis H37Rv
cgccgccaccaccgcugc

SEQ ID NO: 1289969 - RNA, 23 nt, Mycobacterium tuberculosis H37Rv
cgccgccaagcucggccaccagc

SEQ ID NO: 1289970 - RNA, 14 nt, Mycobacterium tuberculosis H37Rv
cgccgccaaugcca

SEQ ID NO: 1289971 - RNA, 16 nt, Mycobacterium tuberculosis H37Rv
cgccgccaaugccacc

SEQ ID NO: 1289972 - RNA, 17 nt, Mycobacterium tuberculosis H37Rv
cgccgccaccggcgacg

SEQ ID NO: 1289973 - RNA, 20 nt, Mycobacterium tuberculosis H37Rv
cgccgccaccagcugcgcga

SEQ ID NO: 1289974 - RNA, 14 nt, Mycobacterium tuberculosis H37Rv
cgccgccaccagcg

SEQ ID NO: 1289975 - RNA, 12 nt, Mycobacterium tuberculosis H37Rv
cgccgccaccga

SEQ ID NO: 1289976 - RNA, 20 nt, Mycobacterium tuberculosis H37Rv
cgccgccauugucgccaaau

SEQ ID NO: 1289977 - RNA, 20 nt, Mycobacterium tuberculosis H37Rv
cgccgcccaaaacgucaccg

SEQ ID NO: 1289978 - RNA, 15 nt, Mycobacterium tuberculosis H37Rv
cgccgcccaacgcga

SEQ ID NO: 1289979 - RNA, 15 nt, Mycobacterium tuberculosis H37Rv
cgccgccauuggaca

SEQ ID NO: 1289980 - RNA, 19 nt, Mycobacterium tuberculosis H37Rv
cgccgcccacaugaacgac

SEQ ID NO: 1289981 - RNA, 16 nt, Mycobacterium tuberculosis H37Rv
cgccgccaucgccgau

SEQ ID NO: 1289982 - RNA, 13 nt, Mycobacterium tuberculosis H37Rv
cgccgccaucacg

SEQ ID NO: 1289983 - RNA, 14 nt, Mycobacterium tuberculosis H37Rv
cgccgccaucagcc

SEQ ID NO: 1289984 - RNA, 13 nt, Mycobacterium tuberculosis H37Rv
cgccgccagauga

SEQ ID NO: 1289985 - RNA, 16 nt, Mycobacterium tuberculosis H37Rv
cgccgccagaugagga

SEQ ID NO: 1289986 - RNA, 20 nt, Mycobacterium tuberculosis H37Rv
cgccgccagaugaggacggu

SEQ ID NO: 1289987 - RNA, 15 nt, Mycobacterium tuberculosis H37Rv
cgccgccacugccgg

SEQ ID NO: 1289988 - RNA, 17 nt, Mycobacterium tuberculosis H37Rv
cgccgccccgcucgguu

SEQ ID NO: 1289989 - RNA, 21 nt, Mycobacterium tuberculosis H37Rv
cgccgccauuggacagcgcga

SEQ ID NO: 1289990 - RNA, 20 nt, Mycobacterium tuberculosis H37Rv
cgccgcccgcgccgccgcca

SEQ ID NO: 1289991 - RNA, 15 nt, Mycobacterium tuberculosis H37Rv
cgccgcccggcguau

SEQ ID NO: 1289992 - RNA, 17 nt, Mycobacterium tuberculosis H37Rv
cgccgcccgcgccaccg

SEQ ID NO: 1289993 - RNA, 14 nt, Mycobacterium tuberculosis H37Rv
cgccgccucgggca

SEQ ID NO: 1289994 - RNA, 13 nt, Mycobacterium tuberculosis H37Rv
cgccgccugcgca

SEQ ID NO: 1289995 - RNA, 21 nt, Mycobacterium tuberculosis H37Rv
cgccgccuggacgccgccgga

SEQ ID NO: 1289996 - RNA, 13 nt, Mycobacterium tuberculosis H37Rv
cgccgccgggcag

SEQ ID NO: 1289997 - RNA, 19 nt, Mycobacterium tuberculosis H37Rv
cgccgcgacaaaucggucg

SEQ ID NO: 1289998 - RNA, 20 nt, Mycobacterium tuberculosis H37Rv
cgccgcgaaugucgccgccu

SEQ ID NO: 1289999 - RNA, 23 nt, Mycobacterium tuberculosis H37Rv
cgccgcgacaaaucggucgacga

SEQ ID NO: 1290000 - RNA, 17 nt, Mycobacterium tuberculosis H37Rv
cgccgcgagagccggcg

SEQ ID NO: 1290001 - RNA, 22 nt, Mycobacterium tuberculosis H37Rv
cgccgcgaagcgcucggcagcc

SEQ ID NO: 1290002 - RNA, 22 nt, Mycobacterium tuberculosis H37Rv
cgccgcgaacuccagcagcccg

SEQ ID NO: 1290003 - RNA, 20 nt, Mycobacterium tuberculosis H37Rv
cgccgccuugacccuccgca

SEQ ID NO: 1290004 - RNA, 16 nt, Mycobacterium tuberculosis H37Rv
cgccgcgcauccgcag

SEQ ID NO: 1290005 - RNA, 12 nt, Mycobacterium tuberculosis H37Rv
cgccgcgcagcc

SEQ ID NO: 1290006 - RNA, 20 nt, Mycobacterium tuberculosis H37Rv
cgccgcgauggcgguccacc

SEQ ID NO: 1290007 - RNA, 13 nt, Mycobacterium tuberculosis H37Rv
cgccgcgcaccgc

SEQ ID NO: 1290008 - RNA, 13 nt, Mycobacterium tuberculosis H37Rv
cgccgcgaggaug

SEQ ID NO: 1290009 - RNA, 17 nt, Mycobacterium tuberculosis H37Rv
cgccgcgaggcaccgac

SEQ ID NO: 1290010 - RNA, 22 nt, Mycobacterium tuberculosis H37Rv
cgccgcucccucuacacccgga

SEQ ID NO: 1290011 - RNA, 19 nt, Mycobacterium tuberculosis H37Rv
cgccgcucauccagcgcgu

SEQ ID NO: 1290012 - RNA, 13 nt, Mycobacterium tuberculosis H37Rv
cgccgcucccgca

SEQ ID NO: 1290013 - RNA, 23 nt, Mycobacterium tuberculosis H37Rv
cgccgcuaucgaggaggcggucg

SEQ ID NO: 1290014 - RNA, 19 nt, Mycobacterium tuberculosis H37Rv
cgccgcuaggugacgccgc

SEQ ID NO: 1290015 - RNA, 23 nt, Mycobacterium tuberculosis H37Rv
cgccgcguccucgcccuggccgc

SEQ ID NO: 1290016 - RNA, 18 nt, Mycobacterium tuberculosis H37Rv
cgccgcgucauucaccgc

SEQ ID NO: 1290017 - RNA, 19 nt, Mycobacterium tuberculosis H37Rv
cgccgcguccucgcccugg

SEQ ID NO: 1290018 - RNA, 14 nt, Mycobacterium tuberculosis H37Rv
cgccgcgucgagca

SEQ ID NO: 1290019 - RNA, 18 nt, Mycobacterium tuberculosis H37Rv
cgccgcgguuaucgccga

SEQ ID NO: 1290020 - RNA, 18 nt, Mycobacterium tuberculosis H37Rv
cgccgcgguagacgccgc

SEQ ID NO: 1290021 - RNA, 12 nt, Mycobacterium tuberculosis H37Rv
cgccgcuggucg

SEQ ID NO: 1290022 - RNA, 21 nt, Mycobacterium tuberculosis H37Rv
cgccgcuggagaucacgccga

SEQ ID NO: 1290023 - RNA, 17 nt, Mycobacterium tuberculosis H37Rv
cgccggcacgggcgucg

SEQ ID NO: 1290024 - RNA, 15 nt, Mycobacterium tuberculosis H37Rv
cgccggcaccgccag

SEQ ID NO: 1290025 - RNA, 16 nt, Mycobacterium tuberculosis H37Rv
cgccggcaccgccagu

SEQ ID NO: 1290026 - RNA, 20 nt, Mycobacterium tuberculosis H37Rv
cgccggcaauaccgccagcg

SEQ ID NO: 1290027 - RNA, 20 nt, Mycobacterium tuberculosis H37Rv
cgccggcacauugaucgacg

SEQ ID NO: 1290028 - RNA, 19 nt, Mycobacterium tuberculosis H37Rv
cgccggcaaaggacgucga

SEQ ID NO: 1290029 - RNA, 17 nt, Mycobacterium tuberculosis H37Rv
cgccggacccgccgggu

SEQ ID NO: 1290030 - RNA, 16 nt, Mycobacterium tuberculosis H37Rv
cgccggacccgucgag

SEQ ID NO: 1290031 - RNA, 21 nt, Mycobacterium tuberculosis H37Rv
cgccggacgacaacaggccgu

SEQ ID NO: 1290032 - RNA, 22 nt, Mycobacterium tuberculosis H37Rv
cgccgcgcccaccaugaucaca

SEQ ID NO: 1290033 - RNA, 19 nt, Mycobacterium tuberculosis H37Rv
cgccgcgccccagacgcgc

SEQ ID NO: 1290034 - RNA, 17 nt, Mycobacterium tuberculosis H37Rv
cgccgcgcccaccauga

SEQ ID NO: 1290035 - RNA, 12 nt, Mycobacterium tuberculosis H37Rv
cgccgcgccgau

SEQ ID NO: 1290036 - RNA, 17 nt, Mycobacterium tuberculosis H37Rv
cgccgcgcguucggcgc

SEQ ID NO: 1290037 - RNA, 14 nt, Mycobacterium tuberculosis H37Rv
cgccgcgcguucgg

SEQ ID NO: 1290038 - RNA, 12 nt, Mycobacterium tuberculosis H37Rv
cgccgcgcucga

SEQ ID NO: 1290039 - RNA, 15 nt, Mycobacterium tuberculosis H37Rv
cgccgcgcucgacga

SEQ ID NO: 1290040 - RNA, 16 nt, Mycobacterium tuberculosis H37Rv
cgccgcgcucgccgau

SEQ ID NO: 1290041 - RNA, 15 nt, Mycobacterium tuberculosis H37Rv
cgccgcgccgucccg

SEQ ID NO: 1290042 - RNA, 13 nt, Mycobacterium tuberculosis H37Rv
cgccgcggcaggg

SEQ ID NO: 1290043 - RNA, 23 nt, Mycobacterium tuberculosis H37Rv
cgccgcggcagcguugacgguca

SEQ ID NO: 1290044 - RNA, 16 nt, Mycobacterium tuberculosis H37Rv
cgccgcggcagcguug

SEQ ID NO: 1290045 - RNA, 20 nt, Mycobacterium tuberculosis H37Rv
cgccgcggcagcguugacgg

SEQ ID NO: 1290046 - RNA, 19 nt, Mycobacterium tuberculosis H37Rv
cgccgcgggacaccaccgc

SEQ ID NO: 1290047 - RNA, 15 nt, Mycobacterium tuberculosis H37Rv
cgccgcggcggcagc

SEQ ID NO: 1290048 - RNA, 22 nt, Mycobacterium tuberculosis H37Rv
cgcgaucggggcgacgauccgc

SEQ ID NO: 1290049 - RNA, 12 nt, Mycobacterium tuberculosis H37Rv
cgcgaucggugc

SEQ ID NO: 1290050 - RNA, 17 nt, Mycobacterium tuberculosis H37Rv
cgcgaucggcgucacga

SEQ ID NO: 1290051 - RNA, 17 nt, Mycobacterium tuberculosis H37Rv
cgcgaugacggugccga

SEQ ID NO: 1290052 - RNA, 24 nt, Mycobacterium tuberculosis H37Rv
cgcgaugaccgcaccgaccugagu

SEQ ID NO: 1290053 - RNA, 19 nt, Mycobacterium tuberculosis H37Rv
cgcgaugacgacgaaccgg

SEQ ID NO: 1290054 - RNA, 20 nt, Mycobacterium tuberculosis H37Rv
cgcgaugaccgcaccgaccu

SEQ ID NO: 1290055 - RNA, 18 nt, Mycobacterium tuberculosis H37Rv
cgcgaugacacaccgcgu

SEQ ID NO: 1290056 - RNA, 21 nt, Mycobacterium tuberculosis H37Rv
cgcgaugacggugccgaccgc

SEQ ID NO: 1290057 - RNA, 19 nt, Mycobacterium tuberculosis H37Rv
cgcgaugaucaugaacgcc

SEQ ID NO: 1290058 - RNA, 23 nt, Mycobacterium tuberculosis H37Rv
cgcgaugauaccugcccacgcgg

SEQ ID NO: 1290059 - RNA, 16 nt, Mycobacterium tuberculosis H37Rv
cgcgauccgcgcgcau

SEQ ID NO: 1290060 - RNA, 18 nt, Mycobacterium tuberculosis H37Rv
cgcgaucaguugcucguu

SEQ ID NO: 1290061 - RNA, 11 nt, Mycobacterium tuberculosis H37Rv
cgcgaucgcga

SEQ ID NO: 1290062 - RNA, 17 nt, Mycobacterium tuberculosis H37Rv
cgcgaucgcagugagca

SEQ ID NO: 1290063 - RNA, 18 nt, Mycobacterium tuberculosis H37Rv
cgcgaucgccgacgccag

SEQ ID NO: 1290064 - RNA, 17 nt, Mycobacterium tuberculosis H37Rv
cgcgaugugcgccaccu

SEQ ID NO: 1290065 - RNA, 14 nt, Mycobacterium tuberculosis H37Rv
cgcgaugucguucg

SEQ ID NO: 1290066 - RNA, 17 nt, Mycobacterium tuberculosis H37Rv
cgcgcaacccugccgcg

SEQ ID NO: 1290067 - RNA, 18 nt, Mycobacterium tuberculosis H37Rv
cgcgcaacccggacgaac

SEQ ID NO: 1290068 - RNA, 23 nt, Mycobacterium tuberculosis H37Rv
cgcgcaacaccucgucggcuuug

SEQ ID NO: 1290069 - RNA, 23 nt, Mycobacterium tuberculosis H37Rv
cgcgcaaccagauccgguccacc

SEQ ID NO: 1290070 - RNA, 20 nt, Mycobacterium tuberculosis H37Rv
cgcgcaaaugccugcugguc

SEQ ID NO: 1290071 - RNA, 15 nt, Mycobacterium tuberculosis H37Rv
cgcgaugcuucccgg

SEQ ID NO: 1290072 - RNA, 18 nt, Mycobacterium tuberculosis H37Rv
cgcgauggcagcgccgau

SEQ ID NO: 1290073 - RNA, 20 nt, Mycobacterium tuberculosis H37Rv
cgcgaugccccacggugcgg

SEQ ID NO: 1290074 - RNA, 17 nt, Mycobacterium tuberculosis H37Rv
cgcgauggcguagccca

SEQ ID NO: 1290075 - RNA, 18 nt, Mycobacterium tuberculosis H37Rv
cgcgaugggauaccgcgu

SEQ ID NO: 1290076 - RNA, 22 nt, Mycobacterium tuberculosis H37Rv
cgcgauagauacccgcggcagc

SEQ ID NO: 1290077 - RNA, 20 nt, Mycobacterium tuberculosis H37Rv
cgcgaucaccgagucgacgg

SEQ ID NO: 1290078 - RNA, 21 nt, Mycobacterium tuberculosis H37Rv
cgcgaucaccgacgaugccgc

SEQ ID NO: 1290079 - RNA, 21 nt, Mycobacterium tuberculosis H37Rv
cgcgaucacuuccggauucgg

SEQ ID NO: 1290080 - RNA, 14 nt, Mycobacterium tuberculosis H37Rv
cgcgaucagcgcgc

SEQ ID NO: 1290081 - RNA, 22 nt, Mycobacterium tuberculosis H37Rv
cgcgaguaaucgaccgaacgcc

SEQ ID NO: 1290082 - RNA, 16 nt, Mycobacterium tuberculosis H37Rv
cgcgagucgcccguga

SEQ ID NO: 1290083 - RNA, 12 nt, Mycobacterium tuberculosis H37Rv
cgcgagucggcg

SEQ ID NO: 1290084 - RNA, 23 nt, Mycobacterium tuberculosis H37Rv
cgcgagggggguguugaggccgg

SEQ ID NO: 1290085 - RNA, 18 nt, Mycobacterium tuberculosis H37Rv
cgcgaggucggcggcgca

SEQ ID NO: 1290086 - RNA, 22 nt, Mycobacterium tuberculosis H37Rv
cgcgaggugaaucgcgucgaga

SEQ ID NO: 1290087 - RNA, 21 nt, Mycobacterium tuberculosis H37Rv
cgcgaggggccggcucaguca

SEQ ID NO: 1290088 - RNA, 13 nt, Mycobacterium tuberculosis H37Rv
cgcgagcagcccg

SEQ ID NO: 1290089 - RNA, 15 nt, Mycobacterium tuberculosis H37Rv
cgcgagaacacccgu

SEQ ID NO: 1290090 - RNA, 18 nt, Mycobacterium tuberculosis H37Rv
cgcgagccggugauccgg

SEQ ID NO: 1290091 - RNA, 13 nt, Mycobacterium tuberculosis H37Rv
cgcgagccgguga

SEQ ID NO: 1290092 - RNA, 23 nt, Mycobacterium tuberculosis H37Rv
cgcgagccagcugcuccacccga

SEQ ID NO: 1290093 - RNA, 16 nt, Mycobacterium tuberculosis H37Rv
cgcgagcccauggacc

SEQ ID NO: 1290094 - RNA, 18 nt, Mycobacterium tuberculosis H37Rv
cgcgagccgcacgaugcc

SEQ ID NO: 1290095 - RNA, 21 nt, Mycobacterium tuberculosis H37Rv
cgcgagcggaugaaaucggca

SEQ ID NO: 1290096 - RNA, 20 nt, Mycobacterium tuberculosis H37Rv
cgcgagcgccgcuaugaggc

SEQ ID NO: 1290097 - RNA, 14 nt, Mycobacterium tuberculosis H37Rv
cgcgagcgagccaa

SEQ ID NO: 1290098 - RNA, 13 nt, Mycobacterium tuberculosis H37Rv
cgcgagcgcgcga

SEQ ID NO: 1290099 - RNA, 22 nt, Mycobacterium tuberculosis H37Rv
cgcgaggaggcuuacaugcccu

SEQ ID NO: 1290100 - RNA, 20 nt, Mycobacterium tuberculosis H37Rv
cgcgagcuuggccagcagca

SEQ ID NO: 1290101 - RNA, 22 nt, Mycobacterium tuberculosis H37Rv
cgcgagcuguaggucagcgcgu

SEQ ID NO: 1290102 - RNA, 21 nt, Mycobacterium tuberculosis H37Rv
cgcgacauauuguugugccgc

SEQ ID NO: 1290103 - RNA, 20 nt, Mycobacterium tuberculosis H37Rv
cgcgaccggcguaaccggca

SEQ ID NO: 1290104 - RNA, 22 nt, Mycobacterium tuberculosis H37Rv
cgcgaccgucagggucaccugc

SEQ ID NO: 1290105 - RNA, 20 nt, Mycobacterium tuberculosis H37Rv
cgcgaccgucagggucaccu

SEQ ID NO: 1290106 - RNA, 17 nt, Mycobacterium tuberculosis H37Rv
cgcgaccuccgcgauca

SEQ ID NO: 1290107 - RNA, 22 nt, Mycobacterium tuberculosis H37Rv
cgcgaccuccgcgaucaccgac

SEQ ID NO: 1290108 - RNA, 13 nt, Mycobacterium tuberculosis H37Rv
cgcgacgacauug

SEQ ID NO: 1290109 - RNA, 19 nt, Mycobacterium tuberculosis H37Rv
cgcgaccuggucgaacugu

SEQ ID NO: 1290110 - RNA, 13 nt, Mycobacterium tuberculosis H37Rv
cgcgacgcucgcu

SEQ ID NO: 1290111 - RNA, 16 nt, Mycobacterium tuberculosis H37Rv
cgcgacgcggggcuca

SEQ ID NO: 1290112 - RNA, 14 nt, Mycobacterium tuberculosis H37Rv
cgcgacgccguccu

SEQ ID NO: 1290113 - RNA, 22 nt, Mycobacterium tuberculosis H37Rv
cgcgacgaugugguccaucgcg

SEQ ID NO: 1290114 - RNA, 14 nt, Mycobacterium tuberculosis H37Rv
cgcgacgcacugcc

SEQ ID NO: 1290115 - RNA, 23 nt, Mycobacterium tuberculosis H37Rv
cgcgacggcccgaucccgaucga

SEQ ID NO: 1290116 - RNA, 18 nt, Mycobacterium tuberculosis H37Rv
cgcgacggcauguaccga

SEQ ID NO: 1290117 - RNA, 21 nt, Mycobacterium tuberculosis H37Rv
cgcgacggcauguaccgaccg

SEQ ID NO: 1290118 - RNA, 16 nt, Mycobacterium tuberculosis H37Rv
cgcgacggcgcggugc

SEQ ID NO: 1290119 - RNA, 20 nt, Mycobacterium tuberculosis H37Rv
cgcgacguaguggaagccga

SEQ ID NO: 1290120 - RNA, 18 nt, Mycobacterium tuberculosis H37Rv
cgcgacguaguggaagcc

SEQ ID NO: 1290121 - RNA, 21 nt, Mycobacterium tuberculosis H37Rv
cgcgacguaguggaagccgac

SEQ ID NO: 1290122 - RNA, 18 nt, Mycobacterium tuberculosis H37Rv
cgcgacguaguugccggc

SEQ ID NO: 1290123 - RNA, 16 nt, Mycobacterium tuberculosis H37Rv
cgcgacuagacgccgc

SEQ ID NO: 1290124 - RNA, 20 nt, Mycobacterium tuberculosis H37Rv
cgcgacugauccucgaugac

SEQ ID NO: 1290125 - RNA, 20 nt, Mycobacterium tuberculosis H37Rv
cgcgacguccaccagccggu

SEQ ID NO: 1290126 - RNA, 14 nt, Mycobacterium tuberculosis H37Rv
cgcgacgucggccg

SEQ ID NO: 1290127 - RNA, 12 nt, Mycobacterium tuberculosis H37Rv
cgcgacgucugc

SEQ ID NO: 1290128 - RNA, 22 nt, Mycobacterium tuberculosis H37Rv
cgcgacuugcaccccgucucgg

SEQ ID NO: 1290129 - RNA, 13 nt, Mycobacterium tuberculosis H37Rv
cgcgacagugcgc

SEQ ID NO: 1290130 - RNA, 14 nt, Mycobacterium tuberculosis H37Rv
cgcgacaggugcua

SEQ ID NO: 1290131 - RNA, 23 nt, Mycobacterium tuberculosis H37Rv
cgcgaaaugccugcgcgaugcga

SEQ ID NO: 1290132 - RNA, 22 nt, Mycobacterium tuberculosis H37Rv
cgcgacagacagcaccgccggu

SEQ ID NO: 1290133 - RNA, 19 nt, Mycobacterium tuberculosis H37Rv
cgcgacagacagcaccgcc

SEQ ID NO: 1290134 - RNA, 19 nt, Mycobacterium tuberculosis H37Rv
cgcgaagucguccagaaug

SEQ ID NO: 1290135 - RNA, 21 nt, Mycobacterium tuberculosis H37Rv
cgcgaagucuugaccgcaccg

SEQ ID NO: 1290136 - RNA, 17 nt, Mycobacterium tuberculosis H37Rv
cgcgaacuccagcagcc

SEQ ID NO: 1290137 - RNA, 23 nt, Mycobacterium tuberculosis H37Rv
cgcgaacgggucgggacgcugcc

SEQ ID NO: 1290138 - RNA, 14 nt, Mycobacterium tuberculosis H37Rv
cgcgaaaccggacc

SEQ ID NO: 1290139 - RNA, 22 nt, Mycobacterium tuberculosis H37Rv
cgcgaaagccugcuucaggauc

SEQ ID NO: 1290140 - RNA, 15 nt, Mycobacterium tuberculosis H37Rv
cgccuuuggcguucu

SEQ ID NO: 1290141 - RNA, 17 nt, Mycobacterium tuberculosis H37Rv
cgccuuugagcccgcga

SEQ ID NO: 1290142 - RNA, 12 nt, Mycobacterium tuberculosis H37Rv
cgccuuggucgc

SEQ ID NO: 1290143 - RNA, 13 nt, Mycobacterium tuberculosis H37Rv
cgccuuggucgcg

SEQ ID NO: 1290144 - RNA, 14 nt, Mycobacterium tuberculosis H37Rv
cgccuuggucaccu

SEQ ID NO: 1290145 - RNA, 15 nt, Mycobacterium tuberculosis H37Rv
cgccugcuggccgcg

SEQ ID NO: 1290146 - RNA, 15 nt, Mycobacterium tuberculosis H37Rv
cgccugcugguaccg

SEQ ID NO: 1290147 - RNA, 12 nt, Mycobacterium tuberculosis H37Rv
cgccucaccgac

SEQ ID NO: 1290148 - RNA, 20 nt, Mycobacterium tuberculosis H37Rv
cgccucaaugaccaccgggc

SEQ ID NO: 1290149 - RNA, 14 nt, Mycobacterium tuberculosis H37Rv
cgccucaagcucgc

SEQ ID NO: 1290150 - RNA, 17 nt, Mycobacterium tuberculosis H37Rv
cgccucaccgacgucgc

SEQ ID NO: 1290151 - RNA, 14 nt, Mycobacterium tuberculosis H37Rv
cgccuccucgacgu

SEQ ID NO: 1290152 - RNA, 14 nt, Mycobacterium tuberculosis H37Rv
cgccuccugccgcc

SEQ ID NO: 1290153 - RNA, 19 nt, Mycobacterium tuberculosis H37Rv
cgccucgauaucgucggga

SEQ ID NO: 1290154 - RNA, 13 nt, Mycobacterium tuberculosis H37Rv
cgccucgcccagc

SEQ ID NO: 1290155 - RNA, 13 nt, Mycobacterium tuberculosis H37Rv
cgccucgccgaag

SEQ ID NO: 1290156 - RNA, 19 nt, Mycobacterium tuberculosis H37Rv
cgccucgaggaccaccacu

SEQ ID NO: 1290157 - RNA, 15 nt, Mycobacterium tuberculosis H37Rv
cgccucgacacccag

SEQ ID NO: 1290158 - RNA, 17 nt, Mycobacterium tuberculosis H37Rv
cgccugcuccucggcca

SEQ ID NO: 1290159 - RNA, 15 nt, Mycobacterium tuberculosis H37Rv
cgccucgucgucgga

SEQ ID NO: 1290160 - RNA, 17 nt, Mycobacterium tuberculosis H37Rv
cgccugcccgggugaga

SEQ ID NO: 1290161 - RNA, 16 nt, Mycobacterium tuberculosis H37Rv
cgccugccgaaacgcc

SEQ ID NO: 1290162 - RNA, 14 nt, Mycobacterium tuberculosis H37Rv
cgccugccgcuggu

SEQ ID NO: 1290163 - RNA, 16 nt, Mycobacterium tuberculosis H37Rv
cgccugccucaccgcc

SEQ ID NO: 1290164 - RNA, 20 nt, Mycobacterium tuberculosis H37Rv
cgccugacucaucaccgaug

SEQ ID NO: 1290165 - RNA, 23 nt, Mycobacterium tuberculosis H37Rv
cgccugacgguaaaugucgaaca

SEQ ID NO: 1290166 - RNA, 16 nt, Mycobacterium tuberculosis H37Rv
cgccugaggugcugcc

SEQ ID NO: 1290167 - RNA, 23 nt, Mycobacterium tuberculosis H37Rv
cgccugccaucacgcgcucaccg

SEQ ID NO: 1290168 - RNA, 21 nt, Mycobacterium tuberculosis H37Rv
cgccucgugaguugacggugg

SEQ ID NO: 1290169 - RNA, 20 nt, Mycobacterium tuberculosis H37Rv
cgccguggaacacgaagucg

SEQ ID NO: 1290170 - RNA, 19 nt, Mycobacterium tuberculosis H37Rv
cgccgugugcaucggcgac

SEQ ID NO: 1290171 - RNA, 15 nt, Mycobacterium tuberculosis H37Rv
cgccguucacccugg

SEQ ID NO: 1290172 - RNA, 15 nt, Mycobacterium tuberculosis H37Rv
cgccguuagcgucgc

SEQ ID NO: 1290173 - RNA, 22 nt, Mycobacterium tuberculosis H37Rv
cgccguugaucuugacggucgc

SEQ ID NO: 1290174 - RNA, 19 nt, Mycobacterium tuberculosis H37Rv
cgccuagcacgaagcuggc

SEQ ID NO: 1290175 - RNA, 18 nt, Mycobacterium tuberculosis H37Rv
cgccuaagcauucagcgc

SEQ ID NO: 1290176 - RNA, 18 nt, Mycobacterium tuberculosis H37Rv
cgccguucgggaugcaag

SEQ ID NO: 1290177 - RNA, 20 nt, Mycobacterium tuberculosis H37Rv
cgccuaagcauucagcgcgc

SEQ ID NO: 1290178 - RNA, 23 nt, Mycobacterium tuberculosis H37Rv
cgccuaaucggccugccggcagc

SEQ ID NO: 1290179 - RNA, 22 nt, Mycobacterium tuberculosis H37Rv
cgccgugaguagguccacguuc

SEQ ID NO: 1290180 - RNA, 15 nt, Mycobacterium tuberculosis H37Rv
cgccgucgacgucga

SEQ ID NO: 1290181 - RNA, 22 nt, Mycobacterium tuberculosis H37Rv
cgccgucgacaacaaacccggc

SEQ ID NO: 1290182 - RNA, 12 nt, Mycobacterium tuberculosis H37Rv
cgccgucgacca

SEQ ID NO: 1290183 - RNA, 18 nt, Mycobacterium tuberculosis H37Rv
cgccgucgaagacguugg

SEQ ID NO: 1290184 - RNA, 21 nt, Mycobacterium tuberculosis H37Rv
cgccgucgaaccaguccucgg

SEQ ID NO: 1290185 - RNA, 16 nt, Mycobacterium tuberculosis H37Rv
cgccgucccggcucga

SEQ ID NO: 1290186 - RNA, 14 nt, Mycobacterium tuberculosis H37Rv
cgccgucaugccca

SEQ ID NO: 1290187 - RNA, 15 nt, Mycobacterium tuberculosis H37Rv
cgccguccccaccga

SEQ ID NO: 1290188 - RNA, 15 nt, Mycobacterium tuberculosis H37Rv
cgccguccccgccgu

SEQ ID NO: 1290189 - RNA, 18 nt, Mycobacterium tuberculosis H37Rv
cgccguccccgccgccgu

SEQ ID NO: 1290190 - RNA, 18 nt, Mycobacterium tuberculosis H37Rv
cgccguccccgccgucgc

SEQ ID NO: 1290191 - RNA, 20 nt, Mycobacterium tuberculosis H37Rv
cgccgucccgaaacgccggg

SEQ ID NO: 1290192 - RNA, 16 nt, Mycobacterium tuberculosis H37Rv
cgccgucacgcacgcc

SEQ ID NO: 1290193 - RNA, 18 nt, Mycobacterium tuberculosis H37Rv
cgccgucacgcacgccgc

SEQ ID NO: 1290194 - RNA, 13 nt, Mycobacterium tuberculosis H37Rv
cgccgucaccgcc

SEQ ID NO: 1290195 - RNA, 13 nt, Mycobacterium tuberculosis H37Rv
cgccguaucgggg

SEQ ID NO: 1290196 - RNA, 13 nt, Mycobacterium tuberculosis H37Rv
cgccguaugccgc

SEQ ID NO: 1290197 - RNA, 17 nt, Mycobacterium tuberculosis H37Rv
cgccgucacccccgaua

SEQ ID NO: 1290198 - RNA, 16 nt, Mycobacterium tuberculosis H37Rv
cgccgucaccgccguu

SEQ ID NO: 1290199 - RNA, 13 nt, Mycobacterium tuberculosis H37Rv
cgccgucaccgcg

SEQ ID NO: 1290200 - RNA, 14 nt, Mycobacterium tuberculosis H37Rv
cgccguagaccagc

SEQ ID NO: 1290201 - RNA, 18 nt, Mycobacterium tuberculosis H37Rv
cgccguagcaucgggcga

SEQ ID NO: 1290202 - RNA, 17 nt, Mycobacterium tuberculosis H37Rv
cgccguaagcaccagcc

SEQ ID NO: 1290203 - RNA, 16 nt, Mycobacterium tuberculosis H37Rv
cgccguaagcaccagc

SEQ ID NO: 1290204 - RNA, 15 nt, Mycobacterium tuberculosis H37Rv
cgccguaacagccgg

SEQ ID NO: 1290205 - RNA, 21 nt, Mycobacterium tuberculosis H37Rv
cgccguaagcaccagccagcc

SEQ ID NO: 1290206 - RNA, 21 nt, Mycobacterium tuberculosis H37Rv
cgccguacagcggcggcgucg

SEQ ID NO: 1290207 - RNA, 13 nt, Mycobacterium tuberculosis H37Rv
cgccguacaucag

SEQ ID NO: 1290208 - RNA, 15 nt, Mycobacterium tuberculosis H37Rv
cgccguacaucagcg

SEQ ID NO: 1290209 - RNA, 14 nt, Mycobacterium tuberculosis H37Rv
cgccggugaggcga

SEQ ID NO: 1290210 - RNA, 18 nt, Mycobacterium tuberculosis H37Rv
cgccggugaggaucagcg

SEQ ID NO: 1290211 - RNA, 18 nt, Mycobacterium tuberculosis H37Rv
cgccggugacgacgucgc

SEQ ID NO: 1290212 - RNA, 15 nt, Mycobacterium tuberculosis H37Rv
cgccggugacgacgu

SEQ ID NO: 1290213 - RNA, 19 nt, Mycobacterium tuberculosis H37Rv
cgccgguuacccggaccgu

SEQ ID NO: 1290214 - RNA, 20 nt, Mycobacterium tuberculosis H37Rv
cgccgguuacccggaccguc

SEQ ID NO: 1290215 - RNA, 16 nt, Mycobacterium tuberculosis H37Rv
cgccggugccaccgac

SEQ ID NO: 1290216 - RNA, 15 nt, Mycobacterium tuberculosis H37Rv
cgccggcaucgguca

SEQ ID NO: 1290217 - RNA, 14 nt, Mycobacterium tuberculosis H37Rv
cgccggcaucgucg

SEQ ID NO: 1290218 - RNA, 15 nt, Mycobacterium tuberculosis H37Rv
cgccggcaucgucga

SEQ ID NO: 1290219 - RNA, 19 nt, Mycobacterium tuberculosis H37Rv
cgccgggauaucgucgacg

SEQ ID NO: 1290220 - RNA, 20 nt, Mycobacterium tuberculosis H37Rv
cgccgggauaucgucgacgc

SEQ ID NO: 1290221 - RNA, 14 nt, Mycobacterium tuberculosis H37Rv
cgccgggaucaccg

SEQ ID NO: 1290222 - RNA, 23 nt, Mycobacterium tuberculosis H37Rv
cgccgggcaauacguagucgccg

SEQ ID NO: 1290223 - RNA, 14 nt, Mycobacterium tuberculosis H37Rv
cgccggcagcgcgg

SEQ ID NO: 1290224 - RNA, 15 nt, Mycobacterium tuberculosis H37Rv
cgccggcaucgacgu

SEQ ID NO: 1290225 - RNA, 20 nt, Mycobacterium tuberculosis H37Rv
cgccggcaccuccggcaccg

SEQ ID NO: 1290226 - RNA, 17 nt, Mycobacterium tuberculosis H37Rv
cgccgggcccucgccau

SEQ ID NO: 1290227 - RNA, 21 nt, Mycobacterium tuberculosis H37Rv
cgccgggccaggccgaugccg

SEQ ID NO: 1290228 - RNA, 15 nt, Mycobacterium tuberculosis H37Rv
cgccgggcaucggcg

SEQ ID NO: 1290229 - RNA, 22 nt, Mycobacterium tuberculosis H37Rv
cgccgguaacuguccgcccgga

SEQ ID NO: 1290230 - RNA, 19 nt, Mycobacterium tuberculosis H37Rv
cgccgguccccucggugcc

SEQ ID NO: 1290231 - RNA, 18 nt, Mycobacterium tuberculosis H37Rv
cgccggguuuauccaguc

SEQ ID NO: 1290232 - RNA, 16 nt, Mycobacterium tuberculosis H37Rv
cgccgggguagacgcc

SEQ ID NO: 1290233 - RNA, 16 nt, Mycobacterium tuberculosis H37Rv
cgccgggugucggugg

SEQ ID NO: 1290234 - RNA, 15 nt, Mycobacterium tuberculosis H37Rv
cgccgggugcgccgu

SEQ ID NO: 1290235 - RNA, 16 nt, Mycobacterium tuberculosis H37Rv
cgcgcugaaccagaug

SEQ ID NO: 1290236 - RNA, 15 nt, Mycobacterium tuberculosis H37Rv
cgcgcuggcgcccuu

SEQ ID NO: 1290237 - RNA, 18 nt, Mycobacterium tuberculosis H37Rv
cgcgcugggcgcgcucau

SEQ ID NO: 1290238 - RNA, 14 nt, Mycobacterium tuberculosis H37Rv
cgcggaagccgccu

SEQ ID NO: 1290239 - RNA, 20 nt, Mycobacterium tuberculosis H37Rv
cgcgcuggucaacuccacgc

SEQ ID NO: 1290240 - RNA, 17 nt, Mycobacterium tuberculosis H37Rv
cgcgcuggugauucgca

SEQ ID NO: 1290241 - RNA, 24 nt, Mycobacterium tuberculosis H37Rv
cgcgcuggugauucgcagccgauc

SEQ ID NO: 1290242 - RNA, 15 nt, Mycobacterium tuberculosis H37Rv
cgcggacacucgcgg

SEQ ID NO: 1290243 - RNA, 14 nt, Mycobacterium tuberculosis H37Rv
cgcggacacugcga

SEQ ID NO: 1290244 - RNA, 19 nt, Mycobacterium tuberculosis H37Rv
cgcggaauccgcggcgauc

SEQ ID NO: 1290245 - RNA, 20 nt, Mycobacterium tuberculosis H37Rv
cgcggaauccgcggcgauca

SEQ ID NO: 1290246 - RNA, 21 nt, Mycobacterium tuberculosis H37Rv
cgcggauacgggcagugaaca

SEQ ID NO: 1290247 - RNA, 17 nt, Mycobacterium tuberculosis H37Rv
cgcggaucaccaucgcc

SEQ ID NO: 1290248 - RNA, 24 nt, Mycobacterium tuberculosis H37Rv
cgcggaucaaaaaccacgcgucgc

SEQ ID NO: 1290249 - RNA, 24 nt, Mycobacterium tuberculosis H37Rv
cgcggaucacgaaaucgcccugac

SEQ ID NO: 1290250 - RNA, 17 nt, Mycobacterium tuberculosis H37Rv
cgcggaugcucagguca

SEQ ID NO: 1290251 - RNA, 15 nt, Mycobacterium tuberculosis H37Rv
cgcggaugagcucgg

SEQ ID NO: 1290252 - RNA, 16 nt, Mycobacterium tuberculosis H37Rv
cgcggauguccaggag

SEQ ID NO: 1290253 - RNA, 15 nt, Mycobacterium tuberculosis H37Rv
cgcggaucugggcgg

SEQ ID NO: 1290254 - RNA, 15 nt, Mycobacterium tuberculosis H37Rv
cgcggaucgaccgcc

SEQ ID NO: 1290255 - RNA, 20 nt, Mycobacterium tuberculosis H37Rv
cgcgcguucggcgagcagcg

SEQ ID NO: 1290256 - RNA, 16 nt, Mycobacterium tuberculosis H37Rv
cgcgcguugaagucgc

SEQ ID NO: 1290257 - RNA, 16 nt, Mycobacterium tuberculosis H37Rv
cgcgcguuccagcaca

SEQ ID NO: 1290258 - RNA, 17 nt, Mycobacterium tuberculosis H37Rv
cgcgcguggucgccccg

SEQ ID NO: 1290259 - RNA, 16 nt, Mycobacterium tuberculosis H37Rv
cgcgcuaucaugacca

SEQ ID NO: 1290260 - RNA, 13 nt, Mycobacterium tuberculosis H37Rv
cgcgcucaacggc

SEQ ID NO: 1290261 - RNA, 21 nt, Mycobacterium tuberculosis H37Rv
cgcgcuaaggugggcacagcg

SEQ ID NO: 1290262 - RNA, 15 nt, Mycobacterium tuberculosis H37Rv
cgcgcguugcgguca

SEQ ID NO: 1290263 - RNA, 20 nt, Mycobacterium tuberculosis H37Rv
cgcgcugaaaugccgucguc

SEQ ID NO: 1290264 - RNA, 18 nt, Mycobacterium tuberculosis H37Rv
cgcgcuaucaugaccacc

SEQ ID NO: 1290265 - RNA, 18 nt, Mycobacterium tuberculosis H37Rv
cgcgcucgcucaccggcu

SEQ ID NO: 1290266 - RNA, 21 nt, Mycobacterium tuberculosis H37Rv
cgcgcgccuuggccagcgcgu

SEQ ID NO: 1290267 - RNA, 19 nt, Mycobacterium tuberculosis H37Rv
cgcgcggggcggcugcggg

SEQ ID NO: 1290268 - RNA, 20 nt, Mycobacterium tuberculosis H37Rv
cgcgcggggugcgcgcgacc

SEQ ID NO: 1290269 - RNA, 16 nt, Mycobacterium tuberculosis H37Rv
cgcgcgggugcaaccg

SEQ ID NO: 1290270 - RNA, 21 nt, Mycobacterium tuberculosis H37Rv
cgcgcggguacuuacgggucg

SEQ ID NO: 1290271 - RNA, 14 nt, Mycobacterium tuberculosis H37Rv
cgcgcgccaucgcc

SEQ ID NO: 1290272 - RNA, 19 nt, Mycobacterium tuberculosis H37Rv
cgcgcgccauuggcggugg

SEQ ID NO: 1290273 - RNA, 20 nt, Mycobacterium tuberculosis H37Rv
cgcgcgccgaccgacgucgc

SEQ ID NO: 1290274 - RNA, 21 nt, Mycobacterium tuberculosis H37Rv
cgcgcgaccucgcuggccgca

SEQ ID NO: 1290275 - RNA, 12 nt, Mycobacterium tuberculosis H37Rv
cgcgcgaccaug

SEQ ID NO: 1290276 - RNA, 16 nt, Mycobacterium tuberculosis H37Rv
cgcgcgaccgcgaugg

SEQ ID NO: 1290277 - RNA, 18 nt, Mycobacterium tuberculosis H37Rv
cgcgcgaaccccagccga

SEQ ID NO: 1290278 - RNA, 18 nt, Mycobacterium tuberculosis H37Rv
cgcgcgacaacccggcgu

SEQ ID NO: 1290279 - RNA, 14 nt, Mycobacterium tuberculosis H37Rv
cgcgcgagaacacc

SEQ ID NO: 1290280 - RNA, 14 nt, Mycobacterium tuberculosis H37Rv
cgcgcgacuguaca

SEQ ID NO: 1290281 - RNA, 12 nt, Mycobacterium tuberculosis H37Rv
cgcgcgacggac

SEQ ID NO: 1290282 - RNA, 14 nt, Mycobacterium tuberculosis H37Rv
cgcgcgacggacca

SEQ ID NO: 1290283 - RNA, 16 nt, Mycobacterium tuberculosis H37Rv
cgcgcgaccuggucga

SEQ ID NO: 1290284 - RNA, 21 nt, Mycobacterium tuberculosis H37Rv
cgcgcgagagccuccauggcc

SEQ ID NO: 1290285 - RNA, 17 nt, Mycobacterium tuberculosis H37Rv
cgcgcgagccgcuccaa

SEQ ID NO: 1290286 - RNA, 14 nt, Mycobacterium tuberculosis H37Rv
cgcgcgcagccggg

SEQ ID NO: 1290287 - RNA, 14 nt, Mycobacterium tuberculosis H37Rv
cgcgcgcagagcgu

SEQ ID NO: 1290288 - RNA, 13 nt, Mycobacterium tuberculosis H37Rv
cgcgcgcaccaga

SEQ ID NO: 1290289 - RNA, 23 nt, Mycobacterium tuberculosis H37Rv
cgcgcgcaacccugccgcgauga

SEQ ID NO: 1290290 - RNA, 14 nt, Mycobacterium tuberculosis H37Rv
cgcgccuucacgcu

SEQ ID NO: 1290291 - RNA, 19 nt, Mycobacterium tuberculosis H37Rv
cgcgccugugcgcaaggcc

SEQ ID NO: 1290292 - RNA, 13 nt, Mycobacterium tuberculosis H37Rv
cgcgccugccuca

SEQ ID NO: 1290293 - RNA, 14 nt, Mycobacterium tuberculosis H37Rv
cgcgccgucgucga

SEQ ID NO: 1290294 - RNA, 17 nt, Mycobacterium tuberculosis H37Rv
cgcgccgucgucgacca

SEQ ID NO: 1290295 - RNA, 21 nt, Mycobacterium tuberculosis H37Rv
cgcgccuccguugcccccauu

SEQ ID NO: 1290296 - RNA, 17 nt, Mycobacterium tuberculosis H37Rv
cgcgccgguuggccagu

SEQ ID NO: 1290297 - RNA, 17 nt, Mycobacterium tuberculosis H37Rv
cgcgccgucggcgauga

SEQ ID NO: 1290298 - RNA, 19 nt, Mycobacterium tuberculosis H37Rv
cgcgccgucccgaaacgcc

SEQ ID NO: 1290299 - RNA, 14 nt, Mycobacterium tuberculosis H37Rv
cgcgccgguucaga

SEQ ID NO: 1290300 - RNA, 20 nt, Mycobacterium tuberculosis H37Rv
cgcgccggugaggcgaccgg

SEQ ID NO: 1290301 - RNA, 19 nt, Mycobacterium tuberculosis H37Rv
cgcgccgacggccagcagg

SEQ ID NO: 1290302 - RNA, 21 nt, Mycobacterium tuberculosis H37Rv
cgcgcccggcgcuagcgccgc

SEQ ID NO: 1290303 - RNA, 18 nt, Mycobacterium tuberculosis H37Rv
cgcgcccgccucgaccgc

SEQ ID NO: 1290304 - RNA, 17 nt, Mycobacterium tuberculosis H37Rv
cgcgcccgccucaucgg

SEQ ID NO: 1290305 - RNA, 21 nt, Mycobacterium tuberculosis H37Rv
cgcgcccggaucucggcguag

SEQ ID NO: 1290306 - RNA, 24 nt, Mycobacterium tuberculosis H37Rv
cgcgcccggaucucggcguaggcg

SEQ ID NO: 1290307 - RNA, 14 nt, Mycobacterium tuberculosis H37Rv
cgcgcccgccucau

SEQ ID NO: 1290308 - RNA, 19 nt, Mycobacterium tuberculosis H37Rv
cgcgcccgcaccaccggcc

SEQ ID NO: 1290309 - RNA, 16 nt, Mycobacterium tuberculosis H37Rv
cgcgcccgacacccgu

SEQ ID NO: 1290310 - RNA, 12 nt, Mycobacterium tuberculosis H37Rv
cgcgcccgacga

SEQ ID NO: 1290311 - RNA, 14 nt, Mycobacterium tuberculosis H37Rv
cgcgccccgccgca

SEQ ID NO: 1290312 - RNA, 19 nt, Mycobacterium tuberculosis H37Rv
cgcgcccccggugccguug

SEQ ID NO: 1290313 - RNA, 19 nt, Mycobacterium tuberculosis H37Rv
cgcgcaacguacgcacgca

SEQ ID NO: 1290314 - RNA, 22 nt, Mycobacterium tuberculosis H37Rv
cgcgcaaccuaaauugccgggc

SEQ ID NO: 1290315 - RNA, 13 nt, Mycobacterium tuberculosis H37Rv
cgcgccgaucacg

SEQ ID NO: 1290316 - RNA, 17 nt, Mycobacterium tuberculosis H37Rv
cgcgccgaucggcaccg

SEQ ID NO: 1290317 - RNA, 14 nt, Mycobacterium tuberculosis H37Rv
cgcgccgaucagcg

SEQ ID NO: 1290318 - RNA, 16 nt, Mycobacterium tuberculosis H37Rv
cgcgccgccucgggca

SEQ ID NO: 1290319 - RNA, 17 nt, Mycobacterium tuberculosis H37Rv
cgcgccgcgaggcaccg

SEQ ID NO: 1290320 - RNA, 12 nt, Mycobacterium tuberculosis H37Rv
cgcgccgccgga

SEQ ID NO: 1290321 - RNA, 13 nt, Mycobacterium tuberculosis H37Rv
cgcgccggcguug

SEQ ID NO: 1290322 - RNA, 15 nt, Mycobacterium tuberculosis H37Rv
cgcgggacaccaccg

SEQ ID NO: 1290323 - RNA, 17 nt, Mycobacterium tuberculosis H37Rv
cgcgggacagauggcgg

SEQ ID NO: 1290324 - RNA, 21 nt, Mycobacterium tuberculosis H37Rv
cgcgggaccuucgagccgcac

SEQ ID NO: 1290325 - RNA, 15 nt, Mycobacterium tuberculosis H37Rv
cgcgggagguacccc

SEQ ID NO: 1290326 - RNA, 13 nt, Mycobacterium tuberculosis H37Rv
cgcgggagucauc

SEQ ID NO: 1290327 - RNA, 16 nt, Mycobacterium tuberculosis H37Rv
cgcggcuucgucgaca

SEQ ID NO: 1290328 - RNA, 22 nt, Mycobacterium tuberculosis H37Rv
cgcggcuugggcuugcgccgga

SEQ ID NO: 1290329 - RNA, 20 nt, Mycobacterium tuberculosis H37Rv
cgcggcugugcccgaucagc

SEQ ID NO: 1290330 - RNA, 21 nt, Mycobacterium tuberculosis H37Rv
cgcggcugucacgccugccac

SEQ ID NO: 1290331 - RNA, 21 nt, Mycobacterium tuberculosis H37Rv
cgcggcugccaucccgauccc

SEQ ID NO: 1290332 - RNA, 21 nt, Mycobacterium tuberculosis H37Rv
cgcggcugggggauaccgcug

SEQ ID NO: 1290333 - RNA, 23 nt, Mycobacterium tuberculosis H37Rv
cgcgggcgaccaccgcggcaugu

SEQ ID NO: 1290334 - RNA, 15 nt, Mycobacterium tuberculosis H37Rv
cgcgggcgccgggaa

SEQ ID NO: 1290335 - RNA, 16 nt, Mycobacterium tuberculosis H37Rv
cgcgggcggaucgccg

SEQ ID NO: 1290336 - RNA, 15 nt, Mycobacterium tuberculosis H37Rv
cgcgggcggaucgcc

SEQ ID NO: 1290337 - RNA, 15 nt, Mycobacterium tuberculosis H37Rv
cgcgggcgcgguucg

SEQ ID NO: 1290338 - RNA, 17 nt, Mycobacterium tuberculosis H37Rv
cgcgggccggcgacugu

SEQ ID NO: 1290339 - RNA, 15 nt, Mycobacterium tuberculosis H37Rv
cgcgggccgcgucga

SEQ ID NO: 1290340 - RNA, 13 nt, Mycobacterium tuberculosis H37Rv
cgcgggccgcguc

SEQ ID NO: 1290341 - RNA, 17 nt, Mycobacterium tuberculosis H37Rv
cgcgggccgacgcaggu

SEQ ID NO: 1290342 - RNA, 18 nt, Mycobacterium tuberculosis H37Rv
cgcgggccaccgcuguca

SEQ ID NO: 1290343 - RNA, 21 nt, Mycobacterium tuberculosis H37Rv
cgcgggcaguggcagcccguc

SEQ ID NO: 1290344 - RNA, 22 nt, Mycobacterium tuberculosis H37Rv
cgcgggauccaggcccagccga

SEQ ID NO: 1290345 - RNA, 15 nt, Mycobacterium tuberculosis H37Rv
cgcggugccgccacc

SEQ ID NO: 1290346 - RNA, 15 nt, Mycobacterium tuberculosis H37Rv
cgcggugccggccgu

SEQ ID NO: 1290347 - RNA, 18 nt, Mycobacterium tuberculosis H37Rv
cgcggugccggccguucg

SEQ ID NO: 1290348 - RNA, 20 nt, Mycobacterium tuberculosis H37Rv
cgcggugcgcgugacgacca

SEQ ID NO: 1290349 - RNA, 18 nt, Mycobacterium tuberculosis H37Rv
cgcggugcccugccggca

SEQ ID NO: 1290350 - RNA, 16 nt, Mycobacterium tuberculosis H37Rv
cgcggugauggucacc

SEQ ID NO: 1290351 - RNA, 13 nt, Mycobacterium tuberculosis H37Rv
cgcggucgcgcga

SEQ ID NO: 1290352 - RNA, 23 nt, Mycobacterium tuberculosis H37Rv
cgcggucgcugcgaugcugauca

SEQ ID NO: 1290353 - RNA, 13 nt, Mycobacterium tuberculosis H37Rv
cgcggucgccacc

SEQ ID NO: 1290354 - RNA, 15 nt, Mycobacterium tuberculosis H37Rv
cgcggucgcugauga

SEQ ID NO: 1290355 - RNA, 18 nt, Mycobacterium tuberculosis H37Rv
cgcgguggggucgacgca

SEQ ID NO: 1290356 - RNA, 17 nt, Mycobacterium tuberculosis H37Rv
cgcgguggcggcgagca

SEQ ID NO: 1290357 - RNA, 15 nt, Mycobacterium tuberculosis H37Rv
cgcgguggcgguguc

SEQ ID NO: 1290358 - RNA, 13 nt, Mycobacterium tuberculosis H37Rv
cgcgguggccaga

SEQ ID NO: 1290359 - RNA, 14 nt, Mycobacterium tuberculosis H37Rv
cgcgguggaugcga

SEQ ID NO: 1290360 - RNA, 17 nt, Mycobacterium tuberculosis H37Rv
cgcgguggccaacucga

SEQ ID NO: 1290361 - RNA, 21 nt, Mycobacterium tuberculosis H37Rv
cgcgguggccagaucgaacgc

SEQ ID NO: 1290362 - RNA, 17 nt, Mycobacterium tuberculosis H37Rv
cgcgguggccccgaugg

SEQ ID NO: 1290363 - RNA, 20 nt, Mycobacterium tuberculosis H37Rv
cgcggguggcgccaggucgg

SEQ ID NO: 1290364 - RNA, 23 nt, Mycobacterium tuberculosis H37Rv
cgcgggugguucaccucggcgac

SEQ ID NO: 1290365 - RNA, 16 nt, Mycobacterium tuberculosis H37Rv
cgcggggugcgcgcga

SEQ ID NO: 1290366 - RNA, 18 nt, Mycobacterium tuberculosis H37Rv
cgcggucgaucaggccgu

SEQ ID NO: 1290367 - RNA, 22 nt, Mycobacterium tuberculosis H37Rv
cgcggucgccaagaucgggugg

SEQ ID NO: 1290368 - RNA, 18 nt, Mycobacterium tuberculosis H37Rv
cgcgguccucgagccgau

SEQ ID NO: 1290369 - RNA, 15 nt, Mycobacterium tuberculosis H37Rv
cgcgguacugcgcag

SEQ ID NO: 1290370 - RNA, 15 nt, Mycobacterium tuberculosis H37Rv
cgcggucgaccugag

SEQ ID NO: 1290371 - RNA, 19 nt, Mycobacterium tuberculosis H37Rv
cgcgguaccaucaccgcgc

SEQ ID NO: 1290372 - RNA, 16 nt, Mycobacterium tuberculosis H37Rv
cgcgguaccgcucggg

SEQ ID NO: 1290373 - RNA, 16 nt, Mycobacterium tuberculosis H37Rv
cgcggguuugcgguag

SEQ ID NO: 1290374 - RNA, 15 nt, Mycobacterium tuberculosis H37Rv
cgcggguucggcugc

SEQ ID NO: 1290375 - RNA, 12 nt, Mycobacterium tuberculosis H37Rv
cgcggccucgua

SEQ ID NO: 1290376 - RNA, 14 nt, Mycobacterium tuberculosis H37Rv
cgcggccucccgca

SEQ ID NO: 1290377 - RNA, 16 nt, Mycobacterium tuberculosis H37Rv
cgcggccgucgcggga

SEQ ID NO: 1290378 - RNA, 19 nt, Mycobacterium tuberculosis H37Rv
cgcggcgauuacggccagu

SEQ ID NO: 1290379 - RNA, 17 nt, Mycobacterium tuberculosis H37Rv
cgcggcgaucugcgaca

SEQ ID NO: 1290380 - RNA, 18 nt, Mycobacterium tuberculosis H37Rv
cgcggcgauuacggccag

SEQ ID NO: 1290381 - RNA, 13 nt, Mycobacterium tuberculosis H37Rv
cgcggcgaucacc

SEQ ID NO: 1290382 - RNA, 12 nt, Mycobacterium tuberculosis H37Rv
cgcggcgaucgc

SEQ ID NO: 1290383 - RNA, 12 nt, Mycobacterium tuberculosis H37Rv
cgcggcgcgaau

SEQ ID NO: 1290384 - RNA, 17 nt, Mycobacterium tuberculosis H37Rv
cgcggcgcaagcccacc

SEQ ID NO: 1290385 - RNA, 22 nt, Mycobacterium tuberculosis H37Rv
cgcggccggguggcccggcgaa

SEQ ID NO: 1290386 - RNA, 18 nt, Mycobacterium tuberculosis H37Rv
cgcggccggcgcucgcgg

SEQ ID NO: 1290387 - RNA, 15 nt, Mycobacterium tuberculosis H37Rv
cgcggccgcucacau

SEQ ID NO: 1290388 - RNA, 18 nt, Mycobacterium tuberculosis H37Rv
cgcggccgcggacuugcg

SEQ ID NO: 1290389 - RNA, 15 nt, Mycobacterium tuberculosis H37Rv
cgcggcccgccgagu

SEQ ID NO: 1290390 - RNA, 15 nt, Mycobacterium tuberculosis H37Rv
cgcggcccgcucgau

SEQ ID NO: 1290391 - RNA, 13 nt, Mycobacterium tuberculosis H37Rv
cgcggccccgaau

SEQ ID NO: 1290392 - RNA, 19 nt, Mycobacterium tuberculosis H37Rv
cgcggauuggcacugucga

SEQ ID NO: 1290393 - RNA, 15 nt, Mycobacterium tuberculosis H37Rv
cgcggauuucgccgu

SEQ ID NO: 1290394 - RNA, 16 nt, Mycobacterium tuberculosis H37Rv
cgcggcuaggccagca

SEQ ID NO: 1290395 - RNA, 21 nt, Mycobacterium tuberculosis H37Rv
cgcggcuaggccaagccgcgg

SEQ ID NO: 1290396 - RNA, 24 nt, Mycobacterium tuberculosis H37Rv
cgcggcguuguugcggaucgagca

SEQ ID NO: 1290397 - RNA, 19 nt, Mycobacterium tuberculosis H37Rv
cgcggcguuguugcggauc

SEQ ID NO: 1290398 - RNA, 15 nt, Mycobacterium tuberculosis H37Rv
cgcggcguucgccgg

SEQ ID NO: 1290399 - RNA, 17 nt, Mycobacterium tuberculosis H37Rv
cgcggcguucgccggug

SEQ ID NO: 1290400 - RNA, 21 nt, Mycobacterium tuberculosis H37Rv
cgcggcguucgccggugguga

SEQ ID NO: 1290401 - RNA, 12 nt, Mycobacterium tuberculosis H37Rv
cgcggcgucgcc

SEQ ID NO: 1290402 - RNA, 17 nt, Mycobacterium tuberculosis H37Rv
cgcggcgugcgcgguga

SEQ ID NO: 1290403 - RNA, 20 nt, Mycobacterium tuberculosis H37Rv
cgcggcguguacgucgauca

SEQ ID NO: 1290404 - RNA, 22 nt, Mycobacterium tuberculosis H37Rv
cgcggcgguuaucgucggguca

SEQ ID NO: 1290405 - RNA, 23 nt, Mycobacterium tuberculosis H37Rv
cgcggcggucagucccgugacga

SEQ ID NO: 1290406 - RNA, 20 nt, Mycobacterium tuberculosis H37Rv
cgcggcggucagucccguga

SEQ ID NO: 1290407 - RNA, 21 nt, Mycobacterium tuberculosis H37Rv
cgcggcggucccugaagccag

SEQ ID NO: 1290408 - RNA, 17 nt, Mycobacterium tuberculosis H37Rv
cgcggcgggcccgauga

SEQ ID NO: 1290409 - RNA, 13 nt, Mycobacterium tuberculosis H37Rv
cgcggcggcgucg

SEQ ID NO: 1290410 - RNA, 19 nt, Mycobacterium tuberculosis H37Rv
cgcggcggcgcucuucgau

SEQ ID NO: 1290411 - RNA, 19 nt, Mycobacterium tuberculosis H37Rv
cgcggcggcagcggcgauc

SEQ ID NO: 1290412 - RNA, 16 nt, Mycobacterium tuberculosis H37Rv
cgcggcggccagcgca

SEQ ID NO: 1290413 - RNA, 16 nt, Mycobacterium tuberculosis H37Rv
cgcggcgcgcugaaau

SEQ ID NO: 1290414 - RNA, 22 nt, Mycobacterium tuberculosis H37Rv
cgcggcggcacuacgcagccgu

SEQ ID NO: 1290415 - RNA, 13 nt, Mycobacterium tuberculosis H37Rv
cgcggcgcgcuga

SEQ ID NO: 1290416 - RNA, 21 nt, Mycobacterium tuberculosis H37Rv
cgcugaagccaaaugcgcugu

SEQ ID NO: 1290417 - RNA, 21 nt, Mycobacterium tuberculosis H37Rv
cgcugaaggccgguagcgcgg

SEQ ID NO: 1290418 - RNA, 23 nt, Mycobacterium tuberculosis H37Rv
cgcugaaucaccccggcggccau

SEQ ID NO: 1290419 - RNA, 21 nt, Mycobacterium tuberculosis H37Rv
cgcugaaugcuugcgcagcac

SEQ ID NO: 1290420 - RNA, 14 nt, Mycobacterium tuberculosis H37Rv
cgcugacacccacg

SEQ ID NO: 1290421 - RNA, 21 nt, Mycobacterium tuberculosis H37Rv
cgcucguugcguugcaucagc

SEQ ID NO: 1290422 - RNA, 18 nt, Mycobacterium tuberculosis H37Rv
cgcucguuacgccgagca

SEQ ID NO: 1290423 - RNA, 13 nt, Mycobacterium tuberculosis H37Rv
cgcucuagcgucg

SEQ ID NO: 1290424 - RNA, 18 nt, Mycobacterium tuberculosis H37Rv
cgcucucauagcgacggc

SEQ ID NO: 1290425 - RNA, 16 nt, Mycobacterium tuberculosis H37Rv
cgcucggcgcgcgggu

SEQ ID NO: 1290426 - RNA, 19 nt, Mycobacterium tuberculosis H37Rv
cgcucguuagcggcgggca

SEQ ID NO: 1290427 - RNA, 16 nt, Mycobacterium tuberculosis H37Rv
cgcucguggucgacgu

SEQ ID NO: 1290428 - RNA, 23 nt, Mycobacterium tuberculosis H37Rv
cgcucgccgguaggcggccagcg

SEQ ID NO: 1290429 - RNA, 17 nt, Mycobacterium tuberculosis H37Rv
cgcucaguuuggcgggu

SEQ ID NO: 1290430 - RNA, 18 nt, Mycobacterium tuberculosis H37Rv
cgcucaggucaucggcgg

SEQ ID NO: 1290431 - RNA, 14 nt, Mycobacterium tuberculosis H37Rv
cgcucgcgcgcugg

SEQ ID NO: 1290432 - RNA, 18 nt, Mycobacterium tuberculosis H37Rv
cgcucggccagcaucagc

SEQ ID NO: 1290433 - RNA, 18 nt, Mycobacterium tuberculosis H37Rv
cgcucggcagccggcuug

SEQ ID NO: 1290434 - RNA, 17 nt, Mycobacterium tuberculosis H37Rv
cgcucgcugcagcaggg

SEQ ID NO: 1290435 - RNA, 24 nt, Mycobacterium tuberculosis H37Rv
cgcucggcauggauacgcagcacc

SEQ ID NO: 1290436 - RNA, 18 nt, Mycobacterium tuberculosis H37Rv
cgcucaguuuggccuggu

SEQ ID NO: 1290437 - RNA, 16 nt, Mycobacterium tuberculosis H37Rv
cgcucgcucaccggcg

SEQ ID NO: 1290438 - RNA, 15 nt, Mycobacterium tuberculosis H37Rv
cgcucgcucaccggc

SEQ ID NO: 1290439 - RNA, 20 nt, Mycobacterium tuberculosis H37Rv
cgcugcacggaaucgcaucu

SEQ ID NO: 1290440 - RNA, 20 nt, Mycobacterium tuberculosis H37Rv
cgcugcagcaggucgaugcu

SEQ ID NO: 1290441 - RNA, 23 nt, Mycobacterium tuberculosis H37Rv
cgcugcauacaaccccgcgcugu

SEQ ID NO: 1290442 - RNA, 18 nt, Mycobacterium tuberculosis H37Rv
cgcugcagugguaccggc

SEQ ID NO: 1290443 - RNA, 21 nt, Mycobacterium tuberculosis H37Rv
cgcugccgccggugccgccau

SEQ ID NO: 1290444 - RNA, 21 nt, Mycobacterium tuberculosis H37Rv
cgcugccgccgagcuggcgcg

SEQ ID NO: 1290445 - RNA, 18 nt, Mycobacterium tuberculosis H37Rv
cgcugccgccgaucgaca

SEQ ID NO: 1290446 - RNA, 20 nt, Mycobacterium tuberculosis H37Rv
cgcugagcucgaugucagcg

SEQ ID NO: 1290447 - RNA, 22 nt, Mycobacterium tuberculosis H37Rv
cgcugaucuuccccucggccgc

SEQ ID NO: 1290448 - RNA, 22 nt, Mycobacterium tuberculosis H37Rv
cgcugcaaccgccggugccgau

SEQ ID NO: 1290449 - RNA, 14 nt, Mycobacterium tuberculosis H37Rv
cgcugaccgcguag

SEQ ID NO: 1290450 - RNA, 22 nt, Mycobacterium tuberculosis H37Rv
cgcugagcacggcgcggcggag

SEQ ID NO: 1290451 - RNA, 13 nt, Mycobacterium tuberculosis H37Rv
cgcugagcgacug

SEQ ID NO: 1290452 - RNA, 18 nt, Mycobacterium tuberculosis H37Rv
cgcugagcgacugcagcg

SEQ ID NO: 1290453 - RNA, 18 nt, Mycobacterium tuberculosis H37Rv
cgcugagcacucaugaug

SEQ ID NO: 1290454 - RNA, 15 nt, Mycobacterium tuberculosis H37Rv
cgcugagcccugcgc

SEQ ID NO: 1290455 - RNA, 17 nt, Mycobacterium tuberculosis H37Rv
cgcugaccccggcagcg

SEQ ID NO: 1290456 - RNA, 15 nt, Mycobacterium tuberculosis H37Rv
cgcuacgcgcgcucg

SEQ ID NO: 1290457 - RNA, 19 nt, Mycobacterium tuberculosis H37Rv
cgcuacccggacagggcgg

SEQ ID NO: 1290458 - RNA, 12 nt, Mycobacterium tuberculosis H37Rv
cgcuagccgaca

SEQ ID NO: 1290459 - RNA, 14 nt, Mycobacterium tuberculosis H37Rv
cgcuacugcgacca

SEQ ID NO: 1290460 - RNA, 15 nt, Mycobacterium tuberculosis H37Rv
cgcuaugaagucgau

SEQ ID NO: 1290461 - RNA, 17 nt, Mycobacterium tuberculosis H37Rv
cgcuaugaagucgaucu

SEQ ID NO: 1290462 - RNA, 22 nt, Mycobacterium tuberculosis H37Rv
cgcuauggcauuaccacuucgg

SEQ ID NO: 1290463 - RNA, 17 nt, Mycobacterium tuberculosis H37Rv
cgcuaucaugaccaccg

SEQ ID NO: 1290464 - RNA, 18 nt, Mycobacterium tuberculosis H37Rv
cgcuaucaugaccaccga

SEQ ID NO: 1290465 - RNA, 22 nt, Mycobacterium tuberculosis H37Rv
cgcuaggucaggugauucgcgc

SEQ ID NO: 1290466 - RNA, 19 nt, Mycobacterium tuberculosis H37Rv
cgcuagaucccaguccgau

SEQ ID NO: 1290467 - RNA, 17 nt, Mycobacterium tuberculosis H37Rv
cgcuaggcgauccagac

SEQ ID NO: 1290468 - RNA, 21 nt, Mycobacterium tuberculosis H37Rv
cgcucaccggggccgucggca

SEQ ID NO: 1290469 - RNA, 14 nt, Mycobacterium tuberculosis H37Rv
cgcucacgcucacc

SEQ ID NO: 1290470 - RNA, 19 nt, Mycobacterium tuberculosis H37Rv
cgcucagcgauuccacggc

SEQ ID NO: 1290471 - RNA, 16 nt, Mycobacterium tuberculosis H37Rv
cgcucagcgcggccac

SEQ ID NO: 1290472 - RNA, 16 nt, Mycobacterium tuberculosis H37Rv
cgcucacccggucgca

SEQ ID NO: 1290473 - RNA, 18 nt, Mycobacterium tuberculosis H37Rv
cgcucacccgcccggaac

SEQ ID NO: 1290474 - RNA, 16 nt, Mycobacterium tuberculosis H37Rv
cgcucacccgcccgga

SEQ ID NO: 1290475 - RNA, 22 nt, Mycobacterium tuberculosis H37Rv
cgcucaacaaucgguggucgua

SEQ ID NO: 1290476 - RNA, 19 nt, Mycobacterium tuberculosis H37Rv
cgcgugcaccgagccgucg

SEQ ID NO: 1290477 - RNA, 22 nt, Mycobacterium tuberculosis H37Rv
cgcgugcagccauugacggucc

SEQ ID NO: 1290478 - RNA, 16 nt, Mycobacterium tuberculosis H37Rv
cgcgugacguaccacg

SEQ ID NO: 1290479 - RNA, 18 nt, Mycobacterium tuberculosis H37Rv
cgcgugccacucgaugcu

SEQ ID NO: 1290480 - RNA, 16 nt, Mycobacterium tuberculosis H37Rv
cgcgugccacucgaug

SEQ ID NO: 1290481 - RNA, 15 nt, Mycobacterium tuberculosis H37Rv
cgcgugcggcugcca

SEQ ID NO: 1290482 - RNA, 18 nt, Mycobacterium tuberculosis H37Rv
cgcgugcgcaucccgaag

SEQ ID NO: 1290483 - RNA, 19 nt, Mycobacterium tuberculosis H37Rv
cgcgguggugauugacggu

SEQ ID NO: 1290484 - RNA, 23 nt, Mycobacterium tuberculosis H37Rv
cgcggugugcggcagcccgcugg

SEQ ID NO: 1290485 - RNA, 23 nt, Mycobacterium tuberculosis H37Rv
cgcggugugcgugucacccaaug

SEQ ID NO: 1290486 - RNA, 21 nt, Mycobacterium tuberculosis H37Rv
cgcgguguugcggugaucggg

SEQ ID NO: 1290487 - RNA, 18 nt, Mycobacterium tuberculosis H37Rv
cgcgguguucgcggcauc

SEQ ID NO: 1290488 - RNA, 18 nt, Mycobacterium tuberculosis H37Rv
cgcgguuaucgccgagau

SEQ ID NO: 1290489 - RNA, 14 nt, Mycobacterium tuberculosis H37Rv
cgcgguucgaugac

SEQ ID NO: 1290490 - RNA, 16 nt, Mycobacterium tuberculosis H37Rv
cgcguucucggcaccc

SEQ ID NO: 1290491 - RNA, 16 nt, Mycobacterium tuberculosis H37Rv
cgcguucugcaccagc

SEQ ID NO: 1290492 - RNA, 15 nt, Mycobacterium tuberculosis H37Rv
cgcuaaaccgucgcu

SEQ ID NO: 1290493 - RNA, 14 nt, Mycobacterium tuberculosis H37Rv
cgcguucgaccucg

SEQ ID NO: 1290494 - RNA, 13 nt, Mycobacterium tuberculosis H37Rv
cgcguucggcgcu

SEQ ID NO: 1290495 - RNA, 20 nt, Mycobacterium tuberculosis H37Rv
cgcguggccgccggcgcugg

SEQ ID NO: 1290496 - RNA, 23 nt, Mycobacterium tuberculosis H37Rv
cgcgugcucguaguaguccagca

SEQ ID NO: 1290497 - RNA, 19 nt, Mycobacterium tuberculosis H37Rv
cgcugguaguguucagcuu

SEQ ID NO: 1290498 - RNA, 21 nt, Mycobacterium tuberculosis H37Rv
cgcugguauagcucacggugg

SEQ ID NO: 1290499 - RNA, 14 nt, Mycobacterium tuberculosis H37Rv
cgcuguagucgcgc

SEQ ID NO: 1290500 - RNA, 21 nt, Mycobacterium tuberculosis H37Rv
cgcuggguggcgggccggaug

SEQ ID NO: 1290501 - RNA, 20 nt, Mycobacterium tuberculosis H37Rv
cgcuggcuugggccagcgca

SEQ ID NO: 1290502 - RNA, 17 nt, Mycobacterium tuberculosis H37Rv
cgcuggcugacaccgau

SEQ ID NO: 1290503 - RNA, 23 nt, Mycobacterium tuberculosis H37Rv
cgcuggcguuguugacgaucacc

SEQ ID NO: 1290504 - RNA, 18 nt, Mycobacterium tuberculosis H37Rv
cgcugucgcccucgaucg

SEQ ID NO: 1290505 - RNA, 18 nt, Mycobacterium tuberculosis H37Rv
cgcugucgugcucucggc

SEQ ID NO: 1290506 - RNA, 20 nt, Mycobacterium tuberculosis H37Rv
cgcuguccacugccaccgcg

SEQ ID NO: 1290507 - RNA, 17 nt, Mycobacterium tuberculosis H37Rv
cgcuggcgggcggcgug

SEQ ID NO: 1290508 - RNA, 19 nt, Mycobacterium tuberculosis H37Rv
cgcuggcgucgucuucggu

SEQ ID NO: 1290509 - RNA, 15 nt, Mycobacterium tuberculosis H37Rv
cgcuggcgcccccga

SEQ ID NO: 1290510 - RNA, 19 nt, Mycobacterium tuberculosis H37Rv
cgcugcgccgucgcagcca

SEQ ID NO: 1290511 - RNA, 14 nt, Mycobacterium tuberculosis H37Rv
cgcugccggcagcg

SEQ ID NO: 1290512 - RNA, 18 nt, Mycobacterium tuberculosis H37Rv
cgcuucgcccggcugcgc

SEQ ID NO: 1290513 - RNA, 19 nt, Mycobacterium tuberculosis H37Rv
cgcugugagcuuggucgcc

SEQ ID NO: 1290514 - RNA, 15 nt, Mycobacterium tuberculosis H37Rv
cgcuguggcucgacg

SEQ ID NO: 1290515 - RNA, 21 nt, Mycobacterium tuberculosis H37Rv
cgcuguugccaucgacgccgc

SEQ ID NO: 1290516 - RNA, 15 nt, Mycobacterium tuberculosis H37Rv
cgcuguugccaucga

SEQ ID NO: 1290517 - RNA, 19 nt, Mycobacterium tuberculosis H37Rv
cgcuguuccucgaguucgg

SEQ ID NO: 1290518 - RNA, 21 nt, Mycobacterium tuberculosis H37Rv
cgcuugguguggcccaaccgc

SEQ ID NO: 1290519 - RNA, 22 nt, Mycobacterium tuberculosis H37Rv
cgcuuggcaaucaucucccgac

SEQ ID NO: 1290520 - RNA, 16 nt, Mycobacterium tuberculosis H37Rv
cgcuuugcacugugga

SEQ ID NO: 1290521 - RNA, 23 nt, Mycobacterium tuberculosis H37Rv
cgcuucgucgccgaacagcgacg

SEQ ID NO: 1290522 - RNA, 22 nt, Mycobacterium tuberculosis H37Rv
cgcuucguccagcgaucccggu

SEQ ID NO: 1290523 - RNA, 22 nt, Mycobacterium tuberculosis H37Rv
cgcuucgggcgucauccgcggc

SEQ ID NO: 1290524 - RNA, 13 nt, Mycobacterium tuberculosis H37Rv
cgcuugcggcugc

SEQ ID NO: 1290525 - RNA, 15 nt, Mycobacterium tuberculosis H37Rv
cggaacugaccacgu

SEQ ID NO: 1290526 - RNA, 18 nt, Mycobacterium tuberculosis H37Rv
cggaagacgugguagagg

SEQ ID NO: 1290527 - RNA, 18 nt, Mycobacterium tuberculosis H37Rv
cggaagaagugcucacau

SEQ ID NO: 1290528 - RNA, 21 nt, Mycobacterium tuberculosis H37Rv
cggaacgaaagucuccggaac

SEQ ID NO: 1290529 - RNA, 19 nt, Mycobacterium tuberculosis H37Rv
cggaacgccuaacgcguag

SEQ ID NO: 1290530 - RNA, 23 nt, Mycobacterium tuberculosis H37Rv
cggaaccaaccucggaucgccag

SEQ ID NO: 1290531 - RNA, 22 nt, Mycobacterium tuberculosis H37Rv
cggaacgugaccgacgccgucg

SEQ ID NO: 1290532 - RNA, 16 nt, Mycobacterium tuberculosis H37Rv
cggaacaccgacgaca

SEQ ID NO: 1290533 - RNA, 20 nt, Mycobacterium tuberculosis H37Rv
cggaacacgaugcgcggugc

SEQ ID NO: 1290534 - RNA, 16 nt, Mycobacterium tuberculosis H37Rv
cggaacaccaccaggc

SEQ ID NO: 1290535 - RNA, 13 nt, Mycobacterium tuberculosis H37Rv
cggaaaucggacg

SEQ ID NO: 1290536 - RNA, 13 nt, Mycobacterium tuberculosis H37Rv
cggaacaucguca

SEQ ID NO: 1290537 - RNA, 16 nt, Mycobacterium tuberculosis H37Rv
cggaaccgguaucgcc

SEQ ID NO: 1290538 - RNA, 13 nt, Mycobacterium tuberculosis H37Rv
cggaaccggcgug

SEQ ID NO: 1290539 - RNA, 17 nt, Mycobacterium tuberculosis H37Rv
cggaaaggccgcgguga

SEQ ID NO: 1290540 - RNA, 22 nt, Mycobacterium tuberculosis H37Rv
cggaaaggccgcggugaugggc

SEQ ID NO: 1290541 - RNA, 18 nt, Mycobacterium tuberculosis H37Rv
cggaaagcccgucgucgg

SEQ ID NO: 1290542 - RNA, 18 nt, Mycobacterium tuberculosis H37Rv
cggaaagccuaguacgcc

SEQ ID NO: 1290543 - RNA, 14 nt, Mycobacterium tuberculosis H37Rv
cggaaagaucucgg

SEQ ID NO: 1290544 - RNA, 13 nt, Mycobacterium tuberculosis H37Rv
cggaaacagcaug

SEQ ID NO: 1290545 - RNA, 14 nt, Mycobacterium tuberculosis H37Rv
cggaaacagcgauc

SEQ ID NO: 1290546 - RNA, 15 nt, Mycobacterium tuberculosis H37Rv
cggcuucgucggcca

SEQ ID NO: 1290547 - RNA, 22 nt, Mycobacterium tuberculosis H37Rv
cggcuucgucgacaucgccaua

SEQ ID NO: 1290548 - RNA, 21 nt, Mycobacterium tuberculosis H37Rv
cggcuucuucuucuugaccgc

SEQ ID NO: 1290549 - RNA, 12 nt, Mycobacterium tuberculosis H37Rv
cggcuugcugcc

SEQ ID NO: 1290550 - RNA, 17 nt, Mycobacterium tuberculosis H37Rv
cggcuugcccuccgggu

SEQ ID NO: 1290551 - RNA, 21 nt, Mycobacterium tuberculosis H37Rv
cggcugaccggggucggccug

SEQ ID NO: 1290552 - RNA, 15 nt, Mycobacterium tuberculosis H37Rv
cggcucggcgcugac

SEQ ID NO: 1290553 - RNA, 20 nt, Mycobacterium tuberculosis H37Rv
cggcugauucgagccacaug

SEQ ID NO: 1290554 - RNA, 18 nt, Mycobacterium tuberculosis H37Rv
cggcugcaaccagcggca

SEQ ID NO: 1290555 - RNA, 15 nt, Mycobacterium tuberculosis H37Rv
cggcuucggcaacca

SEQ ID NO: 1290556 - RNA, 21 nt, Mycobacterium tuberculosis H37Rv
cggcuucggcagaccggcauc

SEQ ID NO: 1290557 - RNA, 23 nt, Mycobacterium tuberculosis H37Rv
cggcugauuggcccaccgccguu

SEQ ID NO: 1290558 - RNA, 19 nt, Mycobacterium tuberculosis H37Rv
cgggaauccggugaugacc

SEQ ID NO: 1290559 - RNA, 22 nt, Mycobacterium tuberculosis H37Rv
cgggaacgggcaaaccauugcg

SEQ ID NO: 1290560 - RNA, 13 nt, Mycobacterium tuberculosis H37Rv
cgggaacgccgaa

SEQ ID NO: 1290561 - RNA, 13 nt, Mycobacterium tuberculosis H37Rv
cgggaacgaugcc

SEQ ID NO: 1290562 - RNA, 21 nt, Mycobacterium tuberculosis H37Rv
cgggaaccucgaccgucaccg

SEQ ID NO: 1290563 - RNA, 21 nt, Mycobacterium tuberculosis H37Rv
cggcuuggccuuugccgucga

SEQ ID NO: 1290564 - RNA, 19 nt, Mycobacterium tuberculosis H37Rv
cggcuuggccuuugccguc

SEQ ID NO: 1290565 - RNA, 20 nt, Mycobacterium tuberculosis H37Rv
cggcuuggccuuugccgucg

SEQ ID NO: 1290566 - RNA, 24 nt, Mycobacterium tuberculosis H37Rv
cggcuuggcggcgaucaacucggg

SEQ ID NO: 1290567 - RNA, 13 nt, Mycobacterium tuberculosis H37Rv
cggcuuggcggcg

SEQ ID NO: 1290568 - RNA, 21 nt, Mycobacterium tuberculosis H37Rv
cgggacccgugagcucgucga

SEQ ID NO: 1290569 - RNA, 15 nt, Mycobacterium tuberculosis H37Rv
cgggaccgggaaccc

SEQ ID NO: 1290570 - RNA, 17 nt, Mycobacterium tuberculosis H37Rv
cgggaccauagucgccg

SEQ ID NO: 1290571 - RNA, 15 nt, Mycobacterium tuberculosis H37Rv
cgggacaaucgucca

SEQ ID NO: 1290572 - RNA, 23 nt, Mycobacterium tuberculosis H37Rv
cgggacaaguucgguagcgaucg

SEQ ID NO: 1290573 - RNA, 19 nt, Mycobacterium tuberculosis H37Rv
cgggaauuucgucggccau

SEQ ID NO: 1290574 - RNA, 12 nt, Mycobacterium tuberculosis H37Rv
cgggacaaccgc

SEQ ID NO: 1290575 - RNA, 14 nt, Mycobacterium tuberculosis H37Rv
cgggacaccaccgc

SEQ ID NO: 1290576 - RNA, 18 nt, Mycobacterium tuberculosis H37Rv
cgggacacgucgcgccag

SEQ ID NO: 1290577 - RNA, 21 nt, Mycobacterium tuberculosis H37Rv
cgggaucgccguccagcaaua

SEQ ID NO: 1290578 - RNA, 20 nt, Mycobacterium tuberculosis H37Rv
cgggaucgccgagaccgcgu

SEQ ID NO: 1290579 - RNA, 16 nt, Mycobacterium tuberculosis H37Rv
cgggaucgcccaggcg

SEQ ID NO: 1290580 - RNA, 21 nt, Mycobacterium tuberculosis H37Rv
cgggauccaggcccagccgag

SEQ ID NO: 1290581 - RNA, 13 nt, Mycobacterium tuberculosis H37Rv
cgggaucagcgua

SEQ ID NO: 1290582 - RNA, 21 nt, Mycobacterium tuberculosis H37Rv
cgggauaccaauggacacagg

SEQ ID NO: 1290583 - RNA, 17 nt, Mycobacterium tuberculosis H37Rv
cgggaucccgaucguga

SEQ ID NO: 1290584 - RNA, 19 nt, Mycobacterium tuberculosis H37Rv
cgggagucgguaucggcag

SEQ ID NO: 1290585 - RNA, 19 nt, Mycobacterium tuberculosis H37Rv
cgggaguaagggaagcgau

SEQ ID NO: 1290586 - RNA, 13 nt, Mycobacterium tuberculosis H37Rv
cgggagucgacgg

SEQ ID NO: 1290587 - RNA, 22 nt, Mycobacterium tuberculosis H37Rv
cgggagucgccgccgucggguu

SEQ ID NO: 1290588 - RNA, 16 nt, Mycobacterium tuberculosis H37Rv
cgggaggccaccgcga

SEQ ID NO: 1290589 - RNA, 17 nt, Mycobacterium tuberculosis H37Rv
cgggaggccaccgcgaa

SEQ ID NO: 1290590 - RNA, 17 nt, Mycobacterium tuberculosis H37Rv
cgggauaucgucgacgc

SEQ ID NO: 1290591 - RNA, 14 nt, Mycobacterium tuberculosis H37Rv
cgggauaucgucga

SEQ ID NO: 1290592 - RNA, 15 nt, Mycobacterium tuberculosis H37Rv
cgggauauagccggu

SEQ ID NO: 1290593 - RNA, 18 nt, Mycobacterium tuberculosis H37Rv
cgggauaacccagcacca

SEQ ID NO: 1290594 - RNA, 19 nt, Mycobacterium tuberculosis H37Rv
cgggauagacgaccccggu

SEQ ID NO: 1290595 - RNA, 19 nt, Mycobacterium tuberculosis H37Rv
cgggagaacgugccgaguu

SEQ ID NO: 1290596 - RNA, 17 nt, Mycobacterium tuberculosis H37Rv
cgggacugacccugauc

SEQ ID NO: 1290597 - RNA, 14 nt, Mycobacterium tuberculosis H37Rv
cgggacucggcgag

SEQ ID NO: 1290598 - RNA, 16 nt, Mycobacterium tuberculosis H37Rv
cgggacuagguccgau

SEQ ID NO: 1290599 - RNA, 22 nt, Mycobacterium tuberculosis H37Rv
cgggacugcagcgcggugguca

SEQ ID NO: 1290600 - RNA, 21 nt, Mycobacterium tuberculosis H37Rv
cgggacugacccugaucguga

SEQ ID NO: 1290601 - RNA, 15 nt, Mycobacterium tuberculosis H37Rv
cgggagcaccgacca

SEQ ID NO: 1290602 - RNA, 18 nt, Mycobacterium tuberculosis H37Rv
cgggagcagcacucgggu

SEQ ID NO: 1290603 - RNA, 17 nt, Mycobacterium tuberculosis H37Rv
cgggagaucucguccag

SEQ ID NO: 1290604 - RNA, 15 nt, Mycobacterium tuberculosis H37Rv
cgggagccgcacccg

SEQ ID NO: 1290605 - RNA, 15 nt, Mycobacterium tuberculosis H37Rv
cgggacgucaccguu

SEQ ID NO: 1290606 - RNA, 12 nt, Mycobacterium tuberculosis H37Rv
cgggacgucguc

SEQ ID NO: 1290607 - RNA, 17 nt, Mycobacterium tuberculosis H37Rv
cgggacguuguccaccg

SEQ ID NO: 1290608 - RNA, 12 nt, Mycobacterium tuberculosis H37Rv
cgggacguuguc

SEQ ID NO: 1290609 - RNA, 20 nt, Mycobacterium tuberculosis H37Rv
cgggacgaaaaaaucgugcg

SEQ ID NO: 1290610 - RNA, 22 nt, Mycobacterium tuberculosis H37Rv
cgggacaucaccgcagcaccgg

SEQ ID NO: 1290611 - RNA, 14 nt, Mycobacterium tuberculosis H37Rv
cgggacgauaccgg

SEQ ID NO: 1290612 - RNA, 18 nt, Mycobacterium tuberculosis H37Rv
cgggacgcgacucggcgg

SEQ ID NO: 1290613 - RNA, 21 nt, Mycobacterium tuberculosis H37Rv
cgggacgccuugaucggcgag

SEQ ID NO: 1290614 - RNA, 20 nt, Mycobacterium tuberculosis H37Rv
cgggacgccuugaucggcga

SEQ ID NO: 1290615 - RNA, 20 nt, Mycobacterium tuberculosis H37Rv
cgggaucugagggcucggug

SEQ ID NO: 1290616 - RNA, 16 nt, Mycobacterium tuberculosis H37Rv
cgggaucguuggccag

SEQ ID NO: 1290617 - RNA, 15 nt, Mycobacterium tuberculosis H37Rv
cgggaugccggcgaa

SEQ ID NO: 1290618 - RNA, 19 nt, Mycobacterium tuberculosis H37Rv
cgggcaaaucaagcacagc

SEQ ID NO: 1290619 - RNA, 22 nt, Mycobacterium tuberculosis H37Rv
cgggcaaccacaucaccggcga

SEQ ID NO: 1290620 - RNA, 19 nt, Mycobacterium tuberculosis H37Rv
cgggcaaccagcagcaggu

SEQ ID NO: 1290621 - RNA, 13 nt, Mycobacterium tuberculosis H37Rv
cgggcaacacgau

SEQ ID NO: 1290622 - RNA, 23 nt, Mycobacterium tuberculosis H37Rv
cgggcaacgcgaaccggccaucg

SEQ ID NO: 1290623 - RNA, 13 nt, Mycobacterium tuberculosis H37Rv
cgggauugccguc

SEQ ID NO: 1290624 - RNA, 15 nt, Mycobacterium tuberculosis H37Rv
cgggauuggugaguu

SEQ ID NO: 1290625 - RNA, 20 nt, Mycobacterium tuberculosis H37Rv
cgggcagcaccagcgccuug

SEQ ID NO: 1290626 - RNA, 16 nt, Mycobacterium tuberculosis H37Rv
cgggcacgaucgucgc

SEQ ID NO: 1290627 - RNA, 14 nt, Mycobacterium tuberculosis H37Rv
cgggcagcaccagc

SEQ ID NO: 1290628 - RNA, 13 nt, Mycobacterium tuberculosis H37Rv
cgggcacgaucgu

SEQ ID NO: 1290629 - RNA, 15 nt, Mycobacterium tuberculosis H37Rv
cgggcagcaggcgau

SEQ ID NO: 1290630 - RNA, 20 nt, Mycobacterium tuberculosis H37Rv
cgggcagguaggucugggca

SEQ ID NO: 1290631 - RNA, 21 nt, Mycobacterium tuberculosis H37Rv
cgggcagccccuccgcgccga

SEQ ID NO: 1290632 - RNA, 16 nt, Mycobacterium tuberculosis H37Rv
cgggcaagucgcccag

SEQ ID NO: 1290633 - RNA, 15 nt, Mycobacterium tuberculosis H37Rv
cgggcaaucaccgcc

SEQ ID NO: 1290634 - RNA, 15 nt, Mycobacterium tuberculosis H37Rv
cgggcaacugcagca

SEQ ID NO: 1290635 - RNA, 16 nt, Mycobacterium tuberculosis H37Rv
cgggcaacucggugac

SEQ ID NO: 1290636 - RNA, 12 nt, Mycobacterium tuberculosis H37Rv
cgggcaccgguu

SEQ ID NO: 1290637 - RNA, 19 nt, Mycobacterium tuberculosis H37Rv
cgggcacccgagccgcaca

SEQ ID NO: 1290638 - RNA, 21 nt, Mycobacterium tuberculosis H37Rv
cgggccaucaagcgauccgag

SEQ ID NO: 1290639 - RNA, 22 nt, Mycobacterium tuberculosis H37Rv
cgggccauucaccgcgcacgac

SEQ ID NO: 1290640 - RNA, 14 nt, Mycobacterium tuberculosis H37Rv
cgggccaguucguc

SEQ ID NO: 1290641 - RNA, 22 nt, Mycobacterium tuberculosis H37Rv
cgggccaguucgucggcggugc

SEQ ID NO: 1290642 - RNA, 20 nt, Mycobacterium tuberculosis H37Rv
cgggccagcgcaucggucac

SEQ ID NO: 1290643 - RNA, 19 nt, Mycobacterium tuberculosis H37Rv
cgggcaguccaggcacucc

SEQ ID NO: 1290644 - RNA, 16 nt, Mycobacterium tuberculosis H37Rv
cgggcaguucacgguu

SEQ ID NO: 1290645 - RNA, 16 nt, Mycobacterium tuberculosis H37Rv
cgggcaguuugcgggc

SEQ ID NO: 1290646 - RNA, 15 nt, Mycobacterium tuberculosis H37Rv
cgggcagugugguca

SEQ ID NO: 1290647 - RNA, 21 nt, Mycobacterium tuberculosis H37Rv
cgggcaguggcagcccgucgg

SEQ ID NO: 1290648 - RNA, 21 nt, Mycobacterium tuberculosis H37Rv
cgggcagugcgcggcgucguc

SEQ ID NO: 1290649 - RNA, 13 nt, Mycobacterium tuberculosis H37Rv
cgggccacgucga

SEQ ID NO: 1290650 - RNA, 16 nt, Mycobacterium tuberculosis H37Rv
cgggccacgucgagca

SEQ ID NO: 1290651 - RNA, 20 nt, Mycobacterium tuberculosis H37Rv
cgggccagcaccucgaccgc

SEQ ID NO: 1290652 - RNA, 14 nt, Mycobacterium tuberculosis H37Rv
cgggcauaggcgcu

SEQ ID NO: 1290653 - RNA, 21 nt, Mycobacterium tuberculosis H37Rv
cgggccacgaucggcugguua

SEQ ID NO: 1290654 - RNA, 20 nt, Mycobacterium tuberculosis H37Rv
cgggcccuccacugcgagcg

SEQ ID NO: 1290655 - RNA, 17 nt, Mycobacterium tuberculosis H37Rv
cgggccgaacacaccgg

SEQ ID NO: 1290656 - RNA, 18 nt, Mycobacterium tuberculosis H37Rv
cgggcccgucgucgucga

SEQ ID NO: 1290657 - RNA, 22 nt, Mycobacterium tuberculosis H37Rv
cgggcccucuaugcgggcagcg

SEQ ID NO: 1290658 - RNA, 18 nt, Mycobacterium tuberculosis H37Rv
cgggcccguagccgagcu

SEQ ID NO: 1290659 - RNA, 19 nt, Mycobacterium tuberculosis H37Rv
cgggccgcaucgucgccgc

SEQ ID NO: 1290660 - RNA, 16 nt, Mycobacterium tuberculosis H37Rv
cgggccgcaucgucgc

SEQ ID NO: 1290661 - RNA, 15 nt, Mycobacterium tuberculosis H37Rv
cgggccgcaucgucg

SEQ ID NO: 1290662 - RNA, 19 nt, Mycobacterium tuberculosis H37Rv
cgggccgccaucucguagg

SEQ ID NO: 1290663 - RNA, 19 nt, Mycobacterium tuberculosis H37Rv
cgggccgccgcgauggccc

SEQ ID NO: 1290664 - RNA, 14 nt, Mycobacterium tuberculosis H37Rv
cgggccugcacgcc

SEQ ID NO: 1290665 - RNA, 13 nt, Mycobacterium tuberculosis H37Rv
cgggccucggcga

SEQ ID NO: 1290666 - RNA, 14 nt, Mycobacterium tuberculosis H37Rv
cgggccucggcgac

SEQ ID NO: 1290667 - RNA, 12 nt, Mycobacterium tuberculosis H37Rv
cgggccugcgcg

SEQ ID NO: 1290668 - RNA, 18 nt, Mycobacterium tuberculosis H37Rv
cgggccguguccgccgga

SEQ ID NO: 1290669 - RNA, 16 nt, Mycobacterium tuberculosis H37Rv
cgggccuccugcuggc

SEQ ID NO: 1290670 - RNA, 20 nt, Mycobacterium tuberculosis H37Rv
cgggccguccggcgccugcu

SEQ ID NO: 1290671 - RNA, 21 nt, Mycobacterium tuberculosis H37Rv
cgggccgccucgaucgacucg

SEQ ID NO: 1290672 - RNA, 18 nt, Mycobacterium tuberculosis H37Rv
cggcguacgguacggacc

SEQ ID NO: 1290673 - RNA, 21 nt, Mycobacterium tuberculosis H37Rv
cggcguacucgugcaccgucg

SEQ ID NO: 1290674 - RNA, 15 nt, Mycobacterium tuberculosis H37Rv
cggcguacucgguga

SEQ ID NO: 1290675 - RNA, 15 nt, Mycobacterium tuberculosis H37Rv
cggcguacgccggac

SEQ ID NO: 1290676 - RNA, 17 nt, Mycobacterium tuberculosis H37Rv
cggcguacaaaccgucg

SEQ ID NO: 1290677 - RNA, 18 nt, Mycobacterium tuberculosis H37Rv
cggcgguuccauacagcc

SEQ ID NO: 1290678 - RNA, 19 nt, Mycobacterium tuberculosis H37Rv
cggcgguuggugcagcgug

SEQ ID NO: 1290679 - RNA, 22 nt, Mycobacterium tuberculosis H37Rv
cggcgguugccccgaccgccgu

SEQ ID NO: 1290680 - RNA, 18 nt, Mycobacterium tuberculosis H37Rv
cggcggugccgacggugg

SEQ ID NO: 1290681 - RNA, 21 nt, Mycobacterium tuberculosis H37Rv
cggcggugccacgaucggcgg

SEQ ID NO: 1290682 - RNA, 16 nt, Mycobacterium tuberculosis H37Rv
cggcggugccgacggu

SEQ ID NO: 1290683 - RNA, 15 nt, Mycobacterium tuberculosis H37Rv
cggcgguggccagcg

SEQ ID NO: 1290684 - RNA, 22 nt, Mycobacterium tuberculosis H37Rv
cggcggugcgcugaugacgcgg

SEQ ID NO: 1290685 - RNA, 14 nt, Mycobacterium tuberculosis H37Rv
cggcgguggccgac

SEQ ID NO: 1290686 - RNA, 14 nt, Mycobacterium tuberculosis H37Rv
cggcggugggucgu

SEQ ID NO: 1290687 - RNA, 16 nt, Mycobacterium tuberculosis H37Rv
cggcggugucacgacc

SEQ ID NO: 1290688 - RNA, 20 nt, Mycobacterium tuberculosis H37Rv
cggcggucuuggcgcgccca

SEQ ID NO: 1290689 - RNA, 19 nt, Mycobacterium tuberculosis H37Rv
cggcggugaacgacggguc

SEQ ID NO: 1290690 - RNA, 20 nt, Mycobacterium tuberculosis H37Rv
cggcggugaacgacgggucg

SEQ ID NO: 1290691 - RNA, 19 nt, Mycobacterium tuberculosis H37Rv
cggcggugcagcagggcgc

SEQ ID NO: 1290692 - RNA, 17 nt, Mycobacterium tuberculosis H37Rv
cggcggucggcugggcg

SEQ ID NO: 1290693 - RNA, 21 nt, Mycobacterium tuberculosis H37Rv
cggcggucucgucaaccugcg

SEQ ID NO: 1290694 - RNA, 15 nt, Mycobacterium tuberculosis H37Rv
cggcggucugcagug

SEQ ID NO: 1290695 - RNA, 23 nt, Mycobacterium tuberculosis H37Rv
cggcggucugcagugcagcgauc

SEQ ID NO: 1290696 - RNA, 15 nt, Mycobacterium tuberculosis H37Rv
cggcggucagcggcu

SEQ ID NO: 1290697 - RNA, 21 nt, Mycobacterium tuberculosis H37Rv
cggcgguaccagagcagcuca

SEQ ID NO: 1290698 - RNA, 22 nt, Mycobacterium tuberculosis H37Rv
cggcgguagccgaccagcgcua

SEQ ID NO: 1290699 - RNA, 19 nt, Mycobacterium tuberculosis H37Rv
cggcgguagucggccagcu

SEQ ID NO: 1290700 - RNA, 17 nt, Mycobacterium tuberculosis H37Rv
cggcgguaaaccuggcu

SEQ ID NO: 1290701 - RNA, 15 nt, Mycobacterium tuberculosis H37Rv
cggcggucagcagcg

SEQ ID NO: 1290702 - RNA, 16 nt, Mycobacterium tuberculosis H37Rv
cggcggucaccaccga

SEQ ID NO: 1290703 - RNA, 23 nt, Mycobacterium tuberculosis H37Rv
cggcgguaugccacaggcugcca

SEQ ID NO: 1290704 - RNA, 13 nt, Mycobacterium tuberculosis H37Rv
cggcggcggccag

SEQ ID NO: 1290705 - RNA, 15 nt, Mycobacterium tuberculosis H37Rv
cggcggcgccgccca

SEQ ID NO: 1290706 - RNA, 21 nt, Mycobacterium tuberculosis H37Rv
cggcggcgccgcccaacgcga

SEQ ID NO: 1290707 - RNA, 19 nt, Mycobacterium tuberculosis H37Rv
cggcggcgaggcgagucac

SEQ ID NO: 1290708 - RNA, 18 nt, Mycobacterium tuberculosis H37Rv
cggcggcgaugucaacca

SEQ ID NO: 1290709 - RNA, 13 nt, Mycobacterium tuberculosis H37Rv
cggcggcgaugac

SEQ ID NO: 1290710 - RNA, 13 nt, Mycobacterium tuberculosis H37Rv
cggcgcggagagc

SEQ ID NO: 1290711 - RNA, 17 nt, Mycobacterium tuberculosis H37Rv
cggcgcggccgcagcca

SEQ ID NO: 1290712 - RNA, 21 nt, Mycobacterium tuberculosis H37Rv
cggcgcggccggccgcucacc

SEQ ID NO: 1290713 - RNA, 21 nt, Mycobacterium tuberculosis H37Rv
cggcgggcgaucuuggcgaca

SEQ ID NO: 1290714 - RNA, 23 nt, Mycobacterium tuberculosis H37Rv
cggcgggccgcgcggcgacagcu

SEQ ID NO: 1290715 - RNA, 18 nt, Mycobacterium tuberculosis H37Rv
cggcgggccgcgcggcga

SEQ ID NO: 1290716 - RNA, 16 nt, Mycobacterium tuberculosis H37Rv
cggcgggccucggcga

SEQ ID NO: 1290717 - RNA, 18 nt, Mycobacterium tuberculosis H37Rv
cggcgggcagauggugaa

SEQ ID NO: 1290718 - RNA, 14 nt, Mycobacterium tuberculosis H37Rv
cggcgggcagaugg

SEQ ID NO: 1290719 - RNA, 20 nt, Mycobacterium tuberculosis H37Rv
cggcggcuguggucgcugcu

SEQ ID NO: 1290720 - RNA, 15 nt, Mycobacterium tuberculosis H37Rv
cggcggcgucgacgg

SEQ ID NO: 1290721 - RNA, 16 nt, Mycobacterium tuberculosis H37Rv
cggcggcuuggccgcc

SEQ ID NO: 1290722 - RNA, 16 nt, Mycobacterium tuberculosis H37Rv
cggcggcuucgauugc

SEQ ID NO: 1290723 - RNA, 19 nt, Mycobacterium tuberculosis H37Rv
cggcggcuuuggccgccgu

SEQ ID NO: 1290724 - RNA, 14 nt, Mycobacterium tuberculosis H37Rv
cggcgggacgucgc

SEQ ID NO: 1290725 - RNA, 20 nt, Mycobacterium tuberculosis H37Rv
cggcgggacgucgccgcagu

SEQ ID NO: 1290726 - RNA, 18 nt, Mycobacterium tuberculosis H37Rv
cggcguggucggcgguga

SEQ ID NO: 1290727 - RNA, 20 nt, Mycobacterium tuberculosis H37Rv
cggcguuaccaccgucaccg

SEQ ID NO: 1290728 - RNA, 14 nt, Mycobacterium tuberculosis H37Rv
cggcguggauccgu

SEQ ID NO: 1290729 - RNA, 12 nt, Mycobacterium tuberculosis H37Rv
cggcgugcuggc

SEQ ID NO: 1290730 - RNA, 15 nt, Mycobacterium tuberculosis H37Rv
cggcgucuuccucgg

SEQ ID NO: 1290731 - RNA, 18 nt, Mycobacterium tuberculosis H37Rv
cggcgugcccgucgugcg

SEQ ID NO: 1290732 - RNA, 23 nt, Mycobacterium tuberculosis H37Rv
cggcgucguugaggaagcccgau

SEQ ID NO: 1290733 - RNA, 23 nt, Mycobacterium tuberculosis H37Rv
cggcgucucgcagcaacggcggc

SEQ ID NO: 1290734 - RNA, 14 nt, Mycobacterium tuberculosis H37Rv
cggcgucugcggug

SEQ ID NO: 1290735 - RNA, 18 nt, Mycobacterium tuberculosis H37Rv
cggcgucuuccucggcca

SEQ ID NO: 1290736 - RNA, 11 nt, Mycobacterium tuberculosis H37Rv
cggcgucugua

SEQ ID NO: 1290737 - RNA, 22 nt, Mycobacterium tuberculosis H37Rv
cggcgucuuaccugaagccgcg

SEQ ID NO: 1290738 - RNA, 17 nt, Mycobacterium tuberculosis H37Rv
cggcgucuugcaucagc

SEQ ID NO: 1290739 - RNA, 16 nt, Mycobacterium tuberculosis H37Rv
cggcguauugcaccgc

SEQ ID NO: 1290740 - RNA, 15 nt, Mycobacterium tuberculosis H37Rv
cggcguauugcaccg

SEQ ID NO: 1290741 - RNA, 22 nt, Mycobacterium tuberculosis H37Rv
cggcguagcagaaggccgcggu

SEQ ID NO: 1290742 - RNA, 19 nt, Mycobacterium tuberculosis H37Rv
cggcguagcgagcgggugc

SEQ ID NO: 1290743 - RNA, 16 nt, Mycobacterium tuberculosis H37Rv
cggcguaggcaggauc

SEQ ID NO: 1290744 - RNA, 21 nt, Mycobacterium tuberculosis H37Rv
cggcguagaucaucagcgacu

SEQ ID NO: 1290745 - RNA, 23 nt, Mycobacterium tuberculosis H37Rv
cggcguagaucaucagcgacuug

SEQ ID NO: 1290746 - RNA, 22 nt, Mycobacterium tuberculosis H37Rv
cggcguacuucgacagcggcga

SEQ ID NO: 1290747 - RNA, 12 nt, Mycobacterium tuberculosis H37Rv
cggcgucguuga

SEQ ID NO: 1290748 - RNA, 20 nt, Mycobacterium tuberculosis H37Rv
cggcgucgucgauggcugcg

SEQ ID NO: 1290749 - RNA, 22 nt, Mycobacterium tuberculosis H37Rv
cggcgucgucgauggcugcgcc

SEQ ID NO: 1290750 - RNA, 15 nt, Mycobacterium tuberculosis H37Rv
cggcgucgucgucga

SEQ ID NO: 1290751 - RNA, 21 nt, Mycobacterium tuberculosis H37Rv
cggcgucggugagcgcgucgc

SEQ ID NO: 1290752 - RNA, 15 nt, Mycobacterium tuberculosis H37Rv
cggcgucgucgauga

SEQ ID NO: 1290753 - RNA, 12 nt, Mycobacterium tuberculosis H37Rv
cggcgucacgag

SEQ ID NO: 1290754 - RNA, 21 nt, Mycobacterium tuberculosis H37Rv
cggcgucagccccgacugcgc

SEQ ID NO: 1290755 - RNA, 20 nt, Mycobacterium tuberculosis H37Rv
cggcgucacggcgugaccac

SEQ ID NO: 1290756 - RNA, 18 nt, Mycobacterium tuberculosis H37Rv
cggcgucaaauccagcga

SEQ ID NO: 1290757 - RNA, 18 nt, Mycobacterium tuberculosis H37Rv
cggcgucggucgucgggu

SEQ ID NO: 1290758 - RNA, 14 nt, Mycobacterium tuberculosis H37Rv
cggcgucggucguc

SEQ ID NO: 1290759 - RNA, 15 nt, Mycobacterium tuberculosis H37Rv
cggcgucggucgggu

SEQ ID NO: 1290760 - RNA, 14 nt, Mycobacterium tuberculosis H37Rv
cggcguucgaugcc

SEQ ID NO: 1290761 - RNA, 23 nt, Mycobacterium tuberculosis H37Rv
cggcguucccgccauugccgccg

SEQ ID NO: 1290762 - RNA, 15 nt, Mycobacterium tuberculosis H37Rv
cggcguuaucgucgg

SEQ ID NO: 1290763 - RNA, 15 nt, Mycobacterium tuberculosis H37Rv
cggcguuaccaccgu

SEQ ID NO: 1290764 - RNA, 13 nt, Mycobacterium tuberculosis H37Rv
cggcuaccgccga

SEQ ID NO: 1290765 - RNA, 21 nt, Mycobacterium tuberculosis H37Rv
cggcuacaucggcggcgucga

SEQ ID NO: 1290766 - RNA, 13 nt, Mycobacterium tuberculosis H37Rv
cggcguucgccgg

SEQ ID NO: 1290767 - RNA, 13 nt, Mycobacterium tuberculosis H37Rv
cggcucagcgugc

SEQ ID NO: 1290768 - RNA, 14 nt, Mycobacterium tuberculosis H37Rv
cggcucaccgcgca

SEQ ID NO: 1290769 - RNA, 16 nt, Mycobacterium tuberculosis H37Rv
cggcucaccgaacgcg

SEQ ID NO: 1290770 - RNA, 16 nt, Mycobacterium tuberculosis H37Rv
cggcucacgacugcgu

SEQ ID NO: 1290771 - RNA, 23 nt, Mycobacterium tuberculosis H37Rv
cggcuagcaacgggucgaugucg

SEQ ID NO: 1290772 - RNA, 23 nt, Mycobacterium tuberculosis H37Rv
cggcuccgccacuggcgccggug

SEQ ID NO: 1290773 - RNA, 18 nt, Mycobacterium tuberculosis H37Rv
cggcuccgcccggcgugu

SEQ ID NO: 1290774 - RNA, 16 nt, Mycobacterium tuberculosis H37Rv
cggcucgccaccucgg

SEQ ID NO: 1290775 - RNA, 17 nt, Mycobacterium tuberculosis H37Rv
cggcucgagucgcagca

SEQ ID NO: 1290776 - RNA, 23 nt, Mycobacterium tuberculosis H37Rv
cggcucgccggcgcgcaccccgg

SEQ ID NO: 1290777 - RNA, 15 nt, Mycobacterium tuberculosis H37Rv
cgggcuuggcgucga

SEQ ID NO: 1290778 - RNA, 19 nt, Mycobacterium tuberculosis H37Rv
cggggaaccguccaagccg

SEQ ID NO: 1290779 - RNA, 16 nt, Mycobacterium tuberculosis H37Rv
cggggaaaccggccag

SEQ ID NO: 1290780 - RNA, 19 nt, Mycobacterium tuberculosis H37Rv
cggggaagacgaccgugcu

SEQ ID NO: 1290781 - RNA, 18 nt, Mycobacterium tuberculosis H37Rv
cggggaaggggcucagcg

SEQ ID NO: 1290782 - RNA, 16 nt, Mycobacterium tuberculosis H37Rv
cgggcugugauccgac

SEQ ID NO: 1290783 - RNA, 22 nt, Mycobacterium tuberculosis H37Rv
cgggcuugacccuugggcacca

SEQ ID NO: 1290784 - RNA, 17 nt, Mycobacterium tuberculosis H37Rv
cgggcuugagcgccgau

SEQ ID NO: 1290785 - RNA, 21 nt, Mycobacterium tuberculosis H37Rv
cgggcugugaacagcgcgucg

SEQ ID NO: 1290786 - RNA, 13 nt, Mycobacterium tuberculosis H37Rv
cgggcuguaggcg

SEQ ID NO: 1290787 - RNA, 15 nt, Mycobacterium tuberculosis H37Rv
cgggcucggagauga

SEQ ID NO: 1290788 - RNA, 20 nt, Mycobacterium tuberculosis H37Rv
cgggcucgcuucaggcaccg

SEQ ID NO: 1290789 - RNA, 17 nt, Mycobacterium tuberculosis H37Rv
cgggcucgcgaucguca

SEQ ID NO: 1290790 - RNA, 17 nt, Mycobacterium tuberculosis H37Rv
cgggcuggccgacucga

SEQ ID NO: 1290791 - RNA, 15 nt, Mycobacterium tuberculosis H37Rv
cgggcuggcgacgac

SEQ ID NO: 1290792 - RNA, 16 nt, Mycobacterium tuberculosis H37Rv
cgggcugaggcggcga

SEQ ID NO: 1290793 - RNA, 15 nt, Mycobacterium tuberculosis H37Rv
cgggcucucggcguc

SEQ ID NO: 1290794 - RNA, 21 nt, Mycobacterium tuberculosis H37Rv
cgggcucugcugccagccgaa

SEQ ID NO: 1290795 - RNA, 18 nt, Mycobacterium tuberculosis H37Rv
cgggcucuaucagacgau

SEQ ID NO: 1290796 - RNA, 14 nt, Mycobacterium tuberculosis H37Rv
cgggcgugguaacc

SEQ ID NO: 1290797 - RNA, 20 nt, Mycobacterium tuberculosis H37Rv
cgggccuuguucuuggccac

SEQ ID NO: 1290798 - RNA, 19 nt, Mycobacterium tuberculosis H37Rv
cgggcgugugcaguccgau

SEQ ID NO: 1290799 - RNA, 15 nt, Mycobacterium tuberculosis H37Rv
cgggcgugguaucgc

SEQ ID NO: 1290800 - RNA, 14 nt, Mycobacterium tuberculosis H37Rv
cgggcguuggccag

SEQ ID NO: 1290801 - RNA, 23 nt, Mycobacterium tuberculosis H37Rv
cgggcguucucgauugucgccgc

SEQ ID NO: 1290802 - RNA, 23 nt, Mycobacterium tuberculosis H37Rv
cgggccugggacggcggcagucg

SEQ ID NO: 1290803 - RNA, 16 nt, Mycobacterium tuberculosis H37Rv
cgggccugguggauga

SEQ ID NO: 1290804 - RNA, 17 nt, Mycobacterium tuberculosis H37Rv
cgggccuucagcucacc

SEQ ID NO: 1290805 - RNA, 14 nt, Mycobacterium tuberculosis H37Rv
cggggcggcggugg

SEQ ID NO: 1290806 - RNA, 23 nt, Mycobacterium tuberculosis H37Rv
cggggcuucaucuggcgccguua

SEQ ID NO: 1290807 - RNA, 20 nt, Mycobacterium tuberculosis H37Rv
cggggcgcucgcgcgcuggg

SEQ ID NO: 1290808 - RNA, 22 nt, Mycobacterium tuberculosis H37Rv
cggggcgcugcagcucacgacu

SEQ ID NO: 1290809 - RNA, 23 nt, Mycobacterium tuberculosis H37Rv
cggggcgcaccgcggaccggcgu

SEQ ID NO: 1290810 - RNA, 18 nt, Mycobacterium tuberculosis H37Rv
cggggcgcccggccaggu

SEQ ID NO: 1290811 - RNA, 16 nt, Mycobacterium tuberculosis H37Rv
cgggggccgagccgac

SEQ ID NO: 1290812 - RNA, 15 nt, Mycobacterium tuberculosis H37Rv
cgggggcgccgccgu

SEQ ID NO: 1290813 - RNA, 14 nt, Mycobacterium tuberculosis H37Rv
cgggggcagcgcga

SEQ ID NO: 1290814 - RNA, 18 nt, Mycobacterium tuberculosis H37Rv
cgggggagcgaacggcgc

SEQ ID NO: 1290815 - RNA, 15 nt, Mycobacterium tuberculosis H37Rv
cgggggccagcguca

SEQ ID NO: 1290816 - RNA, 21 nt, Mycobacterium tuberculosis H37Rv
cgggggcaccguuaccgccgu

SEQ ID NO: 1290817 - RNA, 13 nt, Mycobacterium tuberculosis H37Rv
cggggcgcucgcg

SEQ ID NO: 1290818 - RNA, 20 nt, Mycobacterium tuberculosis H37Rv
cgggguccgaugcgugccga

SEQ ID NO: 1290819 - RNA, 21 nt, Mycobacterium tuberculosis H37Rv
cgggguccgaugcgugccgac

SEQ ID NO: 1290820 - RNA, 21 nt, Mycobacterium tuberculosis H37Rv
cgggguccaucggggccgucg

SEQ ID NO: 1290821 - RNA, 19 nt, Mycobacterium tuberculosis H37Rv
cggggcaaaggagccguug

SEQ ID NO: 1290822 - RNA, 20 nt, Mycobacterium tuberculosis H37Rv
cggggaugccgaaccgcugc

SEQ ID NO: 1290823 - RNA, 15 nt, Mycobacterium tuberculosis H37Rv
cggggaggucgagcu

SEQ ID NO: 1290824 - RNA, 17 nt, Mycobacterium tuberculosis H37Rv
cggggaguuccaaaucg

SEQ ID NO: 1290825 - RNA, 14 nt, Mycobacterium tuberculosis H37Rv
cggggaucagcguc

SEQ ID NO: 1290826 - RNA, 16 nt, Mycobacterium tuberculosis H37Rv
cggggccgccgaugcc

SEQ ID NO: 1290827 - RNA, 12 nt, Mycobacterium tuberculosis H37Rv
cggggccgccgu

SEQ ID NO: 1290828 - RNA, 23 nt, Mycobacterium tuberculosis H37Rv
cggggccgccgucgccuccgcua

SEQ ID NO: 1290829 - RNA, 21 nt, Mycobacterium tuberculosis H37Rv
cggggcccggacaggcucacg

SEQ ID NO: 1290830 - RNA, 22 nt, Mycobacterium tuberculosis H37Rv
cggggccgcacuguugcguagc

SEQ ID NO: 1290831 - RNA, 23 nt, Mycobacterium tuberculosis H37Rv
cggggcccacaccgaguugauga

SEQ ID NO: 1290832 - RNA, 21 nt, Mycobacterium tuberculosis H37Rv
cggggccccgcggcgccgcca

SEQ ID NO: 1290833 - RNA, 14 nt, Mycobacterium tuberculosis H37Rv
cggggauccgguaa

SEQ ID NO: 1290834 - RNA, 23 nt, Mycobacterium tuberculosis H37Rv
cgggucaccagcgcaucggccag

SEQ ID NO: 1290835 - RNA, 22 nt, Mycobacterium tuberculosis H37Rv
cggggugggaaguagugcaucg

SEQ ID NO: 1290836 - RNA, 12 nt, Mycobacterium tuberculosis H37Rv
cgggguggcacg

SEQ ID NO: 1290837 - RNA, 17 nt, Mycobacterium tuberculosis H37Rv
cggggugcgcccaccga

SEQ ID NO: 1290838 - RNA, 14 nt, Mycobacterium tuberculosis H37Rv
cggguccgccguug

SEQ ID NO: 1290839 - RNA, 22 nt, Mycobacterium tuberculosis H37Rv
cggguccgaaguacuggccgcc

SEQ ID NO: 1290840 - RNA, 13 nt, Mycobacterium tuberculosis H37Rv
cggguccucgcgg

SEQ ID NO: 1290841 - RNA, 20 nt, Mycobacterium tuberculosis H37Rv
cgggguggcggcgcugcgcg

SEQ ID NO: 1290842 - RNA, 14 nt, Mycobacterium tuberculosis H37Rv
cgggucaccagcgc

SEQ ID NO: 1290843 - RNA, 12 nt, Mycobacterium tuberculosis H37Rv
cgggucacgacc

SEQ ID NO: 1290844 - RNA, 16 nt, Mycobacterium tuberculosis H37Rv
cgggucgaugcgcaac

SEQ ID NO: 1290845 - RNA, 20 nt, Mycobacterium tuberculosis H37Rv
cgggucgcaaccgccgccau

SEQ ID NO: 1290846 - RNA, 20 nt, Mycobacterium tuberculosis H37Rv
cgggucgccgggcccgucgg

SEQ ID NO: 1290847 - RNA, 18 nt, Mycobacterium tuberculosis H37Rv
cgggucggcgaccgcgcu

SEQ ID NO: 1290848 - RNA, 12 nt, Mycobacterium tuberculosis H37Rv
cgggucggcgcc

SEQ ID NO: 1290849 - RNA, 13 nt, Mycobacterium tuberculosis H37Rv
cgggucgaugacg

SEQ ID NO: 1290850 - RNA, 18 nt, Mycobacterium tuberculosis H37Rv
cgggucgaugucggcaau

SEQ ID NO: 1290851 - RNA, 17 nt, Mycobacterium tuberculosis H37Rv
cgggucgauuucgccgg

SEQ ID NO: 1290852 - RNA, 22 nt, Mycobacterium tuberculosis H37Rv
cgggucgaucaccgacaccgug

SEQ ID NO: 1290853 - RNA, 12 nt, Mycobacterium tuberculosis H37Rv
cgggucggcgcu

SEQ ID NO: 1290854 - RNA, 19 nt, Mycobacterium tuberculosis H37Rv
cgggucgguuuccuccggc

SEQ ID NO: 1290855 - RNA, 20 nt, Mycobacterium tuberculosis H37Rv
cgggucgguuuccuccggca

SEQ ID NO: 1290856 - RNA, 13 nt, Mycobacterium tuberculosis H37Rv
cgggugccgagcu

SEQ ID NO: 1290857 - RNA, 23 nt, Mycobacterium tuberculosis H37Rv
cgggugcaggcgaguuaggccgc

SEQ ID NO: 1290858 - RNA, 23 nt, Mycobacterium tuberculosis H37Rv
cgggugaugacgccgucggcgcg

SEQ ID NO: 1290859 - RNA, 18 nt, Mycobacterium tuberculosis H37Rv
cgggugaugacgccgucg

SEQ ID NO: 1290860 - RNA, 17 nt, Mycobacterium tuberculosis H37Rv
cgggugcaacggcguug

SEQ ID NO: 1290861 - RNA, 12 nt, Mycobacterium tuberculosis H37Rv
cgggugcaccgg

SEQ ID NO: 1290862 - RNA, 22 nt, Mycobacterium tuberculosis H37Rv
cggguggaucuucaccucgaug

SEQ ID NO: 1290863 - RNA, 23 nt, Mycobacterium tuberculosis H37Rv
cgggugcugaugggucaggccga

SEQ ID NO: 1290864 - RNA, 13 nt, Mycobacterium tuberculosis H37Rv
cgggugcgucgau

SEQ ID NO: 1290865 - RNA, 15 nt, Mycobacterium tuberculosis H37Rv
cgggugcgacggcgu

SEQ ID NO: 1290866 - RNA, 16 nt, Mycobacterium tuberculosis H37Rv
cggguggcgccagguc

SEQ ID NO: 1290867 - RNA, 15 nt, Mycobacterium tuberculosis H37Rv
cggguggcgucaccg

SEQ ID NO: 1290868 - RNA, 14 nt, Mycobacterium tuberculosis H37Rv
cggguguggcagug

SEQ ID NO: 1290869 - RNA, 18 nt, Mycobacterium tuberculosis H37Rv
cggguguggucaccaggc

SEQ ID NO: 1290870 - RNA, 17 nt, Mycobacterium tuberculosis H37Rv
cggguguggucaccagg

SEQ ID NO: 1290871 - RNA, 14 nt, Mycobacterium tuberculosis H37Rv
cggguguggucacc

SEQ ID NO: 1290872 - RNA, 16 nt, Mycobacterium tuberculosis H37Rv
cggguguuaucggucg

SEQ ID NO: 1290873 - RNA, 22 nt, Mycobacterium tuberculosis H37Rv
cggguguuccacaccaggccga

SEQ ID NO: 1290874 - RNA, 13 nt, Mycobacterium tuberculosis H37Rv
cggguguucgcgc

SEQ ID NO: 1290875 - RNA, 16 nt, Mycobacterium tuberculosis H37Rv
cggguguggucggugg

SEQ ID NO: 1290876 - RNA, 24 nt, Mycobacterium tuberculosis H37Rv
cggguguuggggaucgcaccgugg

SEQ ID NO: 1290877 - RNA, 20 nt, Mycobacterium tuberculosis H37Rv
cgguaaccggcccgaugacc

SEQ ID NO: 1290878 - RNA, 13 nt, Mycobacterium tuberculosis H37Rv
cgguaagcgaaac

SEQ ID NO: 1290879 - RNA, 18 nt, Mycobacterium tuberculosis H37Rv
cgguaacgaacagcguca

SEQ ID NO: 1290880 - RNA, 22 nt, Mycobacterium tuberculosis H37Rv
cgguaaccgcgcguaggccgcu

SEQ ID NO: 1290881 - RNA, 14 nt, Mycobacterium tuberculosis H37Rv
cgguaaaccacucg

SEQ ID NO: 1290882 - RNA, 19 nt, Mycobacterium tuberculosis H37Rv
cggguuaucggcagcagga

SEQ ID NO: 1290883 - RNA, 20 nt, Mycobacterium tuberculosis H37Rv
cggguuugaucagcucgguc

SEQ ID NO: 1290884 - RNA, 16 nt, Mycobacterium tuberculosis H37Rv
cggguuuggccgacag

SEQ ID NO: 1290885 - RNA, 20 nt, Mycobacterium tuberculosis H37Rv
cggguuggugggucggggcg

SEQ ID NO: 1290886 - RNA, 14 nt, Mycobacterium tuberculosis H37Rv
cggguuguggcacc

SEQ ID NO: 1290887 - RNA, 22 nt, Mycobacterium tuberculosis H37Rv
cgguccccaggucguaggcgcu

SEQ ID NO: 1290888 - RNA, 21 nt, Mycobacterium tuberculosis H37Rv
cggucccccgaaguggugacc

SEQ ID NO: 1290889 - RNA, 19 nt, Mycobacterium tuberculosis H37Rv
cgguccccccguugccgcc

SEQ ID NO: 1290890 - RNA, 15 nt, Mycobacterium tuberculosis H37Rv
cggucccacucgucg

SEQ ID NO: 1290891 - RNA, 18 nt, Mycobacterium tuberculosis H37Rv
cgguccccgccggcgggu

SEQ ID NO: 1290892 - RNA, 13 nt, Mycobacterium tuberculosis H37Rv
cgguccccucggu

SEQ ID NO: 1290893 - RNA, 19 nt, Mycobacterium tuberculosis H37Rv
cggucccggcacgucgacc

SEQ ID NO: 1290894 - RNA, 13 nt, Mycobacterium tuberculosis H37Rv
cgguccauucguc

SEQ ID NO: 1290895 - RNA, 17 nt, Mycobacterium tuberculosis H37Rv
cgguccaucagcacggu

SEQ ID NO: 1290896 - RNA, 12 nt, Mycobacterium tuberculosis H37Rv
cgguccaucagc

SEQ ID NO: 1290897 - RNA, 21 nt, Mycobacterium tuberculosis H37Rv
cgguccagguucuucuccacc

SEQ ID NO: 1290898 - RNA, 16 nt, Mycobacterium tuberculosis H37Rv
cgguccagggccuguu

SEQ ID NO: 1290899 - RNA, 22 nt, Mycobacterium tuberculosis H37Rv
cgguccagcccagcgcgcgcaa

SEQ ID NO: 1290900 - RNA, 23 nt, Mycobacterium tuberculosis H37Rv
cgguccagccccaucgcuggucg

SEQ ID NO: 1290901 - RNA, 16 nt, Mycobacterium tuberculosis H37Rv
cgguccacgacgucga

SEQ ID NO: 1290902 - RNA, 19 nt, Mycobacterium tuberculosis H37Rv
cgguccacgacgucgagcg

SEQ ID NO: 1290903 - RNA, 15 nt, Mycobacterium tuberculosis H37Rv
cgguccagacccagc

SEQ ID NO: 1290904 - RNA, 16 nt, Mycobacterium tuberculosis H37Rv
cggucaugucggccac

SEQ ID NO: 1290905 - RNA, 15 nt, Mycobacterium tuberculosis H37Rv
cggucauggucagca

SEQ ID NO: 1290906 - RNA, 17 nt, Mycobacterium tuberculosis H37Rv
cgguccaaaacaccgcc

SEQ ID NO: 1290907 - RNA, 17 nt, Mycobacterium tuberculosis H37Rv
cgguccaacagcgccag

SEQ ID NO: 1290908 - RNA, 22 nt, Mycobacterium tuberculosis H37Rv
cgguccaccgaccuaccgucga

SEQ ID NO: 1290909 - RNA, 17 nt, Mycobacterium tuberculosis H37Rv
cgguccaaucgccgggu

SEQ ID NO: 1290910 - RNA, 13 nt, Mycobacterium tuberculosis H37Rv
cgguccugcucgc

SEQ ID NO: 1290911 - RNA, 13 nt, Mycobacterium tuberculosis H37Rv
cggucgacaacgg

SEQ ID NO: 1290912 - RNA, 13 nt, Mycobacterium tuberculosis H37Rv
cgguccucgaucg

SEQ ID NO: 1290913 - RNA, 13 nt, Mycobacterium tuberculosis H37Rv
cggucgaccgugc

SEQ ID NO: 1290914 - RNA, 15 nt, Mycobacterium tuberculosis H37Rv
cggucgacgaucucg

SEQ ID NO: 1290915 - RNA, 15 nt, Mycobacterium tuberculosis H37Rv
cggucccugcgccgu

SEQ ID NO: 1290916 - RNA, 13 nt, Mycobacterium tuberculosis H37Rv
cggucccgccgug

SEQ ID NO: 1290917 - RNA, 23 nt, Mycobacterium tuberculosis H37Rv
cgguccgagcggcaucggucacc

SEQ ID NO: 1290918 - RNA, 22 nt, Mycobacterium tuberculosis H37Rv
cgguccggggcaacgaucaggu

SEQ ID NO: 1290919 - RNA, 17 nt, Mycobacterium tuberculosis H37Rv
cgguccggcccaccagc

SEQ ID NO: 1290920 - RNA, 22 nt, Mycobacterium tuberculosis H37Rv
cgguccggcuucggcgaacccu

SEQ ID NO: 1290921 - RNA, 16 nt, Mycobacterium tuberculosis H37Rv
cgguaggccaucugcu

SEQ ID NO: 1290922 - RNA, 17 nt, Mycobacterium tuberculosis H37Rv
cggucagcgcgcggcuc

SEQ ID NO: 1290923 - RNA, 12 nt, Mycobacterium tuberculosis H37Rv
cggucagccgga

SEQ ID NO: 1290924 - RNA, 14 nt, Mycobacterium tuberculosis H37Rv
cggucagcgccgac

SEQ ID NO: 1290925 - RNA, 22 nt, Mycobacterium tuberculosis H37Rv
cggucagcgucaggugcgcgac

SEQ ID NO: 1290926 - RNA, 17 nt, Mycobacterium tuberculosis H37Rv
cggucagcggcugggcg

SEQ ID NO: 1290927 - RNA, 19 nt, Mycobacterium tuberculosis H37Rv
cggucagcggccaacccau

SEQ ID NO: 1290928 - RNA, 19 nt, Mycobacterium tuberculosis H37Rv
cgguagccuggcuguccgc

SEQ ID NO: 1290929 - RNA, 13 nt, Mycobacterium tuberculosis H37Rv
cgguacaucgacc

SEQ ID NO: 1290930 - RNA, 22 nt, Mycobacterium tuberculosis H37Rv
cgguagcuuccgcgacgcucgc

SEQ ID NO: 1290931 - RNA, 14 nt, Mycobacterium tuberculosis H37Rv
cgguagcucgucga

SEQ ID NO: 1290932 - RNA, 19 nt, Mycobacterium tuberculosis H37Rv
cgguagcguucgucguagu

SEQ ID NO: 1290933 - RNA, 18 nt, Mycobacterium tuberculosis H37Rv
cgguagcgcggguggcuc

SEQ ID NO: 1290934 - RNA, 23 nt, Mycobacterium tuberculosis H37Rv
cgguagcgauuccaggauggcca

SEQ ID NO: 1290935 - RNA, 21 nt, Mycobacterium tuberculosis H37Rv
cgguagcggcuccgaaggccg

SEQ ID NO: 1290936 - RNA, 18 nt, Mycobacterium tuberculosis H37Rv
cggucaucccuuucgcgc

SEQ ID NO: 1290937 - RNA, 16 nt, Mycobacterium tuberculosis H37Rv
cggucagugggacggg

SEQ ID NO: 1290938 - RNA, 17 nt, Mycobacterium tuberculosis H37Rv
cggucagugggacgggc

SEQ ID NO: 1290939 - RNA, 18 nt, Mycobacterium tuberculosis H37Rv
cggucaguauggcgacga

SEQ ID NO: 1290940 - RNA, 13 nt, Mycobacterium tuberculosis H37Rv
cggucauggcgac

SEQ ID NO: 1290941 - RNA, 19 nt, Mycobacterium tuberculosis H37Rv
cggucaucggccgucucgg

SEQ ID NO: 1290942 - RNA, 16 nt, Mycobacterium tuberculosis H37Rv
cggucaucgagcugac

SEQ ID NO: 1290943 - RNA, 13 nt, Mycobacterium tuberculosis H37Rv
cggucaggauggg

SEQ ID NO: 1290944 - RNA, 15 nt, Mycobacterium tuberculosis H37Rv
cggucagcucgucgg

SEQ ID NO: 1290945 - RNA, 23 nt, Mycobacterium tuberculosis H37Rv
cggucaggaacaaguagccgucg

SEQ ID NO: 1290946 - RNA, 19 nt, Mycobacterium tuberculosis H37Rv
cggucagcucggcagcauc

SEQ ID NO: 1290947 - RNA, 20 nt, Mycobacterium tuberculosis H37Rv
cggucgccggucaucgccga

SEQ ID NO: 1290948 - RNA, 22 nt, Mycobacterium tuberculosis H37Rv
cggucgcgcauuucguggcgcg

SEQ ID NO: 1290949 - RNA, 21 nt, Mycobacterium tuberculosis H37Rv
cggucgcgacuaccaucgccg

SEQ ID NO: 1290950 - RNA, 17 nt, Mycobacterium tuberculosis H37Rv
cggucgccgaccacucg

SEQ ID NO: 1290951 - RNA, 16 nt, Mycobacterium tuberculosis H37Rv
cggucgccaccguguc

SEQ ID NO: 1290952 - RNA, 20 nt, Mycobacterium tuberculosis H37Rv
cggucgccaagaucgggugg

SEQ ID NO: 1290953 - RNA, 14 nt, Mycobacterium tuberculosis H37Rv
cggucgccaccgug

SEQ ID NO: 1290954 - RNA, 18 nt, Mycobacterium tuberculosis H37Rv
cggucgcaacggucacau

SEQ ID NO: 1290955 - RNA, 18 nt, Mycobacterium tuberculosis H37Rv
cggucgcauggucgacga

SEQ ID NO: 1290956 - RNA, 20 nt, Mycobacterium tuberculosis H37Rv
cggucgcauggucgacgaac

SEQ ID NO: 1290957 - RNA, 16 nt, Mycobacterium tuberculosis H37Rv
cggucgccaccgccgg

SEQ ID NO: 1290958 - RNA, 18 nt, Mycobacterium tuberculosis H37Rv
cggucgccaccgccggca

SEQ ID NO: 1290959 - RNA, 12 nt, Mycobacterium tuberculosis H37Rv
cggucgaugacc

SEQ ID NO: 1290960 - RNA, 18 nt, Mycobacterium tuberculosis H37Rv
cggucgaucacacggucc

SEQ ID NO: 1290961 - RNA, 15 nt, Mycobacterium tuberculosis H37Rv
cggucgaucacaucu

SEQ ID NO: 1290962 - RNA, 16 nt, Mycobacterium tuberculosis H37Rv
cggucgagccagcgga

SEQ ID NO: 1290963 - RNA, 22 nt, Mycobacterium tuberculosis H37Rv
cggucgaggcccucgcgcgcgu

SEQ ID NO: 1290964 - RNA, 21 nt, Mycobacterium tuberculosis H37Rv
cggucgaguauugcaggaaau

SEQ ID NO: 1290965 - RNA, 21 nt, Mycobacterium tuberculosis H37Rv
cggucgagguggcgggcgaug

SEQ ID NO: 1290966 - RNA, 15 nt, Mycobacterium tuberculosis H37Rv
cggucgcuugcuguc

SEQ ID NO: 1290967 - RNA, 17 nt, Mycobacterium tuberculosis H37Rv
cggucgcuguccacugc

SEQ ID NO: 1290968 - RNA, 20 nt, Mycobacterium tuberculosis H37Rv
cggucgcugcgaugcugauc

SEQ ID NO: 1290969 - RNA, 22 nt, Mycobacterium tuberculosis H37Rv
cggucgcuauccggcggccagu

SEQ ID NO: 1290970 - RNA, 21 nt, Mycobacterium tuberculosis H37Rv
cggucgcucggcaugagucga

SEQ ID NO: 1290971 - RNA, 23 nt, Mycobacterium tuberculosis H37Rv
cggucgcguugcagaccaccagu

SEQ ID NO: 1290972 - RNA, 17 nt, Mycobacterium tuberculosis H37Rv
cggucgcguaccggugg

SEQ ID NO: 1290973 - RNA, 18 nt, Mycobacterium tuberculosis H37Rv
cggucggcgaccaccagc

SEQ ID NO: 1290974 - RNA, 21 nt, Mycobacterium tuberculosis H37Rv
cggucggccugcggcaacggc

SEQ ID NO: 1290975 - RNA, 23 nt, Mycobacterium tuberculosis H37Rv
cggucggccugcgaacacgcgau

SEQ ID NO: 1290976 - RNA, 17 nt, Mycobacterium tuberculosis H37Rv
cggucggccugcggcaa

SEQ ID NO: 1290977 - RNA, 22 nt, Mycobacterium tuberculosis H37Rv
cggucggagcggugccgacggu

SEQ ID NO: 1290978 - RNA, 15 nt, Mycobacterium tuberculosis H37Rv
cggucggcaccaggu

SEQ ID NO: 1290979 - RNA, 16 nt, Mycobacterium tuberculosis H37Rv
cggucggagucgagca

SEQ ID NO: 1290980 - RNA, 19 nt, Mycobacterium tuberculosis H37Rv
cggucggcagcuucucgcc

SEQ ID NO: 1290981 - RNA, 13 nt, Mycobacterium tuberculosis H37Rv
cggucggccacca

SEQ ID NO: 1290982 - RNA, 15 nt, Mycobacterium tuberculosis H37Rv
cggucggugagccgu

SEQ ID NO: 1290983 - RNA, 16 nt, Mycobacterium tuberculosis H37Rv
cggucguccggaucgg

SEQ ID NO: 1290984 - RNA, 22 nt, Mycobacterium tuberculosis H37Rv
cggucguccggaucggucggca

SEQ ID NO: 1290985 - RNA, 14 nt, Mycobacterium tuberculosis H37Rv
cggucgucaccgua

SEQ ID NO: 1290986 - RNA, 21 nt, Mycobacterium tuberculosis H37Rv
cggucggcgucgagauagucg

SEQ ID NO: 1290987 - RNA, 23 nt, Mycobacterium tuberculosis H37Rv
cggucgugccggggcugccgaac

SEQ ID NO: 1290988 - RNA, 18 nt, Mycobacterium tuberculosis H37Rv
cggucgugaucagcagga

SEQ ID NO: 1290989 - RNA, 17 nt, Mycobacterium tuberculosis H37Rv
cggucguuggucggggu

SEQ ID NO: 1290990 - RNA, 18 nt, Mycobacterium tuberculosis H37Rv
cggucucggugccgagca

SEQ ID NO: 1290991 - RNA, 15 nt, Mycobacterium tuberculosis H37Rv
cggucuagcugggua

SEQ ID NO: 1290992 - RNA, 17 nt, Mycobacterium tuberculosis H37Rv
cggucucagugcucgcc

SEQ ID NO: 1290993 - RNA, 13 nt, Mycobacterium tuberculosis H37Rv
cggucugcaugcg

SEQ ID NO: 1290994 - RNA, 16 nt, Mycobacterium tuberculosis H37Rv
cggucucgucgcgggu

SEQ ID NO: 1290995 - RNA, 15 nt, Mycobacterium tuberculosis H37Rv
cggucugcuccaggc

SEQ ID NO: 1290996 - RNA, 15 nt, Mycobacterium tuberculosis H37Rv
cggucuggacaucgg

SEQ ID NO: 1290997 - RNA, 18 nt, Mycobacterium tuberculosis H37Rv
cggucugguggucggcga

SEQ ID NO: 1290998 - RNA, 21 nt, Mycobacterium tuberculosis H37Rv
cggucugcgccaaaauccgcc

SEQ ID NO: 1290999 - RNA, 18 nt, Mycobacterium tuberculosis H37Rv
cggucuuacggucggcuc

SEQ ID NO: 1291000 - RNA, 19 nt, Mycobacterium tuberculosis H37Rv
cggucuuuguccgucgcgu

SEQ ID NO: 1291001 - RNA, 17 nt, Mycobacterium tuberculosis H37Rv
cggucuuugagccggua

SEQ ID NO: 1291002 - RNA, 14 nt, Mycobacterium tuberculosis H37Rv
cggucuugacaccg

SEQ ID NO: 1291003 - RNA, 21 nt, Mycobacterium tuberculosis H37Rv
cggugaacuucuccaccagcg

SEQ ID NO: 1291004 - RNA, 19 nt, Mycobacterium tuberculosis H37Rv
cggugaacggcagcacggu

SEQ ID NO: 1291005 - RNA, 17 nt, Mycobacterium tuberculosis H37Rv
cggugaacuucuccacc

SEQ ID NO: 1291006 - RNA, 18 nt, Mycobacterium tuberculosis H37Rv
cggugaacaccagcagga

SEQ ID NO: 1291007 - RNA, 15 nt, Mycobacterium tuberculosis H37Rv
cggugaacaccgcca

SEQ ID NO: 1291008 - RNA, 14 nt, Mycobacterium tuberculosis H37Rv
cggugaacaccagc

SEQ ID NO: 1291009 - RNA, 19 nt, Mycobacterium tuberculosis H37Rv
cggugaaaucgcacagcgc

SEQ ID NO: 1291010 - RNA, 19 nt, Mycobacterium tuberculosis H37Rv
cggccugcgcgaccgacca

SEQ ID NO: 1291011 - RNA, 17 nt, Mycobacterium tuberculosis H37Rv
cggccucgucgaguucc

SEQ ID NO: 1291012 - RNA, 12 nt, Mycobacterium tuberculosis H37Rv
cggccucgucga

SEQ ID NO: 1291013 - RNA, 18 nt, Mycobacterium tuberculosis H37Rv
cggccugcggcaccggcu

SEQ ID NO: 1291014 - RNA, 17 nt, Mycobacterium tuberculosis H37Rv
cggccucgggcucaaac

SEQ ID NO: 1291015 - RNA, 20 nt, Mycobacterium tuberculosis H37Rv
cggccgugaauucgccgaac

SEQ ID NO: 1291016 - RNA, 17 nt, Mycobacterium tuberculosis H37Rv
cggccgucuucggugau

SEQ ID NO: 1291017 - RNA, 16 nt, Mycobacterium tuberculosis H37Rv
cggccgucgucggcca

SEQ ID NO: 1291018 - RNA, 13 nt, Mycobacterium tuberculosis H37Rv
cggccgucgucgg

SEQ ID NO: 1291019 - RNA, 19 nt, Mycobacterium tuberculosis H37Rv
cggccuguucggcggcugc

SEQ ID NO: 1291020 - RNA, 14 nt, Mycobacterium tuberculosis H37Rv
cggccuuaggugac

SEQ ID NO: 1291021 - RNA, 18 nt, Mycobacterium tuberculosis H37Rv
cggccuucagcggucgca

SEQ ID NO: 1291022 - RNA, 17 nt, Mycobacterium tuberculosis H37Rv
cggccuuauucacccgg

SEQ ID NO: 1291023 - RNA, 17 nt, Mycobacterium tuberculosis H37Rv
cggccuguucgccgucg

SEQ ID NO: 1291024 - RNA, 13 nt, Mycobacterium tuberculosis H37Rv
cggccuguucggc

SEQ ID NO: 1291025 - RNA, 15 nt, Mycobacterium tuberculosis H37Rv
cggccuguccaccga

SEQ ID NO: 1291026 - RNA, 21 nt, Mycobacterium tuberculosis H37Rv
cggccuggucggccaggucga

SEQ ID NO: 1291027 - RNA, 14 nt, Mycobacterium tuberculosis H37Rv
cggccugguacucc

SEQ ID NO: 1291028 - RNA, 19 nt, Mycobacterium tuberculosis H37Rv
cggccuucagcguccagga

SEQ ID NO: 1291029 - RNA, 22 nt, Mycobacterium tuberculosis H37Rv
cggccuugaucaccgugcgguc

SEQ ID NO: 1291030 - RNA, 15 nt, Mycobacterium tuberculosis H37Rv
cggccuugccaccgg

SEQ ID NO: 1291031 - RNA, 18 nt, Mycobacterium tuberculosis H37Rv
cggccuugacgcacgacu

SEQ ID NO: 1291032 - RNA, 20 nt, Mycobacterium tuberculosis H37Rv
cggccuugcucagcacgccg

SEQ ID NO: 1291033 - RNA, 23 nt, Mycobacterium tuberculosis H37Rv
cggccuugcucagcacgccgggu

SEQ ID NO: 1291034 - RNA, 18 nt, Mycobacterium tuberculosis H37Rv
cggccuugcgggcucucg

SEQ ID NO: 1291035 - RNA, 14 nt, Mycobacterium tuberculosis H37Rv
cggccuugcucagc

SEQ ID NO: 1291036 - RNA, 13 nt, Mycobacterium tuberculosis H37Rv
cggccuugccgcc

SEQ ID NO: 1291037 - RNA, 16 nt, Mycobacterium tuberculosis H37Rv
cggccuugccaccggu

SEQ ID NO: 1291038 - RNA, 14 nt, Mycobacterium tuberculosis H37Rv
cggccuugcgcaca

SEQ ID NO: 1291039 - RNA, 20 nt, Mycobacterium tuberculosis H37Rv
cggcgaaaguccugcagugc

SEQ ID NO: 1291040 - RNA, 19 nt, Mycobacterium tuberculosis H37Rv
cggcgaacaaccgccgcuc

SEQ ID NO: 1291041 - RNA, 20 nt, Mycobacterium tuberculosis H37Rv
cggcgaacaaccacgcacgg

SEQ ID NO: 1291042 - RNA, 17 nt, Mycobacterium tuberculosis H37Rv
cggcgaaccagcgcguc

SEQ ID NO: 1291043 - RNA, 19 nt, Mycobacterium tuberculosis H37Rv
cggcgaaccagcgcgucuc

SEQ ID NO: 1291044 - RNA, 18 nt, Mycobacterium tuberculosis H37Rv
cggcgaacaucaccgucg

SEQ ID NO: 1291045 - RNA, 19 nt, Mycobacterium tuberculosis H37Rv
cggcgaacagccccagggu

SEQ ID NO: 1291046 - RNA, 20 nt, Mycobacterium tuberculosis H37Rv
cggcgaacagccccagggug

SEQ ID NO: 1291047 - RNA, 17 nt, Mycobacterium tuberculosis H37Rv
cggcgacaggccgagca

SEQ ID NO: 1291048 - RNA, 20 nt, Mycobacterium tuberculosis H37Rv
cggcgacaggagacgguacg

SEQ ID NO: 1291049 - RNA, 22 nt, Mycobacterium tuberculosis H37Rv
cggcgacaggagacgguacgcc

SEQ ID NO: 1291050 - RNA, 19 nt, Mycobacterium tuberculosis H37Rv
cggcgaccaaggccgaccu

SEQ ID NO: 1291051 - RNA, 17 nt, Mycobacterium tuberculosis H37Rv
cggcgaagucgagugcc

SEQ ID NO: 1291052 - RNA, 20 nt, Mycobacterium tuberculosis H37Rv
cggcgacagcuuggccgguu

SEQ ID NO: 1291053 - RNA, 19 nt, Mycobacterium tuberculosis H37Rv
cggcgaagugcuccaccuc

SEQ ID NO: 1291054 - RNA, 21 nt, Mycobacterium tuberculosis H37Rv
cggcgaagugcuccaccucgg

SEQ ID NO: 1291055 - RNA, 23 nt, Mycobacterium tuberculosis H37Rv
cggcgaaggguaagaguucgcgc

SEQ ID NO: 1291056 - RNA, 17 nt, Mycobacterium tuberculosis H37Rv
cggcgaagucacgcacc

SEQ ID NO: 1291057 - RNA, 21 nt, Mycobacterium tuberculosis H37Rv
cggcgaagucacgcacccggc

SEQ ID NO: 1291058 - RNA, 12 nt, Mycobacterium tuberculosis H37Rv
cggcgaccaucu

SEQ ID NO: 1291059 - RNA, 17 nt, Mycobacterium tuberculosis H37Rv
cggcgaccaggucggcu

SEQ ID NO: 1291060 - RNA, 19 nt, Mycobacterium tuberculosis H37Rv
cggcgaccaucugaucggg

SEQ ID NO: 1291061 - RNA, 16 nt, Mycobacterium tuberculosis H37Rv
cggcgaccagaaucuc

SEQ ID NO: 1291062 - RNA, 17 nt, Mycobacterium tuberculosis H37Rv
cggcgaccacggcaccg

SEQ ID NO: 1291063 - RNA, 16 nt, Mycobacterium tuberculosis H37Rv
cggcgaccacgccgcc

SEQ ID NO: 1291064 - RNA, 22 nt, Mycobacterium tuberculosis H37Rv
cggcgacggccgcucgggccag

SEQ ID NO: 1291065 - RNA, 13 nt, Mycobacterium tuberculosis H37Rv
cggcgacggccgc

SEQ ID NO: 1291066 - RNA, 21 nt, Mycobacterium tuberculosis H37Rv
cggcgacgaugucgagcgcga

SEQ ID NO: 1291067 - RNA, 22 nt, Mycobacterium tuberculosis H37Rv
cggcgacgaugucgacucgugg

SEQ ID NO: 1291068 - RNA, 15 nt, Mycobacterium tuberculosis H37Rv
cggcgacgagcgcag

SEQ ID NO: 1291069 - RNA, 14 nt, Mycobacterium tuberculosis H37Rv
cggccccgccguua

SEQ ID NO: 1291070 - RNA, 17 nt, Mycobacterium tuberculosis H37Rv
cggcccccggucgagcu

SEQ ID NO: 1291071 - RNA, 18 nt, Mycobacterium tuberculosis H37Rv
cggccccgccgaugccgc

SEQ ID NO: 1291072 - RNA, 15 nt, Mycobacterium tuberculosis H37Rv
cggccccgccgaugg

SEQ ID NO: 1291073 - RNA, 14 nt, Mycobacterium tuberculosis H37Rv
cggccccgccguug

SEQ ID NO: 1291074 - RNA, 22 nt, Mycobacterium tuberculosis H37Rv
cggccgcaaggcgccgauaccg

SEQ ID NO: 1291075 - RNA, 24 nt, Mycobacterium tuberculosis H37Rv
cggccgcaaucaugucagcgcuga

SEQ ID NO: 1291076 - RNA, 21 nt, Mycobacterium tuberculosis H37Rv
cggccgaugcgacccgcagac

SEQ ID NO: 1291077 - RNA, 13 nt, Mycobacterium tuberculosis H37Rv
cggccgcacauga

SEQ ID NO: 1291078 - RNA, 13 nt, Mycobacterium tuberculosis H37Rv
cggccgcaccagc

SEQ ID NO: 1291079 - RNA, 13 nt, Mycobacterium tuberculosis H37Rv
cggccgcacccgu

SEQ ID NO: 1291080 - RNA, 19 nt, Mycobacterium tuberculosis H37Rv
cggccgccgaucugcugca

SEQ ID NO: 1291081 - RNA, 21 nt, Mycobacterium tuberculosis H37Rv
cggccgccgaaacucaccagc

SEQ ID NO: 1291082 - RNA, 12 nt, Mycobacterium tuberculosis H37Rv
cggccgcacugg

SEQ ID NO: 1291083 - RNA, 18 nt, Mycobacterium tuberculosis H37Rv
cggccgcacgccuacgau

SEQ ID NO: 1291084 - RNA, 15 nt, Mycobacterium tuberculosis H37Rv
cggccgcacccguug

SEQ ID NO: 1291085 - RNA, 17 nt, Mycobacterium tuberculosis H37Rv
cggccgcaucgcccaac

SEQ ID NO: 1291086 - RNA, 15 nt, Mycobacterium tuberculosis H37Rv
cggccgcagugcgac

SEQ ID NO: 1291087 - RNA, 16 nt, Mycobacterium tuberculosis H37Rv
cggccgcaucgcccaa

SEQ ID NO: 1291088 - RNA, 12 nt, Mycobacterium tuberculosis H37Rv
cggccgcaggcg

SEQ ID NO: 1291089 - RNA, 15 nt, Mycobacterium tuberculosis H37Rv
cggccgcgucgucga

SEQ ID NO: 1291090 - RNA, 13 nt, Mycobacterium tuberculosis H37Rv
cggccggacgggu

SEQ ID NO: 1291091 - RNA, 19 nt, Mycobacterium tuberculosis H37Rv
cggccggauacgggcugac

SEQ ID NO: 1291092 - RNA, 13 nt, Mycobacterium tuberculosis H37Rv
cggccggaggggu

SEQ ID NO: 1291093 - RNA, 19 nt, Mycobacterium tuberculosis H37Rv
cggccgcggucggccacca

SEQ ID NO: 1291094 - RNA, 13 nt, Mycobacterium tuberculosis H37Rv
cggccgcggugac

SEQ ID NO: 1291095 - RNA, 19 nt, Mycobacterium tuberculosis H37Rv
cggccgcggugcccgucgg

SEQ ID NO: 1291096 - RNA, 20 nt, Mycobacterium tuberculosis H37Rv
cggccgcguaaaccggcuga

SEQ ID NO: 1291097 - RNA, 15 nt, Mycobacterium tuberculosis H37Rv
cggccgcgagacgca

SEQ ID NO: 1291098 - RNA, 20 nt, Mycobacterium tuberculosis H37Rv
cggccgcgauccagcgcuga

SEQ ID NO: 1291099 - RNA, 16 nt, Mycobacterium tuberculosis H37Rv
cggccgcgacgacacg

SEQ ID NO: 1291100 - RNA, 18 nt, Mycobacterium tuberculosis H37Rv
cggccgccgacuccccgc

SEQ ID NO: 1291101 - RNA, 15 nt, Mycobacterium tuberculosis H37Rv
cggccggugaugauc

SEQ ID NO: 1291102 - RNA, 21 nt, Mycobacterium tuberculosis H37Rv
cggccgguggaaaccgggcga

SEQ ID NO: 1291103 - RNA, 18 nt, Mycobacterium tuberculosis H37Rv
cggccgguauuucggcga

SEQ ID NO: 1291104 - RNA, 17 nt, Mycobacterium tuberculosis H37Rv
cggccggguucgcgucu

SEQ ID NO: 1291105 - RNA, 19 nt, Mycobacterium tuberculosis H37Rv
cggccggguucgcgucuga

SEQ ID NO: 1291106 - RNA, 13 nt, Mycobacterium tuberculosis H37Rv
cggccggugauga

SEQ ID NO: 1291107 - RNA, 16 nt, Mycobacterium tuberculosis H37Rv
cggccgggucggugac

SEQ ID NO: 1291108 - RNA, 18 nt, Mycobacterium tuberculosis H37Rv
cggccggguuaucggcag

SEQ ID NO: 1291109 - RNA, 22 nt, Mycobacterium tuberculosis H37Rv
cggccggguguagcucggaccc

SEQ ID NO: 1291110 - RNA, 23 nt, Mycobacterium tuberculosis H37Rv
cggccgggucuuccggugcgccg

SEQ ID NO: 1291111 - RNA, 15 nt, Mycobacterium tuberculosis H37Rv
cggccgggucauccg

SEQ ID NO: 1291112 - RNA, 20 nt, Mycobacterium tuberculosis H37Rv
cggccgucaccggucggcca

SEQ ID NO: 1291113 - RNA, 18 nt, Mycobacterium tuberculosis H37Rv
cggccgguuggccagcca

SEQ ID NO: 1291114 - RNA, 13 nt, Mycobacterium tuberculosis H37Rv
cggccgucgaucu

SEQ ID NO: 1291115 - RNA, 12 nt, Mycobacterium tuberculosis H37Rv
cggccgucgacg

SEQ ID NO: 1291116 - RNA, 14 nt, Mycobacterium tuberculosis H37Rv
cggccgucgauugc

SEQ ID NO: 1291117 - RNA, 16 nt, Mycobacterium tuberculosis H37Rv
cggccgucgcgcgacc

SEQ ID NO: 1291118 - RNA, 21 nt, Mycobacterium tuberculosis H37Rv
cggccgucauggcccgaucga

SEQ ID NO: 1291119 - RNA, 21 nt, Mycobacterium tuberculosis H37Rv
cggccgggcggccaggcgcga

SEQ ID NO: 1291120 - RNA, 12 nt, Mycobacterium tuberculosis H37Rv
cggccggcgacg

SEQ ID NO: 1291121 - RNA, 21 nt, Mycobacterium tuberculosis H37Rv
cggccggcgacgcgucgagcc

SEQ ID NO: 1291122 - RNA, 20 nt, Mycobacterium tuberculosis H37Rv
cggccggccuagccgauggc

SEQ ID NO: 1291123 - RNA, 23 nt, Mycobacterium tuberculosis H37Rv
cggccggcaaugccgcggccagu

SEQ ID NO: 1291124 - RNA, 12 nt, Mycobacterium tuberculosis H37Rv
cggccggcaccc

SEQ ID NO: 1291125 - RNA, 15 nt, Mycobacterium tuberculosis H37Rv
cggccggcaaugccg

SEQ ID NO: 1291126 - RNA, 16 nt, Mycobacterium tuberculosis H37Rv
cggccggcaaugccgc

SEQ ID NO: 1291127 - RNA, 19 nt, Mycobacterium tuberculosis H37Rv
cggccggcacgaccgcucc

SEQ ID NO: 1291128 - RNA, 14 nt, Mycobacterium tuberculosis H37Rv
cggccggcccgggu

SEQ ID NO: 1291129 - RNA, 20 nt, Mycobacterium tuberculosis H37Rv
cggccggauacgggcugacg
